United States Patent 7,745,391 (HUMAN THROMBOSPONDIN POLYPEPTIDE) - sequence listing, part 296

SEQ ID NO: 999820 - protein, 278 aa, Homo sapiens
FKAPHQSFQYDYTRTRNEYLEQDQTATVLRTYRNACRNDTWRVQHCTRDIPERRSYHWSEEESDRRTNDDLLDKAILRYCVHLYHKRHFAMMSDRRFYLDFLTTTEADDAACSQPIGHLPFFPKAYHHTQQAQRKKVHTEQAANCIQHGGKNGPPRQGGNGQCKLRNKVSNTGTISKAQGSTDRPEIAAADNAQTYPKRHQGHRTRRRDDHPNKTRQAAKPGLPTQRASKAELTSRDINFDVQNYRFTIKTQKSALTLGRPINNRPIGTYGQGRFSTT

SEQ ID NO: 999821 - protein, 158 aa, Homo sapiens
EDRQERRSTNEEAERSPQDSPTSGRRTSDQRRGYVPTSRLDCRCTVQSQTAAGVERGGLAGWKQHFPGKKRLRKGQRTEASCRIGECRKSVEDASLSGTMTHRTRDGGQHGGRNNGKTFNPGLEIKPRDESASTLGEFSSHATSRVKHGRPGSGHAAH

SEQ ID NO: 999822 - protein, 254 aa, Homo sapiens
MESRSVAQAGLQVSQSYRLIATSRPPRLQEILLPQPTRVSWDYRRVPPCRGLNLWLFLSNRWGFAMLRQTGVSDISLDLSVRSLPTPGFPQMVLGINKRCRRHHGPVLLLQFLEAHPLDFPPGSLLFPAVTLLHTCALLYTLWSDRVWAAHNAGLILQRASCSGLLGSPIYITLPGVSTLLNALWRSFADSPTAGLSIGDAVLRGVLQQPCVAYKSPPWGVLPGHDHGRGETLLKAPFGLNAPAEAHVFPPSLF

SEQ ID NO: 999823 - protein, 164 aa, Homo sapiens
MLCEVCSHRRLLALGLSSRIIHNGSMYFEHDDIIAFRIGSPSDVPYTRITREMEYHKSTIFCYFGIPGSTASDKVVMPWSARTGITPVPDAQHSLRSILLVVFTLKQVYWRRYYTTSSQQLNHHRISQTLWMTIPNSRALYGNTWDPFPQTHDARSRKHTGIEW

SEQ ID NO: 999824 - protein, 397 aa, Homo sapiens
LRRGSPCYRHIVDEAVNLEVILPGPDVQVSSNGGISTAGNHRHGAMLREFYESSQSVQSVMTYHDTAECQHWILGGSTRICIECHLRTNSMVREMVINSSRRIAKGGLFVYRHTMAVEEHSLGNRPWRTPAIKPSCPYPSKRGPRALDDGAIQPQQATVLHPLGCLVTLSPRPREDTTRTASCGSHVHATLANHNKDPLPRTCQPDNTQRAPHSSNANGNTHTHRCPGATRQRAPTHASSQVRECDLTAPPIGAATTGPAQHMPHVEEHPKAQCHTRTAKARRPQRTALPTAAHHAAAHRDNSPARPPPPPPEHCKHRHPNGGPRTRTDHADPPHPAATRARPGTTAPPTATRGRPPPAPRQHPPPAPPRGMPPTGPQARHTAHSPAAPHTAPRAPP

SEQ ID NO: 999825 - protein, 177 aa, Homo sapiens
AGAGGTGFRTVGPGAAGAGGVRGRCEPIVDWALPGAPTLGGRRSGAGPSNDRYMLPLLCYQRAVSRCEPVPIAHSERWTCRCVCSCLTSGLASGYPYRAMIRLRPTGPWYRTSARRKDSVRIKGIAVECFTTPCARQASDGSEWHYERIDARGAVLARNHTNPGKATEASQSESNAS

SEQ ID NO: 999826 - protein, 71 aa, Homo sapiens
ARTRFWKERRDGCAEKMPRGPVQTCMGWWWSVTGSKPSLRARTSVLTLCDISRRHERTCSLAVEVLDGSLP

SEQ ID NO: 999827 - protein, 228 aa, Homo sapiens
MAVMAPRNLVLLLSGALALTQTWAGSHSMRYFFTSVSRPGGEPRFIAVGYVDDTQFVRFDSDAGSQRMEPRAPWIEQGGVRSIGTGDTESEGPLTDSPSGPGDPARYYNQSEGRFSHRPEGCMAATWGRNCASSAGLPPVRPYDGKGFTIALKEDLRSWTAVDMARLRPPKHNVEAAHVAEAVESLPWRAHVACMWLRKITWEKRGKETLQRNGRPPKGILTHHRLFS

SEQ ID NO: 999828 - protein, 259 aa, Homo sapiens
MHRFCCPLTGPSSLVSWMDANLVFPDGAGATIKMAMGWRCADLPALVGKRTTARLGWEGKGGSARVGEVTADSDVRMRGSSCNIHVSLLPAGSAEFSRAGFRGGVTLCRCTHVQCQPGDGGESLAGTNERVVPGQRNTLVIVVLPRCAECRPGAQCRPSTEKLSEDVKNHAGPWATPSDEVGHNREDSIWCASVESTDLNCLMAVSQAVTRNSVVRFELFLTLVPNPYGAHSDLSPGVDQFDLRREIARPGANTGTECF

SEQ ID NO: 999829 - protein, 143 aa, Homo sapiens
VWIRCVSEWNGPKFQERERKKEEEEKEKERVGYASDRRGMIWWWWKQWTSNSNEQGNFPPLPTRPEELVVPEILSSGMRMMKHVTGDDVREGWRCDGFDVLTEGRMTKTGRRRSEPSIPQTGPGHLKYNDMDDGFRLMKKKGR

SEQ ID NO: 999830 - protein, 225 aa, Homo sapiens
SSAQGGADARMRCAESVDTRCVYILDCCVRRVHLVRRKSRAGAALRLKLGQELCGMLHRARHATVSRSLEGTEAQVFKAKFKNWDDVFEVDYTRNAEAVLQKPGSLREGETDAEKKDQMKADLTAAFPAGKPPCRLAEEREQLMEEWNRDLDGMDGFRAGSGKKFARGCRKEEFGHFYTRGVVGLPLQEYWVAVEYEEEEKKDGPRRRMVECKRWRGKQPVEAIG

SEQ ID NO: 999831 - protein, 87 aa, Homo sapiens
MMLDDIQEKPFAQELKALVVCCARERRHDMIYEPQTGEPSDCHCIPYYSRMVVLHKQDSYDDAGRLSVELYWLVGGWASTSGSLSLS

SEQ ID NO: 999832 - protein, 109 aa, Homo sapiens
VEVTSSVKPAWHSLTHRRDAQGRQGDGKSNYFLKIIQSSWMIIRNSSHCGSRQCGLLKQMQQIRMSLRDEGCGADGQEHLMMRKDIRGHLDKQAQLWRNCCLISGGMWA

SEQ ID NO: 999833 - protein, 120 aa, Homo sapiens
MASHKGDDEEVVLSYIIYVVSSYVVRIPSSSCAESSMQQQQREGGGRVLHLLHNDEDQIIIMCAAAAAAKRSSNTAAAHEGGACCVDEKIVTTTSYYHPSLSMMIVVASKHSARQKKESS

SEQ ID NO: 999834 - protein, 84 aa, Homo sapiens
MPGYPRDMNLFRIPWRRHIANILVHSSSLHAQKIWNVTQTSMRPANFRGKKPGPCKAVSDSLHRVSWKLFHQLTSTPLQGRDMK

SEQ ID NO: 999835 - protein, 141 aa, Homo sapiens
MKSVKVQGPRCYFEWYNNADGLDSDKIRRRNGDCEKGGMNYTLGGITRKLTVPVGSVDLGYEYAWYTLSALLLLADGHEYTFFLAKRYKLIRIYAPFERDLHDGPCVTYRYVAWSNQFHVIVLPYSHMCEVNMYGLVELLF

SEQ ID NO: 999836 - protein, 202 aa, Homo sapiens
VVCERARLLRQVRASRLPGCPFPEYSLMAMSRPGLPGVYRADGVLQCSLNENLILQWIDLLNGGIPSVSHPSSVWQGPQAVWCVASSHQMDDDSLHSIALDYPEDTFASVKTDQPAASLASVIERRIRPYGTDRNVNVGSDGMHVTSRVRTASAVRGWAGCSCWPANLPFRLHAPSKPLPMGAQAGFCRHFCSVPVSHVYLS

SEQ ID NO: 999837 - protein, 279 aa, Homo sapiens
LAYSLLLERQDVRGNVEDDLIIFPDDCEFKRGAGVPQREGLRAEVQGRVQSGVFFWMQEHKTDQDDGALPESQSEYLNKLPDALGHLGASGSSGHELVLPLVLSDGWRCYEPCWEIMKPQASVMQRHSGPRRGYGGTWVGAWGPLSWTWAMCQLTWWKQLVPPGDASSFLQTPGACRQQVTPVIHRTHFTRAYLQSLTAPASVTRVRKPGALEPQLPGMEPALAGSPTQAIQHERAPEHPGHDERTSRASRRQQVDLGSVLTPEIWSHLANADVQDRMF

SEQ ID NO: 999838 - protein, 262 aa, Homo sapiens
GRHGDDLRNTKTMEISEMNRMIQRLGAMIDNVKKQCAILCRTPLADAEQRGELALKDARNKLGELEEGLENGKSRDMARLCCVEYHELMNTKLSLGRGDRQFDRKLLEGEECTQLSVRRELGPVKISVVTSSVSSGYGSGGGYGSGLVWEVLSRRPRVEALYAGRVSYLEMLTTPFSKVERVLSRPRMMDSVVGGSDLLVAKHVAERAGGDRRYVQGAREQHGIQAVKDWSSTNSFTSRKGRLHRSLKKPCLAKFTGLSQGA

SEQ ID NO: 999839 - protein, 171 aa, Homo sapiens
MLHQGKHGSCASPVSLTYAIRTQPPLFTCVESLQAMVGLELGPGIPTLHISRVGTFLGSFAYAARSWTTASNVQRCGGWRPYHWSLNSLARAQAEHLDVILAHIPRHSSASRSASRTWLQLSIPSLAHVSRATHLMCARTDGVPRIFHMHETLYGQDRAIFPECSIKRWTR

SEQ ID NO: 999840 - protein, 178 aa, Homo sapiens
GASPGDSHRVRLLFHHDVGVYCQSILTNALWAWMESLQLKAVCSGWIAACMEKKHEGTQYRTHGGTRITGTCGRVNSDVRVLKQRQRVPVAVGLRSECHCTPDEREAFEYGRWLTRRVGTSYLGSKGVRHSGDHFVCWADLHKDEGVESCSRSTQVSLRIQPGDAHDVLVLLGIIDLV

SEQ ID NO: 999841 - protein, 111 aa, Homo sapiens
MRYPGDTELDDNYGYRSRLSRLNAECSSDSEEDEEDKNTPCVQLWMLRANKHQIKQAVNECCNDHLDCESQVTTRLISSLMDDERKALVYRLGFLTYECFGMYVNPKVGIL

SEQ ID NO: 999842 - protein, 296 aa, Homo sapiens
DRVRPASTEPRLCRSGVPSTPADQLTMAVMSIAARRRSSNGSGLCKAGFAGDDAPRAVFPSIVVAPQAPGRDWWAWVMKDSYVGDDGPMMSYEEASSALKYPSLSTVDRHQLGRQWRKIWHHTFYNELRVAPEEHPVLLNRGPPEAPRPTGEEDDSRVMFESFYRCPAMYCCYPWLCYRLYASGRTTGFVMDSVCRGQPDTVPIYEGYALSPLSILRLDLSVRDLDLTTSVKILTERGYGFTNTAMREIVGDLKEKLCYSRPGTYDPGDGHRCFQILTEERATSCLRAGHHHWQCT

SEQ ID NO: 999843 - protein, 180 aa, Homo sapiens
AGKSRCATPGYASDEANPMGITPIEYTATDEGAAKSSDDAAPLLTYTHEAASCRWYGTECSIETPSFNGLCWLMRLVHSFRSFMLQLCSEFHDMDQALQSNVPNLYDNDQWYMKNADDASRAALRALLGGELVSLHIDYATKCNASLHLRSNTRYYAPTFTHCFGCLPERATRMPIWLGS

SEQ ID NO: 999844 - protein, 271 aa, Homo sapiens
ALARALEEAMEQKAELERLNKQFRTGDGGPYELQGMMLGNEVSMTLGEVQAVPYEQQVEESEDSSVEKLDGRVCRPPRDAKAAVRRSTVQAMRGPVQSGDAAGPGTEHEPSENARRQLGPDKCAGDDCEARVCEARRQDSMLLRIADSGLPGRGKPGSLDAARTLGGSTVELVHNQRIQGTNADQIRLRECCMAQDEGLHCASWDDNPGPLAEEILARGRKRTSNETLKQSCEAEMSQVAGGTGSRGTCLAPGQHERDELADEIANSSGKG

SEQ ID NO: 999845 - protein, 186 aa, Homo sapiens
RTSAQTRSSGMMDTNLMTVKLSLERNSSERAKELTPPSSACCSADPSKCQISSERAGPWTVAEKHRLVVAVLKLCLQEWMPRNSFLLSRAPGLAAVRCTCAGPWWRAALPSFHADRQLLIIPPAHRLARSLPGLTPRDVVTCRVSMCSWFQAPPGSRGAQRSMPRRPGRTSRGLRPGRSMRNSDPK

SEQ ID NO: 999846 - protein, 98 aa, Homo sapiens
TKPERKSQAAPRLDVVATLLLHLSARPWFLGVLVCGAVELCVIAPEQKFHYQVMACLSTVINYSTARSTHHTAAVQFGRHAGIGDDKGLHKNGKHAFT

SEQ ID NO: 999847 - protein, 101 aa, Homo sapiens
MAIEHRAFRMVVADGRAPSSQMQHVRITSYTHKYTRTIGRQTGNSCRTSNVGARDHSAGTTLSLGDANKRFLTNSKAVSLFGQSRRRGALTRTACNGNEPG

SEQ ID NO: 999848 - protein, 132 aa, Homo sapiens
IRWRDVSQQSSLGSHDMGPSSFLPRKRRQSRAILMLKVKSFPIRWTSSNCRVHLISPSWRYTSVWLVTHIDAGKVDKAGHPSVTKKDVDERLDHLLEAHSKPMGESVGHIRWACHVLRNTPPRDVLSRGLIS

SEQ ID NO: 999849 - protein, 225 aa, Homo sapiens
DNAGSVGKIRTPVMDEPCRDLIVHSNRASMPMTGAGALGPRESQVQPGIPDSTCFSILVTSAPRHESQATHLHVSSWYQAAVARDWDGIVTWSSSQIHCDVWQKALWAIERHSRISSTLESHEGVGQRIDCHLDNHRHDVEDEEADVTTMWKPLGARGDAQCQDSCHARDDGQTIEQEANLMLYWQTMASLEDWLEPNPCESGEYTRPNIEQSGGRLCLQCDEQP

SEQ ID NO: 999850 - protein, 210 aa, Homo sapiens
MSRCSVRMVTMSEEVCDGAAAVRREVFPSGPCNYLASLPVFASPSEQALLEHPWDAVVQCLLASQDCVETMSPEHRKIVVASLQDDQLLIIILRTDCRGLEQCARVHSGQTSKLENLCVHVVLAHDFRLDSSILTHGVISEPVDLDRTLGVEIAMAQTFVGTIWCLKDSSRVAMVTLQFHVETAQRASRLGEHAAAKDHRVVMRPVGPGD

SEQ ID NO: 999851 - protein, 156 aa, Homo sapiens
MKALIAGAPEPETCVRNEAHSYLTGDAPKMTRLSTCSSQTLQASSRSHGMAIVRPLKRCPHTQKRSRKGRMLDGARLRGTGDRTVNLQNDSHPARVLQSGYNASSYQQADEPRDLNEQCPPDTEAVAVRASHRSGKNMGKRLNCLDNGAARYTALT

SEQ ID NO: 999852 - protein, 266 aa, Homo sapiens
MHTTNDAATGIAIVAMRQRQHAHSRWDSSRCSHKDAVKHRHTSNRTTGKRGTHSAQATALATQAASGRGPPLETTAGHHNTLHSPRQRSVPRIAATAGQPSSLLSPGHGTARGATTPPYHPHLTGHRQAQQHASRAHTAPPYSGHPHPSPHPAAATHRGHPKHPSQAHPSQPEGPTNEAQPDTLRSHGPRGLVANRPTPTSTTERRYQPRRRSVNTQPPPRQRPPVPHQGNTPRQAARKPDNTRCDNTWACLATSDGTRPTSRRHL

SEQ ID NO: 999853 - protein, 312 aa, Homo sapiens
TGGHVDIPCSTTPMDPQHLGCSTLTTDEPGPPTSHGHHGTPPMVTGKVQHEEAHGSQIAEQSRKKDDCRHHLVGTDARRQRRRHPKMAQPRKNHTDTRSDEEQQRNSRRRGSRQNNNAQQPRDEKEEAKDDRERQRHGPHAEQGEREHEREHERARHRSKGRTKTATEKKGSEKTGQPTESETKPRRTDSERRGTDDSTRGEGEREDRSDSRGGGAETETERSQRRDESRDGTKEKEDETEEAAEKRHGEDAPGQGEEETEGRQEAESRAQERRREKRRQRSGEQQAAKRRADSDRGHGGDREGRGRQRRRR

SEQ ID NO: 999854 - protein, 603 aa, Homo sapiens
MRLVVTADDFVLLALLTAEMSVYLCDVPFLCLGACAPAVVLLSCVNCVLCSRDDAAGCEHVPCMCSMQSHSVCHRTAQPFVLTCAWPLLCAPVRLPAVLSSILPCSVPLWMCYPSHCAHDCVTSLCDALCCAVPCEQQVVTIFPSGACCDVPASPSTRTGICSARMCNPPPTAMAFPGPLRTRDCLRAQGASPSGLRPPKTLKTRSCPYHLPGETPLCPFGAPPTAMGHHPPKTRAQPSHGRTRDGPTPQLAQASIAQPCLALPPKSCPEFALAPNTPLGFSLAPPALWPPHPFGPNEGPPLNFGEQAGLATGPVYPKPRGLRKTSVRPPGASMAPTATMGLCRDMRYTARRFSRALFDPKPASSRAHPFLRGKRVGRARALMRPLGPRTCRHPVYAPRPPPSAPRPPPSRYRAEGQAIAPSHTPGAPPQVMSGHHGHPDRLGGGAPPPRHIQYLLTRPECRRTTAVVAPPIIDPSADYLTMRPKRKTPGPALIYPTRQWHRQDPTLYDQAPTTHPLLFTPWSRPHPSLPPHTHILHTPPSPTYSYNTSTASTSNIICNLLTTQTRNQLPHPHLIFTTPPHPHQRRTISSPPTYRANTTTTAA

SEQ ID NO: 999855 - protein, 208 aa, Homo sapiens
LSGGEKALTADAAGVAMFQLNPAPFCLLDEVDAPLDDANTERYANMVKRMSDKTQFVFISHNKIAMEMAQQLIGVTMQEQGVSRIVAVDMDAALTMAEAAEMQDNNLVMGLLGAGVVFVLVIVVYNQWQIRKARRPEVYNPAVDETPRGEGWTERAESALGGERDETGRVEPRLEPGFSAKTHTPATGSAEPKPGDRSELTPSGDDAA

SEQ ID NO: 999856 - protein, 207 aa, Homo sapiens
MAEREPTAGAGGLQYARWRIEEERCTSRQPTSTPGHDRSIRGDRQERDKDDGGACEEVQRRHLLGRVARFPQEPEGPERLRCCDMARDPWVVHASVAPVPHWRPGIMSGRPWIAFKKQLVYVLNGGMVELAESGVFVKRARALHRAVIMGPRNEASHRGQYLFDVTKRSRQTHILTCIYDCEGDGLVAPRSRDEIVREVPQDFPRVC

SEQ ID NO: 999857 - protein, 86 aa, Homo sapiens
MKTPTLGDLTDRAEHLNGPQGLSDPPPQTTKEPGAHLNQRTARHCRHHTNETLRWDHTKRPSAEQGNCGTTHRHNAHTLRDKIIPH

SEQ ID NO: 999858 - protein, 351 aa, Homo sapiens
LFLTGRSANMQLNCRWTIKPVDAEIDKCCNPGPGGLTASQVRRFRGTLAWGLREEGRPRGARLASRTAMTRMVTDCVPPSRPSSEKLQRRENADGYERDTGIEWNVMSIESSTFMEGPRPIRGTLPWFVYQIGTLLQLQRGPNKSKKQNVRTSEQIVITCRENEYLFTEKLDETTVVRLNRREAIMASAKRTDGHYRARPMIAVGAANGQLLAVRLINGYTFRILLISCYLSTPVGIAPSPYYVHTFTGTDVALCSRLDNHCAPTLPRRHTLWLDMAPPCPTRLLAPNTNFYLASPLAGHTEEMYPAILLPRLGFVLPTGQPSIRVLVGKWDLLGLDFPPIRSPFTPSKHI

SEQ ID NO: 999859 - protein, 166 aa, Homo sapiens
MLIDWSNPDEQKHIACLIGTPRSAPKFGPSHLLFVYSLQTLPHWYFSATTEVKYINSRMHPLSITESECNISFHSLNDKSQGVSPRQSFVVNAIDFCVDNNYRPTLLGSSHATELHLRVVCAVLGEKYAQESDLLTIVRNGVSTCSYILSHDASSVQHARSSPVRT

SEQ ID NO: 999860 - protein, 88 aa, Homo sapiens
LNRELAEQKASEKQHITLALEKQKLEENAGDLTLTVAEMHENITEVKYRLNRIEIEDRMKSEMPWKMKVRTQLRRQAAAHTDHLRDVR

SEQ ID NO: 999861 - protein, 135 aa, Homo sapiens
MTCMWSLRARRWSLGMYAEATYRKFGVLMEYQVERYDAHSGTSAYACWARGGNKTRRTMYHVNGRVEDSCESPSVLGMLGHRNRPLGSLCRPDPPEQAPGAGRLVGPLVQREEPPVVFREGLPRGGLLRARLDRR

SEQ ID NO: 999862 - protein, 75 aa, Homo sapiens
DELELSYAKNGQDLGVAFKIRSTEVLAGSATVARHVLCHRAVQYDFTLWSEWNSHIYQVPEDVYFHSRNVPLYAI

SEQ ID NO: 999863 - protein, 81 aa, Homo sapiens
GDTRRSAVLGRADYRDLEGARSYVPDGRTQQNSSSAIGGDGVNLTSDCSQFVPWATIGHINMQERSVGTWIYACLLHTQER

SEQ ID NO: 999864 - protein, 75 aa, Homo sapiens
RRRKLLPHSLEAEAKAKAIKKAKKAVLKGVHEPRKEEDPHVHPPFRVVREDTCRRRVRHVPSISSEERSTGETRR

SEQ ID NO: 999865 - protein, 149 aa, Homo sapiens
MRAPPQSISPAPSWLFIPIYIWVCQKALSNNIISSGVLLFSLPRVLSRFVTRDAGRSGPRRPAGLPAALALPVPRHAPHIVLRRQPQREQPQTHLLNATNGRHISSAPKALLFDRPPYLFHRDMVCHTKNTPAAPRCGDTLQDRRRISL

SEQ ID NO: 999866 - protein, 84 aa, Homo sapiens
MNQEKLAKLQAQVRIGGKGTARRKKKVVHRTATADDKKLQFSLKKLGVNNISGIEEVNMFTNQGTVIHFNNPKVRHLWQRTLSP

SEQ ID NO: 999867 - protein, 264 aa, Homo sapiens
EDCLGVQEYSKLCLTSIFLLFLLSAVYLVPWSCQGPCWSAAKVSTRQSSWQWVKALEWNRLRLSLMSRQKYVRATNLPTVKLVGRRSTMRQLSCGLLRFLRPRGEDASIGYVCFRSNMVEPRHVLAGALSLVGARCSSRVANDLITTSSLAGLLTLARAASVRAPREAPIAWNHFGGRRAGRDSRTVDRQLRGASLAASALMVPLGALSFWFQRNEVSRTRRKGSWVRRVRAVTASHAHDASFKVTTCSSRQSLLLTHLVSESV

SEQ ID NO: 999868 - protein, 100 aa, Homo sapiens
RELGCRFCEALPDTRAFPALAGRAPCKVGNAEPRTRSAASGSPSGGRREEPGGEGPGGARGLAGAPAPSRVGSGQTEHKYAVMEEERRAQKDEGQHEARK

SEQ ID NO: 999869 - protein, 337 aa, Homo sapiens
AAVLALSDKPTACEAEFEYSHALHSSIVAASDSNGRQASRTRELYAFRERASSSIHERIISDVIATMPAYPRRDICEALRHVPTLMDSAESVRGAYAVVACVEPVKPAQKAADPWLGMWGENPIWYELCAYNLRLGEEKANPESIETHGAQGPGQCVRKMDFRSSQLRTRFHACGPFALKSRRQTRGQERQEVAQCALKRAYLRGYPLAVNCVPGWENRRHDAIPRCCDWVWLEGSESMSPKGCREEGTVHVHQRLSIAPPRCGPVQVDRPRGDYRRWRVVVDVRIRRDTLDKNYLCPPKVSSYLKQRGGALWDVCPILALGQFHGAAGGKEYTIWQ

SEQ ID NO: 999870 - protein, 247 aa, Homo sapiens
ASCRPHLLPGKPAWSPMANCDYSPVSGDKPCCRLSRRAQFCLGVSILVLILVVVLAAGTSLGGVLAVIDCVRDQPPMRFPETVLEAIASSITENSSLRLMTIGRRCPHARNSAMRFEEGCGCIMLTDQSHCPHCTSIRTTYRSAREFEASVEASGAQYPYARLLEFLLSAMHDIIHASWSRSWFYVEVRTRDISSPPVQDHLLLRALTLPRSNLIIGCCVGTSRPTSRTYILIHILAPKPVEDNGSD

SEQ ID NO: 999871 - protein, 279 aa, Homo sapiens
MGVQPSSSGLRSDVALRAHNPEFLQRRSWDAQEPKHIHEEEDAVQQSQASFSVSPLRPLEGSDGERYRATGRCYFNGPRQHERKSEPHGVIILYRFLILDSQLMKIWVWPISGASSVEETPSEAVQGMGYQGIEVTWDFREAQLLPAPDLFLLREEDSGGDQDRRASKVDARGLYRKLDLRALTPALGVHLRLIPYPPALPTFSRMRPWVCRALGVPHLGAGAGGPLFGPRLPRAKKPARSTSLYGVEDNASASRTREVSNLGDGRAHGDRQGANPGIS

SEQ ID NO: 999872 - protein, 179 aa, Homo sapiens
MLTTVRLWSWEVRCRMYEGTVSSGRAVTQSRMVVQMLNLGYCRELLGDLDGDSGVMERCISGGTCLGYEREYCRSCEAGVSMSGGWGKNGWCLANGVMKFLGRIGYRFLLHREALCNSGLTNGWTGRHSNVTIVPRLGTGLAVVGRLGADSRYFVMCGSLVGRKRNFPAPAADPCRVSG

SEQ ID NO: 999873 - protein, 70 aa, Homo sapiens
LLPQLQNFRPVHDIFGFLTLCYGCIRYPKYVYSGAIHGPVAERLLLACVVLDKASGSGGVPVTARLDPIR

SEQ ID NO: 999874 - protein, 142 aa, Homo sapiens
MISLPHWSASEIVIPNATHIKRCSPRVNGRHGQGVTSTGKGFPRSGKLPMRLSAGVLWPPNAMGLCARCSTSLCALSCTVALSAFQWNTLSREAHSNRCLDEGRPPEVPYGAARELASLEGRPCAESVLQKSLGCAVGGLGG

SEQ ID NO: 999875 - protein, 115 aa, Homo sapiens
MASIRKRTSLLAVHKPDTCQACRYTGQQTKYENTHAHEHYSRHTHQLKPTDRSGSAYETRHVHAYVQVHANCKRMHTHIRVQLLIHGKLFHFCTDLPIDPFAITNFQTGTNMGNS

SEQ ID NO: 999876 - protein, 111 aa, Homo sapiens
MDLGIQSLAEAVVVASQRLLQAAGTSTHVHHIVAEVKPLEAETGQEIRRTNAHGTSCGNRISNPFFVLRFLAAQWLNGERLADLRCHRIVKRPSTKKQTLIALAIGPGVFF

SEQ ID NO: 999877 - protein, 113 aa, Homo sapiens
PEKEPPKPEQVECRGALPCSGDIAHATCEANCTSLGSSIAGPPHQCEETMVQLGPERLGGRTSRPRIPVIQLLPGPVQSGILAQMPCCVSPVSRRGPGPHGGIIVAQNIACTA

SEQ ID NO: 999878 - protein, 218 aa, Homo sapiens
ADDEKVAAGWDTGMIPLDSRTWAVRDYQTHYRLKRRATVWESACYPGTGELSASVNRESGEVLRHLAQGSTDVLRNTACGCVPQHQLTRRVLSVPEQARYTNHLVYAPVGGPWVGLSRMGIPLRGHTHEIGDDRKDHIDRHRRRHHTGSDELHGIMYQMGQEGRNLGDVTITYRRITKYINTHLYKTGTQIQADMLRNGEDECSPGSPGSYHQGSVPG

SEQ ID NO: 999879 - protein, 132 aa, Homo sapiens
KAKKEAPATSVKAEAKAKASEAKKADVKGVHSHNKEEDPHVTAAFRRSEDYCDSGDSPKYPRKSAPRRKQALTTYAIYQCFRCHTESAMKKIEDKSITLVFIVDVKANKHQIRQAVKKLYDIDVAKVNTLIR

SEQ ID NO: 999880 - protein, 429 aa, Homo sapiens
LHIMDLWILSCFSSSGWCLKRFPGGSCMGSSDEVTLSGGVMRPHWSLAGVIIPKRRVIVWSQVTTTVTCHVRINVEREAVCVFAGTEYLRITNEEYAVGVQTSDRWAEVPGRVTGGVGGSALAALRYWKPRAERTLAVKQDALAARQAGRPYVRGLQPRGFVEDASPVLHARADVVISRGVIVCNHWPTRSPLDPLLWHQKCVPSGSLSPGWTIGMRECPCAKPIGRKVHGVGYRAGKPGARRRRKEKSTCGGVSVGARTEGAPFRISRRENRGKAIRRGKTPVLPKGGAPPLAALGRGAVGGTRIDAKEVCATHSRGQEHGVSQKRAGGVNAKTPPSWSSHHHRDVRSRAQPIRQQQEGVPRWGGGTGKQTTTGGVPPQHNTTGFREREKKRFARGTGEGGQPSGGATPFVEERFPHKAPTPKGKRKR

SEQ ID NO: 999881 - protein, 106 aa, Homo sapiens
MTTGSIRELGTAKPYSLSRLSDHDDMAAGHATADQLATQGDINVLLNRSNQRHSCSVLCCTYEMTVLWSRRPRSPVIPVADVQSCQATWTPGEYPQVREMRRKAKA

SEQ ID NO: 999882 - protein, 69 aa, Homo sapiens
TTKRREKKKNLLGKINRLLRKWILYAKCSLVLSVCLPMSPSPRTVRTLMSQIVSNSLSEVEAQAGERRR

SEQ ID NO: 999883 - protein, 239 aa, Homo sapiens
MVGMASPKISILLFSGALCLVPSIVERVSPLHIERIAYERITMLPGAEREGVSRISVSRSGRSVWNRYERRMSCRCRQEDLPQSPEDGSRGRLSDRAGVGRMYWDRNKRNVNGPLTVMYLVNSGDPAAASTNSETRTGSHTIQRMYGCDVGPDWALSSAGTRQDAYDGKDYIAPERGPALLDRWRDMRQAQITQRNVGGRPMRLEQGESLPGGPVRGVAPEIAWMNGKDTHADNVNPRK

SEQ ID NO: 999884 - protein, 42 aa, Homo sapiens
MGPFVESYGAPSVLVLLPVVSFLSLASFASRWPMIGVLLQFA

SEQ ID NO: 999885 - protein, 211 aa, Homo sapiens
YTRVHIFCGVLVVVFEAEPRSVTQAALQWPNLCLPGSSDSPASATREAEAGECLNLGGGGCSELRLYHCTSIQPGNREDSVTKKKKRTKEYSQSENYQGKGTTRPRDKPDENTVEEAQKERRCELTREGLQEAPRTEARNQKLAERPPESIVNGSELGGKENEWGHNAWRRGWHEIRTAGGKDAEENREGSVTTDPREKRRGEKRGTPERG

SEQ ID NO: 999886 - protein, 91 aa, Homo sapiens
MASRGQRMAHLPGLDPLLEAIDSSIGDAREVFSGPLLPGTWSRNWGVPLFPTLCGTLSFFLGAFVDTLTIWVPARALLPGGLHEGAMLPVH

SEQ ID NO: 999887 - protein, 407 aa, Homo sapiens
MPLTSDHRRGPTMSDAAVDTSSEYHHQGTFEEKKEVVEEAVTMAKPRPGALKGVDCQDVATNDVVVPSVRGELHGSGTIVRHNGSQRQATVHKDHTNGETYVRPGHMHRQTAGTHGHEATWTARPLQGGLKRRELPALTHMTRGPPLARTDNCDGHLVLSYTPTRHPKRQQRQRHILQQAKLDWTYQRPPVGRSANAAMERGTARRDVTYADGTQQGTKDAPTPEQGRGGEGDSNVTTFEPRMAHGDANTNAETKSRKRKLEPKTDKVHTEEEVHHNRGRDERRRANTAGTGRQGHAGTRTREKKRERTRKGKTSACGTGTRSDATERATDREGPDSKHQRPRQAKDSRDRYRMSRTTIPDKRQISRKAGGPGESATEGTPENKEGPNAAGQLGGGNSSKDEKETEK

SEQ ID NO: 999888 - protein, 221 aa, Homo sapiens
MSAAVTESIHSVLYPTQTRAPFSDTSNTPAGGMRYPPPSVGVTTKRNMVWHKQSATQRTDGPPKQYRSAQRMTPTHVHSNRSSGDHPQCGDKNTLRDARRSRAPDRWSAHRRNSTNSHKVSAAGRQHALSDQHTAAYPSAAEREHRQARTHPPQRDAPLIQIDDNTHFPTRRGTLRDTNPYPIDALSTAAGESTPTYTQRATQRAKQTHTLLVCNKRDTNN

SEQ ID NO: 999889 - protein, 231 aa, Homo sapiens
TILLNDPVSGEDAGWTTVVVHMAGLRCTTVFVKLQSRIKFLVIALKSSVGRMYACVPPNLVPQIRWPFKILCQTVPHRPLLVDLTVKRSGARGSEVIYGSIAGFHAVDCRLGEARRMTSTSLLHIHVAMIIASMSIIFLAADTDGMEMLLCYEDEGSSTSNTVLGALSFKDCGCLQWGEMPTSVAYICLQPDNGLGVRNAIEIRSVETGQLDGVFMHITMLRWLKFLCERN

SEQ ID NO: 999890 - protein, 184 aa, Homo sapiens
MAIIKKSGNNRCWRGCGEIGTLSHCWWECKLVQPLWKTVWCFLKDLEPEIPFDPAIPLLSIYPKDYKSFYYKDICTWMFTEALFTIAETWNQPKCPSMIDWIKKMWHIYTMEYYAAIKEDESMSFFTDMDEAGNHHSQQTNPGIENQTPHVLTHKWELNNENTWTQGGEHHTLGPVAGKRPVER

SEQ ID NO: 999891 - protein, 112 aa, Homo sapiens
GNSLAVWPRLDCGGHNHSSWLPQSPRPKKSSHLVAGDYSSQHTWAKNFFSWRETGSSYGAPRLGLQAPGATNGVLPGSTVSKGQRGQVCDRLWLPCAIHVPQTERFHNTYLK

SEQ ID NO: 999892 - protein, 149 aa, Homo sapiens
PGAAPLAFPPPPSQAAPDMSKPPTAQPDFPYGQYAGYGQDLSGFGQGFSDPSQQPPSYGGPSVPGRGAPPPAAAALDEGRYPTNVQVHPYRRYRGAGVAGQTQDPNCELVTITNLAASGDSTLGGGAGGGREALDGCGVVWTEVLNILL

SEQ ID NO: 999893 - protein, 355 aa, Homo sapiens
GDQHHGGLARTSALRKGREQEGAKQGKWLSPFSKKDGYDVKAPAMFNHKQHIGNRRVGHPGPEGNRTYAIMYGSSTGSGVLRKVQSVPGLASNGWKLPFHRDILKLSYLKDGIRGLKNRGAVHKAFQCELECYTAVKRIVLTTGSREIGRLNELDRSGYEWVKANITQNGVWTYALIRYVLNMEVEGLIEREDTERTRAKMRGINENRTLSVMSRKENQEQVVRGTIEARGHDTRKWTVDHVRVEPPRSGMGGQETTNWNMMERRNRLGCERNQIWPEAQETQGQCGRKNRKRYTEHQRGVGTQHSEEGRTERKPRQSGKRVPVRNARQKTGTRKTGDDEARDTPKRYQDNTAGK

SEQ ID NO: 999894 - protein, 113 aa, Homo sapiens
MWVSQYSRRVSLCGGPNMCWCTHSVGGGKRCALQALTKSAEKLWAVLYTAFIQAGVVHPRSDLFNRKCSAVRSSSKRPTRRRRQREQKKEETTRIETTMKNYRPKKEIIHRRQ

SEQ ID NO: 999895 - protein, 110 aa, Homo sapiens
MSLKSLFTPAVVSKSESPKEPEQLRKLFIGGLSFETTDESLIDAIFEQWWKRSRTVCVSDEIQEHQMRSMGLRVCHHYATVLTEVDAGYECKATQGGWKSCGNQRELSPR

SEQ ID NO: 999896 - protein, 214 aa, Homo sapiens
RLWLLLLRRPEDAMAECPTLVGRQSLDHPDRLWAWEKFVYLDEKQHAWLPLTIEIKDRVTRFTGCFLRSGRLSVLGRPYVPRYPEIVPNALRAVSLWHDSEPCMVLSTILRLLVSWLLYVYHIQDLTACEDMLLRAAAQMTDVWSVGVPVSFHLQGLMPGQPTLGDVVCSVSPFVLLCLWSSPPRLGSGRNGPDRRMSSSRVLWDLPVSPLCSP

SEQ ID NO: 999897 - protein, 220 aa, Homo sapiens
KTPALLPLAGYLAPPSSLPLYCPWYDGTLAQGMRSTIRRSPAACWVVPLHAGALLEILCRFDPDLIHRRLSEWNVKAGDCIGMTALWGGSPGSGGERALCAVVLWAARAACSPGDPGDREVLRLLRPLHCGCSCCPCGLQEMEVQAPPGTTIGHVLQTWIPSSPSSPSRMPIARQSCEWCGPAGPVAVARPTLSETRDDSECGPITWGAVRTPPCDDLGY

SEQ ID NO: 999898 - protein, 173 aa, Homo sapiens
MESSWEEDAWVHAGTCSACGGGCGEGSLPQPVAAVAWRPSRGWGRGARFWALEWVGAVCLPAAFCPGGFARLLEKQGFGVHGASLMFVMSPALRMLQEFSDVERAIETLIKNFHQYSVEGGKETLTPSELRDLVTQQLPHLIRYGRSTPHLSQYPDFPSKCSGTPTTLALANP

SEQ ID NO: 999899 - protein, 166 aa, Homo sapiens
MEELPWLVIGSLIPSQAVLDRSSPKTVNGSVYWSAAWREQDSWRYDIHIRYTVTQHIVFACRVEPQNIHAPGLKTDTLPKGWVNQPSVHRVQFEEDIGMDIQKAILSCIINRGTLLVGRERRLATTRKFSSDGLRSSVAGPPVEELNGTEVSSLATSQDPFRSNPL

SEQ ID NO: 999900 - protein, 222 aa, Homo sapiens
VVQDEEVGLPLRLALSHHHLRPGTVSLMIQRPAGPRSADSEPPPTGTAPASNGGPRLRESPQPNGTPPEAITSTAMSHPIQQSPALRRGCGHYGHHTKAQTTRTDWESTVSHDPSRQNTQEAHPRTAHNTDRRTKKQREDAKEQGTDTYKTQRRENPPSNMAWQPIEQPRRHTERPPLPENTPRSKSHTKTSMEERRKNTWQNKTTHKMTMDREGAKTEQGR

SEQ ID NO: 999901 - protein, 145 aa, Homo sapiens
RILQRLRSEIDHVKMQCASLYAAIAELLITSVGTMALMDAIEQAGQGLAGCPCDKGTAGLWSGLLEGDTMELDECQAGPWHVEIGSYSQAAGGLECRLNGERVGQVNVICSYMSTHRPVAIAVPAVSAVALGLGGGSRYSYGRWI

SEQ ID NO: 999902 - protein, 305 aa, Homo sapiens
LGRWPERIAGSVAAGLLAAWLLVPAMAAESWDAGAQCLCRAVAMKGKDGEGGRRTVGRCAAVKPLRKSPELRRSSNGARAKSVIVQLGLKVPCEVRCVPLLTACADHCMQHDASALGRAVRRRPLECLERGQIFVKGAAHYLSWVCNVPSLGGIGDAYASVPNRPKSCKTSYTMALGPNGRQAGIENFRGTENSPSAHIEHQRKNKKGCLVKHGNLTVMAGLQFQTREECKACTFLNLLQGSICRRGAVERRVSLGKEVAQAENPHNGLEYERTRTGPIWSVGPPRQETPCNLDGAKKATRYHIG

SEQ ID NO: 999903 - protein, 74 aa, Homo sapiens
EVRKALFKDIEMAQCFIQTKEVVHWLLGKLLVVVMRGGFDVNDYFPSCQLKLQMVVMASVAPVLADVHIGWQLP

SEQ ID NO: 999904 - protein, 321 aa, Homo sapiens
CPQHTRHSNLVCKVSDFGLSRVLEDDPEATYTTSGGNDPHPLRPSPEAISYRKFTSASDVWSFGIVMWRGDDLWLSGPTGSCPTTMVMKAINDGFPAPHYPWDLPSPIIYQTHGCHVLVINGACSAPHSKVRLTIVYILVQAHSCPCTPSGPWLTFDPRRVVSWLPRRETARDGVLPFRAVSEWLESIKDAARLRSRSWRPGVHLSHRHNVVQMTNARLSTSDRACGCPATRSALDYTPAGTSGPREPWWVIPILSLQQRPGAPYRALRMRCQHHVLRLSALLPCLGHLGDVNLHFSLLSFRLTRPLRRLSDAPLAPPERY

SEQ ID NO: 999905 - protein, 286 aa, Homo sapiens
QASEHISFYQQDARIDVTSLLGTMSTCKPDQFTSSSSMKGSCGIGERQSGSGSSRISSVLGRERVLSDGPQTPTGAVCLYSSRFSSGGVLRAGGRSMACGFTQQQSASVVASGDDTGGGLGCWPSDGGLGAGFGGGFAGGDGLLVGSDDKVTMQNLNDRLASYLDKGGALEEANADLEVKIRDWYQRQRPSEIKDYSPYFKTIEDLRNKIIAATIENAQPILQIDNARLAADDFRTKYESMNWACGRLVEADVQWPAPGGWTELTLGRMPGNADRRLKKEAGYLGD

SEQ ID NO: 999906 - protein, 244 aa, Homo sapiens
LLRPAEALCSPGTSNTTRCLVLLTPPGKQSHHVSSSRDVSFRSGGSRSFSSRLCHHPVLSPAPDLHLRDAGPGVGRKDGGFEQGQPCRVLVEWVAMRQSRSTLQSEGGLQEDIHQTLVGVQLQEPVRCWCWRRLWLWRWCRLVDSGLVGGGAWLVALGSVAERGVGGGFGGPGVSVSDLLEGIQEVTVNQSLLTPLNLRIDPSIQRVRTEEREQIKSLNNQFASFIDKAAVPGAAEQGSGHKWT

SEQ ID NO: 999907 - protein, 122 aa, Homo sapiens
PEYPVKLQIDPSIQRVRTEERETRSGPSINKFGLLHRQGAVPVRQSRILMVLGRQRVTLRAWSKGRPRTCLSARILRACLVLMQVNRDNTLQGESGLEYMPNRMCGETGGPAWNITSRDENY

SEQ ID NO: 999908 - protein, 158 aa, Homo sapiens
MGEKCLGAAADPVAWVLHQQEPEDQGSGRPHALGAGLNHHFIDLDYLLPDGSMPPLHTDHERPLVQDIFYCLFQALGHRDDCEQMAGHMMGATVAQGYNEDLEPSENPQECEGQLATPGAQTLDYPRIAGKKSLGMHTDTMKAQMQKATNKDKNNRIQ

SEQ ID NO: 999909 - protein, 266 aa, Homo sapiens
MAVMAPRTLVCYSRGALALTQTWAGSHSMRYFFTSVSGPAAGSPASSQWATWTTRSSCGSTADAASHEDGAAVAPCGYSRRVRDYWRRWRHVKVKAHSQIHRVDLGTLRGYVLTMSPSAGFSHRPEDVLACERCGVGDLALSFRRGLPKHSTALTDRAKGIYIRTLEKKGTLRLLLEPGEVEQIGRSRTEPKSIDVWASAGPQCVARRDPNLGKKAYSPVGKGAHVFAVCNVWLLPGNELPWGAKHGEKRSKHRCANGRNRGKAPP

SEQ ID NO: 999910 - protein, 233 aa, Homo sapiens
TEKTRGKYPHAKDLTHLKEYWNDPEWMKGSGSCGITLLNKGYEEEDRGGGTMKRKMEDRGGGPRIPQVQTGCGRLHQTKGSCFRKKAGGTFDSSKYNSPFLEAAGLSDRSTHLTLRQRSPSSAAPSTACSASNAQHTGHASTPGRRTAAGHQQPTAKRGTPAPPPSDPIPLTPTRDRADLPRAPRPGDRHPLTRPRSPRASPNRSLLGGPSNPPAPTPSSLTPTLFQRPEKKK

SEQ ID NO: 999911 - protein, 130 aa, Homo sapiens
MFPGPLVILGGMFRGKCVIARGSEKPRALLICERETPFLGVSAKAMDTPLVFVELQPGTFLAWEVATSNLLENPLFAPVYGLVAHGIEAFGVIPPFVTDDVIAPFGPQYSPCTRCYGQVSLVHPVLLFPS

SEQ ID NO: 999912 - protein, 178 aa, Homo sapiens
MPGLQGFPELVLVYTGTQCSKVGGRRCVCPPVSLDLAPGSPMPMEGPWHAGYASLIITYHRITDSMLGSTLRTSWHTLENNSVEEMICKMHVGDSRRGRKARSGVSYVPPQRKVLPYTSKVETVGPRESRRGKRRTRERKPKRRIARRSHGKDRRGTEDGRRDTRGERRGGHLGGSEE

SEQ ID NO: 999913 - protein, 106 aa, Homo sapiens
LDTEPEVLGMDENSMLIPIHVGGALSGAGPHRPHRLPRLCRKTESRRLPDYLAWCTQAQHACTGPRVPFLMELRDPVRSGRHSLSGKPFLKLCFSPTVKFILQALY

SEQ ID NO: 999914 - protein, 501 aa, Homo sapiens
AETGGHVGLYVLSMLIPRWAMERSCAGALLDGLPNMLTKQQVTWLPVRQAACMSDPAAVPIQDESWHQDAQCPASDQSTPERTMPSLDTGPDGLTKSLLSMLSPVNEAPHARPWLFLSLTAKTPQSRLAQAILEHTSFPCQRTVRPKPFCRAMHLRQALQHQGPLGSRRTGLAPRAHNTLGWPSSPYLLFPLNQLAPVAAAPTERNGGPFGLPFLTTPPLSPPLWSHHFVGLSHHFNHNSLTFRCYNGKGNFWHSILNPPSSPFQKRPYWDSTPHPRDNTHPPFGIPNQPTTTFWLSTQPLTTPKPFLGRNHIKGSSPYNDRIPVFPSLNTRDRFAPNLWAKALFTKPRVYPHLRAARRHHNRDAPSHYIAGANENKDLTQPSGTLLRSETTKGPPLKRANKTGRAQQNAPEDDQTIRGDAHIRGPAPGAPPQQPPPIIIYSGPPDRAARTQASLTLLGTYGNLGGTPPKRAPAVSPIYQADRHPQEIFDERAPRNGAYPV

SEQ ID NO: 999915 - protein, 70 aa, Homo sapiens
MCLASSSYDLTGSHLGPSELELMAEAAGATTIRWLAVQRVLRSRATRAQNRRCDMACVCGDHEHVIIAAD

SEQ ID NO: 999916 - protein, 326 aa, Homo sapiens
SIRDRQELLLRFNLAPLCVREPASTRTKVQPILAGVAPKASGLCGVSGGLRAICTSTRRTASGKCPDRGRRTKEKTQRTAVRLDLVCPGLAPRTRIRRGELRSEVTEPPIPRPDSLRPRDGSGCPRDYSPRNARRLRTGSLKQLGPWVKPHLTVALEGPGSPGPNEQDGKPGTQHCERTESYDTKYTTTDPRKTASNDCVWTKVRQKSHPSFQSIVEKYTDIKQSLPIEEEKILTPFSGKKLSEPRTSKTYGNLMAQSAKTHETANTGTRTQHTIKGENEILPRDKDNRHCVTNPPGNRYHEKNTQSGLIVHNAAPKSPLNITKEI

SEQ ID NO: 999917 - protein, 241 aa, Homo sapiens
GSSTGLEFRDVSEMMLRLLLHTDDIGGKYSHCHITNSPNVSPPLVANRRKSPFVVHRPVSEAMKGPVEKLASTWRYCSRPTDMDDAAHVSGKRIEASGSPSSPSGSCLLTGAMYLLIRWGSRYVDEARVSSSWPQVILATSVSQSAGITEHDTLITPFVGYKDHNFQAQPNPAEVKDVFLVPLAISCIHRSMTSIYVTRLGHRFINHIFEYTNPEDGVTYQINGMTETLQCWWLYHFGKKT

SEQ ID NO: 999918 - protein, 218 aa, Homo sapiens
YGREFGIEMLVMALERPPAALSGLARDRELGGSHSMRYFYTSVSGPAGEPRFISVGYVDDTQFVRFDSDAASPREEAAGAVDEQEGPEYWDRNTQICKTNTQTDRESLRNLRGYYNQSEAGSHTLQRMYGCDVGPDGRLLRGHTSSPYDGQGLSSALNRGPELLDRGGHRGLKNHPAQVGGGPVVAGSSWRTYLEGTCVGVAPRYLENGKETLQRRGP

SEQ ID NO: 999919 - protein, 150 aa, Homo sapiens
MVWHAPYSSFFSVLYLLISFIDIWRWEFSGAQRRGSDRRRNTTDIRLQTIRPSTEYQAEYSEHIMHIHQRISWDKHERTNTTTSTRLKYQREINIGKERQGRSSAHVVRAPRTQGHEKYTVKQVKDEKSQHSGTYKKHQHKKRVRGDIKH

SEQ ID NO: 999920 - protein, 145 aa, Homo sapiens
VLYGRKFGLDRVAPGAKSLAFAIQRPSTGRRQVTMDDDICRARRRQPAPACAMAGFAGDDAPLGRLPLHRGGAPGTRDVMVGMGQKDSICGQTSARSKRGILSPEVPHRARTSITNWDDMEKIWTPHRSTMSCAVESRGATPMTA

SEQ ID NO: 999921 - protein, 82 aa, Homo sapiens
AAFPSSESASNGFFILYMSASYSLSSTYVTYSAVFLLFIKPQIPLSTGHKLCLYFSDWQDSQGRSVYLHINGPLGCALQELW

SEQ ID NO: 999922 - protein, 137 aa, Homo sapiens
MAKKHLAGTILGIGYRVRHSGSVDDLSYRVHADSAVGKSPLTQYQVAPITVTSNLTGGYTRSQSSRDSDEDSSLAPTDQHHEGVVPYTLRGTNSYVRDEHSVRKDQEGANRLCKRGIGVTTLGRGISIGPVIPHELW

SEQ ID NO: 999923 - protein, 421 aa, Homo sapiens
DKAETEASMSHCIRIVETVKPLYRWNQALEKLGRHGPGCRIDLQRCVSLDAQRSKVFQEAFCGSIARAKIQDTVRYMSLVQKCPIGGTACFSILWVPQYSSKRATGVEQKRHTGLLHQPGCVAWPEEAAWEAGSKESIAGSEIGGAKPPPAAQSLAWRPIRDYARPWPLPSSRERLTSSLPATEIWPLRDLPGDIHFNLTTLSSRLRYTPHYGTSHESAGGKRLTPDHEGTLPIPYEARGGDKRANEAMRYRRVELVLGPKPLPGKANITARTTLLPFRQGHGVLSDVTEGLCPGKRPRTHSRFPPLADSKRRRTYAYGTISSHKGLNRDFALLTRISRTDGRLFNRQTPSAIAHQQNTSTLTAHNHSNASLQTADATMGTPNLSLDIDPHIPPVTLKDKTVELPPAGNKWCTRSSKIRKP

SEQ ID NO: 999924 - protein, 105 aa, Homo sapiens
MESTGIAKLDDLTGEVQFLFLTDHSRGQLLVLIVPYSSRNGMPNAYRGKNSVRLYTKYAGGPQRCDAPEGYYYTASLTASKILQQESLRINRHIYITLYHHLAGR

SEQ ID NO: 999925 - protein, 72 aa, Homo sapiens
MRQPAREQTHGEQGGGKPDGGQPTSRENQEKRDTQGDTRKGQATGPGQGDQHTQTRKKREPERQPPGASRNP

SEQ ID NO: 999926 - protein, 80 aa, Homo sapiens
PCVQRPVPSNHGYGSVWICVARQHISVDRLCALCVAGKSWFPWVQVLLTWDVFPVSRHGSVCVSGVLRGLDGARGMARRD

SEQ ID NO: 999927 - protein, 294 aa, Homo sapiens
MRSPRWSLTMSSWLVCNSMVCSMGTDASLGVACLSYPICRATPRRPGASWWAWASKDSIRGLTEAPEARRGIADSLKYPIEQWHRQPDWDDDGRMIWHHDLHTTMLQRGPGGAPSAADRGPPEPQGQQREDDSRLCLMTFNQSLAIVRGSSRPCVSLYALERTTGIVMDSGDGVTHTVPIYEGYATPHTAYPAVLDLVDGTDRLPHEDPQMRRGVPVSPPRTTREIVRDIKAEAVLRRLEFEQEMGKTEYSSFSGEEPKKLPMAKVIHIGNERVRCREALSSFLLGMESCGIPK

SEQ ID NO: 999928 - protein, 382 aa, Homo sapiens
NNLSAQYMMLPGMTYLEFGLTTEFRAGGSACATPSLTAAEGIIGSSAIIINDSKSQIHKDQPVHVNLGEELGVGGRVEEIINVSLRNESFVLWNVPGIRCVILASMCVLHERARCMERAHWCQGPGWVTDISLSWRWQCLDLHRLYGECNDYIEFDNFEKKQRENGYHGWDLRKDTAYQAGDGPQSILWALLELNLAALVHKRKFDGGGTFYDQHVLRNFLHTPRQFHVFLLHPSKNWGRMVLIAVVDWVTRASKRIGDECNSRLSHFASVSNSPSSKWAEEHRGETHPKRFGKGCNGWGQFERFTYLVLETRLQAGTWAFTGNRMQEALRGMPRSPPTGETNKFRVRGSVELLQLKGGERAEGNPWLKRPELADSVSCGRF

SEQ ID NO: 999929 - protein, 291 aa, Homo sapiens
AKKPIEDARQQTAYLSSSNTISVLHHGPESSNRLDLGMADSTAQTDDNYRSLRCFWKRIGRIAVYISTSTCGKRLLQSSKHLAPTHGKPLRSTGRALESRLHIYAHRTSVVDTEHQTQGLGHAWDDVTRCDHELNSEGACIHQDMVPSHGMVPVRRRVLNHSKGYPSDCAFLVTIIFAIDIWRHRDRLLLIVGSTDWTGSNTMESQKRLPFLIVWPEAIGWNPASTCSSSRGGPFILLLVVPAYQFETPNVVLFHPRMIQSGGEESPHVKSSHARYPRSDIQSSSRELVAG

SEQ ID NO: 999930 - protein, 143 aa, Homo sapiens
IKRFLSVCSSRACVLLPCELHGWEQRRAAQIYESKESLQQLVCGCVRGASSSTLRMMTPGITMVLCTLGAPLLSNGDYHCLVSDELVQPPSTGLCLVGPIAVVHGIGALESCWSCIHSQDSTQTYPNRQIGQAHIFRSGRSPA

SEQ ID NO: 999931 - protein, 147 aa, Homo sapiens
MGRTTIFRRDTPTAERSTTSCKRPTGGREGAESSARPSMRSGGGVLPHKERHEHHSITVVFHCGWRRLLTKRRPPFVSLVEGDEQFSPRGSTPLLLMKTSAPSPRTHHPLAQVGTYLPTPAGAMVVGADKTGGGGKTHATGAAAFTK

SEQ ID NO: 999932 - protein, 305 aa, Homo sapiens
MTSSCVVVFRLEQLAECSPGYRSSPSTGGYVKRAPLTPILEAEGDFWMSLAWFLAACIIVLVYSARSGTSPMTKLGELLLGFLVSYWSAPGRLHVGATLWEMNARVCLHPLLAPPMGDCRDSDYDEMKGSLLTAGAYAINGGNPRDGYVGSNAREGSIKGLVQERGVTPMEIVETSSWCPESWDPIASIRHPVPETTLNDFSGTKILPSRGLPVQWKYAKRGYSGLFFNCSGSIADTQVPPGTGQERSHTHFWNEGLEERLTLSKGPDLCSGMVGREPIIQETPQGSCDGVITHLGEYVAVTATR

SEQ ID NO: 999933 - protein, 121 aa, Homo sapiens
MGTPLALYAFVDCCDPNWLPNMSRTTRRVRPKAHKRGVGHDKRGSHFRGYCPEASSTFTAQFLVDEPVYRARGPMRLNNAGWKAALLKYHPRTSRPGIGDGCPYREIEGISHEDRSCGCYL

SEQ ID NO: 999934 - protein, 203 aa, Homo sapiens
MTARTADHIGGKYTLGFMSDREKLDQHEENRRRKRQDEEKMQDRFEEETERMTANWEETFMSEESAGIQETTEVLRQDAVTSLHQGVRRYGGGTRIKYLHEESTDNLSRYPPPEIDIGATAAVPGATAGDIDRASTATEAAKSKILPESGHPERSPGRAAGASEGPRTGGLRAPTGRRLHGGQNEKDGRRDLNPVFPGAVNIR

SEQ ID NO: 999935 - protein, 237 aa, Homo sapiens
TSQVCRIKPGSTRMTTFPKAPGDHSGQSPWGRKPVGVPGSQTWRERSHREQGRPSVGKGGYADKEQTVVPLGQRLHSVPSEATTEGPSYQGSGLPTTSRGAIRPSSPGDPPSRVAMSRRGCGAPYLPDCSQGSKNNPQPLIQSQQPSRDSSMSSTKEKIAIVVLTPTYSGVFWEFSPLTRFNSFIGFSLLHASPVLISSLASYLVTVTSSPVWSHRPHPSPTTFTFNPLIQYAGFGR

SEQ ID NO: 999936 - protein, 80 aa, Homo sapiens
AHQPRNYTLEGSYVYKCLHHSTAARTRYSKLGIMDKSHSLSVFFSKADSKTHKGSCMDRDQLYQLVEQLKDLVYRCSAVA

SEQ ID NO: 999937 - protein, 222 aa, Homo sapiens
GCLAFYDPCVGEEKNLKVLYQFRASCISDGTWISRGPPDSQSSPTGSIQMDKLPRTRVSVKGQQQESFFAGESYQSLRKIDTTTPAHADVSDLYIIIIEGGTIINYVKDMQDTPAFEGAEGLGLEAAHTWEPDCSLAHGMFSQGSVPGGKGYGPDSAVSRAHVTDTQPADTVVLGWVWRCLWSILPSPQEREPLLQSTLNMGNNLKSRQASRSGSLCCAGFP

SEQ ID NO: 999938 - protein, 261 aa, Homo sapiens
VEVDSAADDDRDALGMRRECRSDAMREPIAQHAALVFLSSAWVPLKAPMAASLTRAGPCSECEASRGPIGLRAEASTVWKDQRGRCVCSPFGWLKMCVESCGAPGFRAMSSAVYWSMRDSGSRKRSARMMCWHRLASSGLSKSPRRRGPVKECDRQFVLLSSPTTRERALLTKAVELCFQGPRSDGGILADGLKEGSVDSSPGKAGRCRRLQSPGLGQAQVTFTFSRFRSLVVCCHVGIWSTILGGLRKGVWDRALLLAAC

SEQ ID NO: 999939 - protein, 178 aa, Homo sapiens
CDAIVQPAPHPPSTVTVPSAASARAQAPPPLRPSPPAVPSVQPIVKSVLHRHHRTPQHCSLWSWECPEEHRGHHVPAEQGRAKEAPHASRSFCTVASRTGIVPVHQLQQAVPFVGGKQEAGDSPPPAPGTPKANGSQPNCRLPSAWLRDAPPASPRIPHMQTRHSDDNMQHAKRKEVE

SEQ ID NO: 999940 - protein, 113 aa, Homo sapiens
RAWDRRNQRGIAMRREKGRGDGPITPRKALRDPKVAEKDLHGQLRLGVAQAIVDDRSEEADLKAPGRITQEHCYTGQWAVTGEQSSALTGWQRTRSLYPVASPGWVVSPVFQL

SEQ ID NO: 999941 - protein, 243 aa, Homo sapiens
VQHAAVEPKYDCQEHSLSNPRKSIGHLKATSPGTNLRLATPATPDLSGKQLTDQGQGVPQDTWSLSTVCRHKDVSNRYKLMLCTAPPTVSTHVQPMEQQASGQLTYYPKSTCERAVHSHLTAMRSLGSHNAGEYARMVAITSCHFPLSVALSANRSWHNSLNGMAPRVFIYGQFCYTKTFWAASKCDVRPGHQWEPGKAATPEPSSARTVPRAYTKRPSHGKAHSIRLSTSQHTAGTWCYRKN

SEQ ID NO: 999942 - protein, 69 aa, Homo sapiens
QCALWTMVPVFHCNSIGLVLPKSTTVFLFRLFDVSRSRLYSNRCAVCVPMASSVRGLAERNSLPPRSLL

SEQ ID NO: 999943 - protein, 116 aa, Homo sapiens
MLASFRLSRILDSIWLCLFYLWCFLLCCFPQSSMPPSVCISLGCLCSDDVFLLFVYLSVSSLLCFGHLSRTVLYYWCVLFLLRLSRLRKSSFLLLIIDYLSADIYAYYFVSRIDFT

SEQ ID NO: 999944 - protein, 68 aa, Homo sapiens
LTDDRLVIRAIPCDLCGARHLHALGYNVLAMHQVITCKSSHFQSVGENGKSASEHAVEESVNGISNAS

SEQ ID NO: 999945 - protein, 204 aa, Homo sapiens
MPAPESWGSHRQAHAGALYHWSPSMKQQQGHVISILVTAKVPTLHAHHVFTGTMVGLTSFSGGTWLELDGNTVYTRMVLFPWWIPAHLADAKLGSIGCITEMAFTLESVLSLSPQTSVHMCSLRRLVLSSMDCLCSYSAVYFEGTERGIHSLWYCSFCVLHSYVIKNGVPQRREMAFPACLLCPDQSFSEGTVTLTLPAQPMYT

SEQ ID NO: 999946 - protein, 289 aa, Homo sapiens
FIDKVRFLESAEQGSGHLEWTLLQEQWTKTVRQNLEPWFEQYINIPSGGMLCQHRWGNGGRLESELRNMQDLVDDFKNKYEDEINKQYHWLSNELVMVKKDVDAVIDEQGGAEEAKVDALMDEINFMKMFFDAELSQMHDVVSAETSVGPLQWDNETVNLDLDRRSSLKVEAQYEEIGKLEPGMKPSSWVSRPMYEELAVKTAGRHGGCTSRQVGQGMRSAEDVNRMIQKAEKPRIDKCQEDEWLPNRAETPLGECRACVGKLGLKGIARETRWVEAGGGLRKAKAGPW

SEQ ID NO: 999947 - protein, 278 aa, Homo sapiens
DNSSIDCRLSLAQTVSLLSTQRGGAGAMGWQPPVCCLLRILFLSRGLWVVNLFVAECAPGRAIIPAPVYPTWGDLSTRDFSTVVLFLGLRGMAIVEEGMVHLAAVGWHGLRRSSVSSLFTRTNAGLQCFALLSLSSLHSGTRSGALSPIPCRGASVDIEDRSVHPVPALRRRAPSKSDQRSECLHHDFRPMRLYDSQAPLWTVRCVGEGVKHSSIRTVPPVHLGLRSIAAMCPATQSNMQEELPSDSTVTGGTTRWRAGFASKFVIKVVSCVPSSLAP

SEQ ID NO: 999948 - protein, 323 aa, Homo sapiens
QLHLGTRAIQNLSPGMQPSTANRTGPKVGWGHRLDGFPPGRPSPDNLNQICLPNRQHVVYGPVGTVAISPAYSPTVISPGLRPLNCLEIGEFPRACHCAQPSTKPPRCVPNCVVGGSNERDSVRPRFSVKTRTPLVVCIAAQGGGSDSPSVLQEEAPRADTYQAPGPAPSHQPDIVHRVLSWPYPPGVATLDRYQEHLPILRRFRLCATQPCQLSDPLERELLALIQLAEGVPALLPPGEQSHLYMEGLGGYPDKYCDREYSCEDPAHLCGPKPSQPYTRDEWLGRRAPYPHYDREFLDHWRSAKSPQPHGATLWNPKSSHKR

SEQ ID NO: 999949 - protein, 147 aa, Homo sapiens
MGEGELQRSLCVPACDALGGNWTPGRATAAGIPSAHNIGRTSPGNHVPFQDIHQISQNTRETVAGEGMITSDYHYLTLESVHRIGTTPGRIEVRTNITPLRVGDISPMATKEGTREGDFEPRGHQELVPQADTRNLTGERVRLARGV

SEQ ID NO: 999950 - protein, 100 aa, Homo sapiens
MGVAKYYDSSMLKWAALDGATSKEARCNGNGRPGPINIQFQRPTDGLPGTSCAPNLNVAQGGGIRGARNEANAPFQGWSMTAKGDFRECGYLVANFVVTS

SEQ ID NO: 999951 - protein, 76 aa, Homo sapiens
LAPVEVSEGSAAEIWGQITGVGLFLCLGESPVRMESLPAIDFYGFQEEGEQDGGDVGLMVFGPLYTLENGCPGYPS

SEQ ID NO: 999952 - protein, 147 aa, Homo sapiens
QSYRTRNFQSIRSRMQEHKSDLKGYKAWCCSTLPEPAICGDSVEYGYSVMMRRNEKLASRTDGAYSDVTLIKWLIFEHKKEIAFSDPTPDGKLFATQYCGTGQFLVYNFHYWHRIARTRQILAYTTRRLLLHENGLVADFNQELGPF

SEQ ID NO: 999953 - protein, 316 aa, Homo sapiens
MVARGEYVAGRKFGINVTKSRVADGMNDNVILRCDHENQYALMDGCLHVGIKGKTMADSPTSQRSLNILSYSEDDKTGTLHLEVAIQISNNMDMKPTNVSVSPRCARETTNPKQVDRRILEGASSNVATDAAWIEAKLRYHPGVAVTAWRFGLNYYTLSRFKRKQTKMTFWEVTYNTVCLHNECRQPRIPDDTPWKNTQKYRTPPGHATEWEKPGKAEPSQIRTKNDHYHANTHAHEMQNSKDIEATEDKIGQGNNQVEQNTKTKGTTKQKNNTIRRKEYTAKEGPSEAGKGKQSTSKNRTTTNKETNNEKTNQPE

SEQ ID NO: 999954 - protein, 89 aa, Homo sapiens
MSLTDRGVMSYSEGMCLSCLGREDWLSSAGAESTCASGGPMQCMCGPTVANTINERHVEAEVKLASPQNQDRGANLGPPWNLGGLEKGG

SEQ ID NO: 999955 - protein, 255 aa, Homo sapiens
MDDDIAALGRRQRLRRCARPASRATMPPGPVFLLHRGAPLGHHGRDGVVSGSERIPSVGDEAQSKRGILSLKYPIEHGICHQAGTTCEKHLASTLFSDELLCGSQSEQPLCCCPSAPLKPQGATADEDDPDHVRDLLTCPGMYVAIQVCAIPVTPSGRTQLAVVMDSGDGVIHTVPSLRGVCPPPCQSVRLERWLDGTLTDQLMKILTERGYKFSTTCEREIVRDIKEKLCYVALDFEQGWARWFQSSLENSLKC

SEQ ID NO: 999956 - protein, 206 aa, Homo sapiens
MGSVDNMVWPAGVLMQEVRNRVIAVVSYGGGLWFLCSSDRIHWRKMIRATHNVDGCEPCYGPDIVKSLLYGSQIGLWHKMLRVVTAYFAMHATALIYGESDDECVLDEIHVGGCENTYLDLRKDMLWLEYYFVVFLNKTIWEQIEAVMGKRPCPNVLFIRTSTRTAPYQIYATTCKYSVVERDHYSSQTFAGIQVIDGGLTAVHLG

SEQ ID NO: 999957 - protein, 299 aa, Homo sapiens
ITMRCCTALGPAMGSLRLACTELIMDAGWLRLGLSPAAVWPAAVGAAPEWAWLVALPVTGGGHALVALGRGSCAPEGPGEPRQFICNECGKSFPGGRLLNIHQRIHTGERPYACPECVRRFSQKPNLTRDLRKHTGERPNPDRTVDGGFRQKQNCSSTMCTHLPGAQAEPMTQHAVRADEGRAALSAHQRAQDVAEADVRAGEPGDQTQDEDIPGIGREAEEIQRYPGHRDALLSARGQADLDWDNGGDRAKFNFESEVREENSQKGVRRQTITQEFKNGLNGPNTCTEMRATDKAERP

SEQ ID NO: 999958 - protein, 423 aa, Homo sapiens
AGGAGPGALHGRGLMLHGVLCMDGPSRSKQVLLGRDGVVVVIAVKSIHMIVLVRLNSARIQGCERTLGHLAYRRGRYCTATQSTLRRRTARNHRSVAPADRTSYWARPSSDGTRLLHEDTPMGWPWLDAGCVTQMVVSDSGIPNRPLAEQRKHTQTRSACTVFLSPCKAVRSYGLRRTLKQRKKGFVDAICLGGGLPVWAYMRDSGVERPWGGIVKTNKRAQEFGTGEPLNPPWGGWAQAKREEATIMSQEQTQRDRGKYADIKHKGGHQGKIPPRRRGTFRHWNMAPVHNKGGKQIGKRVSQAYTTATTGLAGKGKQGKTQRHILGKQENAVLEATDKRSTGEVYTYRNMGNRRQGGGAGITHLGRTLHMGRDDHARNYTQQRDNLELRIDLCQHAYTKVGRTTLSGRRPAAAPPLLPTLHT

SEQ ID NO: 999959 - protein, 195 aa, Homo sapiens
MCILCTIYLDASTDVVGLAWNGSIYMFQAGIPVLYGLLGMSGIPIGGAYTGVPGLATGRSGWVDTKLVHGTILSHSECVHGTLDGDFGRVTVYVGELELASPWYCYTLKHGKGLSKPSDSPFSRLAGQSSTVLPSFRLAVGFLGLMRVLPTGPCGVPCELAQTSIKPIPRLGKGARHPYSSVQSDPANLRALLEE

SEQ ID NO: 999960 - protein, 54 aa, Homo sapiens
EEAGGGTGGPNGCPWHDYRGQFLMELQGLEQEVEPSRKSARCHETRSDSQPWPP

SEQ ID NO: 999961 - protein, 108 aa, Homo sapiens
MTPGGGTSCSHLRLGVSEEDAAEPIRQKHEENSLQKRRVRAGKRRASKSRLPVEANLEFRQQLKAVRRQSRVVTRPYDHWPIKVETLNGRRQEGACIARTHVRRHLDR

SEQ ID NO: 999962 - protein, 135 aa, Homo sapiens
SSPRPPPAPSCLPGLRCGCLVETIPRKPLPRHLLVSPISCSVSDARPPGSVGRLAPRRMSLAHHPCVRSPYPPRECFHLYHCDVIENGNRTVFPERNRVSQFIRVRCRFHLTRRTARPIVSPGYDKHGGVSPQLK

SEQ ID NO: 999963 - protein, 31 aa, Homo sapiens
MEAAPTRRTESPRKIIAPQGATQNTQLGSHI

SEQ ID NO: 999964 - protein, 59 aa, Homo sapiens
MERFVKKYTGSDRNPVESCVRCEPVQMGEFPNLHFGTFREEGAVCQLQLIPKFASGSHK

SEQ ID NO: 999965 - protein, 377 aa, Homo sapiens
MELVSGATCWRLPQMRVPLQLGFLGREQVSSASWGTVKMLPYRMTLSSLVHLTAFLGYKAGIDSHRCGQCRTGLGSKVNKKRVEVEGCDHLYEDSQPMVGLWRIVRLTWDNSASEDLREPFNEHVFCLETTSGEVELQRTGSISYYSNIGTKHRNRNDRAHLTKLLATNMAQDDETGQERHDCADRNYNANDMKHKDHLSQRVHNSPGSIHFRPPTNTPNESRHAPLDVSHSLDASRQKANRAPQPPLNCGRNFPTGLGTPVECSSQPWLRSPGTETSTSGHSLEEAPPRARTRTRTALLWIRPNDQSSPFTPVENFTHPQHSLYHLGVSNHENCNGTLTFRQQHTNYTCDAIVPPHMWTKTRVAITQHNRRYQPQK

SEQ ID NO: 999966 - protein, 186 aa, Homo sapiens
MGIGGRVSGPSSLCPTAHVGVWAANKGCMGCIGAQKYKWGWWCRHGREENAGWDNSCVGETPVRRGDRGHSQRVHDRGDTARRVGERHSQTLFLGGDQNHTRVETPYSLWGPKSAAEDTNERLLCGKSYSGVLTQSVPHFVREGGGGRPPNTRGVTSCSVESPERYSAVRHKIVLPPKYASWRQEE

SEQ ID NO: 999967 - protein, 113 aa, Homo sapiens
FFRRSAVAFLCRLSAPTRGLSWTVVRPCALAAPRAVPPLPRVPDGLVAPSPGEQKGVGGARRSGRKWNERDRRDWSFDNWLRAMCDRRGCCWVDRTAPQMHVFSSSIQIRGAP

SEQ ID NO: 999968 - protein, 77 aa, Homo sapiens
AAFPHALGTRCLIAIAMMGHRPVLVLIQNTKRDFLEEKFQNLGHTVNWLRTGSIARLLIRNSAFGTLMLLCTDRTVH

SEQ ID NO: 999969 - protein, 118 aa, Homo sapiens
MCIESNPVHVTYMFHVPPVRYSFFLVGCVHWVRNSDTTHGCNGWVYMALSVYLSPTTENNQYGRLQTDIPHIYMYMRLILRAAQNGLAEEKLLDVSVFCVLHECVSVVVQTVTTLHQL

SEQ ID NO: 999970 - protein, 152 aa, Homo sapiens
AEEQLRADHVFMCFHYNREDRADLDSESLQLSGSYDDSSDDRGASPYVPHKESPELLAIHGPTQFGRRVVFRDEDVMRRSESRLWGCVASWTPGGQRLVMPGGEGTVKFDSSSLGCGPKMEVYQDVRTRIDCYFRIVYVSVSWKDTDRDRED

SEQ ID NO: 999971 - protein, 111 aa, Homo sapiens
MAPIRPVRNTICHRFDVGYPRTSFRAPGVELGRCVANKGGDDVRVLRREGTIGLTYQECWSRKRRAVDRDFLAYLQRQFTPVYISTNRIPSGKTLHGSGTTAKWHHFRIVS

SEQ ID NO: 999972 - protein, 109 aa, Homo sapiens
MTVTNSKEDRQGAVYLQKSVSNCAPAQRSNSRLGSADRSLLQGSAMLAPCANGLECRLVGVIILLGVMTGDDSLQSLHHGYGVVPVDIWCLSIEGMWFAPHLTEYLKSS

SEQ ID NO: 999973 - protein, 179 aa, Homo sapiens
MAAKVKVGVNGFGRIGRLVTRSAFNSGYTCGYSLPTQVDLLTYDLQTTMVLPLFQIMISNPMAKISHWHPSKGWHEPGMLLSFQHGNIPHSANLSQRTPTNPFTNNSTGGGPIALDAWKYPLRGSLTWGSSSQPNPCEQRAGAASIFASEREAHKGVHPFFLGPPIHELDCTPQLLSVQ

SEQ ID NO: 999974 - protein, 188 aa, Homo sapiens
TTPTVTTPSLPQKVGSPHSTEVDESLSVSFEQVLPPSAPTSGGWAEPSRCVDPGRVRSAFPTRCVTCALVVTLLNFEHRKAVAKWPPGTWRPPAARMTCKCPVTGIGQVGWGPEETPATSVSDVPGPPCLTRIPVPLVPRCRQTHDEDNRGLRSPSPQTLCPEPSTKVHAHHWLNQSSILTCHEHPVS

SEQ ID NO: 999975 - protein, 258 aa, Homo sapiens
TGASSAGITRLAYDGKDYIALNEDLSSWTAADTAAQITQLKWEAARVAEQLRAYLEGECVAVGSARYLENRDSETLQPRGTPPNDHSCEPNNPNLLNHGRPTLKVAGPPGAFLTPAGRIHNLTLGHAGDSRTGTPKLPGTTGGFVEDPVPSKGDKKPFQEVLGARPVALGWPFPWQEMNGHDKLNRSIAPMVNRGTATGVLGLEMPPYIPIERFADAQSFPTVHKRSTQVLLEATWVRWVLGTVPLAKLVATSERTGG

SEQ ID NO: 999976 - protein, 269 aa, Homo sapiens
MPTPVNKAGGKEWWLRPPAVVTKHSRLHKRGESPALRRQAKCNFPVVGTGTIHVPKEYPHPLLVQEWPLHIVERMQAGIAAISRNQSCLVRLPPDRLTSFTTVLPWYASRISHNSGLSLLDCDLSKVRDPEDQKTMRDERTEHLLGTRVARRKSTGLHVLIREIVRNPTADAALSFRSHGRLIHTFNQPCVGSNQAQASGVEGGEFDNTDRCLIPSRSLGKILTLALALAARSQTLRRVPIYLADFTPIATSNGHTTDGRTACTIQTAK

SEQ ID NO: 999977 - protein, 274 aa, Homo sapiens
TTAFRKPLAGYKSLRFWGSVGPARVHLVGQGAFQSTPGSPRCLPAPSAHFTPMRMTRVLRHRHHGHRCLQERSGVTESSPASKGTRIAPKKDTIRTRVHIIGDHSEQEITEKTIRNTKSNMKTRRPQKAKKTHEMTRQNKESTTKDGPERQQSNRHESHNGHDQDEHTYDSSKRTQASQEQEEQRTERITQQKENRDNNSSNETAQRSNERHRRQQVETNPGAAKNKDRKIKTSAPKRNRDEPQSTRGHTDAREKTHTTRTRRSNTERAKSPNK

SEQ ID NO: 999978 - protein, 336 aa, Homo sapiens
EASHTLFPPDLFGELLASSELEATAERVEHCEPLLWRMPAPVLVVLRYLFTFLNHLAQYSDENMMDPIQPGLCASWPTAAYLVPRMCAVNLVCAAEERVNQLGADDSYVQPDGSSRTHDLCCTETTSTQTVQWHPDYPAMLHLEGDSPRLDDAWRGGQLTPERGQPKMPRTRRTDLRGGRRTACGTAQALHRSRRRNTRHRKTPRQEEDQYTGQHAKTTGPIEGDLRETASAKATHGRIARGTSKHTKERRYPQTKNTDRVTRDHKHRCDETPNGQSTRHRHTRKPGEHRTPERRDNHRRTQENRRGQTKRSKKPPNPAAGERQEEKPTGEANHDD

SEQ ID NO: 999979 - protein, 210 aa, Homo sapiens
KSHKSLLYERNKVVLYIYLQNRDLFTVRWRPVVLVRDRQRVVRRREQPCLPVARKQGTPAGRGAAKAWVGEPASVFFPQVETVVSIVAGWEWNPEFHAGPVEVQGRMLEFEPRNILGLTHRVLGVLWGKLCAPRAPDAVRSCRGEMSRGSQLAGPDSRFQFVGTGHVRTLSGLLIAAGPGLLAGPPGLAQKRPHLGTPGLEHLQELRPGP

SEQ ID NO: 999980 - protein, 42 aa, Homo sapiens
YTGTVGFLPAEFGSWTGLRIYVETIHVKRTPHDVIGSACTSP

SEQ ID NO: 999981 - protein, 36 aa, Homo sapiens
MQGNPTMVSLPHEGPAASAAWGPHVRCSALVRGMDR

SEQ ID NO: 999982 - protein, 439 aa, Homo sapiens
WVKKPADFIGSGGRGLRSSVGGRVRFLLSPSHRPSVACAGWWRLALCGCGLPCAQVRGGYLCPVRTQWCSRCCLGAWRRAFLCRWLSPAPLGEVWAGLSGFGRRSSGFELDHHETTFCRVGLRPGFHAPNRSLRVRIQLLSCTRRKENLAGAFSKRFIGRPPRLIGARAIYSPLFVDLRRNTWGGRQGLPDKPDPFPLCGREFARKEHVGGAGLSPSLTGRAEPRRESHRGLKHRGKKPPMCGRNPFFDISRKKLSVFLSTHLRGCLWGERRFGDEPRPVNAAEKSTAPKGGVVLWADTPSLLPTSGGAKSKPPPFVVCLFLSSKEVLKEIPPACGLQEESPFCWGQFLGRKTTLCTHQVILVCVPPTVVAPMFFREGCAPKMAASTQTPFLLGNNGVPQTGFRGEIFIGKVFTRHTQPNTPSLSTEFTVGEHTFWGVN

SEQ ID NO: 999983 - protein, 211 aa, Homo sapiens
AEPGDEGEPGRSVTGAGTHEVASRLRDLVLPVHPDTACPMSHVSRAGGHQRPAWLQRCGPTMLHACRVLRTTSFFASSMWHEMRCSSTLEELQNDLRPDLDGASSRCRFPCSSNRLYEAEAGELATSVEEIESTCCLARVWMVAEVLLGSMNISSLFLQRAMSFALEQLKAQANARIPRVLCLRCRKLRAARWLPPAAVLKDMIPTGDAAA

SEQ ID NO: 999984 - protein, 64 aa, Homo sapiens
MAEEKNDRRKQNPIPPKARQHLPGHHRSETTKDEHTRQGSDVPTSTTKRGKWVPARDYPIPRPP

SEQ ID NO: 999985 - protein, 109 aa, Homo sapiens
MQLLDQRKIGLLAASRRSFIAYTVLDGQDHRNNGVGVQGEKRTGFVGEQLLRHQRYKKCLKRGGKFNRQSGNDRRGSMNKPRLKWQGKPGNTKDLVGKMEQNRQQASNN

SEQ ID NO: 999986 - protein, 35 aa, Homo sapiens
GEDVSSDSAPDSAPGPDSQATPWRGAQGVSSARVH

SEQ ID NO: 999987 - protein, 348 aa, Homo sapiens
RFPGPASAVNSRALGVSRYEGEMEQRCMKRAIRGGTAVSNFVVSGYHLRGRRVSRPALAIFCCALRTRLPVVTVHLAPVGVGFCQLRRPSPTTWSPEGEASVRCQYLGGTRRVVLWAEEGGVCQPGSRWDYRLDGDGIGEKETGVLNGEESPMNHRVSGDSQESVTGRESMGMRRTHEMCWENYGNLPCYYEEDSIVAQRDLRCAWHLQHHVVRERFVREELQFHTIGTLRWNWARKWWPVWRGRDKSFGGTPDPSDPENEDGNFATGRSKGFGRPATKPTLEEKDSRGKGPIVTGKLFPKKAIEAKNFSPFLQRRALALPWPQETFPCFGMGNTQVEFSSHVQTNAS

SEQ ID NO: 999988 - protein, 350 aa, Homo sapiens
MTEVAPCPIINGPNITGTQSSDIEGFYPNLPTEGTSSSSSTHLLEAQGNWSWAWGAPFLKSPVQKTPQSVWPSGRQQAVHSRKFAPPGDSRTGSTLLSGESLWGALPGARQGSGAHRGAAEYVMPPIKSACTSLMSTMAPEYGCALLSYILSPSTVSATLFFYDYLRDNGGTHPGGLQLYKGLTFPRGNPKGRLKSPAENMPAGTRLAQRIYAEVFFRTHMFCKATPQSCGPKTTGAPQGLKAPPKRKEHNHGVWFSRLFSPGGIDKTLISRGLRIAEECFCGNPPVIVAPRVVLFDMGPPDIIRTTPLMLRTALYSLGGPPHGVVHPGGSSPRKTPLRLSSSLPPGGFP

SEQ ID NO: 999989 - protein, 120 aa, Homo sapiens
VQAEVVSDGDKPLLRNRSKGNSCYAKRLTAFCPSPRDLWNFELERNDSGYLAEETSRTTRAFKRKQSIKVGKFAGDHFGILRFNDWPIGCDRKEKPHFLGRNSSPMQKFAQVMRNVKSPR

SEQ ID NO: 999990 - protein, 66 aa, Homo sapiens
VPEQHGPLFAPNACKKGGRVVIEKVLDAACVHIDDIRLRNELRASRRPWDDLPIIPQVIEAPGNQE

SEQ ID NO: 999991 - protein, 282 aa, Homo sapiens
ENKMYLTPSEKHMLLKVMGFGLYLMDGNVSDIYKLGCQEENESYPKVDTVSLSSVQDGCHRCCGRLSSRIGDSRQDTIKSQCFTLEENRVQVDVQPMSSISPQVQYLRADVVQIRDDHIRFISELARYSNMEVVTGSGLDSQKVRRGVSRALRPTLRGLQLLSKWSAHVMEVYSWKLVHPTDKFCEQGLSWHREEYERATRYNYTSEEKFAFVEVIAMIKGLQVLMGRMESVFNQAIRNTIYAAFAGLRPGDAAVSPAAGGTEEEECPHQVLQAIRKTICDW

SEQ ID NO: 999992 - protein, 239 aa, Homo sapiens
GYCEYGGVKGEARTCLRPGGYGPIDYKRNLPRRGLSGYSMLAIADWNPDLLGLPWKHNEDGTVSAGAYEIEDFRGVAIALFAYCYRAVNHRSDLAYALRENLVGDEAIIMKDCARLPRWGMSVFQTIRWVPPLIGELYGLRTREEALHASHGLHVVHVGPVPSGHLDPRGAPPTWDGIKCFLQDRVEENEPKCLNDTKNFVGDERSAVEKGFHKPMWRGGPWCVEMGKVEEGNKMLCHK

SEQ ID NO: 999993 - protein, 85 aa, Homo sapiens
IVTMAVLMRVWFDLLSRVLSGVDSQDRRASVLGAGPCAHASDLGAYLTYVRFTEGCCFLFRHSWRPWEKTICHQTFIRFYDEAYP

SEQ ID NO: 999994 - protein, 135 aa, Homo sapiens
IDALDPDLQMYYNEGTKFRTWTQSTGCDSLLWNMARGHGLPTHTRAPTSHDMHSIAVVKMIDERHDMPELSMADVKFSFQCPGRMYAPAWVAPEALEKKPENTNRTLSRHVHGCSASVGTGDTGGYLADLSNMGD

SEQ ID NO: 999995 - protein, 105 aa, Homo sapiens
LFHRESTIIVAVETVELIAVRIMIEFHNNIYIKGWVQMVHRSVMPMCFGTAEVGESPAGTEEFKTQPGQHDKYPIMYKVLQKINLGLCGMCAVIPGYSGGQGRRR

SEQ ID NO: 999996 - protein, 108 aa, Homo sapiens
MVDTGQFPGAIGKQGKAARHGTVKSTLGIFTQRWGNLLNRRSAPCPSILGLQRLEEATEGQLRKQGIVAGAVDVLPPELDGHAGRADSIGTCGQLVGAKYLFTRMERF

SEQ ID NO: 999997 - protein, 276 aa, Homo sapiens
MTKDRWCESSCGSKFSRLYSYESLQRLGRKYVPSKVAEQLEVAEENLVLVTLREEGDSNEDLDWYQIIAAWLDVGDTGGWPQFNEQGKPEAQKNTGTTPARGSFDNEKSYRRTQMACSPSHSLTDNARSHSETNKRRSMQQVLPFTGTQYQQELCRTLLAPGLASKCLGRRLAMDFFQGTISANPTLHTQKDLKGPENNNKTNHLRHKEDNTTAQSRPPPPGDPAKNELVPTPTRAGGETRPPRGGTEETQRATKRALRERSRARRQKARRATHQN

SEQ ID NO: 999998 - protein, 417 aa, Homo sapiens
GRRRWSSHCFPAFPQMTEGSRPLLTQTLLLEHRTSPTYEREDNPWYCWILETNKVNTCSYSEKEQKQHNTITVPNEKELTRRQGKGTQSPPAQQGGQSRGTTTTAENKKTQERNKQRTQPRNRNKTRKKKKARHPSKEENCNMQDTENRRSTQSRNNAEKQNTETRRKEAATQNKKRKKKRKRNNTRKREKESEQRRRRSDEGGSQEKKKNGQDTTKHNKEREKHKRNKTRAGARERQERRKSQQERERKTTGTRRRKAREKATRTTKRGEKDREGEGPKQKTGAQKHNTGGTRTQGAEGHGERNGRKGQRRRRKEKAQAKNKRKEGSTDEGSTTADTVRDKKDRETRRKTPAKKKSTTSHKRGREKGQSGEGESAPRRREERPTEKQEVEEESEPKAQQDRKSGNDQQETAPEREA

SEQ ID NO: 999999 - protein, 131 aa, Homo sapiens
MVWSAASYTWSPSPPSSGSEGCYLSLLELSERVVSVLLLGSGFRLRYLHPCVCDGVFPGLLSSLFMRHLGPLDKVVTDYVQWGCLARKVHKAGVLALSCFEPLLGFCYSQLSRCGRSAIADGMLGKALTLL

SEQ ID NO: 1000000 - protein, 75 aa, Homo sapiens
MTRIAHDTFYCDGYTLSLTTHTLTYTYQLGLSTGLPNIQWTVRSDGYSTAHPRDIAMKLYTPSHMLPIAVHICNN

SEQ ID NO: 1000001 - protein, 140 aa, Homo sapiens
CHLKVQLKETDQMCRLEISSMASLWLLIKTWNQRWSVLTAVDEPMEWVSLDRMVCFLKVTLGLIRKLLAPALCKSYRQVGKLYPLEIRIPAMNWTEYGLTGKNHPAALQSRQTFYEACEHMTSDQTKTASSPDWAAHVEL

SEQ ID NO: 1000002 - protein, 70 aa, Homo sapiens
GSANWFSYEAHQFILPGCAAQQVTKKYDACSNDERLLIAMTYNLSSKPKYSLKDLTGGIVGVVMTCHHQT

SEQ ID NO: 1000003 - protein, 114 aa, Homo sapiens
MDIWSVFKQNDGIILNIRAYSHGQLIIYQTLSNYCTHTTPTTFVEQMSMNYSIAIALCLYIGCDGGSSLRTERIRKHTVLVKSYTKVHRMSMGRNMVIKHWSPPCTRPYNAHQP

SEQ ID NO: 1000004 - protein, 210 aa, Homo sapiens
MVLRGSHSPAPGTVPPRTLKTRADTRCNVRRSPSRNGAGGKAHHGAEGQRLQATSEGARERVAHPRKGPGRTCAHRDYLPTMPHHSGIAPPDQSVTRYLYAHGRRSWNRPPQRLNTSPAPTVKPRQQRRHVPNTKSAATPVDTAHDAQRSHCPEAHTSRGHHVPGYPVHHARTSAPRGGSLQTSVETRAAPLHEPRNRHSRRTLREKTRP

SEQ ID NO: 1000005 - protein, 343 aa, Homo sapiens
KCRKILIRRSLDIDEIVLVVARLEFQRFSNWLTESNNGKEPSRGINRRGSCSVWCCCPGWCALWLTQGSCVTWYCLTDCPLTLGLDVCGRCLDRLLISNGSTVVPYHEVIEILSMLLSDLSVCAVVGSSGCSCSGVVALASVCVRASVRPLRASSVALVSFVPSLASFCGGPALSLVRSSRVMYVRLVRGFRLSGVGCFSLLKRVWVSPGAVLLAARCFSLPRALWLPALCRGVSFDVISFPPLPGSLLTRLPTARLAHPPLPLLLRSAPRLPFPPRWRLVFSVCCVSFYLLPPPGLLAPPSRSPGFLASRLHLLRAAPPRRLHSRLLHPLFSLGSFAAPFVC

SEQ ID NO: 1000006 - protein, 298 aa, Homo sapiens
RARLLVPASDRRTGCFGYVTSQGRTAILSRSERSSLPGAAGLPLRGCGASQLADVRSPDLKPEEQSCTCAEADHRAPYQDNYCVTVSAELPALGIIVTLWTTGLSRDHVPRAWPPSQNGDQLLGCGVPERQAGLSTRLSVADLSMLAARMSEAAGAKPSSHWRGVAGASSLRRCCRALADGSRGALWIAALKKPACSRTSECRGQKYEGTRDIRLSSGACVFGESPQRRVVTEVGKDAPRWKHPPYHQVGLVEVGRLAPISRFARGDSMGSQARPGGHHGIHPPVGNTISVQMATLQS

SEQ ID NO: 1000007 - protein, 263 aa, Homo sapiens
SIFTVCLDADHAQVSEDVYRTHLAGQMLHGGGSRLNSRNSLDSDQVRLHASVAGEKMASCVDLLYDDMLLREGPPIVIRSETMSVDVQRMKPAAWCGLRMGARCRMTTRKLRFTQSMPSRINVATIEKAKQNLQIIMIQDLDITVMVFHQIWQRLPQSRRSSARDAFIQMALELAIAYKDLRTGSVPAYEKCLPDGMFITWGRHTMTITTRLASVHSLTVGQWHMALSSSVTEAPEGWTLSGEVPVQSPTGGYQPTRAILSGK

SEQ ID NO: 1000008 - protein, 280 aa, Homo sapiens
QERQAAAGAVTGDRAPFPCTLLACRSSSVGSHASFLLDWRLGALPERSEAPPEYSEVVADTEEASLGGSRSPFHAFRMEPDMSSVKARYFDYIQEFRIAAVIAMYSVGRYPETQSWRDMRPRCVDLLYRDRVPRRGTMVCTPDFSATMTAEGVLLDSRADLPLTVDSKVGEPKVSSTCGEGPIRHFSTMENRGGARLDSDLPGPLTLGGIEMPSAVSERLANKPVVQEQEVVLEVPVGASQSGRSRARHREIQVSENPEEETMQRVRSPDRKDEKESLRD

SEQ ID NO: 1000009 - protein, 144 aa, Homo sapiens
MDPCRMEWRARKLQRDMIRSLVHGLAWDRIWGFTRIGVHYVRGFDGPSWGCSMGAPGPFRNVYVLGLSYVLLTAWYLAYAFRLGPGFVGHRWGPVGATFTPITESRVHVPPMVTLAWRTQPLSTEALVVFGAHGGPTGFDPGHY

SEQ ID NO: 1000010 - protein, 162 aa, Homo sapiens
MSSEEGKLFVGGLKFNTDESGTGKTTSGCFGPISEVLCVVKDRVDSSVSRGCGFITFTNPEACFSCHEEPGTESLWYGRLRIRVGFMLGKSVSGNQRTVALGPMGVGRSYSRGGAGTRAMGVGTVFIDSLTWRGMDMDMDVPETIMAETRVVLIRYSWRKLT

SEQ ID NO: 1000011 - protein, 310 aa, Homo sapiens
YGPDPRAMAGYLGWDPEQAGEGSALIRPGAMAALMTPGTGAPPAPGDFSGEGSQDFPTLRSEPIAAPGSCSCMKRDGGRLERSGHQGLRGRCGEWDAALGRYRIGALLYGHPTSGSVALWSETSCADPWSLGSRRAQSRWPWSSRPGCSSDALCDTAFRQGGCVVDDRSTAGCLATLPLGVHCGLQRCRMITRTWSGSTQVRHPWSKLGVIFRGFNCRVQSPEQYAECCWTYAGCCIVGRSEQLVPAEESYMLARDVTAIRGTACHVCHRLHSQYRNVGGGACPVWWWTLSSEGAAGFPNEELARELGKT

SEQ ID NO: 1000012 - protein, 197 aa, Homo sapiens
MCKPTDKEMLHRPRRTLTSRSAPDTTEQYRPTPALRNEDTTRRMTRQGHKGDNPAAELQRGTTRRRPGRTPAQTPDGNTNSREQTPKQENNHKKQVNNKNKIKHKGRCRTRTTRQPPERTREKAQRKTKKKNEDRGRERTTQNKKSNSKKKKNQTKQKQHKDKQRKAKNTKAKEEQRKKRNKTRKNNNKNKAETAQE

SEQ ID NO: 1000013 - protein, 145 aa, Homo sapiens
IQKGDEWHLHAYESAELVGGQCWHVPALGLCTSICSYAWASIFRFYLCRTESYDSLHVFVIHFTGVGPFRKPRGGGKQRRLVDTLDTDALELTEGPCKHSRSRAHAGFFATKGVSQRENLGPFRAQIFWVVSDGIPYNTGPKPPL

SEQ ID NO: 1000014 - protein, 100 aa, Homo sapiens
LQEVLEVEEEEVEEPVDLPHGEDIMDDGGYSMNFNMSSSRGPLPVKRGPPPRSGGPPPKRSAPSGPVRSSSGMGGRAPVSRGRDSYGGPPRREPACPLLG

SEQ ID NO: 1000015 - protein, 156 aa, Homo sapiens
MEAAFLLVITQLKTLFLRCEIGDKGQTETHGIVHGRHRHPPGCTVGIFLCDGKQLATRVVLYPPFPGRDGPRPCAACIPPLCHSTGRLLVMFPALALMPLNSHPAWYPSLLDPVLTLEAEPYVSRPSPSPLSRSNSKVVVPRLRFPLRFVEIGIMC

SEQ ID NO: 1000016 - protein, 135 aa, Homo sapiens
MASVVSASAQVAGSSSEEEDSGKTGTGLQAVSGLPERPGGSSVCLYAVSPERGGGRGCAESTYREIFFMLGHKNCALNCLPRAAGGQLSFHWCCWAARLWDMGALCAPDLCAFLWPGRFTSGQKPLDTPGLGLPF

SEQ ID NO: 1000017 - protein, 168 aa, Homo sapiens
MCTSIHGYNFHMMMENFINSVTVTHKGESAVEQYDRFQFRASSPVEELLTMQNDEGNSDMLVVTTRKQAFLELKKLRKVMKEARRSVLKLIAVLEKKITAQLREQVGEWKENLGMRKKDVTNCKQNKKGLTEVTLKLTNGKVKSCKKRFSDATSKAHQLEEDIVSVTP

SEQ ID NO: 1000018 - protein, 167 aa, Homo sapiens
QCEGQVQQARARWRTPGHVFLRIHSFQDLSSSILAQSRERVASAREALDHMVEYVAQNTPVHVVSWDPLPLESTEKAPRRRRSQGERERDSMLWPLSYTLHARALESSIRGSISTLHFLSRTPPSSSVLVHLVKLKALKTGNHPVEPSLSLSESWKKPVLSLTLSVM

SEQ ID NO: 1000019 - protein, 355 aa, Homo sapiens
MTGKKPRFRHITESWPVLTLASRRTHHIGNPKTFTFRVTSTPPYMGTLPHAPHAHYSPGRKTNTNTDRFYRHPQPYTKHIAANATFHSQIGAQKRQKQTLAKRTQLKGHPTSVHTFSPYPELLYPTQTNAHGPPNNSPYKINITVVRSIGPEPNQRNSQKRNRTLRHPNHAQRPPPPAPRHPQLYGPHDKQAQHPKSTPPPYPNPTPKHTQTDNNLRAHRQPLAHTNNDHPTAWAPATVTPIATPTTTPIHPRHPGKTSHPLWTNKHLNKDATLWRNDRAKNNHICHPQHRRPNGTTGKANTTTHNGPKHDADQQKGQTNKRHEPHETKHKTSYGPTEQKSRNNSPTAYPGPPTP

SEQ ID NO: 1000020 - protein, 166 aa, Homo sapiens
MWKGRQQVPCEDTIHTSVFRVSLKCVLGKNPKDSKPLSGGIAGQGLRKKGILCVAQIRTAEKLGQNPLLCYCLLCPLFRGGFRGGLCTRRPPYEPGTVEACQCFPFETPELAFFPELRVPLCVVQPVPVWAGGILLPCGNLAAPRAPGLLRKTTGAKAKLGNCANP

SEQ ID NO: 1000021 - protein, 116 aa, Homo sapiens
MSIDEEWIKKMWHIYTVEYYAAIKNDEFMSFVGTWMKLETIILSKLSQGQKTKHHMFITHRWEMNNENTWTRGGEHHTPGPVMGWGEGGGIALGDTPNVNDELTGAAYQHGTCIHM

SEQ ID NO: 1000022 - protein, 136 aa, Homo sapiens
MPPISLLKHNKKSPLLQFPTSSSSPSETTSAWTLVFISLSAFLSNIKQISEEVPNFPTFSYILLSPPNCSNLCLLPSSKVASTFLGMFSATPHSQYQFTVLVCFHAADKDIPVTGKKKRFNGTCSSTWLGGLRIMA

SEQ ID NO: 1000023 - protein, 411 aa, Homo sapiens
AAGWLLCESGCAFCSARGPGSRAAGHRASDVNVGRAGRQGDCVASALGAKRGAGGARTAERCQECQLVDLDIIQEPPNRTTPVRSGTLLTRDEYISSVSKLGAIDEDASRGSSFMTSVTGLARVLWPGLGRFDRDDCCRGRMRPAPTTAGGHWYSAVSGLLVELASSYRSPNLGARSSCPCNREDLDRVEEGSAFCRGPGLLEYVNRNSLGSEQPHEYYAYVTQVMIPGIVAIIRLPISSGWKTTTPMRRKSTHSGASPGRRSEAVVLCELRVRASFPRADGTRPCRAWGLRFGANVLGSPAKAKQGCYEANWTGMLQLENAPKMGMGPIPKNANASEPQALRANGSYGMGVKRGQQGPKARPCGRRQDGDPERLQKGFSVTGFHSSKKNSIQEKYPWRIVTLEDGSPMNK

SEQ ID NO: 1000024 - protein, 111 aa, Homo sapiens
MPFQGVSTNGYTRKSNLTWHKVEVQQCLLDRRAPNSRHTGLPESLASQRALLSSNESIRRLGTPRRASARELPLVSVASTSTLHETMPPGNPQGVRIPHSLAHRATNNSIS

SEQ ID NO: 1000025 - protein, 40 aa, Homo sapiens
MLTREEKANIRMGPTKKSQTWSHEEALSDTGISPYLYTLR

SEQ ID NO: 1000026 - protein, 66 aa, Homo sapiens
FLLLALSSEPVTGVAFQKPSFYMDVSALESRGLLRRQTQGYTQRLTELSILSYLSHQAASALCVWV

SEQ ID NO: 1000027 - protein, 189 aa, Homo sapiens
MGELYREIDKDRREIRGAKRMTSLVAGDPEASRVTISMGPKKVVDAVADEAGSELEVNFYLNGQEIGAFVAEQKVEYSLGEESEAPVAEGTPPSEWSCTGSWEKLLKEGSSNQRVFDWIEANRSEHADSIQQVKFRALMTVVCYSAMILETPLRVDVAVLKARAKLVHEITCVSEQKELQALYGLQVRL

SEQ ID NO: 1000028 - protein, 324 aa, Homo sapiens
RGRCIRAEACPRCDPLRRYTAAQSPPSSSPAQARPLHAYRVVDGHHCAPARMVGHGGPACALGPACDCSSSGLRDVCDRDPVSTGGGLTSKALGSARGVPPERRGSSWQGRETEGADSAIPVGKPRSSAPPTVYKDPNRRWVKDHRRCPVEIPACKPESRPGEERFRRARPPGFPGRGQLTASPRPKASRFRGRYLRAPWAIMPPVASVITGTSRIPPGRDFDMGRTREVGLPWSLQTGRGQRAGGTGGLRPVDGSMTRIKPSPPAAKGSRRPTVSPCVGTCSVCDRNCVDACQSSLVHPSRLALATRGLVYGQLLGLSARPGK

SEQ ID NO: 1000029 - protein, 268 aa, Homo sapiens
RGWDHGTWNPPFTPLERPWALTQTWDGVSHSLKYFHTSVSRSRPAGSPASSLMGYVDDNPSSLQLSTRRRRDDPHGWCPRERPCDGAARGHVVLRTVEITCGVHGYTRHQIFRVNLRHAARYYNRGAEAAVSDPSVDAMAANCGPDGRFLRGDEQVRPTRARIISRPVMMDLQLLDRGRNIRRAQDLQSNNVKLMPLRAGASQSSLPENDTMTVEWLHQIPGRRGKETLLHLEPPSDTRDFSDPISDHEVTPAVLGPGRLPCRRSHVT

SEQ ID NO: 1000030 - protein, 208 aa, Homo sapiens
VTFTVIPPVAQATVNFRIHPGQHSPRGPRNSRRTLWLITESSSMFECLYDPLPVSPSDDEDLVLPDMLRPGPIHVRSFHGMSHYYMDPQCNTYLSVGQKHQELRHLTSFYHKPSIAALALLQRFIPLILLVSSPDTTSKRQSSGCASEIQSLVHAYETHVNISSLELELQELLIIMTHESLVFLTLHKLLRVNGGLLGLSAMPDPSGQ

SEQ ID NO: 1000031 - protein, 67 aa, Homo sapiens
DNFHQMAPKYIWDQKGFGSCSQTHNSTKPTSQAQGSFHEPLNNIALNFNLFFSFHLLLYDSGFSVHG

SEQ ID NO: 1000032 - protein, 248 aa, Homo sapiens
VVFTLGVFSAGSRILRHMRMTLECVTTSIYLSLSHHGKSSRLLGWLSLSWAFDRGRLANLSSSVNDKMEELTHSRAMVNLRALLLQLAGLRESLCGASVQTAHPLRRGPFSLRGYCADFSRSLWYLMPRGGLGLSRSGLRPVFCTVVLRSTLVHVTFYNQLGLDICGSLVHSKYVTFQPRNVVVLTRIFERLLTSVSLPSLLIHRLASSLGFRIISRYAYIIDACLNVYQANRATELLIRRSLAFCWK

SEQ ID NO: 1000033 - protein, 185 aa, Homo sapiens
LTSNTSETFSTVYIEQTPTIVPYMLECIIILVCLHLDTCYRSWDETMMLLYADLMRCTSAGCTMRADTHITEITSDTEWGMQYNCPTMPNEAAFPFYRLFNDSLPATFRDYMLPGFPGTPRPTREKSVRIRIMEKMGGGGVGDGTHCRKEALLILEEHHGISEELPRVLVRMDTNAATMGEYFAS

SEQ ID NO: 1000034 - protein, 103 aa, Homo sapiens
SVSASWLPPHFFRLAHSVSASRPRIMKVASVACIRHCRRGPHAARFNGLANDRRRGAARGGALVCLSTSVVHLALLPGASGCAACSCSMTVLMACRLCCAWSY

SEQ ID NO: 1000035 - protein, 96 aa, Homo sapiens
RITRVQEIENILATTVKPRLYYKYKKISWDYRRTPLHLGDFVFLVETGFHHVGRAGLELLTSVIPPLGSQMLDYRRDPARLHQACLFLGHSEGQLS

SEQ ID NO: 1000036 - protein, 181 aa, Homo sapiens
RGQVRRRLVRVGLGPALPRDVKYNKRVGDGQRMPVRSAGAPVPQLPPHAGSAVVHLRLPGADSGSGPMAVCSPPFTCGPDEAGLTVATTRCSFGAMDGARGYLLNRIWGCSWRSYAALVAALPEGMRPDSNLYGFPWEFGESVQLLWDLFGVFSFVFVDASCNSRPRSRPYCGTEYEQACF

SEQ ID NO: 1000037 - protein, 69 aa, Homo sapiens
FIAGQSMMYRTDVVRARKRVCWEPWVIGLVIFISLIVLAVSALALTVHSCEIVIKEKTYNYYTHIVIYN

SEQ ID NO: 1000038 - protein, 41 aa, Homo sapiens
MGKRGKKDRYPYGPVFPRLGETKRNSNAVMSMQRKDLLTFD

SEQ ID NO: 1000039 - protein, 316 aa, Homo sapiens
SGESPSDAEMRVTAPRTLLRAVSGGQRCLDPRAWVWLRYVLVMVILAYARVFRWRPGRRGSSRLHLDVGLTAGRATQIRWSVLIGRSVRRLGGTGRHPMAHGNYSKEGGSRVYWVTLGNDELMSLRMERSMMRLLRRGRRCCGSLCGRVVSIRAKQADRTRALVETQLPQYEMVTGLAGPIERGRGTVDGSSLTRAQLSHCLGRYLSLGDRELHMPTRGDRRMNPGSLSVGRLRDVITCQGSTESKDGGNAAEVRVTVLEESTMHDKCATLRRGNDACELCLRQQEALETRRGTGGPSCEEPTGILRKMNRLVNPR

SEQ ID NO: 1000040 - protein, 110 aa, Homo sapiens
MRARWTSMHAGGVAGEGRGALVTWPRVPGMEVYGRSDGPLSSPCRAALAPTRRLPCSEIISFGAHTCMSRWWGGEEMTVCLTTFLVGAIDTYAHLISSSPLSWIHGHVPW

SEQ ID NO: 1000041 - protein, 181 aa, Homo sapiens
SGARRSPAPRPGGDPPREGLRVSAAGRLPRSHARHSCLPLPRAPEQSAAFPRAARLSPTSLGCRLVLVRPMGNAEQATLQAPTMFARNLRRRTTRASPDAASCHASSVTTGASLNGTCPTVNRSMVDDASTNDLAPRLPFPIGERTPKICLTHVLHDTYVTTNQTMRTHTTFSRTFDRLPA

SEQ ID NO: 1000042 - protein, 255 aa, Homo sapiens
MIRGQLIHYWINPINGNNATRVERNCYKRLAHDNLLPGTHFTHRDCPNTAVGMGLTLFYDHARRYMWGPFTQKDVSSAGVPKNSGDRTKGRKHSTVDHQNPKVRQRRPDDLKVIVAENNTFDILKEKQPRQIVQGAKHQQGHVDSGPGWKHPRGLLINKHRPPAASCTTQVFGRRVQQPPVRRGEHTKQQECGPHSNKAGGKSQRCTSIKRKNAGNTTKAPQTPTTTGGHTTQKAGAAAEQQNGKVKAGSKSDSI

SEQ ID NO: 1000043 - protein, 258 aa, Homo sapiens
AGDVGGWKSGEPATADLLARATQRRGSSTVHFSTTEGKYCVLSTCVVRELKASSFWNLNFNEAMWAIKCVCEQQQQSSSNVHLESMVHMCRQQIPLQGGNLFDPTPRNQDNLHRILDSVLTSSTFAAERHRTNRDNTSITKEDQQTQSERETEKSVHAPKRGERTHRNQRGERARDNKTRPNATRVGATEERTRRRRRESELQKRHKRRPYDTPRHTPRTAENNEAGDTTGDVGGAPTRASSKPQPRNRARPAGQTSA

SEQ ID NO: 1000044 - protein, 138 aa, Homo sapiens
MATVNSLYVTFHIMRGPTVPGLAGATTNTRAQMDVPGITIRARTYTQQLVTILGQADTRAIEYRHHRVPAQQAQCAQDTRARMRESLRKNGPISEYRKLQFTFSTTQSASMLNYRHTRRNIPYGSKQQTKIQQEHKRK

SEQ ID NO: 1000045 - protein, 103 aa, Homo sapiens
MNLLLPASCPTNIRALTPEQKKELSDICYRYRDHLARAILAADDVHWEQFAKRLKSIGHRRTLEENRCFYRELLLTDDDRCEPLAIAGCHPSFHEDTSSQTGG

SEQ ID NO: 1000046 - protein, 177 aa, Homo sapiens
MTDRDKTTERGQKEQRKKKTNRQESNEEKTHAKKNKPRRKKETQKETTHEENEKAREKNETNEQEAGAEREENREESKKTQRTARRNTTENENTTEEGKRGNRQTQRQKNERKQRKSEEQNQANKERRRTEGTKTKKKKHRTRRNKRKEREHEERRKKEKTQKRRRKTRQRGRKQRS

SEQ ID NO: 1000047 - protein, 220 aa, Homo sapiens
IRLWALQLIFSVHASAPVAMHCELPEDMRRMRNVHQGGDNRSEFKDIDGDQNPEGPDRMLPCGGPTQAVIFFLRSSSNPSSCTSSMSCTTVSPCSGLVKLQRLVLDPQHMWTSFDAPRAHGGRLSSHDVSLTLQGVWRFAIHAAMSLEIVSVCCNSDTWFLAKITRIATFNSTCARSLRIKEKDSMRWDEANLVARAVMALDRPAFPKRQEILTLELRAI

SEQ ID NO: 1000048 - protein, 88 aa, Homo sapiens
HSLVNTRSAYHSGIQSRGSPSQFLVLIIINLSGTEEAKRSSRFSFGRHGSYGSARSCIMVNPGLDPLSTWKCESLHFQSCRFATGNRY

SEQ ID NO: 1000049 - protein, 185 aa, Homo sapiens
SGLSLPSGQEPDPRVCVSARPLLRTGGCPLPSYGATMGLTGQLWSDVPSQREICTRRRSYPVARSGHRRTGLTAGEATMLRVVGNPSDGEWGTAPMIAQVSEVKVEHEYAFRERDNAIVTYMKYGDLANAWMHMTAACMNGNKPSDDCAYARTRQGLAQAREFARLEKMFGTMVTKRDAIWWDCG

SEQ ID NO: 1000050 - protein, 114 aa, Homo sapiens
MSCQQSQQQCQPPPKCTPKCTPKCPAPKCPPKCPPVSSCCSVSSGGCCGSSSGGGCGSNSGGCCSSGGGGCCLSHHRRHRSHRRRPQSSDCCSQPSGGSSCCGGGSSQHSGGCC

SEQ ID NO: 1000051 - protein, 85 aa, Homo sapiens
MSNKYNTTKVLATIVREKRLKLTCNRPFNYRMHSADFEVVRCRACVLFGGIRTEFSAADMAPVAVSPTGYPGLSSWAFACDRRVF

SEQ ID NO: 1000052 - protein, 199 aa, Homo sapiens
SGTGKMAAHHRTEHSRRRKVQVSYVIRDEVEKYNRNGVNSYCSWIQQLNRLIHRPVVDSTHKNMDVSTQHDAKIHILASTGTTKLDLALTRPLAPLVSSTRGKTINSLAYFLDNDQHTPVLGKAHPHGATIRHLYQQHFNREHQLHNAHLTGFQKEPINAIYVPPTRELNIETLQNDHITRLGDHGTKTGTVLTPLLAE

SEQ ID NO: 1000053 - protein, 67 aa, Homo sapiens
SGLTRTHTRAQEAGGRAPPAPMDAPRRGAETPGRASRSGRQPRISGQDKSEYPLTDKHEPAPPPAPP

SEQ ID NO: 1000054 - protein, 271 aa, Homo sapiens
ISCSSPYKLRAVQDMRPFSNGVIGQPHSPIALISPGSHRCGAELHERNAKGFRPVNGLSSSGPSAFNLQYPGGSEDVGHYGDCATYRGPKANRVLRINLHRKIPQSNSGPGVFASHAKVIELGDISLYIILLIRRHTSSLSFHLVPTYMRQCSVYTSFGYKNKVPAGGWFVTMNFGVHAIMYNLLHLLKSCTTVKAPQDAAHAHHQSLQILQMFVGANVSDPHCTSGGRITDATPRWNTYSGSFILYMTYFILFDHFFCQTYIRPQGQSKT

SEQ ID NO: 1000055 - protein, 142 aa, Homo sapiens
SGAACLSRTAGYVIVSSVSWAVTNEVDRGAGQMPSTEEAYAQTLHRGFRADIWQTKLFSEHHAHKEEQHHEDPEAGAAHGPGRTHRTTQEMNSVHGDEAQATDGQDADTHEGTIRTCRSLCPHDTAIPHEPQLPKTVNAEWI

SEQ ID NO: 1000056 - protein, 68 aa, Homo sapiens
SLPLIPDDEGRARSVRFSCDTVRDEKALMNSKRTPFCLEVPTIMTCYLIAAYGCAHMCILDVLRLPSR

SEQ ID NO: 1000057 - protein, 106 aa, Homo sapiens
MRGRSGLSLAVGGGISVWERVGGGRHSGHEPAGTHELSPDLGTCKLDMPGYKGQSRKIGHLGQVLPEPKDKGLFYVQDSDVEPSLGIFSWAAIWITWGPHNGPFPN

SEQ ID NO: 1000058 - protein, 74 aa, Homo sapiens
KKLCELQPEEKCCVVGTVFKGSCPLQSSILREVMRGAATWSPSSRSDVYTIHPDETELVLEDEVQRIITKMAAD

SEQ ID NO: 1000059 - protein, 128 aa, Homo sapiens
MADQLTEEPDAEFQEAFSLFDKDGSMATIDQQGSGDSDEITGTEPPLKQDAARTHDQSRWLNDGNGTIDFHGSTCPMIGQKDEGTQTDEEEIKRGRYQGSFEKGDGKWIKEETKEKGSSNDETEGEDE

SEQ ID NO: 1000060 - protein, 188 aa, Homo sapiens
SGGGPYYTMTVDDTVEKADNTREETRRQEGLMLGGKVKKGKLDKLTMLQEGEEPYGSRISLSVVQRNLTGIPQSLPVYTSKGTVQEEVLRPLKSNIENDKRTEKVLATVTKAVGGDKNGGTRVVKHSQNCLDIILLKMCLEKTVETTGKKALQVRHVSKLLKTQTLPPGTHTDQSITGRHRGNEGGKT

SEQ ID NO: 1000061 - protein, 42 aa, Homo sapiens
MPQPAERRNHTTGNSPSAPAAEKQKRAATTEAGTNGQREEAG

SEQ ID NO: 1000062 - protein, 63 aa, Homo sapiens
MLITQARFFLPHSHRDTSTRPLDGDRSDPNGTLGRGWIKKMWPRGTRERTIQDKNCSPNGLSD

SEQ ID NO: 1000063 - protein, 387 aa, Homo sapiens
MSLHTEHLLICSTNCVQARTCTNRTRVSDETSTYDSIAQTLAAPMVDNVEAWLTAQRPSWVQEATRVCTSNSAKIQEALSEVPAQHNLGSEFNKTPTTWAQSRLGRYDNDNQDTVSTTEMLVLPNSSQSFYYQHYSVYRSKAFAPSALLSGATLGPYWGYRNNVLPPRILCHHIYVFDLMALPIGIYGRVIEHVDFIRNRVHRIRGDPLILGNVAGEAIYWSMVGSTWVYDDGELTVGEEALNLISYGYTLRVVTEYRSPYIESLDAEHTSFTEFYTKHPVVERGPTLAEHSRSCQIVPHVHLHHDGPSRNITYEHSGHGSRRDMGNRAANPRASRAQHRTQRYSRHNAEDPRIPTHNEPTPPTHTRNTRRQTQPTQQSADKRNSTQ

SEQ ID NO: 1000064 - protein, 331 aa, Homo sapiens
MSMQDMQDNTYMMATLDVKLRPSCHNSFRTHMDSMEAHERHDELPLVSTLAYPLRMHNTHTHNTPTDDTNEHQEKNKTQTRTERNTRPYTTRQTMKETQNTTKSKEQATTQNNKATTTQHNHKTLTTQTKKKGNPTTKQTHTQKTTKRKRNTRSKELTDETMRTQRTEARNKNQQQQEDIETRRTQQQHTTHKENTNNDANRDKSITSKIEPQFTSHSPRTPIAERTITNQHKTHNIVNKNKLNKHRNRTATKRHTQRHKKKRGKKHKNKEHPTPRSQQTPKTKDNHRAHHHTHQTTGAQEHHNPKQLSKAKNKTGHTETRRKTKQQPQNK

SEQ ID NO: 1000065 - protein, 153 aa, Homo sapiens
MCIIRPKSIQFHINTMNDKIKKEDIDEIPHMPCFLRFESLWLDIVALNDHCTTEVVHVPLIIIERNSGLIHTMPLRPRYNGFPFYGETNATTVMQATDLGISYHKQCVATLSLPTPTATQTQHNTANTCGTRTGNKARNKKTPGQVETRTFHA

SEQ ID NO: 1000066 - protein, 233 aa, Homo sapiens
MLRMDQFMYPFIYSSKHFQSASHGPCSDLPSRNTGMNDRSIPPEQMGLMSIEVQDALPHISEKYFVPKSQKKTKNSTRGIQSHQKIALMILTQLRYHHHLPRIRMGRKAREANVRMAGTCKLQPGSRNDTAYIYVDAFRQGQTERWRHTDERPREGTWNRTKRTMSMCEEVRDNGEPTNKRRDIKRKRTGKRARTKKKGAIKSPRIKSGKGTQDNKRKREEPINGQNKEKKKQ

SEQ ID NO: 1000067 - protein, 98 aa, Homo sapiens
DDAMLGFVGRVVACSGLRGRAETHPFRVSCPQLSSYCGPLQTAGPSCQGVCGANISFAQKQAPCTGRHRGRSLAAVVVASSFDEGLSPILRVPWNVQG

SEQ ID NO: 1000068 - protein, 267 aa, Homo sapiens
SGVLCVDRGGGAEAAGRLSPARALCEHWWCWWLCLLALWLTLLGALVLWVPPALSALLLELWSCLVRLWALLLCGPGPYGWLYGAVLLSCSCAGMRRALSWPCACCVLSALSLRPEARYGAFCKGAHAAQLLTFFDLAWRLRMNFPYFYIVGSVMLNVLLQVRIEWAPACGERLKALAEAGCQCPLPEPGLGRRHEGSWASGEGGGGWGGSDPWTQTYADRAQTCAALSPAADISPGAHGIAQKRTEWAHAIGAPETTMGSDEPGAS

SEQ ID NO: 1000069 - protein, 71 aa, Homo sapiens
SARYNITYQQPALASQSAEIAASARPPPRLGSEEQYLTERRIVWRCEEPLCLDGQSGEVRSLYSVQSFDPI

SEQ ID NO: 1000070 - protein, 353 aa, Homo sapiens
MNVVYSIHTCGYPTNADLILLTVDGLMAYQSDITRHKLDSGRHDPNYIPLVATNMLLVPELLIRYHTYTNTRAHHTHPTHCVHTSAKAPHSELRIRAAPRSRAPPRYLLLDPTPHLAHFRALTRKSSTVGGNARRDDAPSPTCNFMPRAYAGSKHTGHTLPMSPATSRQLYARLRPHIRPHTAIRHWTTHTLHGPHRDTFTITWSVVTHQLGGFTTTIWRYPRIRRTTTANPTICQRDASRLIAPLQRDQRHPPLASAIIHRPPPPERRTACLHHSTVFNGIQSTPNTPHKQTQHTFANIAGYWSLTFKSASLSVTHLNTRYSSDTIHARNHSYYNQSYPPFTVLTPCTTNTV

SEQ ID NO: 1000071 - protein, 96 aa, Homo sapiens
NREHTPDSEPAQADVLVSAALSQYVPRCLLSSLLVFLLTSSFFHVTFQDTVISSPQIISFILCVCILFNQYEIDKESSLPLWDRQNFLNLVRNHVF

SEQ ID NO: 1000072 - protein, 234 aa, Homo sapiens
MVVDHKTLNSFDRQANREYRVPTPISTEVPLLSLSEVTLISGASYHSIVIERGGASPRSLAVYSQCLLLLNASSQHGVNHIYLEPAPCAASLCYLLIVMSHLFSSGGLSSPDGMVVKHTLWCYNSTMLLTTNPYLMTYSALRIHCEAPKPCCMTACFPQPAAERCTLCSDHHHISAHPITHDYAAEPPPTPCFIPSPLINPSHRRVLMFSGGDVSAGRFLLSAVADEFLTLCLF

SEQ ID NO: 1000073 - protein, 172 aa, Homo sapiens
SGLPKWQPPVAHKCYLVYRGDAEESKRSSAYDYRTYAVRRKRDGFSSKMKYEKDTCYKFERLVDKAKRELGVIRRAGPHWPTVFNLIKLDHGRIRDDCLERSRQSPWEPAHRVAARTYFSIHSRDLSWGLPKTQVTSRPILRWLIRGGEREYKARCSIVHVCVQGVSERRNC

SEQ ID NO: 1000074 - protein, 97 aa, Homo sapiens
MRWDRPGSRVHARPSGGGLIIDMGQADAAHSSRTLGAAAVATLPLCRHRFTRNNRLCWEPPQPPTRPPDNENQETPFGSDRDRCIQDIAPSKDSAMR

SEQ ID NO: 1000075 - protein, 395 aa, Homo sapiens
MALGWLTPCAWCQPRAVARRVLHAGSSQAASGPWRRRFEATGQPCDALREQAAVLPPTLSRTPEVQWPGAHPGAAHTRSCRPGHGDASAVPCEAALALYTMLSEAGACGLWVEREGRTWLNGAGPAWKRPVGTLEGRAMQRFEDPWSLNIEHPLLVTKFTACELTLPSMFTEQANPPRLKTAIVNTQEQLTTGGSQFSAVMADGKKAALTSALSIPELPLIVHVDPGLIEQQTTKVIEFTRSRQDLAAVLALQRQSLAGTEPDLEASADPGWAKLTSKTAKCALLRAQSPVSQWPSRPGYTGSDRAGSTSGPRNSRRRTTETAGPHAAACLANNLFPPLRETTTGRRHSGRYRTSSPSSYKPRDHLAREKASLPQEVTQQSARRAREPLSRQTNR

SEQ ID NO: 1000076 - protein, 297 aa, Homo sapiens
AGLSLIYGSAENRFSSRSISTGGGGCSSSHKSETLLRSNRKQTGFLTEQQTTPWQESFENVAVCLPFRCPRCGDIPDLRTLVILEGPSGASVTATKTEPSGHNCRLFPLPHKTLDLVTFHQQLLTHGHDTMPAARRHRRVHSRTHPRVHVKPRRYEVINTEHFPTAHGKPTYDSARNTTRTSMIPTCCTQPYTPAHTATPHTCTHPRTGHCGNHATRSIPQVLNKRSHHHTAKQHKITPPPITPGTLDTRHNKPTTSLPKSHNGIPTRSLRTNHAHPDETAHNTSHPQTHTENVPQN

SEQ ID NO: 1000077 - protein, 393 aa, Homo sapiens
MATTATCTRFTDDYQLFEELGKCVKKTSTQRLQQPEIINTKKLSARASPANYERCGSDYVDLLHNIQHTRCRPPLHQLTDSCKQRASHVSHRWLPEPLLNPGPRAQALPPRTRQPLRLRHPTQRNANLTSLQTPTKMAPTPQPCASLTRIATHRSTHGASKGWSHNAPTEVSQTPKGPTHASPRVPGHPPATTPGPPPPRTHRTPPPHAPQPPSGPRRPSGPPPPNGLSPPSCTPTTHAALAPPRPPRRIPTIHPPTRGPHYAPDTLPPGAPSPIHRAARTFPAEAQRLTNTRRAHTETAPTRPHAGPVEGRPPPHREPPPPDEGPPARPPQPPPPPHRRRPTNTPTRAHPTTPPCQTAAHTPTANHTPDNTTPQRPPPTQKPLRPHTRITPT

SEQ ID NO: 1000078 - protein, 445 aa, Homo sapiens
MSPEHDNRISRDWIVRTTPMYHSYGVTIDLRPSAPFPTYWHTSLAPPSGQLAHHRPLRGHTSTNHSGRRHRRLYILLGTLLPRRPSANFIISAPHRNIALLHATSSSVTTLIASLSRRRPSPQTPLQPTPSRARTLLAQPRRAFNTAVSANTNAQTRRADHLPRRTPPRHHTARHTADTLSSPPTDNHPTHRERDIGNHRAHPHSDHPAKATPPAAAFPPPSRPNPGGAHIARRKPTTRTHTRAAPIEPRTLAHLPRRPQPRPRETPTLDTISPLNERLARHTETPPTQAAAHQRRHAAPRTTTPPHNSLPRRPRRTPAPPCGRTLTRGQHSHTRQPPTPAQHKRNTTENNKTKYVGSPPEPTPDRHHPRRPPTPHPHEFQTTPQRLATPQPPIQTATRTKREQPHDRPTEHKQATRATEPPRAVPTPTERNLRSRHPARSAPRI

SEQ ID NO: 1000079 - protein, 146 aa, Homo sapiens
MSISGERPGRLYSERWSRPQIGVFPRGMLTPGSCGGCMVVVLSTSPYRLDILGHIYVQGQSLGYTDLLIKETEVGKPGDSGTGYGGLRYRAPRTGSQQGHTKGNSGHEKEQVDEKTDSVRDTNLETQSRDMRGKQRPQYRCRGGTE

SEQ ID NO: 1000080 - protein, 167 aa, Homo sapiens
MSAPCCPGRGLRDRELRSLGAVTIEVLTSELDAASTEEAMPALLRIRAIWRSFPASAHKEDAHLRPRAGAARARQPPAPPGMFSYRREGGQTASGPRALDCALATARSLAHASVWGCLATVSTHQEDPRTAIWELPPVSDGPSSIALGFLSSTGHARSPVVADSDDE

SEQ ID NO: 1000081 - protein, 221 aa, Homo sapiens
SGARPHTRRSKLGAGGVPASSLPEAGPAPPRPRVAPEAPHQRRIDPGLHRGAAHSSAGRQDMTQHRADTAQILPQDCYPPQGHGDQGAQTSTYGPEATGNRLSGVEIYMTSRPPKAEWDDDQSIEQAVRKYQIINTRTQRELAATLEIATNTEYKGPHWGVIVEKPHSKRERQRRTRQTVCETTIMQENCKPQMLTLGVCVADLSEGCDEWMNDAKGQKEG

SEQ ID NO: 1000082 - protein, 101 aa, Homo sapiens
AELISRHEEESNILKAELNKVTSLHNQAFEIEKNLKEQIIELQSKLDSELSALDRQKDEKITQQEEKYEAIIQNLENRQTKMVSSQEQDQTNQLHSDTLNL

SEQ ID NO: 1000083 - protein, 140 aa, Homo sapiens
SGVDVGFGERIRMQAWALMRLGGATASRRARAGRYPGVAAQGRTIYGTDESRPVMGSVLCQATCHSFRRHYDPVCHVAADDPQDQLDSAFLRTFATLSLSSSSLYLRRGTPLGSPRRLGVERQLPLEPRKLVVGFRRGAV

SEQ ID NO: 1000084 - protein, 205 aa, Homo sapiens
ADRCLLGEVSPVAAATDGVSEAAAEENGGQRAGMQGAKTAAWDGSTVWVGRGGRRRTLCQLLLVVGAPGALIGQASPGTPDDGHEREYRRPAERRCSESPRDCCAGPVWASAEDLSILTGTLWRAADLRPAPNGVAFHLQTPLGGVGSTGPYGTLAVELPRVLVPVLRVVCVRGPSITLRRGVPAYSCTIPGAVAGALFILHARF

SEQ ID NO: 1000085 - protein, 131 aa, Homo sapiens
ERSHFMRTGVAVTVGPVRSLSQDDLRKPIPKTNRWRTRRVETYAFQAKNMPSWMSLFSSSTFYSNKEILLRELMSNSSDAVDKIRSDSLTDPSNLDVWERAALLILIPNKQDRTLTIVDTGIGMTKAALDQ

SEQ ID NO: 1000086 - protein, 72 aa, Homo sapiens
RIDPVSPQNRGRRVMMCEVARLSPGHARAVAGSGSSGSSFGCCISGCRCIRGFLRKLRADDERMTELTSSHD

SEQ ID NO: 1000087 - protein, 66 aa, Homo sapiens
RGATPYNSRTVMNGALVKPTHIIVETMMWALSGRRGRRLSCCLLTLDSHRTRFTELYICTRIFFFW

SEQ ID NO: 1000088 - protein, 99 aa, Homo sapiens
MGRNKQSQGCEQLKKTLGISRAKLVFQAADPQNGGGLADDSQSRKKFLEMSLERVRRVGVHPWSGNTANWGIIDLHGTLNGLWITKRENQIVKFKTLMK

SEQ ID NO: 1000089 - protein, 137 aa, Homo sapiens
MWNGLSAGLIPACRASSVTSLGLNGDFLWVAIDRHDLVRLYDFIRMRVSLPNGDKENAANQAPVSLNESSTLKKALNFFLTKLTSISWSFGVLQGEFPGAQRQQTRAPAGISAQRSCPIDDSTDKGLETNKLHCPRG

SEQ ID NO: 1000090 - protein, 113 aa, Homo sapiens
RPQVLMMRLGLMPHIPTLCESYFSSEIYYSLSADGYKKLVTGHTTADAMFHNMLRSYARSVERPRAYSGIPRFAEKCKLLVPQEQIATPEGTQVDEVGRRSVLVRRRQFVNIA

SEQ ID NO: 1000091 - protein, 177 aa, Homo sapiens
MGTGVYSYITCILSHSLCSRIDKMHCGDFEELPESRGSRVYVIGIVHRIIQLLYVTMVEYTPNVATPNVIVDATRYIQIGLWVNRGYLRYTGIGDKVIASESLPYQDIIRDAEESMRTMDTLHQYVLLWNARCSEYSTMYGVHSMYYISVFETSIDKSYCYDLPWTSYDSREPSWVS

SEQ ID NO: 1000092 - protein, 148 aa, Homo sapiens
SGEAGRGGLGCARRRARGDLGPGGLGDRRSDAVVRPGRVLGGCVVLCCVQCALPRTPDSQGLGQRGCHGLLWGASALRKPRLWQVHTMTPGRGDEASPLTVKTAAMECGWTAWPTRAKGTLTGTRGWSPGIIHGILTTMENRKPVAPD

SEQ ID NO: 1000093 - protein, 240 aa, Homo sapiens
RATPSGAAGEGGSLGAGAESAGGGGGRAAGGRQEAAGALVLLLEKGLRGVRLRLALSPARDWGARAMWRCVVLIVLAVSAWVLETCGRDVPLMKTGHVECACCGPVTWAAECWPAVLAVLAPCTTMSLLMCCSPVSRSWRSKLTILNDRGLSCMLTRLYNINEAMDKFAKHVADPKAKPSYLIDKNLESAVKFIVRKFPAVETRNQQSTACTTTRPQPSETLNNLALYYFTLCRCYGIKD

SEQ ID NO: 1000094 - protein, 50 aa, Homo sapiens
RVACVAPGAADGPERPAPPAPPRAAPNTTERSGENPRANRRDETRQSSTN

SEQ ID NO: 1000095 - protein, 69 aa, Homo sapiens
SGFLYRAAAHGSSRSALELRALLGPRERWGAADAGCWGGGWGGDGRTRASCDAVHISGRGGLADVLFIS

SEQ ID NO: 1000096 - protein, 254 aa, Homo sapiens
MWYSDVWSNLETLVKQAECPRGMLLCGSRDSRELDISCGERTSTLAELNDMPSLPYVNPTIIGSTIAHIDNESGPAHEMGERKPQRERREKRKAPQESYSDPTQDKIDGSPRTPRRAPPRYIITNRKGGELRAPLDTQRLGCDEANSIKTRNRPKLTAYDRQGDGTQRSKKAYSDKVTRENGSAIAAPKRAGRPISGRRHDPPIDEHTPHSRKTTTNLAHPLGATENEEGGSAPRTGRQPTPTAWHIKGESTST

SEQ ID NO: 1000097 - protein, 233 aa, Homo sapiens
REKCPDGSPGHTRSAGASGIGMAVSHRVGGRLGSNIRNKCRQGPGSDSVSGNSPFEEDGPGEGRLVCGRHVVSYPTRPTGKRNWLALWLDGTLGYQLRMRQRRTEEDRDASSIFKCPVTLNDPDQSAHDCARHPEGQEPRVAVLTVNLREGGRLQHSCDWRAKDDAPSVDRQALPEAKVHTLGQRHTSAVPTTTYESGRPTYCTSKGDVWSARYYRTDHTQALAMTARDSAGQ

SEQ ID NO: 1000098 - protein, 183 aa, Homo sapiens
MTARIGPEKQPEKTKSHHGKYTPRKTKEMEHAYAEWRGQNTPYRGRRVKATRPARANRAADQATTEHEPLHTTDRAKTQQGTTHSDRGSGWSMHELHSWCTISHSRPQTLEQLKFQNGEQTFKCKTLDKYARPILPADGNSLSMRVGKHSSLNSTHVHPIHVVQIIGSSIARGESLPTYISLT

SEQ ID NO: 1000099 - protein, 167 aa, Homo sapiens
MHWVIPVTNRPRSDADVMGRRVSQMEPEVCRSSWNGDYFAGELYLDESKQLYKEAEASSGTTVLSILAQPALGKPVRDVAAKAKAVGIQGNLSGDLLQSGGLLVVSKGGDKVLLHFVQKSPGDYVPKEHILEVLGISAEVCASGRLRCDQRGVQGRRRRWAPTDLGG

SEQ ID NO: 1000100 - protein, 169 aa, Homo sapiens
MAVDACHDRELLGLDDRRRTGPAGEWRTGKPEGACVSLDETRMKHCYSRLRELVPGVPRRHSCLCSGGNPDMVCHQTINSLILTRYVLCLGHVPGPPGCVPNFPIQGMPRSRDRAEQPWLRMLLGPSELPIASRNSSPLLRSNQTAGARSGTCRSPTTKGAFATDSAVS

SEQ ID NO: 1000101 - protein, 315 aa, Homo sapiens
SGATSSACAAWISVAARSGRPGLPWRVAPAAPAAAQRRPGNCPAAPGADASKTSHRRQPRDVVSLPARSLAAPEFSSTSVLIYPRWPFQLTQGRRQGLAAARSLSQAECASSRICDWKPLIERPVINQEERDHNVKTWGFQKRLEANGCIAGQARIGDLPNRRGTKECFGVAFGAPGGSGPGLVQDLGHWVLYAMDTMAFPRYSGLRRGVDIHRAAEGHPGQGQVAKREPVAPRYLGPQEGEHQEAGEATGTGTRRRGAPGKGPPTATGQGERGTPKQIAGGARDQDEDTQPEGTTPYTPACEGPEGTVTTSKAQ

SEQ ID NO: 1000102 - protein, 152 aa, Homo sapiens
RAVWTRVDRALCDGGGGHRPGCRPVIIVAVCRGVEQPGDGWTKLRQRIVKRLCVARRMAERDAPSQEGKEALEQCRRPKVRGDRRTSVGTRTLVLTGLTLDGSRDPPRRRSLSIRAEQGSQVAFMVALQPPSRAQSGQAPVGRNGRQDWQSA

SEQ ID NO: 1000103 - protein, 103 aa, Homo sapiens
MIVALHSSLGDSARPCLRINKVCDEDVHTLYANTVFFFFNLNSRGNKSKTRVSKKKKRFNLTINLSMGSIQVCLAGGVGATCAHIVAAYLGRQEGRRTHLEPH

SEQ ID NO: 1000104 - protein, 82 aa, Homo sapiens
AEFAVAEETPPQIAEYIAGFHGSVCLIASLNIQVCLFDELIEKMQQKAQRYPGLAFVKLRNNTSMRTRERFDALLEFRMHCS

SEQ ID NO: 1000105 - protein, 141 aa, Homo sapiens
RIVRSGPGCRRDGPVSGTSNWLGRVRYSPTRPWRVANRYNRITEETSIIGANSPLIKAESPCNRTVQFICATREIVGLVDSEEFDSPITYDQTIRCHVWRSADTGSMSESTGIGHEHITGPFGYLSDCIVLVVCNLSNVEE

SEQ ID NO: 1000106 - protein, 355 aa, Homo sapiens
AETPCGAWDWSVVLSRFLAGRCGRRFLGLTCLLVPVRVGRVLLCLRHALCSLDGEREGLWARCLSRVPPSLDRPEGRCLFDACSHGCGLHLMPAGDLQVCGPERAGDPVDLPCILGVAPCATEMELSEYVGHSSAVPSFDARGERKRETRRLAVPNYKEFSEPCDVYAPMGQFHATAILDANGGSGGRLSMVQCVFRNTSAFSSGVHRGGTNRGVGKQTGFVESTTAERIASRHLMCHDSCEVATCDNYNIPRMPLDADPKAHGTRVALAPYEHNGSRRYGTALMNSQPRRTRKSHRLYDQVNIPVREDETPKEDYPTNGTEQPKGLGNARTPQTRTQSVAHERGYQSSTAGTGN

SEQ ID NO: 1000107 - protein, 180 aa, Homo sapiens
MSSGISPDQCIAFTLCGGMLGVLDRLSFTDLPNAGRNLCPREGLHRFARTGDLHPDEIHEGNDVDNEDTHLRPRLPGGEKGTLRSHSGQRAAKRGPSNMTMSGLDAEHRDIDLTPGCNAYTIWQTSGYQEESGGTWTFTVQWDTEGYAGGVTRRRLRGYQLSKNIAGVDSLESKTKGGEC

SEQ ID NO: 1000108 - protein, 132 aa, Homo sapiens
MRGSRGYGLEGVRGVQGAICSDTLWAGLEKSAEPGPDSNDIFQIPCRAPTNGSIEEEFAVIATSGNRCVTKRFVECHAVWPICDRRRRDIIAMRNPAGIQYVRRLAMHKQEVGYRNHVFARSHNTMLRIDEK

SEQ ID NO: 1000109 - protein, 103 aa, Homo sapiens
MRAPGMRSRPAGPALLLSAALPRSGRVGASGPASAPLHFFTGRAWILGRCRPGSTKPRFGVFIHWGVYIGDRLGQTRWFWMGHGQGEEADASNKDSRRRKKTQ

SEQ ID NO: 1000110 - protein, 162 aa, Homo sapiens
SGVGSSILPGAAFARRRRLRRGLSLLKYLVGQKRWYRGRVGSGRAVLHTWVSLPRAVCSGSFGPVGGCGAAGVACAVRPGILPVMEAARRRPTAGIAADAPFHYEGPERMGKYRTHGGRKREGLQPAMPGAESHISRPQTYRPQHGYQNHLSRDRKLQVPRK

SEQ ID NO: 1000111 - protein, 131 aa, Homo sapiens
AEKPVGRAGLDGLPIRKPRTRAVPRRFDLYPLSSNTAHLTTYLGSRTLVRAATLILLSEERRALIYAYVLVWDVTNELDFWCCRRTDASDVTDWSVLHGNSRVESMSERLTEVTVCMVPSSMIVRRVVRSM

SEQ ID NO: 1000112 - protein, 139 aa, Homo sapiens
EREMEWWCVSNLMVCNLAYSGKLEELKESILADKSLATRTETSDSRTALHWSMLSWILSEIVEYLQQLWSASELITDDAGWSPTSYCGYCWPGMRLYKPFWEQGAQVTAVNHNGCTSRYIMQLRVNRHEIAVMLLDMRG

SEQ ID NO: 1000113 - protein, 37 aa, Homo sapiens
MGRLKAAHTDTPIRSPVTIFTHTPRYNVYDHIDTSAY

SEQ ID NO: 1000114 - protein, 149 aa, Homo sapiens
AAEEQGGDAWWGLTSEPGDWMLVLVLGDLSQSQDRWREQFARLRNSTKTSWSAQRQSISIIVSATRKAPKGVVSDYSQASLGWKMFDSREEEHVSNDVKSRHVIHDTKREVVTSPDSFEKWGPDSEWIESGLVPVGDDNGSCLYAHCST

SEQ ID NO: 1000115 - protein, 306 aa, Homo sapiens
RGTMVMAEGTAVLRRNRPGTKAQYIPHNIRADCSEYRENDGDEGEEPKERRVMWRGRNQSEEEGVKIESIKWKNEWEEDKEGEMEGRKKEKGEGEEWNGGREGQTEGEEEDRQWRAGEQLKRGAEARGRGRAGESGARRRKQHRRGAGTGEGRGKCDRRRATIETEQETKGEHTRRKGPKGEQRERKVREEGEQGRPQRENTGTRHAKRKQHREKQQDETIDRNGEQSRTSQETERERAVVEKRGRRRRQRAVGEKRSRSEGERKDKPEESGATGQKRRGGGEGRGEKQRRGQRRRTGERDEGGNE

SEQ ID NO: 1000116 - protein, 376 aa, Homo sapiens
RLENALLTMRTVATVENSLGLKEARSGKLAAIRCSDEKDSTWKGFIHCTKEHDSKCRKFHSEVFGGLHSSDKESRYPNTRSILNDGSRDILFLASANGQAIVMRMHMKNSLWHGTSSGSLCPLAAGFRNRRFLTCLGGRQDTSGYLETQELMKGYLALHITPVINRWYRNSNDPNDREEAYSFKHTLHVSPANEEMQTFASETAQTESRWEPKVHTVPCYFPYTRLADNRAVNGGADAYMEHGPLNDWVAVDWRVGVTHHVYPTPGKTVDRPPGTNPEQRGHRRHTSTLRALSNSGVPPIGRGPKPQDDLDRPPLGPHNTEERRKNWGHKQYYHVVTNSHRMAPVSKWCWKQRPSVNDTQRGRPQQLGEKSHYDSW

SEQ ID NO: 1000117 - protein, 99 aa, Homo sapiens
ADLSRCVMSSDIWCAVTRVTSSCELQLNGRMKVMVSQAKPCNLEEPCEKVAFQNVPDGRGGILTLRSTVLDTLGKRTVDTYSCACYIHNPSVFKIAPTV

SEQ ID NO: 1000118 - protein, 153 aa, Homo sapiens
MREEWLQCESFLTFLCSWRVPRTDRALCWYRSKPLEDQDIKGTDEIYVTLPFIAQNTGNSMSTVRLRDQTTRLCGRTNGLASNVRLTKLDLLGEPILLVARNITGHRNARGDNSDHGHPIQTAATWCVYRACASYLASDYYDFLCPGNPTQIY

SEQ ID NO: 1000119 - protein, 352 aa, Homo sapiens
SGEPEVVPGLAAVPRLTGGSQDVGRRELAGRDRGAGVYGSTPRDSNPLRSTGSHYPYDLTRFWHCVRRTRRAPRGMDERVIGAREGSGDNGLRTDLRASFSVATCGAGSDGCSSHHRCVIAMNRCSIQCRVDEPDSPHSTCGPMVAWGCARILCSCLELASSYAIVHQCTRGMRKDYGLVPEWLRYSRSACLEPTTLYRADYGVVATEREVLSRIHEWSIEAAFPEQEECTMNDFPGMTTLLERKTFAELRLTDLPCCCCHRRVLGANPRWIVDLEMLLALGSEVVVGVTVGQGTNGYSCVVPWKSPDWGQLIAQQQAEQGVASGIPFVRHYSPVHPSVRRKHTNISVTRFL

SEQ ID NO: 1000120 - protein, 85 aa, Homo sapiens
RESGVQGAEETRLVPRHAPRMATSGDGACVRWMLGAELGPRALLIKDVSAFSPSMYPMVSSDRIIDQPRINHLSFQPEGSCVYHR

SEQ ID NO: 1000121 - protein, 111 aa, Homo sapiens
MDRRGGDVPALENSVRPINAGLLPRTSGFLGDPMDEVLTMTLGGVSKKPELGDEARVRGVPAVALGTLTRAGGSTKCMGTPTQIQYDLMLTLSNEEASKGWGTIQGLSSKS

SEQ ID NO: 1000122 - protein, 220 aa, Homo sapiens
AVLPSVSRGRLMEAPGGRRRGGLQCGGPEGQSAPEARLHFRVARFESWRQGVNAWDAGPFPLPLLAPFTIEFFCETKLDAYDPYLIAMSSIYLVGKVERAGTMRIVRDIDRMCTNQYFNAREVSPWNWTPAFWELRDSIVQCERSHAESSGFQVSFQYCTASSLLPVPGVPPEAGLNRQQLADGPPCCRHRLGPAAGQFTMGRCASDFQAQYIAVDGSST

SEQ ID NO: 1000123 - protein, 271 aa, Homo sapiens
MSTRFGIPRCLPRETNQLACPATSVPNDLEGDLTGRQLCLKDIHNHLLSKLKHVQQEWLFYPCRITSHALDDTEKYYSEISNGRSLETVESSNAILVDADMVGKANLRFIDDCLISPQEKDPSVGCIVGGVFRDYDRDASLRNRVQFFHNIVDSRGIASRDHRTRQFGRLEGNLRDPVEDRQSFNKIRSCLRLLLPRLVRHQYLIRTRDPLLKEYTSENLRISDPGGYHFRTKFPGSLAHTKARAKNFRKGFARLPSLIPRKVVSCKGRKP

SEQ ID NO: 1000124 - protein, 189 aa, Homo sapiens
MVGLESTGGHAEYPGACGHVSLRRLSTDLAHLQGPGEMALSCAKLFHGLDGAWRGYCFHGSCCARVRVSPPMAEWAWLLYLASHGSRCALGWSPGTRMHPDEVQLVLNHSHAREHAPKKTWKPLESNNVALRVGIAHAKDLRRARKVGLRAGRAHLGPERSQGRLGGGPRVSRIRKANVPLISIDRFFP

SEQ ID NO: 1000125 - protein, 70 aa, Homo sapiens
SGVERALLWTTRHTTAHAPDGSCTVVAHAVRTRLVLAEPGSIARNAVILERLGGDAVWVLGERQLMTLIR

SEQ ID NO: 1000126 - protein, 158 aa, Homo sapiens
MGTEYDPVRGTTQGKMQFLLLTLGEQIFKPARQSLTIAKLPPRAGAVYIYVQQLNQDPHFSNLISQKGFFQLAQPSKIRYRIYETPGHTAFSESGTSPLKSSAPGKGAAKRHREFTNPGNVQHHLTQPVQRNPHAKESPLQHYGTIGILRTTTGHQKS

SEQ ID NO: 1000127 - protein, 84 aa, Homo sapiens
GHGHAIGLDLQAEKYENEVALRQAVEADINGLRRVLDELTLTKADLEMQIDEPDEELATLKKNSRGGNDQTFEMCPLVTVNVPK

SEQ ID NO: 1000128 - protein, 282 aa, Homo sapiens
ENVERWQGPVRGPAGQDLGQAVLDSMATQCPCLEKTLPQLLAKSDASCENLWWCTTASLALYRSIGRVRELIAQARGGCQYRSRVPMKFNWALRGAACSTPNVESCRPCLPTLPSSSTMQGALEPEPGAGLPEGSHLVMYHGARRHVPTGGTTWACVVLPLTHEGVHRWGAIDTWRLDVLSALCHVPVTIPIDATLWGRHVRPASYSTLDLGTSSRFLANHCPAQQMGRTTSIESKDTPKGVDQREGPPWGQIGGLASKPLTVTRNRTISSTRFLTGSRGQR

SEQ ID NO: 1000129 - protein, 102 aa, Homo sapiens
RSGAQEETEEGGPERARAWRPTCRSGRSLAGLSASKSSPWATPKWGKAVLYKRYCETQDSCLNTWQQLELTMESQRYTSETEKSKLTSLIWLDIPSIYEVTK

SEQ ID NO: 1000130 - protein, 69 aa, Homo sapiens
RTGSEEPRGMEQFPHLSFWQDLGNLVPDGCDYDLPFKDLEIVPAAYRGVGDDQLGEESEVKEMTIYYHM

SEQ ID NO: 1000131 - protein, 352 aa, Homo sapiens
RTSAAMSPSVGWKQTRTPSGSPPMRLRFPDMAQVYYMYHITMVTPKGMLSLADQRLLRTIFTLQHTNAHSMDSHSMADSSAHNGRADHSLGLSCNPRTDNMTQIQPSGTRSTGAHLPAHSLDPGPRGTKMPHWRHTSPPPTQESSMKANPEILESQSTPYNFTLNNQPMTTPTYATHPMDTQQGLRTLPSRPSNADKPLRPTTPHQPPPQLTRMATQKPPPPKTKQTSQTHTEAHPINPTADATPTGRQNEKHTIHRTIPPMAETTPHTGTQHYPPKPPHTAPPPPRPNPRATTPTPTHHHGNNIVIPLLPHNLTRTSNVHPPLHTFLYISHITSTTPQSTSSGTTTTQHID

SEQ ID NO: 1000132 - protein, 71 aa, Homo sapiens
RSEGSGAKSRTMPPASTTTDRDTPLDPTGPTAVGTWLRRQGYRTPSGSGRWLTGLQVSSNLRGRRRIIGPA

SEQ ID NO: 1000133 - protein, 48 aa, Homo sapiens
SGLRDKAPGDEEVAWTAGAHTHTHTQPVSQSLAPNLHSVNPIPPAPRA

SEQ ID NO: 1000134 - protein, 162 aa, Homo sapiens
LSGVQCEGALVARERPRGPRAADGWRPRPEAWRGSLDGGRLRHATHDGQVHTRRRQARRHGFFSPAMKAENKPHGETGRNKKTTKPKSKERTKREKKGESPLTKSKRVTRSQATCRHSERAAAKRTNTPKHCGRRKANPQRRPAEPQHGTTAKTPPRRDSSP

SEQ ID NO: 1000135 - protein, 144 aa, Homo sapiens
SGGAPGRRSRGGGRREAGGVGPLKRLPPAPAPAGPTCRPRLATPTYPAKVRGHAGSEQSKPMRAARPAAVLTRRSSWPPRRSRGSMRFKNRFQRFMNHRAPANGRYKPTCYEHAANCYTHAFLIVPASWAVPSSIGCLMTAGKR

SEQ ID NO: 1000136 - protein, 353 aa, Homo sapiens
ERSGFMRSRCWLCRWSCGGHLAKMPEETQTQDQPMEEEEVETYAFQAEIAQLSVIDHQDTFYSNKEILLRELISNSSDALDKIRYEHGLTDPSTLDSGKELHYYTLYRTNKIELSLLWILELDTEHRLTMINNLGTIAKSGTKAFTGSFAGLAAAYSLMIGQFGCSVPHSAYYGLLTTSNCDHQTYTHDEQYRSGHSQPGGSFPAARTDNRVKPMASLEPTGLSYHLQTNHPTDYLAQCNRMNLNGAICCTSTTYLHLYSATIPPFLPPHSTTNATRLHFTAQVTQRLHFTGPNATREQPPPTSELTAHYACRNELPSSTSTRPPRHPCSPTSPTPPHQHPPNTHPNNTPTPH

SEQ ID NO: 1000137 - protein, 274 aa, Homo sapiens
RGGLARSLLGRQRSAVQRTEGPTGSCALPLSQESPEARRPASRSGHEEADGGAESDCCSPEARWSMTERWCMCRTHEDKDYLSTYQSCPVYSLVGQIASCGWRSISAIAPVGSVTADYHVHNTTLKSYRSHSMVARITHSGTMGRSSPRSHRDRDSARRHGESDTRELYDEPEQGNVTRTINCGDSDALVTDVKRKLLLKVYPRTLFALGGRRNWLQTEHALRTGHIPWAGGKGPGSMVKFPVYINSKCGIEFQTGCAREEVCRLHTLGRRTDD

SEQ ID NO: 1000138 - protein, 86 aa, Homo sapiens
RVLHHHCDGIRFRDCHCAPSACPGPTQDPQAGLCTGQEGYPGTDHGLFMGPHLLFQVQVKRTNLKVEVTELQDVECEEWPRGSSSN

SEQ ID NO: 1000139 - protein, 241 aa, Homo sapiens
MVASRRAALWHAILTDRTLPDVSVAASGPARTADPGPWKSQCGMFCTSGVTGALTDESNDTIRMFGTDRNECCWTRSGRVIRAADIVLRQSRLWALWALETVWLRVGLVAILLPGVWATFEGNFGSTAETVYGWKAHSGGLAGGSLHILPRGKKASESLTPGLRPSERPLGLAISLAQAPPGLALTGQKRICTQRPRNREKQNCGSIKWLNSGYISQFHFRRERDLVHRELPIATFRIPKA

SEQ ID NO: 1000140 - protein, 111 aa, Homo sapiens
RVRSGTHSSRRPPRARSRGRSSSRLLRSSQRLSCSLCGSVHLRHLGLQYRVAHKPFRFVPLVYSSLLRPEPDTRRRWWTVETHWCTQARAWSSSRRTRLRTIIGPQANEQT

SEQ ID NO: 1000141 - protein, 118 aa, Homo sapiens
RIAAVAPVGAPLSRVSPPMELWAPPTPPLPRTLSGAAPARRNRAAHVQRSCRRSQEHLCPRLAWQQCSCGNRDNVRVILCAGVPWSRAAVRAPPGLSTDTRGKQARGTNPAQNPTMPP

SEQ ID NO: 1000142 - protein, 59 aa, Homo sapiens
MVAPCVGKQGRFYVTQTCIGHERTRVYERRRIFSTNRTTAWRRVPGELRRCRKLKEQHW

SEQ ID NO: 1000143 - protein, 254 aa, Homo sapiens
MNKCRAHESQELGTSASYEVWQSRAPRKSDGGIGLEVLLATDGHEEAAPVCVPRGWTELGIRCCSVSGRVANMVGMDGLDEDEKSAVLSVGHREKQTDTFASHTYFAFARKKLSHKTYSKDIFYLDCWNYANAASLRVIVQSSCRTLHLVFILIHLYLGAPSHDVVAVKAVLSERTPTRGRQDPRGHGIMYAHEHNKQSNAKVVLRQKGALEGLGKPGVTTGGEPDENGVTGELIPREKAPISSLQNDVPNMPV

SEQ ID NO: 1000144 - protein, 339 aa, Homo sapiens
AEVRAPVRQREETPSQCSQTPSVEEAWRSSIQDCDRYSNNRLRVRRLSSANARLILSVLVGGRMVLIGKINVHPVDIRTTDNTRIIPYRAIHWYPDMVFEQLNGESNRFIDSVSRRYPIVPTSGHVSFSTTVATWANERECSRPTEFNGTRAWEVLTAQARDHEIVTVYLKGSVVMMSSRDCGSYRQLRLQFFGKQSALKSAENNTVRGDWRIGTVFRAVQATKLVVFHQQMRRNSSQLLSVWSIIVIWGRNSSNTMFWESLFNWKGKLEPLACSRSPSNVVGMGKNLFLAPLGGKVKSKPNGKMPAVNFKPIPEGKRNRLGVWNQQKGPMGGAHMEYG

SEQ ID NO: 1000145 - protein, 109 aa, Homo sapiens
MLSGTVIPRRAVDCTAHHEVVNLEGTKTEECDHLLIIGFAARRLASRGVASEWLACLSAPGVSGGLKEVVHRQNYCNCVGFCAKSYHEEVFLRNLRLREHRCIEDLPRA

SEQ ID NO: 1000146 - protein, 104 aa, Homo sapiens
MSQSNIISFTYDTSSIRDCECLRHTSFMWPGDRTGRPWVVHQSELRGMVRWNVPGMHRTLDARSIPLYSVKNTWNCDEGKELLIRPPFITGYLGEFDGYSSVTT

SEQ ID NO: 1000147 - protein, 199 aa, Homo sapiens
SGYREREHLPSQRPRPPLPFSCRDLERKTAEVKDEILGCTGTNRVLRIPSSEERGCGERYGPDNLGQLGTQHVQRSSAGIRTEKSTNSTNIETATERKSVRREESTLDLTAEVDENARAKETANEERCKTSYKDHMGADLALQPDRRRISNMHTRTQGARANKCGEQKKELRRNTQTLDLKKTTKAVGTTAQGTKPTLE

SEQ ID NO: 1000148 - protein, 174 aa, Homo sapiens
SVVTDPASFWLATYRYGGNKMIARRALAPDSSGQSESQGGHDMHRQLVVMDSHDRNGDATEHAQLLDHCRDFIAPSSPRGIDVRFSQVISVLDRFYTLLSRFWYSNTMMSAGSFALEPRGVSSSKNLGKTQRETDNSLSSSSSGNFDHYDFQAIKNPPLKEPKQFDGKRIPRGE

SEQ ID NO: 1000149 - protein, 138 aa, Homo sapiens
MAWPNVVQRWVSCMSHVQLIIMLYVFAASAFIQCISLHPLLHRRNIEQMSTVTYLLSSGPQVTFNYVSMSPVGDLAAGNHVVPPVQRKRVLFLEHTGIPVYPRSPVCCGPYSSSGSLADQVEVCEWVLVYYGHVRLLR

SEQ ID NO: 1000150 - protein, 72 aa, Homo sapiens
AGTNVLRGSWSVNQLTSFGYTAKTRNQRNVEDKYEEDIMVICLSEYYQILDPLLLLLPYHAHGNWPISLSLS

SEQ ID NO: 1000151 - protein, 131 aa, Homo sapiens
MGFSALVHLSRYDVGFVQSMATVCAIFRSCKEDSLCDIVKMNMYNRYYSPTWCNDAKDDFVVSSFTMDRTLASLSEWAYDWESLRGPLGNLITRKRKIPVQLQLGINETGPYKKLRWKRNFDIIFWNGSFD

SEQ ID NO: 1000152 - protein, 125 aa, Homo sapiens
MPVGVCALSCCPSCIDRFFPSVTTIPRMCPEASSYRRDFSDCVSGIASCDVLFRGNGSAKNRRVAWAVHRISRIISCDFLVAHCWYTNGDGNITVIIPHSHGIELAKNVDKGGYDRTMNPTNVHW

SEQ ID NO: 1000153 - protein, 177 aa, Homo sapiens
SGGENPYASADLQMFVRSVGTVVAFTLAGAGGAQPGLCWAPRLEPGSTQSKTLMAAVFHGNAFMKYSTAFGYIAGGLLAAFSRDHRAWVLGLVWYGSVPSDSEKLQKRPSSAQEYFKKQYETSQESFVDLEITNPSSASITKVSMGVSDSSIPDRTYKAILQKYCINIYSWHQGQFT

SEQ ID NO: 1000154 - protein, 80 aa, Homo sapiens
RGVAWRTGRGRLRAQSCNMCVPSGHPGAELWVLPSCSGMEVTPCDGSCSFPGRTQDPAVCVTLLLYLGQDLGMIDADELR

SEQ ID NO: 1000155 - protein, 108 aa, Homo sapiens
MMNNNAREDRIEIAPYAYHDRHSLVRATREHAGLTTTVYERRLSVEQPKDASRRQYVRGNPGEQIERALELTGQSKWDRYKGATRITRTLLERNQAGLTPRVVEGPKS

SEQ ID NO: 1000156 - protein, 186 aa, Homo sapiens
MPECIVSVFHTTGYPEDLIYHVDHRCSLTPETVNTPCILIQSNTANVFMLESHSWDMGLGIGQTRVAWIPSMCCFTIATRPLVFAAIPRVPISCSSMQKNCDQERRELRVVRSNTARCRFDKERREILDYHDKKPGMRPQNVLPQSSSYIVPTKKSGRNLVQPPGASDSRNKCRQHLFLNSSAGKT

SEQ ID NO: 1000157 - protein, 149 aa, Homo sapiens
MNRHIDTSIMQSALLRARTRASSLTPTASTVGALVGHSRQGIPKRMLYHALEECSDSNATSYDKFRSNDSGSSSQGEHSTVVFHAITELYPCIRCGPDLQQARAPGCDMLLGLANNRSTLLLTGFPYYSIRVQDGRLGIHTVRVQAILS

SEQ ID NO: 1000158 - protein, 190 aa, Homo sapiens
MTALTIATIALDFTGHLAVGLLNQRIRIRISVVESPIGNFSDLDRQPGGKTCLVVACSVSCFMGHLGASLAPNGYCLLHACAEKDAGAPWCMPARIDQSAEEVQYRITTHWLPIREEAIMPLHRYVRMASSFRTCYSFERESELSTPGVAFIKPSSYPMVHLNYAAITSQVVWLAAWGPKVELSGDIVGP

SEQ ID NO: 1000159 - protein, 104 aa, Homo sapiens
MSTIRKEGGRCPDRYRRLLRCLAIRHEKNSKHVTPRQSRQDDKHRARGRHVESPMAKRHVYHKPWAEERDAQQSKGQKLLDRQSPGLQKGLLSNRQHKGAKNGR

SEQ ID NO: 1000160 - protein, 37 aa, Homo sapiens
AEELRDGCSAGGSGDAMYAADELLAGRGWRLRGLSRR

SEQ ID NO: 1000161 - protein, 71 aa, Homo sapiens
MGAYKQGGKHTEDNHGRCTKLGSNKHTGKLRGSNICKTQRAETGPHKSQRVAKEQEQDSDNNTTTHRPTKR

SEQ ID NO: 1000162 - protein, 111 aa, Homo sapiens
MAAAVRAGSRSGTACVLGRCIVFAAEPRALALGLETMPDRDVAAGCDKLLPLHYDRYTSSRSGWIRIAHSVKCVGGDRLGCDSYTTKSHTVSEQEAGMGMMYSGNVETDLR

SEQ ID NO: 1000163 - protein, 200 aa, Homo sapiens
AECLERSPTCCRGGRAETAEPVPSAAHHPLRTQKHPVMDDQGAGSDRPILGEQAERYDDMAACMTSELSKELTFSNEERNLLSVAYHQCVGARRSSWRVVSSIEQKTEGAEKKQQMDREYREKIETELEISAMMYCLSLDKVLDPQLLHTAREQKSSICTLNRRLRTVTWLQVAAGDDQNGIVDQSQQAYQEALEISNKG

SEQ ID NO: 1000164 - protein, 112 aa, Homo sapiens
SGGVRESRRSRSCSCFRCRGGRLGVPGERDPRRVSARGAPGLNARSGSRGPELCPSRWRARCSPVARGAVAGASSGLVARRLASGCYESSDCVVCTSRSLTACSARRGYCAD

SEQ ID NO: 1000165 - protein, 368 aa, Homo sapiens
MRGRSHAIPVWLCRLVLCGHLTKMPEESPDPRSTDGRRRRVETVRLFRRDRLPSLDVDCIIKYLSYSELQSNRFMTERDFKNSTQHAIGPQIRYCISLSMNPEVHNIRAHGDTEKLHYFTHYTRYQHQNRSRTSSTLSGAIPLGTSDHDPTWLDDIESNLHAFGSTKYTKQLLGDPTQGVLNEHMTSMHGLELARIILLIGSRGPAFRAVLGTPLNTLGVLLSWRLGLRTDHTTYSRLGYTFRLPTTHLQRDIATRTAEATPAHLPRKRYPALTRQQREQPTPPLPPPRIAKRATHGHRNQGGSRQAPTKIGAAYQERTDKHTHTTDVQSPPITRPPLAHNRTTETPPHTLGTYYTICATRAHPHHRE

SEQ ID NO: 1000166 - protein, 182 aa, Homo sapiens
RKWRCTQCGKRGERWSFIRALHKGSAAAPARPKETVRSEYLSGIQAYRNPPTWAITWEPLRSWVRLQDEYDSVLYSIVELHLLLRFPSKTPAVLRIELIRSDMTAVLLACGIKPENNIILFQQSQVSELVRQGRVGSLSCYGRDYPRVTTLYISGRQETTKKKHDGTVGLLTYPVLQGSRPF

SEQ ID NO: 1000167 - protein, 343 aa, Homo sapiens
SRGVDAWDRSACRSLGAVAAAAAAALELGDAGGLLRDGSGACWLLLSSGARGCWPLLGPGPCPWPSLVVPEPLVPGTRVLAGENALSIYEPPRARAHRAMKRGREARAESGATDGGTAGRPTEEGAGSPEGCTPQAADRRLHPDGVPRVSLTSRPEAMDARRLGRCRLHTTCRLSPDQGLADDHDSGCMVWTRTDLIVPRRLAIPLEVQTLYRPLVCAEVLIGPQWTSRPTDVHSASLRARAPPSGVPVRTIRLTQGSRSAHMNLTPHVGQTQVPAWTEVCPRPIGTGSLVNAARTDPIPPHCEDHRCQYTERPGNHRRDAYTRAYVLPLSLYPLHRSAHDST

SEQ ID NO: 1000168 - protein, 102 aa, Homo sapiens
MLDSNKDTQLYKYISAITLYVGSHIHMKSSTMINELPELTKVPTVTLLCTVPGLTSYGDNKYSTQTALHNNKCNTGTKHKVHGNYHSQTAQKLQAQQDSTIL

SEQ ID NO: 1000169 - protein, 105 aa, Homo sapiens
SGVGHPSTEFCPREADPSRNASPAVRLLSCQHAHEPTDTMKIRYTNTHIQIEMPLTHLSNEPSKHAPPASHAHHETDSQPSNTTHNTLTNPTTQQDNEHNTQQTT

SEQ ID NO: 1000170 - protein, 110 aa, Homo sapiens
MGHAPLLKTTDFGEEKAADTDLSSPVTPGKREEKHSENIYRQRQAIKQCLQKAKGDEALTKSYPSSNEKHEPLKKAILNKKERTHHRSEEEDEKRMGTTELNQKQGITGR

SEQ ID NO: 1000171 - protein, 179 aa, Homo sapiens
ERSGSLDDGCGAESCGCAQRCPPEEAAGPQASRDEEIGACGDSRSAMDPHWPQELLSDETIMHCCDKRKVKKNGGMEGAGGVISYSMRMLSSCCNDDMTVMTEGHNRLWKISNKQQRAAPPGLEACVSQSGPILRKSRPSVSHSDVLIRDPHEWLKYRGLNKVILSTELFVPDALVLMN

SEQ ID NO: 1000172 - protein, 130 aa, Homo sapiens
ERGGGAGSVVDAVPLLVVRRAAQCGGAGIAHSAPEQQHAACSSIGGTPDRRSPALDARQPISSLLIFLPSDRTMDDQLNEEQIAEVQGSLLPIRLTDGDGTITSKRNLDTVMKVTGSEPTDAALAWILIN

SEQ ID NO: 1000173 - protein, 508 aa, Homo sapiens
MLAEGKVKLRWFYCPFTSIKQARTYTMGILRAFSCLKTDAAQLHLASFSLEHSLSEQTTELDSSFSLYSLFVSLVDLNGLLRLTSWPRNCHFLPGYRQRRTLSSQPRTSPNLANPNHFTLAATVTGLWLFPLTNSWLCHTGPPWRRNLLTFSFLGPSATGPSSIHFKPHTFYASTPPLTKPPRTLAGPTLRNPTCHNFTRGVATPGASPRKRHAINPSSPFYKVLRPHTGISACKPLVLAFNPKQTYANLTHNPNAQLMGVDLPPFGAHSVGEPKLNLCRPTALIKRFTYRSLNLIAPSSTPGGLLGPKPAPNASLHIWPPQLSTTRRTPNTRSQPLTTDNTLGDPARHHFCSHPPRFAISRLSLSRWARELTPAYPLSLHLRHPPTFSRSSAQPLRAYTPRPLHVLDIPAAVLLPAPSVRPPVPFPLFRSGGRPAIAPTAPPHPRGLSYAGALSRPLRGLLPLVARASFSSLSPPSPASGRPPAPRARPPPHSARLLPPASLSALSL

SEQ ID NO: 1000174 - protein, 113 aa, Homo sapiens
RGYDGPSGGDTVWNVRVGLGLGVGDVELHRNAWLSNALQHEFDEKGVDRVTNDAGDRCACVGRFDLVPSLAPVQRGTPTGWHMYANAASNRAIVRVPPTAGRGLGADQCLEET

SEQ ID NO: 1000175 - protein, 46 aa, Homo sapiens
MARHRSTDAPPVIHDVVLFTHRLASPSGPNAHNPVRLPPDNVSPLL

SEQ ID NO: 1000176 - protein, 201 aa, Homo sapiens
AGAERVRSRLVPVAWPCARPSSPARCGARHGGKLSLERLSNAIDQERPGGVIPCGGTRWGDQIGRPPVSGLDRGSSVRLEDLTLRPSLCCGGKTRATVSEALADTECNQHHLWKQSDRIRDTRRYKPTSRRLNGHWPSTGAWQRAREHAVLVAFHENEADSGLTYGIQEEMDSRLGLRTCTDVCPNMCAACTIGNTNRKQR

SEQ ID NO: 1000177 - protein, 157 aa, Homo sapiens
SGVVRTKGKEEKALKCGVSWCVERGGPRAEACALPSILPQWIMPSGGMRRVGCCVSGSDWCCVPGDQEHACLISQNNNYIAFNTKLLFLHTSNHRTVPLVLIITLHQDDTPDQTQRDRICRSAVTLSTPIDHLKRPHTITNITRFKKSSYLKRSEKQ

SEQ ID NO: 1000178 - protein, 336 aa, Homo sapiens
AAGCRLVLQEGAWPDADRFPAVPRVPVVPCCLRAWLLLACPLSAGCAPAAADEPSSADGGWETLSAGRHERPQRRPFRHRLFLASRRCALTLLYPYVSTRPHQRVMGIVWLRKSAALKMADGNEDLRADDIAWASLQRSYESMDACLPRLSAAATDNRTADGRPHVRLGAATRSNSHVTSDHIDFSLCPRGTHLLRSTTLDDMARLEHTLNTCTRDCPSFYCSTDPLARLVARAENRAWPGNLVRHADHPLTQATITKSNLLPLARVHSNGPYHDEKAVQLRVNTTFGFAVKALSAPSHNHNRAHSHEGVLRAFLYPTPPTHRSPTPVTATRTKPY

SEQ ID NO: 1000179 - protein, 323 aa, Homo sapiens
SGVAQPPGQSYSTSSPINIVVSSAGLSPIRVTIGPPTVQVHQSPPSPIHAAERQQSARTPTVVATPSAWSTRPSRYSEAAREELYAHGHTYQRPGSLAAGSRASYTQTSMGTLGPELTGPEQVDQNKHIDPIYEGPSLSEAPYERSHADTEPGGPHCRPDTERGLNGKEQKNPKHYTLTTAARHITPWTEAQEQDRANAPRKTANNTGTTTHKRRTKPPLYTTTGHHQAPPDQTASGQPLDTQEEDTSNTDNIPRHRNTTTRSQKGSNDPDEHSHNEQGHEHEDTHIDTRQRQDKRAPCRNKDYQTQQSTPQHTRTAHATTPT

SEQ ID NO: 1000180 - protein, 151 aa, Homo sapiens
AGWARRSSIGRFHLLSLLSSGARASVAAEAPVGEEDGGVFTGGSSLRTTMCSSQAPECGHRTDGASRLLEAFPSSWRGFWTAEASWTCRCICLENGELVHEFEMDDPNRTENLVSRRYRLQSRSWNTGLSHRFVVHMETDVEISLEWRDDY

SEQ ID NO: 1000181 - protein, 263 aa, Homo sapiens
MFDVALKVWASSSINYHGGKKVPVLYHTSEQANIAFAFALSDVRDAHIDQERMKLSGTWERREKHALAQEGVMKGATHYPRVMSWNTANEQDFKGDINPMEWKAHMRHTNDTGKVIHNTHTRTEGRCQNPRERHTTQVCLVRTSPTEDGVHQRPNPARMEARHETHLTNSKKQTHRTGHRRKDRKGQQDDHTDPNRTIPHKGETTTPKRAADTPGEQSAENGTPRAKRPETGGQGTTRGGPASGQPRNKQRHNNNEQKKAKQR

SEQ ID NO: 1000182 - protein, 276 aa, Homo sapiens
MAFKAGRATVLTELCAERATVRTKYLTPTTRITENSEGAMTETKSAPRRTSRSKGLHVERIFSTEGVHPYDEVTWERRDVVQTNWRTGDVVFEQRGVEFPDFWSVNASTIVTNKYFRGALGTPAREDSLKTLIDRVVNTYVTTGRKNGYFASDDDAKVFGEELTWLLVHQYFSFNSPVWFNVGTTSPQQVSACFILSVDDSMESILNYREEGFIFKVVLVAGLNISRIRSSKELLSSGGYGFWSKSPLCVVLMLSTGTINSARHSSCCKKGRLDNR

SEQ ID NO: 1000183 - protein, 348 aa, Homo sapiens
SGGGEARRHATPGWARTGEASRYLAGRPATREPVCVGGGGGDYARGDAAAGLVQDAEQSAAAAGAASWARGAAVSLRCWARWALGDCRARRLRRRWFRTHTAVAEARWARHGGAHPWRRSHDRSSPLRSRLLSMDSVARTGMLVQDCRTRSAEEGRTTKLDNRRHIANRSDMNGYRYDDVITAPLQYERIIEPSSLSTDIDVGRLIRSLRWVQADNSVTVLSTLQCFTLENPKINITFMRAHMVYTMGVDPPGRAKDGFSKTQRARNRAPCKGSQPGNTADRSVTNTHHPRTAHPTTTHPGTSTNDPGNVHEPTRARTTTRLSAPDHTRKPAHDGHQRPTPHTEHKPQ

SEQ ID NO: 1000184 - protein, 206 aa, Homo sapiens
MLVPGWSSEFRDLRVIQHTLGLPKVPGNYKAVGALGLANLDGNNGDSALFATLQVDGGNTLRTMPHLELGCLPTPLEGPNQKGGTVYRAFTKGFHNNRVTFLLGPTPDTWFHPQVQHVVTPIVPYKHATKHLHRRATFHTLVADEQLAPGEAAHPKRAQNNARSVDMGAPNSQGYQFYTPTSLRIQPPSVCHGERTYRTADSPNIH

SEQ ID NO: 1000185 - protein, 258 aa, Homo sapiens
AGWLACGAWRPTGRWLRGLPPRPGLWVQPWLAAGDRKGRRKGGGRSRHAEEQPTMPLRQHGLLDPTDRHARLASPSGGSGVLAWAASDRDDGFWPGGAEQPGFPEKLSKLKMPPDPDPAEDLNIARARHYCSRCLTKPAARSPTCTSTRRTASDLGVFLLKSGTSIPLQLTPGMHGMLKGCCTAPVRIRMRWNKLEGWARLGNRPRDLDQPEQARTEPDGLQPREREASADGRAGYGRAKSPRQEDHAYLNERDKLTD

SEQ ID NO: 1000186 - protein, 103 aa, Homo sapiens
MAWRSGLRRRMPRAGSYVHSSVQAADSVAGGLGELLEEFSRTQYLGQGWQPGPGWLYTVERIETEKSWSCFGRDYLFQRDSKTQTWGYLVVHYPRQHTVFLEY

SEQ ID NO: 1000187 - protein, 246 aa, Homo sapiens
RTAARRKNRAWLCLSRWGLLASVGSDNGILGLAKSDASRTRVPRSRSLAWQDELEASRPLPGGHVACNQCDQGMLLVDMCTLEGWAPAWCDTIAVSVLSGIGVYSFRWVTALVKTHETLLIYDVHIFNAVSLSLDKAVPRERLPSVWQAPVCTLQCSYGRLNQSSLDRSAVLLWWRADMTSERGLQLLLYAFDVISTHKWFMITECQGTVPGARDGHSGCVLGKIMYIFGGYDAAGGRVEPMTFTS

SEQ ID NO: 1000188 - protein, 206 aa, Homo sapiens
SGGLAASTGSRSAREQAGWRGSGRMKLGPGRAWACCCWRPSPGAAVEPITWDCLAGLPVLYRRLYCSAIAGERSLPGGLEGSGRQLLDSICKENHLKLLVGFIKTKPRNSHALPARVDRHRKNFVSKIMQKYYEGGLNSDYVTCCGHMTFHMLQTSLVQGSVTVVDSRQRECLCEAPSSYLMNMDKMHAGLIDAIKPFLDYYDLVD

SEQ ID NO: 1000189 - protein, 80 aa, Homo sapiens
RVPLLVRSCVLLEKRRSDFRIFGLICFAAGLLEFAGGPLQTLFAWVSPAEAAEHLILGMADVSCLIVSSGSFVSEGHPAV

SEQ ID NO: 1000190 - protein, 202 aa, Homo sapiens
ERVYPLVDSSRAGPAASRRAGVGRRVSGHERGGRCTVAFVGRELLAAYGVVLRGKSGLRLQSAAPCVDVRAKWPQRLAPYANPRLTCQGPDSDRAGPRERTWGGLGGRRLRWEQEAAFAEFSLDQKRSRLSVLRSGGTSPEWAWLSESAVYRRHRSTGRANMPSSSDCKVIVCQSVVQRWQAGGRGFLCWNRMSTEQVCLPD

SEQ ID NO: 1000191 - protein, 433 aa, Homo sapiens
SGPAQSYDRQPAAPAPSRVTQSQRTPRSRKAGRPAAATGPGEPAETSATQHEKKEEEDSGEVIQGDNAATRREKAERRRNTRKKHTEKNARDQERKNDDHERSSRGRQRMIATSRETCSERPSSGVITEEIYKAEKNKQASERTHASREARSREPRERKHGRKKNEQLKRKRPQKLSARKQYQHSHDDRKIRGEKMQRQSETNPHRGTGSEQTGRAKQRETKGGKQETEERAREGDTGQRQLHTNAQQTQTRRETKKEEKDEMRTEQPKKREHENREQKEQQKKRREKNNRVTSNTKETGRHSERGLRTPTRDSTETSKRTKGQTYETESRRQTETCSREKANRQQDEEQQIETPTSGRKEQTRTERTQQRYIRTAHSHRQTRDTRRPLPHESTRAQLAKHSRDTRAQAAEHAKQYRGPRNEETARENHNQPG

SEQ ID NO: 1000192 - protein, 127 aa, Homo sapiens
MGSNSSVAPYHELERNGSNYAFVPLVKYANYALSFHLCRKDYLIALAESHVVVPGRRTRIGTHLVTEDNTQVIDAKCNSHVNARIFDHTGGSWHVDRHVNTSHTCNVRAGHISTGAPIGFLYHGAHL

SEQ ID NO: 1000193 - protein, 135 aa, Homo sapiens
MHVEKSERSTGRMETHSRRKRADESKEQRMTEQGEKQHSIQAGTFMSKGQSASKAIRIHMVKQIERMKLMATPQDPRLDQPTPVKTLHKSIFKSKEPPRITSTITARNRQHDRVHPNNSHTTHASTTAPNHSYAT

SEQ ID NO: 1000194 - protein, 223 aa, Homo sapiens
RVVWSYGGGGQRAVDPDDGHPVNVLLLSGHAQCIRPAEAPAGTGPGTLMVTHALTMEGTSPEACDAGGLDPGAASESASGHLSPEEKALRSETEEDRVVSSDCRRSKRRLELSELEQQVVGFRRRGTQKCIARLIQTFMRENSWACNGESGVETDSLWDGWRWWLKRRRKTRVHCCEGTLDGGSDEFQPAVQDRLWRALAGSVPGRSESNTCQKIYTMDSGGI

SEQ ID NO: 1000195 - protein, 348 aa, Homo sapiens
AGHHRASLGGVSWRMWLGAPCSCGRDECGWRLAGSGCAGGCDGVEPMERRFHGLLLRNLGTSGVPCALSAQHPEAVMAEVPGPLLQDTDQETYTLEDLEQLKSGLQGRHPQRNRVRRSPPGSAWFSFLASPQTSWSNENLSYIEHIFEISRRPDPTHIWWLTTSTRCADTVSEADELETTKLTRNPQVQGSTTDTYPAAPLRQETHSTLGSHQRTKGLEQRRAARRTRRGRAPSKATQPPSPRYTHKSSARDRRGREQGATTRPTPKQHTKKNAGASPYPHAQPGVPEWRLVAVETPQRPRPRPRPNKTPDAPLHRPRPDHTTEQRDGPQPTPPPHRAGRRHHRTPDP

SEQ ID NO: 1000196 - protein, 56 aa, Homo sapiens
MQRVRPWAIEPTGTATRARGVHITSGMRSTEAPGLHPVVDIRLHGSTRHLLHPPHM

SEQ ID NO: 1000197 - protein, 286 aa, Homo sapiens
SGLNKRPGLLGGRRGPDSLAEQPPRLRGEASMLRNLSTTGLSRPFYALLTRTVFNTLPQQQAHLDLNVFVDLVSLSWWNRERRPPSLCRQVGMQIPRFCYHEQVVLLLATLQDAALLNIEKAPNGCYAACAMPVNDTGWQYPNTHSEHIHTEPGQVCMAVLIQPNPHMRLSSSCDQGRCNGDLQRTSPMHVRHTCIGSRIFSQRATAVPVGPHPDTIGAPHGYQTTSYSTTRLATYTWLPSPCNFTRLCKRDAPAPGSTTSNTRDNPIQPAGHPDILPPLGHPPSL

SEQ ID NO: 1000198 - protein, 118 aa, Homo sapiens
MDDDMLTSLKDPHHRQYNGVGKVSLGSLRFDRMIRLIGEFARNRYGVDFKVKTNFEVDGNKAKFAEYGILVVNEEVYERLTSAVIIEVHRGVNISSHECRTQEAAYICQTGINGNKCN

SEQ ID NO: 1000199 - protein, 319 aa, Homo sapiens
MLSACARLLAGRPAAWPPHAPMGVEYSGSSVGRDHGMRVEGYHHVSRLGPFAGVTWLALVVHVHTRDVVPWAQRRPKNGHGYLLLKVIKGIDGLLELLTLTCKRMLGGFQIVGTFATRQERGRFDERRVQLLDLSGMHTYPRKPFLLLSLVKGIASQRCRAKAQDCLDLLQFSWKPEVAERARPYREANCHARAKGPRSARGAALVPKVRLMGIRRTVFCATTQVLGRRCVALGGSSSASKHRHARTENLWLRGFKGRIPCPSMVLPWKLAMCDLSWTRTSEHIAWGGCARSWHPKGGKYRWVGIGGSQCRVNPPGGSS

SEQ ID NO: 1000200 - protein, 298 aa, Homo sapiens
AGGDTSLGGTVSVAPGGTEENVELPVSGEYGDYSLDEFRTALAGGAGAVTRRRRSGDVPCSAAERLGSAAGRWAPGAAEQASGDPALAQGLPGGRWGGPPAGAVLNSGRRGTGPYAEADHVSPLGPRGRPQGRVEPSWVGTRLIALNLNMIMNMHVASYILDYPNVAFTELAPTNNILQIYWEPGKSNLREECADSGDAMYVGKAVHFGRKGNCTRSHDGDTKRHGSPTTTRTQRAYPNYPGNITSPPTHSCDPNSHIALRQSPGHIPTPTESVRPTPQTATKHWIDTTAPNLRNNTT

SEQ ID NO: 1000201 - protein, 156 aa, Homo sapiens
MSAASPASLHLGRTCLGVRLLLSSGQEHDPEPERDDFRRPISNVSLGAGDVPPDGHHSGHQKTCEGRNSWRCPVLIVSVVTYYRASGENVVMRAYCLTELSELVIVNVGKHEQTSCIRYPRGNPDVEEHVLQIKRTVQSPHFYNFQGHATYIRYKW

SEQ ID NO: 1000202 - protein, 263 aa, Homo sapiens
RVGSRPGRGRRPLSHRLSRTAEVPPSGTPPADPPPCRTSSRGRPTHVGVQAPAVAAVASIHACQERAESGNTPVVHASSGTEPMKDGAAADGARCSSTRPRVRQPSRACTVATDALEPIRKAQTADIASLDERRPGTGDADLGRRARETSHPRSNHTPTRTDSPADRTHPKAHHTLLLLYTTERDCGEANFKPMENHTRDAPGPVPWHGTLTATPEGDSNRGKDPEYNNVVGDSHQPTLKGAQAGGVRPNTSRSKSLCGGRDS

SEQ ID NO: 1000203 - protein, 190 aa, Homo sapiens
MSTGPHPSLAVPTGWAGRWELMEEALDSISRNYALPISSRHMRQYLGVRLVHIVILDHVNVSQVCVKLSFELTWMAGKRRWASSGSEMVPRLVVEVFEGTSGYRCKRKRPVTLYCGIFSVDIAVSRGYAWVGYSDGSGKPIEQEVLLYLAEDFLDIMGQPINPSMSKSTQEEMIRTWQFRPSNGMNSIAR

SEQ ID NO: 1000204 - protein, 248 aa, Homo sapiens
AAFGGGGGGGGGSSAAPLNSLRARVGTTVRHAGGRSGRDRTVRDTDARRDQRDRTRAYTQYARLESNRVATGAIIQEQEVRRIQEAKQSGTTVSKQVHRQRRKPRTRGHQKTSRGQTKGPPHEDRTEGTQRELSHPSNIMQRRQQRHNEQAYKAHNEKKQTQKPRQTKYSLSGNILPGPRQHKPVSRTRTPFTIRPLTTINTARMRCLPRKHEGTETATTDTMLETADDMRREASIERETQHQQTPEM

SEQ ID NO: 1000205 - protein, 458 aa, Homo sapiens
RVLSAQAPGCPRSPAHAPCASSSVGPAPWIGHMSSPASVQASECSLSDSARGWPRAQHSERQPLSRRNPQRYTLGSRRQGVHAATRKTPRDLRDTCRQSPEPSSAASTSTPPQTGRTTQRETTRRTCGTTATTRGGHTPEDRQPQPERAPAERERPQQHQSHPTTYTIVDSEKHTQDGTPLRPQQPPTRPATSRREHRTIPTSNAHPHAPLAAHHHHNNTGQPHTSPQNHIQRTTQSSPNHAHYAIRKHHTTHSETAESTTPPDTHHSHRHAQPSTHNNPKLHNHTTSTRGQPRTPPSKHQPAKPQQSTPHAANQYAHTHPCATPHHVKAHAPTTTATHTTRYRQTPHKQHRPRPPTDRPHAHNATEKQNKQHTKEGHHQTQTSNYLKTRTTRGASDTQTTDQRPDATTRVEQQTTTTDETDETPWGTRTDTNDNDACTRASDTSHAMQDHATYVSDG

SEQ ID NO: 1000206 - protein, 126 aa, Homo sapiens
AECCSPAVIGGEPRLMRVCTEACITVCNNEERGPGRRCMRQLAKDENSAPVRKPTKSETVICFHNGLPAFRRPGAEGCSAMDSFERIDRAQHRQRRVRNFPAARLPPMCVDPSPGGTISRASRAPY

SEQ ID NO: 1000207 - protein, 213 aa, Homo sapiens
SGFGRAVFVSRLALAQELVDPSPLLASSTLRSPWVTTVQQLPVALMICRSLGTHRFQMTGHTMECMRKVASYAGVIRIHRRPMAVPYICFLLLTSVHSVNSMPCRAVGRLFVIPLIHSLGARLNSKVIANRPRHVSLLQSDATRSSTRGSTHTLLTQCVKRSRCETCLQGVDAQVQARAVHKTVRPCITIFVLIVEARILGGTTLLASVYWTA

SEQ ID NO: 1000208 - protein, 189 aa, Homo sapiens
ERQLLLLRDLRLSQTGWCGLGILLVTSPAKVPQRTLTRRMGRGVLAVMYFTMTATTSQRMVGVQEETEGKKALDELTDRGGKWSDHKLSLDELGRKFPRWTCPKSLHTTQAWLSDISGLEAWAQTALNTNSPQTHLTWVTSSSLSKVSTGEVLPSIAPWNQPRYTIMISQSPTENPKACQWEGLTPSQR

SEQ ID NO: 1000209 - protein, 202 aa, Homo sapiens
RAAVVSGVGGGSRQLRQQLRQPRRPRAHTRRTWDVGAEDTRWTNDAPEAGSRRRREDDTENSRDEKASTQANKSTQSSNNRTHRHRREKPTTEQTPTETARAPERRHGRRRGDERRPQQGGANERTDGHGKQTTQPEPACDHSATRPTGTTRPTDEPQKTKNPDTTPRRRPDPHATTEHQPPRSPAQHATSEHRATNRNQDA

SEQ ID NO: 1000210 - protein, 186 aa, Homo sapiens
MHEDLIRYSYGKFLLQAFVLVSTVTLMLTHVKVTCLHEREPWRQVYSEIGSGVRMHQPLSQCGATETGQSRMRQSRGALLSRRCNNMTAAMKDETGLRNLMMHVCAAIIRRTSSDIGPGYWAMRSITAEIARSDRIIGEGLIPCKAENLMKPTTCNKDAGSGLVCPPGSPPNAAGQIVLMLLMVIL

SEQ ID NO: 1000211 - protein, 160 aa, Homo sapiens
MNDWKMETHTWNGIARRSGRSWNFKINENPLSRKGEYNEKKKNSKGKNQPGHNDHRDEHPLYTQNREHSQETTREETHTQNHNNKITTAPNKDKANEKQTTKTEPKQRHKQNNHKHSNNTQQSTTENQHTTQTATNTQKTNNTKAPQNSTNNNKHTHNRA

SEQ ID NO: 1000212 - protein, 105 aa, Homo sapiens
MSANGRSGANEEILRGFNTKLDEPFGMLRTREDTLCKDKQKTVSVPGVEHEARVPKKNPQVHRHVSRELNFSSIRIKWKNSAWNKKFTSIGQCLEEWFFEWLCDP

SEQ ID NO: 1000213 - protein, 229 aa, Homo sapiens
MWQPRASGSRPWPRSFIVALRLQVQVCFILNEEVMRDGVPRSAWTICGEGTPPGQPGSWKVMVAGRVEFTFYSKKRVDGYVDTESKFAEVMVADIKDRLGLMDKCALKAESRDLESSRFSQDCFMSRTRTEELLVDNLDLFPDVLVAVIGGRDCCPRVFASERGESVCMCLPRNAYRPVRSRPVPCVFLHIIFAYAHVCPQYVPWHVGGTVPLRPSLLMGTAKRGVCWV

SEQ ID NO: 1000214 - protein, 107 aa, Homo sapiens
SGSLPRRTPDLCQVRSAILVPSSAGPCPDARGILQSPFSAAPSVRSGHHGQVEVARSLGDSSLVPLSLAQIDLNKPDRFAGVFRRGEYNVSSYSNLIVTGGSLNHLA

SEQ ID NO: 1000215 - protein, 128 aa, Homo sapiens
RLVVRRNTKLGDDAGVQWGGPGALVAPGDGAKPAGCDVPRGALWSRPSGYSGGHEGIGRTRGAGHGEPRPARGSRRHKPRTKGRWIASYNLEGAAWFYTDIGRINVLRGRRFLSCICVPLARFHRTSE

SEQ ID NO: 1000216 - protein, 251 aa, Homo sapiens
RTEVQSFLAGWLLIVWYIALALLDWYSCLRLALRVTGEIQDVYLLMVKCSSMRKLGGRPCHQSGRACVQKRLVMTPGSHELCWVKSVSDGELNGLKLEDEFVERIYEVDVELNLMEGHLAILRINQGRMHEVVFSDANDSGPPPIQLMPALMSALLLLLPRMSIIESPRNEGRLLQRDSERRGDGDSMYPRSIPCRRKSQCFSAQYAMVRSSKARVPITIMPCGRDHSQKSIPSQRWNLTEKGGKNLQRGG

SEQ ID NO: 1000217 - protein, 74 aa, Homo sapiens
RVGLPRHGAAGALWRSAGDALLVDFLWSSRRSWPRQSNQSIEMHSQVEDTNHAEEPFLHSGDRGLTWEVDTLDS

SEQ ID NO: 1000218 - protein, 86 aa, Homo sapiens
SGSTGRQEARSKMAVNQSHTENRAEPSSLTVKVSGSGLRMWSSAFPQRSEGSNVFMVERQEHVSHFAYRVIFITSCSISDPDVVLL

SEQ ID NO: 1000219 - protein, 135 aa, Homo sapiens
MKPAGLGVGASCEERAGGDARLGGLDSEWGAFLAPPPRLVGLGYYGGMTSNWRGGPPRREHRTLATDRDWGPRRPRRKDVAGPLMLDQEFEAGEAASGAPGYSEGGGRADGHIRWSREHAWGRPRLYAGQQSTGG

SEQ ID NO: 1000220 - protein, 110 aa, Homo sapiens
RKRRGVRYGRRRVEGVLATRSDEPARERCRAWRQLRKQRSLLKLTINLSFCRDVFFLEWPRCPDVGNVTAYPVEVAIELRGEIYEISSTSFASILQNAKDIGYQSISQEH

SEQ ID NO: 1000221 - protein, 87 aa, Homo sapiens
MASRVLREYSRPSLAARLAESARQVAPYRLPMPRDEETEHEVGDDLRVREIADGVSWMLDEVTKYLTLRMYLNCCCDSTEYVVRIVG

SEQ ID NO: 1000222 - protein, 131 aa, Homo sapiens
REWMRSEWLGWCWRAVSVPAGDSPSHRFAGSTSSRAGCLTGTAGPHCAFPWGSVNLSSNLIGNPCVEGIVIRRSLGRRAIVHSSIEFPLLKQNCNANEHVRAVARASPHDSILNVCEITHSGETMHCARVD

SEQ ID NO: 1000223 - protein, 73 aa, Homo sapiens
SGVLQTEPRRVCAAACLLHSGLTSVNQQQATIEGSMIASIRTRRPSSGDDTLRKIKYTLREDCTCQNEHRVFL

SEQ ID NO: 1000224 - protein, 116 aa, Homo sapiens
MYDEIDPVEAFHLKYSIVYERPGRYDQWTKWKIIMGMEDQNYVGFEISRYKMLKQLNCVTLRNIVSFTCARMKNGCDIAIKVIQTRLLVFAAEEVLQYDSRRIVLDSEDTYRPFYD

SEQ ID NO: 1000225 - protein, 275 aa, Homo sapiens
SGQWLLPQAGGGRHGGVSGWRRGFTTTVVAVASAAAASIASAHEPELQLPGPSVVCQHARCPRSFSGACCKHRPRWGCGRRRTDRTKGSRAERSGGGQAGSCAYWHYPAWGRGTRPDLTTMKHCVYAGTQSPSRRNSDPGSESHTSSHPARAVKEDALDDSGLSAKKGRQGSEEPEVTPDGPTRLPMSWDSPWQGFAKPTISEQRVGRREPRTAQQVINGVTPRRTGKARPGCTPSPKILHSRDPARDNTGTTPRKTRGPENPEAYRANNHPGAS

SEQ ID NO: 1000226 - protein, 222 aa, Homo sapiens
ADVFGSRFRDAASAALRAPCAGLLRRRPPRWRARSPFRQLLQRHPGCAPSPSGCSAVLRRFRAAAGPPCCGSLQCPMQPVAVCCGSLHTDGDKACVDFLSDDTLREERNNSRSITISSHKMSGGLRTLEAEWDQKRNLSAESLPGKQIHGTTLTTIYQQHPTKHLMREAGNPRKGRQVEEQEPETDYQLPNFVVWKFIKHCMHGKKALVWHCHYPAGCTLDK

SEQ ID NO: 1000227 - protein, 417 aa, Homo sapiens
ADIDPRPRSNMASSTVSLASPPAWHYSASSGKRPARSTRGPPVDRANLTTGPIHGARATPTPRDCTRVLRRESRDCTMSWPPPPANSRSTESVWLVRQLFVSHFGGTSAVGNGHRRRGPGEPLSSTYCGAGARWARRLARRDRRDHRGGDGAGGDCRVAQKRRVPNLDELRASAWVNVVSDERQGEQSPGVLQNAQFGIQAEGPWSPGYLTDEEVLDDENPFAQLLSGGRCGSFVSGSISSTRADPQECDDDTRDTVFYPICACHTPQDRPLATPEEADGPTSLHDALKPTSGAYTGEKRPGPHPTRRCHAPDPDSGEDTPKRNRTHQRTTNQRGHGTSPDPDVSNATQRHQSETANRRSEQTEQATKGHNKSTTQERATSKRAHTTVPDERRHEDPAATTKTSRTRRAHGRGRAPW

SEQ ID NO: 1000228 - protein, 91 aa, Homo sapiens
RGSAEWLASVALGMATFSRPGWVHILLVLHSPARECIVSRFDKHVTVGAQDYAKTPYTHKRTQEDTKRQTLRPWEVRSYADGRPSLILTFD

SEQ ID NO: 1000229 - protein, 209 aa, Homo sapiens
AGCSSLGRSGSCRRSGAPPALLKLASLPASCHAPRTTLETGGDAGCEHHRREGSARTWLARSTPLTHRLSGKHDGSPQTGFSVKPAARIPGHHPTETHAAPGDWLRVDRGHGISPRRTGSQGHLILQTGLQSPSRPTKRAWAETQVSQSHSHRVVFDNCTDKSLAGKRYITFVTHDVKVALYERRVRGQGKAVNHSLCARGPMGFPSVP

SEQ ID NO: 1000230 - protein, 143 aa, Homo sapiens
MVDPAGAKIGNGGSTLCARSNVWKSYHGDNMDILVTIFINVTLMNGRKKSSESIMLSRIERLEDDLTDQGKREADRTIGTIFWYLGYMCHKMQLCDEAFSKVNLNYRNCKMGCLYYINVCMCGGKKSHIRTLMLKGLRPSRLT

SEQ ID NO: 1000231 - protein, 113 aa, Homo sapiens
MSVRRAAVRHEGVSNDRMNVPIVARMRGAMKTGTRAARLTCLNGTCPKALGLQGLDEATDKAWMKTTLPDGRNELGRGLMHGTKSSAWLPQCSMHSLKKDEGRDQLMTRKCAA

SEQ ID NO: 1000232 - protein, 377 aa, Homo sapiens
MEMDMPTFMAKMFADSCEQWETNGPTSLASGHFTGSNVEDRSQLTVLAGMAGHPSPFRNYGDGTPYDHIDQQVTLGHMTSLSPPVCQFHEYISNNMKRGSYSSDGDDESRRYRVDQQQSLLGGDSGIMGKPRNASSPRNEDRGFQVRIRYSVGNEVPEGKAVFSSKCLVAGTRRTRRVRQNVPSQGCCQSYAGRMASKYRLTPSGQRYTVGISSQVLITYPPKLEQPEITCWPLKSSALHLQSSEELRPSTARDGGNPVWESVHPTWGTGNSRLGRYARDNVRRPNSFLQYFGNRPRQGLEGNPLSFRTNESEFGNGKYLFNRLPLRAETSKFPMVFASRHVFKLFPMANLVVSTNPHTRDHLSGVPLPCGNGERNS

SEQ ID NO: 1000233 - protein, 205 aa, Homo sapiens
MARVGAGLSRSCWLRLRLRTSARSPWGLGHAGALRSLCRFVILHVTKGRESERDYGISLREIGRIDEKRGQYFFTICRSSLRWIRNNGRIERNRWNNFWFMKGVSSVPLTSTDMVFTGAKDTVWNQQELLDSFLSLLTDYRTALTMLADPWGDTSIHEHNHEVANMARPHRWYSAHLYRSTRLLTDYAEKRQSRKILACYRRQDF

SEQ ID NO: 1000234 - protein, 177 aa, Homo sapiens
MEHKRRTGAVVTGQSSSFICSTRGALRGDLMNTWVHAWMTTHAELADVIQTQIMRTRRGIVGDGETKEPFRMTGCKYSVPSVTVRGGRKGQVVMIVHNWPRIVQRVDGQDARVLVPDFACLGKEALGEGKTDTGEQPAVLKMDTGVTTCLRIVPSWRVTSVILELHLSAREDTVHVA

SEQ ID NO: 1000235 - protein, 230 aa, Homo sapiens
MAVNVYSSICDPDENLSRHDHACMGQQTPLDLNYTKIEQLCSGARYCQLHGHALPTVCVQLEESEVPGQKLEHEYIHNFKVHATPRSSNTDWRVRPHSIPSLRNDTSSADTGTRPTDPTLSSISRRLPPQHPLTRTSHSMAKAITHHPLPARRAGAPHGTATPHHTPYTPSGQLTNSPHTNNLPKRTTPIRDHHATVTQKQSEPRSPPTTRHQPNTTLARNQQAPAIEAN

SEQ ID NO: 1000236 - protein, 94 aa, Homo sapiens
RLSRKAQGVESTAGEKPGASPGGSLDSHWVSSLIGSVRYCTARMDRLSGISVWISFVAVVWDNVIPSGGLKGLVDKLQALTGNEGRVSVEEHQA

SEQ ID NO: 1000237 - protein, 139 aa, Homo sapiens
SGLSGGAQEEEEQEQKQKRGPELRAYAGPVSEMPVRGDRRVSTTERELSGWLRDPSAWTELAYGNRYTVTLQHLDSNKRIRQLQMSGGSTTNPTYENGENCLICHFLMCSRSGTCMMALRPSTMTRVVMVTWNTHMEGT

SEQ ID NO: 1000238 - protein, 110 aa, Homo sapiens
MRLARVSMIQLVIVDYHQMAEAQCVHSTVDHPSIEGYVSNLGPAAITVGPRHRVIASSRHELRSSWKHWTNAKKRYESGRGGEPLVDHRSSRLEWRASSRLERRFQKGLE

SEQ ID NO: 1000239 - protein, 103 aa, Homo sapiens
SGGETGEESAMRGEGVYVLGGADQEYSALRVGMVSDCVHVRSSDVDTRHESDEFNGGGYKRSIQQIYLYVVFMASHMLLQTRRSNVYLRSTYNWDIGNVLVES

SEQ ID NO: 1000240 - protein, 163 aa, Homo sapiens
MVSRFKYIQKAGVETTIFIQGEIPKARLMALELQTNPDADLSQNVPSRVDCPATIVAVKAIQNSDRRTRIGTETWARANVSSYGSIIREAYFAKETRATVDQSVFTDAWLMRSSQKVVDTRIILARDAGRISLAERMAPDRRYLWTKSTLGHLNAPRNTSNRG

SEQ ID NO: 1000241 - protein, 136 aa, Homo sapiens
ERGRVAIIVAAARAAVTAETHPLPLLAPLADLSVGKKSRSLSGEAPASCRRSFPNDTGRPGRSLHGTRLTAACPPSLSRRGRRRSAELSTSQQSVQTPDHYRHHTPTASTREPVVSRDGKREASVNRQKSRKKALA

SEQ ID NO: 1000242 - protein, 226 aa, Homo sapiens
MPLKLSCRVLMDEISEVEVEIAEQSVTIKTMLEDREWTDDTEMMTQFPLANVNAALLTQGHSVVLPITRMSLLLLKMMRTKISCTDDIPVWDQEFLKVDHWTHFFELILAANYFRHHKGCLMLPCKTVAHYDPWGTTLLHAAFGQIFSTSVRDSYGLLLSALRRKRNGKALADVVTGRNCCHTPLAELLLTRSPPPCYTGSDVPGHTLAHPPVCVRSVGSLIYLTI

SEQ ID NO: 1000243 - protein, 160 aa, Homo sapiens
REGDLVGTGAGQQPCEALTQRWGGGRAEMGGVCVRAAQAEMEWGPGLKTGHGVECCLGWTAGSAVAGGSAESATPHRRPGRSAAQQLLDAVEAACQTADSMDTIAACEEMLRQLGSEEPGARLMAGTSQTNHGGSTHQTGCLRQEAAFHTGCWRMELRSP

SEQ ID NO: 1000244 - protein, 211 aa, Homo sapiens
MSAFFRQSGEVMSGAEYGRIGRDSRSSASWLGDDGSVNSGTCSHLTGIWIHTVDPRYNRNRRAARAGWESTTRILLFPTLVLARIREYLTVHYFTALYRRRLGRSRRSTRGDWQSELCEVVYNGIRGQARMVKHILATGEGPSAFNTPSCVSWNPSFMGIPVGYPSNKARGLSGTTRTARVGSRGRPLSKVTGLLPQKGVLKDPYDGWARA

SEQ ID NO: 1000245 - protein, 139 aa, Homo sapiens
RDADSSSEEEEYENMIVCPRIRNIIRTRKQHEQLKVNIRYYRRTIHAVGLASVVGISLGRYLVMTVGIACIMALSLSKRIAYQHVSYIYEAGLSASRALVLSQQRLSSKRYDSTVKREKIILWKASSLLSHIPNVSSGS

SEQ ID NO: 1000246 - protein, 117 aa, Homo sapiens
MGRLSPNSGRLMVEPPCQLRSGCSSVSLRDVEHCRIPMFLMDHFGMHASAYEPVMLSGELCGYRTHSLSDLQDVQTMSYGNAGTVTKARSGMQSGVEDCIPLLWSAGNSRDGLSWTE

SEQ ID NO: 1000247 - protein, 209 aa, Homo sapiens
MGTTIIDKESAPSRGNVSYLRGADPSLAVGDHKMKMQEELNCSFLARIILRLGIQTSVEPVFREDCHLKISCLYIRVAIVLQGYRPDLVTSSLVGECSASEHMTGARSERGSEGLPEACRVPMNARSMKCLRAGHRPGSPTNEIRSYFRHSRTWNNEDSSSGVSYSEPLLGLDRFNGGGSFTRLEAPDGTGKNHKLAVNGGEKLLLGLN

SEQ ID NO: 1000248 - protein, 269 aa, Homo sapiens
MHMLLRGSRANIRVSMTGRLRAVMTRLLGYVDPLDPSAEWLASSPVIFNPLYWNVVARLGTEDPLKLSRGPSDPRYLAFYSLSITILLHEAFRSRIDICYHCYVPMLSQSPGMESRGHSHVWAYMSWVLVAPRTWASCSCSPVFFALGFAGTFLGDYFGIPQGGESDRVPFNILDNPCTGEAAIPGLAIMHASPGPAPDGAGGLNYIMALYKKEPLTVRIYRQKAPGPQEELIELQQFGEAWTSSWLAKWRPGQGDWGLRSKVARGGCQ

SEQ ID NO: 1000249 - protein, 70 aa, Homo sapiens
SGEDGVLMAVRRRMFRVGHVVLSGGLAHGPVPLVIDSRGRGTPGKSTLAQQHRPDGSAVTIVSADSMAGL

SEQ ID NO: 1000250 - protein, 221 aa, Homo sapiens
MIAVHGLLYNGSGMCQYHGLLLGDDAPRSPCFRSQIVRAPQADQRQSMDEQLAPKHAILMLDQGAPTNNAWHILDPVEVTPNWSMAIVDENLETIDVITDLAPTSHSYDTETCSVGPREREPPEVSVVHPERPPLKRTIGDERKGGTYRIVQDVFLLLNEPFNHPPGPLDIEIGQIAEDRVLDLPSSCRLGAASRAGAVCSIGSFDGMTRRSSPNEQVSTF

SEQ ID NO: 1000251 - protein, 123 aa, Homo sapiens
MYHMAEDELITLQRHYSKQRRSTRGKSPYRVYWRSSCQVMPSHDLPEGFDKNGDGTIDFREFICSSVPSPSRGELLMHEAVTGAFNMYDLDGDVHDDPVEMLEIIEDIYKMVGTVIMMNMNED

SEQ ID NO: 1000252 - protein, 548 aa, Homo sapiens
RTPSTSRAAADDYLPPTYLHDDRQNYYTTYRADTEQQGAYPEPHKNNDNTEKNTKRKNKQTHTTNKTHHTTKREHTSTQHTPTTTTHDNQKKTTHKRKTRKTPKNQNNNKQPHNTQTQNNRTKHTQEEDNTHTKKTKTQKHKNHTPKTHTKRTRKKKPPPNTTHTHNTNHKKKKKQHNHHKTNQNKKTKHKKQKHTKTKQEKKKHTKKNRAQQKNKRKTMKEKTHQHKQKNAREQEKKKTKPTKHRKHQEKEATNQKQKEPKTTTTTTQQTTKKNKNRHTTTHTDKKKKHTHTTPQPRRKKQKKNKTKKQNTREKQDTQASKTKTTDTKTQKKRTRPEKQTRTRTPTTTTTKQQKRRTPTQTTAPKKEQNKKERKEKTNNIKLETHKKQEKPTRQKTKYTTRKTQRTKENEEKNTKNTHKESKKPRNKTNNSTDTKENKTQTNKSKTKRETQQTNGRQTNRRNEKTHKPHKTTRQKPQTTKQQREKKKKTGQQRKTKENRKKNTTKRKQKQRRQAPETKQNKTHNENPQKEQEKKTERRNKKRTKRTQ

SEQ ID NO: 1000253 - protein, 129 aa, Homo sapiens
SGSEPVADWWLPERLAEVGGAGTWRELSICQGGRKGAASPTGCTICRVRESSGERKDVVPVKSSFHHLYFGMSTFAHTSNKASHLMLNPRTNKGMAFTLPRTTNAWSSRTSISQNRDTRYSSLTDFIDT

SEQ ID NO: 1000254 - protein, 115 aa, Homo sapiens
SGIRLRDETTLVLCVYEKKPNRLNHRVTDDSVRIEQRVVSRSHEDYMLQRGRQSKISGLAFRWITVTKEESSTGMRENGLTVQCWLEAESISTERMKAPGMPTGRGRKNGRRQRH

SEQ ID NO: 1000255 - protein, 277 aa, Homo sapiens
MAFGKSHRDPYAHLRGPPHRPKDAVKAFAQQTGISHTHTHQSITTANPNFTIVHFHCTMLLCQHTVGHQVIPVISALVAQHRHILSHTAATFQLTGRSLANPTAITTLAQSQATISRHQQSFANFKFKQLGVPQEGISPTVQGFVVHRFTCSQKSKHKQQVIHPSRNTVGAYTGNTGGEVIHRTAFTFHHSPQATGQSTEAFRTTHQAYRWQHQRKRKVGPIPQNTLPCTTFQTRTIRQFPRKRQNFTVGISTPSLNQLGHIDPKRESAYLDPIAPL

SEQ ID NO: 1000256 - protein, 158 aa, Homo sapiens
MEVTAQHVCGSTCDPRILTGGENCTRPLLQRIGRAIRQGPIPAQVGTHDVYGRNAILTMGTLARSSCIRPFPLARKSYQITRAEDPTGQTILRSLLWEGTQFVFGKEFRRTAQMPLVSPHRGKLIRGKSFELTHEEGSDKVDLQTNPDVGREGTETRV

SEQ ID NO: 1000257 - protein, 380 aa, Homo sapiens
SGGVADSGWSGRPRRGESCTGPLRGRRQHVGTSTEFERQLIRRIKLRAGTEVESGIGSAEQQASLGAVDRTDAGDRSRDRRIPGTQRKTRFPGTWRQTQLNSVGTLEAHRERRHGVTDFVSLAAHEVRRRRSVIYWDVPNPSRDFVDTTSNTRKYAKYRWPMSKVVAGSRVCDDRLVSLRATQAVYPRDRVLGCGLSETGTEVTPMSSVRRPWIERTTTWPLDGSPYRWGLTVTPCLGKFYMQRKGQWTVEYLACQRTHNVMSALGRVGLDPLKGTHWDITSNGGISGPVATTLNTKRIRRKGSRAVLSGEACPLQGCGTQELNAKGVIGAFTEWHIRSFPTGTKIHIKTIPGQRHLQRTYPSPGFTWACVHEEDPITDL

SEQ ID NO: 1000258 - protein, 262 aa, Homo sapiens
MVLEAECEENRERGSWATGTPQGETGTRGRKTHGKHRKRMMCHPRYKHKNNEGTRSTPGEERGEITRGAPTGQQHEEYTPQRDQTDKATLNKKSPSITTAVAGDTRTGIQRKEHVENVGGKHKTNHIRATTHTRRTPWRTEPPERTTQHTASAPRGHRKRQTKRREPRTCQHRRHNAKTKRPKRRPTRRTHRAKETHGKPLGSSADAGTRQHRATSRGTVGKSASGEDSSRDTAPLARKGGAHDASHKRADSAEGRVDATQP

SEQ ID NO: 1000259 - protein, 68 aa, Homo sapiens
RAAAVADLNLEGEKELLAPGDLPAIAGNGWVNHGIARTESQHVILLQIAVRDPYIPHIQELEGPENEE

SEQ ID NO: 1000260 - protein, 225 aa, Homo sapiens
SGVCSPAPAGGLASRLTSHPPAAAALRGRSHSLETGSLALTVGWTERGLSGASKEQCPCMYKGMARQENGKERQRHNEGGFQTASCPARACSDSPFHYSTADCTANATPIGHIEGQGETPKGSGHHDGATPTNTGTSDGTTRFPQAEKRVPIARNPAHIAIPQAHSTAGAQTWRHTNPEQQNSPHRRTNDPNRPPGPPPTADNTAGQSGGDSTEPTQPPLNTRAN

SEQ ID NO: 1000261 - protein, 75 aa, Homo sapiens
SGCDRKVKHASNSWLVIVFLILMVARQGLELVWSKKDLSGRCVVGLCSSSLALVEHYGHRKNGLNNRKKLCRAGQ

SEQ ID NO: 1000262 - protein, 326 aa, Homo sapiens
MGAPGTTGPQLEVQSTSTSCHRDDSSRIRPVHQRETRPKSRKYQQAIDEMDGGLSEDLEHERPDDHQLYSRHVLTINPHIHDMTDETTQQTTTTRDTQESHTTDPRGSKACSTRLSMPKHYATEAHILSHRDMKQIGQYEQYRDMTYGAKQGRGSTMNVRMITNASRTVMDAENGNSTKDKKNIKETKCEATHELDLRTDQGSEEADMRPQRREDTTSKHVQTTPMRSATVASEDPDTTENAKGGQFAHASRKRAAYERNNKQQNQIEEDHNKKTQRKDDNRSTSPSRTKQNRPHHVDTPPIKKRLGDTTKKETPNRKTRNNNKLG

SEQ ID NO: 1000263 - protein, 178 aa, Homo sapiens
RGGLGAVRLRQRSRCRRVRDALNLGNYVTQHSGLERHLFHHGTGKFRIETQLVINKFIRKSSKRCYVRYRESGSLTYEEFLRRLAELHCLYTANSGFWPGHNLFSLRYNLGLIPLLIGKLVVRVRLYQRLNTQRSAHSKAGHPRTHDVEYTASLPTTLVNDISKSTQTGALGPDASTY

SEQ ID NO: 1000264 - protein, 227 aa, Homo sapiens
RGSRVGGPGGAAGCVAVAAGTAVAYGVRLGVGKGVRNSCILRETLCRTSCPVRGPTGCVSCACLADVTVWGQVLVCSCGAVLGLVCGAGWTPACVPRQLCGLSSIHLIATAPVDPAVSREEHSDGFLAQCNVDSKQRAKSRREEYLQMCWVAEPLASNRNKRRRTPSSKDSSAFWLLTPGRRLETYQRLMKSSNSGKIPADAGRFAYGEAFQSEYGPMIPLVAFKFP

SEQ ID NO: 1000265 - protein, 244 aa, Homo sapiens
MTVFIQICHGKYYILTVPLDFCLNIAKLLMDHERESARVSFPDDYSLNVLSHRNNTLGQRSDYLHTDTASLHTRDAKELSLPHGTNRLRHTLSSLASPNQERTTLTRQHTPMKLRYHQPLLLRRPKPAQDTSPRSVPTNYHLECPHTHCAYVIHILLQRINSRHACTHTTWHSLRHFTTQKPLARSGHPTATSDLHSTASKTTWPTKPYEYTGPNKHGHMTPGTALDNCTLATPSRKTLCTTPN

SEQ ID NO: 1000266 - protein, 375 aa, Homo sapiens
MTNAYARGAHRAHDTPSNTRDREPRRARTTPWCAPGAQENTDDDREAHHRPPHHTHAAHPTADRRKRPTQNRPRINQHHNHRPKRPIPAIGTTKPSRLRASITTRPRGTVEPHHHDASNHGTHDTPHLTHTANAPHKPNTNHPPPRTTTTPPTTHQPDPRPRPPTPTTTTKHQTDTGAQNNRTKTRRRKHHHATTAQHVTRVQTEAPDATTTPQHTHPYTDNEQPRTPAPRANHQPRKQTKQQRSKHTHTDAPAARNKHQHDNSTDRQTRQNEHSERQQNDEANDRQQKKQQQTTTQRSTKDNSSTRAANNAPTHRYDARQSTHAHRERSPQPRHRQNQTSNSRATRRRQTAATRPHQRSTRHTTPRPPDHHHPT

SEQ ID NO: 1000267 - protein, 69 aa, Homo sapiens
AEEVVSSEYEMAALCAVAPAPRTVHEHTVSSEDGSESMDNAEKTHVSGLISVVSIPQVAEHGIVKASDR

SEQ ID NO: 1000268 - protein, 50 aa, Homo sapiens
MRGFCRKGTLLEWIDLVGLNTRKDTSYIDLNDVVYDLGEGICDEFCAGWN

SEQ ID NO: 1000269 - protein, 134 aa, Homo sapiens
AGWLPRLGRIVEPAPLAQDLRPRLCPRGVHRPSLRSPMDALPAPSRLGPASAAAARCALPLLGGPEWTRSVLLEACCADWTPDGHVIMKGLLVMPYATVILKNAGWCTEQVACSSRSSLAGSVLHVPRAVMLWS

SEQ ID NO: 1000270 - protein, 298 aa, Homo sapiens
ERRGALRPAVRPPRSALVALAPPGGRSLRGVGGPGADARVARDRCARGALVRVSAVKVTAEGLRGLEAAGGSLGSANTDEKRDRNAGEKSVRRRSGTGNCTSGPRGRRQWTRKGPDEGKQTTECQRDRDHNERRSRTVFPVCTTGVLTPAYFSEAFRSRACYITGDRDRGPQGNCAEDSRLRTTNNKSSPKGKAPRCHRASRSATPQREPQGKVRTTRHMRAKRGTGTPSQTQPNGNNPRETQRRRARAKGRLATTRAPSGQHARVTLRCTVARNRKHAPHGHFVKPKKRTPGPQTHQ

SEQ ID NO: 1000271 - protein, 143 aa, Homo sapiens
AGSKLVRLTNLLKSYGTRHWTIELVGTTEQCRHLCNNIDKQADNNDIDRNGYDRRKRELFSQSAPAAADQNETRCATHRPRTKTLTYRIDAGGRIHQLRTYTCEDETVSMMMHTMDITWGNVENQGQKTYRQNKYQETMTAPI

SEQ ID NO: 1000272 - protein, 270 aa, Homo sapiens
SGRVRRLGTGIWAGGREKHAVMAATSEGEELMWTLCSTVRKGIGYRPEERGYSFAQFMAEQVNEELLMVEASEQSVNRKKVSTGDAKERWSWYCRSGKISGIEGYTPRAKIRIGLSGNGLCIELSVLCIKEMPHWDAVIKLSSRTKQHWKKKPGHRYRANAVQTSQVCRIPSSRMKFRDECGTNGTGTSRCFKTCEQENKSQTSDSTMILLTGRRSDLAPRDLTFTKTHLDDTTASKDDPPSPQRNLTYVDQTPTARTGASGTNHGTDTT

SEQ ID NO: 1000273 - protein, 231 aa, Homo sapiens
AEVSRPRARWSGNPRGRGISGLARAGPARLDAPTRGLGRHWGTLLPRAYKHQRRQPDTARHHWTLRNGPPHAEARPPAMTRPWETWERTKEHNRFAHGQTGNAKGNRASSACHKAEWHTHTHTTENEHRRDRRRHTNGYRKGKTRHEQGNSHLPGNPRRTRARRAHTRLGPSGHGKHTTPGQQTHPRHHAARHTAATRMGPKRRASPERNAELTLNQRGQRAHEQAIAPHR

SEQ ID NO: 1000274 - protein, 72 aa, Homo sapiens
SGGGLRDASRAACVAPTPHSITPQAGDGPGGGCVVFGSGVAESEGTHGVLSPHVRLWDGIMGPIDINDKYSC

SEQ ID NO: 1000275 - protein, 257 aa, Homo sapiens
MDTFVGHIPVTSRVWRDVGMIASARVRPWSIASWRMSQTRQSVEQQPDSQQAGHAFAGAPNKRAPASERLESHRWQLAQAPEAFKGARGQQQAAKRGRRRRQAAARRRSRRNNESNLPLSDMHRHPQDTTYEDATRPRSTRGGTCLARPSLPQGPNAGPPPQVATPPKNTKTEDNAQPKTQPQQHNANGGTETRPIKNPIREQTPTDGDLGARTTPRGHQATRHTQGRHPSAKHGPHHESPREPGAEAATQQSADAE

SEQ ID NO: 1000276 - protein, 56 aa, Homo sapiens
MTLNLWIPIMDQYAYHFALDVIVLPHRFISQQAGTIECNAQLLEFRILKTKTPIHD

SEQ ID NO: 1000277 - protein, 158 aa, Homo sapiens
MVHPWPPGSHLGTLLRAYFPKRVWLEPNFSLSSEPLRGPWFPTWESRGHSHRAWVLKGGGPQKAGNISHVALETSQDPQVSPHTWVLRVGQPSPHQGRVVPKCASGTKRDTPPVSWRQKRTKGPTRLPLDRGTPDEHRRRPAWSGMGPGHQTPPSDNG

SEQ ID NO: 1000278 - protein, 109 aa, Homo sapiens
MTGLRQESRSTGTLYRVSPQGPSRRSSFVDLLGAESEGRTRQTCFACKPLPTQGGMNVLLDNLGSLDAGTESRDICDMRNERLVVSTQITGIPDHENIASKVDVPEDTD

SEQ ID NO: 1000279 - protein, 195 aa, Homo sapiens
REKVSVSKMAATLPSGPSCSGGRDGQTRGVSMWFVSDHVQEPWGAVANIRTGAEEVACKCEDRQSGTIYYVKIRRNYKCTRSAKAKPSCTTWYRSVQHASNGLSVVGRQEEQQDHVTRGVTGSAQGAPKGHTPTHYKQHAAKHAQGTQRRGQRHPTGPRKGKSSAPAQTRVNNLGPPQCPLQHTNGGDQGISHNA

SEQ ID NO: 1000280 - protein, 147 aa, Homo sapiens
MAFNISRGPAAKRELRIIQSSETERESRIREDNRSCPAPDTWPHLTKESGCNASIDRSASTGTRQAHLPARDAPNHKAYRHEPKTVGTDRRFGATDTLTGNDGIGTADTRNSIAVTFTRARRPEPLTTEPFEGGAVTMPGARVGEFS

SEQ ID NO: 1000281 - protein, 90 aa, Homo sapiens
MCPDGDWVVKGNRVQTRNRPGLQRRGTRDFGLHQMPGSPLRRPYSQRVPIGDVQADSRQRMAEASKAYTNDITMVHDRSSWARRDSFYSL

SEQ ID NO: 1000282 - protein, 206 aa, Homo sapiens
ERGASRQWSHLRGSRRQLEGATAPRPIMAEELVLERCDLERGDQMGETTTLDNQCREKLRGATGAEPMSWHEPVATWRAVNYGGLSVRTGAAPFRWSMTGARRLCQEAEDQGAQDLTSYRRVTDETERVNWNRPPKVGTQGRDLTCLSAGQAAKHARPERSLPCGACMRAADAGRVLPTGDLAQGHSLPVWCWGPTSNCVATCKRP

SEQ ID NO: 1000283 - protein, 103 aa, Homo sapiens
MRRFPGPRNRAHRCTLACVHDRTQRAIRTHDDDDPPMSSRRQQLQPPSTATERTMWMTTIENHDGRGQRRQEGAMSAHPSRAGVRQRIRQKCWTEEMLISDET

SEQ ID NO: 1000284 - protein, 201 aa, Homo sapiens
MSLQLESVPEVAAESVRQPADQHEASFPADRRPRHRTRVSDPVTERSRVVSGPPERRQNSGAGSGPLQSTDRGGRVNGSEYPWLAQGQNMQSAVSLLARSLARCITCAPMPVCSGSSVRVQHRGAEYMRWSAKRGSQVQRVTNFHTITRVGQAVVERAMGPGNDCGSDVKKGDRKGPKHVYTKKGEPEGRDAGSVRSMGEG

SEQ ID NO: 1000285 - protein, 134 aa, Homo sapiens
MDVVSVLQLEGPDGSMRHLQCENLTLNPDYSDTELVTRWLYIQHSCGCPPKCHDPGANSEEELAYDRMPTHGGRGRQGPLPDYAPDAKTELKHASCRRDLAHLLTSNKDCGSIILLLDGGAGLLGETQWVKRLV

SEQ ID NO: 1000286 - protein, 74 aa, Homo sapiens
SGWLGATLVEGRVCRERELLSSTVPELAAGCVLQLETSMDRSFHVLSGGRHGAWRSWGIREECGVYGMHKTQRE

SEQ ID NO: 1000287 - protein, 87 aa, Homo sapiens
MYNALNELEHDGTLERAQGTGACQPNNRHFCQLPLQIEEAQEGDFLVLQTGFCPAGYTHFNGNPPTKSMVNIELQVEHCLHRYPRMV

SEQ ID NO: 1000288 - protein, 42 aa, Homo sapiens
MWKDEYRDYIRDNDGGVKKRRWGAWSKGVEMYITIRDVVKVE

SEQ ID NO: 1000289 - protein, 89 aa, Homo sapiens
SGWRVVRRSLWPELRLRAGAPADVSRWLELGELKHMVMSFRVSELRVLLGFAGRNKSGGSTDAPGQWLCTLLKSSCAPSVQMKIKELYQ

SEQ ID NO: 1000290 - protein, 262 aa, Homo sapiens
MLWPGMPGDAAPVLNSALLLCVHATCDVASAHARRSVACVWVMWCVDVRCCVEGPALCHVAPGAARRVPVSCCSHALLLEPMPGGLCQCLLCRNVWVPWLCICPWAADMTSLPLGVKSRTDSCLLGNAGWGDGLCVPCPRAADRWALAGTGIGGAGLRDVGAKPKMLSPVLRSCALSAVGRGASVGHGVSQCNAQWLPDVYDAAHWAAPFRSGPVARCRAEVGLLWRLRPTEEAVLPARGRFSSCGEAHQWNVAARFVFAAE

SEQ ID NO: 1000291 - protein, 107 aa, Homo sapiens
AEGAIRRETASHKKPPDPETLREICFLLKVPVPPVHCAVSLILSPKFSWQGIDRGDIYDWGGRGSGRFSIPKLQVQDVIGQCVAKIAPTCMLEGCAPGFEPMDCAQS

SEQ ID NO: 1000292 - protein, 102 aa, Homo sapiens
MMWAAAVSLSSMSRRLCNPAVLTSAQCVPIRGMAVAAFQACTPTWEWCTWGLAGLPECCPGGRNGRSDDDGLVRGSCDNKAGVENELGGPRRDKAPWEKEVP

SEQ ID NO: 1000293 - protein, 74 aa, Homo sapiens
RSGLDVIAGNERVAAADLVTVRLYPDCLLLQGLHDYLTVYYVRPLQLWPFLHMKRSRSERLSLENRHDFKVMSH

SEQ ID NO: 1000294 - protein, 87 aa, Homo sapiens
ERGSSLETLKADRLTLTRIRGLRASEADGHGVGAELLYNKSEYLETVARVRGYGILLFPSLRCRLRPGRRSQPGPIARHNRMIPVGH

SEQ ID NO: 1000295 - protein, 119 aa, Homo sapiens
RRYPRSSSRADRALPPLCPVNVPALVAVPSFQRAKAESLKFSVVNKAQRESVGKPRSGGPKPGGRPNTNQPVTCQFPPRTGDAERPANGTHNSNTHRTPEHHERGTRQTQNTAPGTKRE

SEQ ID NO: 1000296 - protein, 326 aa, Homo sapiens
MVAVWAPCCAGLPLLPAVLVLPCLPLCLPQTIPAPARIVVNDVSQDCVPRLGPGAERLRTPGRRWSRCCLPHSGMDQCVTDGGASLEKVLEQSSSRLLGQTCAKRRDLRGSRHSKLTPDVILTGHGRNPLQEGQSWPTAHACTLYPRGEQHYTNYMRLSEPTRGGPLVTRHEHVTPLGIYPLRCSQNNNTFGGRLRRKPSTRRSKESQFCKPRTHDGCYLHVAVFGGAATPMAPQHFWQASHRRRTFVPTPIDDVTRAKGQALLGGKTQARFHFAPTRFYCGEPDALLWRFPVMFATQTSHGARSIWTQQRDVNVTAAWWFRVVVT

SEQ ID NO: 1000297 - protein, 98 aa, Homo sapiens
MVRGTKRDDLSLLIRTESGVDSPPSVEAIEGRLAAMMKCNGPHDSPLCRHCGLGLSRPNGNPGCGGLGLRRRGEDPNPLRDIRRLVVEQDSPADMKEE

SEQ ID NO: 1000298 - protein, 265 aa, Homo sapiens
AVLLDDDWLNARLAKEGGRHVKIVVSFQEEMTWKEDSENATISYLIGCIGSSVARRSGMCSNGVVGGLCNRIHHSMSTQLSQTRAEFRQLVLDYVLSEKINAHETRSETRGGCIAMVGVLMVRHDEHRVNLQVELVQEEGYVNSHRRDSGKLLAWDAHWSYTLNLPPKAPDHWPEGLDRCTRKFAGQLGKTNPDTEEIQFIIVLGTHTKVVYLHEEINNHAFTTCVPRPRAVVRGRLLNRVWRFSGQKGGTVREGFGMQETGGHL

SEQ ID NO: 1000299 - protein, 76 aa, Homo sapiens
MPAFFVTSVLLLLSLCSSLRPFFCHAIPYLLSVCSAESIPSVCCQSSHSCGSTPSIFQAICPNINAETKPLSPSKR

SEQ ID NO: 1000300 - protein, 119 aa, Homo sapiens
AGKACRELGALWRHPACGVVWRGKGTRGMPVLKRRKEPLILANRRSGAVGAGRMGEADLHHGDVGDDRLAGQQNEFRVRCVQNKRSMELPSYCAARAQEAQKDEINTGNPGRVWECTSK

SEQ ID NO: 1000301 - protein, 75 aa, Homo sapiens
AGEALHPESVWSVFANSPDSSLLRCSNTEGRHRKVDNDSNTQFETLSLWSAIPILWTFEKSNSLNMAGVVLDSSP

SEQ ID NO: 1000302 - protein, 208 aa, Homo sapiens
SGRALRGRPGGRACCLPRCPVRRGRRAGARGDPDSPGCCAAAALVSRGPQGYVIVELRSLGPTTKRWTEELEAASTLRDGNSPEAARRNPRESQLRGPRETRVYPRNIPCTPNTKGGREKTGQNKLTEEHTGREGETKPRAHGGDPRGPGSDPPKTTQRQQRKKVNNDNNNTRGRAKRGARNHENNRRQQTTEKPNARRDTNKQQMKH

SEQ ID NO: 1000303 - protein, 264 aa, Homo sapiens
SGWVDGFFFFTVCVCTGEYSFICAQFEREYYKFSQHNPPFEAPNEPAPPYRAPIDDGPPAPTDAPRASKPRDEQQPTGTRRNQPQERQYDHSRRHTQPQPHQEKHPHEQHPGQTQPHWQSRAADRATLRHHTTHETRNDRSSRRSEDAHQGSPRDEATSTRPTQAGAPDQHGRRASVRPQRRQPHTHKQTPTDSTRNTAHPHRPRTTHTDRQHDQQKLSGHNPAGTRKPTKPSNTDNTYSPRTATKPGLKTKKQHSHARADSPH

SEQ ID NO: 1000304 - protein, 187 aa, Homo sapiens
RSAGARREGLEGGDWTCGEFPPKRQKPPPHLELRSGKRLTACAAAGAHLAQHARPGTDAGKIPFCDAKEEIRAGLESSEGGGGPAEARSRCGAAGQEHRLEDCRPDELAPLVGPVYSLVLTPHKPRPITLTLGLLLHSSWHALGVTVVPIDCGATRSYRATADSEDIPGCQTTPWITRMSILRVVQD

SEQ ID NO: 1000305 - protein, 203 aa, Homo sapiens
RVQRAQKIAQRLSAPLLRELTPRSPRPPLAPDARTSWPCLCLEWQAVSLDVNVRGRTEQDPGRQELQRSITEMKRLEEMSNMSQSSGVQLTTLQNQKPKQKGHEDDSQGKEQRTGTRCCDYRNSLSSCGETPKDRHPAITRYRVHRNLNNRCETSAVLQRSAWTQSIEQKWDALVNQAGGDERHCGKRHRGTFTWVNPSPLSQ

SEQ ID NO: 1000306 - protein, 196 aa, Homo sapiens
SGGAKENAASLRRRVERLEDTTVIHVESQVPGSPGPNPYPPNIRVPVEVPNPGTSQTVYESHTCHDELRVSVVVTRSAASGEDILALQSELSSMLCVRLAAVALDCRNLVPEIAETQITRQVDLQTFKGTHVVDMELNVVYIASFGALRCNQRGGYPLGNAPGRNLPINWTYRYPILARNVEHPTIRGFHQGCQQW

SEQ ID NO: 1000307 - protein, 234 aa, Homo sapiens
RGFRCQVEGRKEGAGEWASDSSRAEVGLGSQRELERNLLGQRQADCSWLQLIAGTGSSLPYQWTSAKTRLPVHLHCGPTVPRHAAAVIMANIFGRLLKSLIGKKEMRMLMVGLDADGKEHHPIQAETGGRIDNKIRLTYEVQMMENRWSTEETSDLTVWDVEWQENDSNDIWRPASTQEHTKGVEYEIGRPRNRIGGRRRYTMTSTGDRSRACRQCISGRDRSLRGMQCNDPSA

SEQ ID NO: 1000308 - protein, 104 aa, Homo sapiens
MYHSWTSEARLVNAIRSTWSSTPPYVYLSMVSAGGPKRWLGGRARVPGARAVGGPGVWPPAGSPASLRPSGRMEAARRFPRTSLAQESRGQLGSSRLYPENAPS

SEQ ID NO: 1000309 - protein, 131 aa, Homo sapiens
MESCQAREKLLWTAAGSGHYSRRGHCLGDIIPTGAMAVSASPIRVHNKRVPSQECKTELPCKLIARYTACRRAAFGNGMTIRVLRAGQERSNVTGEAQHYSSQVTRSVSQQIEGVLHSTYMRFYRRIRAAR

SEQ ID NO: 1000310 - protein, 152 aa, Homo sapiens
MACVLRFPLRFGWELGARDRPSGRGLGDRVPLAGLSGILLPFLAPCSIETASSHVAVGIQSGASTGCLGAEEGRSHGLPSVARSRVCRCHACSFAMPRDPEDAVLTGEVLPQAPWLFLGQQANPDCEASSRCPLTPGGRLTCYSSGTSTQGR

SEQ ID NO: 1000311 - protein, 161 aa, Homo sapiens
AGWARVDVSMGHSSFISRRHLEIFTPPGGGGHGGAAPELPSAQPRPDAGGDFYLRCCGKNGVYVDGVFQRRGAPPLQLPRVCTLHGSRSTKHQRYTFTALSSEKREKQEASDVSSARDSTDHTIIDHLNPLNTSQHTHTDHNHTPHEPNHTPRNKPETTHS

SEQ ID NO: 1000312 - protein, 244 aa, Homo sapiens
MRRLNRKQNFNVLGKTTSRLPYPNALPDDATVDDLSAKWTATALHLNKHFTTPYWRLTYTKKFGHIIKLLLHRTPHCDLTRYSTLSRKDTTTPRTITPYAPPLYTNLYTYLPEPNFTPLGSGTTEDHDGTTLTCSADSQSNSSLPAPPIPHHDKNDKWRNLNHISLAPDHPGATSHPIQPLPKRTARTQDLTTTLCHFPYTSRKHPKHTRPAAKTKRQRGRHKANGAKWPIRANARFGNLFPNG

SEQ ID NO: 1000313 - protein, 268 aa, Homo sapiens
SGVGVLRRCRVDAVADAMQLTVKCAAVAWRVQPAGARVTELVSTAESSCVSMKAELSHVRQHAVLLFNGQGPWQTGKLTLGLYASGPSPSSTYVVTTPWTKCATRRQCECPRVLGRRPAITPTESWQDLILQQVLAPPTSVAGMTCTRQVGPRQPSLHGVGINRRWIPLRFDLTRWDLTIPTRFGPRPGYPLQHSPAKGGTLDAPTLVTAKEGLFPHHTHTTTFPSGKSPLIAQPCWHPEPTPQRAISHDYATLELAPPYNPDWLPLR

SEQ ID NO: 1000314 - protein, 106 aa, Homo sapiens
MRATTSTSYKRRYVETPRVHISSVRDGYSTISAQSNSSYSRAGVIPRCSVRRSLLLQTLDSSMPHVWTKLAREPRVPAHPATTSQSIRHAMRRRQLHAPHLNRIRP

SEQ ID NO: 1000315 - protein, 70 aa, Homo sapiens
SGTPGRSRKQPVSRLQAVVAAAETAGPEVRALLRVQKTGAFEDDERLYRMSQSHTSDSASIEIDVQGVRH

SEQ ID NO: 1000316 - protein, 230 aa, Homo sapiens
MSPAAASLLVPGACASGAEPAAQSQDSLSMRWAAPCGRKEDGAAGLGAWCWMPSEHPLLREAGPWETESSWLSYTRHLDAADPVSLTAPEQRTRKRAGLHTRAKRDAKKNACKAKSPLIDQLASNADGTRSRRISKGTVVHTSTRVRSRQGRWTSSVSFTALDPIKAHLKQRGLPLGWDLNIYLDVPGHKNVALPWPCKTGCPEYGGDPYCSHTTLSIVQLTSAQLAHIM

SEQ ID NO: 1000317 - protein, 209 aa, Homo sapiens
RAALDPGRESQRSYTRGRATRSRQAGEVFPCAACAVLQATGSVCTKQRTEPAPADRRRQRLPQSRVYPRALKEVHRSLHRGPRRTVQWPSRKNAKSSGNRSSKRHPAAVSDRVSVQGGSPRGPDRDQAWRTHNNGRKGGLSGTSFFTVVYGDFIAGRWTSVVCNVWFDLVDYEEVLDQSKKDFRYNLSEVLQGKLGIYDADGDGDLDVE

SEQ ID NO: 1000318 - protein, 177 aa, Homo sapiens
MIPRNLVGHRSHGGPWPADNREQERDCERIAHRTTGGSRTFIPNQIQPYVSGIISAHNEWPPIALFGTVGKAFPCWDIVHLSKEAVDFHWRNLLVSWTTDCWTNRQRPIRTRVGVVGVARPHNLPVNRKAVGKGRMHSMGSPLVTYTPYVPGTRTAVGTTNEWNANPVGVSPRRTVH

SEQ ID NO: 1000319 - protein, 138 aa, Homo sapiens
MDLYDVDGVASTRNPCFPGAGYLPRTMAPKGKVAREEKKQIFEAEQRDSEVSTCGSYWWANAIYCLVTKVLLLLICHHFGPGWSWALVTGSVWGQLPLYRARWHEQQYSEDGDLMAWWPWNLNMEHGIGTNTLTDVES

SEQ ID NO: 1000320 - protein, 143 aa, Homo sapiens
MVRTHVACSQDGSRDRSERRFGPRAFARAEAGRSLKEGQDDGSVEPRCRFVVAGPFGEPEALLAPPFGYCSDASVCAFYMFLYECMRLRGSSCACIRRFADLKRKTIVPCPPEKEKPGGLMHRARRPQRTGNRARKVRPTYKR

SEQ ID NO: 1000321 - protein, 146 aa, Homo sapiens
RNGDRAWCCCMAEGCGKKGWSSAALLREDVTSHRTLAPVPLMDLHRDTLFAAVLLAGSQQFIYLGVLVSIFVISIMENSIYWRNSQPLNEPTHCQVPREFVFHSHAMFPSLLNRTHYYPRTTYEITIETHFAKSQRPNYVQENKLE

SEQ ID NO: 1000322 - protein, 227 aa, Homo sapiens
MGVWNNSLAWPRESDKPWASGWFQAWCISQYLNFPWKFGYTSEGGTAFLPVDDKQLLLLAIFTYPGAYLTSPDSDIHVLSIVVFGPVKLTTHLTQDSQNAVVQPGAPITQVWISAPPYTLRNLDPSVGLRLFLTGHVPSSHVGGTFLLNFRFLEIYPNLKRLLAPSSFFVSHIWPRTHHLFRRLILTKRHILYTPLPPATTPSTLILLPHNPPTHHTSPQPSPHPTR

SEQ ID NO: 1000323 - protein, 720 aa, Homo sapiens
FGSRPGESRRRRELGERAQGADDSPADRPPAPRARLAVARSRRVPCPSQARRQRAPRQGSACSEGEQTGYGAINNPYQQGHRHASDGSTEEGQRPTRNMGIGPQRENQIHAGIGTQGKEITGKHKAGWHGAAGNAEEQPQPRQGTKEQTNRRREEHLKRPHQKQTGEHKRKDGNSKQGTTRARTRANTQTQTTTTQEEKQNEQGARTHQKRRNREDRKRNRKERDHKAKRRRRKKRERETKRKRKAARGRSRPEDRESTERRATQRRNNERKGARARRRRAGQRQATREDEKSADTPGAGHKAHQRAAKNNTTSPGNRARRTAANKATRNHGPGRTRHEAHRAGRQEERKRTNSGAQRQAKERKRPDKRTRRKHKDDEEKQQRQRHGSKRRKTGKRKTQEEEKATDRAKNKQEQNEKEKGKKTREKQGGERERRTDSDRPRRRKTQETNAKQKRSGKRKTERGRRKEGEEETTETHKKQKNKREADTRTGRERGRQGSDREQNRPQKKDKRRSKDQQRKQKQGKEGKERNEKSEGEERRDEEGKRRNKKKRKQKRGQGEEAEEREKRKRETDKEKRTTEEQRANKGRDKEREGEKENERNRGEKRRGEREKGEQEREQKEREPGRRQRRTKRAQSRQNKKREEQGHTRTEERTDKEQRQRKAKRQRKRDRHEGQREAEQRATRRRHDERQRTKEKRGERRQTRAAEDSKREGDKKGRAAE

SEQ ID NO: 1000324 - protein, 104 aa, Homo sapiens
MTPQIADCRRHVYHAESALPGPRCTTAGATGKTYRFCSQRNQTHRSSLHYKTTTDLRISIENSEEALTDPCPFTTEGAPVLTRYFTRNQRDIYTVTGSTGTRHD

SEQ ID NO: 1000325 - protein, 263 aa, Homo sapiens
MNTHTNQHAQTAAHTKTATQNAHTTDTNDHDNAPRTSRTEMSRRERATTRRSDTRRRQRTQNGGERARRSSPPTPGARRGGRPTRTAPSRRGAAETRTPQGQPPRAREQHHNTEPRAAGHQHGRASTERNTERTQQKSRRRTRETSATRWSTLCVESEGIIGLCALSVRVVNATFAFMSAMSGPVSLQMAALCVPMALNPRARTVNSQRALYQTEKGGCTSGDRLGDLSALVCSGVSCHQDHKPPLSRIDNENNKPYLHRPSI

SEQ ID NO: 1000326 - protein, 101 aa, Homo sapiens
MVPLLLTEQHADMAFSRTFEVGGWYTFWTCWNVQFTNRVWQPLVACSSCLDVSGKTALTLKLYCHLGGFTVNPLGPDRLHSPWSMGHQVNRLPHFNTPNHV

SEQ ID NO: 1000327 - protein, 66 aa, Homo sapiens
AEHLEGMRRRQRGVLLLSMKPQQAPVSGKVFILARLASHVCTRCQFHDQMFPGGAARTGLIWQQFE

SEQ ID NO: 1000328 - protein, 147 aa, Homo sapiens
MFARTFELAPSWREPLRLTTNSSMNPHYHGTLIHTQDDPDINKRRGEDSYNNGTNNSNLYTRHVSKPHSERARPTGIANRGQSWATKVKPKTDPGLRQKRGQEPAATQTKHAMFDNLRDDTPTTSTTRSACQQPASTQTVHKMSQSE

SEQ ID NO: 1000329 - protein, 173 aa, Homo sapiens
MAASKVKQDMPPPGGYGPIDYKRNLPRRGLSGYSMLAIGIGTLIYGHWSIMKWNRERRRLQIEDFEARIALLPLLQAETDRRTLQMLRENLGRRRPYSQRSVPRCEKCGRSRVLPQNPVCAPQFDRRMLYGRGTTEEALHASNGFMWYTEALCPPATWIPDPPHWDGINALQT

SEQ ID NO: 1000330 - protein, 132 aa, Homo sapiens
MKPQQSAGVRKGVSFSETTVSGTRCQFQTKFLAELENRDGYGNQFESIQFRTRKTNRLCRSREARRPVISRKVCLGSGRNSIVPSSVCMETHYEKVLKKSPMYIQEQTDEDLCSTKGSSVTDPYVSDGLRVS

SEQ ID NO: 1000331 - protein, 399 aa, Homo sapiens
RGDEQPGAQAAGSGRAPDKSYSCEPCGPRARAMTSPCWSLAALAVAHGRAYGPTEHRWHARAPAGLRDTLPLNATFTCETRVAQSPHGMRRQLRVHEMSRPVNGANNDSRGGFNPARAIPRGDASHAGSITVTVSTREPTRNAPADVLPLLTCARFLHSSTDKRGTHLAERKHKLCERPRVHTPWDIRRTQHAWLLRHGHGQRSHKGSYEKEPRVPRQWERFMKRNGLRTHGKFGRLLPEVKALESEDTKATLETQPRRTMGQTFHSYKAAPKRHLDYLTRRTRGPIGSRHTWTLGPTELDVMPTSATPTHLRDYATEHSRKPNKQQPPYHNPQTQPSNSGDKTPTEPASKPNRHDHNHRTHTHPTDRTQTCAPRTSNPMAKKQIKHTATNTGTTGDIR

SEQ ID NO: 1000332 - protein, 500 aa, Homo sapiens
MAVEIARYRGGKLKKEPEETDRTAGARHALTVRYWVFEPHNNGAASELKWYEIALQGEIGTVQTEFAQNLTHWDGLATSSKTEIVDAQSIYAYSQDTVPNPRVRRSRTEKREQLRGVPSLDGKHCAQRYRWNCVKHANPLERYIHEVSLQRGTSRWVARPATDLGIMGRQRLNHAVGKHLATLHHIADVGNPHPIGIHAKSRPIADHALFPQRSENTERATANVVRTVPCVCKRPIYAPDHVHRAPRATSRERTLFTLRRDTKCAELVHYPAMFAKLVSTGAPDFEQMQPAAAFKFVSEQACSRVNTSVDPARLNVDIPGPTSGKDSLWNQRHPVATVMPTPQYSQAAYTNALEVAMPAEKRDSPSKARCLLERIHKHTVLRTAAVGHDAKDLLAAPSEYLITRTDRNYTTNNLTTRQKHRATQQLLSHTNTFGPRMYDNPPLNLSYKRVKTTHYLTDSYSHSDDSLFIGHYNPTPLRLSNILPTENPTHTHTLTPNTPP

SEQ ID NO: 1000333 - protein, 416 aa, Homo sapiens
MASNHVVSASPSTLARLDVQHWQVPAGSSTAWNTDIQPDGHDAKGAKSTGGGDDSVQTALLHDDDRGLARCNVPRGHAVADTTWETHDGPFELTPFSHYGDRSRPGLLCRPVEAILTHSVQSSKQLAAQFNLNDARRGYLTNNVGRTVGIQLDPPLFGTLTLTANALGPNQIGTGSSPRGTIYEGLLSQRDVVWVRAAHIVITLRVTHTLRLGSPFGTTDTPFAISQSHLLPTGKSIPQSLIGRAYTCPTVIKPPPVEDAAQQEAPPTHAQLQRGSRHAPPLSKRPAANCTHASTKELKQTTNPLGTEHLRLDTMARPHSNKESEGTHNRNRARKNLTRKHGPKDQQRRQTSHSRRHNIRTRPGSQNRPNEQLKQHPPQYEREVNPNAVAPNQRERLTTPTYTRRHTPPRTATAQT

SEQ ID NO: 1000334 - protein, 314 aa, Homo sapiens
AVVHPSARLWCSGGGFLFRAASSLPFYTSPADPGDRPPWLILTAADRTLGNQRMHLGLRCYACPAMPDASSTEILTMTYCASTWIPKEAVPTQTPTTLSSARQSHGHRTVDVAQDSHGETYESYSRLAFESGHRKRDKGLMHTHIQVRSEHPWTCTSVASPDILHQMCALNTLNSAHGNVPLGYNSRTNTAHIGSSHMSSYSHTHAPYETMKRRHHHLIAASAMAVKPLADHLNLSQSPHGKATPTVVNTTWQPSSHPHTERLRAKKGNRGTRLPFDHLSPPHISLTGLTATRALPVTATSHIFNPQKTRQIHR

SEQ ID NO: 1000335 - protein, 154 aa, Homo sapiens
MNSLLASTTEYSSVAQAGAAVAAISAYSATSDSQVQGDTPCLKAPEYAWALTGTPDNTPTHNTTTNHAQRAAVTPPLATIATKLPDLHDPPSTKTPPQERGNLNRTRKPNATQASRETLTNDGSTRKPSTNSIRHRNSGPAEYNQSTKTPNEHT

SEQ ID NO: 1000336 - protein, 74 aa, Homo sapiens
MCSCLGKILRRPPVVWGGQHWEELSLRCLHQTGTHLGTPPPSSSNVSNKVHSPDPSDDGADTPLDTAGMKREDR

SEQ ID NO: 1000337 - protein, 251 aa, Homo sapiens
AEPPDLQPPDLAAARTRPTARMSQLRLLPSRLGVQACEASMAMTHDRTRLFGMASSRSSEAHRTPSQAAKVEGGSRLHWSEMYFAWLRQHPLELIRHKLRGDTALSQREQPSRRDSPLLPGLCHQARRNPHIMVVPMTAARDASHGRPKLGNTQGSRGQNTYGKAREPNPGALVDERTRALAGAPYTSNPAALHPTDAHPQDAGENPPPWGDKFFMGKLATKTLGHQLRIVGLAPVTGTVWKSTPKPQVRD

SEQ ID NO: 1000338 - protein, 163 aa, Homo sapiens
MGVRGHFVGKAIGRLGKEKEAPKYHFEVPIAHMVATYYRCDTEHLMRPHRMRKDEALANIVSDVCTENPKSPFVRTGNWLFSCYYLIPSWGSLGGKSEIPFVGSSVLQSYITMAVALGAHSCRAFGLARRPNRPMIDLVNTESQPQGTETSKSFPLSFHRVTL

SEQ ID NO: 1000339 - protein, 411 aa, Homo sapiens
SWGERGGGEQVCCWAAPVTCWGRGLGGSAWGREWRKVPGHGARQPRCSRSKSPALGQPPAAAVAATICCCFCARSPPSVSLAGGSPVRWPSAPGSVPMVARTTAGRLKPFYLVTLRHTAWWRTRSHSSLSTLSTREHASRRALALLAGPRICNPLASFAKNYGNRLINAIAYQQRAKSPQWEAAMGSRGGFPTGKAGQDWWPKHPQATPKRNVDPLSRIDLDTMAAIPEEVQAHRLGALNGACRSLYATADEHIVTKMVEQDSHHGWALRDEAQRRDMAQYTTETRIPWPPRTAPKRRTPSRESETTDTGRGKKNRASQTRTTNANHTAQPANTEQEERPSRPTLDRPENHDEQRRQGWLIEKAEGISQGWAATKTRRAGGTGRRERPQHSDNTAATAATYSQEGSVTHTR

SEQ ID NO: 1000340 - protein, 55 aa, Homo sapiens
RAQSGLVVRGGAEFFARQNCGSSLRAAGSGSVRSARQWPKDPALGEQNTSARTSR

SEQ ID NO: 1000341 - protein, 355 aa, Homo sapiens
AGLCRPVQGGLPYSLQYALKASGPLKFTIEGSAVTQCVPALGRHGEIEIREDRGWLPGGHVLAEAFPPLSTNLCSTWFRRRPTTVSRPPSILRSIRMLVGFFVRCPGSSQMLSVEAANRRMPGRTCALELGSQDESGEPCEEQDDGVADRRAVGLGFPGTLRGAVFVDAVQLWLCVGLGLGYCAECHGQSPGRIALSLHTIAEALSLVPPILYYFISCLGSTLERCGLRVRFVRSLRLNMRLQTLGFIAIPCPLLGPKVSRRSGLTRFIGPAGQPGPSVALGKFSLPLLARGCADLEYPLAEEQTWRVFWTFSARAGEAELIFEAMGGLGPLVVEHGKVLAGRGTPVGTLESGKG

SEQ ID NO: 1000342 - protein, 268 aa, Homo sapiens
MSLAGGRAPRKTAGNRLSGLLEAEEEDEFYQTTYGGFTEESGDDEYQGDQSDTEDEVDSDFGPLDCTGIDPIPVSVAERKKDAKDRNTRRCSHQGPITEPLNELKASKGQHPGWLALRRRDEEQQAPTATYELQRLTALTARKSMRHVYQLTHTPTNVPSGTGDGTAHVNDGDNGAPLEPATNPRTERAPGRPQITHRRSTFTGQLEDHLTRLARLLPHEARVLQTREAAPGPTIPYSSRDHRPPPRHPRPGRERALNAPPPPPPGRS

SEQ ID NO: 1000343 - protein, 286 aa, Homo sapiens
SGGGAAGGGGVCRWAECLRWTRAWYAPAPTTGCVYADLPEYLVPWLDCAGRTGVVCRKWHGRCQWDRVPDGGMRRSTDVLPGGHASVTRHPVVTVLGTKDFHRADMTTVPCVEVQTSAGIGSRTGPCILKSSPDSGGYHVQQSMLTLDKRVLNDLWRHTTLDLSQRVCNYALDYDEITYNLRGKESKFLTEFQIRASESANLAVGLCEEVLPLAADSEIPCIHGEKELLVYHSTYDFTFSACLVSSELREQWPEWTVFGLFGSPDELGITLVGYLAPESGRIIYRL

SEQ ID NO: 1000344 - protein, 119 aa, Homo sapiens
AELATLRGRNAAVWNGQVPAAGVPRQPVSGMSNPSAPPPYEDRNPCTQASALGAMGSICLQEVSATGYPQPGYGHPAGYPQPCSPTTRCPERTDQAWTMTRDEREESDRPGPAQWHEQD

SEQ ID NO: 1000345 - protein, 125 aa, Homo sapiens
SGLSPHINGHCPPRQHLLLWAAPRTGAHDGEVRTVEKRETGARGQGAQERPIQTAMLKAKGDQRPGIQGESSASPVSLGLILSSIKMRNRGLQEHGGSHVESPLCVEPRRVPFLWAAILGVAPPV

SEQ ID NO: 1000346 - protein, 99 aa, Homo sapiens
MERSHSLRRITIFRNQCTTTALHTRGTYRIHIRTLRDSSRPENAQRMRPHIKTMYEHAAHEPLTEAYCLASLTTVERKHIQQSRTWPVRYHAVTKRSNA

SEQ ID NO: 1000347 - protein, 107 aa, Homo sapiens
AGGAGPELECMWRDLELTAGHPLYTGVQADSSASASRVGDSGHGHMPQDLPAGGPSMSTDMGCLFMRCRPMTLTLEWLGLRSLLCEEELYGVNAELSQLQIYRDALS

SEQ ID NO: 1000348 - protein, 78 aa, Homo sapiens
SGPIMVDPDLRYPSVLDRGLLQLSVNVDALRHLLSTVQNESYSCNIPVDCQSAVLCVYHCEVVVAESTHASNDEIPAP

SEQ ID NO: 1000349 - protein, 385 aa, Homo sapiens
MAVQAAEGVSQRRPPCTRPRSISGVFSRFLVPARGTRRRKQANHPIANDFMGRRTIASGDIATTADGRQIETGINRLRDAGSRHAETMRAFDPAEQSHGAKVAVEGDGQSVRQSTHRKQRAVPGHIHAEAAHHSPNDQCRQTFHHIKTPQRIDYTQGSTGPEARSILRRWQQDEGNTARIMEKGSQCRRNPESPRSARRRARAAGNRRPSGHYRVGSRRQCATLMVPRKRHWHCGGTPGHNEWVAQTIKGPMESKLPKKTPEGHIGGKETLSPGRTGQRTVRTPKKNARKRGSHSTEGETPMSNRQGGTSTTVGTPDHPEGTRRGHTITKLRECITPRGRAGAPLKHYSTGRDWHNQINNTEVTKRGGHTMRRYPPPERPTPKRQ

SEQ ID NO: 1000350 - protein, 69 aa, Homo sapiens
AGGCHRAACPTSPVTGGCMKTPGVLGGEGSGAMQVAEPGACGALAAVLRSCGPILIDCRYMSEVIANDS

SEQ ID NO: 1000351 - protein, 125 aa, Homo sapiens
MVVNPQAPRGHDTHDKARPVLYMALFLSDVKQGEAAYSDPWDHCRVVASGLCRTYALHSLSMGIFPKELNDQDRRFGSRHRKGIGQSGKCKNRKGGLVDSIVVGYFTGKAKKNGSEWQGGRLTRH

SEQ ID NO: 1000352 - protein, 49 aa, Homo sapiens
MSRIRRKPFDCRLTLDTWVCRPMDGSVDAHHRVTRADGCGYPDGGQGEL

SEQ ID NO: 1000353 - protein, 108 aa, Homo sapiens
MAVERNLSLLKQDSSWAAQSRKRVKPSNCVATDEGRLMASRSDRRVHVNECIAVCHEIRICADLSMTDRDVVVESPIQQGTLMRRRSDKNKYVIRDRRGIKKRTLPSK

SEQ ID NO: 1000354 - protein, 235 aa, Homo sapiens
MRHDVLTTDLTSPSPHLEEFLRSWMGENSHGTAGSKVPEGVRLTEVVVDIVRASLIVHRDLSTTGRYGETKTTKGGHTSDALVLARDPRHAPAVDVGKYRCLGTVIVVAELRLQEFGNKWMEAGTNWPWPNSPRWVCAVGSRGEFSHCEKSWDAVAALEAHPNADTKVGYRVAPLYPVIARCPVGMDTFMARMLERASLDLGDRDDEREPMAEGLHLAIPWDRLANVDTQISSTK

SEQ ID NO: 1000355 - protein, 105 aa, Homo sapiens
MGESVFVAWNELRWWDLATRSMNDRQHERGRRGEILDDKLSKTDKWSLDETPLESSEFLNNSDSYIDRWLLTPCCVCMLINSCETDLDPVAWVSEFGAYAVRQVH

SEQ ID NO: 1000356 - protein, 154 aa, Homo sapiens
MTDRLMALCRSVHSTSPVPESIPAGEHVVVSGGPVVALVRQPAHLRACEVMDNCELTLIPNSCVPTSEDSLVMHADGHAGILRSITSCRGDRDTSWHPWFQEAHWIPDDGDTLRDPGSHYCPPLGLEARYEDLVQGLEQDGPRRRSGKLPLQEK

SEQ ID NO: 1000357 - protein, 77 aa, Homo sapiens
MSVLSITRMFQVEMAVGRSPDARGSIRTSGLRRVSRIIKVHWAHLRPNRKHRGGPQRQDGYRLWGSEMALRNGTEGL

SEQ ID NO: 1000358 - protein, 113 aa, Homo sapiens
SGAAAVAVADRGGGGGSPRWRQLATSEMAETVADSRRLITKPQILNDAYGPPSNFSRDRCEQPAIRVVGSCRGRFTTYEISVLDRYLPIFNADKKIYVLDRQTTVSFELAAEV

SEQ ID NO: 1000359 - protein, 111 aa, Homo sapiens
MCTDIKSQENYTDPQQKEATTYTPHESTRHEISHSNPKQIIAKHPHRQGGLTGKTKQTHHDRHDHQPRKQNEARHQNTTRENTRTITDQDTSQITQTNSQTNQYLTPHEIK

SEQ ID NO: 1000360 - protein, 254 aa, Homo sapiens
MGKVKVGVNGFGRIGRLVTEGWFSNSGNTWILLPSNDAFIDLNLHGLHVPISFHAMANSMAASKAENGKLVITGNPITIFQELRSLQNQSGAMLAAEYVVRVHPGRLYILPMEEGWVLICMGGAKRVIISAPFCCDAPMYVMVVGTYEKYDDSLEIIINASCTSNCLAPLAKVIPVTSFGVVEGVLITVHAITDSPEELWMALRETVCSDGRGALQNIIPVSTVCCRAVGQVIPELNGKLTGMASVSQLRRVSG

SEQ ID NO: 1000361 - protein, 85 aa, Homo sapiens
RAFSPPSSPSSRLPAGTFSRCRWDPVVIDHARCTMSPLRKGGDWRCKTDPQSIGQIWNLTGTTWYMSEIARMLGNTLAVTLRDVL

SEQ ID NO: 1000362 - protein, 137 aa, Homo sapiens
MTIVFTLFSFRGGVLAYVFVPGLHTEGGYVGDFQRRELGPEGLSPGLVPWFGEHALCALVPCRPIASLFDWAACCRIAGTVLGILNSPIRPRDAFRALVLLKGSLTLNFCRGPMRGYMENSSVARLFALSHPCVHKH

SEQ ID NO: 1000363 - protein, 35 aa, Homo sapiens
MDASIAKASSRRGRVRSVANGVLESFASITLCMGS

SEQ ID NO: 1000364 - protein, 239 aa, Homo sapiens
AGRLVSPVRMSTTRVLLHLTRCPLLLCAAVPVLLCAAVAALSARPLRRWVGVQAGGAPGAGALMARPNSMVVEHPEFLKARERMPGLQIWRVEKLDSGARAHQPLLETSSPGDAYVILNHSAAEGTGNLQYDLHYWAGQMSAGTDEKRGHGRHLYRASWIDYLERPGATCSNLLKVQGLSKSGPTILQAYFQGPGPDSYNDRDGVPIQDFKPPWLPNTTLACVPQDSFPRGQNVGRHRS

SEQ ID NO: 1000365 - protein, 149 aa, Homo sapiens
RIETLSGFAYARLRRSELSRVLPCEVCECVGSIREPSRRQLVSRSTSGISDSNPYPGPSVEPAELNESCVPRIYRTIAEEGLARSVLCAVGAVDARRDCAARSGHRDMMKHFDRRRRLNAGSAQIVYLRNAFGPCKSRIGIPSEWTGNR

SEQ ID NO: 1000366 - protein, 130 aa, Homo sapiens
MLTPREFQNLLLERLGILRGGTCVSQNHLMEIPTRWEAIAGQNWKMSGNPGTGRQDAMVFKKDQFRGWQRPFLSRNRPIFGAPKILVVPLFPQTGATVGFDIRVNVGSPLHKRGFALGGTGEPLDLWGPP

SEQ ID NO: 1000367 - protein, 177 aa, Homo sapiens
AGSAARRSTVSARALRDLSNLVPSRLCPSPGDARTPRQPSPPPASLHAIVAALSAASQSVWRASPLRLPGWPRIRSASPEGWPLLRAGVWALLCFSGRASQLADFLIESIDFSQRYSQVDPLTIAMKQKRRLHTFDVHVLVQSYLGHLCRRILLVLIDTCGHRFLVGPQRALLTYTS

SEQ ID NO: 1000368 - protein, 265 aa, Homo sapiens
ERAHCHRPRDWLGLARPRALLLGALLLGRRSPQPPASTGRAPPPWSRLSVGAHCLAAAAEPGSPAAAERARASGPLAFFYLGQPAPRCEGAVLTETRPARRCDELLRLRAERGGGNPPVTMPEVWKRGRSTRQERRRNILTKTTFLLLTNERRTSCVLREEMVTSLAPQRTPNKGGWSHQGHQDRVHRGQNRTLLTIAGNHHEFVSLVKGPWPGLERSPSRRPSTLSFTHVEKAVLRSYTGADCEAHAYFLRATISRPLNDVVNE

SEQ ID NO: 1000369 - protein, 125 aa, Homo sapiens
ERVGGVRSRAGVGGVLGRACAWGRGGARQLTAESARGLPGPPQAASAPNLGPGDIAMHHGSSIDAPGACQPRYRDSAQIHSIGTYSDYLTDTYTDANLKTTAARNRQEGHPIRHVGTTTRLRPKD

SEQ ID NO: 1000370 - protein, 231 aa, Homo sapiens
MEFFPFPVHEDSVGGRVCGKESQKGPRNPSVPYNPPPDTLHTHTGFSETHTKKLPVRGYNSRQTPNYNVSVAEILTLPQTDSLNPINTQFFTTEAPKHKHVYLRTVQPKQKGHFFVVAHLGLPGAVTNHTHRQADDSNNTSSKFSQRGNITMCEAYPIFCTPYIVTLNPGGFAAQPRRGGSWGGTRGEKFSLGPMTHFFQHHTRHTASKHTFSHNELSAPPTHNNHNTTAT

SEQ ID NO: 1000371 - protein, 108 aa, Homo sapiens
MVDTTASFYLDVLDREVRATFRTIGREGDEGPKPYSLALVDPDVTVLDPVYVKRLTEDLGDTFDGCHVRDKKYFLNKWSRNAREDIFSMNSLEQMGQCELDELFVDIS

SEQ ID NO: 1000372 - protein, 102 aa, Homo sapiens
MAAAGYPGCGGAGSWGRSALTDGLGDLRSVAAGEAGERRGREAPQCQYHGMMWPHRVSSLGLMEEYVAEIFVRKLCPHNVQVCLASDDVRRSVSILMASSQC

SEQ ID NO: 1000373 - protein, 122 aa, Homo sapiens
RGSLVIYSSQRLVPDFIWLLLAELTESSVMEHMRLGFSEIVSAMAVSGRWYRGFARFAGSLGAGSADHVNTAPSSVSEIVKWTHVENEAVCPRIQRRRKPRNLELCICSQERAGLADGVCLP

SEQ ID NO: 1000374 - protein, 76 aa, Homo sapiens
SGAGRGGGDGDCRLSREIRVLLTEMERLRSSTMAQEKNLCKAMLGLVLTRAHNSQGTTRNNRVDNEQVIEIHGMYR

SEQ ID NO: 1000375 - protein, 103 aa, Homo sapiens
MGYLLSPLFSPEPLCLHSIGNTVSHSQVQAAKANELKADSGETLNPATHRLAFHLGRRQRVHPPVDFPCPNGKVTRSYYKRETTDILSGHAIKSCTTDDGTDR

SEQ ID NO: 1000376 - protein, 183 aa, Homo sapiens
MCVQSHDKPGDINDRVSARKTLFLTNAKNTRGTERLIKNYTYVAVHRTVNQACTQEQVLISNTAHNTAAAEATTAAMLHTNTATQLKPHNEYNKTHRRHYNDAPNQREAKQEMREPHMPEQNHQRKKKKRVTMWRSQTRTNNRDTHTQRTPQIAPPYNQNATKRQLETHTEQERHTSGANRNS

SEQ ID NO: 1000377 - protein, 76 aa, Homo sapiens
MRLFQKSDDIQSRVEVLTDSWQAWYRTKLKNVGMPSCGRTCGRASRSRTLYHREKCRDYEPVDLRTECALGGPVIH

SEQ ID NO: 1000378 - protein, 150 aa, Homo sapiens
SGGAAVRGHDQELSLRQMTGSSFQDERMPTEACGVGARCTGETEELPLVIGDSYWCQVQQRSYHCLVLAPVSLPQTICWDDTCRPVTHGRHLPQSGPPETSTPSLSITQKFQWAPRVPAVNCVPSECCRNEDMQDLGFGADDKTRKHSQA

SEQ ID NO: 1000379 - protein, 82 aa, Homo sapiens
SGGAGVVLLREEEWSRGDAAAALTMSFLGGFFGPICEIEYRSSMMGKPRKMAEMNTVYDGKVEKHYLFYDGESVSGKGKPSL

SEQ ID NO: 1000380 - protein, 162 aa, Homo sapiens
MPLGDNREVRKMYGPRGFAYAARHATSVTAVMGGPLVVFKFYSGNTRKRPLWEIDKSLFANFEFCYQLGTFDFHSGRQPQDNVGPWVFWAEFRLLAQTGKELTTEEGWCGLHPGKGTAVVDNQRLRNSKIRPVWRLAKRLFRTKGQHYSREWLTHPESTPFG

SEQ ID NO: 1000381 - protein, 232 aa, Homo sapiens
RGGRLERPGSFQLNKVRHKADYSSRVQLESESQTTVVLVRVLCTDVWYGTPFASLVATESCVLVWGGIVFCGCGDMKALNWRAVNSKVEDLFLQENYARLVSTSSVNVIHAVPRNVYLLEAVVYILLFLYVRTTHCLVLTGLRTSDRTTVRQILGDYKTSICGKGLSAMETGGQTGEGFQRPSINAQYRLERVCHSCGKMARTSSTELSQGINYVPENVCVAPGVSLLVLCM

SEQ ID NO: 1000382 - protein, 207 aa, Homo sapiens
RAGFFACNHGNFEVCPTIYTWEQELHLSLTGWKKWVSNEGGRAKRYASQRKELCQSPPVPPGCKSRINGGTFTYDSIVQFHGSKVYEPMVTGPAALAPEGSGWCNAQGCEPLRLSQGLMIAPSKSTMLALPRDPGLLITPHAGVHVIQEPGTQRQELLDPTYMFLFQGVDELGNPSYPYAPGQCTTHTNAHLYPNTQAPSQVYGGVT

SEQ ID NO: 1000383 - protein, 238 aa, Homo sapiens
RRGFSNTSGLQRRSLPPLPRLQTLKGDLLLLLLLERSIAHSVSAGILRMARPAYPSVVPRPAPISQTAATAASACRLRATSGSRADTAVQARAQRTLRGSLGLRGRRLTSVAAEGCGGPGWIADIGLDNRYGIDREEGLDCGYGDRIGDMGLGSSGGQGTGQVKGDQGRCLLIKSRLVWESREVTNMTVYGFRSHRGQTGPWATIDHLYTGSGYPNPGNRNLQKIHKADCTTGEARAN

SEQ ID NO: 1000384 - protein, 308 aa, Homo sapiens
AGEHFDGFGLPGVDYWVSPMLDSLLSLSPFSELVPLLLAYYSTYYNYLYYYLLYLLYCKDYFYKPIYLPIYTLVDHHCDYFCSTTTTTTPITRHYRSTSTCTHRREGTHTKQQGDSPKREYTEQKRGRDDNAGGSHREKEAEKRERQPEKGKPQKYAESSHHERHRKRETRRDTATHKHETNRQGDNRATRGSPRSENSTHENDTPKNHNLIAEKRKTRAQTKAADDAAKKTKKKNAKGRKRPPNENRNTTVTQEGDDDKTHNQRHNNKTQNSDEKHRTKHREKTKTKRKTKKAQKTNAQEKTQKREQ

SEQ ID NO: 1000385 - protein, 72 aa, Homo sapiens
SGPDPGPQMPTRIGPDTAHDLRSYPYIFETNHGEASAHLQRFYHSLQLTDYNEWTNSVQGSERVSTFGYSTE

SEQ ID NO: 1000386 - protein, 172 aa, Homo sapiens
RSGAATHAARAREDHQRPEPQSEAWLPGVCGRGELSTCEGLAGAGSKRVRGAKEPQTVRRQALAKLLRAPAPSWLGDSRWVSETGASGLQRNEHKMSHWYPLVLQWSIKVRITISGLAGTMPKTEDSSHGPWRYEPTSMEAHKMGYRIPFELNGVCGVNRTASNQTESVAMT

SEQ ID NO: 1000387 - protein, 238 aa, Homo sapiens
ERRGWCWNLPPQCSRRSVLMLPGSGRDKTRPPVLGKARVSWLGVALSDEPCRRGPVDAVGDCAWSLGMPAGFAPGVSVSPRGARGSSRGGSMRAATLAGCGAQMTGHLRVLRLPTRSYPRADMQQMGCICVFAFVGFAMLTTGTIKVPVQLTSEMGCDECFECGPWVSFAWRFTYQDALVPMEQNPLLGQCPDLDSPLDLARRIGTYFAVHFDIFRGRKLIGQIACKLALALVFVDRN

SEQ ID NO: 1000388 - protein, 99 aa, Homo sapiens
RVVENGGARDPYVVEGLLRGKPSGRYELWSTDLPGAGAGRRAGLLRMSYVLGRGSDPNSFLSHPMGWTRVRFAEAVNTVIIPRGTRGLEASEDVYSSYI

SEQ ID NO: 1000389 - protein, 151 aa, Homo sapiens
AGCGVDALARWRGAGSGKSTSNVSTFDERPFSVADMKRGQARGCASSTAAWYSVRRRCSVDELMRPKLSKLPLSAAGNRVGTGVTLREMCMKNAHVTDPSGGVICLVIIGDKIRTIGKTTHLQTYRKPAGLDVYAGFVPMRTKKRPKGLKG

SEQ ID NO: 1000390 - protein, 231 aa, Homo sapiens
MYCSELTLSDLSTESLRELSYGRRAAVELLVVPVQLVAEPRLQHSAASRWLRWPPVAALASDLHQGWCCTTQRLPYSLPLTEALGDSADLEPRNWLGGKHAKRTLANNCLRDLVSNPTLDEAKFCLSNRRHEATGEGHIPPLISSGYTCWGGASQEFGQHREHDDLKHTDFDLRSQLTRIEVTVYSCRRYLTGSTECEPWQSTPCNSLDDPPNIRERKTGLFLAELCAVIP

SEQ ID NO: 1000391 - protein, 175 aa, Homo sapiens
AEFWEAAVEGGWWLTPSLALTAGRYPTPGTMFPAGPPGTDILRHHPMTCKIAATGGAETDGREGDMRNRRQHPARRSPPMRKHVVIARRYPTVPQWTCYTEAQAARTAPEHYNGCQPYPTITQRDTLHSTIDCATNNVATPQPFTHSATHTHLTEPHPTDARRGHAAPPPPRTDT

SEQ ID NO: 1000392 - protein, 220 aa, Homo sapiens
AEWGRDAELCASPTQARSLPGAAAGFRRRWLGSGEERHQRAPYGPQVRRGRAVRSRTSSSCLKPAGACGRREATTRRGASSRVSRCGRRSSLHLLARDRLSRSASLHSLRRSSRACRQADGSTAAGTEHKGRTPGGSEGVPPTAVWCSEPIRPVHAGQAGMLWAAPCIQAIHSEGPFELTDTSSRCPGLQQRKKAPALRISGNALPCYEYNNGLRRRHRR

SEQ ID NO: 1000393 - protein, 78 aa, Homo sapiens
RLERMNQVELNDGRSVLYGYSVYDPVCCLLSVQFAPVHNFVLERAIYWLSDSGIVASVVNCALEYIDIATSHYSMAYR

SEQ ID NO: 1000394 - protein, 96 aa, Homo sapiens
AGGLDVSYLAWRPGIAAGHWSCKWAQAWSFQDRQDVCSLHAWSSDLPLLRGPLRVALIRQLEATEAFLSPGAVPSRRRNQVIVDEAPTRWNRNAGS

SEQ ID NO: 1000395 - protein, 111 aa, Homo sapiens
MLGVDDYLTGILHPERPMEMVLRPSTKDPGRISRTSVVPWRVVAGEMDAGKDQHRAISIWNRIVQASIWVSGNTLLFPERGIRRTLTVADKGKPEEMASHVEIRSSRLMQK

SEQ ID NO: 1000396 - protein, 105 aa, Homo sapiens
MRWGMGPEGISYVERLKATVARVFILTLKIRQLSMASIHQRGNEHVSKMRGQPRTLTNNRCFVLEVVPREGKQPQLSCWTQKDDLEIANGKHEDEKIDLQKLLVG

SEQ ID NO: 1000397 - protein, 113 aa, Homo sapiens
ADWSDRSRLPPDRRSGCTRTRSEIAELCGKLSAVVDLAIQIVQSIDISTGYRLSSACMTIVLRTSTSPEDIRLNRVVAVEVEGKMVGRTMKVTVVVTQLIGGYARPAEETRGR

SEQ ID NO: 1000398 - protein, 121 aa, Homo sapiens
RVSGSAKYSREKGSSARWELVVRIPANVEKPGACPGLSVSSHRRVNREPGPKVVRICKLTLLSPWQSYRKSLQVSQMRRELHVDSRRLMSLASLHARPHLDTLVRLACKAISKIKEGTLQR

SEQ ID NO: 1000399 - protein, 121 aa, Homo sapiens
ERDGCSPPFLPPQALAVVLAAKCRDWARQAEVVGDCAVFLESPRTSSREREGSASNCARRTKRQVRYLDKTQTILGFVSLRHSIHINKLEHKHDSLSRSDMAKENPKVNISQERSNVTTIR

SEQ ID NO: 1000400 - protein, 91 aa, Homo sapiens
MGRKRGPEQYPSEPVGEKHGGNTGPEGKIPRGETSGGTPPRANNRGQRKNTHRGNHWGKSKGVRPGHGKNTQGHDSGKKGQAHQNRRTKRN

SEQ ID NO: 1000401 - protein, 78 aa, Homo sapiens
MCRVPTNATTVAPVLEDTYTDEVTLIRRQNQLKEEAKTFKSNFFSNFSSVGTNIQPESITLGPTYLATVNSSDSDNGT

SEQ ID NO: 1000402 - protein, 273 aa, Homo sapiens
AELLPPAAPVPELRLSQFPNPPLPLPDKPRYSPVETLDLTHNQTSFLLPPGPPSIGVHDSPSGPRRLSTEGNAKATPGARFGHPSLRGDKDRLERTGRRRRQNSVTETKKKEPPETARDTKGRSMETERARLYGHTQGQRPQRKATANILAQPDPRFPHERRPAEDMRGHKSRRRHEQTQKTARAKEQKGNSTTRQKYAHTPKHSRLANTTERHTEHSRHTQTSTTKTRNTTGHSKRHQTTDSSRTTPQYTHAGRKVHTRTPNRQDSSYRRAR

SEQ ID NO: 1000403 - protein, 49 aa, Homo sapiens
MYRNRAFVNRTMNSDVAVTSWLPWELNIKEWELHSLNVQLRMGQERIDK

SEQ ID NO: 1000404 - protein, 78 aa, Homo sapiens
MPDRERLGQVPGFIPYNACPWMQGFGVTYHYRGSASLFYQIGNVLWPYHCGGLHIQQWIGCDHSWKSPSSRTTANLLT

SEQ ID NO: 1000405 - protein, 121 aa, Homo sapiens
RKGRLILQNRRTKRTGVRTLAGWEPWLGITTHRGRVIAPKLQVAERKQDEMTGRGRESADVHAALQTEDSSRESTGRRAQRKQRTEGGCRVELPWKRAWMCTRGVGRNELEPMASRQRPWA

SEQ ID NO: 1000406 - protein, 61 aa, Homo sapiens
MPASGGTETDFSNLFARDLLPATNGEEHTVQFLLDVVDILLTYVRKHIRSLTKVLDYHHPH

SEQ ID NO: 1000407 - protein, 248 aa, Homo sapiens
MAAVSAGCNSGVLLLLLMAVTVPSRARGSGCLGRDWCARGWRGRSRGRGLWHWWGMLLEHSFEIAMTCANFRKRGSLLWNQHDGTLILSQRQTQQKEELGPNPRMWPALNGLYRVLDPKATRGPVMGWKLVGYVSILCTLSESWWESHDVGPRDPCTVELDGPASGCVGRDHGRVTGTHWGGTCAEEPEERCDRHRCDPWETMLHKAKPSISHELPRPRTRPKKATQGHHEAQEKGHHGRLAAALGTD

SEQ ID NO: 1000408 - protein, 213 aa, Homo sapiens
RERRAGGRLGNRGAGCSLPHNIRAAARGGKPSSRDPDGVMELDGRFSSIDNGSTARGGSTKRVEATADSQRHKQTTDRTGQREREGAKDAKTRNRSESIRTHHTQTTRRQTRGPERMRDQTPSNTGTRPPQTTEASERATKVSTIRHQAMIHRIQERDQHHNETPESNQSKSQTTEPSKPHNRYTHTEGETHTKKKPKETMRGRSTPAPRSDN

SEQ ID NO: 1000409 - protein, 140 aa, Homo sapiens
ERVLRWIQRGAPTRGEEVVPGRRQEEEREHERGAESSRPAVLSFLEGKGGGGKVAPLEGQRPVARGLSQVPAGGAHSLAFHRRGHTLVLVSSRTLPPVRALPVPSLPRGTSRMTGQPVPMLPGYLGGNICRRTVDALGSE

SEQ ID NO: 1000410 - protein, 283 aa, Homo sapiens
ADSSGDEAESPSQMKRSKGIHVFKKPSFSNKAGTRILRTKTTKPKKENDIHRPEHQAQTKKHNNTTDDHVKTTLTSRLTGRLNQMDTDTDRKKKNAKFRTPRRVAPSNMSDTKNHQNPHYLKEISVLDMNCTLGRRDSNALDIEYETMSALHKARYYPDVNGYSEITDTEEQVNGPIEKQRRGTSYQRRLSTTGHTMTQNPQQALGDLASPEQTRDHEPLPKEPGEQGATPSNQRNRLEATSKLKLDDTITTTTGETKHTQPRPDHRQRKHKEQHATLAPTKR

SEQ ID NO: 1000411 - protein, 199 aa, Homo sapiens
MTSKGSGTVWPVAVSSGDQRWGSLTVWCRPIGACVSHRDGTCCLTPRGDSVVYRDVLQNRFRPCTRAELARRSCSCEASPRDSWWCGTDPLGLLQRLPGPFLCASDEGPSLNMAWIRYKLALQPAGAPGTRVLVNDYGRGGTAEPLEPGDPDLPFLDRVRCARGGLAWDRPSMRSKENRVQNSYTGRGRAEQMFTPNRP

SEQ ID NO: 1000412 - protein, 87 aa, Homo sapiens
RSPAGWFGWSGGLAVLGEGMAEYQECRDEGSGRIWPWGAEAQAGDEGYFVKDIKIWASGNSDTLYLSMVAGLHMARDDAKEQERQGH

SEQ ID NO: 1000413 - protein, 148 aa, Homo sapiens
SGDEIFPVPDFPVDLLRMIEGSQDPVNDHKNGWSRSTCVSKDHWLQYAFDRDHYPRTITRMDYVSAEHSWTGEASNIQGMDCLLADESSKAMRLWTIHTRGEMCGKAGLVDDFEMKYIALTVPVPEDTSIAQVDAEENRECEYLVLSG

SEQ ID NO: 1000414 - protein, 119 aa, Homo sapiens
MVAPATNPGFKISKERYWRINLQMEFSTLNLANYSQKLMSRAHRPIKLYWRKMVQKDKAMANFRDGDSFYKFKNSPNGVHIPHHHKKIAPKYGVLEGISWAKQKNLMGIISFNYTLPKF

SEQ ID NO: 1000415 - protein, 141 aa, Homo sapiens
MGRALSGPTLGPRWRLAGPPNRTRSPQLCSTIKFRRTTAAASPRPHSARRTRTRSHEHAGQPLDANGQAPADQDPIKGNTARHPSAETNPTTEPATRRVLASHHTQGSNKGTNPVPLNYNYGALPTASERKQAAAHGDNER

SEQ ID NO: 1000416 - protein, 64 aa, Homo sapiens
MHRREAVRWPYLCLRRYGYDSSSSPLRVAAECQTGQGIFAFKCSRADEIFNLLQDLMQCNSINV

SEQ ID NO: 1000417 - protein, 80 aa, Homo sapiens
AESYLRRESSGFAGSTVLRTEPGARCLTRWVDLDSPPSHHIYRTHRTANWGLAGLIAPTGRWSTLGRADSRCRQYISARQ

SEQ ID NO: 1000418 - protein, 250 aa, Homo sapiens
AASAFNSWFENAEEDFKLDPVRCNSLSRNQPLCARPIDAFRSSLSVCDRLIFNHGWPSWTAEIKSFRASLQATTPGCTMEAQEENDELRQEVGPARPTPCTSGSKRPGHTSSMGPVVDESGTLESQFEATKRSTRKFRATENVSSTNDRGPGGRHGGRPSSWTHKYTDAQHREASLQQWDQLDQLGMRMHHNLEQQIQARNTTRVTDRGPQRIQHDVIDTLDKDKSGRLNHQEFKSCLRSLGYDLPMVGG

SEQ ID NO: 1000419 - protein, 261 aa, Homo sapiens
RKRNQAAFLSIGVNLKPTGNSQFFPITAQLKTLINKYYCAVSCHKGRVEGTVPFGVVRFHSNPHAGTASPARTNKPNDQQAIEQRRSEDKEEENSHKTSGKRHESLHSESAGPRRRHGDVNTPTAYTDQEGNITRATASRPKRRDRHTRRRTRRNQAYTNQAKHPNGHSPQRHETQSGRRNKSTDRQKPPHSKDQTAQQTTQDTRPHKSCIRNVKDQDDKIPEEQAAGTHATRTRHDTRNTTSTTRRGPMPREQIAKDLKH

SEQ ID NO: 1000420 - protein, 304 aa, Homo sapiens
MEWIGLEGEAIIDNIFITMYRMDDSYIGVVLSNSYSMYYCALRKSDMIELENVMSHCLMKLYRWVRDNNSDGNRRFIMLEEGHIDEKQRHYSHNSFRHTSIALNEPLKLTRRDRERNSDCNARVALVRRTQEFCGQAKEGLYYQWLCRGKVNPVICRYENHHGITSEDTVVLPYNTFETKKAYLGKEGQLPSECVTALTFTHPFAFRITKYTSSDGAPSPEARKLELRLAPSRRFRRCVATENSKSRMEITVWLFEDYFGPIFLGSGNHTFQGSWAWFNFLDVGVTYINVLNTPAPYRCNSYHE

SEQ ID NO: 1000421 - protein, 257 aa, Homo sapiens
ADFRVAAVPEPEAAVAHISASDPAAPCSFRCWMGPGVTPHWPACVHTHVMLPLPEPRPAARLCGAGCPRRCLPRPLAPAPATGSPTCMAPTCAAVPAQSTSTPMSWAPCKAEDEANQPFCAVNMKEALSTERGKTLVQKKPTKYPEWKSTFDAHIYEGRVIQIVLIAGPAEEPVSEVTVELCQVLAERLKDTNGKAEFWLDLQPQAKVYDVWFSISMERRALATHVLCADEDDGQRPNRVTRPGSHSHQGQNPLTSR

SEQ ID NO: 1000422 - protein, 104 aa, Homo sapiens
SGVKQDLGPWILLKKGSHGREYGRGTDDKKKGVLNAVSHAWGAFPYASLIADLSCSMRVSPVSVAARAMKRFLELINILLNAYFVDGKNCWRHYWMLSPMIEIV

SEQ ID NO: 1000423 - protein, 183 aa, Homo sapiens
RILFRQNTKWRMTPVQRGGPGALVCPEMGEPTVASCVRFQASGDGARESQAGGTGDLGREASASSAEAKALRHNGSGCLVHQVRACLVEGTLNDPRFPWDGDSTHRCVHCPDVTEIMTIDFEYSFAEGAVLSIGLKSCLERIELHRWPGKATYPAVTLGARQHPEGFQNGHFLVCGSLRSEVA

SEQ ID NO: 1000424 - protein, 244 aa, Homo sapiens
MAHGDLPTGSEKIWAPREDVAIEIECAEGTLTWPSRQHTRKRKTLEENVIDRAENLCQHADTHLSDTARIENERTRRFGYIHVGSTACAGLTVVDTCNLETTLDVALGRERCWYALACQTCHVGRLPLARLQDYVIAEKYNWQLRASCEVGAPRGNRRLLGTYGKDMSGHRGDSRGRKERGGKQPRRSIGDNTSLHARRKTSRPREESRVRVFGRELRTIPACNFTPIRAQLNADWTYSRMSRA

SEQ ID NO: 1000425 - protein, 213 aa, Homo sapiens
RVEAPRPQPRPEGPADARLESARMAGAPAAPDGLPCACVLSAGERGWWQLIAVCSAACGDVGPSVLPRQHHPSILAPWPHWDERKSRPVPTLEAQPGGTPPGHGGHRRYFTHGTGPGFILVPSWDRNGMYAGPGEPWAYITKKAPRPFIPNAAPKWRFPAGFPWHPGHAFSPRGTRFYPSFGNPWKMETNPSQQFPFTTATKQWCGPIMCQVQ

SEQ ID NO: 1000426 - protein, 123 aa, Homo sapiens
MPEDRARMCLHGNVRFEFYASMREGRAIGTDSVFDHWDAYRQPIGLGQYLRYRDNVGWKRNIRDQSLRAIDNSAIAHRKLTNQGIKPNSCDKRTSIRIRITTGNLHKLLTNRTTIQPGKDLIA

SEQ ID NO: 1000427 - protein, 119 aa, Homo sapiens
MRETMILTVIRKKHLLRTCLGELFSELAELDKENYEKFYEAFYKNLKLGYPRRLQLTAAACLETACADHTSQSGDEMTISVQSMFHRMQGRHEKSIYYISGESKEQVANSGCVERVRKR

SEQ ID NO: 1000428 - protein, 187 aa, Homo sapiens
SGVTTCSRPGEHNLPRSPGPEPDPSLSPQPGAQASPPYHGRMTQDMRNELEEMLGRADQLADESMESTRRMLQLVEESKDAGIRTMVMLDEQGEQLERIEEREDQINKDMKEAENEFDGPRRNSAGFVCVPVDKLIIKDAYIKSLEATNQDGSGVAVETARVVDEREQMSISGGFIRRVPNDARDNE

SEQ ID NO: 1000429 - protein, 224 aa, Homo sapiens
MQNVVNDYSEQLLTYVATGHRDFQVLVARAIGEFTEQLLTINTNYRGVNVDSSHRYFSVRTDIYDMSTENTLQELQPWQFNSHNLTFDGRTCIPGLYYRATNNHLVSSSKNMRRTRTSETQYLGKNHFLTPWSGHLRHGVHRAAKTPHEHDIRDYHYTTTILNHTPTLDLQATNLATIGTTPRTGHRPPADATTGERTAAPPAQPHHPRRGTHRQRDHTQRSPT

SEQ ID NO: 1000430 - protein, 85 aa, Homo sapiens
AESDWKERAEWLCGSSSRETVWLLLLDGCTELYVKHVTIAEFMEKLIHYLTHMMVMELEHTKDHWDTVTLEISWSQNSHRMQSYT

SEQ ID NO: 1000431 - protein, 148 aa, Homo sapiens
SGLTGMGGCSDPGLPKGVPQQCLVAWAVTLSLKQRNQFFWAHEVAVPCSAEPRVAEHASCNSILYADSVRGPVATSLALVWRLPWSQNEARESHWVPDLPGTGDRSPNMSTYHYDFLHGNERPPGNCVDGIMHLTRPASRLMWALECS

SEQ ID NO: 1000432 - protein, 217 aa, Homo sapiens
MVGGGGGPEDRSADDLIQLAYVPWPFRAIGVYRVEPVGHSVNEDGYSVPPAASPCHVARPQHSLLAGCSSIPFSHFPSSLILFFSSQFSAVHIAIARGNLDSFTLTVALARVGAFASNMGLYKARTVPPLSGRHLTFHSAGPRLAQSGARKEGRSVTFDLESPRELGRHLTHIAISKGGFNPEVEKGNLRHRYNGKEDTRIGAMRIKDREIEFASEE

SEQ ID NO: 1000433 - protein, 206 aa, Homo sapiens
SGVTSLPRAETDPHTISLCLRFPIFAFSARPIFSVGTLAASRELPTRCHTRSERDCHLRYVYQKHLQLDERKSKIDDVWCDDNCGVDTVGQRSRGNTMTRKGLLLVRGMTEPVGHARELSSAWGGFLANSGIAESVEGSIVRHERTYLAGKYIQEMWVHYRGLSGYIGLSCRIHTIISVSGCGVVIISTGDETLGREHHTTSLYPE

SEQ ID NO: 1000434 - protein, 96 aa, Homo sapiens
RGLTLAARIARRRMLGYRSPFSFIRNPPLWTKNDLLLYVYCTFIMFIKNVLKNALFHDVLARVIRREHAKSAYRVEAANRPIFLSSLLHSKLVADA

SEQ ID NO: 1000435 - protein, 319 aa, Homo sapiens
ADLPAGFDGVMSHRKFSAYSRHGSLGIPASESRSQHGSRGKGDDELPLEDCTRTMLGASSTDLPGIARLGIDFIIVLGSRQAGIQGVTRRTVVDGCEHLKKTARHGGCGALVRATVEERTFDVAPDPSMICLLRDAQFLWMNWRSRRVLLQNSGHQDLYAHEGLYQCYSSKNMAGWTDGKNARLVARTSVKRLDEDSSVTEVSPVSNCPGASIAPDFSVLTPRNRMGHPDGRSQVKRERHLLARSKSGLVPDERLDAARVPDGILEVIMGPRNAVLTPDVNRRVDPEGAIGSYKRGSTKSLGHHRQMGCHCTEPPEARR

SEQ ID NO: 1000436 - protein, 687 aa, Homo sapiens
SGGWQRAGWRRRRLQARRAGLLAVRAGMGAPPGVLALRLQVFLACPATWLGLSSRSDCCAATTLHTHAPMRPQTTHSALHTLDHGTSAFHLKGNGGLVTQAAGTLAVKAALATHGRSLLRGLQTPRTRAAELAPTLLRFPGPSLMARCAHVATWRWHLLRCGPSIAGRRHTMFPRATLFPFRFPFSSPRETTLVGTLAKAGRVGAAFACACTTGSAPANGTPSFTIWPESRNSFLLICASSLPVILLKGRSPNHFPLWRRPLYSPPRTSGGPNVPLSCNTGWPTTLWSHSRLHPISTTCAPIPPRVVGRVASFWRVSYSPKPTQRGGPSFWISSSPVVLAPTIGDSRYKPPVIPPPLCRTTLHAFGQTLSQASARAFKRSGGGRYTTCAPSHRNNCVAGLLLGANSGALLAEIPRPRQRASRFPQVLVTHPLSGRKPCPRPLFGSGPPHYGRRRAQRYGRPNRTPPTRATTPGAAQLGDDTFLSSRHPSAHAVPPPGDRSDVAPPLNMLMAATPYCGAYLRQVQSIPQRARTRFMAHVGPVIISDANPCEHVSSSIINAPRSAVFVGDETYFETPTHAARMADIPVLGERAEPQTKCGFGVNRHQQYFPRTQTIYGPAPPYLSNNSHLCAPPFCDHSPYFLLRDSRCRRDFPPRPFASYTHLHTKPAVPRDYRYHTLRAQNKQHISC

SEQ ID NO: 1000437 - protein, 195 aa, Homo sapiens
SGSILIPKPGKDTSKRRLQSNNFDEHRCKNTQQNTSRPNLAAHRNKQNKKEFTTIKYGFIPGMQDWFNIYKSINVIHHINGIKHKNHMIISVDTEKAFDKIQHHFILKTFNKRNIEGKYFKITRAIYDSPTANTILNGQKLNAFLLKTRKRQGCPLSPLLFKIILEVLTRAIKKEKEIKAIQIGTVKIKLFLFSR

SEQ ID NO: 1000438 - protein, 67 aa, Homo sapiens
AEGANDRGEEARNAGASTSWVGTMDGINTIEGVNGKHPKFLTSQEGVMYALSCGTDARLRDKIKLVR

SEQ ID NO: 1000439 - protein, 256 aa, Homo sapiens
SGVRGSDRSRRSDEPMLAVTHAGDMHILPAAGPAILREACACYQSRSTSATRHPVRLAVCADTPMCPGAGPTQRPRDNSKQLSWIEQKVSLIQALRLGRANKCDRLIRHHDYWTEGRHEYWERENDARNGTDLNLTVVTYCIGTTPQYETPVVQGTKLCILGIDDDRGDGELEELILLLAKRRRLDNHRMRGWTVPPQFARKSPLMCLLAISFWKQSTVESKTVTTRLAHAFVERPYNERSKGAEFLWGPDLKTKW

SEQ ID NO: 1000440 - protein, 181 aa, Homo sapiens
RALRPPAHLVRVCIARDGCLGRHGVPEARKHNVLRPVVLGLPCSREPTVSCAVTGGGAGAYWTDGACGCLYASTWHVSLDSGLLGTSQRRKAPEPRAVGLTLEECGRLSMAYVNRVEHAQKTRNGSGGNGFDGGTGLTCDTENGHIVVGWLLWTLWIGKKGHLVTISIWLCRLTEVGWNRS

SEQ ID NO: 1000441 - protein, 96 aa, Homo sapiens
RVVGVRVSVGGLVVVRMACRFYETCIAETDDWSGDNRMHQTCLDVQETCRSENEQAVRMRREDECLSGMTKRPSDWEHEPGFHAGHQWVWYSIGCF

SEQ ID NO: 1000442 - protein, 306 aa, Homo sapiens
AEFGAFLRRVCGGARLHRGDRAWQTPDRAEANQRARERLGPARRPRSSPFRVPAALDQVSFAVCHPRELSRLTFALCVYNLDSLGDLTAVRSYSFWLNPQALVGAQGGRMSQWLQNFSSLTQNSWSRFTMLYDDSFPMDIRQYLAHVVRNSKTGSTLPMMSHSATIRFHDLLSQLALINIVASLTADNFLLTSTNIRDKATRTLQDNFRKTQSRCLRLIYSCLNGSAQDKLPGTTPRALHQASVRGTYSQHHQLMFRPQPKRRFAQNRPDTCEQDKVLCYEACTLQPPDTHKHGHNDSPGQLDKPK

SEQ ID NO: 1000443 - protein, 77 aa, Homo sapiens
MIWNGSMGGDEKTLREETLKGNFSGRLQSWRHSYEGNRSSTMIIMNEVWPYALKSGEVIFIKSRASKSAFSGLYLYC

SEQ ID NO: 1000444 - protein, 162 aa, Homo sapiens
ADVGTVVGAATAVGSSCVLLFVRGERADASARSITWGDHGPRHVVRTSSLACPPVSYVPCLILLEDLRGLRHVYILMGASDARGVSRKVEYRVTVIYDRQHIPESALRLQRQLEEVTPRRVCLRWIACVYKQCLGYRFLRIDESNAREEACQNAVWVELSVR

SEQ ID NO: 1000445 - protein, 103 aa, Homo sapiens
MMYLPGPHQSTAGDVAPIIYKIREIADGLCLAVEGKMVTEDRRYMDDSLIGGKCLRYMSRGRRVPKAQVTQLDVYYLVCERGIICHELTFQQIEGLARNVHST

SEQ ID NO: 1000446 - protein, 197 aa, Homo sapiens
MSEVRLPPLRALDDLVLGSARLGGSRIHQQTREQMSDRAASINKPPSNVPNQTTVLCFGIGLALAGLRCGPTSLLPPSSSAWYVCGGPLAMHGCGQSETRDELCAACRQYATPVDVLPWPIVACRLASVVLLGRGRRLLTFLFSIAGPVLLILVHASLLPALTIKNKDGEREIESIGLKRTPMGLLLEALGQEQEAG

SEQ ID NO: 1000447 - protein, 350 aa, Homo sapiens
RVASTGKPYSAGGCGAIMLSPDALNESHAYAAEYVNTEHRSGADGKIPFMTIIDRCDWMVGPETSISTLVRCLQRKWLIELHTSIRYNRDETRQAPGERALVRVRVQQLGRTPSSILLARKLHDVSTLKPIWNPPIYLALYLETERLTEASRSRTTRIGPQKFSRAAAERLGSHNALLGAKQSISHPAHSQTNPLGRSPKTLWTANAIPRGPPSNVEGPLERFQTFSLGRALGLETDFATQKKRRRTSESNNRDGQRRALGMPDARLKPPWSNHTVLTPLTWFPPPGNTEKHHIDKRFTFSLTMRPPGSGSIPERVATPPDGRTIQRHLRINCSSLNGATSNMSNESTQP

SEQ ID NO: 1000448 - protein, 109 aa, Homo sapiens
AGITVRRGAGQCSSAMGRSAVEPCSNRIPGRAAGAVWVALYAPHADWCKASMKHESRFLQSEGHSVVLGRDACRAATTPSASENRRWLHRATIAMIIEALSSFDWFTPQ

SEQ ID NO: 1000449 - protein, 105 aa, Homo sapiens
SGAVAQATAAVDTSGGGGSQRAARNAGNVRAGLWPARGYGVRVVQCWAVGWACAVGVLSAASGCGRLRTRASVQSCIRARLHFGVSWLNRQLASRGRLLEEALAC

SEQ ID NO: 1000450 - protein, 136 aa, Homo sapiens
SGVLEPRTELVAAARGARRQVGGCGAIERARGLAFMAWEVAPGAPLQVAENMCAFVERVQVAGRTFRPCVLLVAVGLPLHRSWAWAMHEAEGSGVNSVELIKSIGKFSLGFYVTLHALRGSPLGAVERHATDRGAS

SEQ ID NO: 1000451 - protein, 536 aa, Homo sapiens
RVGERVYLWRRPSDYLLRADGDSADSGCRVNDLCPVPRFYRRDAIQASEHYYLHRDREWTLHSVWTYYVRFRIALEEKLRPAVVWVTIDARLMYTGFRTECTKRALTCEGSASRCIYCLGPTEHQTIAEEKSLSELIQSQRERGISRKEIMRRKQTAIAGMNRQGENVTHLRGKPQVVELFEMASARGLNVFQRVKRGSTKSWGPYDFIGRVPRVHVDEPACEKSPIILLVEMNGIVLLLATGKAGLFKKARYCGLEMVWYRETKSPRGGIAKRKGRAEIHGAGIRGHEMEGSARFFPECGRVCVLGGKATIGGCRLPGRPFGFQGPEVGAVGALGSLEVEAPGRFQAGGAFPQPSKRAQGAGPGGPTGGRQGPAQTTGKWTHIRVTINDLPGVVDTFCNTLGGDARERSHKYGNHPRVTNMGERSGPHHKGDTITKRQRRKGGGSDDQSQAWGSAPGHKSGPPRDNIESNRVVDKHPSTPTRGSNNNRVCYNTPATAMSNTEETKYDDKEATIHPCSRRNENTTAYEWNETEKEE

SEQ ID NO: 1000452 - protein, 166 aa, Homo sapiens
SGGGGWRRQRHGRRGVAARTEVGRVEAGGGRQCCVELSEAELKGGLTRPGSSLVRRCSGVVGWLRMERYSRSRVDCVADGWTRGSRGGTVRCLYMGVGGDPRTVYPPVVMRAWARGVARGVWRSQVSRLMAVFEEVVQDGAFEGTSFSDAVLTKLFVEISPELPSD

SEQ ID NO: 1000453 - protein, 182 aa, Homo sapiens
AGRGCERELHVGGLTPSEGAGGRFVLVLVGVTEVYALQAAEGPSGGDRPRMWTSLGTIRAPEGSTVRRVLTVWVGAGQGVRGESAKSEEALRVNRMKTAERERGDAGPRLRSASRSMRSSLEAEARPSSHVSCGIGNVLWMNAAWYYTGQLKSNGGIPKYMFQSGKVAKGGHLRKSRLQETA

SEQ ID NO: 1000454 - protein, 94 aa, Homo sapiens
SGVSVGTRSTEISSGYTCQLGGLQASLRFLLLRADGDPKWTRSSTIVAYLCETYSHVARGRSLLSIFAGELHYLYRWSDRTLYASYTGLRVQDG

SEQ ID NO: 1000455 - protein, 125 aa, Homo sapiens
AGGFPNLFRPPGSRSLEPGRIGCNRIREPRQDSRPRASPLVHSRAPQGRRQLVNAGLFNVRVLAPMNWEAQWKGTEPQEDWMSESGSIHSAHHSIRPVRSVVTGKRWISYELDSRVTQVWTHKER

SEQ ID NO: 1000456 - protein, 265 aa, Homo sapiens
SGQSVSPRRWVGLGSDGHGHRQNERSLARPTDVARTWRREHRASQEAGSCRQWYKGLHQGTAPTRNPQLWYEFNELSTAKLLSAMVTPSKVVPELRLPHLLTSNSDGTIDLSGASVIALSVSSRGRLEQKLMWAFIMYVPGTVNGLHHAGSDYAVRSCSAIYIDAYRADDEVCREELSRPRQREDGRKSSANWTRIAMYWHGCPCEEIQSDGAKGDPSSCVCCSASTACASRVLMRTPGFPFLPPFAGPLPVLRFHVPCVYLAGG

SEQ ID NO: 1000457 - protein, 227 aa, Homo sapiens
RKSQKQIKVVGLDVCWPRRREALECSSRLLVSVARPCALLRGSSPVARAPAPDHGRRLSLIQKAKLARAGRASTTDHGPACNERHVTDAWAPDAVQRGAAICSPWTYKNVVGGRRSAWRVISSIESEDRRLRQEVCSVIEWTIGMHKLESEAEIICTTVLEWSGHYLLANATNPEQYRSSYLNLKGDYFRYLAEVAVLVLIEFNRLAHSRGAYQEAFDISKKEMQPK

SEQ ID NO: 1000458 - protein, 138 aa, Homo sapiens
RSWEAGDPYRTSLLCRRVSFPRPLQAARSRSRSPAVEAAIAAGSPHAGPEARRATFDGASHVDAMVKADFLTPLWPRTEGKNGRNPKSGDEALIIPLQRRRPRGTAMDYSDVVPVGHKEDPGVGALCFGTMHFTACTV

SEQ ID NO: 1000459 - protein, 122 aa, Homo sapiens
MPEESGPKDRKLNKSRSTEKTVGKLLALKQGCEGADRCNLSLSRKTVSVEGFREGVPCPKTIDFGSSEAGEDTSEDEKAKVKFIIKKPEMFETAIKESTSSKSPPRRSKVHRPNVNTTCIRC

SEQ ID NO: 1000460 - protein, 227 aa, Homo sapiens
RGMLSAVLLRRRRDLAALVRHARAYVRGRAHGTGCRLWALTRCPSPSASPTLGDSSTVPSVRQVDVPTLTGSLRHPGGPRAPQLQVLAAGAGRGAAEDGTTRPIYFREQRFQIDSERRLFECSLLAEVGRCGLDHVGPGGSQGKLWRRSQAELGGEQLIEAHRGVRRSRSEYEVQRGPGEGPGVGEPAAKVDLELLELDVVDERDQSRAPIEKSREARKHEEDLRRR

SEQ ID NO: 1000461 - protein, 253 aa, Homo sapiens
MQRRLRCVAGRAGAARTRAGQGAPATAPAALLDAPEPPAGPDSSMPEIPHTNGAWTYSRVDDTNERTRMNTTGDHDKDHQSEGPEHNGKRDQEPRDDEDYHGEAATMNGRKRTEQGDWRPRARRRKMTQEGLESHPEKSDPTRPINRYQKQEDRQTSNMKTKTNEKKRTRRRKKQTRVPRRTDKRPGHDELERHLPSTHAEHKRPRTGDTRNKHNGTHRQTRKGATHNTGEQQGEDEQTDTGDIEQNSRPTHG

SEQ ID NO: 1000462 - protein, 304 aa, Homo sapiens
MAAPRGSGRLRKGASPGQAAQTPAQPCTHRRPRQPAQGRDGGEAFVQPWTSPMDDGYVSLDSHLPMSCTVRDVMITSELSCSVMKEVNELLKLNPGMLFELNARQIDTVWHLPESSYGRSRSERIYIEEMKDISVNKLRSTPESYQSLGIIGEVIVDMCSEIHRKELELSWLIFFKSGMQQQLSLTWQASDNGVDSRQSKSYWRYAEHAGCGSKFLTRRIVKKVTVNGCWENQKRNPFRKLLHTGEQSWVTEMDTVTDIWREDSMYQEYRHSDPITRMGQINRYRKTVLREFIHAVLTKDTYEK

SEQ ID NO: 1000463 - protein, 281 aa, Homo sapiens
SGRLRPSVVNAVSSTCLVVWPQPARPFPLALLLCSCLAPQHWSLPISFRPAPFNSRPVPPSQAAFTTGTCSVHLARTQHLRPSLGALDGLRSHLQASTSILCWPIILSLQTAGMPTKGHHLPFTDCTAFMHHVCKCVLQQPTGTQGGIPGPTLCIPSAPCTAMAVAGRNTHYRKQHCPPVRSKLEHHSAGQQLAHASARHLSSTSHRSIAFLPHIARTPQPDGRMRDYPTRRSTTTPRGPHTFSILFTCSWSPFGTYATWQVFLPCDSFFPRPTHIDCSYA

SEQ ID NO: 1000464 - protein, 291 aa, Homo sapiens
RGFGPCTCDSRPRSPSAPPGAAGPMAPSRLQLGLRAAYSGISSVAGFSIFLVWTVVYREPGTAGMGGLAGVLALWVLVTHVMYMQDYEEDLAQGAARLLSVVGGPLLGTICHRVRCRAPFPRDWRSHRGQSESLNSTPTQATERSSRRSRSFSVPFEVEPFRAQPSMPTGYRADLAEISILREFLTQGVRVSAAMGGPEDLDSASEMWERLLGIALVSPRTVAENTEEDEVVSQEAVLGVPFDGNLSVVEQGILRCCSSSAWAEGSLRTCSIDSGSCAALMELLKYSREKG

SEQ ID NO: 1000465 - protein, 124 aa, Homo sapiens
MRHQARSAQVAELVHHNFLLRQRTRSNLGNNNLFTLESQFKPSLGPVPMGDTGNLGLRRSPFLQLCTYKLDPQHWGFVITHSRAVEPHTGQGFGNGKGARLGDSSLNKPGANEKRDFLTGKISV

SEQ ID NO: 1000466 - protein, 227 aa, Homo sapiens
RSICGYPEHGYLAGYTCTSVSARTSGLPLLGDETQWLEVHHVYAQDPCQARSWTLAGIPLSRIESLHPRKGLFRVCLVAQWVASTGIYEVLELLVTTDKSRYSGEGVCRRPAESTFECENYVRLPWLARNCTVSEQEKIDKLSDLRVDWKQTNKSKLLGAKRHFWGCPLAVCQSIGADGEGGPPVTANIADLVANSEAHPGHVGVAFNVIEWRLLMHVQSSLRIAGV

SEQ ID NO: 1000467 - protein, 117 aa, Homo sapiens
MLGLPQIRARTDYVIEEVKSTWSVRLESGIGEFRVSLKIIKTQVYIVWRYKSVACVQHLGGELGLYFFRVELGTICEDSDSTRSHDRCCEQYEHKCSLEIDYPDFYMELVSVEKRRL

SEQ ID NO: 1000468 - protein, 84 aa, Homo sapiens
RRRTHTRAQEAGGPGPERPPWTPPARGAENPRVAAHPVRRATPRDLWTGQDSELLTQHTARDPQTQCQDNCGSGDGNLLGKGNT

SEQ ID NO: 1000469 - protein, 314 aa, Homo sapiens
RGGLTVRGRKRTAAAISWRRRDGGGGRAWKPGRRQAHHPGSSQDKGGVGKSTQSSTETWPWLLAAYARLSKVGILDVVPVWPQLSPRMLWGRMGQGHVGYPDCELARVEQPVAFLSTVAVRAISALWSVGAFPAGRKCGSMAVVLDEDPNEETLLGVKTKFVIQTCVPWVGTLESTWLGVTTAAPWGNLPMYAQLGPSYESSMQSLNSCHTCGEPLRSVSALLAHQETEWYLVCGEPLEERLKSSNLTCNGKTVALLELNGEFVGESMSEVFIWPLHLATEVHPCVLSPVGRADRVKLGPQDSAVECPFRYGSP

SEQ ID NO: 1000470 - protein, 166 aa, Homo sapiens
AEWRRRWRREAGDNVSVQAQQSPGGGPRRHGQEMPDRRYGRRAGMPRGAMERRYRSLSDRGINIVQDELEDARVYTTRVRMDTSRVIEPCAGSEFAEWSDFGSFIRLYLSDIHVPIAIFYIFVTSTDMSEHEWKVYENMVPGGELRRLCMLTSFSRCGTMTMSGEA

SEQ ID NO: 1000471 - protein, 105 aa, Homo sapiens
MTISTDSSSGPMVLACMRADSSGGSTSDGHPASLEGHGPVSWNLPTIRGSTAIALRKAGERSMRRSGARSSALYRINVGQRQPGCAAKCPGPAVALVHPMRQWAV

SEQ ID NO: 1000472 - protein, 185 aa, Homo sapiens
RGGVGFRALVRRWCCGGCWSGPAASRPQLVERLSHVAAYPQRAAQIYGLRTAARRHLLVARTRTRRLQDLSAGLRWAPLCAAALSDLADAFTQSSYDRRGSVGPLVGQHQVARGALDANIIILGCAGTGGRISFSFRGSTDVHQCGGVLPGTARGLRIPTGIVGPSRHRHAVRAYGQTARSVEVL

SEQ ID NO: 1000473 - protein, 322 aa, Homo sapiens
SGASLSARPGRKRRWCWHLDFVLGWTTRRGPTPSSEQHAGASALKDPATSWTSLAERPHSAAGDDSTAPCRSTRFHPYPSQTPLPRVAGRLPEASSPIPRKTHACSPPAGSTPHSSYLPTPARDRPVPLHRRAPRAAPLPTRLPRLSPCRPALTSLAHHTHDFPLLRVLRATHSSRPLRRPRSCAPPQPTIDPLEAFSGNAPIPPGHTYAAHHLLTPNLRQTSSLLPGCATQFQPLVRSARTSPRTAPARPNQTQFSGTTPPAWYTTLWFSKHLGVDTFSRFGERSSLMPRFFSQHGTPFLGPIGTALAGPISNTPVVGNHW

SEQ ID NO: 1000474 - protein, 128 aa, Homo sapiens
RIIPQSPASRGSRARLGICSVVLSIVSSTPLGPSSPHISLTSRLSIARANWPCARLMRAAQLAPCWPISCARCVRGPVEVHEGWLLCPWTGTQSAAIGLREGPSLKNAYSVEKESEESSSCTVVPENS

SEQ ID NO: 1000475 - protein, 373 aa, Homo sapiens
SGSRAVTSRAARVYRCSCAASRALPAPRFGPRMRVLDSPAPIFHRSRHGPRACECRCRGRVLLAPRACAVLSADHGALSLGCEGALTAHCGCGTVQQLLASTYEPSNTHLLAALASHPRPASNMLYRQCTRPVLRWMSCAYRAHTQVDYPGCSRKAPSACVTWADAIVYKPGDTANAPLTLQGLIAGHDPLSVHTTQPRLASWSAADPATRGLHCATAFPFPWHTVTPNAHLASPLNTANGALPYRPGGPFSRAPPNFTPCVRRNFRTFNPNAQSSVSGCRPWAPATTKTPWRRGRPALHYGLREPKRTSFATRGARPKRRPPISGPFTLDQLVNSLNKHFHNALARSTFRKPAGHYAPCGSHVTIGHSLGVY

SEQ ID NO: 1000476 - protein, 169 aa, Homo sapiens
MTMDKSELVQKAKLAAARLSDYDDMAAAMKAVTEQGHELSNAREQICSLLAYKNVARRPPLFLGVISSIAQKTREELRRSTHDGHKSTVRRLEAELQDICNCTVPPPVGHTYLIPNATQPETYGCSTGQLTGDYPTRIFSDSGHPGDHKTNHCVEPPSTAYQERTLTLT

SEQ ID NO: 1000477 - protein, 254 aa, Homo sapiens
MYALFLLARLLGRRLLAGPVLGAETNAPGARELWCQELSNDRLSELRRLSEARALQTVWETKAKQGEHCPCAWRAILRKTVRHSSSLLWIIACRGTNGHMNGRQDPVALYVGRKDTADVALRNTRRRVILRSMQKEISWHFAIIPWSMPGRVIEQEIMRRVLAEMVLVIWLLMLLAESSCAEEQPAEAEIEPEEHGCESEYRIPRMLGPSEMKAGMDSLSVGQEVPIISFRLVHQGRGRRNAMPSSQKGIMGDS

SEQ ID NO: 1000478 - protein, 580 aa, Homo sapiens
ASAERFGRSLGGVGFSLARPARSSSRQRERGRGGSGAKLALTTFGRLALTTKQLRPHTQSHEPALAYSYHPRCAQKAPTRPTTRMGEQRNTPTQRKHTRPPPSITRDRAACTRKRHIHSTVNTGHPGETQDGADLFSTQGTLRFSLLLQATGSATPDAIGHPIPRGNTTMDPLFPSKGEFRGLERGERKLQTRSNGEPFFQHNNPRNPRGNAAYNSNAKDRSKDPQIFPEDIWTRSLGPNGSKRGTLKQNRENTAPRIKPPIGRDVSERALPERFFQGKTSRPNFNTVPKKGRACGTCALGPPAKELSSQNSQGNPLLKKQGETGGKTEVFARKQQPRNTYAKKIVGATRPRGEATRAACPKEILQPQRGHHLVGRTPTPTYPRGPHPGARQNHFINPQEGTQRAHKSTNNEQNAAKGHPPDDYNNNRGQLCAETTRAGGSTKKRHHYIPSPCTKPFWGGSPREATLTDPSDEGALKHEASCNTSHNACFYHHCGGLSHEPTHKTDLKTRLLSSPAETEHHTILLNNKPISFSDDGAALAGHKPTQICNWYMHINPRLPDDERAYITHTAAEKTEEQNAF

SEQ ID NO: 1000479 - protein, 470 aa, Homo sapiens
MAPATQPTSKQPGPLALNNHGGLWHHRLASAYSKLTPFSHPTRALLPALPNVCKSKRGGKPVSQYYTPTILGRSLKLMGNALMFPTLANNRPRPYIWSQVGNNAGQPAWAPTLKLAKLSPAHTPLLKLTGPTPKDTAPTVNPNPNPVAHPERPPQTKARARTLGRPEKPPRGPSSDTHPSTHRIGQNSSTAGTTQPAKHTVPPKKDKNTRTFSTTQRFLATAQLKRYRRQPPVCPTPQTPNTTRTGTLGNVATTRQHNTNRTLTLARRPSARLLATPQPQGTLDQRRRANLPALAVNNPPFPFKAPSRTRRAYTPGLNAPLHLYPLQTLPQPPAAQHGLLTKPSARPPTTSRSRGAPHPQPQPSSRNMRGPHEEPPTSPPLCGGAAARLVAAICGPPCRQHTRPHLAADLQQTTGAPRREQDPNSSRAFGNPAFRQQHPRKSSQHPIRRAADHDDTPLGVIGQSRQNAAK

SEQ ID NO: 1000480 - protein, 269 aa, Homo sapiens
SGVLGPEPCSERESSRTSAKISRMTYYLDLPRLKIFHCINRWALRVFHKILMRLVASPGYETARSVSRPKLKKTLAQTSDIRNVVVVDGVRTPFLLLALHIEDLMPHDLARAALTGVCIGPVSLKEVVDYIILGTVIQEVKTSNVAREAALGAGFSDKTPAHTVTMASISGNQAMTTGVGLIASGQCDVIVAGGVELMSDVPIRHSRKVRKLMLDLNKAKSMGQRLSLISRFRFNFLSTGAPCGSGVLHSETMGHSADRVAAAFAVTRL

SEQ ID NO: 1000481 - protein, 394 aa, Homo sapiens
MVTIIRSMGEGVLPMPHEDGQRGREPEESPTQHKRCLSPWNASGMTHCSQGHQGMDTIDWTGRPAYYTLVNADRRRLGDRELTGEMKSLGGREKMPSGKARPFMRRDIRRTPGPGQLTETSDRTSVAPVTGASTTRTRRGGDVPGNAVVATERRNYAARQRSTGGVESRGQRGQDGHVAPGQRLRKRKTPLRYQQYKAMGTSKSPSYSKAVPLVGETCGVGPQQWAAAKGTWAKSKGRHRPAHDRDRRMTWLRPEGAELHDPEEVIPTGQSSLGTRRPQNTVGKEEGEKSMRTDTYEQCKKGRSQHAMWNQTGTHKRTKEGTIPKGATTAQKLDEQQEPRLETCEGTTVSEGKPQNRRERQHQHRGQAMRKGCAHSGAHQQEGRHSAKEMRIDT

SEQ ID NO: 1000482 - protein, 335 aa, Homo sapiens
MKHSPGGPDVGAQGTPEREPRNSQVALTTAHQPETTSSPPTTQGLLQEQQHQKRCLGRGIYTRNADSILTVACGQEKEFRDVLRKRQHLQFSADVERDICVVEKGGATRHRQDLNMGQLGRKTEERGNMLYYLVWETLWGCNTWLCEENNEREKRQMLAGNIDNSPSRIVHQPHTAGNLPMLRDVSLVMLRTTCCVDDDSNPAGLWGEQHTPACGSTHGGGHNWVGQPLLVGRLWEPLLSRTDKRTTRQNEALSLRHATHQCVGTDVRNTMRAEAQQAMQRRRRSETASPTYEHRETDSRRDREARKQQNHVHRASTRCECDDRARRETGRGGRG

SEQ ID NO: 1000483 - protein, 228 aa, Homo sapiens
SGFRAETACAGTRSCNAPLTDTATGRPWRPEMGLLGRRSYWMVVASVDACDLLLSAHTLVACLAAGVLPCRLTCCSRTQYKHLVNDVLLKNRLTDTYGCKHLNNELALGASPRYSIERSLHMPGLPFGNTGRVCSSVVARFVELCNILTAALTHHPLSAQSGGERLPSLALLAISCIAVSCWLREMDTHGSRECPDTDVTDDTAHAVAAARDEGRITRMHAYTVTNAA

SEQ ID NO: 1000484 - protein, 202 aa, Homo sapiens
AESHPEAGRERSCGAAWFSRGSIESISCVVVSFRNAHFNEQPRKVVWHRCTDMVGLGGYLPSRCAITCDEPPNVHWGEEIEDGKWNVWTDRHVSIEDLPEGGAEIGKSTDDEWHTMCVLSVLLQEIVGGMCLHQRLNRYLYARMCPLKRPPAYTKHRTNSQRQNFARRITGAAMRRGLSELLYSGGDACGWVPGKHRGPSTK

SEQ ID NO: 1000485 - protein, 321 aa, Homo sapiens
SVAEEVQQPEMAAVLERMSDSRCPSTASRSARTRRSGLWAEGAPLLAATCCHRPLPPGSWSAALWRLNVDACPEPGEAAAGGRGGGGAAAGAAAGVSRLDGVVPALALRFFKEKRWHKAISIPTLLTEQIDSFVARAITQVLIGPILIPDTCSWGSDFFDCVGDLTRQDQHWAALGKHVYTRMPCWTFVKLLTLGVAISFQHMLRPQTSTPAEQDTPTGPAAPPSRTAALTTRTPPTPGLAPAPPPTVPATPHPPQASAPGPASPSHGTPRLGPHTNGASRMCTQRTTARHNNIGHLLTQPHNSAPFTFPGSRCHPHSRTP

SEQ ID NO: 1000486 - protein, 669 aa, Homo sapiens
SGLTQSQPPRRPQMPHCCVISAHPSLSHMPTHHTTTLHTSRDKHDKRTHPHRHTHTAQRPESNGNANASDYIHTHTPPHQPKFTQDKKTTSTTNTTHPTHKNHQHTPHHHTNPHTKKKNTTPYKTINTHLPTNTTTIQTTTQTIHNTTHINKQNHTSTQPKNEKQSRQKQAELQTRGNDTETRNGRHTSRDKPQHTRNAQHNNEDTPEQETATAGRGAEPTANRPQAQRLPTPHDATNQHRRQARGQVNGHRRRRTTHATTHNKRPGRERQPRPTQQKRRAQATRHTPPRDDGELRRRKHATRRTRGATGRGHARSTAMRDERGTPGPLRPTTRDGLIAHPKAGARRANKNSPMRSRRATREGSEMKQTQRGGRVQSGNGGGEARTARRGPGADKSERRGRGHSAETRADRQIAKTHSQTTGTRAEPTRHDHRTQRDISPGAQTRGEETDASTQNDRPCDAKGAADRAPAQVNEDGARYTTRASGTRPPSAEAGKNPATHRETAAHTTHPTSDNEDSRERPTEQTARKERESRRTTQRTTTEDSEEPLEAQSQKPASEERSSERTPMHQLPQTPHQTTAATARQNHAQAAHGNNVRGTSSTRTRSEKAGATAERESAATVRAERHRGARGLHGRTTEASETRDEETARWRPRERGKTNLGTQSSAPLAP

SEQ ID NO: 1000487 - protein, 254 aa, Homo sapiens
MSSPWPGYRHLTWAPPILCVGVFQHGNGGDHLPRTMDNRTTPSYVAFTVLPERLIGDAAKKPGGHESPILDYHHSTAKQADWTDIFEDATVHLGYETLARSGMAERGEAKPKAASRATRGQTTDLLPKKRYPPWSSRRLKEIAEAYLGRQGCTSAVHNGPGLSSHDSKPPRPPQDDRHQSPAPHCACAITHTTPTAGPANRPLRALEPPTARMTPPPREQQTVSSLLRPLHKSRPFSTAAHNTLTHTQALAQST

SEQ ID NO: 1000488 - protein, 254 aa, Homo sapiens
MHELDFSLTACIAIRPIHYYPPKLYRDTALEPFIPNAINDAYQYHLPDDCLAPVERLSCEKLPFSKTARVWLQHIRAYVRLWQCFFLDAATAVNSCHDPSWLPNSYTQWLLAKRALPLHVEVPYLIDGNDTYILTPVEIARYYARSPSNTASVTPHNITNIVRVTTLCENQRHIEIALMANYPRHRYFATNFIDTKPPAHFQCIVPWEPTDENNGTLCSLRGDEPPEGQLAHLLGTLETLCCDNKQRNQAQFAV

SEQ ID NO: 1000489 - protein, 178 aa, Homo sapiens
MDTFLLVLPYSSRYTFLHTKGPGRALQADESLLPCMNCTGRMRLEGKLAVPQLVARVRSERFGPGEENRIPRRIGRFHDRNVDVDVTTIKRFQFARFRPSKRYCQLTVWLLSTFLIYAMVTCSAIGPASQNAPRRQTQDEGPNLSKIGPWLVAQKSSEDYGRTVFSITGFIHSVTGQA

SEQ ID NO: 1000490 - protein, 68 aa, Homo sapiens
SGQAGKMAAAGAGRLRRWCASAPAAAEPPPARPGAVWPRARTYHKNGCNHYEILETWGPVWNEGGKKG

SEQ ID NO: 1000491 - protein, 99 aa, Homo sapiens
MAEYGTLLQDLTNNITLERSENMLNVWPLQNGKRPIPPSQNNDVEDDHYMAVPAFSFLESHNKLDKDNLSYIEHILSSNSFPLPRVPLKPLTSTYCVAS

SEQ ID NO: 1000492 - protein, 309 aa, Homo sapiens
RTPTSLLERWAFAGRTGSHELEMEPLLLAWSYFRRRKFQLCADLCTQMLEKSPYDQAAWILTSNDALNRHTGYTEMTLTVTTQRRNLPATLMLDDNAIASSSTPWNVFETPCELISTGGPSQAVQANSHKPAKTHYSALPSSAPSTALQLRKAHAHSLATQATPRTTPQETPPSHPAPPLITHASPPAHTHSRPTPQPHNRAPVTQCPSPPKDPLAMAHPHLHSTTLHPYSALGTFLTPPTVHLPPRTQPLHTLQAADNRSLLLLYRSAYFIPSASNSQSASTSRTWFLNGTLVSQFLSATGILLQASL

SEQ ID NO: 1000493 - protein, 251 aa, Homo sapiens
MREIVHIQAGQCGNQTRCQPFWEVSPSMNTGIDPTGTYHGDSDLQSGPHSLLYYKEADRVGTVCPSLPILVASRSLEHHGNSVSSTRSSKQPDANRTQTYFRIMAQSGAAELTGPKAPTNTGGRRASVDSLAPRHAGYPQRRQRDLVTACQGYQLTHSLGGAHKASWQWALSLSAKIPTSNTLIASLNTFSVRAFTQKSLNTVVEPLQATHNRPNKGTKYRLTNKGHEHKALQNIRPPAPRADHTNTREPT

SEQ ID NO: 1000494 - protein, 165 aa, Homo sapiens
RGVAVVVAKVGCRTRSSRTWNNRGRLRDPGASLVAEGEAEEESDFDVFPKFSPLPCQLPGGGAQMYSHGIELACQKQKEFVKSSVACKWNLAEAQQKLGSLALHNSESLDTEHAKAQTAVSELRQREDEWRQTKDASSSTKTRQMCLWSTDAITHGMLSNYRYEL

SEQ ID NO: 1000495 - protein, 41 aa, Homo sapiens
MTGYSSVRGCDCHLGNFAKATFDGISKDLQLLEPRTLERRT

SEQ ID NO: 1000496 - protein, 235 aa, Homo sapiens
RAIASWLLDSSAVSLALLVQIGQDVSLVDPLFVETELCGADTYMAPHRHGSDNPGALVDRRAEGIEKQSARSDVSAPLMTKPSDEEMLFIYGHHIKAKTHLLGPEPLYSNWYNVALAVVGASYSRSQMGQRLADLSLAKCTTCIAGNFMRTRMSHVSVVQSTKVRRELHTRRTIRGHYRRGAGHVGYHLWPSSSSSHENLSRQNGLSFFVVLKLPGRDIVRANFRRDTNSNPHVR

SEQ ID NO: 1000497 - protein, 122 aa, Homo sapiens
MCDSQYRKFHKDCLKVKRGKARQSYHSPHIVERISNSTRICLNQLEDILEVPLVPARQYRHTIISKLVSPEERRKEVAVIGGKGQKRRKTFPWKTKPVNTLDIAASALENLGTKYLPRGSAR

SEQ ID NO: 1000498 - protein, 69 aa, Homo sapiens
AADVSFVLFFDCNNEICIERCLERGKSSGRSDDNRRELGKREFRPTFSQQSQLIDLYEEMGKVEKIDAI

SEQ ID NO: 1000499 - protein, 297 aa, Homo sapiens
PAARARATPAAARAPAPALAPPSRPRAPCALCRRRPGRCGRMRGGSPGPRLGGSLAERRRPARARDPARVGSPREAAALGPARPRPTPGPWTQTRPRHLLHAPAPTSAAPPMTSGNGNSAIQHRRHCPHRSGDEYTHTRPRVTSPTLLTHCYRHGFVIQDRAAAAYPRQGRSYRAWLAHSRRRSMHTGVPGLKKLTTRHASRPITNCTYGAMRAQFRSSAHPHSKTAAAATPPTSSTSDASFLARTCADTVCLTIGFNAVHGPITLIHMRRFRDPKCYTPRGMSRNPAVPNYFPLFP

SEQ ID NO: 1000500 - protein, 139 aa, Homo sapiens
RIPLRNHHGGWAPCTRILKHLEGASEVSHRCSVQWGSGPRCVSGQPTPRFQCVAREAKPEPLTFLACKLSVHALSEEMECNDETGRLADLSAKELRNPVRCHTAASSYTLVVGMYILNADIGELASVAINYSLMGELVP

SEQ ID NO: 1000501 - protein, 90 aa, Homo sapiens
MLIDTGSMLEFQLECYWVLMLGGILLSDYTVRVIDVESVWQSRGTGVSVEAVDPVFQATMWALLKPDRKAEMGEVGITVPGLGCGFWCGY

SEQ ID NO: 1000502 - protein, 119 aa, Homo sapiens
MSDQEAKPSDLKTVSGFRRNGEYTSQNLPQVDLRPATSDLAGSPVHKCNMTITFIKETQSNRYLSQRQGAIPMNFTPGSLVLRRAPGAHCMSESPIRPKTADVEDSGRDKKKVCTVKGF

SEQ ID NO: 1000503 - protein, 337 aa, Homo sapiens
RATVPPCRPAALPPCRPAALPPVVPARGAPSPPPPHVLPCVVERLGYNMLGMIKNLAVRKLYETWPWQVLTQRGQRKKLPMTERACEGGNICHSEEVTDKPVRMRLYGQAMPNGRKVCAGAPMTTGNWRWPMTVPILISCVPQLNDGSLPQELTSLVPDSTTNFHTRDPPAPSDNKRSSIEANGKAITCLSHCQHRALTCHSEPDPRSATKPPVLRASPASATATYRGPHPPPHRQTTLPMNAPTRQAHRSNRLAERHQRPNEANNTPGTSSLQCPQHTAGTHAHRPSHAPARHKHPHPPPLNARTRHPPDHRLAPPTPPLRHPTTRHHDAHPPPPH

SEQ ID NO: 1000504 - protein, 251 aa, Homo sapiens
MPQGTQEDSTGPLAEPASTTRTAREARGPPNRTGYGDSAAARPQEWQPLQDGRRELPGAEPALEVTMEHTQAEHTSLGDQTSRQSVTTPGPKPWQPPQKRHALELAPPHTYRNSLRDEHHGHPERHFPRPSWGTTDGHPRERYRQLLTAVTRPRQTTTRTHQSYTDMHTRTVHHPKPTVSDQEAIPHSVMHRLQTNRANDGQAGGAIQTAGWSGVRSSSHRLPRRTHCKGAVSNQGEHPTCTKRRFQRLMT

SEQ ID NO: 1000505 - protein, 328 aa, Homo sapiens
MVDGRSPNQLAAAASMCAAAAAVTEDREPQHEELPGLDMPCVRQIENWLRVGDELSTAGRRKLVPCGECTGIMQLWMAYRACGRGPVTPSTFPGCINNATLFQDDDNTRRLNWRDWWKARITVLLPAAAWALPGQLVWSKSMASHPLNRRSIELPNIQKVERCTQYEPAAVSGHIDSGPNLTLYQFQPLPISIAPRYLRTAREAGYWWTAPVTDTSGFGPMNSDRLFCMACMTHTITGSRLPPLDKLVQSLGNPSSCTNPRYTKHDFAPFCLPLAHQNVAFVLVEPPCGQILGSDLRRGHTQKGTWLSPHSQIAALCTHALTSSGLHL

SEQ ID NO: 1000506 - protein, 395 aa, Homo sapiens
AGRNVGAGLVVLAIKPEAVAEAELAGLRRRSVDEFHWIPMNLVEVFSACLFFRFTYSCLRDERSPQSARSPGTRSPPMRKTGGSIDMDLTYYVIKMLLALRWVYSIHGGEFMDVRGKRVSISDSQLLLEVKKTFKVTRDSENARSHLRETCTIAWNAQAQSRTSAWELIRRAQVPPTLVEVISCVIDQWYEKLGIAEVSHARPAGWYGHIFLTTKGCNGLDLTDILGYILGVGRIGWSRANINRFSNKGTMKECARREARSGTMFAFKCSRTAKVRSTEGFPWRNITCGPQVYGSAGVAEKDLVEFVEPRPVNISKELEGGDHRKGRVANYGPVGSPYQGKKKTKTNFPLNFFEENATVVAKGKVPIKTVGTQGRFPKERNLHCGNCHFLEPGRK

SEQ ID NO: 1000507 - protein, 70 aa, Homo sapiens
RESVEPLAGPAWAPYRRGSTPLAGQMEDIKLEDSLAPGINVGLSSCHAESLTDDRHSDDRLLMSFITYGA

SEQ ID NO: 1000508 - protein, 76 aa, Homo sapiens
SGSLAGDGGQGLVLTGCVFSAPIVPGSVALGPVRYRGCNPRSKYCLGAPGSLEMGSLTLVADVGSYDSSLLVGCWQ

SEQ ID NO: 1000509 - protein, 115 aa, Homo sapiens
MLLVGSTKIVIWEVSKVSVAVVEVTKAISLLPLPVRWPASQCFSLLLPSSRPYPFWILAPVTNIIRGVIPKISLRSCPWITAVSAYYGGLDRPLVEQLEAALTPQGPFPGHDKYD

SEQ ID NO: 1000510 - protein, 200 aa, Homo sapiens
MPKRRGTRKILESDHSNCSYPSKRNDCRSTWFTVAGTKKTQRIRTIEANEVLAHGWLGETEWTTGPWLVMGPWNPFRKPPREKAFLIKAWALPELEIPGTERGPFPSGLHNPFYKFPWDNGTLFFKGPSYPNGLRKNIVGSLSRGSTKGTKPVGKNRELSPSSPLIGVWSRHPITWGHYDGSVTTLYGTRHTKISSHWNG

SEQ ID NO: 1000511 - protein, 71 aa, Homo sapiens
SGGNPGCSARSEVMEIPGSLCKNVELSNNAQNEGNADEQAQVGDQDHHVSRKKRGQVVGSMRWLSVVALVW

SEQ ID NO: 1000512 - protein, 203 aa, Homo sapiens
SGVGWTAADVGEVRGCKRAGRGVPWRVVGVPGACPHGTQEWAWPAVPLLRMPCGGWGGRWCLLAPADWALWTPHAACDAGCPVALQACLSPVLAAVLRLPPVAPTFAQVSLCRVPCVFTLPCCSSLQLWCLRLTVPCGAWGLLRAAGPAWPTGSCNSLLVGAYARGQTHGSPGPDLLRHQDNRTQAGTRALGNPRSGDTGPCR

SEQ ID NO: 1000513 - protein, 354 aa, Homo sapiens
RAESACRASGWWRGSCRPLRARAGAARESWACWRCNASARPAAGVNGLAAACPVPGASGAVSAAKCDLWETLRAALGTRLPDRLGLGSDWRGGRSEQAELHSALDACEGAQEWKLASRGPRIWAHVTEFLKFGHKSNEKKQNLVRSLDDRWPLEHHELEQSPGEQALQPGSILSEDEFYDALSDTESERSLSRLERRDKQRSFCTSDGGAFGAGRTSTRNVRTKSRLVVARECSRPSANQGHHRKRGLPSPTGLAQDELHFRLVLAAIGSERTMANWDSGDATTQRIDRTAKGSTSNMRPSLRVSPRRRPLTLHIHIGVREQRYTVEVTRTGASGATVFVHSVCGTDCEIQRCA

SEQ ID NO: 1000514 - protein, 101 aa, Homo sapiens
MFKEDHSLEHRLRGVREDSRKYPDRVPVIVEQVSRPPPESLTIDKRKYWSIMIHSWPQFMWIIRKTDPSPFPFPDNRAIFLFVDEDSPTVQAPLKPVNLRA

SEQ ID NO: 1000515 - protein, 427 aa, Homo sapiens
MWQAPSHGSRRPEIVYCGAMKATKYRVSSASQNESYDEMKFHQSSAVVHSCWRVELTRWRTGVSSGTWIGVRPEEMVRFSVYMERIEWRMSSGETTERANAFMTCMRRARPSLTARHLRLRELKLTAPVERVKDASEGELGNAGRPHFFQGYDLPSLMGVGDTVPEEIMVLCWGAPLGVHFFRLNSYPSVDPLHCFVGASTQGIWNRLLAGFLCWHIPRSPAGGRLRRLLIPSLILCPPGEILQQSILTKTLAYNGCTRVGMYPIPIILAVCSRLATQFDSFPPEVLVHPPLGEIFCAGGEHNSSQAPFKRANFGFSFETVVAPRPLRRNATGQFNDGIWGGLWRFSFGFCFGQKRFVGYRPRLHNQTLRTLEIISAEVGNFDNPKQNTRRHDTRYFQSSALGEFARTQSHRGALWKNTLYYEQEGE

SEQ ID NO: 1000516 - protein, 118 aa, Homo sapiens
MGFNKTASCGARWATYDSATISLPIPSQTKGELVDASTMAKDVPRRPRNTLFHAICLETVQTSPSQSLFDNRFLLSRFLSDLEVESHHGKDKGYVGMESGVLHQHIRPRRIRPMRTVC

SEQ ID NO: 1000517 - protein, 355 aa, Homo sapiens
SGPQLQPAEARRTQPPEKPRSRAKPVTDPPDPVSPSHSPATTMAEARRHAHALEEMHATGLTSWLMSRWKAPVVCCNWLKRVKMLVSGLRLMLADTRRTTRIVSNQGMQPIIQTKNDEGRLSSKHFYTSISGQMLMAFSSCPCQHSLNQVDAEQTNALVGTYITDRQWLRPGPTALANVVKCDSTQGSQMRHQAWRAHFIPQRYPEIDAPEEHMDTLGIENTAYKGKGDDGGTPSGEHHNHGTHLGTPATYGATENDIERAQRHVRPTHSDTGTSIGRKRLRQRGSDTEAQGHDRKERATTPTNRCNPKREWTGDERGRNRWMTPPHGSATPTSKVTASGQENAQEQAQTSRTST

SEQ ID NO: 1000518 - protein, 107 aa, Homo sapiens
MGTLDVHTDLRVQLEFPIPIVHSDLVSYRAVRGRSVAPHVREESSPLVKMVTHVPGEVQAEMLAVSVPGVRWDRILQLSSAKSIVKGIIVSEYCPFRVSQQGIACMT

SEQ ID NO: 1000519 - protein, 94 aa, Homo sapiens
RDGRFGDVNESLSDVLIIGVIAERRGDQTSSSDQYRLIDAFISSDDSDVDKRTQVIWVKCRESVHSELINPKGLRNGHCNRDTSPCIDTKCTRV

SEQ ID NO: 1000520 - protein, 268 aa, Homo sapiens
MRKMSLGLHLGSGQLDALSVVLVCTHNQTLQVSLGKIVKLKNMLKVRRVGMEMEERWGASQWLGILGDEGPRKVNAGSEGEARIELCITLVGTSIKHGLRGRGMSVGKPLGGIRIKAHPRITKARERALETEWSSQRCNVGHKAVQGETGLGPAAVNLDRLIRRKNPKAGFAFEHEQVGVPKRTRCSSLTPGGSWPRVGPESILVPHRHRLMVLKGGHGARHSATTGTHMVHVYGLGLDEYVHWGTREVRMCAWGNLGPATGRNTVKA

SEQ ID NO: 1000521 - protein, 117 aa, Homo sapiens
MVEAGVDGLGLLLLTRTLVCTQGHNTRQGSRRGKTQESKDWMDDDHRAQWPLQQAGLMQRCATLRDSKNQKTTRNPPQNNAARAERIGNTDLERYLERILDQDCGQGTGLNRPGPPP

SEQ ID NO: 1000522 - protein, 147 aa, Homo sapiens
SGLAPTVAGSQTQCGGRQGMGHGGAREGGTGSAGPSRTGASQFGSAAEMLSGTDSSAGRQCMGINECTAGMDAEPQVAKGKPGRAGMENSTRTSGSTCAVTLKRSHSALQEKAHVCSLGSCNSPGGEHWRLGDGSMQLLVGWISRAW

SEQ ID NO: 1000523 - protein, 122 aa, Homo sapiens
SGLLGFGLAAVCLTAAEVVWLIEGGGFCCFSYGGVCDGPESRPRQSGRRVPCRRRLKMQYATGRCSSSRFVFPEAYRRGVMSEYMRGYKPVGTQTFRIDGENYLASTRYIRTHTHLSCQSSN

SEQ ID NO: 1000524 - protein, 338 aa, Homo sapiens
SGVGGLTLIQPREGDGRAMSAVCLELAVPIQTPGGHKPMRPRARQNDGRLEEEGTAGACGGEQHVDEPCASGCSCCVLETLLAVAQLGWPCGVCVLARLKGHQEMHQVRMHLQRRGAMMRLSGPDETCQAGKGTRAVLPLPQVPNPLNSRIHEAEEEAIQLVPGGSALQSDNASTIHACRFYNTALVGPHKLSDVVSVRVFPGVTPKRVPETNPMGRCHGILVAEGPGISPLTFGRHYALGKLRGCCGTEKPASYVVGPTGSHTAYRNSPRTGETEDTFGCNPGIQQVSRHSSLQLPFPCNPRMGLARKGRRCSVPGVTSQVHWDMGESREAHAPGHI

SEQ ID NO: 1000525 - protein, 91 aa, Homo sapiens
MRWNHDDFASDYFAYGRDYFLSNGVTFTACQVDQQRLVSMSDGCDLDEGCQRATEFSRCCTSQSITLPLLRTPSDGPSVGLALRGTLDLSP

SEQ ID NO: 1000526 - protein, 77 aa, Homo sapiens
MCDDEETPPGVRQRLWAGEGRFAGDDAPRCCLTRPIRGPPRDQEVLAGMGQKEILRKVMKPQSKRGLTEPLRYTIEH

SEQ ID NO: 1000527 - protein, 175 aa, Homo sapiens
MARVPPRTRGWGARAGPMGPGPQRPERRRPACVSLVARLSYAVGHFLNDVRVMWFTYLLLYLHSVLRLQLPRAGLLLLLGRWRRAVHTARGLRGDRAASCCARYGPRKALAPGRHRLRLLSFPFIFSPCLGCGGGTPEWAASSITARHRDLPVWVGLHTDFPPQPHPELVTTDHE

SEQ ID NO: 1000528 - protein, 118 aa, Homo sapiens
MRLLVAPLLLAWVAGATAAVPVYPGMFPAPSVCLPDPAWYTAPLVLQEATTVDWNDYSCRSPTGTPRGTTGPCSESNSIVRVEQVSWATGNLTELDCPESFRMPRLGFPCLATVTDLR

SEQ ID NO: 1000529 - protein, 67 aa, Homo sapiens
MPWTKRHEPILANGSRLDCGGLPESGQACRHTALNHAGCALPSVLSCVNFLSEASVWCLKAAVFLAS

SEQ ID NO: 1000530 - protein, 467 aa, Homo sapiens
MAGKNRPFHTRAYRAFRIEISRSRRHELFQINDHRDMRSIPERAMHCSAIILCVHGTMPGDAENMSVSITSQHKHNARRLRRNYSPARLALAHRMRGKGHDAKQSKAHGITRKDSPCTRQSRSKPISHTFIEATYASKIETGPTRSARASVADAPAARRHPVACTLGETIGHRTETHTHGRRAASPNDCVLRVAHGTRPHTSPTHRSGRRARPAHTYHPQGGTTSDTNKRRHSHSDTRTRPLARATHTPPHRTRPQLQHKRIAPVGGRPWQNRKQHTPLDNPNGGPTLRLSQHIHTLKQSTPIEPHLPSAHPPTTAIPAPKSIPRPATIPAPRHAPIHPFHSTHSPRSTPAQRPLTSSGNRHRTHDPHPPCDPNTPTHTTRAATAGCRPPANRPGSTCSPRTYTTHPPKPQAAPTSTPHRTLHKATPPDRPHANTPCHSDHPPHHTTPPRPSPPNHPNPPPNSTNPA

SEQ ID NO: 1000531 - protein, 243 aa, Homo sapiens
AALFHSEAYSAAACAAAMSLGDSLKSSRHIVAEILNSQHRWAGKIALAITGIKGVGRRYDSCGVEETQTLYLTNAGTRRTITEEMRNENVWIHTLCRIHASTKIAQTGFLNMTTNVMYNGCDKISRQDAYDQMARGTNIARVKTSESTEGRISGRHTRGLRRLLGPTCPRGRHTKNIGPSWCRNRAVCPRRNNLCTDLLCIIRYVYTIQKMYMKIVLPRQISQITGDNNRRGAPEARSRNLKR

SEQ ID NO: 1000532 - protein, 227 aa, Homo sapiens
MRSRPVGPALLLLLFFLGAAEIACVWAQAPTPLHPRLDSSLDSRPLQSLVRRSQVYGVFIHWGVFSVPAWSSEWFWWHWQGEGRPQYQRFMRDNYPPGFSYANFGPQFTDCTSSTSEEWADLFQAAGAKYVRFDDKASRRLHKRGRVLCLGTGTPKTWGLIGIRVGNWENGHSGEREYGYGIYHSLLEGFHPVYLLDKNNGSKHSILSVQKTMPELYEPWLTAINLI

SEQ ID NO: 1000533 - protein, 297 aa, Homo sapiens
MTLYRIDSTTTHITVGAKYSYTQNNYTDFRETRKPTVANSSCGKKDSTGRTKPKAVAARATQTRYRLTMHESNTAKHMPGDMAANGAQNTEELNERRPNNKQPNAAGHHWNPSVTPHDQQGEDTTVRKREHPKGLHEHVHAPDNQLDTKEIGASTNGAEHIGIDTNTHQGYQNPCERRRPNPNEYTFVTADELRSQGRKNHNKYDFGAQTLRGQHQNTTPDDETHNLKREMEFHPDQHHTEEQANERSPRQQTLTQKAEKHARSPNAYTVRHTTQSTTVNTQARVRNEHIYNERKQH

SEQ ID NO: 1000534 - protein, 48 aa, Homo sapiens
MYTDNTKVGAHNTNVGPQKKTDGHPEWCNKRSDKRRDAQQTTHRRQAQ

SEQ ID NO: 1000535 - protein, 137 aa, Homo sapiens
MDVVLCTTSNGIDERTSTSEGFPKGWTEIYSLDDTADASLYSITLRKSIKMFPLDMMDGLLAFQNSRLTDSIITEIALVGIKRMSLELGDYESGDDAQYAEMVHVSDIYRALSVELVEKNPPYPHGAHYHVDKVDAS

SEQ ID NO: 1000536 - protein, 198 aa, Homo sapiens
AEAPDQAEGEQCQSTAKKVSFGKSERGKPVVMQKMLTESRDFVAARGKPGALSLDPVPGFYQICPERNRGSASQNLLSRTVWHFLTAKSRPPGGVTQGELTPPFGTGELGPRDSGENTRGRGPTSGTLREEELVLALSPGALWGIGNSASRCAICGHRFGQLGPMAIPVCALGLGFGPDRRTPQKTARIGRTKATRQQ

SEQ ID NO: 1000537 - protein, 85 aa, Homo sapiens
AGIGVFITQQIPLSHRRGALAAGTRGDENGRRHEQMRIEEFPRAMTPRTKRCAPQEQTRRRYTEHTPIQATKATTTNPEPPTQTP

SEQ ID NO: 1000538 - protein, 124 aa, Homo sapiens
SGLGFFGHLWSSREVVAMKVKLCSLTGYKNLPRTRKVVYVQGPYRCKVSPVSRNSRRKIARSSVSPFHKKDESFVLELTRVTVSFLHDMERAEKTATSCGKEIFRQEREKPRAKPSCKFSRRCT

SEQ ID NO: 1000539 - protein, 99 aa, Homo sapiens
AGGRDRRTRDEWSRSGSAEKWEYTEKGPSPEETIQKLKETRVRYLIEGIPGIFSQKIPTSELDNTTPTRNVIGEPTISMTSVLLRSGYWRMRRNIGFRH

SEQ ID NO: 1000540 - protein, 149 aa, Homo sapiens
RVEENGRGWQRWLQIQMVMRRVWWRWGGDWRYMSQQSSMEDCEWPEQAAVDDQIENLCEMLEPSNSTTCDGRCSKSLAFVVREEKLLAMDQVVDGNIGALDGDQEMSIERSTWHRIERIALQIYSKIEIHTGSPRWIGTVCKGGRMSVA

SEQ ID NO: 1000541 - protein, 121 aa, Homo sapiens
MPTAVTRDTSNIGDSRHNPLRVERAQEAQQMDETPLRASAMTDTHNTAHHIDSAMTHARNAGRREAQPDGTDRQDRSAAETARQHRTLTGGPSKRLQNRTGERDDVDARSSAPSITALWRG

SEQ ID NO: 1000542 - protein, 93 aa, Homo sapiens
RSAPNGRAAGEINELVTRVLYIQSQTVVVPRCAYVSQEQHSDEELARMTGCPTSESSGPVEIPDHTMTPDSESAATIVNCLRRLSPCFSLQVQ

SEQ ID NO: 1000543 - protein, 210 aa, Homo sapiens
MASAGICCARRLRASSLSLPYYHARCYERLGKSAGADRQCWWLLLNRTPGAGGPFSAQVMRSLRDMKRVLSEHCINALCVTQQRDAGACLRTLTTRICTMVVMYRDARQNLILFSTYLEDILSKRLPIILKSPSYPRMKFTPMNGSSGPGRLMAGGVMPGNFRWIISTSITNVFNPIDGTEGTTNPALGIRCTRMIQEGYRSTRSFDLRL

SEQ ID NO: 1000544 - protein, 83 aa, Homo sapiens
RGFILGGTQKMSNKQWPPLASCAFIVIMLGSRGSLQTHTSILRSCLQAQPSPGLVTGQPLPPAPTMLSDLLPVPSPAIPITMA

SEQ ID NO: 1000545 - protein, 695 aa, Homo sapiens
REGERAGPGLPAAGSMLGGGRGHAWLGQVRGGMPGARGWSPADWLVLLHAAAMAAWQHGIVRTIDACGLLRWAFAQSSRTVGPITPNSTSIAAIQRLVTPTGTGERHCTHYPSHADTWLVPALTLNWALTVSHCTLAVLWLPGTPTRARTLHNVCHGDRTRDSHIHAQKRARARLPPERRRTPQHADWRKAIPTRLATPRRQEFQGLHTNIIGLIKQTRALATGHHSSTNRSYGHPFVRTHGAASPFLYGIRTHSEGANTRWLRRFQEERTTKGGSHMPPHHWRVDSPIWPRGANELPQLRGWIPFPICEQATRNAKLRGRKDNPPRTGRGPTPHRQRSRQEHVTPTPKRRMTDTRDPHRPTHEEGPRERNAHTRRMQIRRQHMYYTHRATKTTQPGVGTPNERATATMVRARRAHTVPHTVSVRNTRNKMNRRDVQESSDNTGSGYAQTCHRRTATQAPRRGGARTTRDDYNESNTTRQPAQRRVRPQSSRAAKPQPEAVHERSGEPASFDGIKTTHTQGSNHLSPSKTKIGWPRRKEHSEREGWGHPRTRRVHRPHPRAHQNTWKNRHHRGADYRRRHVPSTPRQNVGYGALRTRGRGHTSTPRVDRINSQPKQDRRMRKTMCRRSAEQRQTPLPRDSVAHQTQRERSDELWINTTTKLSRRYAPRRPQIAQTAIDPQIMTIRENKADSLHTT

SEQ ID NO: 1000546 - protein, 119 aa, Homo sapiens
RAELSRKLGERRRSGNYPGCAAARQLIPGPSHYAGSAPHRPVRTLVKRNNVNYMSSGGHNPSAYYRTAIDTKGCIEKLALQVDQSWSKKQMTGENVYIRLSLQLTERPRLMQKKQGHHY

SEQ ID NO: 1000547 - protein, 86 aa, Homo sapiens
RSRFAFPSGEQAIRKAKDGCSTSTLQETMDERSSADVMRLSSVGSAAGELPPVSLSSSTGLSRAHIHGPELKRGTTGGLSRTKVKD

SEQ ID NO: 1000548 - protein, 186 aa, Homo sapiens
MEIFPWTNRIWEATVYTIYKGESGATVRGTLAISVTSHVTIARRGFKAFCKWVLQASGKKKRWCGTQKLIGIPTVGWGKKTCALKAEDYTDRRKPYTIYLQEEKIMNFFTCGKGKEGDTAPKRVYGKDRTKPNVGWLDDARETLDRIGFGWAFGTNLVKHTWLKGEIVVFPKIILSFGNLASWFLI

SEQ ID NO: 1000549 - protein, 147 aa, Homo sapiens
AGAEKEPPGPRQTVSGVGAGLGTRAGPASCSSSGTRTALLAVYGEGVHGCLITDVTVEAPVKDLEDVVKSTKIIIGMLRGHHRSWCAVMLVAFYKVCCKQYQTPQSTMGPCSTGGDHQPWTEEADSADSVVWRGRQWSPRAQVGEWW

SEQ ID NO: 1000550 - protein, 273 aa, Homo sapiens
SGSRVFSSSQCPAYLPSPLAADRVLPLTDRVALLSSRMIFLLLLLLLLPPSLPLRLIMPLDPLRQQVPALHKEVQRCSVRTFRPLTRHVTRVVCSGTPILTLGRLSGLLPPEQRYTTRGARPLTPHADTHCTLWHTRRWDRLYRSTTTPILGSAKHLATIGIRQHSCVRVEVRNCILLPWETVYVEPAIAAQHQQGEERRGAKQQRDVVAPSQEEVPTERSTTGTQVALDRTRDHSWNTKRTLTRNAKTRPQTRARTGDPLSTGLVTRTAWYQ

SEQ ID NO: 1000551 - protein, 101 aa, Homo sapiens
RGAVSGRVLCEESECVELEMRGAYELTLEDGGEANEELRADASPRASIRAFLRAWMRCSKGRAERGDSVTRALLNDTIYQENDELVETAIHELKRIEKLSR

SEQ ID NO: 1000552 - protein, 73 aa, Homo sapiens
SGVWHRGEMETKTVITCLKSLLIIYSLVFWITGVILLVASAVCGNNVTLGTVVLVPLIDREHQGNVYRICGSS

SEQ ID NO: 1000553 - protein, 123 aa, Homo sapiens
MRRTSSWRHHRFYRAESAGVGPGREHAVAGGTEDPSMEPLRGPTSRRNDEHQKSSVCEPLVHNYPTEAMLSVGPSLSGAVAWFTSKARTGAATQSVGNFGSIGTDLGRTGGIQARQRRCLIRT

SEQ ID NO: 1000554 - protein, 79 aa, Homo sapiens
AELALVSPAPAACPPGLVASALQRLVEQLKLELGVDEDQGSHHGSCMSLQTDTVSARYACEDAYCWWAVPGGSNPFRRA

SEQ ID NO: 1000555 - protein, 129 aa, Homo sapiens
MHTWTDDSHNVTYRIVTGASSTIDPCSSFIALGAGIDVLVALYSGDALCVQKDQGIMGGRRSIILCIVAVIVLDHAVVVELVHRKEGSFISEHQSSLYGRSAFLRYSAVSRTYRVPGYSYYFLEFTTLG

SEQ ID NO: 1000556 - protein, 37 aa, Homo sapiens
MDTGQANGDCPHAVRGHDGPRGPGTTPETATTGTTEN

SEQ ID NO: 1000557 - protein, 225 aa, Homo sapiens
MPRLLAGVPVAPRSPLVRYFPLLTTPNPEPVSAEVTGRQGGPKHDVPQWTAGAAAYWVRGAPEPPRARGALGRPKKAPRAAARPSIGAGLGADGRPCAVGCAYGAIQPERTESTVCPRVTPENRQRRRSPCWLMAKRLATKRVHTAKCTHGPRKRTRRTSARSPQSSNTGAAYRRRKTSSQKRRPTHTQRNEPAKAARGPSHDYSNCTHQHSEADACPGCTQTPE

SEQ ID NO: 1000558 - protein, 274 aa, Homo sapiens
MAGSRLPRQLFLQGVAAVFMFAFASLYKQIPGLYGPEGILPVKEDAAGPQGQWGAGSSCGRPRRCCGKRRDWRLDTGPEDLDDCMTPWLRVHIDEPLGTPVLAWRPSVTDQTLSVIIACVSEHRRYTEYSAAEGGARDVTIVIVRCGSSPGLLDDWDFHGAWLGGVRSLKAKPSLAGKAGPTKGECSAREPMSQRIDHPRSELVQMAACSSTRCTPSGVVKLTSQLTCSGGGSADLNSTTTETQLPSHARLSGSDNSCRSGCTSSAVVDTFLIE

SEQ ID NO: 1000559 - protein, 193 aa, Homo sapiens
LTEDTLRWLKKIAPSSDHRVRMSNKMVLQGLLGDLLHSPNRGANCLSRVRAAYPTCGCSVDWLVQQLAARLLACGGLGRGPAVMQDLCGVGPWAPCAAALSDLETAFTSGRLRARHFRRPASVWLIIHGMPDGALAQTFNPGLCWGRGRYAYSFRALHVASMWTGSVPGHCARHSNPELVIVWPADIPLHNEP

SEQ ID NO: 1000560 - protein, 230 aa, Homo sapiens
SVRSRRQGGNEEALKSAAGKQLSYRHPAKMISSRAQTGQYPDGLKDIVARRELGRAVLGNARPCETINNVLQLAVLFKELDYVIEGIATMDITRSWINSEVFSQDEEYERSGSGRKRNHEKNIRSVEQRTEDNSRVGTRKSSLTQYGERSTRHETDIVLDAEHELVSDERTMPVFTSSLLAVRRHLSKREGKIGGRFFPRRRHPVETSTPPIITTVQQHVSTMSLRYVPA

SEQ ID NO: 1000561 - protein, 167 aa, Homo sapiens
RVQRAGRRGDPRNVVAPADSALPPVLGDACVPDHDGAAQCRPPGSIMLATTLLGASCGRSAGPLVRCRRDPYRRTVTQSRSAGRPARPFCCVLCSGLSRQSMDGSLKHALDARAATIDTNWRTTRAYVGSVPDARRLRLGVRPTPRPRVDPQAFVREQEELVVASQA

SEQ ID NO: 1000562 - protein, 203 aa, Homo sapiens
RSGGSETARWVERVFLEGCDKVGARCLGMLLLLPSRREIYCGVGAGCRLDLPKPVRMGTCSLTVARSAERIQARVEVCSNAGLQVRWVPVAVLTSCAISTTLALTRMRVTVPVGVWRELLRFHCLISSYYTFTVVFRALCRSTMRTGETQNSDGLGHYGCGRNNTAEERRISVAARRITLRKTPKDSWVAHMVMVEVILYTQA

SEQ ID NO: 1000563 - protein, 157 aa, Homo sapiens
RMLGLDACELGAARLSERLLAAWRLCGAGGPSVDCIKEGVGSGLAPDATMGGGIECCVLEVPGSRWGGMSPLENHSGMLETSVTDEGDLAQRLLMSGCRAWEPTWPTRCPAVTPMHVLAKCCKGVTEGLGTRSPDQWKQGRLAGASCVPMGSSFQQG

SEQ ID NO: 1000564 - protein, 83 aa, Homo sapiens
MLVTMSVRDADPCTCCGLSQGSDDRPAEAPAGARSKNRGYAATLPACQRVPARQDGRLENAERRRLHPRVWHNAWPPETPPDM

SEQ ID NO: 1000565 - protein, 30 aa, Homo sapiens
MVGGPCVWFGNNVVRVYFARDPDVCFDSRI

SEQ ID NO: 1000566 - protein, 268 aa, Homo sapiens
AAVAVAPLRGCCPVDPYHGGDHLKIPPHQSVLSGVSVYNVALRSVFKQCGEVLQSLEGTSDVIIPSPSISSLVERIGLASVEWGGRRTSEYYTFMWVTLPSDLNKKSAKQQEVQVKTLTTCPRMMSISSSAMWMRMVWSGEQVLLCNSGQKMRKTSWWLPTQGEVAEIEQHNKELCHENQELKDGCISLQKQNSDMLAELQKKQEELETLQSINKKLELRVKEQKDYWETRAASTEKNKTRRCPQTSEKTGTPTWIRFRPQLSLQRQN

SEQ ID NO: 1000567 - protein, 264 aa, Homo sapiens
SGVFSLAAGPVPELRLSHVPASHLGPHNATIECVESQQKHHWNEHRARRAKAMCEEGELIGTSMAVVLLYATGPQSYSARDTQTATDAGRRQRSQGNEERQQLIGVPTWTKYVDTAAENERQHWRTPPGHRSGANREPHSRHRKNTVAPKTLPEERPPNTQPAAHDHAHYLPSKSIGGPTARNHSTIANAVRRDNARPGGTPAIEDHADPGRPKGTLTKAKHAPQSTNGDPPRAKRNGVSHRQAVPRRPGRQAARRRTGASTTG

SEQ ID NO: 1000568 - protein, 124 aa, Homo sapiens
MVGLPERLCSPLLSRVIASEDIWAPAPPGPGRPWAAASTRRGMDKTLLSLILYCHSGSGSLVGIDNKIEQAMDLVKSHLMCAVREEVEVLKEQIWELGERNAGWRGEWAVRAWQPEQWSLPPRG

SEQ ID NO: 1000569 - protein, 132 aa, Homo sapiens
EFSTEVKAVKLRRDRIVVALDSMIKVSTFTHNPHQLHVFETDNPKASVSCPNSNNSLLAFRARTRAMCSLWTGSREATDILHTRCLSCDQLRQDDDRKDAYRYVLWIIRLRVQHISALHRGPIWFRPGMLFA

SEQ ID NO: 1000570 - protein, 116 aa, Homo sapiens
ISARHPRVSVDPMCPSPLKPLNQAVWPGSLQANKSPTSIELLGLFLCPLITTQLFSDYLAWSLILLSSPDLLWLYCLLSYNSTSSTSPVIAQLGPQSCRSSLCSTTPTCPRDCSVT

SEQ ID NO: 1000571 - protein, 212 aa, Homo sapiens
RRKTERRESRVGGSTSGAKGRGGTLVGADEEGGLSELVPPRTRPPSRLGSRCLLERLQHARKREPSGRRLAQGGPVGCNQAPWPECGTRARGGAESADRRQGLRANTARRGTADELGPGRRRAPWAPEQQHRASYVFGLTAELCLDGSSNTELGTQRHSRSFGDNTYQVLRKLRTRCHIGRKQNLREYTDELGPPSSRYYALLELVFPHKES

SEQ ID NO: 1000572 - protein, 104 aa, Homo sapiens
MRHNLLVCAFAKTVGKAQNYGWECLDFSRYRIMCVGFAVGLGNGNFRQSPCASWREVMPLPCSVWLHPPSDKTTDEVNPVPHVWKMQEDQSSHSGSVNIMGKLA

SEQ ID NO: 1000573 - protein, 235 aa, Homo sapiens
RILSSDAAVAAPARRGGKETPSAGGKGVYDSGGRWGSTGERDGNKGDTDETAGQADGAEGRRGGPGARGGPSRRFLGPSLPVLPALQNPGQRVSLSRLILHRLIPDTLRDSASYSAQDRLPSHDLLETGRPHLTRNSAGVLPHHHDGSPAPGSEGVPSTYRTQTQGEREPETGTPFGESLYGLKLREIAEAPSGARDAPDEYTRGPYMRTPLKRPSTCKGGRDHIHREYCPATTK

SEQ ID NO: 1000574 - protein, 249 aa, Homo sapiens
RETRRMLQKRETVLLLRTFQGRRCEIVREHYCRSCVPCHSPRLHHSPPHCRPRWETLCLADVTHLPCSLDVGQVVAPYISEILALSCGCRRHPIQCMARTSPSFPALAARALKHERPAEHHVIRSQPSAPTHPMRLSTGIARRSPRTHVTLPSVSDVPPVTTLSPSPTRRPWPDIRSPHPQRARQRNEARRYPHGHRTRPEPPETPQTQSAFISHRPRHAWPPRHPPTSTSHTGQREPATRPPNSRAHG

SEQ ID NO: 1000575 - protein, 66 aa, Homo sapiens
METIDVAVLNHFTFHENCGPPVKSQFSNYAGPGLDHGFLIPFLVMPDYTKPRGNSGTVPSSDGSHE

SEQ ID NO: 1000576 - protein, 134 aa, Homo sapiens
RGYLAASESSLVDMVTVMGECRGRRLVRFVPGVVFVCVWVAVLRCHRVASGRRTRSSRVVGALLADILGIRGAYVLMRALALEDETPLALRRSEGVFSTSESCEWTVGVNAWCESNGRPLVCGRGETLGWYGMP

SEQ ID NO: 1000577 - protein, 200 aa, Homo sapiens
SGAIAGTSVPQANKAWQFPPHVNELAGNTTDLWQAESSRKPFDLSTLGSLINGDETVLQKSGLQSLSVLASVNRRIRSGLSLCVSCLEYKGKKVFERMNSLSLVKKSKESESKALKKADSVVDALECQADETWVRLKADGQLERTRHLGSAFGSQENLTVEDNDMTHWSSTYSTYEACDNIKEHEIDTRSTVLMATLATR

SEQ ID NO: 1000578 - protein, 72 aa, Homo sapiens
SGFCSHFRPRTGGSAASAEGPSARGVWDGVGPANQRLEYEWKPDEQGLQQILQLLKESQSPDTTIQRTVQQF

SEQ ID NO: 1000579 - protein, 108 aa, Homo sapiens
MIQRASTLARVRCRGMAPLMEHQFPLVRFVPLLRRNPTTEVVRPGALLDKLGGEAGPMTVREGDTWELFPKSIVRKLWWSTLHLVRPIQLWITRWFFEKGSPPFVISK

SEQ ID NO: 1000580 - protein, 40 aa, Homo sapiens
MRRHSGATQSKALAEVIPFIFPSQRKMVTAQACALTLSPE

SEQ ID NO: 1000581 - protein, 70 aa, Homo sapiens
RSLNDDQSTTRTYMCRTSILLSILVLGLGIELLELSIKIRAYSSVEWSIYGLRRWGFPDIGSCHLQRKTT

SEQ ID NO: 1000582 - protein, 254 aa, Homo sapiens
MKRIRNDGPKTERKNRTKPKTKEEEKNPKTRKNTTGNKREAKKNQKAPKRIKKEKKAQHNPETTKGKDSNDTTQNRTKKRTETHRKEREKKKKQKAKKHKNKKKKQSNHTKQNQEKKRQKKKTKKTKTKQKQKGNKEKETDNEKGKAKEKQKQNKDEKKRANKKEKKKKRKNKKEQGKESEGNKEKKEDKRRRENRKRTEKEKKQEDKQSKERQKKRKRAQTGTKKKGAKKRETRERRRKETKRKRERHKQIKD

SEQ ID NO: 1000583 - protein, 67 aa, Homo sapiens
SGGDSPVAPWRNAEDGRKLGPLKNLQDESEEEESEEEPKTRMYEEAYPSGVTEYDFKRMQVAVMTDP

SEQ ID NO: 1000584 - protein, 213 aa, Homo sapiens
MKRLLAAAGKGVRGPEPPNPFSERVYTEKDYGTIYFGDLGKIHTAASRGQVQKLEKMTVGKKPVNLNKRDMKKRTALHWACVNGHAEVVTFLVDRKCQLNVLDGEGRTPLMKALQCEREACANILIDAGADLNYVDVYGNTALHYAVYSENSLMVATLLSYGAVIEVQNKASLRPLLLAIQKRSKQTVEFLLTKNANGNALMSLNAQPSCLHM

SEQ ID NO: 1000585 - protein, 206 aa, Homo sapiens
RAFFLAFPAGWGPQPRPDPTGRPEGGGSLVRAGARGPPPNGVTDHPAFLRSWSSRDQWGVPFGGARPCNWWIFLNRFGGGSAALGAGERSWLELLLPLRSALSCRSAPGLPRSSPRSADALPDAAPRAGPLPGAEMKVLGHRLELLTGLLLHELTMGGLQELGFPEEKPLLRGQDAHRAGELRCLPLGCDTDWKDMTSEITLRLLD

SEQ ID NO: 1000586 - protein, 168 aa, Homo sapiens
SWGGTRGGGQYRYLPLSSPRLVAALAELLLWRELEAGVMVSVAEKESARGDWLRGSSSALMATMYGTADAKLSPRQQPTVCREASLVVCQALGLKLEAEYTPFLGKYRPYMWVRCCQTCTPKSWESLFHRSIADLGFCNVILAESAAENHNGYQGAWAGIWQASCLYS

SEQ ID NO: 1000587 - protein, 194 aa, Homo sapiens
AAPTPFLFLNRHVPGSSPDSLDYYGIGRVLTAGEAGKRILGRKAWLGLRRRILHRDLLGNVILFYYFLWSWLYCRAGRRGCSRPGRTCGSLKAPYRRQPRAAPQPGTWCRLPRTLSGKRRRPIGTRETVTLLLEADSSQASHKPQTSPQQPTPREVPQSIGSLDSLAVAMGRYSSGACPLVSQASDAHFMAQQG

SEQ ID NO: 1000588 - protein, 137 aa, Homo sapiens
MPAPAPSVLFSGASQAKPSADTEQRLPGGPQPPRESARHPVSCLPAAAQGRRERVMVTHRHHPGCGHLPPAVPWEDRPLLCACGEKGGVIFLLLPEHNSPPPALSGVSKVPPDRLSGHCLFLLYREQLGRSNPQDRP

SEQ ID NO: 1000589 - protein, 209 aa, Homo sapiens
MVSTDLIALARTAVSNSSAKALGVWRRCRGNSADVPRARGCQIFVYPGHNRRVGTLGRAGHGAICTPLGGEVHSLRRHALQNLGAIVPPVGRNHHDNPPPIAVLDRVAIEGPVAPCVAFTKVLERGFGTVFLKLAGIPVTYLYPNCGGKLWELAAGTPLDQQRVSAHFRKSLGLLETPRNSEWKPKRWGPHSKWGNTKRGSKRLFRISL

SEQ ID NO: 1000590 - protein, 235 aa, Homo sapiens
RKGYRSPGKDGPGSGAEPSVVRAMDVRRLKVNELREELPAPWSCTRRGRQGPECCLSGHAGGGGGRRAVTTSGTLRRRSHEPGRPGHDRTRRCQWYEVLNHGRNPEFYRSTRKDQSNITDKIGRHELTEQGDHRGTSWKDPTMPWAYFVTKTTEEIEEGKYETATTEDHAHRKDVCAYSQPLKQDLLLSPSDGTRPRAEGVSPRSLRHEGALFVGKNTARQEWLLFETTWKDGLM

SEQ ID NO: 1000591 - protein, 230 aa, Homo sapiens
SGGSSSRAPGVGPRRPVDGTLVPIGLAGLISNDSELKFVVDATHSDVGDTVETLMITSGKIKSVIVVASDRVRTVLFHSITQCFLGSPFKTRSCETRIHDLSRIYGSEDSVGMLGVYSLGRWFRYGKSLDGPMERDVTLTSVEMSSLTIRNHTSGKASRSSLKPRSLARPFAQRRFWSQSSLGRVGLYSSSLAGVMYSTPYHPVLQKTRYDSGKYWASETYLTHALRSIY

SEQ ID NO: 1000592 - protein, 307 aa, Homo sapiens
SGPLSLAAAGAPRLVFTALRPVLIKARRCDPVTCKNLEVHTLHAATAPLDTPRTLGPLTIYGTVTHIELTRLDATLGNCPATTCRTTRHFYYYDDTVTCVTTTPYPRHTLRSYPLAHFARIVYTTTEPALHPWPSARTRASHERHPCDHSLTLNRTLDRTCAHEPNYPDPTGFTCLLPSTFSSWPPTQHLASIETPLHRPTHSHTYTHNCNTYPYCASRITHPVRDYPFDIQLKPNVSTRPPTATPVNTRGAPRNFGTRAPPRPLYPHGPPPHMANPPTVHPPSIYTKHRRRNSRARLPPDHVGISP

SEQ ID NO: 1000593 - protein, 81 aa, Homo sapiens
RELRVLRTGGQLCVSDSGEINESDLSNSCLADVASSRAVGNEMCLGMRDMAVLDEMTPYSYYTEIHSLWLPAEKYADMIDK

SEQ ID NO: 1000594 - protein, 319 aa, Homo sapiens
RVLNIRGSRPDPDRVWGLREAERCDGVVLLGLYFLSHIPITLIMDLQGGDGVRALPKLQRLERKPVCTAGSGSKEIHNTSRVLHGAPRPGYLRYFLIIDQQLQVYSGVPYLLPSLATVSAFLNGWINGGGNIPLIDSRKSGPTNLSGDRYLQSGSGDGSPYALVVENATMDFGGKYARVDLCLERDITCGVTLTVCGHQACTAAGTSYWEKYHMSVNYMKALHDIHVNANDAMVPSWGEFPPDTTLDSLFYAAYILFLMASGLCIHTRAVLNAGRKQRLNPYNVAYSYFNLSLPVPISLNCSSTHSVTPAHQLHMPNTL

SEQ ID NO: 1000595 - protein, 109 aa, Homo sapiens
MRLVQTMLDYYVRSDSTTTIDIIYSSSKTDMEPVTPSSTGTLQWYRILRTNCKLHKYVTTRIIYREQISAYRISLEENGEGRILCKVTVISLGCCALSRMISLSIGLNT

SEQ ID NO: 1000596 - protein, 247 aa, Homo sapiens
SGFSGTSWVAPGTTVSPGSFSTATISPGASRTTGAAPAAETTTSLEGGGTTGAEIKSGATSGVPGSKTGTAGVPSATTIAPGSSNSEATTSLGESGKTRVETITGTTEGKTLAAGSAHTEATTFSGGSGSTRAGPLGGASGTSGGYVPGRETEPTTSIEETGTSRTIFKTVGITSAPGRQAGTSVVAPSTTVAPGSFSTAATTSPGASGMTGVRTTSKTTSCLGGTGTTRTEIKSGATLEHQELRQI

SEQ ID NO: 1000597 - protein, 259 aa, Homo sapiens
MRVGGGDRVSVLLLRLPHLAQRLAAFPAYCSPSRSPQSVTLQETALQSPRPDRRTNDPARHGLLQPHSTFTEPPEGRGRPGPADRSPRPHDDPLAPRYTEGVERPAGHSSRGRDSEIHADTLSSERKSRTPHDTYPAKAPTRTKRGRPRPATQTLCSVPDTLGPPRATTLPQHQLRRHYLSLAPPPATTKAHPHSSSTPPPTPPYTGQQQPAHLPPPPANWPSYSLAPPTPHRHTKQSTHTRTRHPTRAAHQRPPTTPP

SEQ ID NO: 1000598 - protein, 149 aa, Homo sapiens
MDPRKKPARPGFYVELQRLSGFGGEGDYERDFNEMNPVPSAFVLSSSRVLVTLMVLSLFLKINMAAYSPASQTLVQPSGKWRKNYLPTGIPTRSPGVLARFATQIGKNTVCARGLKWTIVTKKSRDFGGLVAENSVFYKQPCSTAGLPV

SEQ ID NO: 1000599 - protein, 212 aa, Homo sapiens
SGVHFRYYAAVTMGAALVRRREAADKLFAASLHGRSPCPILGSVVRDWRSPDRRPRRPVSWTSLRRTNRDDDLTAILHVPHDTDEKAGTDCVIPRWVCELKTNLKTPRTTGEHIGAEDTAVTAGKPIHDADNGKADRLLRRGDHELGHKSNNCRTPPVTDQACNLRQSTNTPAEDGTADTAARPRYAHGSDDANHNGKQQAPSSPGNIPPIQ

SEQ ID NO: 1000600 - protein, 186 aa, Homo sapiens
ERVTQVSDALPSCGCWLCSCLLIPLHGVSLASPAVCPLVDNCAPVPCSLFVVCDFADASSDACLVNAVMECLSAVVACGWVMWSWCESWWLMCPGPAWPWLIPLGLMHLTPLGDVSAPCWALVAPLVMVRHPMYPCNTGCSGVFALALVVHNLPLLTPLLCTPNSCVCDIARDILPGRWPLCLGPI

SEQ ID NO: 1000601 - protein, 224 aa, Homo sapiens
SGRICIAAKRDSNMVSQRNRSPRRERRPFPVPHSPGEEKRTRRRIGSDGLGREIGGRRTHRRFPRTTTGWLRGAHRTEHRLQDRHVSPFVELHRKTTTMTGNRKRSNSKKRPRKGNRRRIYSKGKPPYEGANNQLTERYFWTLLEVRLGFWPSCSTSTKEGYTTGVHGRLGAMVTRDCPIKMVVLKKGEDSYDGRYDCTVGTEGWNVLAREHFWRVIDFAMHQY

SEQ ID NO: 1000602 - protein, 395 aa, Homo sapiens
RGRRRRWGCLGSYLCLWSSRSALVITQHIALFARKYVLLERPRRGLETRSGGELRGEAHHAEEPARTRRSGEITGNQDHYCARHSRTQGPTQSTAPGTDRSSDKHSVTVTLQQHQEEHNGTTTKTNMSQHPSERTPQAASTDSRRMTCRTEHRRDNRGDADTAQQQDDTAGTRPPSHQGAVNRAGQPTLRLRTATRSHPPPTRMANTPSGSAHDSLACGTRRQGEVKPDTRDLPAFGTDCNRKQGRSNRQHTQSKQEKHQKTGKKYQTRKTAYMDNAQESGQAPNSQRKRRRRSTEQSARPQRLEEKIPKGRRDAGTRKAKAQPEGSRDAESNRGWTAEATNSGTTSRGPGHRQQRQRDRRRQHRIKRTRTARREHPHTHHRRHHPHRHRHHQTQ

SEQ ID NO: 1000603 - protein, 248 aa, Homo sapiens
MGMPTVPVRLSCSAPGSAYSCLVLTRRQHAQRASAAAHCKEAKSPSNATLLSAQTAVYVGLYSCNWMFPVSLYVTCEFSFTLTYSQRGDLVLRYNVSNSKRHSRNYAETQKRRKGGPGRRETGKRGEKGPGNDASGPRCGARVRAAEPLGPQAVVTWVATLVEAEELLDRRFGGPSGEAAGVVAESSLSSSRRLAHGSRVPDALAVSAAPSGAPRIANSRLQLKGRERGWVSGKPFYITGSDAHVRSE

SEQ ID NO: 1000604 - protein, 110 aa, Homo sapiens
MSGSTYSSGVTGPTNNLYPYSRPWNHIASMYRPRHGGLYFSPNKSWHTSTRVHPANPSVLPVLCQVYGSRKRNPRQAGSFHYAASTTSRMATSLLCARHYQRVHRPTGGH

SEQ ID NO: 1000605 - protein, 198 aa, Homo sapiens
RITGAKQGTCKSHGEAILKPAAYPLIDTYKMSLVQFGTVVLVPKGTWVSRESNLRERLADKLLLTSLDMHDITVLVTAGTDEGDELEDAISSCGIHDLWLPRTLKDYSTLGQPMAWCQHASTGHTSRHYHDDCLLNILIRPEATHTNTTPVEMPRIGNHETLYSLTIPRCRDDGGTHITTYRRGTTRCALYLNEASRL

SEQ ID NO: 1000606 - protein, 280 aa, Homo sapiens
AEGETDAGADRAVRPSAARRPPEGDRASLAQVSGLRGHRALMISVIAGPPSAHWNLDESDLTLQNLASITREGRSSPATSSQDAICLGDAYWCPARDASLNASVPEAGPHRSEMISAPLGRTSDIISAMLDEPDTPLGTALFLNSQVGESDDKSLDEQRSSSVFQIAAAVYQGESPGLAKRSQTGRQRGEREQQVDMRGLPAGLGPVRTRMPQSLPQRNEKGGPRTNGAPRRLSHSSLVVHAPDERTANCRGRGGDAEATAREEGRDPGGLGPRCTTRTR

SEQ ID NO: 1000607 - protein, 306 aa, Homo sapiens
RAGRRAVAGGAVLGLVVRSVPRPDPPALRPRSSSKKEPMRPEAFPAARDPDTCHPLLPLPVHACAAKRQCDLTPVLAVPVSAGHVGPCVCSLCLDEPHVPPVYPMASALRGGPPPDVTEAMLTEECSCPGLGPSSPSGSAVDMITRRSLGYWYVNFQQPADAERALDTMTFDVIQRGKPVRIMGLSADPSLRPNVELAQHIHYQIWTNPLHPKALYDTSSAFGNHPFLLTWLADDTLVPRATRFVPFETHEAPAQAIAHPAWPGPHDCHRIGGRFSLPQHASRPGTGPTLRPLPSHSGTHATTPHR

SEQ ID NO: 1000608 - protein, 109 aa, Homo sapiens
MGECMRGGGWSAAAWLPCALGRAMTMRNGAVGRKRRTRRGPQVHRRRGLGGAEGRPDVTDGSPWRKPTLFRPSCLVKSVKFLGRPSPVVFTLLGLYSWNTRLAWHQKPQ

SEQ ID NO: 1000609 - protein, 267 aa, Homo sapiens
MQSGWGTGPAVPLQADLSKASGPPYSGLPDALLVCVFVNGLLWLTIEMGVWVELPLLVMAAARRAGRCRSYLAVVIQLANIGPLLVSLLHQFRPSCAFRSAHDLQRLARAWEIRQPCIHRLPVTLGDMSLRGVRGIGHAQRVAFLVLTFFLALVDCTSSVTFLPFMMPAAPPYYLISFLVGEKDSVGLLPALVALAQGSGLTTCVNVTEISDSVTKPCTHRGQTDIEAGSSQSFGCPASPAMEAALSRLESRYLPPTFHPGLLPPPI

SEQ ID NO: 1000610 - protein, 77 aa, Homo sapiens
ADQTFRGPGDTGSELAISRGPKNIDVVRTMWNMYGADMTITVTKVIDFTLEVLTIMGVLGRVRRTDSVLGDALTCQN

SEQ ID NO: 1000611 - protein, 242 aa, Homo sapiens
AGGAASSLMAAPASVMGPLGPSALGLLLLLLVVAPPRVAALVHRQPENQGISLTGSVACGRPSMEGKILGGVPAPERKWPWQVSVHYAGLHVCGGSILNEYWVLSAAHCFHRDKNIKIYDMYVGLVNLRVAGNHTQWYEVNRVILHPTYEMYHPIGGDVALVQLKTRIVFSESVLPVCLATPEVNLTSANCWATGWGLVSKQGETSDELQEEQLPLILEPWCHCSTDTCPTTCPKCCVLGTS

SEQ ID NO: 1000612 - protein, 171 aa, Homo sapiens
AGVLSIERAGTEAAYRRSAGGCNPLTELAASVCARASDGWVRRIICHGSMQFYDIPGSSGALGRTLRCHDLCCYARSLTASNRGELSTKGATESDGCAEAPRLGSGELKPQPPQLALSRDAVGLNILDVGESRQFTCNLSEYSPKIWYWSMMYRRVLLQREYTMRLVTEST

SEQ ID NO: 1000613 - protein, 216 aa, Homo sapiens
RAVDLGFSPGQSESKPGPQGGSCPCESERSCDLGQLEGLWAVASPGRRRKDAGRMSGGSLRPPAGEPRRGALEGHWDAWVGWVGERCSPEMSESVMGESHHSHHSIFKAKSVTVDGFEYLHTADLTRPVECLTHVDSPWRTCDAVGEVQWHGDGSVYTTEGVLAEEVPEIGHSAEGGLKFSRPPECLRHHDPCRSNGIIRGKGTSGGACTVVTDNG

SEQ ID NO: 1000614 - protein, 113 aa, Homo sapiens
MSFHNSGLAAGEKAWEACSPDGRTMQDSGIYRRRLTWIEGNARHHRILMPWLGYRRNSSGEFLLEGTVGRIPVHIRFIEAGETSCRRKTAVGDIKKKRLGSKCCPGLLYFLMQ

SEQ ID NO: 1000615 - protein, 146 aa, Homo sapiens
MSCTIRRQQRNFGSKLLETRYTRGQKFHPMENSNVLETTRTPVPLYTSDRATPTLRRASVHTSQLRLIPATTHANIFAPSSHLQSPPSHLDKIHEYHFGTRPQPGHQDHKPRLRTTRHTTHTPRSRPHLPAHNLTSSTAAYHHDTH

SEQ ID NO: 1000616 - protein, 446 aa, Homo sapiens
SGVAAQTGQDVGRKGQSCPGSQVRGGRGGPSGQGQGTGQEADSSRQRRGTHETRRHAKQRVQQHTKQTNNNERQQKDKQRTQRHKTTHKTETTNTTAHHAQNGQNTGEVERIREEGEKERPNTKTQKSETGKHQNTKERSTKQTENATRDTRTTQETTKEGSNQRKAERQEERQREEKRLKGERETGEQQAERNGGSETGRAHEQPTGRQANERAAETRRRANQGTATDGGRQRRRGHHAAEAREAEATEEEEERKTRSERRDVTPRTRKTQTRPQERRHSGTADTTTGRAKGAGPKPERASRAEERTQATRHKEASRAEPPERKNRTPTRRRTGERKTQERRGSTDRRTRRTSRKRTKRRNKHQGRGPGHRGPKREKGEHRRQRRKQRGKIREKTEQREVLGAQECRRRQTEDTHENRTHRAQETRGKRHKEQGHTAERGADKTT

SEQ ID NO: 1000617 - protein, 136 aa, Homo sapiens
MRMLETSRILRPGRMICNESGELACEWSACACTVDSALWMLLNLWTRASTASNCSIYMCQDSRGFSPHYSAQVLVPFLLTYIAHDKFPTVGSGRGNNVGRAVRDRRLCLVEKDCGKEVEGLTIIPILGDPGKIHST

SEQ ID NO: 1000618 - protein, 231 aa, Homo sapiens
MKKQIQTDMKARMGKPEHDERQRLTKTNKSVQHDSIVHYTESHDRPTVKATERRPQDWPTTNTPTKAAIMGRSKWIIAQRGPQRAMRKPRKQDTQHRAGHKHTEANPTHHPPKEYTIQVKTTNHKPQRGQTHCPPNTEHANQIRKTLNTPYHTGRTTPGPSAGQLPQRTAGGDTSSPVTHPRQHPTRGPPKRGRTRQHSIGPRHRPHPHSAYHPTPPHPQPTEGPPTQTHT

SEQ ID NO: 1000619 - protein, 74 aa, Homo sapiens
RGPGSGEAGGGEGRGGAPVAQEAVPGARRGRVRGEGAQEAGEDRGAGEAERGTQRCCRYRKPGTKERRTTWQTT

SEQ ID NO: 1000620 - protein, 315 aa, Homo sapiens
ERGGHGVGRVRPEEGLMRRWRCPHRMCPRRPLQATVQRSPVASSFLSSLLGLSSGHIFCVSGQSTQPPTPCPFFHFQAGRVSVYRWCNTANKVIASISAPKIHRLPLSTARSDARGYPWRRHLNASRSLTQQLADCYAGCCTVARAGPGPMSQSSLGLLTDSCGPLTDSHEGPVDPSNRSDQCYVRLRRLPGLRHFTHCIATHRGDLVSLVTVEPYPNTEDSGTSEERRPSRPWRLQDFDTGPNTHRISAELSFHRRIRAYPYLSSNRYFQLHPATPVAQTTLLVDVTLHLPLRRYLRLSSLSCPLREAFNRNPT

SEQ ID NO: 1000621 - protein, 318 aa, Homo sapiens
SGPAVSSSWGSVVAMLVGQGAVAAVGPRVCHLRGGAAAELAWGRRTARRTSWWAAVCFVKSDVEIKLLAHRDKRCTPSMATLKYQTDCAPNNGNLMIPLYAIKGDFILKIEPPLGCTFSEPTTSGAPCAMESVTSDHSGGDIELLYFTGFSAELAKASHYLKASALEHLLNILATHPTWAVERRQANTVACNQLPKPHAVHVPLIVCLATMLSGLCRDSRRGDAIRKWVEQSMRLKHLPTRLHDSSDSRAPTPQSVPPTLALRERRATRRRAGPGGTVLGKQTRATSTTDRDTVQQSTNNGGQTHQAHAVLANTDNPA

SEQ ID NO: 1000622 - protein, 145 aa, Homo sapiens
MSQPNEDGKNMTWTTQQEAKGPRKGDKARQRRRNYNRRNSKRTSDTDWVSRRLKASEAYCKVNNARGEEEIRVGRSWAANSWANEQIERDRNSRTMPNNDTTKIANGVTDGDGGKRQHKNRDRNRKWEMEKTKVEPGQFKGALDI

SEQ ID NO: 1000623 - protein, 271 aa, Homo sapiens
SGGVIEAVSRAFADPRGSFTPAPNLPRLGLGRPSMLALGSTSAPYLQLLAHVRSADSPRTIEPQAIVTAGPSSPRSECMMPTGEPVCLHVPHLCKELLARDTVQVELIPEKKGLFLKHVEYEVVQPAASSPSVYQDEYNDFVVFAGRCSCTSSAYRYGACPATQAECLGAVTGDVHSEARRRAREALRQPGGAIAPMFSEDVVLKLFLSFSGSDVHEQVKGVSTVRRGRIPELVSWIPGPRTSSQLTSSQFAISRELIRNIYNSCHKAPRQ

SEQ ID NO: 1000624 - protein, 220 aa, Homo sapiens
MGRPVLRAGQQLVACGGPRWRELHAGPCAMCWWLGVGLPGPGPPDAGMGCCACAACWVSADPWEAPTSVTTRPDLIAWSPSHFSAASAAQEDPELDSDKDETGAYLIDREPHLLWSYPQTTSDHGKLIITKELARTNACAGRTADVLQHRVPLCALVNAPRDYSGQLRTELHKGPVTARVPESCQCHGKKEAFSRMGVARMVRRAGDFRTGYEAFGNSSL

SEQ ID NO: 1000625 - protein, 208 aa, Homo sapiens
MKRPEAGGPEMSQAMDVPTCLKRKEPGRSLRIKVISMGNCLNVGKSCIIKRYCETRFVSKYLATIGIDYGVTKVHVSDMRHQSYTSLIWLDILFFYEVRNEFLQGHTGCDYWSMMLGRNDSFDALDAWLAEMKQRALAPHGNMDHYLLFVALWPTNDLTCNQTSAVVELTSDGRSLRLSRTRGPCYLGTLQHQTWPRPSLITVQNLYI

SEQ ID NO: 1000626 - protein, 179 aa, Homo sapiens
MDSLMLPSCSLAPIPSKYGFPTTDTVMPIANGVRLENGDNGDWADSVARGPPTTPDIDQKGRRGISDGRTRRPNSDTGRSGPTEHRTANPTDEQIALSTVKVNCNHEEGTELLITPAQTYRARMDPNRGRQGGGLGGPRKRQGASKDTRPEAARERGGQTETKAEDGRVRRQKDGEAGT

SEQ ID NO: 1000627 - protein, 172 aa, Homo sapiens
RILADAGATTRRSRHAGRLTVAQRGMCMSVSGAERELVKTFEGTMRVCEAFIVTTQGPVDRILYRWYVDVLVRKPPVNLKVTCWVLYETRLYEIFVAHNSPQRARNETIVPLSKIGYFIEQGVIDRNHPVAFIDADVCEQVRLDTNLVILKRKRKQHAWDRRYWGDRTPIGL

SEQ ID NO: 1000628 - protein, 116 aa, Homo sapiens
MIPVGYKCSAYPNAAFSRWDLVHFYPPLRTWVERDWLMVRHEEGHKLLERTLVLELAATRELDHGRGVDAKRVRLALAPRVACFRDHQTVVKGNLLHRLPTWPGYESSPRGQIQNN

SEQ ID NO: 1000629 - protein, 374 aa, Homo sapiens
MGVSAGAAGAVDSCTGAGAWGPGIWPMDTLVSDHISSDVESSIPLVGSRPLQATIYLPWVKCTDVISDTSLYTSLTDRYETCTNYGATYPFITVPLSTIQHGQVLTTQPRVSVKHAHREVDGGKLRADAEWLSREVDDTCVPWAPGGPHMGKSYLGEEDTVVKSGYARKIRGPSRRMESLGVEPRVEDGDHKRDERRPTLAASAELPITDRTGAGGVGKRHRATTEGAKKSQEWKSENGEPTAHEARKRRQREGTWAVTSTATGAGGGKERDNGKVKGTDGREAPEEKEKMRRAGRKQKTGRGKRTEMGREARERKDEEQSEGETSNKRGTHVKRLEQTRVENRGRQVGGRGKRKEQNNKRRGGERRARDGRRN

SEQ ID NO: 1000630 - protein, 203 aa, Homo sapiens
MRLARIKERLETQNCEIPASKTSRRAGWLEDTFTIDERLCSPQLAYKLWFIVRWTSELINTAYTNVLLLRQLSAQAEKWYLKGYRQTSLTLETTAQLIRTKLPDSRQQHEITSSNHTSPIFHHAHQSQTLAYHLQCTRATQQTLPHTKRQLGNARPRPTPGRTSARHTVDEPPTLPGPQPPLDCTRPHHDHRPAHTHTLDHAP

SEQ ID NO: 1000631 - protein, 208 aa, Homo sapiens
SGVSGVWAGPALSPAPSPTAVGAGEAPTGAMRLNAELTCLCQTPPCWLTKYPLLLRVCVLRVNDPDGAAAPRRPSSAMILAPLCSGFHPGTVELLWHCRPSVHVTRHGWLVPALLVDARIPTCPTAVVAWKRLPAERIVRANAFPRNGISSWQPFGAFEHCSARVPLGRPFPRGGNQPASHGPAWLGCVRNPWRRFHPSGARLHAHEM

SEQ ID NO: 1000632 - protein, 318 aa, Homo sapiens
SGCGCAACCGCDEAGGWSLEEEGWLATTTRKTPRPGAMELGCDCVVCVQPARRVLPGAMRSHVDIHWVSHEKCVGAVRTLGGVLATGAQTSPNPMGPLRRVAASTSAFVLRLAWYPRSRTLAFNPRQERYGVGEPRSNNVERINVSEGVYSLQTRSLFIHYLIEECGRKDVRVTEEKNFAVPAPQDHRYANRNLVEKGTYIGVAYKNIYGNDTGAERERLLDQRYTCLGAQEKGRGRHRRGNPSKVSMGERGKGGEERHQGRRRTGRGKEHKGYPDMRGRPVHRGMDHTQTPRDRGGHKTAEEKARQTRPEGTWEVGR

SEQ ID NO: 1000633 - protein, 421 aa, Homo sapiens
RGGACLCCDALAVTCCGLAGAVVLWLAAGCHCELDVASVALCPAVHVELLCAVHDNCVLGAPVCAMRAAVCCLTLGQWPVCLCGCCVLAILQSPSSLPCDVMCAVPAVRMPIDVVKLTFVCDGPETSGVVILMPLVVEHHCDAVNNSHISLNHVRQTVQSKEPDGDTCALYHPRMDAEGLGLAPLEMDGPRKQVDRSAVTRNTGAARSRRTPVERVKRVEASGPLGSSNGPPSVVERNVAETAGPPERNWFLRLKGHSIRVGVKRLVLARDDSYQQRDLGQSLPLSGTESEIVAHLNAPCLGRDTSSHLGKEAVWADPDKVGLGRRATSYLPISRLPTTCKALEQRRRATGRLVYLAQRNSVVPVRPRINGSKVNRLIFSGDPASGHEGEDGEEASGKPFAYFPEDYSIAQVALISKCGLQ

SEQ ID NO: 1000634 - protein, 172 aa, Homo sapiens
SGGDLTKIIYDSSKSKQQIFNVEGIAFYWKKMPSRTFMAREEKSMPTSRASKDRLTFFLRTSEASNFKLKSMLIYHSENPRALNNYTKATLPVLYKWNHKAWQHICLQQWFIEYFNMTVEIYCLEKKDSFQKLLLIDNATGHPRALMEMYKEMNIAFMPANTTSILQPVGQE

SEQ ID NO: 1000635 - protein, 314 aa, Homo sapiens
MGEAEAGGSLERQEFETSLDTHGPHSLNNLGKIWANVHGVYNNKIPGYSGGCRDANVTSLRSTEVHGLVHSLADCVHTTGTPPQHSASPQGERKRSPYITNKQYAQVPADQHPRQRPTDTTTTDTKQQQHERSTTNTDKCKDYTLIHNKKYEFITIRKQKGARSTSIREARTTSAKTHNVTRDDVRLREHRADTKYHYTHTKCSADSTTVHHFNHATPQRRTKRRTLSKSAIKRKQGRAMSNNLTHRMRLSRPRKPYGRASHAPMETESQRRDNHNPPHINMNDPRRALTQTTTQQAHIQHNGTGALPKTRHRC

SEQ ID NO: 1000636 - protein, 136 aa, Homo sapiens
MVRRRKSRRLFYPVNTSSQGHRQRYFQEPIQLKSIQLTCNRCCRWSLTWTNLMWSHKATSPSTSNLEEEEVIFPGGCYGSAVETRLCLGFAGANGDKRDIRGAICPGILGMGRVLVRRVLSGVLYDARTGDSPLVF

SEQ ID NO: 1000637 - protein, 254 aa, Homo sapiens
SGARYRQYVWWLASSVNLNLSSRQRLGADVRKEGTWWLTCGEGQVGHAAWVPWPHRARRRRVSAVPQSRRGHQASRCVSGYLVTQSDGRGAGCTRLLEESMLAPSEPGTPPSLGPVHGGLRVGVGLPRTIPTSPVFSRSGPGLDARYRGARRGARRKSVTGGEPRPRLLEFPHNTWSLQVAGKELFGVEFQAAKRKVYERPEGGLLLGGWELRKKAAFGKEGSTPLWHYNTRDLQKYLKQRWVRIESNAVIPKR

SEQ ID NO: 1000638 - protein, 51 aa, Homo sapiens
MTTTNNIDYLKYTTTAQKTKKQHKHKHNRTNIHQHNILTPHQLTTIESQHN

SEQ ID NO: 1000639 - protein, 90 aa, Homo sapiens
SGADGWRGPGREPRKEEGSPDNGVRRAVGHGLSPPAGRNGEEDTTAETTALKEELIMYSSQGKSGRADTVQGHMGKYQGHSGGIRSKVKA

SEQ ID NO: 1000640 - protein, 225 aa, Homo sapiens
RRKSVGTVGCSLVSGDEAGGLVVTAVGTLAQMLCVPAEVTGVGPVMLELVMLDGLGMPNGWAPTPEDPVPWDAGCCRWQKTPCMQPECPSGTDEQMPGGRCLSVTCTHDHHAVHQDARVRHAVCCWARYSTEELRESYRMPCRNADTGSSRERAAQACSRQQCAKPGRNPQRPHTRGDESHTLALEPASGTQFHLCQLMKRQHPNTLAARVRVPLSWDKDAHLTT

SEQ ID NO: 1000641 - protein, 150 aa, Homo sapiens
RRGARATRCRRVPPPPYPYLVTGIPSHHPRVYNIHSRTVTAILPTSYSWIEGETVHVMQRYGVQWRTACHAFPWDIVSWHIITHSTIYETSYMPVYRSAVGRERPNGNAPQTLLGRPDVCSLLKGERNDGPRGVLTITDDKLQSILSIKW

SEQ ID NO: 1000642 - protein, 199 aa, Homo sapiens
AGLACLGPAEVGPGGWWGELHTPQEMSLLLASAPLVGLAVNRLWVRSGLRPALLSVPVVCRPPMEHWNSRDSWSGRRDHAGAKRAQVRVQRRWMQRFGQRSQNDEYYSDTKRDMPKQTTGQQKLPPAAPQAPPEDDTGTVSLKNHRGKEEDFNDDSSGRVWRRPSIRCGGRSVSRSRLPHDRMTSQEADWFPDIISGPE

SEQ ID NO: 1000643 - protein, 157 aa, Homo sapiens
SGGYSLADSSGVPQRDGLRASRPQRAIHGWKLLEEPRCQCAGMASGRATPLQSPLGLTLSLPACPALPEQELAGRVLCVRGHVARSTMRCESVMVFHDQVSITRPGSLWPIMDENLGRLGMTSSIGIESDRRINLNAQFGMSSKCEISGHYYFLGPV

SEQ ID NO: 1000644 - protein, 130 aa, Homo sapiens
MPEQSIVEKPYHRVFVKPKFSKWTTDKVFSVFDYGLYPCCVQSPQKYEIPLDCMRLTGGEISFYVAIPRSSSALLTDSTFPTQGTCHLTHCYGNIFSQSRVPMETSWICAPWHLTSYKGTEKLHEQYPQY

SEQ ID NO: 1000645 - protein, 370 aa, Homo sapiens
MPRWWKWADARWCCSGHAPHLCECPSGCCPCEWMCVLATLAVLMLRCWQPGRTALPFVCPCDPLLSLTLALTGCICAPVPCWLYCDPGCRMDLGLGSLLFCTPVMKSSWGCPLWTGYWLPWANGECRDGGPGIGEQRADVVALADVETPWEPGKRRVRDRAGMELPHRGPGYQRTGSHQLWVGGRKPQKAYNLPLPDARDPILGITADTRKTGYSFPKGGKPFPCVPTPSDGGTSMPGRSAHASRTSQRTCTGASTRTGCKQPMSSRPSRDAPFEPLSETPEPMGQDRTPEVPFPPGRLAVDPGRTRKTARTRSDRGNTERPDPPRREKPSQQNGTPKGDRRRPRASTPGRTNRTARARKRSGRAVHDAH

SEQ ID NO: 1000646 - protein, 159 aa, Homo sapiens
REGGRAGQVSGCALGLEGGGGPELGLLAAECIAEPRCTEATTLWEVRYKGGPDQETPFSRSGGGHGYAVPTDSSLRMTLKVMAEGAPVARSQHDSFSCERMAWAGAPAWARRSDVSVVAGGAASRDLDLWGSGLEDCFQRLHVGVIREEEKEETVEKKH

SEQ ID NO: 1000647 - protein, 236 aa, Homo sapiens
SGGAGSLAARCASAPQALWQSSIVDYYEVLGVPREASSEGIKKAYRKLALKWHPDKNPEDREEAVRRFKQVAEAYEVLSDAQKRDIYDRYGEARAEGGCAGGRPFKDPFEYVFSFRDPAEVFREFFGGRDPFSFDLLGNPLENISGGQRNSLGSRSRGSDPFFSAFSEFPAFEGGFSSLIQDFVPLAPWESGGLSSFCMSYGSDGTGSFKSMSTSTEHQLMVTKITTKRIIENGQE

SEQ ID NO: 1000648 - protein, 254 aa, Homo sapiens
DAECQPVCPARTLSAPSLLACSVSGPTPQLGLEMQLGLPALCLRLWLCLGLLDGLVTWLLHDPSRPGTSRRSHDVIDTGDMPVQCPALVTCKPLDVVLVPGATVTAAMPRGRQRSMRWDHWVVCVPVNLGAACHDDRPSARTCQRVGCLDLAPKGYTCQPEHPVQGYRSWLTNKVTIPGATGHFGRAPTRRGTGTRLRVNWIACRVGRIELLEEDAWPRSAPQFETQRAHWEKHGRHDGVQRHVGQWALPELLA

SEQ ID NO: 1000649 - protein, 157 aa, Homo sapiens
SGVCGPQHPIPCPPLPWAIIARPFTFCRILLEWRECEEPYTGNKTENLSIIRSSAASMASAKGVDASNIQVEFIIQEFSPRQIDHAKELIEEEIEGPLMCQVRSMAQVVHSATSLVQLGALSPPWGTLTNRGVQPREDFRTALLASAECSLHSIKQD

SEQ ID NO: 1000650 - protein, 325 aa, Homo sapiens
MLMADGLPACLPAVWLVSLLCACGCAVPLSGYVVLALKLACLCDDLIVRSRVVLCTPRRSTARSAPTVYISTDIVVRKERTFDSHFSGLGFGHCFRHYSPSHSFGPVSGITRSNVNGSGNFCQATIFPKGAAWSRTQSGSRHELEAQNAGYFCDVAAQVSPPLYSIGVATVAPCEWRHALSQNTRLAALTTRYATRLACARQEATSQAHTLINTRYSLCVNADSATARVHTLRSAPDFEGRVIAPLARLRPKVTARSSAIIDAWAFTGDNTEMGCIPVGHRPFAFGIPTCQAPRGQTENAVEPLNAPERTAGSAAPTVLHSGLTA

SEQ ID NO: 1000651 - protein, 126 aa, Homo sapiens
SGVCAQAPVFLSVRRPYLGRSAAVVRIQAERPDRSGRRVELTRGGGGGDSNRGTMPDVEGRSVTQKYPGDSEEQVLIKHRNLRNPHRRRREAALEDRPLPPVLFWYDHGSELGTSRLTVDRVCPNA

SEQ ID NO: 1000652 - protein, 123 aa, Homo sapiens
MVTLKYAPPTYTSIWFAWTVDPDSSHSARVDSMAEWAYEERSAKRSTDNSSFVNSVYTYDQLMPTKDTSCQISTVGQNCRQIIECLHEILLLNRKARREANVKFEERYNDRQRTSGSIQKLRF

SEQ ID NO: 1000653 - protein, 109 aa, Homo sapiens
RVVLNGSQPVGGKAAGLESQQADMLRRSVQPSEVLVQWQCVTSPASTADAGYLIAGNLLAMGSESGSGGQEGQVHVLGSDVMWHDAAKCTSPLSNSDGVWSINPTSLTC

SEQ ID NO: 1000654 - protein, 176 aa, Homo sapiens
MPKSRQKHITIPGDQHAARTRILPALVFTQRVVEGPNVDQAYSPMDPKGPDVRTSLHSRVGNGLRQHSTDRDLKPCQDPWDIDTLHNHALNNTNTVPRPKGARKQKKSRQTKGKANRKMAHRTQRASTQKPKTRQPHKAIPHSQNGIKLTKKRKMDARTGDTIPHMQHANNTTNRT

SEQ ID NO: 1000655 - protein, 308 aa, Homo sapiens
AGSKVPVCRTEGWCVSGGSRVLNISTSAPARLVMQLVPPDLAALPWCSCCLQSLACEHDPAAWLGGLVSSALHDNGFQWREHLVPLAMGQWTGLEIRARVSAYSPQWGLSALNVVPVWSQRLGESSRTQEVGESVVLACWKYADQSDDMKSSLDCRGTGVKSNSRNGHEGRIVLAKQGDTVGHSAHMAHRALMPEATGRARVNKGWAMHLGGLLMLSGNLSYLREEHKTHPVEGDVALVSRHRVVHNTWIRERRTVTADPERNGEGTGKNAKGIHAYGDSRTKGSTDHYAGGQVDIPERYGGEQTRHR

SEQ ID NO: 1000656 - protein, 170 aa, Homo sapiens
SGALTAFAGNMEYTVSVTVHACVRRERSRTYTLRYESSRKARATGRDGVCAWIRRSRWLPPGVFVRKPAVPALTLRASCGYVCSVHVACQQLMRRRKHKCFRSAKSHGGRRGFSARCTLALMCVERYSETTWDERLSRDGGDRKQNDANKKLRCSSNRYGKIRNGDTCED

SEQ ID NO: 1000657 - protein, 30 aa, Homo sapiens
MELKYRNRPYFITLEKSGEADCMEVPTSKD

SEQ ID NO: 1000658 - protein, 229 aa, Homo sapiens
MSHMPLSSQHTWLFTLSPAPAGPWVGMGIVCRNKLEAGLSYQPPCNSGWELGAAGSCRRLEQQRLCGQAMQALRREDGSERKREREQDIYASTGYEAGAEDSSEIHSGSSVLQGNRPCCLEIQDGSRLDRMQPARQEAALQKRQRGRAGRNDLTVKDATGSRKANETGKAESQQNQGSEEQPGSLTRGRPRESRPAKPEPGSEGPCQDRLEQDQTMAPETGKNAKTQET

SEQ ID NO: 1000659 - protein, 188 aa, Homo sapiens
MDGHPPTSNPKTSTNQEKRGRDRHGTTDRRTWQKGKKASRNRKQDRHESIKHQITETTSTTTDKKSLQREDRPNGPCTKKDATEECHQIEIAQEQAQGGKGQNKQKASMTNGNAHATRNRDSKRERNRRVEDCTPTPDTDTTHIGDRDTHREHADNTADKAINPGKERKEDAGGTSARREEPQKEKQN

SEQ ID NO: 1000660 - protein, 107 aa, Homo sapiens
MADRLRREQRPLGATDEHDSIVLLPHDPGGHETRLIVRMSESTDVVIARRDRGHNATRNGYGPVDRTWWQTAWSAALTSHKCDVRRSRRDLDAGAAVQVACVTETER

SEQ ID NO: 1000661 - protein, 52 aa, Homo sapiens
MQRCPLSSPLHFPCPKRVVSYTPEILTRSFTRAATCRFITRKTYVRSLADGL

SEQ ID NO: 1000662 - protein, 229 aa, Homo sapiens
SGGWLESASQTEKVGGRSREGDVLKSSESITEENQRKPVVDRYQVRYRAYMARAFIRRLRSVKILLLDTGCRNCTILMESRRILQTDHGSELPRSMDPQKLKLGNHDVDPEISHVNFRMSSLHRRSRDPIQALRKFTELCHTVAEARLHCHSSKILDMLADGADHDLHAPLSSSVLVTDERCCTQLHMTLEDPDYDQYTDRPNDTLGLVAPHSHGPGHIIVAATQILDH

SEQ ID NO: 1000663 - protein, 323 aa, Homo sapiens
MYSTTTLRMQVIGNVGDSSCLISFTQACRSEEENQTRKQTPAYSRSAVHTVGTRQITTAKELLIDAQLIPWTKLQRRLRHMNPSSEFGRLPIPGNTLIGESRKEGPTQHTPHTHHISPTIGADNVAFTLHKGDQPSTLAQAPTLTTPWVKHPTLSWRLGSAPSKHTHALRISAQTFFSPSNFQDFYSHCNHFSVGQLAQSHQLVKAYGKRAPGARMSGLWRTLLTTHEGMAQTYHPRHIDLCTQLPPMRHFTPSGYSPKPNNLSTLAVYSQRPHSPLASYTCALGKPSFYIPTGTYRSTHTSRADYKRPGETLTRSYQWEPLM

SEQ ID NO: 1000664 - protein, 71 aa, Homo sapiens
AELKLANWDDWRMQALRQRRVRPAPAVWTAAVAALMLRRREFTKRQGDALVKKMGTDMGRNNGCLYMNDEK

SEQ ID NO: 1000665 - protein, 146 aa, Homo sapiens
MCMTQNSVIAKRTTYLPKFGMLRKLTGHSLYEQITWQLNAVALYKITSNMIFNFEHLSDLQIILRHKYKSTASKQISKPRDHEGNNRYLDLQKLHSDSKLEELRNTNSVLDPKPPPLTEAQKLGLIGTPPAPVSSDDWEKVKRALC

SEQ ID NO: 1000666 - protein, 41 aa, Homo sapiens
AEWRSRAGRRQQQRAVPPACALSADGSLEEVCDSGCLYGKG

SEQ ID NO: 1000667 - protein, 336 aa, Homo sapiens
MAYSGAGGFAQTVLVDILSLAEKTFIPVCGILQERSRADASNGYVGPFHDSTGLSGSTWTGGMAEDVVDIYVYSPSHESRYYVVTQLLQLQVPTFTNFSLSEISTSKVLEDPMLALFLAYQGECFLTRQDLVKRMHRPNGIRTHGIAMPLRALHFRHSLQLIAETIQLVTLNPAPAACLTIEQQHVLDEVDRNREIRWDNDTNPSRQLYLSGPAQECPGYEDERWALLGEALSEIPRYNVAPTRFALMPMRKNGGLHFARKPSNVGNTGVEGNASPEDALRHTAFKQRKMPWREIPMLGKNFGGGFPRRFKGQRTLLCYTPNRVDSPAQPKIHSHD

SEQ ID NO: 1000668 - protein, 153 aa, Homo sapiens
SGLRIRKLRRRVVRPRGGRRAWEGPGWDGKRYVAAGPLWVMVVPELDWCMWPLSAELLPCDERIKCMWCACAAVLSPSCMLGMVVCMPSFPECFQDWNGPMCVPLMIAPNHSGWVVALATWPSWMNVWCCAPGADHRGTEVGLAVSVAALCLA

SEQ ID NO: 1000669 - protein, 250 aa, Homo sapiens
AGWGSSPSRPSAQASCGSADRCRADWELARCVVPCKAMVVPGEAAEGGMGLRPGRQRGSTAAPDSLGFPQTHHPEHRLRRTCRITREPKEPQDAALTLSDRIRRDSHTATERTPLGLLQAMATRQPPAPSQRPPNRGTHISTPGHERHPRQRGRTGLLDHALRQNQQPQGPDKSQAPAQLPTHDHSKRPIERTVDPGTTSNYPRHTDQRRTADNTTADHPHDPYGKNAQDAGPTSRTDTIAHPTIHQPWH

SEQ ID NO: 1000670 - protein, 118 aa, Homo sapiens
SGSLSKSPAVFLPLSFLFVFGNFSFLRIYQPEEMKVLSFPTSLLHKWRNKESCCWKDSTSVDEQSNSRLSPLAPVSLIQTGRSPMKLRSNKGQASLVIKHHHCHHHNDIEMTQKCSNF

SEQ ID NO: 1000671 - protein, 110 aa, Homo sapiens
SGLGPHLGKRRSGSGSCQGGSSVQTLLCAPCSPDPYPSSPDGAGRAERAPPPTITTGARWQTACLHKEQERLLVISTCLWNMTRNSDLTGSISSLFQTLTEHWTNKHTFR

SEQ ID NO: 1000672 - protein, 319 aa, Homo sapiens
AEVRAGGRLRTANSSGETFLFPLSLRTPWRPLPMQTTHACAVRVKRKCARLMYCCLGQAAARAALLNCIGCVPLSCYDALVLSVVTPSSPGTYDTSARCDGRTAIQTYLKRIRANVRCYAAHANKLYQEQSAIHRQRPHILLHTLHRATDRDLALETGTARAIAPIGEEHDDTVQGSAPTSNMWAIHYKARTVRNDALHQQHPKVFHPQDYRTCFRRTQHTDREAKAKTKMFATSVSAAFTIVPKLLTRGKPKSSIRPPESTILGTDAPLAHRNNTTVGALQQHFLAQVSTLSTKTRDILTLFVFNRTYKTARNQLANY

SEQ ID NO: 1000673 - protein, 252 aa, Homo sapiens
SGPRAALVLQSCGHIQGTRRSLGWKPGVRGAGSPDGPRSHPDELLTISKGKKATLLRIVREARLARKLPDSGRRGGYGIPDVSPSIIPGIPFSVLLSNYRRSAQYNETAHWLMQNSIMNLRFSRALTSGMVYRSLTYKFYLMPDRSDGGRSIIVGTDKGHECLLRRHRHLSDSQASSKLGTCLCTACVNIRSYRIVIHPRELDQGWRKGRSRSCPVGVTADPASPRLGETAGRRPGPRSQPGHRCRWERASP

SEQ ID NO: 1000674 - protein, 92 aa, Homo sapiens
MSRALVFLGLFTGPGGVKGARSILEPCWTQLKSFYDARVLCDVTIEVVSAWERAWHGRLFSCNRDGARQLRVPTSRACSAGGMYESQQASVS

SEQ ID NO: 1000675 - protein, 205 aa, Homo sapiens
RAARPARRGPLRGRRPCASPSAALGHQCSTGDRLRGPTVDDPGRSRACCHWCRGAREASLIIHGPRRRQAHGARALGSLGARLLRQRQMDRPGRPEQGTNAEDPRYFSGTRLDWIVRHAVSPFARDDVLDAFATPAFVIHDALVGLGGSDEGRICGKAGLPDLSRLGEEVLASCQVERLPVTWTLTEILVEAIHGYVCGLGPYVA

SEQ ID NO: 1000676 - protein, 304 aa, Homo sapiens
MSGAPWIWMQSACLRGCREPTQWVPTTCKELKCVCGCPESAAGVVCLSKKMASGDSQLWSECVATLGHRLHELAPCPVLCLRYLARLLDHLCLPQLVVSGVYAVLTAVCQALNHEDWHISKAFCTCPTLAYHWPRKGPAVTINHKKHLRNTIGLCPLPSHARNGYLHPHWLHHALAVDTPEYGNATHALLYYTYTYRRPHGPTLLGTHLMLLYVTQTKPCTWALFSTSGLLKYTLIYIWAHLTRGNCTLVGYKPRHQLTCTPNTPAMVPLRFNHTASPYNITPILSHPRTYYGSGRNILLLPKR

SEQ ID NO: 1000677 - protein, 154 aa, Homo sapiens
RGVQRLCLFVCVSLQALFMGSPSEVRRAGWYVDHRRGGRIGGASVCPGVEQKEETVSVDLVEALKPEYVVSLVLGLLSRESVRRMVAVCEVGRRMDWTQISAEERTLASYCNDTRISPMTPEAVKANLEDICDCENASKPQSIQESTWPYNEKF

SEQ ID NO: 1000678 - protein, 200 aa, Homo sapiens
MGSCSHVTGLYGLDYSNDSARIELNLTREETGKANVDRELKEGHNGVIARTSQTIADRVPIQRVLPNENSRKVCDRDSPTVTNHMETLRKTRGSAPPGSKTDLSKYAQTRAEREKTPHGISHTKSTSGNLHGEHLRNRPTLVLNKQERVSQTYPYHTQAVDVSEKLTYDGRNGNRLQGVRHDTYEYKDQPGIHDNIDEAE

SEQ ID NO: 1000679 - protein, 173 aa, Homo sapiens
MININDRQHYPDGCVEVRGSKPGKNVQLQDNEIRGLCLKSVKSFSDQRYPTRHLKHHSKYVVTSMDNTMICCELFEYGGFPPESKLPVAWWTMWTGETRVMGDDLPHYWPTQITDILRICPTIYRGNHECASIKREFMDFMMTVKEDTTLQSMERFHMTVFRLCTIAGIVDEK

SEQ ID NO: 1000680 - protein, 102 aa, Homo sapiens
SGGFPEPPVAGLRGLGRERRGKKRGLRFGAFCQRGRTCGLESDCTPALFLQVELTAFRNGLLRLCWEALTVLQRTHFCLFLCETFRSCLHQVLYKYTGFQTF

SEQ ID NO: 1000681 - protein, 218 aa, Homo sapiens
SGQPPKALMGALGGGISHDRRFRVLVPPIVIMGRQDKNPRLPDPTPHVHQSHQETLVVARLPRSELVGPTDLDSTSAISRVAKVNPEKTQNLPEVTRQLGRQGRGQNPGYLQMPRSTSVSCFSQEYRSNGLPRELQDKQRRMHLRVDYYAWSHPIVEGSMVVGSPWWMVMGVLPLEGPYGPPDWLEGPDGHTQIAGMYHTSGTQGGHYGRRSTREAHY

SEQ ID NO: 1000682 - protein, 55 aa, Homo sapiens
SGASAPQPAPSTSPFRNACAARSKVRLNFEAGLDALPLPINADHQEERRRKETVK

SEQ ID NO: 1000683 - protein, 78 aa, Homo sapiens
MTARTKRLYIARANATIGTGNHQPGKRPTSHNPKHKKQTVTQQPKTSTQQSEQPLGDQNDTERNIQTPTPKNNGDTQK

SEQ ID NO: 1000684 - protein, 37 aa, Homo sapiens
AAGAAERHQGSSRRSRRRWAEEPETRAGEVAAAAERE

SEQ ID NO: 1000685 - protein, 148 aa, Homo sapiens
AEPPPPPPPQARPAGAAESSLGEGGGRGAGVGSEEAKRGGGRGAQGRPRAINGRLLRPGPARPTRPSDPVAPAGEEGQTHRSGMTNHVAVTQGTGRSFFSDVQYLRDMQPTVDSEYQACRETTGDIEESASEKKTRLRFGGNDTSVDE

SEQ ID NO: 1000686 - protein, 122 aa, Homo sapiens
SGLGRVSALGGPLWALGRRGAPACCAEMSWVPRLSCGGSAPLWARLLGWRVVPFWESTFRQPPCAERDTDAMIIPQNGGVAQETTTQNSRASKKTCQQEEHELKYEEIRESADHQRWLPAGN

SEQ ID NO: 1000687 - protein, 338 aa, Homo sapiens
ELWDVCYRGPNTATAVMCVLMLSCGTACDVVLLLHRMVTPVGASAVCMCAYCLDVMPEPFDLCVTDTCSVTQYVPTCVSLCDWMCDSVSCQSYTGMFTWMCYITLKHEAVAELENEAYTVYLARCKAQRASAFNRRLGDQSYTKYAYEPVGSADVLVGLQFALENRAVRPLCCPGAHTIERQLQMMRTRRGGRSYNASLNVREMHSEDGLQFFAFGVVAPERGLSTFVVSSVRDVHAYSRVNFKLLAFRSSPWGEEIEILADEREGRTQRDARFELYTSVKAVYVSYHRQTHSIVHHPKRCKASRYYENGYSTRKIGRGFHKTHLFVDGQLRRALYEY

SEQ ID NO: 1000688 - protein, 36 aa, Homo sapiens
AGVRALPTASRQCGGGSGEGGAEESKEFPPSLSGTS

SEQ ID NO: 1000689 - protein, 154 aa, Homo sapiens
MEFGCHVLVTTRGPYMAAKSWRCLWASHGAHECALPRLVHSARASFRGFIVLVPLVNRVKHQAGKPGREAVDTRRRAVEIRIRTTQRIPRLGSVLEEVTIRKARKQMVIEVDRRAKSVRRNPRWHRRPTRMDERPQFTIRVGMAIRVELGTFGL

SEQ ID NO: 1000690 - protein, 105 aa, Homo sapiens
MEGPMRLDPRGLHGPEVFALFLDSLNDDLLQMLLYPFAHMRYTWRCPSQKGRADGAHKELMGPLSRAEQGTPQARIGIDEHRGRVGMPQQTGKKHRRERQASTIG

SEQ ID NO: 1000691 - protein, 121 aa, Homo sapiens
MSEPSERLNNRKCNHEINKNDRVTEDINDKQEEQMNIDRIQSNRKVTYCHTMKHGQAKPSGRHNRRTPGFPINSRYNPERTAWMTEQDDKHHQTREVGARRQERGASTSKRRHGRQETNNA

SEQ ID NO: 1000692 - protein, 268 aa, Homo sapiens
SGAGGWVVVGAAAAEGQAGALRGRPAQPSPAQPSPALPCPCAMTLRPAARPPAPHPCSDSTHPNLARRHSQSSSPVVRENGLQHPCHPQPCPTLEPRDQGTTSVDGTGLTSTAPSWTTRVGSSPGDHARHTETALGARPGNIHSHAHTETNRSHAAVYTVLPDDPDVSTAKTVTDGTFARNMFQQDLPPKTQTRLHWWHYSLTTHVSVKHPCYQGRDLLTLLLKNVGLYAFLQPDTSSQLERTTESPIPDERTLAWSDEREHDRRKLI

SEQ ID NO: 1000693 - protein, 340 aa, Homo sapiens
MSSDETRPKIRGDSQWANEFEKMTMEKQKELNPKFSCSVVGGEFYELTHNVQAWLLRCYARSSFICWMAWLDTRARRERPSRRSFCPTHSGRDGLTFGPPVVALSLTCGHKWSTALFAMGLDARNPEHRNSSWITSLEKRCDAKSDVWSLRASKNVEELKIGPKDARLRRDPTGLASRSHWGIWHVKCVFLVSRERNPTRAVFEQLVGGHVSFGNQNTFACENASPISSARILTDCTAAEQRNDRDYPCAVREREEEIRCDHGFQGHECGPKAVTPRGRSSNGVQTWAMGRRWTHRRARVIGTGANLHGAVDPWGRATSGVRKPHGGDWSHTSMRTHEDI

SEQ ID NO: 1000694 - protein, 183 aa, Homo sapiens
RGGERAGRGGGGGVVSCLLSGGPGRAEPRCAAATPGSCLRQAGCLVPRGGLLSPRSMVPSRRTWNLGATPSLRGLWRVGRAPEPEPGMARPATAQTARTPPFPTQPVPGMVDEPGRGRNDTLESCRVTRYSSVARSAARTYLVAQCRALSVDWAGRRKPPRDSTCSLRGRIDLKEKLISRPQE

SEQ ID NO: 1000695 - protein, 125 aa, Homo sapiens
MGLTLEETLCMVSLRNSSIVRLTEVEPYNTLESPPSKRECLARSFDREKRTSFPSPKTPGPVVRSRELRVPRRRPSDVASKIHEVLPCEPLGCALSCMGRSMRCGLGLPLVTASLSPGNHKSLSV

SEQ ID NO: 1000696 - protein, 135 aa, Homo sapiens
MAASPHTLLLNAILTGLRRRLCWYLEEKKLYRTPLTSSYIFSGMSISSGLHFRHFSVPQYACMSRRAEQKAQPSKVKTPSQNLVAIIHFLAYKTSSGQAKAEIYEDETSLTAQPIFVQKAKLNKEVDRTRARLGN

SEQ ID NO: 1000697 - protein, 110 aa, Homo sapiens
SGVLLSARRWRLRPEAWGGVAAWAGCWPRRLPLLGAAGSAGGIGVSCGVVADAEHALLSDVTEALSERVMVRGSWAQGEPSGCRARDLMQPAPCAWSRVREQVHEGANGT

SEQ ID NO: 1000698 - protein, 209 aa, Homo sapiens
MPRHYTDKPHMKHATTPMRAVTHQRPLTAVDINNKRQNSKKRNGMRPEPPEIRDHRTNMRPQLATDSIIHRSIGKTPNSSIHPSTTGMVTHSPEKNEETPEYTKEIAQARGSNRTDDTRMPQLTLSRTTTKLDRHQKEKTTSRDTKPLRRDTTAQRTKPHGQSTKLTLRNVGDKLYSVIQRIITLNINISADAEHVDQDNNADTLTTQT

SEQ ID NO: 1000699 - protein, 116 aa, Homo sapiens
RVGFDAEPGAVSVGGGVEADSWCSRMSSWPGMPGTRGGVTRCLHLIDEVHRGSTTDRAGDPCVVPCVGLVIRGTPSEQERRHSEFSPGAWKNADTIATRNLQDLYRRIVYARSILL

SEQ ID NO: 1000700 - protein, 138 aa, Homo sapiens
MSLMDEGGAAPDHRYAWSIQESVLMHLATRVRELTVYDTVLSVAVQMDRCRVRRERVTCGGKQILAEYSLVVRDVPRQPGAMCWYEEVKRLYDTVPCVEVQTLSGTRHEQVICDLNFSHSGYQFAFCSKDCTVKIWSN

SEQ ID NO: 1000701 - protein, 222 aa, Homo sapiens
SGRGAPSGETQSDGNPGWVAGARTSRAGSAPGRLAPPAPVPCCCPASVAEVCRLLGRREKPRRALSTGMIRCRHMSVQCVPEGLTCPSRPCARSISWQTSDPRTVALSSRTHANVKPNIPVFMTGKDQTQYRCTVDLFSIGRRDSPYPQGNRKLVVSCEWSLEWVSSVGLEWTSLHLVPVTIHCLSMWVSDLVAHWACIWDVTVYLLQMRSGEIQEGLIQYD

SEQ ID NO: 1000702 - protein, 112 aa, Homo sapiens
RESDSRRARPQPCPGLHVPLRPRRARPTLSVVLTAPLRWRAGLTEGPAPPPAPRKPGFRERSLGSSVVVGDGRRDLASTPPGNSGAGRRHAHGRRAPALHTASTPHPDFDPT

SEQ ID NO: 1000703 - protein, 165 aa, Homo sapiens
SGASALGAAEEMASGSKASVPADSFRTHQPGQARRKVRLRLFSGVHGGQARIREGAPGMPNAVGGGLPSRPVIEGEKVGASETAMLLLQRLHAAQCRGYSGRGGGVRTAEDASLRVHVPDWMRDGGAAPLSPLAVSAGIDVAASLARDDEGCQLYLRGKWHAKDV

SEQ ID NO: 1000704 - protein, 119 aa, Homo sapiens
MTTQRLLLACRVDRPISLCGLSHAGKDLMQSWNDAGRRQCWNDISGKTEEVSSTVEMECVPEALLSIHTTVRARHDIPDLYRAVLGGGTSSSHLHNMRPVVLSDVDCGHVGAVRVTHVS

SEQ ID NO: 1000705 - protein, 199 aa, Homo sapiens
MRRAFELHREVLSDSLTEMVYFSGYRDGGPTLLRDFVEVFTAVEAQSVASGLNHRNYYSAQGGGLRQYRSSSPTALPRAILLIVSHHGSLPHGERAMGQVGAGDETVSLEKVVGTLAFRSHGHPRRGNRRADYGSRWPFVVSHVVANECEPSFPKQFVEEAIRREFLNSHRLFARNTRRTGRSPTPATQGPGSPSSGTL

SEQ ID NO: 1000706 - protein, 104 aa, Homo sapiens
MPNSDGSLVDAPRVRSSTRIRRGYLLTAETLTSTKDLVFTLCNVETGIDTFNGLGMPPCLFTQYTDDPRLLTSSYKRIVRSYLTPSEALAQEYPSLYVEYSIGV

SEQ ID NO: 1000707 - protein, 113 aa, Homo sapiens
MGDARHSPLAAPISCILSEVIKEMGESLPALVVVCAIGALREGLVALVRVLSVLIWKNRVWQGPLYSLSHVMSPECGRKWSSMCMTSQGLDLWQEEPPDSVLGFPVHLLACTR

SEQ ID NO: 1000708 - protein, 300 aa, Homo sapiens
SGVARLLDRPSPGGYVPEGAEASGSRAPWRAADNWAEAELSLSSTTEFQVTLQLCVTVTCPQSESRPSEPLGPRHVPRNAHSQNQNYDAPRAASLAARRQSAPISTPHYPPRDSGIGLSSAQRAPTNCAELAREATTRHANSTPRDGHRSIDTLIGKDFPNVPPKLTEPHRETTLTPTAANTGPHLKSEKPRCRSHMAPSLPDLPGTSRRPRARVTVKCDDLAVEHGRATTQRPWRLYPRGNHQTLRNFSNPPTDSRHGQTLGTNPRGTAGVQPLETRMWPLHLSEQGEQSLTVERGQER

SEQ ID NO: 1000709 - protein, 408 aa, Homo sapiens
RKSPPDPEAGWFHLSMAPAAASPSTSPFRRCESRFHSPGLAPRECAAYSVHSALLTAASLTARARLPRGPPTDGCSIHSSPLHPSATSRTLRCGRPPLSCLRCCTPTGPRAPPPASTPRPRPPPALLLRTLRPAPCHCPPPPPQSSTTTPPFPNPSPPTPPTSAPLPHPTPTHPTTTPTPPQQNTTYPTSPPNHSHLSLTPQHKPRYYTRDPLEPRQVTRANYTAEKTLCLTSKSRSHRAHPTEAKATARSILQDPILLAYAIRSYLHQLYELKRDSTYSPEVDLSSLQHYISFYTPPFTFILTSLPIAPTLPNNPQTHHIAHSPSPPTTHPIIASSPTHNNTTQHITMTTLPQTPLTLSPTNPSSHTHITTHTPSPYHTLTIPTPHTTTSTNNQHPPNNHITPQTPP

SEQ ID NO: 1000710 - protein, 104 aa, Homo sapiens
SGTTQGPPERQESGADLQGLEGPGHRESGHGRRDVRFARRASAESFRTRADSHVLSSAATVMEECRYQESLSGDVNSGDMSPPLRSLDGREVGEIRIGSCWTWS

SEQ ID NO: 1000711 - protein, 118 aa, Homo sapiens
RGQAWRSQTYKGLSREGSENTSPLHAHTQALSLSLCHTHTHTHTHTHTQTRCSTIYQSEACGDRVERKRVVGWWYGGCVCVKWVCVSDTREVRRQWVTCRGLSSCVQRSRGREGLRVS

SEQ ID NO: 1000712 - protein, 188 aa, Homo sapiens
SGKGRAAGGKGRAPLARGDMGRAVTVPGEAAGAMLQCHAAVCAKLGGVAVLRLERSGTSEQPATARRAWLLLSERGVPLLPSETLDRLEESSASRSGFRDKSATVSKEMISDTFTFKKKHRKRHIISHRAKRMISRLSYRGAGSQYKLLGRSINKMEADNGLRKEQKYENIKCDGQWVKMREKKRLIC

SEQ ID NO: 1000713 - protein, 133 aa, Homo sapiens
MSGWRAGSGCEASGQSRDPGFGGRWKRYCDRALRTSGRRLRKGAYRRVDANGEAHRTLSQSKNGEKPSSLLTMEDTEEYCLFLIPDESGDSDNTSRRFCAEVRCERIITRFALYAWSPYSRRRESSLVESSIV

SEQ ID NO: 1000714 - protein, 199 aa, Homo sapiens
SGAERQRRRRRTRTRAAAAPPNRERKHRRTKKKKKHATQQGRKKRKQKTDKRHTTNDHTAGPTHTTEDTRQQEKRTKHRQRQETQANTQHATNKQEDTKEKARGRQSDKGDERRERPQEERRRRRREQESSETGERRQETKGAEEKEKEGEEIGEKNAKHKTGRKKKKQKRQDKATEREKKEETKKKREKGRREKRKED

SEQ ID NO: 1000715 - protein, 465 aa, Homo sapiens
LECAVRAAWLVAACWRGGGFCLLVCLPVVGLRGPGAVMGPAPEVPGALHVPATFSMRTCWRAHDCLLLWCSGAHTLVVYMRLRAWLPWVPGGRGQRWMDFGQLLLIDTQMAHNWSWRSKTHCPGASWPTCSAWDQRVASGLPMLSISTRFYPGQRAQAWRTAVAEGTARRQLDGDLEVMRLKWCRGKGGKAERRRGGCDDMGDGRKGGNREVTGMRSAEVSSSHAHYRELDVGGGQRRAVDGEANSRRPMAKRGRTNRNPQGERHKGDRGRSPRERESARGNRRKEYAQQRHRESGPRKQAKRARTGQSTRPITGGVSTTTSETQPGRETRREASERTETTEAEHNGAAGDPRERTTQQAERRHRARRRKRERREPAGTGEEATQYWPRGEQKRRKERERPQSTPASTPALATQPSSGDIAADKREKRRRNQRSTREASTDERRRTRRSRRESSAVADAKGGERR

SEQ ID NO: 1000716 - protein, 57 aa, Homo sapiens
MGSLFEGENSRSQRPEPEDAIFAQFNNGFETTQGEPPVRIQNVLPLAQRRGEDGAQG

SEQ ID NO: 1000717 - protein, 408 aa, Homo sapiens
AAGADVVWAVGFHSFRRRQTLVVARGAGWTGLALHLAPGYNGPTQPPQRDTENEGIYLGDRAARKTEKEDKNRQRARRPRHEDMRTEPEETEDKQEPEARTDAQTHTQRPGPNTKTTINGQAKHWHPDPTDNRKKPKTHLRAKTRKTPGNADPSAQGRHRTRKAHKDNGKTPSTQPRDRSQRTKKTTNEQATTQHNHRARHNTSRRGPQRKPGKTNTQRRAPVRHQDNNIEREQQPQTTMHSHRKAPQNRNRDQQRKDERTTQTTNRSITTRNNQRHKKTTDRNQATTKRNKQKDKRRTDKRQQTRQNNNTEEKATAEEKRTARGKGTREQQKDRSNKQKREGNSEPQRKKEDTEEEEGKKEEPEASNEGNGENEQKQEEEEKQSERRPNEKERETKKQGKQRKNRKT

SEQ ID NO: 1000718 - protein, 212 aa, Homo sapiens
MVSQDAKLGRRRKFVGALLKRPFYQCRKKFQVQCGHGFSHKTLFPTCYWPCRKALEQHDSRGLMSRRIYCKVLLLGAKFWPQGDRVIGQGAGLSQHRHGRAFSACSSQQSPKPARSVYPPDNPFQISLQHLGEFRKVPSIVASQSYAADTVTGKLASPWEQDLFRCAILWEESESTNVCDKDGDLSGNGCYANNLGPTDMGLGGPYPHSVND

SEQ ID NO: 1000719 - protein, 63 aa, Homo sapiens
MLQIYDSETLARAAVGYPYKGKRMYSHYADIHVVTSYNEKQLRTNISRNSSLSVPSHRKASAT

SEQ ID NO: 1000720 - protein, 104 aa, Homo sapiens
RRKLECGGANMAHCNLELLGSRDPPASDFHLAGTTGMCHHDRLIFFTFQREEGESHFVARLVSNSWAQAIHLPRWPECWDYRCEFFLLFQRDSLTSFGVTQKVE

SEQ ID NO: 1000721 - protein, 107 aa, Homo sapiens
MVMGPLAAGEHGTASAKTDKAVGDTDQRQDDSTDSKEKSDRNTANRNREDGRKRRKAATRRNKPVKGNTNPKAGAAHPKETVKSTEKNDKKQQKRGEKEGTPSRGNE

SEQ ID NO: 1000722 - protein, 239 aa, Homo sapiens
RWLAGGLRPAAARPEVGAACPLPGGRPALVRATSGLFLPGEEQSRPPAVTRDADAHRTQPDDPSCRVGLGREPHTQIQHPLNSGGCIMEHHDLHHPNIDAPSYLRDEGATHSGPDPGIMSGTQMDHLSEPHQTHQNPRWTSKTLWHRSPRSYMGSRHDQGRSRRDSTTRDDATTFHIPMGYFSAGKKSSLLGSNLMTPHFFFILKVISRSYPWKGHQDYCKTINISGKISLHEGGALGR

SEQ ID NO: 1000723 - protein, 156 aa, Homo sapiens
MLPCSLDYNVWPIRFQLKTDPAKVPGAHTGNVGVSCFTEQQSVGNVGVEHEKFLYISCPGRRRSGVSTDLNEVKTRQNKRLYVIDDGRGAEKKRGPWAPGKNVTIDGARDSPGGGQQYSRDGNSMRTSRADENKERPRSKKERLTPTKVNKQGSSV

SEQ ID NO: 1000724 - protein, 282 aa, Homo sapiens
SGPGPAAPARTRDPDTHEILQSSLSSASWTASDCAAPRPENQPNIRSKEKKNKSKKKTRHNDKRETKKKNKHKDTRTKTKREKNNSENTKLQETDDSETERDKSSTADAREQREKRESPQKRQTERGTRRHTRRVARRNSRRRSADTGRRTNSHAAGHVKAGHAKPANMSARTETRPRRRATRHRLQHTRRTPPRSSRSETRHRTTGGGNTNETETTTRPRAHQQKTRDEAPNTSGTETPKLHKPIQATEMNRNAHPKTESRNSDHHQTDKRKPNQRTNKKE

SEQ ID NO: 1000725 - protein, 75 aa, Homo sapiens
AELPDYQHLGCYSKAHSDERRKKIKKTITSSLSLKLLCRMSIYRVISLSASVLIDVTSCAQRIVLVNESQCGLID

SEQ ID NO: 1000726 - protein, 221 aa, Homo sapiens
SGELRAEDLGRRAAAWSEADTWQQLVSSPGGGSNSWRRDQALCQQACPALHQLTPRRQTLYIHYTLLVPHWVARYDYSQRADSSATKSTSITHRQQNPCTARGHLRQPSIQLARHRRFGTARLQAFEPAAKSLQSKEDNGLTTETAHTTGDTAQTTRRHWDWNPQRPAQPPPPPCAVQIDNTPHTPMNEDTTLRSQLLPPPTPIESTSGASSRNPTDRRQP

SEQ ID NO: 1000727 - protein, 91 aa, Homo sapiens
AEVWRVTLGGLSAAAMACRSGLCRALNVGGGLGSLTCRDALRGLRMEDAEAPLGGQARRDARELPSASSVSRWRNAVSVLADLQAVEGLGP

SEQ ID NO: 1000728 - protein, 136 aa, Homo sapiens
MASRDVRGPGRRGHSPCESQEKHGENTERSMSGSRFENTQEVMCEAETRDATRNERNVGDDRVPVKPHVLGRPEADDEETGTQKGTLPDTVSRDKDFMGQVNNNEHQPPNYSTDSIQLRGTLGVDQHVEQESRRED

SEQ ID NO: 1000729 - protein, 266 aa, Homo sapiens
ERAFSARCADFERLLPVCAHSQRVLKKQVYRPTGIPCTRAGDLVFVNDFRCYAHLACRLNQTIMTSGPTVYQSVFHSGSHETGLPEIPKRLFPYKECKDEVRQAQQEARLSAAGAVGNSKTTPWSRPPICPLASEKGSGDGPWPEPEAAEGDEDKPNHAGGGGDKLGKLDDDKPTEEEKGPLKRSAGDPPEDAPKLTQGGSPEQEEEAEAERAAEAERAAAAAAADGVDEESPFLVAVENGRAPSEAGAGLRSQLSQRTRSSGEED

SEQ ID NO: 1000730 - protein, 201 aa, Homo sapiens
MSPSGAGEARERDPLHEFYLTPIDLSSRPAELEEKGPARNCARSVSEDHRAGPTGAAAEGLAPGPPALLLTDPRGPTAAWPGPGDGADTRQRGRRPPRSRAPAPESAVVRDPARAPAAPGPDPDPSPGQATRPDQTHNSGPKPTPHNCNPPIRNTDRALDCLGRPTTTPLGSDTKPGWRTTSADSTPCWNEPQPLSPPASV

SEQ ID NO: 1000731 - protein, 166 aa, Homo sapiens
MSNSPKQNGPIKKPFGCNNLRSKFGPNPHGGHEWTESSMFRGQGALAKIDSLLEFEEDNGVYSRKGWFFHRRGKIWRLIPIGEGFSYSIRCLRKMGMSKCNRDLASGGGPIPLGARAVCPSEEEQVSSERNPPLKKHPWKSSGKDSPSELERNWTGKGKLNIERVG

SEQ ID NO: 1000732 - protein, 134 aa, Homo sapiens
MTTAHGEHGRSETRHDKRQVTESRPHVPKRMISPNGIPERKNSTHRRETQGAAQRQGATTDTSTPRSYTSNKKSTQRRDTERQGETYLSNRSETRDHGNRQGADKTYSHTTPQNDRTTKPTPHEHHAHKKSRED

SEQ ID NO: 1000733 - protein, 176 aa, Homo sapiens
MDGSGSRAGCNGETDKAFLRDLSELLGMDEPSAVGHDSVQVLRHRNYDTAATLEWRWCAIRYMKFPHIASTTGGARYTQHMVYETATCYVSLSCEGMQSMCIARKTQQVVSAMWRKRIATFRASSRIIVGTNQRSRQLGKQSLAADVTTPPSLAAHTVGPKAYKLAYVHLRLTNWR

SEQ ID NO: 1000734 - protein, 86 aa, Homo sapiens
RSGGSCSGGRLLGVEYPSAPRDPTPLSVLLRAPAYLAPRRPMTTNPSTFKVSRSQAAGIAPDVSAVVQCGSDPIFSYSVLMNDITT

SEQ ID NO: 1000735 - protein, 102 aa, Homo sapiens
RVAAARARFQKRHRGGGSGGGYTGLGQNQKEQTNDMPSPGGSKQNKNATHKRQRAGDQTHKKEKTGRPQATHNCTREPKRIRDSRHQNIARLQKGPREPRPK

SEQ ID NO: 1000736 - protein, 119 aa, Homo sapiens
RLVSNSLPQVICLPQPLKVLGLQVCHRARPRWEYFYGHFTYGRTVSLTIEQLAQLGAVTTRIPSSFGEPHPTTGPTAGQDRVLLPPSLSWWAHGYVAVSSFTLRSGPNPVWSPAPFSPS

SEQ ID NO: 1000737 - protein, 152 aa, Homo sapiens
RSALLAEEGRRTLRSNVLSVLINACVWVLTASITVYTPTMILDGWDESLILTTPAESYWLPLSTYSSDNSESREASQLILAVLSIVTNSNTGHWTIDSSLSRVHEDGSAANTAYAQKMRLELVPSPGTTWFTLFHSLKRVTRRICDTLGKPR

SEQ ID NO: 1000738 - protein, 137 aa, Homo sapiens
RLCSSCLFGTDGVHARKVPALLDISSTYPPSDARREEAKGKRAGLWLEIHARECTRADMSWPLLVCQYDYTHTRHYTRNEREPTDILTSMFNGRCYKAICDRYEAAGFERLRQMLDFYLFSPPGINRWRLDCLDLFD

SEQ ID NO: 1000739 - protein, 102 aa, Homo sapiens
MAGYGSQQWQHARVPFHTVEALLFHSLGPHCFYELEHSPQKSAASLLKPGDHEPTGRNEQLQTRHLKSCNIAARVRGFILEVSETKNPPIPDAAPVMEADMM

SEQ ID NO: 1000740 - protein, 419 aa, Homo sapiens
MGRAPGCVLLLLAALLLRVLLLPPVPCLLEAASLAAALPVLPSSSVFLSPACDGDAAAVCDPLCMIPAWLPSAQLSLLALPACLVLCTHGSSPFVFPVNCHGLVPSPFEVARCHVVLPVWLLAYLACWRCLDVASLVWLPVVAVACNVAHLLPEMVVCAPIVPQWEQPSEGCAGISWHPIRGDAMSALKGLFSHGQLVVNPWGRWQGGTFMWANARISQGFGLFGPFSVNFEFGPAVVGRNTDNVPPGEWVGTKDMARVTRFYQIQTHKDVGSRYLDRGHTVIRTVVGGTRSGDRPTSHRNTDPGGTQVVWERNSPDRATEQNWKTAPEVECAQTKRSECRGKVGHQATVFSQLLLVVNDARSTWWGRPKQRITARTEFGEFIPHQQWQFRGGERDPADVSVPFGIMGVRKRYGESAYE

SEQ ID NO: 1000741 - protein, 151 aa, Homo sapiens
MILASRRAWVPFLTLLAPVLSCLYRNNSPSRTSDEARPGATPTGASRLTINRQSPRAPDSLQRELTLLLALGRASRIAPTPPTRETWGTDPVNGGGTRHVLPLTSPSASHTPQNYYTFPPCPPLCRSSAHFVLTVHPHTSLPETQHTALCN

SEQ ID NO: 1000742 - protein, 252 aa, Homo sapiens
AGCLLRGGAGPGRGPGRCGDAWILAPPGRLPWCPEEAADAPGHGPLSQDVVTWEPRPIACGACGEWAGAPRSPEPGMASPAAARLLDKATVALTGPFYEKTGLGEVEEHGRWRKDNPQVAEQVIVVNYARLAPEGCKTSHQTLVSSVHRSAVRQLELETVNLRKGPRPIGTLILENSTLDKGYEQQSRAQADVDGHTLVRTRRGPQGDDVDSPEDWQEDTMDGYRDGGSTGPLRHEEANTGGPWLAVRWKKM

SEQ ID NO: 1000743 - protein, 371 aa, Homo sapiens
AGVNGNLRIRGRAVWGTARGRGNRHPTDVLLCRTPPRTRSESTWRRASGSGAGDERTGLPGTLARVRQNCGTRPACSSGGSRARPSAASTRSGTEIDGSRRRNYSMEDGDTGRALGDLEFVTTIAPPTWRSKAMDPPVVTSTADNCSDHIAVPPKRLVDPLDAWWTHHGTKLWKTKPATFLCHLVIPDFQSIATLMRLSTLRSIVAQTSTPVTYGELRIQWCAPGWYNLPVGSDKVPTLCSQATLRNFDHGPTTGCRIYSAHHTLGHGNWGPLHLGRATWPPRVNSSYAPIAMLQTNLANTMGAHKTGPTYGAAIIDKLATGPTLPPRVAHTHCDIYPEPDTVRKHAAYTGHHILHTYACVYDVTTPSFST

SEQ ID NO: 1000744 - protein, 46 aa, Homo sapiens
MRHAHRPRPQRPLPRHEAHTTALPDTNPHTGQTSTDTAHKKTQPGY

SEQ ID NO: 1000745 - protein, 103 aa, Homo sapiens
AGCIGAGPAMAVARVVAAALPRPRRDTSEAGTEVVADADTAWVLRSGPAAMEDFICDLVTTSGSESSEEAATTVAGRWRDDAEPCKTETPARMTRRDTETGDI

SEQ ID NO: 1000746 - protein, 220 aa, Homo sapiens
MDEGRNNEGAADQTSTRNDEAQKTPRQKQKSHSGTRLDKDSNKTTQQPYSTTQRSNEKENKQEETQAHTKRANHEPTKRENTQIATDTHQRRRRQTRTQKKRTRQRKRKKTAQKQRKQEKTTQRTQDKDDTREREKPTTTQQRHSEKHTQRGQEDRRTQQQATTTDETDPKTEQENDKEPTRDATKRKGDRQTAHKRHKKRSNTQHDKNKHGNPKKPHDE

SEQ ID NO: 1000747 - protein, 253 aa, Homo sapiens
MGSQLGCGPRRRMSPGERSGEEPFENGQNGWLGPKPCNVVLWSALVPLGGVQRQSTCGFAWELEGGAIAFPLGFVLLHFACGGNRAHRIGDGDGAFECGAKSAVSRFGSAIRRIRGGGHRPRHGRSRHTRRSEADPNRLVEHQTKVTQHPLRQLIKLYTFTANFADSDLTNLADTGGLGHVTTPRHGPMCLWTTELCVLVACGTPVWRHRADLRGVRLARKTVATIIVTDLGCPRIRVTNLYRPARLEANLQL

SEQ ID NO: 1000748 - protein, 57 aa, Homo sapiens
SGGRGSSSAQSLRPARALLARPRMSRDGDDKEMCRAGDFKAGRLILDDVHGWGGSLA

SEQ ID NO: 1000749 - protein, 157 aa, Homo sapiens
SGLAVVAGDCSSEGQWGRRWQGRGRVTPAGTRKKKWPGGHLSHWLLPGSSTDVRDDQPGMAGYRGCVWYQRHTWHKGSYHSTLFIQIDKAFEILSNWSLIGRFYSCAIGIVPSSVVLTSYQVMSRVTLIWAVTHSVKEVQSEDGVLLFVMAWTITEI

SEQ ID NO: 1000750 - protein, 119 aa, Homo sapiens
MCLGQTRMGYCSDPMKEINMPVPDGGACELEGDCMTVSHGYSVGLAWQRRLLQYRSIDQCPYSCLKRDGSIGSSSPDSERKLGSVRDLDNGHNAFYEVGDCLPLQMFAELVWQFQIPEG

SEQ ID NO: 1000751 - protein, 129 aa, Homo sapiens
MLIEVLLGIVHRKGPDWSSTKAGARWGRSRTGVHGSGEMPLVKTLVGRQKFGQQNSHIRETSLSSTDRGHILPEVPHIERAAWYSLSRVGVGATGLTPTPLWDSPPVIRQGGLNFHQRLVALLSHHGGP

SEQ ID NO: 1000752 - protein, 142 aa, Homo sapiens
MTVKTYRQLLLLEQSQLRMLQHYTVIYLTRYISYEQPSSPKHDMATESEKRIKQDKVSTTQQRKKKAKENMIDGQQSSTDNTQQQQQQQRKDQKHKRDKTKNTHNAKQQRHNKTQHSTKKKRKKTKSKKKGKKRQSDIQKNT

SEQ ID NO: 1000753 - protein, 66 aa, Homo sapiens
MAKCNQRSSNKLALKSSFRDLCQCYCNFTNCMPDPWQDRGRYDTTLNAQMMDQRRERLTFDSSQCE

SEQ ID NO: 1000754 - protein, 210 aa, Homo sapiens
RVAAPPAAESCYRRSSQATPSSIHRTHPIFTWHSPFSIHLYDSMRQTKPILAATDLISHPITRSRGRRIDPMRMDQHIDDTTYGHIQEQSHKEEDIQQLIERDTHPHRTSAFHTQPGDTHHREPQSHNTDKPPPGEDHHEGKATAAHGGEPNQMDPPPQRTQPRDEYTTSPPNVSQVQTQIQEEATETEKRRAQQEKGTYGQAHTHAHEH

SEQ ID NO: 1000755 - protein, 82 aa, Homo sapiens
ADILNGWLRIIFNGNPPSRPGVVAHAYESQALREAEARWITSASFDDQPGQHGVNTVSTKNRKITAQALACAMPVSSQTRGS

SEQ ID NO: 1000756 - protein, 191 aa, Homo sapiens
SGVGCVCVRSVAEAAVGRLGRMSRWTRAATPLLPDMPGLPDLPEPVARPTVLACRARCACQWQACVAGTEFLCEGAVTTSYYQVARVRAPDSPVEHVLVLRSSSWLYYTVPMQWRCRQLQGTHRPGPAPQTSPHSGYQIRRPGSKGTAPDEGVMEANDPLNHLDLPCDTQLDPLLRPLQTMRGLPSPGFVH

SEQ ID NO: 1000757 - protein, 70 aa, Homo sapiens
AGMLPKLDDACVSGLSFFFSSPGRHSVGVCSLAMPLAISMLASDPIRYSRQHKLSHFAFILAYHNVELRY

SEQ ID NO: 1000758 - protein, 189 aa, Homo sapiens
SGEFRCCRPGWSAMVRSWLTATSASQVQVILLPQPPEYLWDYDTHHHGWLILFFLFVCSVCLLLLLFVFLLETGFHHTGQAGLKLLTSKDLPALVSQSAGITGMSHTPDHTTYEQTSDVKLGRKAGVRTAHETQTRSRPVDAKATSYTERQDDENSTEALIHARHSTTHKTALEHMRTLSTQKVMNQTW

SEQ ID NO: 1000759 - protein, 187 aa, Homo sapiens
RRFFCQWQPAELPLKIAGHEFRGYEAIRRDVCRHSPGGTQLLSPRDQTRHYLKVNIGILNPSPDGHIHDKQKTLVRRQRVGSEEEDEAPILFCDLRRALPATVVLGATVILLLAASLKILRALSNLVPHDVIASARGRVVTSLLPEKLGKWYWYTYEFYDIYTGLTSPCISTGGLLAHDEAMLPIVT

SEQ ID NO: 1000760 - protein, 33 aa, Homo sapiens
RPSPRGRAQPAAPGRGRLTNRAGDGWIIDVSII

SEQ ID NO: 1000761 - protein, 194 aa, Homo sapiens
MPCQHYLRKRGILRTTYNSVRADSGTTLWGSFANNYETLSHDLLQITLLAEVIFCKGQAHKVVVRVILSSKLCDPALLTSARIHHAQKGTFSFTAARNTLQLELQWLLKGLVTQYKCREHPPTGNFLKNQSPGCGHVDKRLCQTTTVHRAQGVGHQLPAGKHSTGEAAPAQRSQQLPTALEAPNPSKNNGRLHH

SEQ ID NO: 1000762 - protein, 176 aa, Homo sapiens
SVEVRRPRTRAQAWLSPGAGPAPPRGAWSPPHCQCRRLSHHDDHARIGEVHSSGAGADISVREHRDSTDSSLSRRKPGEQESACPMHIQNTRAMTEADTENGYRHVDSHRTSKSTRHEKATHARRWMKKQGTIPGNHPRGTTREPRSMPRPKGRTRHIGEGQSMKRTHTEVQVGAP

SEQ ID NO: 1000763 - protein, 246 aa, Homo sapiens
SGFLTISGRRPWSVARKVLDLIGGERGVEEPKARVCEQIQTIQSKKQLDLTRSLEIYIRRYDFEGLHHTSERMLLLILAAAWDLRMTIYFVTNDKTKTGVDKNVSQSADTGARKFPDCTRRASYNVPTGHTVGRQPDVYSCEDEEEELSETHWVALKRHTQRQQALPIEFQKRLEYTFEGHDILPDAVSTVSPLSIPWYSLDTLVDTVIASGSYKPNQGADAIRPTGIPQKELDERRFARGPIQRH

SEQ ID NO: 1000764 - protein, 150 aa, Homo sapiens
SGDRREKAPRVSTSTGRKGRQKGKGPARLHVNRPERQTAREKAPRVSTSTGRKGRQKGKGPARLHVNRPEQADRREKAPRVSTSTGRKRQTEGKTPRASPRQQAGKADRREQRPARYPRQQAGKGRQKGQGPARLHVTQDRTRQTEREKD

SEQ ID NO: 1000765 - protein, 82 aa, Homo sapiens
MADRAEMFSLSTFHTTIRAGLRPPQDISLEEFDDRTILICRSQTDCGLGLSYDYRATDEKDKTLTGGARSQTGDRQLRPAQD

SEQ ID NO: 1000766 - protein, 118 aa, Homo sapiens
MDINNEAGFMKAKLAEQAMMRYDDMCMPLRRRSVSMNKELDIDPMEEEEVFLSVLTYYKYCVDKDVTGRINHVDVVRLNVIEQRDDRKCGLMIRHTAKSGLEEVAEDEEFDDGVVNDD

SEQ ID NO: 1000767 - protein, 138 aa, Homo sapiens
RRGGSGTARSAGGVARAACVCAPASCSGDTIRHENLWILSNMEKNCICVKHTEQELSARGSYLRCTFLRDTSLSSSEHGRNTAGGAEQAPGTPEITSSLCCRNRSSDNDARKAHSDENTYDVTGTVLLKKCMAGKYGP

SEQ ID NO: 1000768 - protein, 297 aa, Homo sapiens
ADWGKRPRFRRVPLKWRPGGRCGARALACRGAWELAVCAAVKGAGPRIPAAVLADVYVAVLMTSGPPVHGSCVRGCADPVIRSRRNVLACGNLVLAGLLVQDAEADVCPAGSKYACAGVIWHANFAPTCMERRMQLSEVLLKTRLHTNRALFDNEEKHDAASTLQHSTEDFIHSGVSANPPWSILYLLLSLSEDPRMAAKQGYLAMLRHLRQDLTKRCPLNPLPIMPGPQSLTRELTRIESSTVRPRATLPELGQASGIYTTLACVSSVAPRLAPESTHHTDSLQSAFNEYDDCLTN

SEQ ID NO: 1000769 - protein, 255 aa, Homo sapiens
SGEAGKSGIEEASIYQGAFLLLHPMMEGGRVKRGEEAVPGILHQLTNLDLDDGLSVEKSVAGQREQCGQHETTSAVSRHSTASHSSSHDSRALKADDSKPPGHCVAEKTRRTPAGAIHRKLKTCMSMTSHGLGPDTLRGWRVAGKQTELGRKDLTRTDGRLLGLIDAHGDLWSQIESNEVSRTSHAPRLMCHLTFTMTDIAQCSAERCIWTSSWWYDWLIPNHWSLPTIEASAENSMYNAIDGQEVRDFYFHKTY

SEQ ID NO: 1000770 - protein, 335 aa, Homo sapiens
SGGAEGGGLWPFALGSAVRSEWERDGPAVDSVWTTPVEDLTVRPAVHELVLLQRTDADRLRLASVAYVHYTLVDRIHASPVDGGSPIDGRLPESQTVGAQRMLTQGTRDADRELTTDGRIQDGLAGGRARHSEHGAAAKHSKTRRPATAGQSEVHRSNTWAHDAPRITATSRSKLLAWGHTNTGTRVPYAGINGATYSRWVYQIVALPINLNVVVICTEAQPWPEHNQEIISTPKKWSRRHWNFASSWSYHRSAQLGLQSLGLHQTYGTSFVSTTAARQRCGGTTVTFHMSSNSLGGQDTARFTRQAHKLVHQWPVCVSQPDARALTSLVSLYPG

SEQ ID NO: 1000771 - protein, 113 aa, Homo sapiens
MSVNLSSVHSQPTELLRVDISRFIPCKGHILNAETQTIVNYFNIFFSVEIPFYSFSHYDAFSLTLPIKSFSIFTPSWAISIQASFVFVIILYNQPYFIFLHYIWQIYYYYYYC

SEQ ID NO: 1000772 - protein, 439 aa, Homo sapiens
AGGAAGAAVSCLPAWIQWGAALLPWELPPPPLRGLPAGSVSWFYTRPVPGMCQVLLHVVLLSPPPVLLHGYDTSVATVCLSPVIPMHTWEWLTGVLGRRLACVSDRCVPTNNRPCYEITIAMNAARMEQGEALKGCQLPNQVFRWLARCTTKDILVGPGWFQGPREKNRQASQKEHGLTKAQSSPGVTRGHEKQSAGQPVATRRWDGKPLRPRTTLHGHRIQEVGQHPQHTVEMTPQEFDRGPTRESDTRQRRWGQPEKTTRRTLAKTTRAMEAPKPQRDEPYRREECTPTEGDKIQAGGWPDHRVPHLSERRSETRKNDVEPATVTEQHADRAHPWYKTRRYHQASAGGTGSAARDKGTGGRVTEYLGCRPNMMAHGVHHRRTRGSWTRHMDMINQRGYANHFGREFVPQLLSQFTCEAAAGHLQKSIDFTPTGPAFG

SEQ ID NO: 1000773 - protein, 430 aa, Homo sapiens
SGLECAIGAGLCWRARLSEPLVACTYCLLSCSLVPGPSAGMAVLGLTAEMLAHVSSEACAADAPGSPKLAVLLPHHAPVNTNSLGTQCPPVTPDAGLPAGEIQNGKKQQTRKEGLLEGKAHRPNGPGRQTVNELGGGSYPHEYYAEDAQLILFLPCKTHLNAPQREQYLRYLVGTPTNALRRERSFYAHGLASVVRIPDAKVGQEPSGLAYPGANKGSQDAVATYAVHGDLQTKDQAHKSVLPRGYTRTKLRILHTEKGEHQVHPQADYVSRAVPRNTHRPLWPAYDTNVGIASGLAQVRLSRNTGTVTLNTEHLPYLNLPGVAMRARVHWDVRDVVPPIPDVTPPIKRVMARMYNATHSACKHFHAEVGWKARFHQASQVGSCECNVSVGWTSGINGAATNTVCATRRAAPSLRCVPTWKAAINMSSNR

SEQ ID NO: 1000774 - protein, 83 aa, Homo sapiens
RICTRRVTGRSRLGSRGLSEEVAAVTGDGGGRREPRAARLGGARASSSDQYPFQGTRSFKESELQPGPAPSRVIFFLCQELHL

SEQ ID NO: 1000775 - protein, 192 aa, Homo sapiens
MDPFRPSFRGQSPIHPSQCQAVRMPGCWPQASKPLDPALGRGAPAGRGHVFGKPEEPSTQRGPAQRESVGLVSMFRGLGIETVSKTPLKRDMLPSGRGILGRGLSANLVRKDREELSPTYGIQKCWRLGTARWQRPPLVGVGRLDRREFRCVFITTGNEQQVVSAEKWTSLPVPSAHRPGVPRSCPSHQLCP

SEQ ID NO: 1000776 - protein, 182 aa, Homo sapiens
MKDEQVSTMISQAYEVLSDANDNGNSLQQMEANTANYTQAWSRCAATQAHPWTLFDYCYTLRLSAARIADDDNVQRVTTLVRLPLQSYFEYTPSDTHLSKLTVLAPKHPPWPPWPDNTPREDIRTNYHSARHTGYSTATCDTHQAAHNAQQPRPGYPPTHATHVVPLAQMRPHYTRHLRIQR

SEQ ID NO: 1000777 - protein, 236 aa, Homo sapiens
MGTDRIIGDMKSRLGGGHKGSQSQTFIQPRRDPLRDKASEKAHSWTTQGETASLVVTPPVRQSSQEEHGESSNVTYVVEQKKDRSEGKAQGVHRDATRGSHVTLSPGGAAVIPIRSTWHRKTANSGENKGATRARKHRHISIGAHNHYKRGTTIRGKHPMYEWIETPWAYNPNWGSIQEEGTMKGNKRDHMRENTEKHNSSGTVEKYPRGDEIPPNNGAAKKGYQEKDPVGKPPPS

SEQ ID NO: 1000778 - protein, 149 aa, Homo sapiens
SGACRSGGRGGRGSGGARPSPNKKKKYKQKNKTNLKTNTEDTQHHNTKPHETQNSDHNEEDILQNKTNAGTHNRPPNTTRRQTETHTQSHEQTGRKDKKRKKETTKISIATHIKEKTESATQNTIERTTYSNNYNEQKQQHREQARDVG

SEQ ID NO: 1000779 - protein, 190 aa, Homo sapiens
RGAKMAGVQVSEAFATRSEAFIAHRGYCRRHGYRNDLAETSRRPPSRGYPPSVGSMSSHSKAARLRRIERWEATGALLAESVDEKLRILTQDAVYEVQWFTQQTFAHVMPDARGTSIFDQGPLFLVEVMARTSAQLEPEPEPEPEPEPALDLAALRAVACDCLLQEHFYLRRRRRVHRYEESEVISLPFL

SEQ ID NO: 1000780 - protein, 73 aa, Homo sapiens
RAIDVTPGPCGLPLLRKLPHAHTVAAPVISRAPNQSPPDTDPRRRRSSLTTAGAQHRQGTQNQHVWTANTSDN

SEQ ID NO: 1000781 - protein, 121 aa, Homo sapiens
RSGPGPVGVLVPSWLTPTPGTLAPRCEDDFNYGQQRWPPPPCTSEWRYSEKSLQRVLSLQVLLTTVTSTVFLYFESVRTFVHESPALILLLPSDLWVGFLALTLNRHKYPLNLYLLCGFTL

SEQ ID NO: 1000782 - protein, 115 aa, Homo sapiens
SGRTNWLVNQQGPGQYEAHHSGHATGLRMDDRHRFTKSSQGLEGRTLEELSLYCCKCCGPACNRNVRGTNRSMPCNNEWGLITSVIGECVRRTEWETPTYPSMGDATETSIHMRL

SEQ ID NO: 1000783 - protein, 249 aa, Homo sapiens
RGADSLPVGGRLGESTWGETVEEVKGTLGDAPRGYQGSNCTVTWSGRGYSQVFYGCMTGSGGLGLLLLALASETILWLVCAWDLWTALVRYVDKLDKVLDELCVRMHQLWKQIEDSGHDYLEFQWIDGLATGETPRRLAQAADSGLVETRATQECQDHHKEKRDKRAIENQLWGSHGATWMPLRVSWSTPEKQFMSGLHPECDETWLTFDFPPEFYEHAKGLWEDEGVRACYERSNEYQLIDCAQYYWT

SEQ ID NO: 1000784 - protein, 97 aa, Homo sapiens
RGVAPGMRTRNAAEASRNSQSAVASQYFIYARKLCAVVDRRIGGADNDDIISVQLKKTSEVDLGKAVVKFSACRLNQCGGEDQAHVTGARREETRHI

SEQ ID NO: 1000785 - protein, 404 aa, Homo sapiens
MTTSVPNMQDVVEPQMLGVINVSNAVAYRVVSQGQFQQYAEPIIIRRKLICGFSFGSCHLVLQMILESPPRFCLCLGLHSADVHSGEMSQAGENHSGKEMVTTENKHGEILRKEREPNTGAKNRPGWYKRHMDEYSSGRESRTMAKRGARDAYQTSVLHQHISRGRRICNTRSRREMTQAGEYEIQPPGGVSIAKAGTTRERVRTAQSKIKGTTCVVTHKSSIIQIPVTVGICPPKGEAENVANYKLNFRIPHVLCHSDDHVGFILILPNGVDFVKSVLGDSSKGCKELLSMSSNAKVTNTNEAITQINEKASGEDTPKLYLTDHGKCNVGEEVTARRATNQLIARHRSFALTKRGHTENIERREPIWRLRDDLQKEPLGDIRNDTKLREVTHENHGRTIRVAR

SEQ ID NO: 1000786 - protein, 221 aa, Homo sapiens
RIFSPGALGCGCEKGSKGGRRRKGRASRPRWGQESEGIAGEGEEHGAGSLDAGLTGHQVLDDLPGSRMEGQAEVHRITAVIDQKLETHQDTWDRVAGITLVEKLGWARNSLSFLSRSTRCGKYVVDTGREGTDRLWGSTSTRYQFVNLIEDARLIGGLRVPKPFREGPGPLQHDVRLKTRDLDTQTGQSVGLGNIGRSLTVAYGNYSCGMITIRYQAAQSL

SEQ ID NO: 1000787 - protein, 128 aa, Homo sapiens
MLEIVYGDEKDERGQFSEYWPGGQQTGSYFGDSHFAEELTLEPTFAGPWTCQKAVRNEELRGMRNTLLVLAGPRKNARKTLDEVPGDEPHDGTRSVTPRQDTLTPLAKPWRQDWGFQHPWHRPHNATG

SEQ ID NO: 1000788 - protein, 134 aa, Homo sapiens
RALSSAVCSRAPGSRVLTVAHARRAERRAAGSLGCTRAHPFRGRAPRLEAPAVRAFAGKRVGYSMSHETYFMLKQVKMAGFLDNFRWPEVCTVLDLGVTMTGNCCARSDWSQVIFVVYTAGWIVIDARVLRCTR

SEQ ID NO: 1000789 - protein, 141 aa, Homo sapiens
MSEMLAMNTCPQVGIRLTGEDLTPLHEEYCLTRGFHELDWRDIVVQSVDEALCALPLRTQSFVGILHTQTCACSKAELHAQSSIYAALQTYASPSRNLWFCGTMLLASKCNVLLNPCLGLCVATTHGLTLLWDLPAIAPRR

SEQ ID NO: 1000790 - protein, 148 aa, Homo sapiens
MEGIRARVPSRCVRQDSADGSDFEGTVSATSKEPLESPWRHARCIKAIEVTHRTLTSTPKGNELASRPRRLVSYGDAFHLCALVWDLMSEGLGDPKHKLPKKLAGTCVRRVQGTYSQDFRRRRRNCIQWLLEDVECRCSTYALGSLRC

SEQ ID NO: 1000791 - protein, 102 aa, Homo sapiens
SGLTEAREADEGCRCLGRRIPEGVVSVASPGPRVPEIGHRRARVCVPRFPARHSTPGARGPVSSAQSLCGIFGVILILSMLPRTRREILETLIKGLQILEIQ

SEQ ID NO: 1000792 - protein, 76 aa, Homo sapiens
SGVAGVLLRRENGVPRRRQEHGGPPEVLYDETEAPDTLLFREHSNETDMKSKTHDLGRVDWERSSILRRGIRRLCT

SEQ ID NO: 1000793 - protein, 249 aa, Homo sapiens
AGPGVSARAAVRAFAVLPLCELACGAPGRAVLMAWKWVLLCARVTPGHPWLHLVMPKWLLLLLLTLAGVPSLLPGELIAKMLQWTSEFWMPALLRGGPATVVVPHVCDQEAELGLVTGLLMPGAHVGYQCSAYTGPLLAVPQDLYVRLSAQAYPGQDRTPLELERRCCPLRHQDPLQSVADILFARLDPRADVVQALHGRCSHSIEAYTGHLRLVEQAHFGTPCTHLECAWPQLGIWTSGPNSKNGSTQ

SEQ ID NO: 1000794 - protein, 69 aa, Homo sapiens
SGVTDELTGLTQRQGSRGSREGLGSRAPRGPPARPEFCERQTLNREKTADSCRTTYKPNNCKHLYVRGC

SEQ ID NO: 1000795 - protein, 161 aa, Homo sapiens
MSHTRPRPSSATIALDRERRPKRDHGPMDQPDRPRRCDCPGNPRAAGAPGDALAGTDSSGTTDAVKHANEPRPLYRALRGARRHADTNRHPETCQAASNDRGPKALRHKKQDDNGDPRPASRQPHAAKRRTQRTTNDGTEQRPDSAGRKTRALTPKPTDRQ

SEQ ID NO: 1000796 - protein, 193 aa, Homo sapiens
RRSPVGFTQWDAARGSAWWSCTASPDAVRPHVTQALGRSMGLGVSGDKGAEASSEEASGPAAEAHGGGGGSGMAGCHGPRALRLLGRQRKEPLLEKSQHSESCVTPRRLRLTINWRRALVRVADQAQCHIGVGGQTMHRRATRRGTSDDMRLSAQSRTGVCPVSLVVSRHLTAHTTHIHDQRLSPQGYMAWDE

SEQ ID NO: 1000797 - protein, 81 aa, Homo sapiens
REVGRWRARSGGGGGSGHGKAEPPKGVVINDLMINLDASSHASAHPPVETQLWDQTSSKDRCQNTKASSSHEWYKGNMMKD

SEQ ID NO: 1000798 - protein, 127 aa, Homo sapiens
MEGHRIAPRSGHAWAPSGSQGPRYVYRLGISSTTCSSVPGPGESFLRETCSGLPSVAWCTWRHRPCVNHACIAAVTLWAPKSSPRQRRSSGERGPCVRRNRGAVVFSSTSQEKTYWSTGGHRVLLGH

SEQ ID NO: 1000799 - protein, 39 aa, Homo sapiens
MRSSALYAGQSLANDEFVTAELGRLDDAHRQMRRPLERT

SEQ ID NO: 1000800 - protein, 325 aa, Homo sapiens
SGSSERAVAPGARLGGSAQKRAERRGGARHRRTRWRPLQADRTATQPVALIYSFILPLGAFPQAHTISVCLGRSLTASDFPITISSTFQAGRVQCRSAGKRANKDFIIILDSQGSPHSPIKHRRDLTDAAYHGGGLLNASGALDKKMADLLCRHEHVAVHGPGPRRQHPGLMRNPDETRSRTPQEARRTRTGDVPDGPDAQARLSRSTDCISQARAHASRATSPTEPTLPGARPHNRTPRRHICDTSATSHDARSLRSKVSPPGHPLTREPVRRHLTRPTPRTGGTPLGDLHSRPQQPAAGTQDTHTPRTRQSTTGHLQHGTPHT

SEQ ID NO: 1000801 - protein, 203 aa, Homo sapiens
MSGRSRGRKSSRAKNRGKGPRQGPEFRPAPDDAPRDPDPSQYQSLGEDDPWRHTRAGMAAGWGGLEAAASAQLLRLGEEAACRHPHWNCGLALLARAAWGPLGQAAVQARPGVRPNLSRRRLGADTVFVGTGGNPWERPNKCPPRWKAGVALPGMMAPESLVAPRGKGASGSIRLGGTRSKDQAAGRGRITFGSQAWRKAPER

SEQ ID NO: 1000802 - protein, 68 aa, Homo sapiens
RKSRPEPEGAGTATLIRAQMAQWEMLQGHLWNEAPPDFQGDRRRGQRKGRVYKPSAGANQRARSTVAT

SEQ ID NO: 1000803 - protein, 119 aa, Homo sapiens
RIVGRGAGVGKMAAPSLLNWRRVSSFTGPVPRARHGHRAVAIRELMIIFGGGNAGPSLGWMLASVYKQRLPKSRGFLAAVEKDDIASMGCAAWTLSVTGTMNYYVFWGDTGFDTTWERT

SEQ ID NO: 1000804 - protein, 144 aa, Homo sapiens
ERVLQVPGSAPPLNGAFQIRRVPEVGGRRLALLRLDVPVGRDREPWGTPKPCGNVPGLRPPPRKAKGKAPGFGRNGGTGQTDTGPDAGFPRPVSPLLATGPGGREKALGGPFLDKQGPGGGAPPRGQTERPPFSPPLGPPPKTS

SEQ ID NO: 1000805 - protein, 111 aa, Homo sapiens
AVGLRGSGCGRWCRGGRGAWERRPRPMPRGAMKGQGRDDTDGRAATAWGAGLAEGPEKTPEARRSSSEHGQSSVQCGRVSTPAIGRLVIATGAAADHPGTQLALARRLIEP

SEQ ID NO: 1000806 - protein, 312 aa, Homo sapiens
SGLGLLTSRLRPAGHAGPGDVLVDVLAVPGLALCPAHALQHAGRLLMTFGSVTCRSCRWPGVCHHGPGGLAPGSAMTSPPVFSAHGPGAVWLLDACADVWPFPAVLPSCTVQCDWCLLCALLVLQVAQTLRAAVATHHADGVTQCASECVCLPIATYQYSRARVAQKDCTGLVRDRGRDGRRSVRGVPPVVCPFDLRLHCRRLHRTALTCWGPLCDPWGPANAYSDQAQTLADSLGVASTERHCTPRIRHSNSGAGFRNEHGLPMSDPRGPSRSEAGIEDRERGPFRGRQRVPPDPERTKAQGDTNSLEPSQ

SEQ ID NO: 1000807 - protein, 178 aa, Homo sapiens
MKRINHEARKNSPMTACTMCALVGNRNCSQKEEGGSYEQLITSDDIRIPSDSPLNEVKEVNNYLLILEGGELCLTIPHGTCVSTFNRSLLRVQCIFCADETLSPLQLHAVEKQLDRKSAIPCNLNILGLDSRDRSRLDLMDALVRTLLSKSTLVGWTHMHLLCYCERMTDDRTFHDRC

SEQ ID NO: 1000808 - protein, 208 aa, Homo sapiens
RNQQQCAKGPGASYADWTKEETHSCTMISYSCLVPIAHYVREPPTSKVPEQSQFQGQSGGRASVAVVAMGSWQDVSCAPSLELSRWSTIATSRDDQRSSLRRLLGPSVTSELRGGSAWRHRPRDGFPLVGVASRPMRRMRRGDAHDIHSHRGSLCHPNRPERRWRRPPRGDGDPLGGFRRHRNSRRSPVNFNVACGIVEVKVHNRDLT

SEQ ID NO: 1000809 - protein, 100 aa, Homo sapiens
RVRLVPAASAAWQDGLLACRSGYDVIRGPLPPGCLRKRYSRATVRDKHVRCSVTCAPGGRGGRPELNATLLGFPNVMKLVSTRTTAERAPWRLMVHLEVQ

SEQ ID NO: 1000810 - protein, 144 aa, Homo sapiens
MANRTTRCPSYWLYDYQVTPERLSIPPGIPLLISSYNTLLNYSEPRDETFPRLRSRPTSPLKQFPLSTPPLPTSRHLPPTHATEDTSSHSHESATSALANPGHTRATRTSLRASTLGTTPTHDHVPTRAPNTPEQPHTQDTIHT

SEQ ID NO: 1000811 - protein, 202 aa, Homo sapiens
MLWEAAPGGGAAGAEGLGGGSAPLGSTELPGLVWKCDRFVPGLVSVEDLEETQILGGGDKAERTRCIGTVQARGAGLLGGNSEAWRIDEEGGCGPCEVLAVAVPGVEGPLKVWPQLGTLMFPGWPFMRVWPQLGTLMFLVWPFTAGGRGVLWGEAALRIRASRHRGVNEPGAAVSPGCGPGCWGGAVALKPHDWPGELAFLF

SEQ ID NO: 1000812 - protein, 128 aa, Homo sapiens
MILTAVEDCVYELHTRFVVSQLMFFSEIEETRVKIDKISEHVEEAKKLYRIILSAAELPVVLTQDRSETYERWSRSEIRQRGAEQRPEQTEGALENRILKEDEVRSSADLRIRKSQHSVLSRKFVEVM

SEQ ID NO: 1000813 - protein, 198 aa, Homo sapiens
RRLSCGVPARVGAVGGASLLRSAGCHRTTAGRPMAVGSRSWSVARWSLGLPPHVAQAVLPRGYRRSQRRSVFADIRDCCGGDTREVGLRAELNSGKREQRVELGVNLGPLTRIEGQYGYRANPSHKLKKSKHAQCPEEGRGGRCVVLYSIPAGKRTASAMGDMMEEFVYKVCEGRWRVIPYDVLPDWLKDNEYLLAWS

SEQ ID NO: 1000814 - protein, 175 aa, Homo sapiens
ADGGSDLLAGAMARGWSSRSASAKSAATNVLTMNGRSAERARCRQPAQHGPGARRVFGSGARVGRVRWTEELARCSGGPRYTSVAVVGASRGRPAARLRYRLARDNRRWLRAKGPRGTMAEGSWGSSQGSAGELGSFIYQRPRARVYVRRGCLPAEFVFPACLVRRPSRVSSGFP

SEQ ID NO: 1000815 - protein, 264 aa, Homo sapiens
MPAGYSRRDCEKERDSSRKLTRCHWATCFRGRTGNGARVRSWFLWAGIAFPKAATAMGLVGNPHIGTANRADGHEFPGAGRTASPPAMTNAWTVTGWGKPFWAQWPAPCELSLQDRIGRPPSGITPFDSNALGRYAFGHVGVRSIAFGNFRERHLRGRTNWRVPRKTDKGAGAKEEDYRAIGVKRLSGYSICGYESYTHDEEELLRASPSVNYSPHPEAYLREFLHTVSPTWTLCRVPTREQNNLRDLDKKKPVIPPVASAWYV

SEQ ID NO: 1000816 - protein, 152 aa, Homo sapiens
MLKSGLQWNDIPSEQELTEITTGMLPGLASLESHNKLDKDNLSYIEHIFEISLPSCPTHYWWLTTEPVVLKISELRMMLDTQANPYPQCQGMYKDIIRQPSEDEIIKFGSPTEELPEQGARTRQAGWTFIRPLTSPILQEHGATGTPPSTTY

SEQ ID NO: 1000817 - protein, 382 aa, Homo sapiens
SGGSAAHRLRRPERLPLPSRALRPWSASSHAILVVPLTFRGSVALEAALVGFTTSRTTVVTGLASRADLTDGARQLTVRMDENRDCSWCVHAGVTVRCEENRYLAPDAPEVGPLCRKRRIYAWLQLRMAYGVGILIYVPSPQGPAKAGVSGHAGYNIWIHNLVHAEQEVLGFSTSEHTDHCTTTKGQRTGNSLVAPHEAGLIPTPQTELRTPPTAEDSRVSNKGRFKRTAIRRRDAILAGGNAIWTWWSANAPRRTAYTTRVSLRQEPKPIIGFPTLGSHGTALGFTQSFPAGPPPRHLHCPRTRRPVYHPKLSTWRPDPRSPTRIPLNLSGFAYYSHPISHPDAGNNKSSPPSSTSLVDRKPHGARDTNPENSGLIDLGET

SEQ ID NO: 1000818 - protein, 66 aa, Homo sapiens
AESCCKVLSTKGASAQHIPLSRASSSSHTEVMMPLTRICFRYSTGTLGLWHERMLVVTGCGPNAKR

SEQ ID NO: 1000819 - protein, 112 aa, Homo sapiens
SGSCVWRLGCKEVAVHNHNTTAGGRRRRQRRFLSGPGGGAAGSKGKEGWAGRALAFRAPCKEFGRAGANPGGNPSNLDWFPGIRPTWFQRNNVQAGGSRGDLGIPKQARGFS

SEQ ID NO: 1000820 - protein, 363 aa, Homo sapiens
RVFHNLRGLELASRTTPQPPAPPPSPHRHLRRMHSIEGPPPFTDTLRHHLHILGISVTGEEAIIGFHCGPGAAAHGGRWRRRHAAVQGTRTSNHGTRQGAGGTQSTTDHRLHPLATHQPSIAIIIRWRQRHRRTGPLYSEQAYPTGHCTGMTQVRHPSTDVANTRMTHEQPDYTVDDRTPSWNKSQRTWHLHHKPNRTHPTLQPTLVCSARRLAGAQDQGHASKQTPWHDERTTAPVTDDPPRRMWWGRSHTNHHKHPNQLRCPRRHTPHTYRNKPNKRTKRSHIRTHPFTQLRMEDPRPTHTATSVQAAWAAPPATRPRRTAETRTTETYGPKGRTHTAPNSHIPRTIRRGTQPTPPSNSNL

SEQ ID NO: 1000821 - protein, 308 aa, Homo sapiens
MVESCGAPVLKVYEAGDSRSGCHHFLVLLMTLVSTQTYEQKGERKEKEKRGEKKKRKEKREREERRTKKKEERKKKKKRKKKDGRQREERDEGRERGRRRRGRREGRQRGKEEREREGRARGRREGAGRRGQSRTRERKEEEENNREERKRTRRGGERRTEKKEKKKERNKRRKEKKERKRRKQKKEQRERKEGRGRRREEREREKQEGRAERKKERRKGRKGEGRREEGRGGKTKKKKREKRKREEERKREKRRKKRRTRKEEKRERRRRKKRREKKRERKEREREQRRRRRNKRKKKKKDKKTGKE

SEQ ID NO: 1000822 - protein, 133 aa, Homo sapiens
MVEYSDITGGRTEAQCRTQLGTTEQVAQVARATERYTTNSTDTIGVTQSRALWSTKTGQKNSIYDNKPRGYAYTGAQTSALRIPNVQKPGESKEAAAQNPHAPRLAQDTTEVPVRREDTPDDTAESKANNTSD

SEQ ID NO: 1000823 - protein, 130 aa, Homo sapiens
MANPINGSDHDNPGLYADGGCRKMLKELCQRRHEGAGRRNSSSGEPIIVEALSRGETASRGEMRSERDVFVYPGRANDHDACKEDPCSSQCCWHDVSHPCRGAGARCGKCVNLPRRSVNSVMNVGRLTEE

SEQ ID NO: 1000824 - protein, 63 aa, Homo sapiens
MGSRTCVEYMSHWDSLLCARIGETLGEAKQCTDMVCNMGLVTIGRAPLCIVTASHSFACQWKD

SEQ ID NO: 1000825 - protein, 92 aa, Homo sapiens
MQQQRKLQITKKQHEELKTVIFQCYEYLVHIKDALPRDPTDAAGGGSDVRDPREKASDQTQVWTVPQVARRYLILVSPAVSALPRNKTFVLR

SEQ ID NO: 1000826 - protein, 182 aa, Homo sapiens
ERCYLSVTTDSERAPYSLIVPAPAALAVRAQVGAGRVTWQTGTADRDREEAHVTVAPSCACPYATVYGGRRDRHRDTAEKGTRHRITGERITRRRPIERVERPGTHEAAKDAESHDREHNMVLNNETVIQGKQCVIERGKEKNLQWSSSFNRVVIHTHKRTYGKEKTHNNEKDMRATRRYTD

SEQ ID NO: 1000827 - protein, 197 aa, Homo sapiens
SGVGPGSRALVEGGVGLLSPRSWRKRQWPCEAGSPVPTTPRAGGDDHDFPGPAFAHIPDTGSSACHSTGGGRWNTVHPRGAKTLRLGALNPDFGLNRKQEKISVFPFRCEEQTSDTSNGLPRGNRVPSMPKLGRHVYVFMRYRFDVRPQRMGQTDHESVTSGLAVKHEASYKRAHQRAFVPLTTSSIPYYDIGPYWY

SEQ ID NO: 1000828 - protein, 173 aa, Homo sapiens
AEWELKKMACLGFLLPVGFLLLISTVAGGKYGVAHVVSENWSKDYCILFSSDYITLPPGPATTPHSCPCMMAPRHPGARVRIPRQQCPAPLLPSQRQLPSDHCHGHEGVNIARFQQRIRLGWRQGQGCPAGLLTREPGHVRQQCLKTCTLEPQDPPPGPLDKTSLIPVGNGPL

SEQ ID NO: 1000829 - protein, 88 aa, Homo sapiens
RVTPSERPLVQREEFLLLSQTLSLSYLTHQIPEIARHGFTYCERRSLGNQECNLVACYLPGSRDATLLPPTVNLTDEHYCAGTVSTYT

SEQ ID NO: 1000830 - protein, 305 aa, Homo sapiens
MRVLFYCVTRNECGANVSHTQNTDLGVLDQVRSSLESFSGLDYSVRIGASSNCTCIARGGLGQRYPVVALNPAVLTAMLCRLSMWQGGHNAPENSYVHSIAKTLPKDSAIPQSTERLVQLKAVPVLGTHWKRPQADLGLGLPERQGAALRSLNDLSSGHGCSQVRPRVFPRTMDKGLREFCTRFQKAKYLKLGRVTSGREGEPRPSSRSPVPVTQVFLVGPSESQAQIGTPRLCKPPSDYIGICQMSEARGCLFAMGASWITQRLSRWGEDGTWEERGEKVLREEGFEVPQPKKALSRRWRKGYR

SEQ ID NO: 1000831 - protein, 186 aa, Homo sapiens
MAPPSSLCRGSAGPGVVPGSFKLTADVSGRIRYPRQKVNLGVGAYRTDELPSLGFALVVKKVEQKIANDNSLNHEYLPILGLAEFRSCATRLALGDDSPVTQGQKRVGGVQVFGVEQVHFELVADFLSALVQWNETTKRHTCLCVLSNPWENQKCCVYRCWFDRRSVLSLLGCTTKRGLDLQGFLN

SEQ ID NO: 1000832 - protein, 76 aa, Homo sapiens
SGLPWRLCTQPGSPAWGVQVVSVAAVASRGASHVLVNARMGTRKNKFMHLVPCETHRVTLLMNDSTIRESDQQEST

SEQ ID NO: 1000833 - protein, 122 aa, Homo sapiens
RSCASQTAVWTALGVRSPAVPRRSARGMVSRSLLGPCVVPAFSTEILSYAQRVGLRRDAAVLRMAVRCAWLARRNVAAREGSKLRVRGVENRGTEKPVRKSFAELAVPASRHSGVILHVGKM

SEQ ID NO: 1000834 - protein, 249 aa, Homo sapiens
RLCSRLPWATAEARQTGGSAPSMVGRYEWLDSQPATGMCSRLWSLMAGESSREEAAASVTCLLTVDGTTLGCLRSRILRCPFPLNTWTRRGKCDSERSHVNTFFKELNNESKSLSSCREYRVDLAAVYTLGKHILGSLLDYPVEGNMPNVNENAGQHPQMAGSWIEPTVDELDQMMREAETEAPEGTEERGISVAHLQRSDHQNKPAYHLRALLQADDCRSMRELYEVCMKEGYADKKTWLRIGKKQDM

SEQ ID NO: 1000835 - protein, 238 aa, Homo sapiens
EREGQHGVQCLKRRACAKRGGSCSPTDPPVQRDEEEETQTRLKMRTEDRLTDHADKDTHGLTRRTDGHLFDGNVTYRHSEELTIRYQNYTRLTDRTLNEPLLAARYFLNGSYETLAQTPYTDLLKFNRHHIEDVVIHQHNVTVSDRTAKTMTIGMTDRRSLGNNNAPKAQSTHAPDNGVPQGRRYETHTNKARSESTRKHGETQKPGAKRRPKERNTTGNTIKQENQQPKTGRRQNVA

SEQ ID NO: 1000836 - protein, 40 aa, Homo sapiens
AESGLMALRQFGCVPGSAHVWSAVHSTQHTSMFDLRYDNA

SEQ ID NO: 1000837 - protein, 429 aa, Homo sapiens
MSNYVGRSFILGSQSCKERAADNSSSQTMGAAQQQALQTDSLPANAHSNSNASIQGSKQPGQAQSFASQSQATCFQQFYKAQHFRSQYITNNGGPELEVSLRIGHHLTVGHCEKNHTQLTQWILYATKGSHKRLPTDIQKPRGVDQSGEIPSQCFNQIAGNKLPATQGKHNKQAPGQTHNKQAHVLIGPHISGTSRRSIGAASQPQFKSISYGNAWSQLTFRQTQGKSRKIDDNNGPQARSNFAGNWPPRHSGNGHSILTIVPAGRFQNMAQSTQENRQNTTRTRAGYTRQLANRITVCGGHPHNDTQLAVAQHHGTAQRDNRPYVGQRDGGDKAPHNSGGNVGYPSGINTQHRSKTGTQDHKAPGGKPTGHYDHMVRPDRTMTGYHFTYRGRRKPALATEKMYTRHNNTIAAATGGKPEQKYRQHRTE

SEQ ID NO: 1000838 - protein, 188 aa, Homo sapiens
MTPQRTNNKTTTEEKKTRRGSRDEEKTGKRRDKKERRGDDPDGARRKSNGTRGIQTNTATSQHARYKRAVRQERHQQTDEKTAEIPARTREQRDDQHRTRRSNQQEWGRAKGRNAKSGKPRSGTKRGKTWRRSQRSDSSTRNHTRGAETGDGPTGKRQAATGGTHKRQQDENHVKSGEEDKWESAREE

SEQ ID NO: 1000839 - protein, 104 aa, Homo sapiens
SGAARLLPSPLRRRCSSLRPAHPPLDLPPTGRGDGGGGGGGGGGGRGGRAPAERCRRRGTRKYQVEGRPIGRHVLLLSSRSIMAEPSGVARCTSRHIPTQAAPV

SEQ ID NO: 1000840 - protein, 156 aa, Homo sapiens
SGGDFNPLFGRLVVMIRTPLSASAHRACSSQDSRRPTPDATCSPRAARVPDALRPDGICGVMLLHATVCCLLRHARNPRGDHGRVVPAETLSTTGLPPGLFTTSGVSRSALDIPQGLTYAQAHPQKPWDLRRSARMARDARVVPSSWTGRQNDLHP

SEQ ID NO: 1000841 - protein, 174 aa, Homo sapiens
AGPAVATCSDSERLERGVGGCRVFGCVRVSSPGDGRRRELAALWTSVGDCGVVAGVLWRSHNVVQVVIIARAVAWRPAGQQTFLHATVCLEALDENERAAQQLTIPENGWIGHILHLVGISVMPGTLQLCIWHYAKGFLFANNEFFGQEEHSASKHRIGFCLLMAFYVCNKGMP

SEQ ID NO: 1000842 - protein, 162 aa, Homo sapiens
RERRWQMRKSETLERGVVAAESFGCRRVLSWALEWRPELALSGSILALGVGGFTRDPHMSAAVSSPRQVGLGGTDGSDDIIAGTASSSQRKDKGGVNSRIPRDRLETTYRPEIGPRSDATGTSFSSAFSKSLPIAKSSFLDKNVQGLELPRKECVRMIPPFA

SEQ ID NO: 1000843 - protein, 82 aa, Homo sapiens
MAKRMTTRDTRTSPQAGVPDAAPEQVTGYALTSRAAQEIALPPPLARPDRSHIPKTKSDPHQVHLSDTEAAARKRSPKRQDP

SEQ ID NO: 1000844 - protein, 258 aa, Homo sapiens
FALHTSVAPEARILSDELGWSAASLSAGEAGACLLPSWLPAAPSLRALALWSCGLPLLLRATGWPDAPEAVPSACNDDGTLGDAPVEPAEELVLLAVQGCCCLPLGCLKLLKVESLARGCRPPGRRRETEVGRCKSDQTRTELDCCMTFGTALREAASPEPTRLPSTVHWWEAEPGGKDTVEDDSEATIMSLRVHTLPTLLVIRRQTGLQGAAVFADDHTWLCGPVASGVCPTVCICATDIVRCTNKNLSKVPGNLAD

SEQ ID NO: 1000845 - protein, 181 aa, Homo sapiens
PLIRKMDRHQAHTRSERPIRSMSGRQSLEDTEGTEGRLRSATKKNFLITILDKMNCFAFGGSEFFIPEGIQIDFEMPTFSATITEWYQEIKEGWRTTGTVYRRAHLFPPRKKHLPIIQNSLLHLVMILSRTFHTYLTWATRTSTINNSKMRRFSRNSESPNEMTLNTLVFDQRDLVHTLDS

SEQ ID NO: 1000846 - protein, 219 aa, Homo sapiens
NLLETQYWAEIRRPIRVGLLYYTFEARDDLNERSAGWCWGDEAVRAVRCYGKTDTAESSSATGRRCFPAHHELPVVDAVSLSDQEYPWRRWNSCPVMGNGVGGGASALTSGIASSPDYEFNVWTRPDCAETEFENGNRSWFYFSVRGGMPGKLIKINIMNMNKQSKLYSQALAPFVRTLPPGTLENAFEPATLNDRDAVCVILCHRSWRAVGHTSSLLY

SEQ ID NO: 1000847 - protein, 69 aa, Homo sapiens
GPDMARDESPALLQLPGSGWDKDLDRPDTRGPSFKGPTPLLALQSKAGCPDSPTPPGSDPRGMPQTRSS

SEQ ID NO: 1000848 - protein, 133 aa, Homo sapiens
LRDGGLRVGASLYSVRRRLLRAVVLWLFLHAVVGWLRAASPPCGGWLLRGCGSVLLLHAGGWAGSSRWAGSCACFILLSEQAVLSLWPCAVSNGCQDAYWSAVSYACGILLVGCAPEFASSNDSDGGARHGIH

SEQ ID NO: 1000849 - protein, 72 aa, Homo sapiens
MEDKTELRPSTGGKAGCEHGMHAGRLGRRMAFRLQSTGQPSKRTSVNQQTWTEAKRLMHPPGWPKSSDAHVD

SEQ ID NO: 1000850 - protein, 94 aa, Homo sapiens
MRPLGDSAGIALPLRQAATCTSIIRPHDDPQALEPISVSQATRESQPRLQTTRNIKARTKKKHWDNARFPTSPPNGTYEARRYTLEKDLTSGGR

SEQ ID NO: 1000851 - protein, 353 aa, Homo sapiens
MPETRGMELMEDYNFVFKVVLIESNQVWGTRPTLSLHGFSATTEFKSTTRAPSTDRGLSSPHPHCRCCGTDCLSKAQNLCDIMLWPCDRATAAHSALRRYLHRWLHVSVASPVCSSTRRPNARRTVLLSVLTRMRLTATLLLHHCVATSRRLRSAHRILRVTPTTRDPPRHTRAPGKMPHLPAKRHDIAYRRCTSTNLGGTLVTPSPWRHQPSTSLLGNIRNPNSALHAYRRLLEARGTAGKKTHSSRPTRSLAPNRASSLNRCTPQCTYPWSSHILAPSHPFTLGSRPVYDPHYVTLGETTSRQTHYKHPLGRRELTTTAHSLLSAIPSYRSIETLLVVPRRNNTLRHLDTL

SEQ ID NO: 1000852 - protein, 168 aa, Homo sapiens
MNVSLCRDVVTLKDSRGSPVAVRTGLNQTALTDSSMSAVTPWSPHPLASRHLLGVIHICGWAVGRRDPTGVDQGISLTINAKQHGGLPERECGRGREWDHLSARADMRGTCTYQGRRKAGMRQTRIKKKESLTPRAWTGSQREWPDTGPRGHTRATRDPDGADGEEKP

SEQ ID NO: 1000853 - protein, 426 aa, Homo sapiens
MNQGTPPGAEKTQESIPAVALVELPIDKRNNETHRRGRNISPPRKAQRKGHKHPEEIARAAGRRNEAPRTTRRQNRTRRTHRGGQTGRSDRQSDEAQVEEGMSTFRRQQQETESESTGYTARAGRTRMTCEPRRPPHESGAATEQRGTHSKDEALQRHVEQRPADMRARDRKAESRRAETQHPSTYREPKDRRETQSTQMSRREAHDERTQARQRSDNATSKTEETEEADMAMIEQAVSREWVRRGRERGAVSVARERGRTPRERAQAGWSNDKQNRRSVEEQPQTIAQRGGAEATSTGARRETQEKRRLGEETTEERGGGEQEKTKQTEKAEKARGTQPDGAANTQEGAERRRKTYGATPGKATGAREKREYSAQRTRREGAKEEAEAQVGESEAATSETQETKSADERTEENEEREKAERERAQ

SEQ ID NO: 1000854 - protein, 269 aa, Homo sapiens
MTIDFLRPRGEGAEDSRGVKAVSYKTAAADAQGSQVPEVTRNLGRAQKLTKLPRGGEHKLIQEQIPDPYKKCTRCSGGHFHMSRARDQTDTQNGQTALADWGLNAQLYAQNLKGLKHHLLAHAFCGLDHFGMAHRARDCAWVLPEAAPCNCLRVKLGVWERRRGARPCLPFPRNGTTGVPLGLGQADTEGELAQRPSHPYQESKPGYHTGMGRQTRKGTRQGDTRSFPSRGKWQRTGYGRPGLNLYGWEASTGASHGAKTQRQNQYAHQ

SEQ ID NO: 1000855 - protein, 172 aa, Homo sapiens
ASCITIVRLQEVSSGVIFFCGLPFFFFIFYLGTAVVKNPEGTWRGASALSYHSFPSEFCDSEYGQSVCCIGRLPSAFVQMLWPSQWPGKAYRRGGSLPETWKGPKPSPVDLGGDHWALSCDVAKEHDVQNTFEEMEETFRSSKFLGKCSWYYQGMVFYVRTKLEDMVSTVSY

SEQ ID NO: 1000856 - protein, 196 aa, Homo sapiens
MGELLGFSVYASREKKGIVIGNWKDNEWPRERIIQYYGPATWAQDGSGDTEPIYMLNWIIRLQAILEIISNETGRALTVLAWQETQMRNAIYQNRLALDYLLVAEGGVCRKFNLTNCCLQINDQGQVVKNIVRDMTKVAHVPVQVWHEFNPESLFEKWFPAIRGFKTLIVGVLLVIGTCLLLPCVLPLLFQMIKGL

SEQ ID NO: 1000857 - protein, 324 aa, Homo sapiens
RTTEDTGLCRVLYSCVFGAEKSPDDPRPHGAERDMASPVQGKDFSLVATCRRVNSVRAACMLVTSEFWPTRMERCSAANLSDEAVPLHEAPRGAFRLAAENPFQEPRTVDVAEGVLLDNGVLPMVLDAQCEPATWLRGHRFRLLTRLRPLTTVRLRGSPGDQLFCCVADLQFEGILIRYPCHIGQSALVLNDQFVQGLAGRSSDAALAPCDSSLGWCFCWHGRGYDTTGMTERFGISSPIAGGSDVLLYQDKWVTEALPKGGWQHGGGGPAVLRLVEPQNFLSLKAAVFSETAAVRQHRLVLETHFSNPCQPIVLELEELLELT

SEQ ID NO: 1000858 - protein, 356 aa, Homo sapiens
RDSLANICEIPSLPKNTKQKRKKNYATVWWWDSCSSRDTQEAEVGNLFDPGEAECCSELRSHDHCVTSSCEATVVENPGLKTKKTGCGGGGVLYYVLLFLLLPHHTTLLSPITKVGNYTAPLVGYHLGGVRRLSHSHHIIYIVSWDKTKKDNKTNHRKLFREEKEHRPFWVGHLRAPELYHINLAPQRGDTSRHSPGIANTGVCFSYTPLLLKPPQDICLDKEACVIPQIATREISQVQSTRPEIDPGGNNLEGATYNELPYIHTTPLAALLRVVSLNQPKCVERDMREHPHHTEGGRNDPKQRLRGNTRPKRERLRGAPNRKELKQQTATTTTHQSTTRGEGQVPPSEKEETSTL

SEQ ID NO: 1000859 - protein, 252 aa, Homo sapiens
GTGSADDGLQARTGSGPPTAGAGGGGAAPMRGPSWLRPRPLLLLLLLLSPWPVWAHVSATASPSGSLGAPDCPEVCTCVPGGLASCSALSLPAVPPGLSLRLRALLLDHNRVRALPPGAFAGAGALQRLDLRENGLHSVHVRAFWGLGALQLLDLSANQLEALAPGTFAPLRALRNLSLAGNRLARPGARGARRAPACCAHSACRTTSWRHSRRGCWAACPLKDALHLPRQPLGLRVRAAPVCAWLRRQPLP

SEQ ID NO: 1000860 - protein, 95 aa, Homo sapiens
MARPSAIGAHVIAREDYARCQSCRTTRGTGVVRTETSIRGCVCPSRPTPSDCAHAIVAAHAPVNCRRTETLPRIAMAMSLGGVDSAARVCTRRKH

SEQ ID NO: 1000861 - protein, 107 aa, Homo sapiens
MGNPSVLSSEHGSDAKVFGAGYPRSVQAMTVSDCVMSNIAKYGCITVIRDTANGSDQRNSEKQLSNRKNKKQKGGSRMTEHKSTEPGSGMTGKDTHPRGYGNRQNMG

SEQ ID NO: 1000862 - protein, 255 aa, Homo sapiens
MRALPTEKGTANMWLGSRGSGPHFFLPFPPFRTVFSSRPSTFPVGGSCVFLFFVESQIQLVGGDFQKAEDLAKHPCVALPNYTKTNLLRVAVERTLSPVGPQGKIVTNTLLCAPPCEPPWLCTCVSCGPVSAAGALISKVFSYRKRLSFCVWGLSVSCGDAAVGSPSLCAGGEPPRENVSPRGVAPSTKKGVASGALSISIAAGHDTRVCVSWGECGGTYFISLCAPLYLCPPVSFTPRGLQRSPPCPCLFLFTL

SEQ ID NO: 1000863 - protein, 101 aa, Homo sapiens
DAVPQPFSSEPLATPRPNTSYLTPTPHVSWQAIATYPVNHYHEDEKLYLVYTNLPTNSRLTYKQFTATELNHISYTLFESTLIPTLPYHHPMRATPGHAYA

SEQ ID NO: 1000864 - protein, 492 aa, Homo sapiens
MDHGLQAPRVERIMCNAVHACTAKTPAQLAGHMQTHLAGEPATHDPGRRTTSQKPTHAEGRPHGTTRRIRAGGHSPMRLAAACQLVPRKAGKTSLAPGHANGNDPAIPHKKLARAASPLHQSGEQERRAISPCSKPSSRHHAIIHFPPKHRVADERLSHTRSGRHTAESQTARGANEHRRTLKDRYRHYRGDPNSPSHVHPPRTLTFYPATANKTSHITYSRRAYTPTHRQHRTDPASQKATHAPTTRERESHKQTHTTRLGPTAHYQRQADTTYPSRSPRPRPNNPTTSHDNLPLPQLASLTTIQPLPSQLRSTTLYGDDPPTQPNNSHDTTAHHTRHARSSTAPTQTQHRTCNDHAIASAPKSEKDKRAQRGHKHGKARTHQQRHHRAIQRAAASNRPPTSRAKQAPRQDGSTTRTRYDPHKRQRQDSTREQKHRPAQRPHTDHGRSDGHYPARTHRSTQRTSAAETTLRNHPCPMQQSDQVGRRAPTPP

SEQ ID NO: 1000865 - protein, 125 aa, Homo sapiens
MAGELNEVMIANYLGKFTNNQRNTGLHFSFPRGHDLWLWASIQIGRGQGLHSLQLVNYVMRPCGYTRLLILEHDGLCCPEQAVHGAHVARRLAGKFNARALLCATRDLFAVSPMCPKSPKSLEPP

SEQ ID NO: 1000866 - protein, 218 aa, Homo sapiens
RAMDDSSVRSITKVERAAEGVQATEDYDRPGIRGEAVMIDTMLVLEGCRPIEDLVMRVSDIFMDTSYAIATALAALDSGRSLSKDETVSMFLRAPVVGRRATDDMHITPRWEGRQHFEAFFRWSESVAKRAWQRIETNSAQLTHVVTATIAVGYERDRLHVGRLPVAHLAWQAKLDTLWAPEVLEAPPIVELKSVWLKFCELGTQEAQSPCAIGGRNG

SEQ ID NO: 1000867 - protein, 268 aa, Homo sapiens
MRVMARRSPPPAALGRPGADRDWACSHSMRYFDTAVSRSGRGGSPGSSQWATWTTRSFVRFEQRRPRAPKGEPRAPLGGAGRGRSYWDRETQNLQDAEAQADRVSLSEPCRGISTNKSRGRVVTPSTRMVWTCDTEETRTEAPSSRGDMHQDPARNERAKDITSAMETKDHGAPWNRRWQTAASESTSATVGTAARAGGTKLRKPTLEGAIRAVATVAPARINSWNRTWSYGRSRSKAAASKRARRGKRGVEPQLLHFSSVIMEGQHR

SEQ ID NO: 1000868 - protein, 305 aa, Homo sapiens
MNEVVYAVTIVDDTTPVVWVCEAYVGVYDEKPSSKASAIFKTVLAEHVSDDKCYEACIYMKSGLKSKTEGLYTKILPRIIAQDACDAQERHAWKQGLQHVTAQIVPSTRFSTVVSLGTDNSQYGVRWLACVASRGLIGPYLVCEIQAERERTVAPRQAETGSRVKSGLYSDLVIILFVNPIGVFGVPVIRTSRIPSWSGQGGYKPKRGNMRLLISEDLAMFGMTSLPIGQAFVSPCHTSPIRAGPAAREGWACLFERGHLCKSMLLMVGPYRPVGAIAGFGRTMRGLTPIRTPASIDWTFETKTQ

SEQ ID NO: 1000869 - protein, 82 aa, Homo sapiens
TGVVKTIPYTFQLGIGNRLISNTCRLGWITYYSGKSTTTGHLIYKCGGIDKITIEKIVRREAAEYGETGSFKYAWILDKLES

SEQ ID NO: 1000870 - protein, 189 aa, Homo sapiens
MKGCLRNQLVAHRDSIATYWAHVSCSTAEQADGAGLKTLETWCNIETIARFGSGPLENRDDEPVCVETPGVSVQDPSVDSLCGRCSTRDYLNVNPWKREVKVRDVLRDTIEGKNMSFVNDLTGHSGMGRTDSFQRFYSKWQRRDYLLLVMEGTDDGRLLEYDTVTRKVNTVSWTTLRFPNGSPGCLLQK

SEQ ID NO: 1000871 - protein, 69 aa, Homo sapiens
ERLGSSGSVHLSLPKCWDYIDVNHVGPMPKPFTFYWALVMIQTDSALKKVGTYSVCAGPSAYYKLKLAT

SEQ ID NO: 1000872 - protein, 302 aa, Homo sapiens
HLHHHLPTTMGVTAVTTRPLYPTAAPHRKTYPQPSYNQYQTVCPGSGTSTIMNQRYSGPPYYVDYDYVELLRGTHQRWYTYTVASVTQRAHTDEDTIAGPIRHNTSDHDLQRTQSIRGHPRQTYTEGMTDWNGGYNTQEELTQPHTKTNSWTPPPRVHEGRRLPHLAPQSHVREDTKGTLSTQHVGTEHRTKRLHHKWDSDNRHHTTLEHRDTNTDDETSTEDRYTQTQSNNGKTTLQQNTHCNANTLEHTGPLSQVTTSQQPKEGPHKKQNHSNTARRRPHQSQNRKKRHNNSQQIKHNHT

SEQ ID NO: 1000873 - protein, 255 aa, Homo sapiens
VECDINGLRRMLDELTLPGADLEMQIDRLKEDLGYLKNEPRLEEMNALERPWWVDDVNVRDGRCTCAWNHEAAILNEMRDQYEKHGHETELSKDAAVNGSSTEDRGAEPRGGLAIERAGAERAIEEISGGSGCTYGRSLRDLTLLGPRLSMNSIPGEQPGRRPQGQLLAMQLAPVSSDADWHAWQEQSGPAPPCEHGCHAEPGSTRVLLVRARRGLEQEIATLPVVCMEWRGRPTSSVLPVRPLDRQSSRDVTLL

SEQ ID NO: 1000874 - protein, 316 aa, Homo sapiens
RSSAGRQVTQQELHLLTDKWVAAEVHPHPQGGKARDVCSHPRTAAGPLFRAQDEAGQSDLRKQNKVTAKDGLAPALQAPEAALKLPGLLQAPLQGWGASQPGVCGGSLPRQTPTPGCLWEQPDGTRCPGSELPTHPSCDSERPTQPNGHSPEAGRGREGHHFGTFPRYCSLGTGDRGHSLFPRHPGPCLYANKPTSIHICLQATGPFGTRPALFTSCVLEADGHSPLGWQGLNHTVVRTPHTGAGRHTRLQGGGSKAATPAPALVPNADPADRRTRLSAYGMNGIQPGLISQEQPGWPGTPELWCLPVPSVPACPK

SEQ ID NO: 1000875 - protein, 276 aa, Homo sapiens
VAPSVLPIRTETSVKNCGDANNLMFIPSVGPGYIDTSMRPWNNHNTRKRVNGKYYETGLQGVPDSDGREIVSITSFNEGTEGTQIEKVHSQEETHRLYWDYLAHRAPALSLELTLAAGLGHFNRDRRTEQLAHDEGPCNMGREVPECPLTVGVEDATTCGGSSMRYCTTNQSSPGSEVSRWVFLGGPSGMGLCKHRARSSRRVAAEVALLVMGTVRGVARLLEALAPGQLPDPEEHFHVTPSSLEADSRLVQCSGLPSQRTLGRVSGSGLCMNPVP

SEQ ID NO: 1000876 - protein, 69 aa, Homo sapiens
GFAARTAGVVKTSPKSQRLGKERDSYQHCRHGHVGLRASPPATGQLIYISAVDYDEKEPFEEEFEKGGC

SEQ ID NO: 1000877 - protein, 72 aa, Homo sapiens
VIYSTIFAGTLIRSAKARADFLPEYGLEHKHARLMIRSSEPIKEEYRSIATRRLPVKYYPHSNAKPASDNPF

SEQ ID NO: 1000878 - protein, 152 aa, Homo sapiens
MDVFLPFGIDEHATVGPRLSECSNGLVMYVYGVAGADDARAAAHCARPRRSEEQTCDVVRAVIGADAYILFQIIISHCIAPDDIPLRESQEVAPQGGNVQPENIDRQAGTRRNTQRPPHPWTLAYEDRDTPRHTGENKTPHTEETEERERLA

SEQ ID NO: 1000879 - protein, 79 aa, Homo sapiens
AFNGRSPSEGSPSKVWRGTPREESEVSGACCSLDAGRSPVSRRCLPRVGCACGGSRGALRTHGSDCFPDAVKTGHPMAF

SEQ ID NO: 1000880 - protein, 118 aa, Homo sapiens
NLKISARTPRVPHNSSQSKPITEQTPWLLLVLGRLFIWPVCLTGLWGLCSQHQNFLPATFHHSSLPVFWKLSDVPGFAGPAQDMLSIWDFWGFLQFITPMCNSNQTEMEDVNMNYWRC

SEQ ID NO: 1000881 - protein, 110 aa, Homo sapiens
MIYRSNNDNAECPSVFPVKQGSEHAKNYMHAGFILNAEYTLLCSSCVETVITWACYYDLRKKLAPRRSNSTPDNSLMIHIRLEPTVPLICIKVVSFCSTSAVFTSVLSWQ

SEQ ID NO: 1000882 - protein, 275 aa, Homo sapiens
IRLWKYALDMQSEQPGASEPHDLPDSFLSFAELFSYVLQDRAAKGSLGDPDLALRDLMGVLYPKGSGKWNGPCSCPESPGDSAQFTKALVIILQLLYLLSESGVHPQPGSPEAPDSSTACFKCAPEGSRTASSPSAHGCETNGPPQTVGRYPVVLDSPSLHVVKVLLDCGADPDSRYFDNNTPIHIASQNKCPAIMNCRCIEAGAHHVDATNAFNEVTAYRAAWTEECLLTHGVPLQAFNYVTLQCLAGRALDKNKIPYKGFSPGRSGGVHSKLY

SEQ ID NO: 1000883 - protein, 138 aa, Homo sapiens
VVAAAGAQRGCAFFAVGPARMPPPQASPAQSLRLPHRKPEAVIPRHTCPCFAERVAALQVGSPTGSPMISHDKAGMPKTSRLPCTHGESKQSCCCTTKPVWVVSSYLVRADVQMHVYATNIQYQITQSLWLSGQSHNL

SEQ ID NO: 1000884 - protein, 226 aa, Homo sapiens
MAACRVPPHDPCGEERSAGDCASGAFQAWTLSSDAAFGQSSQRRVWLSLVGRFMRTAIVIGEQALAEPSAEAWTVLHSNALILGYWFGRKEGAQGLDTGPWEERSRMGEGRVRIRSEEFVTQCLSGRHCEARYEASQQHAGTGQRSQRGLLVGGPPAFVHGNVQVWGACRSRGVTGNRAGLCPSSPSQAHWTPDLDMICHLSKAFDQSLLGFLATMCPSYRASVPS

SEQ ID NO: 1000885 - protein, 274 aa, Homo sapiens
KKPSGRNHELLKGLRAELKKAQESQKEMKLLLDMYKSAPKEQRDKVLLMADGNARLTAEVDELREPHPGIGGEEIDRESKKIADEDALRCIRQAEEQIEHLQRKLGAIKQEEEALLSEMDCDRSRLLRTCRNRTGRLLQQLRDTDDANLYTLMSERIKANQIHKLSAGLEKGLRFEASRVRGGSSSQVDAQLADLVQKAGTDKGAALPGQPRGVSGDRTLDRCARPSPGDSRKRTGGEKPPSLAEDLKVQRGARARLRLAGDPALLARERAAVR

SEQ ID NO: 1000886 - protein, 192 aa, Homo sapiens
MVLLAALLGVERASSVDVLLLLVIREMSNLYCLAQPITLLLSQDMLLRDCFLLCAGFGNCLVTFGHMPGARPGSPVCPIPEGVKCCCGFHVVHQAVVPKDGVILVSSLSMWAASGLGSGRPARAPYGRFDPLGLGLTGGLPCRWSPCLAPWPACLGRLSGVPERGAGPLVHLVVPPVAGDCECPQSPFLVVP

SEQ ID NO: 1000887 - protein, 97 aa, Homo sapiens
DRTTLLSPRKPAPRPTSGEDGATGAPWGAVCPLRHRPQPAGGQNEATRDPASDSLAGRTRAIEGRGATTLVAFDVRVEVPPRTVMTSESELHVPAVS

SEQ ID NO: 1000888 - protein, 73 aa, Homo sapiens
CTARIRDRDFRESYRHIEVRLSTKNYVNKRAPVDNTTSCNQHETNSGEKCEKIYTNQSVSVVSVNQSCLNKHL

SEQ ID NO: 1000889 - protein, 155 aa, Homo sapiens
MGSTGSSMLRGRCGEQDPDVPEPQAHQEKGGVTECAQSSDTQRRNLIIVVCVGFLVLMVVLGLVRIIPFTAASQGPAGSRASSDPKDPDLFWDDSALTIIVNPMESYQNRQSCVTGGFGGQQEDEDSSDSEVADFPQQRRKTHHRDPPTRIRLHL

SEQ ID NO: 1000890 - protein, 220 aa, Homo sapiens
LVRSDFGIEPLQPPGCRSRSPAVEAASRRPGSPAALCAPYDPCVALRGLPQAAPCVKVTFNSLLWPRRRPRRTMPKSGEEALIISPDAVTVDCKDPDDVVPVGQRRAWCRCMCFGLAFMLARCHSRRSILVQIFSHFNQMTLYYCGLPYITDDVILPEPSADAPAALYQTNLTDNIFKSLKGQKTLTLISRCACPRARPIVILPTYVHERTTNDNLTDLL

SEQ ID NO: 1000891 - protein, 261 aa, Homo sapiens
MGPNIYPWERSEELYLKPKPENNLDDGPHTVVDPYERCCRCGKHCGPRWRVSTSFLVEDGHHHHLRALTHNMRVMKFSVSPVVRDGRGGQRTPADLTQAGGGAEAGMANAPSPWLQMHHRGARRRRTLIRSGARPKTCNLRRFCPDTGPLAPTAPPHCHSHQSNDNLDTRLRIFRFTRQQNRAPVQTMISNHACIPGPILPKVPANQHPGRSETRAPCIAQLQQTGTTRPPVSRSATDAIGTRVRRNQFPTLHTSHFKRAV

SEQ ID NO: 1000892 - protein, 107 aa, Homo sapiens
ALKIYGFVVRTGIVPKRQRQLVAGGPTGVRRARRRSSGHCVTLSVVGEDESSSLCRPQGWNCIAAISRLTVNPSSSRRLRAHSPWPHASRVGLRLHGMHPTRPANLM

SEQ ID NO: 1000893 - protein, 115 aa, Homo sapiens
MRPGVSWSPIPLRVAHRTALEVHYICSSYVLRAASPLFKYCAPEMSSPQSVCAPILQRGDNPAHQCETVVSAPMKRTPHPGRPNKTKRLFPPMYNRGRSFSLTQRRGRPFQNSVP

SEQ ID NO: 1000894 - protein, 188 aa, Homo sapiens
MEPVGSGTLSSAGSPGGWTLNHLSGPGGLIRRDLTLIDAVLCLRLSKVSMDLSHWSVIDFVDLLERQCVTHMPYRRDVDHYKALANSRVYDYGKVHVTALTRGIASRGVMNKPGDFLEAFTQGSKTLGQSSNTSLKIRGFRSTDAPRPGPPAQPCARTLVKALPTFCMSCTRRGCLIHLVNFTYEQRL

SEQ ID NO: 1000895 - protein, 275 aa, Homo sapiens
YPGFIKIFPDITSEENKSNLPTAHPQNCDNQINHFGTKIGIIRGVAGHRFLGNMKSLPPFWQRADMETIFARGILVGQWNEPCPDHGPTPGMSGHAANWTWAGSKEKVNFQEEPTRGTLRGQSFSVLERCVCKIIACVYMPHASGYLQVNTAWRKATYNTNELIYISGATQARVTGGVGGTPTGQTREAPSTPLDIRNGLKHPRSPNQERNKKNQCQQHQRKTCNSQRARGPDQQFQRRITPTKQQDTQSAQRQNTIEPGTTDRPTTATNHRRGT

SEQ ID NO: 1000896 - protein, 151 aa, Homo sapiens
MSLRGQNLLRGGRTVSSPTWGSPTIVVFDVSGGAGKQAPRLIHSGWGNGEGKRGLTVPVAIVIAHVSRHDALKVCARWVVPIIKHDRFLCYAYLRHQGGNPGRIEVSYDMSISEHFYLRAEKIDSILNGLRDGASTVVALFTSSQSPDKMT

SEQ ID NO: 1000897 - protein, 83 aa, Homo sapiens
TASAPASTEASSLCRYLHVPSTSRRAASPWYDDISPGITSCDNWLPGQCARVQAVEVGEQNVATPEAYYSHNQFRSGVVPKCH

SEQ ID NO: 1000898 - protein, 140 aa, Homo sapiens
VKQNQLSYRRNSKKQQAAGLRCIVRLSALAEYNIVYEVKNINNNKKPALPKPIHWDGCSLWGWGQSSEFLKTCLGDCLCSGCCNKSSQAAGLKPRGSSPHCSGGWNLPSASEDGAGRALFLAVGDAFTLCTPRGLPWPLW

SEQ ID NO: 1000899 - protein, 226 aa, Homo sapiens
CCSLLFPVVCVLRSCSFVVVRSFSGCVFCLLLFLDVAWVVRRFLVVVVLFVCAWFVFVVARFLFVVFVCVLCFVSFLLGVVPFYLVSWLVFWCVSRCFESRVSYCCLLLALGGVASLVGLCSPWCGLCSSLFAGYFGFHPFLGSCGFPWCLRFLLGPLVARGVLVCLCQDLLRPLCTSDMYYDALIFALLGPCTRLVLALCLVFVRPAVRGVMDIDWDYCGTNACD

SEQ ID NO: 1000900 - protein, 156 aa, Homo sapiens
RRQWRGGKRSSKSDAVFCVPGAAVPTFRCRTHAGLGKGPSSCSADGRPIEKINRNARGALGPGPGALFGPSRRGKPPATGGGPLAARGFLKPTSLFHPWGQNATGLDRWPFNQMGGKRPCGPLNLGAKGPMGGFGGHFFSAYRGFPKTGNRGPLPP

SEQ ID NO: 1000901 - protein, 227 aa, Homo sapiens
MSVTQAAKCDRKSMCTKPVGADMDYKFGYKLIQDYMKQGAGSIRMSLDDYVAQKARLVPYTTAGQKSCISMTLHDKEGAEKVADEVAQHNSGTISHELVDHMHSIGDTEYEDADCTPCFASATAVGCRTLRRTQEQRMAHKTEYLACEPRGTQLPDEWIRHPRKCSQTCPWAHRDIDGTTRRDPREQRWLEGDRLSGGNHENRQEAPERAQTQEDIRDCLVKKPNKH

SEQ ID NO: 1000902 - protein, 294 aa, Homo sapiens
MCKTDSRPRGPADRTWLLPCARFGRALPRAGTHLQGCGLTPCGWTRQRAFPPRTEARCPFGSSPCALLSQLRGPVGRPGPFLHRAPSSLWPPPEGLTRRLCGQVLLSWKRPILSRLCAREGCVGCPHIPAVFHLQCVKFRGLTCSVQPTGAPQVLAVRDMFRRIICGSQLLIPPSWSGCEPGYIKKLLPVWPLFPLCGWVRTWTCLGLPPGGPAQVALSQSVSQVNKLPLCTILLTPQRVPTRGKSFSSKSVSGSCSLLLRGDIYKGALQIPKTERANLGGCVPPLKSPARQGL

SEQ ID NO: 1000903 - protein, 141 aa, Homo sapiens
GVVAPAPSLYAPWNQQVPDKETEEEVMGTQPPVVAGFTIPMLGYTVRVLTVSLVLLLDWAMAFILCPLTCPGECEGSTGKLECCLCLPSQWAVLTAAPHPYRWSQEAGRVGEGKIGKTGRPRPRQNSLSSLHFWSPVVMCL

SEQ ID NO: 1000904 - protein, 410 aa, Homo sapiens
PPARLHLKPRDSSLLVNQRPVLSLVPANGRCARAASGSAAPPRTPPKVSPRLAGRMGRASCRGDCAAGLESNNGAGSVLMDVCWWPVVEAAGSHIPAQVERSDNYGDDHRIYLIQADCVIGGSVGGEGQTLVYMLPDLLQRIAMQVQLLSSLRTSTTCVLLSTYGASKSIECAMEAHTKHARVMGNNKGRVLEKLVHTHRIHQTGAVGYTSALPLGANRMPGVMTDTIHRYMTTRRFLREKIPGNLGVHANFVDVRSRHPLSGPVRKYAVEYSRAGPKVVDIAREVDVCLHPRFDTQAYLGRNNQKGMAYLCDTAWEAFAIDCGSETRTHSVSEGAKARSIREVKDICAVYPQETLGDPHKEGSTRRPQGSGAVKANPRNRAKRNRGNGERSSKCGSQRKPPPGNTSWRW

SEQ ID NO: 1000905 - protein, 108 aa, Homo sapiens
LLAIGYEEEACSPMWKLKGLVSSDLIQDKLKQSMPLWGIGVNHLTGTCLAQNGERIRVLLGRSHCRAVLKAIAVHRYHYGVLSATLAQFDPVTKSGHSSQSRCSSALG

SEQ ID NO: 1000906 - protein, 130 aa, Homo sapiens
ALCCMSRGVKTTVHPRQFLVWTSEIVLVSFYFGRIMHESFTFDRESCTCVATEPPARHHMYGKMKAPKGLTSRAQRLRWSQLQPLLTNTVFSLKATKVYQFTDEDTIVNTPQTHDVHALTISSHCQTVDF

SEQ ID NO: 1000907 - protein, 112 aa, Homo sapiens
MKIHPRANETYRPPAVSPRCLLYGTPCYYVWRLLIRHFNALHALTEKGFNSPKSSQGWRPVVVHLYSSPWGTVRFTLSGDYPGGYSLDPLEMIWSVVREGAQSIIGVMYILI

SEQ ID NO: 1000908 - protein, 327 aa, Homo sapiens
MAACEDWPTPVNTSMRAATRRLSLCWETGGACQKGSCYWAMATGLFRQQSTKGWTTLVDHIIRSSDLCGHEMIQCPPSLPCEPFIASNSLPHAQAVLPHVHFSVSRAICRIRSVCGVGNQPKTARTEMAWLAKGPLYSDQRPPEVYPRLYTYDSIQYPRQQNPYTRRVPDVSIQQGVVTNESHPMCVRGLERKPSTPMTEAFGATSQSTPISNPENFAIDTHLRQIYLTRILVGYSISCFKEIDCHSSALRNAVNSLVPLWLRKYSISPSKFGSYSPKRNKKSRQYRNLVTPIARTHEFSRWGIGTKVACKPPGTHKGMAGKAEPCV

SEQ ID NO: 1000909 - protein, 233 aa, Homo sapiens
GLRRPMNFGWQHRRHAFTPRIFPRCFHIGPDKRPKVGFAHVLHTTLGIWIAPAMTVFLGNDERLKACPPFLGFSRAHWPFPRFQTRSVPRHCPPHLPLRENVDPHLPSTLPATEEWQHSHIAANRRGISRGRPPLRTHLPALMSGLTHIGGNTVLSKRDRGDSHNPTAVARDSPITLSRFFLALLACCLWGMTECGDIHAFPLWKVGGVLDTGSQTEENQSFVPVSLSPREKH

SEQ ID NO: 1000910 - protein, 320 aa, Homo sapiens
VAHRIHKPFERPFYCGPRRPQIYELVAQTVVGAEKLVVLSSLRTAGSLKVPCALPLALSPGPARAAPENPSSAALRTAMVAERRLQLMPGPRESSVTSGPSADQAPRASSLPRPFGKWLYPEAAFMLSGRRKTMGRGLHREWGNGVPRRPATPSPARTQEIQENLLSLEETMKQLEELGGGTFAAWDPSFVSAIGGNICTPSLASTLRFPTQEEPMLQEGERMGREDVRDHPHRHSCTAASHTPRAVDGEGAVGHDMGEGPDSGLLAPVIDDLVPSLHSCPLTWGISGLHSGGHHADPGHLRYCLWGHPSTPYPECLRSD

SEQ ID NO: 1000911 - protein, 234 aa, Homo sapiens
VGRGGRGTRAAICPYPLVLSVKPMAPLFPRELVSLLPAVNGPTSILANPLPLLYAAPSPGSLVTFVYVTIVRLSRGREERKERDQSCPKEGKRSSYEEGQKQGRQRSSYLNYTVGMERSWGQALNIVRTLRICTGEKVQGEQEEEPGGPEADERDGVIRGPGLSEAATRALEVLLGGGGMQPDVPLPSSTPAPAWSCLFIPLPHDRRSLWPMALSSCSCVPCMYPTIHPFLLPA

SEQ ID NO: 1000912 - protein, 91 aa, Homo sapiens
MIEQHRNWPRSWWLIACNPSIFGKAKDGQIMRSGDLRPSWLTSVNPIFTTYAPKIIGARSVGICSPSYFARLRQENSKNPGEYAGSELRGP

SEQ ID NO: 1000913 - protein, 290 aa, Homo sapiens
QGRGSGALGLNVAPTLCSVWPLCCTEEKWPCEVQSVQAMTRALWQVSANSLGEGHAVGCAVVSGLQCVLLWVTHEKPSGEQCPLVKPVPPYKRLDVWANGHEPSLRWHRWPELRHKLEALDYCLTPGRHRALTLACRAPRVPRTSRELPCQKGHHMGHRSCKLSGAGRALPWLLRARGVRATGGRQEGHQVQEGNTDSDADGTPDNDQAAQINPWAENKEQEATGRQTKKTTQRKDTRHTLAPKQTQYAEIGATSTECTRGRRKARRNTTREQVATHRESSTPTHKRHSD

SEQ ID NO: 1000914 - protein, 287 aa, Homo sapiens
GVREKPMSSIVSRRHPVRLLVRECPARGTSASAAEFLDDGGRCISVLKNYDPQKDKRFSGTVRLNVSLPALMFSVSCPCGGLMLATVTDGKGRGYPPTCDILMAAEENSTMNNTNWSNECWPMKYDAFNGLRVSDQADSTESSAQVYNEGQEQFPSLLTHNENTGGQQWMRRSPQLKFQMKKVLCLACSLLGHVHDDRRVKLVEYTFTWHVNAPLDVHCSTKNWQNDPADLSIIKKHPWCNRAPRRRTLQGDTCTNSYYVTTDNKAHAPEPLRGTQKKACRKPELAH

SEQ ID NO: 1000915 - protein, 58 aa, Homo sapiens
MVACSFRQLNRWIYAREDPQSIQRAWVEGKSGPVYGAWSHAAGVLLRTCPDPAPLLSA

SEQ ID NO: 1000916 - protein, 175 aa, Homo sapiens
MRNTLTVQYTTRQENEKTDNDEVSTRNSEGKRSSPEPTTRETNHGNTARANNESHTTKTGGDNHTPLTQRGRATTKQASRGEVTTPRNNIDRHRRSSEQQARKEKRHRHNGAEVERERTRNAGKREERTTAQNDTGRAAQRPATSQKEEESADNEEEKADAAQGEGKRDHKRKDR

SEQ ID NO: 1000917 - protein, 37 aa, Homo sapiens
MKEERRKQQGRKKYDHTLRERTKNWYQKRTTDGERDR

SEQ ID NO: 1000918 - protein, 231 aa, Homo sapiens
MQLPEQGLGLLACNKRHIETHTENTTGLLGWELRLPDGSHDLPSDPRRVGPGTLVRGARYAGSGNVTREPTLGNAIPRGGPSEERQGHNAQTREGTAQRGPQKRSRSEDDKAQKNNHYRTGTQNDDRTETKLAHYVKEAPPNGHKITQEHWRAIASAPQRNGELRGRGKNPPAGDKARPRRNKHGLRKHPEENDEWTPRTAQPPKTQRGNNRRTGQRLPPTDIHANLREKY

SEQ ID NO: 1000919 - protein, 141 aa, Homo sapiens
MSDNKTELGQIRPSAVSLIHTEQTRMAGTRDTGARGYHRRAAQNGHRHKEAQLVGRTKGTFRCGRKRGRHSVGRARKSPRRAVTENLGRIGQPWERPELEKGRTPNIRETGTRKDTHGEASAAKGAQALLKLQHAHMGEKR

SEQ ID NO: 1000920 - protein, 322 aa, Homo sapiens
MHHIVSLTVGGEAPYLPGVTGPGPTPGLPIDPMRRGVEQVRTLFTRTWETKEEPRDLERRNRGPERASPDNHTWTPEGSKCRKTDPQSDTTQKECLIHTQKREEEQSLDRAETTTSTETMCNQHTEDKAHPQGGKAAAHTIKKQQGQKKETEKKEQRKELKQTETNTTHVSRQVETNIGERNLTNRNPQRENKKWGDPPQSNPTDTNDAGKEDSEKKTSKQQTTQTPHTRTHKAKQQARRDKRSTPKADNIRDGTHNKKTDQPSSTKQTKATPIEATHAHDRSTRERGDTTFLRTTTTHRRKTPHTNEQKRTTSRNRAKAEK

SEQ ID NO: 1000921 - protein, 256 aa, Homo sapiens
TDSERTHHGAVSCRQDQGQGLTGVRSVRTLASMVRTPCERMFLSFPSTRPTSRHFDLRRRAHAQVKWLDWRSKVAQSRLLMLTPVKGTVARRCPNCSCPGPWAELHGVTKLRVDPVNFNAPKPLTAGDPGRRLPAEFTPAVHAFPGQQFLGSVSTVLDLRNIVNAGAVAWLCFVAAFWVVRPVGLYPTLAIAMTVTSGVDRVVHTQFLMLATGNEGGYWTITTKMPIRAVMDLGWPGSLTDLLMNISTERGKWFQH

SEQ ID NO: 1000922 - protein, 204 aa, Homo sapiens
MKSLEEEFEEEDAESLRKKHEEEDEEEDISIWKSWKTWSWAHAGGEVEEGPPPPPTLPPALPPPESPPKVQQNREPEPGLLLERGGARDGGGAWGRNSSYLALKRSPPRERWRGKGQAYGRAPPQEFVKKTPLLPTNPVEEETEDGSDEGSPHQRHLQKKRWRQRQSAKLYQEKAQDDTAAMLTKLHTSVPLMMRSHNPTEPTH

SEQ ID NO: 1000923 - protein, 90 aa, Homo sapiens
MGKDSQRRERQPTGGPQPTEATSQHVHTGDTTRMRDTTHKTGQRKGITTREGNRAGRKYNTGEVREKRQHKANVEHKLRSERNHDKKEKT

SEQ ID NO: 1000924 - protein, 251 aa, Homo sapiens
GPRDWQLHCGARSDYEDTKQRTGHHGSSSSSCAWCFSALRGPPFTGTHPREMKKRDQRTILCRMHTVGTAQTRPEGTLALISTGPLAFQLGPQTENIFILPMCSDLLMSLGHALPVGTGSSYQKNAMDLWNGTVGPSTIQKSSRRSELHRGFQQTPSGTQTSPEMAIQHEPRNDLFNELVVDLLDYLIVSAMKTLYLADTFPTNFRDSAGAMKQINDSVAKQTKGKIVDLLYATLDSTADVIMVNTIFFKS

SEQ ID NO: 1000925 - protein, 332 aa, Homo sapiens
PPPTKTDGSVTLDNGIIRVKLDPTGRLTSLVLDGLWQEAIAEGAVGNQFVLFDDVPLYWDAWDVMDYHLETRKPVLGQAGTPGSGGTEGGPCRGQGMGPGYRSAHNRSAIAQERIVRETLGDPICPDSTTEVHWHEDHKFLKVEFPASRAEFPGPPMRSSLGTCSDLPTTIPLGNWARFEVWDHRWMDLSEHGFGLALLNDCQVWSVSARTDPQNSRLLPGSLKAPDATADTGRHEYTYALMPEQGLLTGCWRYPSCYSINSPVDLTGPDPEASKLMEGNKPRDYNQRTEMETGKKGGSRPQDRTRTGADESPGDSEQGDMRAVQSNWDQGK

SEQ ID NO: 1000926 - protein, 112 aa, Homo sapiens
MVGTVGSQLLGRLRRENRLSTGGGSCSEQGSCHCTPAWRGAKLCLRKYEYYIQNKRKLQAREVHTKQTKKHVRSHIITKCLKSSDKYKMPKAANESRHITFGKTDMKITAYF

SEQ ID NO: 1000927 - protein, 307 aa, Homo sapiens
AWIQAEGARLRVSRLVGERGGPHKIQIPSARLVPQVTERTSISSPCTVPHTYEGDPPTKLLQRRMLRYSDTIPVQSCVWSRERGVVWWSAPDPRELHVCTLAVAVNRTVAHHFPRLLYFTGQQGGPGSSREQVVSHGDERPAWLMSETLTPPSHNFGADYDWFFIMQDDTYVQAPDLAALAGHLSINQDLYLAVAERVHMDAGEQAQVHVMGALDYLLSPESPASSAGTSGWLPRETFSVARPDEWLGRCLIDSLRRRLMYHRPRAAVSAHLELGNNRDPEKERSSDFLSAFAVNPVLEGYLMYRFP

SEQ ID NO: 1000928 - protein, 264 aa, Homo sapiens
GPRTHQFRTHWDYRREPPHPAFFSGGGGDRTSCLYSPRPGTCPLAPHSGASPCHILLPSRAVPTQHCLPAPRALRATTPRAPTTRYYCPPPPPGASASPRLLPPASHAPRALLHPTCLSAPPTLGVLTQHPPSENPSSQASHETNHLHGTTYTHKHACHPRQTQHPSHLEATKPTAATPTAPTTPHKQHTTRFREHQTTPPRTPNTHMADQGGRRQPPVNRAHTHQAPPLTAPTTSRNPRPTARMDNTPRPSHKPPPHNTGPAP

SEQ ID NO: 1000929 - protein, 165 aa, Homo sapiens
FSELGSRNAKELAFRDSWVFVRGQEVCSNKSPFEQHVEELVSTSNRGTKGWPEALEHGQAGIPAAEVTASYHGQCHGPGRGSAMTKGGTLRLPERTEAEAHTPEPGQERSLWPNTSGLRGSDQNVVSRWLEGYRGACKEGNQQNAAYDNGKHQRYPEFLFVTLIP

SEQ ID NO: 1000930 - protein, 136 aa, Homo sapiens
MERTAACVSWVYLLKPDGEHSVGTEHGLGQSTANTFWVNGCASYLSRTLEAFENSKYTNARGLRHPLRGKQYRASVPLHYPFNAATIAGDTYMVRVWNNPLSQTTTIMWLETPYFCNFREGVDPAELANGSIKVLK

SEQ ID NO: 1000931 - protein, 128 aa, Homo sapiens
LQVLSVRTGWMTKLPAMALSLELPSLMDTWVLEAVACSHLHPRSAGPLPVDVSVRVVVGEPTEVQVVPGRGICSGSSPSCDSAFLLSPGGPDPCLWAPMYQLSQYCHCLYGVCRDAWVWSAILTLLHR

SEQ ID NO: 1000932 - protein, 135 aa, Homo sapiens
GRCGPGPSQPWETLRLTVGREYSTAVVVRLQARCRARERMLREARGRLKAPWYNWDAVAFLTSRQTWHIPCQAAKKALSWIPATSAADAGVQSEQRASWLAACCSLLHDTTRCSHVVVPWARSETGTACGVTRSW

SEQ ID NO: 1000933 - protein, 60 aa, Homo sapiens
MTSEEAHVRPSSQNTITTQERQEERYRTPRTRKQNHGPKPTKEQRTRRNRTPHQEHKTNQ

SEQ ID NO: 1000934 - protein, 308 aa, Homo sapiens
MMMSVIRVRPRVYDLVTHDPDCCDMTLSDQGATDGEPRRIEGSGRYENTSNYPPAEEQEYHECAMMFSGRIEMASGPECIPMAMRGRAFGLDTQTEWTKKLTGRVPERYGCLHVWLKLLYLKTRCWPNMASRAGKGTRDVRPKATTGDTTQQVQTHLRPFDSTTQCQNVREKANTKFRSQKHIEHSSIHHDGAVKTRRSRNNPAGIGATKEANVNHIGIGHHKTTECLCRVDLLATLSTPIDNPEQEHRRNYMAPNIGPQFRPKRRDKVHLDNRSPQSSADTFCGRITQHQRMYLRQTYLRKFTLAGP

SEQ ID NO: 1000935 - protein, 375 aa, Homo sapiens
VRVACRGGVRPGGPCGGLPLPVLVFFVVASAAVIVGVALSVAVGLLCAALLAGCLGGGAVCSFWDVSFGGAGRLAFACGSVALSEAVRVSSSRARRAVGCFLCRGVFPLRRCPGLRVGRGAGCLSSLRSLPVLCRGPSSVFAFPALCRGLGLVVLSVVVIVRAVPALRLLPVVLVRGSSSCALLRRFASHCLRFSHPSASWGCYLGPPQRCHLCVSRSPVSSLVLLGAWVMCVALPLVVWVSLEAVVVGPLGVDALFCHSVVNVVRRGGAGVSPCGTRVAVGPGSAVVLASCDSACRAGSCRVPAPSFLIRPVQYYGASGVHLIASLFRGLLALGSFMGCVQRVDDCTVTARPSGGLILLLHSLSVAMLEVWPGV

SEQ ID NO: 1000936 - protein, 136 aa, Homo sapiens
TAATARGAAARRQHILRAAVVARIVERQYASCALIAEAMRLSRKAVKRPPNWPTPYSKTTKDTAQCKQGIANAQQPADEARLGASRSVRNGTRALSEEETDVDANSAYRSPSPEPCKQLRGFGGTYRILQTHRWYE

SEQ ID NO: 1000937 - protein, 265 aa, Homo sapiens
MLDTGRGTNVASAGFELFCCAPLGPRGAMSRPANLSFVVSLLCVLVRSEHGCNEGQPGGTLANPSLGLLRGRVNVRELAERPILPEYAMIIARCIGVTQSAQGTLAEWPVAAESEQGENAQATRTKPNYARRSALEIARHRRDVPQGQGELATANARGITPMERRNRASQLVSQGCFRAYLAQSLLSTHAGITAVPLCEGAGEMGIRSGNVGMEPTSHCIDGVRPSGALPEREPPVLLPTNDSEAAERRVTVEEQLSSTGRELIG

SEQ ID NO: 1000938 - protein, 229 aa, Homo sapiens
MEVSHRPLGLCSFRPIRLWDGASNGRRNEWYDDVSDLMVMPCDVPNNAYVRYTDVVIILHHHLADNWLTFWRSLWNRMKAHVNHHTEAPCPAHVRSTENRSLTSVTVYQILARRSKIGEGPIMGHKVDCRNQQETHRRLEEPESLATGVGTLSQHMERREGSHRPPTESPATVRESSGEIGLVRCGQTEILISHWILPLGDAVSVPARSLGPHSTRPRQLRKLGKKERN

SEQ ID NO: 1000939 - protein, 100 aa, Homo sapiens
HHFLKMFFQFVLTVVKELGVSVRTRVLSLVMGIGILSEYSPWRNPSGCKPGCLLAELIGRSAFAQGRVRYYGKVYMRCHWYVSMLGHTAWAQDTLSCIMS

SEQ ID NO: 1000940 - protein, 147 aa, Homo sapiens
MVCEVCVAEDWLFAVGMIEEDSDERWGGTRLGLPSDSAWTWSGTEDDTWTWKIEMDSNTFPTTSLHGKGVANRVHLSFDEKHDVISLQVTDKMFQADEEKCFRLCLYLAGLSGLAALDVELVWSFLEVGLSGGARGAFWDVKGTVSA

SEQ ID NO: 1000941 - protein, 179 aa, Homo sapiens
GIAFQGLCSNTQPRPTVAGTQQSTFLIGLANPLSEVSAKKTPRPGLQAGTAWGYLHHTTHWYLAGPPAGFYMPRVSLTDLSAWADLRIAHRSISQDPKIKYPKENTRWDLYVPLYGRVTGICGISLSIVTEGRNRWHLSDGRTRMYMVKRTHGMEQVATIVGSTLNKVCHGPGVGGSRL

SEQ ID NO: 1000942 - protein, 238 aa, Homo sapiens
SETLPYSCPVFTPARTPQVSLFSPALWKYATAYSPPCRRGNEILIQRRERLYSTMRKALRTLLCLPSLVWVEKCTTVYVALCSALTGTYHRPRDMRYNCSPNAPRMWPKVLGPRRALGTRTTDNADMARDNATVHSRLYRDQDTPRPWPIQALAESVADTDNYGRDKWMYEPTQDRCHKTELFDNRAPGDMMATLSPGARRTAVPDEMLRDAGFFGNKTSTKTDLGKISYFKARRYPI

SEQ ID NO: 1000943 - protein, 74 aa, Homo sapiens
CGFGSGPVWANMSGEAPLSATDFSSLIGPVCVATSHYLVYIRVRAYRLVVVLLYKPQGRVGGLSPVVVIELQMS

SEQ ID NO: 1000944 - protein, 133 aa, Homo sapiens
GSYLASWLPCFAVRFYKGGDSTRSLAPAHFFLIFGSCASQYFAAVLCDSRGHMVLGRLRRAGAFATVVIAERLCYLSLVVQSLFVGLLCICLMPLSPQWFDQGAIVGTAHDHVLVSHLQRQPVLVTLPDELQA

SEQ ID NO: 1000945 - protein, 323 aa, Homo sapiens
GGGRGECPEAQAGPVQPCPRGEAGAPDHRRAACRRPRLRHPRRPCSARMEFSGQDQEGGVKRQHAMQTKRSQAPAVEWRLQGRSYNRSVEDHTEPALSGSRGGECTRQKEARSMERQLALPAHGAGRHPGVHIPRSCAEGAAGGVGMVRGSQARARAPERWGVPRSVPRTRHAVATTEKKTEQTAAAGEGLCTGLRVTAGRVMRAARLRHQELFRLRRIKAQVAEAGGAARRRRRRQARRDAEATQAPEGWRRLKYQAPDITAAELGAARLAIRTRSPRATSFETGFKSFQRRNMIEPRESAKFKRKYKGSSWRTRQTYALHV

SEQ ID NO: 1000946 - protein, 131 aa, Homo sapiens
SCCPRVVSPFGLQLMVLRVKAVGVNQMSLSARICVDPAVRRVPDPFPFTALCDTLVCRRGAKPCRVALPFSAGVVGRTPRGLSFRRPCFPLVVRRFVVDISPRGGHGVRSGPCISTSIKVHGKYIPLQYMP

SEQ ID NO: 1000947 - protein, 88 aa, Homo sapiens
VPGISWLKVLDVCLCVSSSFLLSEALGALALFQDVLSYLVRYLMTLVPLLGPVVDDLGVSLFPVIVDHLCSSHTLHTDSKMLVEMLHM

SEQ ID NO: 1000948 - protein, 210 aa, Homo sapiens
FGSVWVPLGPFLLLLRWSLGFSFASLVSGVFIVCSLAVLFSLGSLLVICGVLVRCIVVGAFGPLVLLLGFLCVAVVLFFVCLSCVCFVLVVLLLYGPLSVVCVGRLSMSRGMRLVLVCGAVRYWFFVLGVFPQMLLFCDFVRGASARVSVGCGARSSLLLIAVCARLCRVAALWSSWALSAICWVFLCEVCGCVQARSGRAGSWRLGGGF

SEQ ID NO: 1000949 - protein, 204 aa, Homo sapiens
MGIAGPIPSVSDLHEPVGYLQCLKWLYGFLPLDNIAFSYTEDIMEARNRSCLRDSFLNGKLGHYVIAKKQGSVTVSSVGSISDLLPSSSVVVDPDISVMQPPPGDTPSPPFESATDSHTLTAPLAPTIPLNCADATVTPSQAQHDLLKSSLLALNTTSEESPQNVWIHSSIRPHHRPPSYTDTVCVLCVCVCLCVCLDRAGTSP

SEQ ID NO: 1000950 - protein, 147 aa, Homo sapiens
LACQRTELLLGCPRCSHSHCGLVHPMGRICIWLYAVPSSPHHEPIPLQDPSITGVSSMHWWHHSEDMLNGMPSGSATIRPMLAGTEYPLSYVDVTSRGVCKVTTVLSPLAYMYVVHRYLSRCALSVRDAPWTSQHARENGSLTMKQL

SEQ ID NO: 1000951 - protein, 146 aa, Homo sapiens
AGASSFVVYYPLWCLLSSCVLMWDVLCLVFSGCLFFLSSFFLGSGPFIGAFLCRIRAWSFLDSSLVVGRALVVVLCLGVSSVLSFLVFPSAVRTVNLLLVPLCVMPCGFARVWRNPIDRLCALSGCLCVQVSLGPCNSGICYTFFS

SEQ ID NO: 1000952 - protein, 183 aa, Homo sapiens
DKNYAYERPVLPHLGACDLVLGAPLLDRNHLHGGQLPFMSWGRCPCVGPILVRVPSGISCVCMYVVGSLWVKFDKAASIPAVNGVYTVRISLLCEKRGWSAAIQLFTHVTVHLNPFLNPFDATTADYKPDEILEGSDPIMIRKGVRISEVDNQSYASGERNKSSRLFNDANHGPNKGISVCVT

SEQ ID NO: 1000953 - protein, 126 aa, Homo sapiens
MNSLLEHSEFDILVYLGVDLGPGHATVLQALWAYTSGRSTVKSLDCKWPLYLGSLRRTFLDSVCSLDPFRGSAILWLPASSEVDPCQLYELIGTAILSLTDRKSRVYSEALSTGLSVIARICGKSC

SEQ ID NO: 1000954 - protein, 155 aa, Homo sapiens
LRGSWLAVSVLDWGGFVVASRVWPFVGSPCSSWSPVCLYFLLCLRCSCIPFFSGYPLWVTFGCVPWFPVLGCAPGDVPHAFALRVHPLVPVFLSLGCSDEALYVFSWPWGPSSLLVPCVLCVSSLLLLLVSVAVEVYPSGVIGTGPSPRVQGEER

SEQ ID NO: 1000955 - protein, 107 aa, Homo sapiens
MFLTPLMELPGFYTAIKGCLFCCVELHSCASAISGSASSVFNTVCSLVIMCNVGSLFSEDRLEDTLEMPFHAAIPVAPSMVIFGCLVYTGYSINSGILLGKSLLHPI

SEQ ID NO: 1000956 - protein, 195 aa, Homo sapiens
MSDLFYKLVMRRKWMEGRVLLPASGSGTSVILVLPVFFLYLSLRGSGWNQRFPTIHPHLTPCSLQASLGKDLGLVEGSLEEPLPVCQTPSLLCRHRSSHRQTEDEDDLGILGGSMTPSPPDPDLGAVAHRHGHSQDQAAQTCFPGRGVRNQHCVETSFKERKAGLRPTQLGRGLTVCLYFMGGRLHPAYAAVFFS

SEQ ID NO: 1000957 - protein, 105 aa, Homo sapiens
LPVSGRWVGPRPLVPRCTVYYCTETVVNFEVVWALGTLCCMWLLLPLGPYGPYMVFTQWAKLGLAYGVVLRVENDLAYMCIDPSCIGFCVYTIRCNHAPIGRVAL

SEQ ID NO: 1000958 - protein, 69 aa, Homo sapiens
CRRVLLCVLFFACVPFLVVFCSWNPFAFSLVVLLLSVCSLVREPFWVLLSVFCMLAFLCVSFWDVLAVP

SEQ ID NO: 1000959 - protein, 208 aa, Homo sapiens
ASPSEPSLVKMTSSTPRNGSSRPTLRVTQEKHGETRKDRALPGSQKERVRETQPPGRAKTGPNEQREHLVMPEGRGANCAETGLSLGTASRGPDAPTRTTNDFEEPKGSHRTPPFLVLYLPMTKTMKESSPDAAFSGAAHHPLHTSSSSMLLFLAIFITPSRTMLDHEAGEALQLRTLLTCRRDRGVPSQHGTGLHSYRPARELLQTS

SEQ ID NO: 1000960 - protein, 150 aa, Homo sapiens
MLARLVSELVTSDVPLLLGLPKLLGITGVSHRARPGYCLIKVVFMILDNAPGHPEPHELLTPLVVKWPYVTPQTQHVPDSAYRSSCHKDLLQAQLAHGTLWIRMVNPMEENPIMKVWKDYTTEDIHRCYRKSCESHLNLKQIPTGEYCIQ

SEQ ID NO: 1000961 - protein, 233 aa, Homo sapiens
MRSDTGITTLRTCTLAALGSCHVSTKMTVFLPRTLCLPKYPMALLHGVITSEPQPQSHDEDSVARPPHALGEQQDAKLEGFRSSSELVNLPSEHWRGGHGPVDSRDSAVDPLSVGSKPVGSPCCKPMKHGPQHALTPVLGHEGHSAEVKHLGRGLGMSFHVPSAGVPAVRPAFMLLFGSFVHEPAQLEETRAPLPHASRLLPTCLSTSPPRHLKQCAPAQGRRPTALNREVPL

SEQ ID NO: 1000962 - protein, 367 aa, Homo sapiens
LFVRCLPLLSPTVVVFRCVSLISVVSPWFPACTLVRFFSYFPYRQSGSPAIRCHFVSASSMFAGFSCWSSDSPQACGVSRRVFSFLPVVVLGSQSSLASFLLVSVIQLVFSSLSQRLLAYLSAKPRVYPGLPFVPYGIRGRGSLVVCFTFRHPKLNPAQVFLPPFNTVVVQYCSVSLSLLTCSYPLMENLCSFPASKSPLGSLPQPHLLIPVRLGSSSPPAGAPHWDSCHSPVGPYVASSMDRIARGSLFRPCLDVYPPVECALGITSVLPHHSTVTLPAHCPNVLPWQPHIVQRPFLVGRYSTSTTSTQAVTARGPEAREGSGGSGTRPYTEGPVGGPGPAVYANVMSSSMFSPNIPLDVNYLYKA

SEQ ID NO: 1000963 - protein, 69 aa, Homo sapiens
RVELWFHDSAKVSLLRMLLMCKNRGLSAVYPVILDVQSMRDTHEAQSLQVSAMAKLWETRVSNVILGYT

SEQ ID NO: 1000964 - protein, 71 aa, Homo sapiens
SLFSLLFYVCLFLWVFGAAVLVVCVVLFFVLPCLLRGLALSVFIPVVFDSVSFVGYVCISFHPSGDFFTPF

SEQ ID NO: 1000965 - protein, 357 aa, Homo sapiens
WDFTEVSSGNASIDVLYFETVVVPYYCTDRFGGRFDFSGSMDKPVLVTIQPAVQECSEHLARYQPFPGHITDVYMVYGYVQPLLLVTEEKVPTEWHRCSEAPPRGLGPSPAPPTGSALPDPQTAIVPSHDPPAASAPSLRHSGRLMLLPFLGHGALGGGRDVQLDEDHRVQETCDFVDGIKKFRRHVHGVIEDIVRTDRWTNTACRSPNQYPVIASGHPASSLACGPPPALLPLHASHAPPSLATPLTLLSSHGLQQMFEGPMPCPAPMQTHQAVARPPRCFSVDNDASSWEALPAQPTPTTGRKPWLSFGCISRTMAKEGFSSGMGLGTRPYSCQYRPTHQQAPNPQAKMARGREE

SEQ ID NO: 1000966 - protein, 150 aa, Homo sapiens
MPSSSCLCLFPFGYLVAGCSRYSCLADHFCMVTLDDDPQLACPWVTLHSIAMCLSLCSLRFPRGQAGSPQPPHYAAGRPTLPSVSLWDSGPLSVHRSPCGQSGSVVPNTRARSDTLSGCLGPHQQERVQAGQAVHLDPQPLGSTPPLCVM

SEQ ID NO: 1000967 - protein, 97 aa, Homo sapiens
HEKGFIKSMSLRLPCTHSKSSPNLKKYGNVHIFRGATSTNSHLEINTNALFHYYIRRINAVPLEKLISAVSFSPDFVLESIKASRFHRPYILEVGSL

SEQ ID NO: 1000968 - protein, 83 aa, Homo sapiens
LVNISSCLYLSVELFICASKWCYVVAHSALRDAVTRITFATIVLNVARLTVYLSVRSHAQLMEARNYLPVNVRNIDGSNPMFH

SEQ ID NO: 1000969 - protein, 192 aa, Homo sapiens
MVPDSCSSRYRNSNGVKWIQPKAHCWLKLRLQRLTIDDIQTISSGSEGDDFEDKKTLTGPMKRLVLVNLPERFALKSTHGIAIKSTNYGLCGQGVRAHLFVRTHRQFYDGEESCYIIDAKLEGNLGRYLNHSCQPPTCLSRSVFVDTHDLRVPHGMAFFCQQKNPRLGQKLTWDYNYESRGTMSEGKELLCC

SEQ ID NO: 1000970 - protein, 190 aa, Homo sapiens
DALLVVSVFRLPSLSCLYSLFSMYFFPITRLSQGVLSVTGFPSTVASSSITVAPIVNVSRQIIYYGIIPPSSSTTTFSAKGVDIPGTCTVRDSSVCTCVSSTHPWVLSIICECLYSLASMCSTPMCPTIVLHLRARESFTRITNVDQLIDVPHGVLGRTIVSCYKAPLLRGIGTRQVSTRGSHGDVEVST

SEQ ID NO: 1000971 - protein, 243 aa, Homo sapiens
RENRTMHLSCDLSLTDYLLKHMVTHTAALRAFQCTVCGKRFTQKSSLNGPHAATHSARDVRPNATAIQAKGSFFSTQQAPSMEAPNRAQGAHPASHDRPLGALGPSPTVGSGAYPHSTATPACEDLARFHDHLERHCCHSLRRQVLSSYPFNPITPYQGISPPYRPLLHVLEPSRWYRAGVWCWLRPLLRRWTIFTSVKPGRSWQHMDPGPRFDSGSHPALSCGAGGRMGAACLPQGQAGQGP

SEQ ID NO: 1000972 - protein, 149 aa, Homo sapiens
MSCVGPLCTIELQWPAGDGHLGQRTTAAGLVAWPWHSGGQASHWACARELYQASSSRDTILEDDKVMGWSEVPPQYAVRAIEEQRLKTQQGPHACLGVLCLGTCEDVKAEPLVTRVPPRQAHLEHHRAQCSAVSSTHAVPENIRCIKRL

SEQ ID NO: 1000973 - protein, 120 aa, Homo sapiens
MGKAQGKGGSGDSAVKQVHDEMALVVLKDKSKHLSMKTGHRNVNVVQGSAFGVWVVSTYQASAKFSQLLSHFHLKQQQQRSDARALSDMFHIIYDVNIDCVSTFARCKTLIIRSTVGLCI

SEQ ID NO: 1000974 - protein, 234 aa, Homo sapiens
GGTLILVPSAVMARGPKTHLKRVAAPKSLDVWINWLECVCSSIHTTGSPDELRDVFPPHHLTVQEADVNYALDEEMKYNETFDMHAVYNHECDGKGTELDLVTLPCHCILVDCYLHTCDNDVGKRRFPVLDLLGPPTGVWLRLVQSLLHTVQVGHIVQQACSQSVHDTRVSLVAATRRRDIPPSNLLPGTFQFDWPGVMPHFRSFTDREFACTIAMACRDDVCLICHECAHFPL

SEQ ID NO: 1000975 - protein, 70 aa, Homo sapiens
ESSAGSRARPRPAGFRRSLTLSPGLECSGVISAQCNLHSPGSRGSPASASQVAGTAGAHHHGWLIFLYFL

SEQ ID NO: 1000976 - protein, 269 aa, Homo sapiens
MIVLVRLVLSQRTYMISKLVDFLHIERIVRAYLDGPDLCTQVIDFRWSTMGRYLQEALQGTRRKRYQQVSCKRFSLIYQKGAIPKVVANQISVVSLERCAIDQDDIATPGGGLAHRRTSANSARLRRDRYHNLPCVVHRGASQFANLPVCAPRGVPGHAKQSLRPLFRSVKRGTAVSVRYNWRTRHLHSWVSTNMLPIAALVNLSGAPRSWLPAERLFVALDPRGVGNRSPICLGCPPWNPYPPHGGMAAKAVGASVCRLSLLPGTQPL

SEQ ID NO: 1000977 - protein, 243 aa, Homo sapiens
GLATQVFVGYSDLTDDDGSPQRRLTAQRTLHSRLRTCLRYTLHCTSWLAHRPHGQGERSEVNGAHRDFTTPDVFPLEERPAHMSCHTSKEWQQSSSTPWFANTFRNRPHSSHKTVSNRSIVAPFYARKQSRQLTIKRPVRFPTIGRNRGKPPFPGPAASGGLSLSRFGLPPDMGPNRSMTTTSGKPLWQTPPPFGPSKIPPKRAHQRTSLAPPWAPLANHIGPQVVGPFGERRIYPIGFVGGG

SEQ ID NO: 1000978 - protein, 217 aa, Homo sapiens
SASSPICSTLGTRLLRAESTADDDAHTRTAYRTDRPSTYSNISEPQWVIRWCELGLNSFAAARLATSRFTEEPTSQKMSMQRVGVNESDDYSLHRFKATNYRKSISPHVGSGITMLVNASYQAHDLRESLTKRVPRAKEAEDVAYVCCHHVEFETWNDAWYFCVRGIGWISCHHAGQGCGKEWHPESSTDGLEKELKAALVGVPHALEGAVVEFFVT

SEQ ID NO: 1000979 - protein, 418 aa, Homo sapiens
SRRRRRLPSARVDSEPKTDPPDFRPSPDTRRSVGVRAGVASTRLPLHRCLCGCVLAFVVGLASRLQLAPVASRRRFAPDGVSPLRTSVLAVGVVPVFTSKRHDLVWAILVFGSILIPDGGTHRQLGNSANRLQFVSQWPHMRDLSELETNRHPKVIPVYTRLTYVTESYREEIARGNSIGFSVDTRAYLDNGRLCGRLSSYPVLTCDLGTYVRQVSPQLEVLLSPRGEGQCNTIGKESAKREAVLRVTVDWSLVLGIQRRTAISLYKKRYSGKSKPSKGSVSVGRKRRFGFSERVRTLALPLPTEERTPLYLVAAQKKCPITRRTISAPKRAEEQEVHKVQKHPIGFTPHIQNDHAFGTQFRCAQRGAEKSGKPDTALGDALIHLSRGAPNQTRWVRNFPPLIPIVGQEFLWGTRGSR

SEQ ID NO: 1000980 - protein, 105 aa, Homo sapiens
MAVSRVECKRSVDLWGVVNRGRTFLNKWLSFPERLDHFSGEHVRTSPMILFSSFFDDPVSGLRKSPYLDHGTGLPYDQAFIAVAQLLPERRLSSPQSPLVPIKME

SEQ ID NO: 1000981 - protein, 229 aa, Homo sapiens
RTLAVAAREECWMGELEELIGSDGLCLAQGKEEAVKQLRKMQRPRMKEPMAGTVEADTAPVPVRSIVLPASRRKVKSLKEPERSELLLRSAVRNWAVLGAVLVRAGSAARTVDEHGKMKVVTMSKPETEACHFLDRESVRLEGRLGLVGRGTSLEEDDMSETHELRQCTVYLLDLVLRVRVIVMQLSCQTERSFSAKADERAGRQLESADPWSYGDAWVRRMRGARARH

SEQ ID NO: 1000982 - protein, 103 aa, Homo sapiens
MWAHLGTPRRTMVQNPKDNANLRPTAHLCWKALAAALSEHRQYCDTFRGGEDHTPLQRRRGGSNTPYRIEDRGTRGHRAISSNWGSKHTSLELDARGTRDTAQ

SEQ ID NO: 1000983 - protein, 180 aa, Homo sapiens
MALLEYRAACTQTVRVSNAVAGSHYNMRMEGGSDAGGKMAAEGGFSGNSWSIHLCAVYWKPKFGGKRRRDRFAERSGRVNVRIENDRKRGWCSVRPWRHVKRLVHIVHLEGSPLSSRLLLTLTGEEVDTEFSLYSSKAPIGGITWAPCLGTHTMFSQVRHVYFQTHLRIASISAKVWAFV

SEQ ID NO: 1000984 - protein, 207 aa, Homo sapiens
TGSEKVLIAQEKSGNNTVYVFAKKDSNIVPSTGECTIHVYENSSRATSSIVGYTLLSRGGQGAKKSATGQGSCGNSYHIVEGKKSHQLLSSQEAEFRVMSVPEQDALLLREHDVILTEFLEGRHDDSWKWVQDLSSRMKAMLCTPLNQEMCDRVSLCSRYANEEARAHRCVEHNSIQRIKMIGHTEVTIENKNVLQHALYGVNADCG

SEQ ID NO: 1000985 - protein, 241 aa, Homo sapiens
MAEKFDHLEEHLEKFVDNIRQLGIIVSDFQPSRQAGLNQEAEFDIVTGLQDIDKCMTGCFMILLYRYARFFEYIRINGQHPLYTKECLAEGSELKMSSYKARSTAIRNLESLLIQELSERYFREVQWAKLSRGIRGAGSTRLLKPAHPPCVKIPWDCDAALRLGLRVLDATFLLRWDWALDTSLSPSVLIVWPHGTEGLEERRSCAPAVPAACLASTGFQSADPSSLWGSFSLRADDGAGK

SEQ ID NO: 1000986 - protein, 226 aa, Homo sapiens
MDLVAQAGLSGTVWLHVQPSTSPGVQAVSAVPQPSQVSVGLRALRHHAKANFGILSDREWGFTSFSNLREPSGRFHPPSRRLPRGAWEYIRACKPTRTVDLVSVALYIIIGKQFLVWKEGEVVNVKSCAPNRDVGDRCGAGSPFSVNGLCATYVGDAPRFYRGGVIYARDGAKRAIYSGQDVPVGYLAPRPLSSTPHTPGAGQKPLLMYPLYCVFYPIDAAIHQGV

SEQ ID NO: 1000987 - protein, 130 aa, Homo sapiens
AAISHSLLESCPLAAFVTLALVAFNEERNRIYVRYPNLHLSTPLLMQGKGDDLLPAGTEDYIIYNSTEKRQEDLTTVQGIAECIYPNFTNRNYVKAFKKKFACNGTVIEHRNMRSNSATGLTQTPKGNHM

SEQ ID NO: 1000988 - protein, 169 aa, Homo sapiens
MSVRAILRAAERPGTGVALAVSAVLVCRRTLFGSSHRTVSSGAPYFPGARSGTLVRHRMCASLGLARLLARGSPNLVAATRVETHFQPRRALAKVAPYGLQGTLCASSSGSAREVIAGGHGRVHMTSNIFRRPGKKYAGPQGVAVYILLDQALLFSIYGICACLLKVQS

SEQ ID NO: 1000989 - protein, 199 aa, Homo sapiens
MVRTIGLSDGVAALNRRAPWLDKRALKYGANSTRSTRNDCGENNLSEKRTGRTHVETLVATPERQKPYSAPREVGASRKQRIAKTRITITRKLTMVGGHTKGSGYIHRRQLKGYLFCGSGAIALAVSIADVDESPSCWNTPSSCNGGAPSAPNGPNEARFWALRGAYSPSRVCVVWSWLLCPPPLKRLCRGPKVCTGVV

SEQ ID NO: 1000990 - protein, 317 aa, Homo sapiens
AGCVVAASPLISPRALPADSLGTQAQGLDAQRWRVPKGRCEPGSVLVLLTCAECPQKLWPSVPGLAFLRPSMRLSVREWLLRGSLACALVLVLAVQLGTAGAQSCLGCVLGWACVDAPGGVPIAGPEQGGSCVDWVWTPKTLLVITCYWPMASIALLILRCGLAVAVFHCGHPRFDLRLPLAGGAHTVMGAAAGRSEDTWHSIRAAVGLAHCCQGTLVSKSLLGPSRRKPCWALALEGPGALTGIARGAWNSTGKWTVDPVCESPSRTRRIMPATLAGTEMPGPPGSVAILDQHHTVTPAIYNPCVPNGSSTEIHKP

SEQ ID NO: 1000991 - protein, 440 aa, Homo sapiens
GTVVAQPVSLFSVRLQTGDMVKRLVQSLLLSFGRWYGDPVDPVLLPCNEILTHMTYGLDFANHQFEGSNDSIHTRNVWIRSRTRELSERHVQGGNVAKMNVGMSEDTDILVLPRNTWRFGETLQIDWEAIVCGPTRHIPNRFNLVAEARSSLKTHLRVNLQLLLSVAIASEYTLQTDCRIRIRTGVTLYPVWKYTRRIRVQWVHITVWVPTRNLGPMYEGWQGARRIIAPSEMSKDCSSSGKSFPEVDLRLELTTTYFDSINTTLALSFQSHRHRFTRVESQYDFAACVSQGTGGAHTGYYNAPKKAYGGLSRETFKFLMWNLRFYLPLWNLRMFRLRPNQREHKPWSTLARSLCRIAEYPCGSLGVESKGAQSPRKLCLDLGADFETTSIWPKVGWPINRNRQLHWSCVTTELKRATLLGPAFGPKLPWVDPRTCAPAR

SEQ ID NO: 1000992 - protein, 192 aa, Homo sapiens
MANRCLRVVVDVLVARGLTYMGRADESGHVTHTRHPLIKARHPVFNVLITLGSVAKGKSRWDKFFAWAHVARKFQPYVQSGVLPNPKYTATVTETPSNLWPRGQRKRLAKKQWIFKFVGAKTHNPTKVDQRFLSCLPIFVPSFSRAGGGKFPLGNATLGPKEDNFDSGRGNLRFGRKNKGKGPLCVEKFNGR

SEQ ID NO: 1000993 - protein, 102 aa, Homo sapiens
THWSTPIANFDYKSLKGTLLLHGGAVKTITVSRYEGAELDLLLTDSLVKDKCPYYYHVSLETVLVGPALLGHTHTSNAMSSDIGGGGCTRDKNFVVLNCLVE

SEQ ID NO: 1000994 - protein, 126 aa, Homo sapiens
VHRIIGRGKTISLNRLSGLSDGGHMVDREHLMFTKLPVKLGMTHIWVTQGRVDTVDDQYVHHVTHRQHVVLVAHYRFDISYFFRPSSVTNVGCDFRGIPSTLILHRMGMLRSLHAYEFGREALNRV

SEQ ID NO: 1000995 - protein, 285 aa, Homo sapiens
GFGGASLQRGYLWPPRLRLPPRDCAPGGSPVEPESAPTAPPCFGRLGLVASMDPACHSRSCAEVRASRYGSTASTNCRAILRRTGCQEGTAAYASVRVRVRVSTSLTRVELARAAPLASQDRLAGALLLSESRRRWTVRASECCVLCCTVTCRSTCCRARVRPCREESPPAGTLHWAPERSRAYILTCERGRAQFAWRVNLPFLGRLRRSDRRRNFGRGPCGSSYGKSTSLHCHRSHSTRRIGVTTPKGGRALRKAMGKFSRLIIAPKLRPKFDFGTDLVIRKYS

SEQ ID NO: 1000996 - protein, 103 aa, Homo sapiens
MQQHNIYSVSLTFTSVGACYPSKERKKTSGNTWNSPKHPPILQTDLLAIISPTIAQFMCEYSAPNKHIVHKRETMQHGDSHRTPKLPTVMVMERRVSAICSPN

SEQ ID NO: 1000997 - protein, 114 aa, Homo sapiens
VVQYFFLYKSILYSHGSSYLYFKIGLGSLDVFLGTSSKFSDLAHSARQSTVIESKYRWPDNSMCISTRVLPHRMAQCRCGGCSLCLTPTPPHVRDYSRGHLWPLDPFPSPPLEL

SEQ ID NO: 1000998 - protein, 38 aa, Homo sapiens
MFCMFMLNRPIQGGSATGNNGSSRGKRELDMMLHSYPG

SEQ ID NO: 1000999 - protein, 310 aa, Homo sapiens
AGPRQPSQPRPLLPPHARTDSRCSREKVEEEIQTLDLRAPSWTIMILRQTNDYMQPEEDWDRDLLLVPGHERSRKRKTMHGHGVTPHHPEGGDQQIEQHSTRGLPGMAWTLSDCMQGSVHIKDETTLDQAQERQATTAHVAQKNHHKTIKQRNLAIPTQPQTQRPSPTGKEPNRGKPARHSGGKRNPTNAIDHHCEPNPHLRTPANTCNTTGTKKKKPNTKEKPKARNTHEQQGKQPHQRHTVEEEQRRNKRQRHHMKPKNKNQNNNQDTRHTTSTERDTQTRDTQRKNIQHTRTTQHKSKNENQGNAEQ

SEQ ID NO: 1001000 - protein, 119 aa, Homo sapiens
LRGIYPHKAQLHMYRHQESLAVLRCLLCTVTLEGLYVISACRETYLVNMLRRWSTSDGSGRQSVEHRVGLQASVRCDQLGPAVIIETFQICWQHLSISIIIRASDHTFPIGGKRNRRQP

SEQ ID NO: 1001001 - protein, 92 aa, Homo sapiens
VVLASARRLDCVLDELWKRRFTIDARATGVAGHASAELLASGTSQRDTCFADWQRTKTCWPNPRAGQCVGVELPAVLLFSGLNIATMTPATV

SEQ ID NO: 1001002 - protein, 155 aa, Homo sapiens
MTAIIRRTVVRVCFFIHRLMFQRKYVAYSVENESIAIVSLRDVKPVLLASRLDEVEFHVPFFVLWMYVPGHYSTTEDRGGGCREQKGKFHDGDWPSDVQSASIGRGQPEFSKQTGEQWLPQEFYPFTFINHVVAEGIAGSLEVPNEVFRELGDEK

SEQ ID NO: 1001003 - protein, 232 aa, Homo sapiens
GYSNQNSLLVPEYFQGRIMNVIGEAIDERRVATHKTSEDIVVRPDIMHGMLHELLWEECSVDARHQCCVDLIIQRFSIRMPCISLHLMPRWVALDTFGAYTLVSCMELVLEDSLHDICAVEYNHNVRRKMPHGSVVTSSAAVDFGVFAGGERRDRQVRERAQGVLDGPNAENATSEISGFRFNSNLLNDSMERTRLIGGACHRDSTSGHTLETGDHHACVDLLARPQRVKRS

SEQ ID NO: 1001004 - protein, 126 aa, Homo sapiens
VEPGLHPSNHVKVTCIEVIRHGTTYSCVGVFQHVKSRDKSPMIREIWIPVQAMSPFTDTERLIRDCQHKESILQMNPHAKATTGTYHGLTPKKPDSYATSAGPRRGKYDELELGIGYGHQRLLDVK

SEQ ID NO: 1001005 - protein, 578 aa, Homo sapiens
DLKYMVIRTGHMTHTIGILVATLRRRGIERVLDALLEEGQFRKRLVNPRPKPSNAQSRIRRISILWILSSRMAIDWKLPSSGSFAREPVDPMHLHIANSLRSPGSHKRRLETPKISQSDRPKSRNMRRPIRFAFLTRVPRTTNAASPNSQCQVALGISEDTLMPDWYPLSPPLLERAFKIRSASDPLVRTPTRKTFPASSFQGRPPPIPAFSALGGLATGAPAGTLWCRPNPQVWLPSQGEFLTPGFHNTPRARRITLPLGPQPPEPSTIIPPDPLGADTVGAPLLTGTLGIVVTPFGGVAQLRITPNGAVTPVTLTGWPLSSRAGCCHARLGATGHRLDIPNKGPKRPSWFLRLLPAYTAPRRVNRRSPPLGPPPPVHTYVGSRTLSPPFVHITPDYSQPALELATFANARSPFPTADLCAPFHWCFPPTDGILGAPVPPRMNALTPTPGASHRARAPTAQSDPQAPTPPMRHTEQLAPPKPLAPTRKRPRPPYAHNMHGPPPTGSQNHPVPRRPPSAPTATLSATPPNAKGPTRAPTHAPPLQERTRASNHSGQRKIFPDHAAVRPHRCHNPRAHT

SEQ ID NO: 1001006 - protein, 313 aa, Homo sapiens
MRLLSLVVWLYLCVSSVKHEDRSQAFGFRKIDLREAGYRAVAGIEDPEPWQQQASSKWLARRCVQCTDGGNVVVIDLPSTLRERAFGVNWMSLEIDIILVKGGIQDLSSCVRKEIYTNNVGEFALSAPSCKGLGSTYMRIVSIPREKSKLYHVAHETPRSTRSAGAPIGEPWLSISQSDYSCVTRGRDNSLGPPARERVERWSECFFPPFLCPWKAWGHDPFVGGYTEAPYTPSQYVGILPPRGPKEGSRIIVAEDTQEEIQSHLEPTVPPYGYRQSEQKAWRIMGAASSRSQVLRLPLRSRDRNKIPNCLPP

SEQ ID NO: 1001007 - protein, 270 aa, Homo sapiens
MGCTVGACIMEAPCEGYFLGASLCYSGTYVSVDTRMADETRRSLNVIRYDLKELIKMEGLGENANKPDGRIIDDSQTCDPANRTIVQRMMVIETSLTRVTRSRETEGRALGAPTRHVRRKTIFDSVLGASQWDHRTISETMSLYAPVAVSVDGPSMGHLGDCMRPGKGSRAWRNLKQGRTGEKKLVNSLRRNRGRQLQVPVGIDFQRGGGTLTPPFLPYPPGSALGENPRKPVKTYLNRRVGRRPGYGCPPFAPASGRMGLPGSHNAPPH

SEQ ID NO: 1001008 - protein, 74 aa, Homo sapiens
MWQGPGARTGPRFLEGAIQTQFRGAPPCGAKDTHYSHQDDKANHKIPKKPKNNTATQRGPRNYHRPALTQGSTH

SEQ ID NO: 1001009 - protein, 140 aa, Homo sapiens
MWSPTQKLSLRGLPLRPTLSMASHGDHTMGFVGLVPGIRQRELQDWQQQLVNISCHEEQYRMHLWTIWGLMHCYDSSAPPKVRRYQVLLSLMLLTANSQTTMVTELGSSCMRLMGMRGLTGGQASCRQDDATAWASLILP

SEQ ID NO: 1001010 - protein, 104 aa, Homo sapiens
MASGDAVREFALNLLVMPENTAQVRCAYQPLQNCSHGTTGVVTSSKMLSCGAAGRVLELRIVRVETTTHWCEVSLSGGQVVTINILGMIASTGSCAAQFENTSR

SEQ ID NO: 1001011 - protein, 279 aa, Homo sapiens
SGGFRAAAGVYGTLALASRFYLPQEPRRVRWSLRLVVRLSARRATVACATRPTWRASLVHLFSFPACIRCCMLGDVGRSGRLALHSFTVQPLRYWRRSCSFGRLVPLLSMGLCTSAQMLPGTSISCHSPIRDRTAHLTLPETQRCAATSRSLHDMDAHTRVDVGPSTLYLTDVGFLDLQCHEVNDQSAIGTHCMGDWSRNSSCTLAPMRRTYTLRKGCKGVGPGRRPRDEFPRRTSILSGCIRSLGIPPNPLTGNSLARRDGALKPTRPSTHLPSRQSA

SEQ ID NO: 1001012 - protein, 118 aa, Homo sapiens
DLYRFAGAGCRALILSAAGHEGFYSKLSVLFSLNDSLGIMACDPERMVRMKRITESHLTGRVDCHEIVGGTLVTGVTTLVDQCAIGPKCVVSPGKTQWPRRVRGVMSEQELTEVRVPT

SEQ ID NO: 1001013 - protein, 277 aa, Homo sapiens
MGELVVSGTEDAMSNENPLGIYLWAARELTRVGQRAEGKREGTNTGQAERILRRVGLTMHNDASRKTTGARTLRFDAKRHRHNRAHISCHMNRTDTTLNCHGKSPGTHEIGTSLRWRSQWCDGLYTNHRVPKCGCDRQMSRLTHLKCSGCRDLFDCAIHTVLYPLWPLRLQLVARTHSVDNHRLCTLWGCYALVAGVIEHILVRNTWYYTHVLCGGCAPGYVDANPPFCLNSEPPLPISFGCQRYRPCGAHSVEQTPVQRQCRFKTVLVTKVFRIAP

SEQ ID NO: 1001014 - protein, 103 aa, Homo sapiens
MGPIYYHNALFEYTPMLPLIPTLSSPPRKLTGGLPKTYKDKSMSTPIRRCNTIPLSSRWGHPQQAQEQKKHPRARRKHPPGEQRVVGQKLWTRGETPGGDNSP

SEQ ID NO: 1001015 - protein, 128 aa, Homo sapiens
MTTVAGSGIVVVQGEGLRDRLGKGDYPVEIRDEGVMELLTAVIVLRLEECQVHKTLVERLLKQLAPSAALRQTRGGNRVRPMGTNWDEHPTDLGGRGLGGAESWETQSVSTTLGAKRGWTQTREGSRN

SEQ ID NO: 1001016 - protein, 54 aa, Homo sapiens
NVRTRRWSGGGGVVGSCTVEIPSGPCWCGLIPVTLALPYRSRWSQNDPIGGSRA

SEQ ID NO: 1001017 - protein, 423 aa, Homo sapiens
ERLLESKRPDLWTDPVSWKRGGSDTGVAPTEAMIMACIQRHGHIVPRIQRAHACGGGCWIARKPNGQMNEWMYCAALDTDERRHQAMVRDEKIFYKRPAWVHMLVLTNCVADLERDCQVDRSLCRDRLEVVYDGNSHPHGHPGPDVVVFSESHMNQGPYVSVLVGRSVHQMANSGKPGSGTFDLVSRDSQIRTCGGSGLEEYVPRLHESIVKEDVTAWRLLGIHWNCRVKKRQGMASARTAPCEPFVPKVKASFGKGPLGAKEFFLNKAHAGWLAEPLFSIQTVEIVCRWPMGRPLVGFPCGPTTGSNLLNVAQSLGKGPQAPLLGKREARGPSKLCPPIACCWDWLEVCVPPVGSRDTPFSTGSTFLASPGKGFGPIHPWVGQVQSWFPRKAGASWPIGGQGPRCHGATCRHDLFWQSFLSP

SEQ ID NO: 1001018 - protein, 106 aa, Homo sapiens
MRVVTCVSGSGTCVRACLPTVGPLLRKQPASVHKGRRFRLERETCERASFREKPYSPKLEEVLEPGLQKVCPLVRESLFFGQIRRHVLKGPPWNLGTSLIAEVPQR

SEQ ID NO: 1001019 - protein, 80 aa, Homo sapiens
SRNRKVTVLYVLTLFSVILTAVTGSEGEMVHRAKAAREIQPLNARLSTSRWPLVVVNRVNQTIINGKKGQWTLTRCCKGR

SEQ ID NO: 1001020 - protein, 154 aa, Homo sapiens
MVDSMEKGLVEVIIQELVVRRTIGSYTDQLQRWKSHNRPDYLLTLVDDDFDKRSEEGRCSEKGLEENNRIPDESGRERTRKVTEEWQEQLTCKVTESKQGDVALQRVCHEGRVCQRVSDEPEDGNGDFSALKSVQPGHGNHRAKESDERGDDEN

SEQ ID NO: 1001021 - protein, 336 aa, Homo sapiens
GEPGFPDPGDDGPGMGMEPEGVVRGVTWESRVSTCFDDMNLLGSLLLRGHLSPYGFREAALPILVRRGAIRTLGNQGAYDGDYVSSSNLVTWENGPDYAISISASMIGNENLNKPAPGRCVPSDRTRETLARVQTTRQVVMATSGRLLVGRLHVEQTLISVGAPNRLTVAGELPENLAAWERYTPTSYERVTHLDTKWFQTDCFTAGDKAGPPKLDAKNRCVTRNDRLRKMLTRQRESQREPQDPYWTLISRKKRHQTAGNGTARDKTQGVVQGATKWPFDDCNLMEVDTKEQGTIEGGNHPCRECSVPTKGTDVRTLGRGIRPSSYNAKWNASDA

SEQ ID NO: 1001022 - protein, 228 aa, Homo sapiens
DLYHLLVGLLLLTVCTCHGRSPAAPEAPAKNVGMAPMSNAGTLPTQHTNNSMHAGFEPVETGCPLILLLQSKPEALRASGPLHQPPHAYSLTLRAPSLAGARSTLLRTNHASLQLVTVYQCMPPLDRSLCSRLSTTPSSIVLPIDATQRGLQMPVSTIIARARPGTYSGYLIGQICHYTFPLLVALLQRPTMPRIWSAEPQCRNRVNLIVPILRSPACLWCPFTSSVA

SEQ ID NO: 1001023 - protein, 112 aa, Homo sapiens
ASEASACFNDEAEYLLSQPLCGHETHSQWTMNCKASYVSMRRVWPHEVAARTLWVNEWKGLCGPEISGGNDKLGIPYEGSGVLTPVAVSCLLLSNVGTSCYQTNGRYLDDSK

SEQ ID NO: 1001024 - protein, 133 aa, Homo sapiens
MPLPVGAFASGGLGTANFGSGRAPRLGNPVATGGTKREGDVLTGATLARRCLIAPGSVVTRKIQQRVGPIYLFKSDFFLPKRGAEKECAPQVAKTNLWCVRHMIIINRAKTTLATGRHYRAYKHFYPTGRSVL

SEQ ID NO: 1001025 - protein, 249 aa, Homo sapiens
GKEEKLLFGEGFSPLLPVQTIEEEEIQPGEEMPHLGCDPSNVESPPFGRVALSLAPIVSKRNDLTPVEDSSQSPTPMTQEVLQLGLGPQPGCVSEDACDSTHGMRRDEEPGLRRKQHHTCITLCGSAGAALLRGAQYFTSWAAELPVPQRDVPLDPVVPGSSVTSQGMWEDLFTDIPINETRATSPRTPSKFCPPQNAHESWRLTPPGQSTGDWISAQYKPPRLPLSPCPEPLWADGSQDHSLAKCSPP

SEQ ID NO: 1001026 - protein, 107 aa, Homo sapiens
WYRLGPGTRITRVHVVCGLGVGRPDLRASGYRLPLLWSPAPCPCPTLLRSPGLRALSAGLCASVRRCCCARGPRSAPAVTRVKPSFKGASSVTLAPGMAEVSIRTMS

SEQ ID NO: 1001027 - protein, 86 aa, Homo sapiens
AVSVSRQTARSSIKLARSLDRPSGPFPPSIAWTTPAPTRSSLLIRLRLFLFRRLEPRRLSGLMSVDGVESPSPPACMGIDVTAAFE

SEQ ID NO: 1001028 - protein, 115 aa, Homo sapiens
MACGAHFSEPPWRKPPYFWGKKGGGGPPPPFFGGGGEFLGNPFRPPSEILHIGSAPRELGDRSRKKLNKASGLFAEKIKSKNKGRESAKRQRRTGVSARRRGRREAQSSREREQL

SEQ ID NO: 1001029 - protein, 314 aa, Homo sapiens
MDGEATRPLAPGPQRPPPLLLWHSVLLLPGHVVPWRRSNRIPNRALYITQKWQLVHPFTTRTVASHTAETIEIQDCRDWLCNQKRDIQGDLHELDGRARPGLQPDSHAHPASPAGLPAAQMRQCPVPLAGSHPCPRVAGPIAHLPPPFVHIDSPPSYIRLPIATQWTLDRRARRCSLEGETERGEKGAHGRYLQINRAEAQTIRERRPLPENHSQIGKQAKHTNYEDTLRRCTKGIPVTPCTIRARLRDKQSAIRRCPKQKGATKADQPDSTQTTLPLATQHRTATEKLDHKRKSRRTQRNTKHRSDSSTNKRT

SEQ ID NO: 1001030 - protein, 140 aa, Homo sapiens
MVGITIFVVVKRISSRFCYTRLCKMMHRSELSASERLISRGDMAGPVRNRLYGVRWNSYYIRRIQLDLKKTLYLVLWIAWPLSCILVWTEVCIEYVVPDEEVMHDGMNGCRVVGAPESYHEKSLLTMRTPEGRQKTGLHR

SEQ ID NO: 1001031 - protein, 157 aa, Homo sapiens
MVSQASVLPAAELRRLQQLPTENLPSGSEQSENGPVPTHQCDCQPKLFGDVVESHGGYGEERWSRGVLANRGHEMCGQEARRAYEGNSNDIRVAGNREVSDDSKPDSGSTREEEGDDEGSAQQQPDLGPLRTTIGATKERTWPTSRQSPPRPHHEDH

SEQ ID NO: 1001032 - protein, 137 aa, Homo sapiens
MNLKKAQKMHRTACVIKTPLYPCQCEHCLEVPLTRGRPRIRKVEANWSSTTHTLKGQKLQRKTARATKKTKRLGHDKTQTEDLTVHITTRHTRWSPIASDRTSGPPKRNRPKHRCKVRSNGYEEVNFHCLEKTPHDV

SEQ ID NO: 1001033 - protein, 145 aa, Homo sapiens
GTNVFQRARGSGMCSNLSLDLGEKATSHYICRFLDPTHRVFARASRRPRASPSTGPAFAHCCGSRGGAWWLMIPKVAHTSCRLRSFSGDLGPFGLCGATGGWVTLDLHPVRVSFHKRLTRPQIADRTGRGCVAWSSIPAKGPRVM

SEQ ID NO: 1001034 - protein, 356 aa, Homo sapiens
MSQDEFSDPSTWRPSRFVARRRSGRHRGKVKSFPHGMTRIQGRSQARAAPYLGIRRLASDITSRDGKVRLGPGIPQDEATIGKSVWRLVNHVVRREHRIECVVGMVGYGGKGLRGDSGGVHRNMYLSRSQYRETDVTKRQFFHKRKSATLGVVKGEEKAMLRAKVEHGRENGARKRVWGRGKRSVVDEVEILRRAIEEATGPDQEINAGSTYGRDKQLGIDAIVFTYSADTMTRHVWPHVELGGNPMRRIGGMGNGLRSAERPGHMKACGGGTGLIHVTTRGPLMTPQTSVMGPGYRKNVVQRSIGKVESITQREGFTETGGLPIPSWGLPMVNVGLQPKKHGAGPWPERRRGNGG

SEQ ID NO: 1001035 - protein, 161 aa, Homo sapiens
MPLVGLRYAQWVVDPRAPFYEGGKPRSLCGFRYPEGGPFTGDDKARTKPGCAPVAGFRIAVGPSCVGAKVGKKRGPLCGAKPMSHMVSVVTPRERGGNETFACAHSLAIHRSGDNTPIKYHSEREFSHIQGALSKHYGRTARYKDGAHMTRCYAGDQVDRS

SEQ ID NO: 1001036 - protein, 186 aa, Homo sapiens
RTFGWTPRCLANRGRGRGGGRDAGGDGAVVKGEEDEGEENYAEWITLTESPEWTHERQPREQQAPWPHPPSAERRYTTSDANEHQLDPPYDDARNPTTGDTQRQHKTHTTQTNTNSRQQTQTAAHTTQTAPADRTNRAPGSPHTTHETKTQAQANKQTRTTEPNTHEQHRATNATDETHEQGENRT

SEQ ID NO: 1001037 - protein, 101 aa, Homo sapiens
MRKPATKRKQELFFATGQPHSRVGRAPTRAAGKNEHEVQGPERSGGPKGSVPGASVELGAGAKAAGHRGAEELDGPRGDTGGAGGRLGRALTSRCGGHRTS

SEQ ID NO: 1001038 - protein, 251 aa, Homo sapiens
MPNRKKAKGNERGSGPSCREQARVLDSGESACFENKAYRILAELDQDSPVPNRDLSRFVKWTRYIRLHRQRAILYKRFKVPPVINQFTAESWYRARQLLSCFNAVPTKYMTMMTIAREECRELSVPVADDTNGCMGKRGLSSTERYHLSFDACELHHLITRSLWWHEANEKSQSVVVIAHDGDPSRSGLSSCLSCVVQLGDPLLPYHRRRQRTGTSKSTGQTLTTVAFLTGDTREDKGAFGVMLVESYQDH

SEQ ID NO: 1001039 - protein, 211 aa, Homo sapiens
LDYHADDRKLYNGLEAKGRQFGSKCNSGVPGLPVCIEPVSLMCSTAQIFFSKNGKRVVLFTIMPMSPDVTCSQQLGIALPVVNVRCGCTSNVCSWDGVRGLTSVLIVGWTVTSDECGCLAYMIVHDGLCAPLDRDVLRRNVAYTYSLDCWAVPNDPAVHFSTPEGSLLPFGRDDRVSHLYDEMCYSQTLKSEATCDERCSQEQGAPCGLDP

SEQ ID NO: 1001040 - protein, 246 aa, Homo sapiens
MTSVKRRWVLQAVPRGTGTASFTLTLHSPRLASTSASRPLGQESPTGPAESPSYSPGGSCGVPQVVDVARDGEGADEHALQLALSALLSRTADNMLRSSVERVGAGWELERLSTLRVPPRWLSEAARSSDPSIPCAPGSSPVPPRVGRSGATAPSGAQRCPWPCRTYLSFPLPLRNHKTHHTPARNQNTLSTILHNIPTKKMFLPTVTETLKEQPQAGPPHIVPVAIPRTMVHIQRIHSSKQHFPY

SEQ ID NO: 1001041 - protein, 112 aa, Homo sapiens
MWNSLLTLILHAANPKFLMDLLDETNFSCIQYEDLTQVKRSGRIKRQKALMKSTIRLSTTPMYSWESCCYALLVTFSSHQAYGSTCEAVDGRSSMVDQAVHMDWVDGTLMVA

SEQ ID NO: 1001042 - protein, 375 aa, Homo sapiens
MSRFGLTTDLLLVSLLLLGMYSAEKPGREFRPRRDDETLHRDPRRSIYVSLRLCPYSLGIPSVGLSVVRHRRNISHCETWMRNRKGPGDRALPVFDLKGTHLEATRGMRKSSGAWREFPSGKTCGTKNTTEHRKALPCARNIMVFALGSIEEGAFIERDLRDGHGVRSHGVTTRGGGGENAIERVRMKNCRNVPKTSHSLGCLASPLKEGVHPGWVRTRQTEKGFARNGMRVGTSDENRFETQKTLDRLVPPGTLWQKARETPDKELRWRTTRREEKALRYALSGGRSVCGPTYLTWLPNTVKRSLFAQDMSFVSENIRFSEEGEPRHIGASGFAWLVTVMAFHIWVKGPPKDGTIRDLVGEVRGRITLTWPALR

SEQ ID NO: 1001043 - protein, 110 aa, Homo sapiens
MATLESEVRVTPTEDRNHYLSRPELQECSVLRRARRDSGKLTCMYVHDTWVGGISQQAHACTKLLVLERVCAHLRRLVVVLHLHRGRSVSRRRLTKHAVEKATMPVPERP

SEQ ID NO: 1001044 - protein, 67 aa, Homo sapiens
GLYIAAWRSLTHRRDAQEDRSTWNSRLTSLDHQSRLMWTDYPRYCFIRGALQDNVGAPKPRMHGIAL

SEQ ID NO: 1001045 - protein, 310 aa, Homo sapiens
AICKSEQAEVSCEPVISTQDWSFDGAALMLLASSPNRGRVAWLHNNRILGGWLPCNSLWQVSRKSEENLILEEETTLDDPPSKPSIYLTEIEVLDVRENPYILVMSDHSPQTCARLQWLQALDVLRLLGTQTCWRSGCLVLSTSGLSCCQRGECGPRGTHEWLRIGCRTAAGAKAFRSRDDQAKQVLKGMSDVAQEKNKKQEESADARAPSGKVRRWDQGLEKPRLDYSEFFTEDCGPAARTDHLADRELRACAGGGSLPQASSTRLTVHCAQDLFWMTAVPSMGDLLLDWREATSTKKAVCNHAVNAQY

SEQ ID NO: 1001046 - protein, 73 aa, Homo sapiens
ARSGGGGGCSGGDGFRPPVRCNADLPGRGGDDRGRQGHPCASMRDQWAGRQISRHEERGEMIGGIELLRLAVE

SEQ ID NO: 1001047 - protein, 83 aa, Homo sapiens
HTPCTLVIADRMQRCKITALVTQHNEDQGIIAPPESQVRPVWIEQAPIRGLSHVLALHSLECRIDAKLEEYARVQAASNRLTR

SEQ ID NO: 1001048 - protein, 329 aa, Homo sapiens
ENKKNPASSRKNLCVRGEEKAVSFYKGNHNEAFAARMPLTWAESDSLLGKIAGLYAEDVTTPTHRMLEESHSRRGRPSEFGPVSTGTTSAKDVSQSLQCQSMVGRAATRKALVDKHMLAALNEGEPYVKPMRWLPKAALREARSESFIVGKVGENGYVEIEDDIGRRAEMNELMEQTSEIIDVCRVRNSQEDACTIEISNEGSDLSVVERAEVWLCLKVPKANREQDQKVSIRLFQQQKHPQGSLDTGEEAEEVGFKGGEEVNVELSDKVSKTLREKKHHGMVFAWSPRAFQGVAGTRAEKSLDVPDCLVTRCQDKLRQGGSPGQEKKE

SEQ ID NO: 1001049 - protein, 283 aa, Homo sapiens
MRVSTGEYHTWYRATNQYPKTKQGRKNTGCPMEHYTDTKSRDRTGSGPKPKNTKPLTGRIPSHEAKKTRRTRKQTCGSNQTQRTRRQGRDNGEKLQYIPENNKSYGHKKNLNPTMSDPWDHRRDEQRTKQSAKAAVSTNRGKKPFTVHTNNANKQSEDDIPKKSDNAKDKSRCEKPQNKSNDYAPMKHNYTRKSKKVNEKETITPRHKRCQGTKKQHGSGRTTMTIRHQSARKHKEDNCKEDGAPYTRREQQHRSDPKTNEDLQHNHTNAANMSSNDNQNNEK

SEQ ID NO: 1001050 - protein, 64 aa, Homo sapiens
MRDRLLRGSGSPRITVSCVPKGLGQNKFRNEHFLKGRHALDAESARDELPLGDGLLESMRIDAG

SEQ ID NO: 1001051 - protein, 298 aa, Homo sapiens
TCADREQLRDIRPYSDLCAVIATRQHRTIEGIRLMNRGDILRLLGSRGASAVIRELPIRPNYLLRNCYFSPSMRRQNSKLEQTFMHDRRIESVIKVMLTLLVLLARACWARTLPTKLRWVGCAPILASTASLGLPIMADNARSLTRTADCCSAPETKEACDVTCLSFDDKMKAHSPKRERITRVMISDRLNLGPPDFVTATSSLGFYLVPPNRVSHSASLLEGARRTLPVLHPFHMSLGLKISVQAIKHLCGNRGLPLGKQGNPSGKAMGLISRSRLKFQGHCLPSIVPPRIPWQSDR

SEQ ID NO: 1001052 - protein, 256 aa, Homo sapiens
MTVRIRIQNLHTLVAEDGIAGYAPPSWLCPSINVYLYATRTDSRELGHVDLLVFAIVRANMRVVVAPCAGGGLVGAESCESLARETSLVVSCRREDERSNTLKSPRKIQCRKHACADDTKIMSANVLSPVRNRSANTRKVGPTSKYVFRSRPIGKRLLVGHRHVQEASVVYIYVTTGICNTICGDAKIIRQTPLVKWGLTAQTDTARCETPAVSGQKLYGHRAPNSEPHHCFVREIQIPDYSSYYKSLDCGRCFPL

SEQ ID NO: 1001053 - protein, 68 aa, Homo sapiens
APSLGPPGGIKGDGEVLEAIWYQRTTTEQINKQATIIATITLRNLYFYLRLIYSTLKSHVRPPSSYKR

SEQ ID NO: 1001054 - protein, 251 aa, Homo sapiens
PVHHTDHALSKNYRVSLQDVIHLGSYRISFTYQKRSTGTQGSECHYLCTTGCPHRQGMHSCTCLTCSFSVCRCYQMPRSSIVCMYGWMAELTINWCGNAGRQGSTNDAHARVFHDASLMSYFSQCVVFGSREYVIVRIHANQYSCIIATYCPIDYLLVFAVHIIVRVGLRPTKAPCAVSLSVILRHLLETVLGGTHKFKGIKKYIVLKTVGTIAHAAKCEYQGTWGKHGKYLRKVRRRRTGPVPSVRKPHS

SEQ ID NO: 1001055 - protein, 76 aa, Homo sapiens
MPSEYGLCGKNGFSLPLNDLPRSLERMTPEGTRAFLEKEPSVRKTFRTLFTVPPGKGSLESVPMQAEPQVRESTSS

SEQ ID NO: 1001056 - protein, 166 aa, Homo sapiens
MSGCRVSIGRAKSSGQGEGRWERFFKGYETDKRYGVLKRGRRGWDLECGGVQGTGGMMLGLLIVMEEEGLSDWVTIEGVLGPRFTMLEGVSEEDSNGNWSSGSLGTSGTDAPFITAADLVQELEGSRVPPYEERGIPYGEHKLAQEHKGSKEITAGEARGTVDRNR

SEQ ID NO: 1001057 - protein, 107 aa, Homo sapiens
MNVTAQRLPRRVIEEGTSFSPQKSRRGRPTSIMICDLKSVMRVLDAHFSRILMPEVACETVAYNWNDPSCSGNITLHEAAVELPRKSGSVNAVKSALDSDDSSKGFD

SEQ ID NO: 1001058 - protein, 426 aa, Homo sapiens
MISAVVLVRWRNEVWVLLQKARVSLRGERTDLALGPDRVLLPTRIGAALQDDAGAVNGWGEWNCNDTGLTILLVPDGGTRDDVERRTAIPQGAVNVRLNREGTRHSVTSNVEIAHCGGTIIWQQSFYLPEWKAAVVGRPRRGSDLADVHVCSLRWAHYRNNSEGNRKMSNEEDFEVRMEITWDFDGNTVLEKLSPKVANAEHAFAMSAYSVLGDINHPMAYTGALRGAQLRAISGADFHSIGALVSEIGKQAGFPSQKKVMVGVAESGNREGGRGPYGARFSVRREWVQQLLQLAGLLWGIFYADLGPLVEESLGEPRRIIHKTLLRKCGNESQFPNFDTIGKLPKARVIVKHDERLSMGRFVEERGLSQTCGCRETTLTGVSGFPNYLIYSSATYNGLVLAYNKAYADPYGCEPFFADTYKSGIE

SEQ ID NO: 1001059 - protein, 272 aa, Homo sapiens
TARRGNHAHQHTDSHGSISEDKGQLSSIFWRRTEARGQPSAILRIGVGVDVAGFQVDPSRAHHSSYVEPEVLSPEAQRRYSAYSKRQPRQTLQGGYQWSPRWIPSMRLLAYSDVCMRAASAASSYDNAHTWKNTRDAQEYNALGKCRVATDCRPLSYGPFGNEKSLGADGLAYQTCIRGRYLWRSQKNNWGTHLEDEDWLPHGRCIRTPPVEVNLNSSFAHLRVPDRVREAPTSWTQEEQSPEHAEAFPDGNPFCSVRSLPICAHTLEANFD

SEQ ID NO: 1001060 - protein, 174 aa, Homo sapiens
MIARVCQGDQQPKFLCNYVGAMKNATISLVGGAAGNFTARHRLETVQLNSLLHNSHTRNARWLDHWDSRSRTMRLDGYIYKRPIFWYSLTLANDSVLGVGGDDGVTTIHDCAECAICLMRELVVRSYDCLLQSEHLGSQGDCGTGFLDRRRGAPDSSSGRAWSSMRGLEDRWVG

SEQ ID NO: 1001061 - protein, 338 aa, Homo sapiens
GEALYLVRVCWGTMDVSLRLATGCMCLLDCAWSWLGLTCSSELLEWPGAVTGCCFDLRDGGCCRLWEACVLVPMSWWVERKLEHMIQKNQCLFSNNQCKGFACCLAYLSESQNAGTLTRAKNIAQHTADRDTQQSNGMETITQGETEEARLRSAGKGYPCKTLYRYVAELHRTVPMLMSAASKHNEPSHQATSGIIPCGQIPTAKGNPFRKTQALGRLECDSGQDPIFGPDMSQLTVTAQPLGPSWSLSHQESTRCLRQDWATDSLSIRVPGLKFHLRWWLPLSGNGRSLDGQCTSGTRRAYRQAPRADMEGIDRIATGCHTPRHHKPSLDALQLSRP

SEQ ID NO: 1001062 - protein, 291 aa, Homo sapiens
AVVYIIAVLVRSCLLHEAVCKTMRVLKQAKGERSQQHGRVPQTVGLLTEQGSTSDRDPRGIGSWTRMGSRGPAVTHSKTATSIEVIGMHIPRQDLSLEMTHSSNRLGTELSQAEVISEPQASAGWHAGQFVREPVVYSVCPTAVTLGRVLTRRTAVVTLSGAPISRCSLAADVGELARLGSRVSADLVTLPGSELGLHWWPGHVLPREGLPLRAYSRGFLPRPRAWLPWEAQACHVPQHALGAVVRQDVVGPSFPTGFQCRGPVPGKGRLGCLRGLGVCGLTVLVRPPKAP

SEQ ID NO: 1001063 - protein, 124 aa, Homo sapiens
MILSSVEHRRQSQGPDRQHHRRGTEQGVKEPIRSHQVYARPFDYDQRYGFPCEPGKTHRLLGGPKDGRRSLTSKTDRPGIRKANHREQTMISQKRYQIKAERVEKDKSWKDIHVDTKEAEVEKT

SEQ ID NO: 1001064 - protein, 297 aa, Homo sapiens
MSTLSQGWILMLLKPAVHALHAWASLIPLYVRYSRGLACPWNPHITVLWLVHGRDWCLCGALTCSNMNAGCGVLCSMHAMPGQVSFPEQLTQHKCDPEMCLETRLYFSSTELAQHASCASSQSEMLWQASFTKAKRIEAQQGSSEDDQKGPLQGNVSNTSRATHKAKAATKSCERDHWSRKKQKATNVQRDTGHGAKLDNHGRPRETTRTAKSTEGQQTTGDAYEKPDRALATAGQPGIRRHRSGRHQTTAEKRGNGIPGKVTSNNPGKRTETITKAQDATIPGRQTTQQEDLARDD

SEQ ID NO: 1001065 - protein, 187 aa, Homo sapiens
MTEVISTEVISESRAQPCSPKPIRLVQDLPEELVHAGWEKCWSRRENRPYYFNRFTNQSLWEMPVLGQHDVISDPLGLNGPHCPKTQCLVETPPAENKPRKRQLSEEQPSGNGVKKPKIEIPVTSTGQSVPSSPSIPGTPELKMWGTSPEDKQQAALLRATEVTVDLDIQTNAVIKHRGSSEVLTPY

SEQ ID NO: 1001066 - protein, 348 aa, Homo sapiens
SSKVRQLELAKNRLYQAIMRADDILAPEVLHGVEFRTACEERRLLRHGCVHIFIGTCAWTSRVIELSRQGKAGEHCLIANLKLAAGKLSNVSEPLWLGEVCQLTKEGDLPQVERFFKIFPLLGLHEEEINEQFSEYLCKQVASKAEENLLMVLGTDMSDGAAAVIFADHTYSSALTGIARICWRPTNHQWRPNYGPGRLYTLITYLQVDMCTDTVGHTSVAQLHASQRGLPSPTVAGHCCEIRPCFRTYRTTTNTDVNPDDPVTPVHALKDPHLQFEVTRLRQRTQLRAGYPSYETAGHTRHLISRGLGSTSPVVLKRRKKRRRATPAQGTLHKPTSHNRYFTKRRAA

SEQ ID NO: 1001067 - protein, 78 aa, Homo sapiens
MATLVIAGLPLTDYRRYKPLLESELNPYTHFGFAPPFGDKVVRPKGNPPRVRTKDYDETRNVDGRHSGEDTSCGERIK

SEQ ID NO: 1001068 - protein, 104 aa, Homo sapiens
MGDWTMETYFRAMAYAKPIFLWGHHYSNIPNYPTAMDIFGIRIGSKKPPPSGIYYGDAGPIPRYRFANVYHSGYILTLYKDKVTPHSDYHLIYDSRHWSHSKYL

SEQ ID NO: 1001069 - protein, 130 aa, Homo sapiens
GTWRQLVSVSAPGGLKNLEAVPGWLLRVDTPEEEAVDLSLVWKHVLDSCICEVQLTLHDQHIDFQQIIATQDISCRSLASMSAGGMPWLGQAPLSAEVSRYLRNSEGSMSGTSGYQVPRRPEARTVSRVP

SEQ ID NO: 1001070 - protein, 207 aa, Homo sapiens
KVYKMFASRRKQRYWPFSMDCTGTEAHISSCKLGPQVSLDPMEDVTCINDIGSRGRRLCRLGISSALTDPTRFLVKRTKREQPLCATERRLPTYVGVAAVEVAPSNGRAGVLTVYARIKLCDPAALGQWVRHRGQHRGLRARGETLTRKRTDTNTTLAESRRSNGRAKARNTGNHEIRTVRTERMPRGDEHLCRPDNLHRNTFVRHT

SEQ ID NO: 1001071 - protein, 281 aa, Homo sapiens
GISLSTSPYWERLLGQRTSLQRDPVAGSEEAPHGRCNYRRQDLGIQARPGSLRGLFWDVGVSELQEPKCVIAMVTCRDWPIGGRRATRAALSRSSQHECHVCGICVLTTLCGPDLMPAVVCRGPGLREQSPRLWADVPSGNDQVPSCWDDVQCTGSRRPRTGPSCDVPVAGLKEQHVGHERDCVAVCPVPNETSERPYILEASLMGSVVREAPYVPDRIDQPRGAATLFVQRECAGSEDALGFCGHIGLVRELTIVGRAMRPVGNRSSGSVQLFTYAGVRL

SEQ ID NO: 1001072 - protein, 357 aa, Homo sapiens
AEPGLFLALVAGSKNGIRICYQLVAACGARPGPLAPRHRRSRATRVAAHRRPAAELAHPSHHVFHRVSLEKEKMSESELEVQTQPLASKHGTPGRALRSWGRRAWPRKQASGESRETAARSRESRQDAQPKCQLARETSGTDQGEDKNKVCCQVPVKTRQKLQEGNQGADPYKAGRSEDRGAASSPRTPSAAREPVHTSDDARSGTFIEYAEAVSVSGVLTQNLDCTDQQWGRRRTYKPKTTTRTRHTKHGEGIRTKAKAEPKKPWERKHARARELNSQGHPKGTKKGSGEKDTRSTKKTQRQTDHGKTGRPDARKRHTRNEKKAEPRIGGENAPKNTQTNKDREPAQRKDTTRPHQ

SEQ ID NO: 1001073 - protein, 123 aa, Homo sapiens
SVVRRLQETEMTRIIWELITEKLIFPYVELDLHSYDLGIENRDATNDKSPRYAAEAIKQHNGGVKCATYTPDAKRVEESQSNHMWKSPNGTIRNILGGPVYREAIILQKYTPVESDMGTNLSS

SEQ ID NO: 1001074 - protein, 260 aa, Homo sapiens
MPKGKKAKGKKVAPAPAVVKKQEAKKGGRIPRVLKKGLKILGIWTGHSSPKEDLTRLCEIGPAYIQVCSRQKKPSSYYSGCEKCAFRANLTEFHPRPRGTAKKAYSRAVSLSCGPHKVHENQEDTKSREEEKSEKTRGVAPGPEKEKGLCGPKRGKRSQKRKERTHRVPSRNPEEILNKPVTPTFGCGEHQEKSLQAVVCGDLCKPTDPCGSSAISERRGWHLIVVLWPRGVCRAKTRGGAPLIPVAFNTEGNTGQKTVV

SEQ ID NO: 1001075 - protein, 326 aa, Homo sapiens
PHLHQPTQIPECPDSCPGPDPHCLPVSNAWDASLCLAALLTPEHVSVLLTLSPCCPFPVDPLPLLGSCCQPACAMETPVPAGCCHPAAVGWQCQLHSAVCPPCITLAAVRRRTCSELNDLLAVYIDRVRSLETGDTQGLRLRITELNEVVQPRGVLASQAAYEAELGDCPQGTFDSGKPKERALPAAGAEQTCVRSLRMLKCAQYQGTDGGADRLASGSGVEGTLGPLLAWNSQMKAAHCRPPGPTSGQKCHVAGRARPSLNIPREPTDVCPNAFHRHAPLTRVQAPRKATFTGMDTVHVPRVVTSLQKQVREEPVRSGTSRLSEV

SEQ ID NO: 1001076 - protein, 111 aa, Homo sapiens
MHARLVGNARSVVPFELIGTQVMRHKSISISITSEHRISSEEHVYIRAKAKARVCIWSRMRMGDPEAFVATHTAFPDHKLKENPKALKGPEYAQRTFLCDLSQEEQDAQDL

SEQ ID NO: 1001077 - protein, 148 aa, Homo sapiens
MDNSRTLLGYGRTPLHRLPLVVTHGTPLCRHHTDGRPAPTEHEQPHDTPPCNERPGHTTPWAEKDKPQGAAYPTPPAIPQQHSFPQTAHHRMHHSPRRPQLHTTLSGGPGTGRRNTPQARPTQTAEQRRTPKESAPRAVTHNKRPVPK

SEQ ID NO: 1001078 - protein, 266 aa, Homo sapiens
MPTGKKVKVKARWLRSQLSWEKQEAKNVVNPLLDEKAKNFGIGQDIRAQERDAHPLLGNGPGTSQACSGREPSSSKRLKVPPAINQFTQALEPTNRYSAAEAGPQVTDQRQSKRRSRDCRTRAEKKAAGNTGTSQTEESHLVHSRQEVNTVSTWEENKKAQQVEIAHDVDPIELVVFLALTCVCNNGGPLLHYQGKGKTGTSSPEEELHHCRLHEQSELGRQRRSGVKLAGSYQGPTLNDRYDEIRRSLGMAMSWVLRSVARNRQR

SEQ ID NO: 1001079 - protein, 192 aa, Homo sapiens
MWRQNEKPGSPALAPEGPPPSQALSLSLGQWEVPVEQFPRKKLTLSSFPFHCKCCNVGNNSRKKEPVNAQAQGALFLGTGHPANGLPLGAFARTMELQEARIPTCPLGQPQDKQMERTPKESNLGYPSPWEDSRSTTPRGRESRDKVPNPLGPLGLVTHPFSKAHDLLEIDSTKPGELLNQISEHPFQHVST

SEQ ID NO: 1001080 - protein, 174 aa, Homo sapiens
APRSPGDLSKYNFENKYGVPGPALCTQHILSQTENKVPVHQEYPGGVPAFFRDMKQGLHSLVEHQVGQRISPGMGVVDVENDCSISKVPEPEVLGAGRCIRRRRPMVPDTFSDARSNRHHRDGQRRERAKYRALGVLDPWIRGYPSETLRREEDTSSDVTIGISRENIGRTEQS

SEQ ID NO: 1001081 - protein, 185 aa, Homo sapiens
GQVAEAPGLVWTYLVGTLILRLLCPWMASPQHQDLAGQRLVVPGTLFPVSFREICDEVIACRCLYPAASPLPVWCIVRNETSAGRAIAEFYVSAELTSDQVRNHQLSGGPEGHELYQESFFCRDDNRTCRDDCPRRMMWAGTLHHSAIEAPIRSVLQPGFMGDVPVGVAPRGPQARTPRRRLNNK

SEQ ID NO: 1001082 - protein, 136 aa, Homo sapiens
MTISHYHSFGPLPHGVTLPLQSASACFHRINVADEGHMERVAGDRSSSVQATGRGHHDRGPKARRKDKGTDAMTDARANKGKPERWRERQSIMTLPRQKWAVGNGQHGHNGTQPGEQQNAPDCGGTEAATHQWGHD

SEQ ID NO: 1001083 - protein, 402 aa, Homo sapiens
MCVLEFQWRKQKDGSKDYQLCDCGPGIQTLRMWQGGIPKMQQAFVQNDHHSSMVLHAVPLQESYTLSLPGNHAGSTCNHMHSIEHPPATLPAMGQASSPRTARIHPRNLPAHESEHQDTPLWRCLKHLAAMGISTHDQLLHNPAQLYQVVRRHAMTGKTRAALHTSRFQTDKLGEQTQYESDNAVLGSDSIALSDTIHHHNNKTTNANVDIDPRLRQVKNPAKAKTATYSNATRTDVHAQDIKRAVDIGAGKSPSEKGEQTKTPLSEHSKDGTEPECGHNGKGNDTIGDDPPVEHIGRHAHTQSGTEPKYPSVNRIPAKGWQKHTGKRNPRRRYYQKRKNTTAIMKAITTKNGTVEPNIPRHHMNPSKRIQTDTGRVNPPIEDVYNEEDTGKSKYAVARTEN

SEQ ID NO: 1001084 - protein, 394 aa, Homo sapiens
LGTEATDATCFAVVPGTRGVHPDMIRALTCRWKFDQRTRSKSVYREVQPEVKSACQVSALAPKIWSPWLVSPKKVGDDICLRHTGDCNGHCRTYGGKVSHSEQHTAHDLTVDAYLPLPLNQSNALNGTHPPTTSKRQARNSRLVQSPPSLRHLTSTLSLDLHLARPHVLTSAHGTSAHTRFRYNAPGKESFLVEETPSIHPLKHSLVRNPDPHRVHVCGTWVRIGLCHLVCLVRNLFRIVNRIKFRLFAQFEGPGMGYDYALCNTCVRKVRHVLSHMGTQKLEEQQTQSYVTILTPGEVSTRVEPTSRSWPRQAGPLTDRQRTNSTQPETEKHEAAETDNNKRKATLHAPKVRVTSTQGQSSSSRGRRPDSRREGREAIKESVPARREQDGITH

SEQ ID NO: 1001085 - protein, 176 aa, Homo sapiens
GDIYFNNVCVPPPRSLCLLARMPADAHRSEISNVAGAIRALDFMAATTKLWHRGSYARITPDFAALDAFQCQVRNHEWCVLKQQAIPWLACADLRLTSAVLTWVVYLALNPCYEPTGHHGRLMASWQSSALMATSRCEHMHHTWGFPRILSSHVTLRTPHDAVSCALGLHPIDALS

SEQ ID NO: 1001086 - protein, 70 aa, Homo sapiens
MPVDEFSPRGVTQPCWETTSVAAADRGGIPTPQGVPTAGGSPFVSEDLTLRYKQAVQNTDGMFPHPKGNT

SEQ ID NO: 1001087 - protein, 175 aa, Homo sapiens
MALEDYQRMLGYQVKDSKVEQQDNFLKRMSGMIRLYAAIIQLRWPYGNRQEIHPHGLNHGGAGMAQILNMEPLSDVTGTLLFDVPGGVWECLMKQYQVQFWQDANSHQRGLLFPELKLSQAQDRWGSFHTPQAVLGEMFGTQGHPVPKGFLNFLLLGLLNVSITNNSRCCKRAHN

SEQ ID NO: 1001088 - protein, 120 aa, Homo sapiens
MRVAVTLAPASHIFCDQHGSGEYSQHHQTNLVLPATVTLSGKLDIVRNKNSVHQRNIKLWYWPGLATRDRVWTLAPERWPFWDHIRARSSYLQGFKAILPLSLLISPVLHFGTSGTLYQE

SEQ ID NO: 1001089 - protein, 226 aa, Homo sapiens
WNPSDQRMGRGLRGPSAGLDVFWSPSEKKVPSGVNNGFMGNTGPTWGSGLTECPKGPKGDPGFPGAPGTVGGPRDCKEIPQKIAVQPWGHVECPPVVKCDGPPMRGTRWEDGAPRETTPGRTQGLRWGSRDTCLRTPKEKTVRVSEIVSPEIYRGRNEGKPNKRPTQEETRLWPRKVTPRTVQGGSPGTCQRVWPRDDKQISHRANIITWVEGNKGKELSARDDTL

SEQ ID NO: 1001090 - protein, 214 aa, Homo sapiens
YSYKKFLIGRGESRDSGWQLQRDLRERPLSTTSIHLVLALELGSLYEARSYILLWKLCEPVSKDVALRANRVRGGMYLSAVPRSPSWHCTIVRGEPRVHLVDLCPQLLAGSVVQALQTLPRRRRSRRRPLYATDQIAQLSRHKALQGHTTRGLRDTPGAPCRENRLPKGWPREKHRGRAPRHKSEGLGVRKPHRKPWCGTTRASIHNPQPRATG

SEQ ID NO: 1001091 - protein, 178 aa, Homo sapiens
RAGAATAYTEEGGRERSVCDVCVCVCVCMCVLYLYFFFLVVGGATGEEVLDRGRAVELCWTRATDLWSPWKCPLEKGRRHAEGLAEANLRNPQIMSLWESWSPSMPHIIKKQRLLCTTFRQHLTDIFWSDWAGEPSPADVPGSAPDDLLHATWLVPYFQTVSSTFRPRWESRGRGATS

SEQ ID NO: 1001092 - protein, 167 aa, Homo sapiens
MVLSPLPIRRPFDSLSGNVTEWTDDIRCRSLAPTHGLRLCAGVSFARRIDAPWWPVIPLAVGSARAQATIGRDWVRSVRSEIAVLLCEAELCASRRQRGCATHSAAERSTQFRGRAISTHKAVDRSVDENSRGDSYFLPDEAAMMDIPRDAITVAGLNRMAPHCGNP

SEQ ID NO: 1001093 - protein, 385 aa, Homo sapiens
MPEAPDSAVASCVCWAWCCCVVLLLLHEALGAVEACMPYTGGNGGSILHGASSHNACIIGVDTEGRQPRYLKAMVRGQQCRKRRGKGSRKREAVRGPGGRTPTLAGRADKGELGAKTKFGDDNMNRCYESRGTAQGSPGEPSRGTIRWREMADVQGTLQFEGTKSKGLEAEINAGQACDENQGERKWPKSSEIGGNTRAAEHCGPRTSLSAKAGELGATIIELKQSGEDAQRGHNDYGESKERRTTPGATNATQVGKRKDSKTRVRTPHRENVGRTRKQVGERHRKQGRGKTRTNVGGKGGARLTEQRAAKRHWTQRQRERTQGMKSKEAKSKRRPRRDKLMETDARTKENPVIKKEERGTEHKEKQHKKNERKSKRGKAKRADT

SEQ ID NO: 1001094 - protein, 41 aa, Homo sapiens
GKTRRCPSQVTLPKNSYTLHSRDTQPNTPAPVPPAEDGIKI

SEQ ID NO: 1001095 - protein, 114 aa, Homo sapiens
GRATSLRHHGEGEGQESTGIWSYRAPGHRVPAFNSGKVDICCHSMTSFIGPQCTMVNMFQYDSYTMANSYAHRSKAENGKLDHTSGNPITSTSHGSEDTASKKFIVREQIARVV

SEQ ID NO: 1001096 - protein, 116 aa, Homo sapiens
MVADNRTPGRLAPTCTTERSPRTASSSTTQPMYPTLAPPTPPDTSPFLIQQQRANDARPPTPSTTAKYAFQRTTSYNLSNNPYNSTYLPHKHPNLAWAPQPPPNEPQSQTTACNPT

SEQ ID NO: 1001097 - protein, 144 aa, Homo sapiens
MDGVVSSLWQACLIQSAAKDLKDAPPYIQWDEIAGAQLVHSSKDALDRPMTDEAWVLATAETLTLSTSRHHVAFSGLELAWGIELLEWLDRLYWRDASVRNSASMPLGRDLFDDADALFTKRKVVGAPVREITVQGHHCDGGVS

SEQ ID NO: 1001098 - protein, 211 aa, Homo sapiens
MLLVTWPHGGPSSRCREQAVRSAAYARLDQHLLSGSDRRLRRTSTVCSRGELSDTIPDECTQSYRRMPHHRAHVCGEQARSPGTQASTTRHRSLQQHSTTQRVAQSSSVMIRAGGRSGSHALGKVSPGCSDYCGLWSTQTCGQGRPEGTFVAECAQGWNVLSVRDSCAGTRWLGRERVTDVFTSKSGTGWKQSRRRSKLRRCRNEAVLIVA

SEQ ID NO: 1001099 - protein, 296 aa, Homo sapiens
MRKLAEGLEILLFLSDRLELSPSYKLSRDGHTPARSAGVAMLPVSLSARIVSPLSWGRQRAPWGEREMRLFGTRNFLQPSGTVGACRELPWNFVPAFLSDFHQKMSPMWSPGHLLFGELPAPPRRASPPGYETPGPGAATFRCVDTQKPVGGTPQQDYVRREKCEHPQNTLELPACVSQTSEAARLIGFLPRRPYINSHRGDLLIRRPGLVFRPPLLANGPPWYATSPFCVTTRRGGAFKRPPFGKYHPRICMGPPNDDMPLKQGPVGGTPSDRQGKNRPRSGKQCCGPRPPHQRG

SEQ ID NO: 1001100 - protein, 99 aa, Homo sapiens
MYFCLAPIQYPLGRKQQKLNFNHEGNIVHNQAGQCGNQIGAKFWEVISDEHGIDPTGTYHGDSDLQLDRISGVLQLKAKGWHNYVSLVPNPMVGTSKEH

SEQ ID NO: 1001101 - protein, 147 aa, Homo sapiens
MTPRSAEVQERHLQGLLCDGSSGPCGAVATETLAAVRRSGWGCALLEAGGSQERVGAPPLLNWQAGAPPSQAQLQPSSHDCKPGHLCTLRGPASPPAPQAQLYLVPPPGVSPLPEPTPTFRNSPKKGVFGKGGLGKTPKGATRSGNP

SEQ ID NO: 1001102 - protein, 348 aa, Homo sapiens
MEEDIAALVIDEWLRLCANRWFLLGVQTLPVPARFLPSVVRRPTYTHRASIGAIVRLMNATPDVGLTAGPETHSSGITERLRRYRPVRALASVLQAWDDHVEKRSWSTTRFYNLDAALLRPRMDAPQVLARPEAPPETPSANRDEDDSVLCYETFISTPAHVRGPSRPCLSLYCPLVRTDWSLSLDSGVRGHLTTVPIYEGYALPHSLSVLSWTWLAWDLTDYLMKILTDARLQASPPRARAGKIVRDFLAECCATFALDFRAREIALRRILLSSWSKSSRGCRMAEVHRHLAMTRSRCPGGSLVPRLPFLGIRILADPRETPFIPSEVGLTSRKTCKPTRCFGGPHV

SEQ ID NO: 1001103 - protein, 136 aa, Homo sapiens
ERSGGLLPPSGREAGGGGAVAAPRGAQAAEEAASFFFPRTAGGPCSSPASFMARGSRDCCSMQEEDLSKSSRVPFALCKSIKSFEEAACAGRVANVKWGPKVSIIEDWWAGAQQACRVGPAARCLMCPRPGKLMNS

SEQ ID NO: 1001104 - protein, 130 aa, Homo sapiens
MTIRLVRAVRSPSHSLSFSESVSCILYEIRDAYGVLISAALSWSQYQQLPVLEGLYLENPEIKIRILGEPKQKRKLVAEVSLQNPSLLALEGCTFTVEGAGLTEEQKDGEIPDPVEAGEEVKVRMELCRP

SEQ ID NO: 1001105 - protein, 281 aa, Homo sapiens
KIPQKRFIIQVSLESRGANRKDSGVPKLRATEGPPNTLWAPRSEREGSAHPGEGLRLNTGVQRVLFENTSSRGKRLNHKYFSWITEAHRGALGRSGRDGIAYEIVGPGVNHPPFIQGTTGCSYTQQNSPPVCPKKRQNTWSSQDKLWHTWQRVRRDLKINLSEGAAPEYHLVEWNTKCARELCKGCGPTELCYDEIISVGGIPEKNACPQRTGQGGRPLGAVGKCDLPRGVWALQKKRSQRTRREAVKNLLQNAAVYKRGPMWETVRNATKVLRPTEGDAD

SEQ ID NO: 1001106 - protein, 376 aa, Homo sapiens
SVVSSAFILFIRLIVFPQALTEFLGNLLATNKRATKAKILKVASDVIFQLQNTFAVGPKIRYTALGIAGTWFEEWPRGLYSLSSANGDKRLRDVYLLWLNYCVHSSPCLKKIKSRCSPITSQFALASVRSPELPNVSQCGQLSQLFDFIAFSAHRLPKAAESRVTDGTIRPKEERKINRVPRLVWPPEGRLVNLRVPRQVVLARKSLLCTGFGSKCAHLKESSRNSRSSCDSRHVDIEQWVSLAIEETPKRASFAGAHRLDSQVVVHRRGPHLADKVSSSWARFWVPMSSLSHAVLAMVWWNGTTTLLCRSGSGIQSVSSTAEKSWAKVHSPKTRAIKTTRYYGAAIWAGNLRRELTRANSAESRKVRYSMRSLWT

SEQ ID NO: 1001107 - protein, 118 aa, Homo sapiens
PVRCFSCGKIVLTSKWEAYLGLAAGPEYTEGECAGCPGCLKRYCLAAGMRAGPRWTVIEKLLKLCEPHGMKLTPRVEPEYRRCAEHYGSRESMHGTRKLHEVVMDIRESWAYMVLDSQ

SEQ ID NO: 1001108 - protein, 249 aa, Homo sapiens
ETSSTQEPLNASEAFCPMEICMVPVVYPGPVEPGQAAWSRCYIVKRVVKPYRLYQTLKTSIRFCSYEHAEDTFTREASPQAEEIADRRNLGPPREVAAGNANKPWQNLESVLSHLEDFFARTLVPTSADSPWGAMPYSPKEFYELTWSLLAPYSVDQSLMRRPLVCAVSSEPYFMADAFSRASRLLLAHGHRRHGSQGHRNCGEDWFRPKLNYRVPSRGHKLTVTLSCGRLPSEPRLGRLHLVPGTSDI

SEQ ID NO: 1001109 - protein, 224 aa, Homo sapiens
SFLENRSWVIMDLQSEYLAMLPGVDWEKSGRTLLRRERSLREAQSRGTTWTDLITFTLTLSLVERFEEELLETPSVQDLLPGRDVVRAGAGGALEILERRLRVGVHDGLGFVLRPPGRCSWCLRMGVRLTRSAEVQQESGLLFQDQIREPSSGPEKPPPPPRDGRPPAFAVIFQLEYVLQQSCRSWTGNAASVTYSVQNWHACTWSVGCLEPLVGTLILEWLNP

SEQ ID NO: 1001110 - protein, 284 aa, Homo sapiens
MECRATSSHRTKGILTHSLGCNTSVQTRACGLATQLIHLGGESLVPPTYANDVEGHGPCELSSSVAKAFLQASHGKPEAALSLPADSTWDNMTSNSRLVLLSMNPRGDDNSRQSHCFRGDVQYSSAIGDLDLSVATRNLPRPVEPKFRESAPCVKRAPRMGPFEREPNQHGNCAQIGSGHVRGGWQLAPISNNGSSPHCRDALTDKPRPAIKVASTYASPWGRGSEPLERRHAFENGFNAPFRDAKEGAGRADFLNARRLCSQRPTFPPLCCSRQTVVAKKFRG

SEQ ID NO: 1001111 - protein, 64 aa, Homo sapiens
MGGLNFLAQWVASQFGQFLCGPRVSPEGPWYLGGSVHVDACAGGPWAPGPCGETRGVSFTLGSP

SEQ ID NO: 1001112 - protein, 132 aa, Homo sapiens
LDCRARPDAAMSAALFSLDGPERSCALAWRQPGAAVVARVQVSLGHEERKEATALDVTHTVKLREKLNRVYSPLNLYSVMLGFFLQSYFRVCMQSTGTICYGATPSNHELFETEALCSGSTKRKRLSMLTYL

SEQ ID NO: 1001113 - protein, 128 aa, Homo sapiens
MEEPYLQGIHYEDGCSPQTQLRALWPGGLRAIVQAVLKRILIPSGLLQIGRYKSGMLPRTGGTFIHIMTGARACKKRMDAWNLINDVRVKQEQLCMHLRRIANEQTTCTVPLPVSACFASYHYMSRED

SEQ ID NO: 1001114 - protein, 212 aa, Homo sapiens
RSLTAGKRLDDSGQEIRYLAPKVPIVIQVTIAFPGAPSTGSAVRQEATVSNGVVSEAASPPAGSTLLSQVPRHSREAEYAEARKRAGQRQALEEVAGVNTNRSDEADIQESSQNPLRIRQVSPSKCDSDQAWGSCLESQWSSKLGADYKCRGNENDAADYACRSIALLVSSGHGFALSVAGTAGLEQRERPDLLALVIPLAPATVTLKPHAL

SEQ ID NO: 1001115 - protein, 32 aa, Homo sapiens
MATLFAGCKVNRIGPRWNNPPNGDLGPTANTG

SEQ ID NO: 1001116 - protein, 376 aa, Homo sapiens
GQLYVSALDPRGPWTTQVVLTLYLVPGDGGVARWILGLCNDAQSCPVTWACCFRRILTHFVSMLSRPSTSSSSGPGFKDGRMSDHSPVDERSLFLKQIILQPYRESDSDLTAVETHTDKLPTTRFWMLTQSYIDLMLTAMQDRSGKAAELKLSDFMVQHGELSLGSLCALTWRQSVRDRCSLLLPDFSPESSTSVKGSRGVREHGSDRDALTRLQPRSTFPLSCELGYSATNYTSCSHEVGSVTDQGVYCRCCDRMCDGGKWLGVNLGAQLLVLALKRRGHVHGEADTVVRTPRSEGRTGIGRGRIGAGPRKAPLARPGGQEPRSKVQDPPGASSCRAFTKDSYRGPPGRERAQGGAPNNPRGSETRSPAVGSCEA

SEQ ID NO: 1001117 - protein, 271 aa, Homo sapiens
IGIGVGCRSLCAGKFALIFPDLVEGLVLVNIDPMAKGWIDWARNKLSGLTRHFNRTRVLSHTLQTGGAGEQHRVGCRANGSRFGERSEPKGQTGGSSWEHVQQTQKTWTLNGLGTVPKSARRSAARDAGSFGDNATAEERGWWSAHAKAGNRHNIQNFREEWPGIWRAGTEDTQTREADMKAFKILTGKGMVLKWRISTRIEPGMGKVTPRNMEVHSTQDAKDPDEEWPSGTTKPLKPNTEEDSEGAWAKGQTKTMEGVPVKSTKDTSERR

SEQ ID NO: 1001118 - protein, 104 aa, Homo sapiens
MLTSYTLSPVVGHVGPSEAWAAAPCVWWPGVAFRASQHFTGGSGGRGVIRVLRPLCVLVLLGGLRRRVRGVLSASEGLLAVNREANAMQNLNETAVSPTWDKVR

SEQ ID NO: 1001119 - protein, 281 aa, Homo sapiens
AETCIPKVNVMTHPPVHLPCCELSISFQVGHARCPDGLCLLVTRIGCTMGFSQMVMLSSDKTSWIGGAYNIPLLCSITFLLESIGCLGPDTVLARGAFKWALDRYVSIESRLSIFWPRYLCTVFFTTQSQLITWSNSRNACTTNVIPLMGLHEYAIGKGESIDPSCVDRITISCPDTGAQDFRWCFSGCSHNALVGGTGSGFTLHFLVLERIVCLTMAKKSKLEFSIYPVPQVSTAVVEPYELYADTQRQPGALRLCLHGGQRSESMTIVPAKPKTSERPN

SEQ ID NO: 1001120 - protein, 251 aa, Homo sapiens
MLTEPVCTSPPDAPEPSLNDVLNYTADKDYHLFSVWTDCIDTMSTQISAPRNMSGITSCLSMGMRTQHLLERRDGHFDISEWLGHKIYHVRLTELNLMDTTRSGKLAHTGCIPYGMGVWRHRQLTHVGSFARFEECERCIGGPGSNVFKIGTLGTFKYDSDEDTQSIRKHVPITTIWNLEREPRSSIGMSSRPFLLLRKSIDAKKANVRGSAPGILGLRVTTLNGTFRNTPYNTNDVGYHQYPFGFRRLGR

SEQ ID NO: 1001121 - protein, 134 aa, Homo sapiens
QQSRMEHVNTVEALHEYPVMWYIMHEVIQSITSSLSEVVVKLQTLELACTSPVSALPTTDNCSSDRIESEGELDDELLHHGTTVKHLARVPVWCQMLIVLEEILVEIDGTSLRKKLAPGVLVVMDSEYTSHRIY

SEQ ID NO: 1001122 - protein, 274 aa, Homo sapiens
MRRTSAKGPDDVRCVDSFSYQSGDVNNSSTRIHGSRVNRFEGVSIHYFPVGSRHDRGKTLDVRSITLGHRYGPFHRSVFVATGDEIGVTVTHDGIRRSVELFLAALACRVRGAATADLKRVPVKKEFTSGACGRLGSTHRKFNTQPMVNGLRFPSARTQGGWIVGCTEPYSAKDTCCDDCVGFRSPGIVIACERTEGESLESVGYVAKQVRFSSRKFPCAYAVTFLLAVQAIGQIPRKFKWEGHGCTLVGQLEHQVGNCQSFVEQFLVNPWVPR

SEQ ID NO: 1001123 - protein, 206 aa, Homo sapiens
MRGECSLDPTLVSHAVLEGPLSRSVQVFGYATKTELTAVGVHCEDCCANVSSIKAERRRPSGDELDARVSADSYIAGWHWPTVRCLLWQYGMQMYLVVDIADVTVVNWRVLVDVGAQTLYAYRESKYTSFESPWLRLINHDKLVVIDGLSNESDESRATISSVRRVGRESRLVWLDLNTLRYVVTRFLKKGLGSGTLVDPLSCGYP

SEQ ID NO: 1001124 - protein, 326 aa, Homo sapiens
MVGGVPGTFISSKCIMMTSGCFAFVRFTTGDAIEQRGPSLPIITVGSVRTSAGCKRRRKPWTAETLVKEVVHDFRYRTFVISDRNGAGRERFHSRARLEDNGVGGGQIDGPRQDGKVRLRMSSLQHKSPLATEIELAGIPGGKRHAPGLKLAKAQPSPPRGGKDDAMKRERRQQPMEIRQEPTRHISTDFPVKKPVAGVPVFVNGRINVNTIVYLWMSPYISILTPPFIIVWIPSRHTTITCGDMAQRVAGHGPITEFRRVSSLQSWNRHFTMDILYFNTANTGRSHRCKICGVEPLKGVLIQKDPGTLFEAIFRHSMAQMITGAT

SEQ ID NO: 1001125 - protein, 94 aa, Homo sapiens
MSEGVGHNEELVEVLLKLERQLFPLLEKWFPQTQTAEDGSRTANSNYRGMEATKRWWAVNPEPLFGVGELPLGNDQIKGLPAKEVGQARFVRKN

SEQ ID NO: 1001126 - protein, 244 aa, Homo sapiens
FLLRMDRAHEAKIRLLHLPDHEQGQAVEGGMPGARARPGPGGAVPLSITTDFYPFPSGCVAYYTLIGASGHERTVSRPTSRSCEGDSLKDIHAVVLLLGGKKAAKSEDRQPVPGQQMTLKIEGDHGARVVLVAVDKGVFVLNTEEQSCRSSNDPGTVVGRTADIGCTPGSGKDYAGVFSDAGLTFTKQPLASRPARGQNFSARSQPAAERRSVQLTGEANGPKSGKNPKEAAQSAAKDGMRENP

SEQ ID NO: 1001127 - protein, 191 aa, Homo sapiens
MCVPPLERELCGGQKNSCVCPGRGGEISHFSKHLEPCCALPPFCGPPFQRALPSDFSPPINVGVSFFPRGLWAKSPLFHEKGPFYRLFRIFSQGVRGPCCGPRGIHVYIHKDTLLATGALVIEFVARPFQTGLQIDDKETLLFPGLTKTLGSGETFPLWDSPKKGGFWSESWEGDKIRWRVLSKWVCGPKN

SEQ ID NO: 1001128 - protein, 197 aa, Homo sapiens
MSLRTEPFDSVRRGTFDNGSRLTATCKLLLLGESTSECLSPAGLSRLGVVRSLGCQHFVTNWMVIYTSTVGDHQSGSGNFGGRKRGAEEAAEELLCLQQLRDSHVSTQGTRDVWEPVLQQRPLQRVSMERNRGCLRDQYFGGCVVRLTVCIGVAKLTLIVVNSVELLAQNNRSSLGGAITTRIASRIKRTEVVGPWL

SEQ ID NO: 1001129 - protein, 135 aa, Homo sapiens
RCAARARSLISSHSELKCDIMLLRSSSDREELDAMTLALHVSRIVPLAVVFDVADARGRRPYWAARVAETEELIRERVRQVVAHVRAQEREAAGGCETLRYQTRANEDDWPVGLRPSCDAVSVSAIRSRASCAGC

SEQ ID NO: 1001130 - protein, 66 aa, Homo sapiens
VSRGPVEDPGPILLISDDVFRLENDDSELSSVLCAVVINVAIKVSAVKPCGLVGPLKKRMPASIIV

SEQ ID NO: 1001131 - protein, 104 aa, Homo sapiens
MYSKNSDVHRLILGEAPKGLRICDYRRLSHETELISKNDSNVSYADGRLTSRYNAQIARNYYGTSPWQSKYTEPSMTRQISSSGPLVRFFEASWTSCHEHWDEI

SEQ ID NO: 1001132 - protein, 68 aa, Homo sapiens
DREREETGRAAHMGPERSLWKLANCQHGSDCAASLGPERRAADSVVGFSIEQVGRSGDMGLNFPGDHI

SEQ ID NO: 1001133 - protein, 250 aa, Homo sapiens
MSRRKERGCLSQTWHLAVKLADQPLTPKSILRLPETELARNTRYGAIVFHSREARVICVAKAPRESCSYEPWSCIDRDLLVVVKLQDDSDTWTSIGIQPGSTVHVLREVLAMNLIERPEPVVQSGLVHGDEFLVCEHTGLSQSVVLLTGMAVLVKMLMVIKEVRWHHASFVVLPLGLRRVTLFASLRVLPGSKDLFLVSSAVCQICLSTSVPHLMPRQCHLSWVLHSVARQWPECLGTDGLFPGACPSRS

SEQ ID NO: 1001134 - protein, 155 aa, Homo sapiens
MWQIHQFQSSGVSIPFRAVQKGGDQEHVLEATGTKAGLFPRFQQPPCDPFPSVTPRPTRTLDADGDGHEVRKPATRNSHLPTPVASTIPSSTSCQPPCRPHLCNRWHHPPPARTPPPLLNTSPRRHPCEPPPPTLTSPPPPPRALSRYPPTTSAT

SEQ ID NO: 1001135 - protein, 215 aa, Homo sapiens
MQKPAGWHMITFTCSCMGMRNVVHDNTFSQDVEPVPRKPASYHGHSRELTDTLGHLKDYCMDMAYMTCNRRTMHRTIMATHWVFAKTTILRTLHTYDSTIGHPTLGDQLEASQHQNTAPPASGEAHALESRNSTGTICAEQNQSIETTPDTYTKHPKCKWTTQKKNLMSPIGAPNTHREPASQNICTTKGKGPTTYTLRRNSFPHPCDRETIMTQ

SEQ ID NO: 1001136 - protein, 300 aa, Homo sapiens
MSRLRALLGLGLLVAGSAPAADQKPRLIACRSGATWWGPQWLKLVVAVWDSRMVMGGTDGEVPEPMEWQAHAVDQELFNEYHFSVDQLMELAGLSCATAIVKAYPPRLMSMEPALRVLVICGPGNNGRRWSGQCCSYNYQLIQGNEPNASITLEGHTSIARALHERFGDPVSRTMDYPFPWGNVRRAMTIDEACIELLGGLHLWVQLLRADASGKPVPHTNSSKLVPRKGDFTLLAPFAPAFDTFPLQRMGDRGRNVGQLGLERASQHPRTFASSAPLFEAPAQKVPWNPKLNAGTGKPN

SEQ ID NO: 1001137 - protein, 186 aa, Homo sapiens
MVGTTQTVPVPQPFFPTKSIWGEGIVGKNRTAMTDDHWDAGSSSIDVMSERMDHVNQKPTHRAPEGELGEQRHKGTQNLGGRERQEEGIGHGQGEDSVSSVPHRQAGGHEQKRRDRQQNGSGRRRHADNYLKDEKDTKDSMGPTSGNNNRCKWNSPYQPQKTLNTKKSKRGRDKGGAGRTARKAGT

SEQ ID NO: 1001138 - protein, 142 aa, Homo sapiens
MVGLCVSSWASLIVDDIGVMAITLIAMKLNRKDWDSLCWICTSLQEFGPGALSPGSFVLAVIAQSSLPTCIAWSHETDLYSASPPQCNSMGRQHVGYTLCWDGIVRCADPELVAFVFPGECFFGSIRLFQDKPVCGSWWYTV

SEQ ID NO: 1001139 - protein, 104 aa, Homo sapiens
MVGHLLRPGLMADMSDDSRSQNKERRKDGKNISTGGRGTQDVRSKSRSLHRNAWDVGSKGLRIGCPQGGQESLHIDHLRNHVSVLRQQYQCEGKQIAAERMRFF

SEQ ID NO: 1001140 - protein, 134 aa, Homo sapiens
MYARYVMYPFEEKFLPGRYPIGSMPELIALLMAGTTVFAKQDKCAVVAMRRCSFGTYTVTVRYNVRNERKGGNGTRAGRNNGAEVSHSVSWRVDRMNDCDCSDVLNHCDQEVEEGNLLTMHQRSVVTGESTGTA

SEQ ID NO: 1001141 - protein, 415 aa, Homo sapiens
MTSAFQLECLSDYTTLPLISRWEGDVHDYCKSSYYMFSLSVVCTSVETMYQQVRSVRSGGVYETMERVYPLKRPIGIDVTILVKLDINQGITGDLLAILNCLHIHVVRLTCHDSLKSVHSLHKSRRNIITEDNPGSLRQCAVATACNCVFHRTEFDLRHNGLSSAPRATQLALTTPCAWVDRQALPLCRAHLDCHICSARHNRLRTHLLPLFHLTLVLTSARDANPKQGAPRCNEPLLHNIDSRTASNLQVCLALFPSHHRWHNLIKPRCTPMHDIPPSYAAYPSAQLYTTRLNILTRLHFGSHQPGTSHGTRSRSSAVILPTSSSPQQTGHRPPDSEVSFHFTHHTRRYRVTIPCTQLPKSSCLLKRDTTVQADQFLGQTPVHWLYRLTATGLCDESNNARYHALLIILLSLST

SEQ ID NO: 1001142 - protein, 146 aa, Homo sapiens
ASVPQALSLAFADSAPVHIRGPAHHVYDDIAALSRRRMAPAMCEGPAFAELRMSLTWPVFHARIVGRTLGKQGSDGGHGSGRIPIVVSRFMASKELHVTYGITLPLACKPRFGSTGDRSTEALGNRALEEESWAAQLPFVNRLVRH

SEQ ID NO: 1001143 - protein, 242 aa, Homo sapiens
MFRWPTEKRVHHIPRAALAPQKKKTKQEKPKRTTCLERKTSITQNEEGGHPQQTRIRQTPLKIYEKNGGCTLSLLPEERRRIMYHKTRKQKNTCNPPPTNTRNLGTTNRHNHKTQQNTTDTEQIADTARIKQHRTGNRKDMKYKQKRRVETDPSHHIHVVVLVRTHGPHAATRTKHMKLSTQLAASVRQPDRLRARPEDDPQSGTDTPCGTINQQNRCRPNVIHRTEATPMRVKAPDKTTHT

SEQ ID NO: 1001144 - protein, 96 aa, Homo sapiens
TFWSLLPWKNNVRPQHWISTVAEELRSATVLRQVLTLWPGSGEELWACTRMYVWDAHRVRLRQKYERIEILIILRYTNVFAPYLIFLVPFTTQDRA

SEQ ID NO: 1001145 - protein, 92 aa, Homo sapiens
NSGLVRSLSGRRNLTDVDAPGVEAENMSCVAEGLSYPREPPDRRQSEEGATATWQDDLNSCAAIASGPSFALLVDAYSDYRVSRPWRKLAHQ

SEQ ID NO: 1001146 - protein, 121 aa, Homo sapiens
MSKSESPREPEQLRKLFIGGLSFETTWMSERCRKPSIEAKWRDSRSTELGVVDIAEIRNYLKRSRGFGFVTYATVVGRWYCMLWICEGHNNGWIEKEFVENQTEMLYSKKDSRRGREVRAH

SEQ ID NO: 1001147 - protein, 74 aa, Homo sapiens
MVIGVRMVVDERGKLCPVRMDNSHASRCIYSGEAEILSYPKTSRWRADGLVRIEYACGGESSVERSSSNTLGAT

SEQ ID NO: 1001148 - protein, 250 aa, Homo sapiens
MSWLLVECAWVLLWPCLGSLRPLGSMAMLLPMPCCPSSLRLGDACQAGALAARLPRLADSWEGFYGLGGVRFEISHHPAVHALSDVDSGAAVGGMQDWRHSLPCHAAGGATGASPCLSGVPRRPLSFSKCNTVEALSSGSLPCVPTPAFRFLKTKFQPLPVWGLGPPWLLQNVHCQPGPPARFPSVSGTQAPSFGVVLTLPGVLEPLYRVRFQKLSRCQSPVSFLPMAFTDCHNRRPLTGSSQPDSAYDL

SEQ ID NO: 1001149 - protein, 70 aa, Homo sapiens
GHPQHEEHGAVMKKGGIILSEKFLKAFAFHLCLLSHLRGHRIGVSSIGRGRDEPPTRHLWMKNWSLYLVR

SEQ ID NO: 1001150 - protein, 89 aa, Homo sapiens
AGPGAPFSASSRVRLVGAGWGEEDERLAPMGIGLQWVGVAMDGVRRDLTLGWPDLLTAVGSWTGTGNCGNALGLVAVCGEVLVGVAWVL

SEQ ID NO: 1001151 - protein, 159 aa, Homo sapiens
MKLVTDRRVHEWHIRQDPRSYEGPGVNDYGQSVDSLETRLTNRQYWPGGMAESKRLRMNAFGKSINLHAKRSKSTTTCRNSCMRNNCWLGHTSDMQGIPEAIKPRAESRGTPMGMREAPEEVQTFTTNFSEPGGILGARKVVLRGPVDTVHDIFGTGSV

SEQ ID NO: 1001152 - protein, 336 aa, Homo sapiens
ASAVERGPAGRRRLMTCPEWNVECGNMSMRVSQWVHAMEWDRVGGAGVDSGELWGPGWTPQASWPVASLIMLPWPLPLASSASPCSSWALTSLFLWYCYRLWLPRHACALGAGSLSYGGVLWCGLWDARECLVWAKPMVVVLGIPGKDLGRNGLSEPAASGLLQGATPVAGMGYEWVPVTLKWWLAPVPWDDGPESPKVYKRPGMRIYTYPRTWLFKSTIERDRRVTAPRGSRRCNVTVDEAGLSHDKLLQGNYEECDAWDILQGNYLHTAIKWDWTAPAWVRPRDAKKSSLLETKQCLGETQAKVDDVSMEEPYEGNLDGGDQTIIDVDRSMEDR

SEQ ID NO: 1001153 - protein, 324 aa, Homo sapiens
GRRLPSSGESLLSVLLGESTAILPTMVELQGRQIRPSWTRRPTSVNMSVIAHVDHGQVQADETPVVCKAGIIASARAGETRFTDTRKDEQERRITIEVKLPYYPLSTDVSENDLKLHQAEQGRCTASSSTSWTPPGMSDFVLESDCLASEITDGRIGGEWTEVSGRSAVQTETVLREGQYAERIKPVLTDETRWDPGPCWRHDKLEARGSSYKNFTNDAIEGTTRETSTHISDVRETGDDTRHTMGKTLSEDRPHMTIRGHKEGDKETNMAHHTRGGGPLQEPSTEHEKRARHKWKIDGGQRAKDTDQQRKEVNGTTQRKEGGQ

SEQ ID NO: 1001154 - protein, 110 aa, Homo sapiens
MRTPFYPYPCVHFTRLAAANSGHTIGILQHSVRTPRLDIVPTVVVRTYTHDTGGGSAKTPFRRNLRRLFLACEHKGIIKGVEQNVEKLFVTGYRSTKKLSNLQAVSNAWK

SEQ ID NO: 1001155 - protein, 105 aa, Homo sapiens
MPALICCMLVSQVTSAMSRQVVGFEPLYIKAEPAALQSKGFLGDRDLSLHVALAPGPAPTSLAPRPQGRGGWGGGWAGEQGRMGSLVLELHMDKALMGVDNVEGR

SEQ ID NO: 1001156 - protein, 561 aa, Homo sapiens
PSCGRQDPPEPRPSPEGDPSLPQRHNVKPGALKSPLENIHDHERMTLSSTRKLPECTHEMTTSERHRYGDHRDTATHRQDTTIPSFHHDSTRDSTEPQTPNSHMGHATGTSHEPLPIETKEDNRPKNKYSQNKEPVTTTHIQKTEPSTQKKTQRRADTHTSKRTKKTHNPKAQTQKNEHTSDQTETRETATQYTLTTATHHTTHRTRKHHAWDTPQETAQQNESNTRTNHDKQKQQTDTTTDQHRTTTKRQTPDTDDTTQHNAIKHQDTNNKHNTHKQNNQNTETKQQTTSEKPQHAHHTEHNKHTTRTTQDNKHTKPQQLHTTHNDTNKEEDNETKHEQNTPTTNPEDQHKTQKQTPIDNKDTDTQTTPQHTHHHKQTQKTHKSTKAQHNKHKNKEKHRQHKPEKKTEKKKPHTHNKTKEIKKTTTKRSHKAQSNKTTKRPQKTKTKHNTRREIQQNNTHTTARKSKPTQRENDPKQTRVQKTVHEDKDKQNKQKHEHNNPAQEQTHKTEQQHRQTPTTKQTSEKTSTKRHQQTRTRQNKHKETTNQTQNNKTKIKTRQT

SEQ ID NO: 1001157 - protein, 172 aa, Homo sapiens
MTRLLGVPSSYNDQADKASTRLKQLKRELGVRPEEEVSGGPYRLSRRNTCERDARYGRHLLDRPMPMNREVNAPLLYEQAHARVTLAVVYVSPTEIGPARRSPAELAPHRKAALTIGPIDGDAGLRGQNTVSEISPSFFLTSLRQWDCDTIMYELKQGRLPYPSKDPPGEYN

SEQ ID NO: 1001158 - protein, 52 aa, Homo sapiens
GQLGTHPKKEPMGGAEHGAGARDFIYACIRRCCNASLLQMIPRMFFQTHVVD

SEQ ID NO: 1001159 - protein, 72 aa, Homo sapiens
MVPAQCRRLLALWGLRPLELARDGPASDVALQLLCQRRRRAGSCTGLPIGMWDLNACPSGNLCWRKALSGKE

SEQ ID NO: 1001160 - protein, 308 aa, Homo sapiens
GLVHKRQVFKVGHRRVPTGTGWMAYDTGYTLAADMVRLLTNTAAGRMTGGFQWAVTTVEQAGTELSSLHRVDLLIRRDGFHGTNNDAVCLRHETFLGLRKLIRARETVSSSEIYHQDDEATGIRLCRDDRAKHYEGRRVALALSSKEIPPECAHRVAVNDVDKWVQPPRGTRREGLSGPRAPERHLVRAQRWTAPEEPLLTGPTAFVSYYLNALGVNVRMHSLVVEYREMVVSGQASVSPLLGGGGHTLMGHWRRPEEDSEELGWPSDWGSCDVSVAWSRQATYPGPKHALPGPAGSLPAWEVGIRRR

SEQ ID NO: 1001161 - protein, 213 aa, Homo sapiens
WEGDPPEGPATSPLTNSGHPGSGVQQQQRRSVLDMLMMHGMACCHLRAWPELGMPQCPLPVCTLLFMQRLVALVTQHVSPCRRLPPAFKSMEVANFYYEAGLLVLLRTAAMAGRRWKPPDGRPGAAPTPNGELGSIGRAQKRSHTTFSRVPGGRWARQKAPGSTAQPGQRTPFEGGFLDTQDQDKKPGLTPGQEHKSRATDRRSREDYRRRNC

SEQ ID NO: 1001162 - protein, 191 aa, Homo sapiens
GSYAVVAKLAPEHQSKVEVHDCLACHVDPRTNMLDLNACRWVGDVSDYGTCIPMDACVSCAIPSVLQDLRTRRNKRRAIVISRSYRTNTFDFSVCTLGGERAQIETPFISGLNRRVARGQTRRDWPFPGEANLQIRYKYRKKVPDARKVVVVEIYGTDLQCAHVKWRDKPVKSFVTRREGTYGRNYSALSY

SEQ ID NO: 1001163 - protein, 190 aa, Homo sapiens
ESEKEDLGFIFWAPEFCAAVRSKVIYAHAYRQELPFYGIQLTGIKVMKLQAKCYRARSRIRCEPMVRRKLRGLGAGLVVPVVVNDLCDAAVLEPPVVSVADNTGPMHTNNPDLVARGYARGLVARFRLPMTQVGACLRRRIPKTKRWDGAIITHFIPRKVGPQTGMLAHMHHAGNMLPFVPAPNPLEAVY

SEQ ID NO: 1001164 - protein, 200 aa, Homo sapiens
MEKPYKSEMKKPGKTTGKPEDELEPDADRKRQTRPEKPDVEGTTDCAGTRAEDRAAEAKVMQRTSAQDDGKAIDRRVARSGTVRGKLPRASGPEEHRSPGPIHRSRRQAVIDAHVLTTALPPKDATLGAERIDSLPPVHIERVYEAYPTGEPHVARTRVPHLPLANGDPPSEGIENFNGVNQGAILRMLKVKPKSRLVGR

SEQ ID NO: 1001165 - protein, 148 aa, Homo sapiens
MTGYSRTSHSAELDTLQYRLPITTTKDQTPRNELARTETIRDRSAYSMDLFYDLKRCCREKKLNAQRDYVTRLLATKDQVRLQSTWYHPNMTRWVHSNMDESEYASKLNTDHEVTLSQCRTVYTFYNIMMTASCTWSVAVRDMARPAL

SEQ ID NO: 1001166 - protein, 106 aa, Homo sapiens
MLPRLSIRTCGATHNGNTLNLRKGGFPSDKETRDAPNPGCHKFTLNPVGRNTRTEDKSACILDTLRMQTMAVTPSFLYRASTWRPCELKHIPVKEGPNGVGQGAPT

SEQ ID NO: 1001167 - protein, 314 aa, Homo sapiens
GRSKSIRSLMASFKLSQVGLKVVIWASSFWYARVTLKSNSSAWLEQSLFQEDIRYHPNSLDTPGFKLVVALARIKRRLEFGNKLLNGHSLQGINLIFLGAWKILEQATPLIMVLDIDYKYVQKGSQSLLGVTPPLVNRGASFFPSQERRESLHGVVMESPSRRVPRGPLQRKNWWRPLQSKWSDHFLENGPTVWMAGRIVLTFRFTRGRWQMDQNKGRSRGARRLQAEACPGRAHLPGAVWVNQKPNWDTPGILAAFSGKLYKCFKKRGESKKQIRAGAEREVHKIGQQRTQRDHGWDGTTPSHGRYTGISTLA

SEQ ID NO: 1001168 - protein, 297 aa, Homo sapiens
MCIHSKVLSDDMKKLRARMQLGHSKDFTEIKMQDMTRYYLRVRCDWLMSSLAEAGGLTVEEGYLDTVVADYEEHHHYSSHPSYIEKEYEMDPRDSPEGNTITTCWQDVEETPDKPGEMTIGEQSRYQFERKVQWRNEYSQGLEETRRDETSTRTHVLVQRGDPVEIMGVEREKRLGWAHVCMGKCQAWQGSHVHGSKSSVYAVKCIVLNAYWVKQVRTLSLSPVLSTQCFRYREGRQKRGGEQQGKRKLGLVANGTSSCLKPPQNPFERWKRITCRDSALSAPAPQSHQGPPRSTWK

SEQ ID NO: 1001169 - protein, 144 aa, Homo sapiens
MGPTTLKRHVFGSRLPKRNDHPHNLVVSSDIFGTGEFMNGELNSVSREGGPHNFFPKRSPLMEKGQRTCRRHCRHQDDGVGKTNFPPSVVLREFLQFRREGTHSDKIWDNQHGGATMMRRPRVSTHIHNKESHTNEARKGGGPL

SEQ ID NO: 1001170 - protein, 141 aa, Homo sapiens
MASGVLLCLAPLATCRRPITCPSVSDRHTSVRNNEGLSNGPCQMRRGAPTRRPMPCGPSTIQHLSGSMSKKHQEPRTNVHAQTKPLQCRTGNRQAAQESSLAPEELRALTSSNPSVAAQALAACPSGPCLLVSVLSHFRRA

SEQ ID NO: 1001171 - protein, 321 aa, Homo sapiens
MRPQRVACPRRRDVRVPLVSPCREAVPASRTAAPFAGKLASEPGAQSLGTMSLPGVLCSLFLMSMTGRRFHDSKDLGYCPSEIGLSLACPACAVRRLAPGVPLTGAHGHLLCPGIMIALAKAHGAPQRCVPDACGDMGARFVPPSGGHRTLALESVVALVLKTCSEVSESRTVHPSLPLLLACSCWHLMGTWRCHSLGATRVAYPGVWPRDLLSYATGTTDPCDAPRSRGLQRPLLAGWTSLHPFDASALLDAVVVALCTGTETASACLSISHASDRASFCSFVVLMPIHSPEFNGDPENVINGEPDPRHVELLGVVFPRQ

SEQ ID NO: 1001172 - protein, 366 aa, Homo sapiens
LTRGARGVCTLSPVCVRLKLSSNQITELSLCIDQWVLVETLNLSRNQLTSTCPQPFCTAEQELKKLYHDFQRSWTCRPGVPSRHEDKHQPNLGMRFMGVPTKRTLESGSRESVLLLVCHNELTETLSVILQEQHLVTHRTDMLDPIYSLYRENRRFLSMMQGSTPPICMVQSSRPKRPQTPKRSVASEDVIQTILNLRRLVRKTCMSGLDGDAIFRANCGLACLQLGWWAHRDPSGIAQMQTCVTSANGFHAPGMTHGQGMVLHGHSQDSLPEENEPPKAGTTAQIARAHSGKGCGVGTKGLEKAPLDYSRVLHGRTLGQVPGLTILGSIENFVPFIGGRKAFHGKFTKADWYLGAKTSWDTRGSL

SEQ ID NO: 1001173 - protein, 461 aa, Homo sapiens
MDALIAKQLTKNARERESCNDVTSRLKASMLGIRNADWFQGLCILLALLETSIENACSWDELHRGFAERDRTSRSRWLQHVERFALETGNSADMGLGTNEPTDASAPVSSNVSNVTSCRRSALTHRCVTVPSVSTTTMKNRLSRWGPGGALFINSGMATMCVTMSLKEKRLGTYGNASSIEQIDLAGSKLTMCSHHGQGPSWYTVSGSNTGVRLSYVRMCICMLKRPWFTEFPMMASRSAIRTHGVYEGKGTASVNEGTVYEWPTNEGVAFHSLGHPAYTHEGQVVDPAYSPCRKRCTGGGELHAVILTDETDGSLTLRLKKHVTHINLCNIQIDKVDGSTVIWDVKGNETKEDKAPVERKRRQRTNPTIEGHRQEVQRVKHHEGKETRTDARGKGNKPGDSKGTGMHKDGPQGRIKKRGHRNSAERRPGAMNKRTQQRQKRKPRVQEQTPIVRKIQQGGE

SEQ ID NO: 1001174 - protein, 373 aa, Homo sapiens
MSGNRALAVPGQCGNQLGAKFWEVTADEHWHLTPQGTYHGDSDLQLELHHTCTTMRPPGWKYSAPRRARGSGARAPWTPVRSGAFGQIFRPDNIRFLVRRGCWEQLGQGALHRRRRSWWTRMLDVVEKGGLTSCDCLTEVSSLTTLPWSAAETGSGDGYTSRRSREKSPADGKITPERGKQCNNGKREERDRSARKKREEQKREGKDHRKANPYQKARKGIAKKTRSRKKTNRALAVNRKDIPTTEKDRVRENHQKTNGHNDTNTIGSGQRNKTETKRPNQRRGGSTKTVGRESGEKGDEADTVAKDPWRRTSGGDEKQRGAEKTPGDGKNNVYGHHGNMEPRENKRREATTEKEKSGGKERRGQQRQKRRRA

SEQ ID NO: 1001175 - protein, 415 aa, Homo sapiens
VKTGHSARDHMRQPVPLETCRVHSDCATRVVTAHWLQCSLPGKSSHLRARPVTDLISTIGIGSDARLTAAFSRGGLLDRGAPWGAQVIAAYACCSYPQRILIAFHRRKTFVFRIHPMSGYIARLTYRRMSAIVVVYRCMRAALDCMGTQYIRFPFSFKRNVHARSHPCAEGPGTRPVDRMQSWQSRVAECLWTLAAVACLWLHVSSAWVYAKTLIPFNGVDITWGYPMRDTYVTAASQIPKAQVIFSCMRPSKAQLRGASRGGQGRTTPLCNERKGATYYGPRTFVAQPRRLQQRKPRGMGDGSPKILKWLVRITQRGQAAVASSAWRGHTRTKPKIGDPVSVGQHPFYTQIKTTAMRRQKGATKGPMGESSKGEATRATQAGKHGRYWRAEPRPWYGGGKRSWTHPPRNAPDST

SEQ ID NO: 1001176 - protein, 239 aa, Homo sapiens
MRVANREENEILPPDHLNGVKLEMAVHLKSRLPPGGRSLGERTMGWRYELRIAERSGESTEEACSGQSYCPEVECELTVKISCQGTMQAWIMDERRRGATSTRGQWRDETRHSFRCRWTRDGDRSRCRWRQSILRLKLSWGDVHRPVAGEGTGCRRPVRLQRRNSPCGTRNMTWNDRWQKPEGTAWIAHARTMPTRVEYLVGFVREVRRGILVGSASKPPTTRAGRGTCSGVQWGERSI

SEQ ID NO: 1001177 - protein, 250 aa, Homo sapiens
SGHATHRVGPVTFKTDKTFTTVARRKVHGDMLTRGHRARGFIDDLSRHQSSSLSVGGAGIPGDFLESHPVTVCSQQREGLSVDFDAHTRKDRQYLITTSSHDDLSNSPGENTSVNSARCCRHVRQIRILINRKGLKGKASRPAHQIHLGGVRRDLNRLVRQATSNISKQLARDKRFSRLVNLSGKGNSCAGLIVGGRHHHRVALSSHEQSSYNRHCRPVRQTASMPGNSFGHDIAFQTDSTASPGFGVSH

SEQ ID NO: 1001178 - protein, 225 aa, Homo sapiens
MRSCLQRTRRSRSERSTWWRVHERVKSLSVGGPHGRRSRTMRRRHGGSICKGGETNQRVTHSTGHPTCWMHPDVQYMRCDPLMNVLHNTPTRITQRIAYLSPAQTQLTHAHRPQVQSDEQAIWSSLRTDVIDHQYQCQSLGTRRRLVGMCPYRGKLVCVDWPTEVSTSNQSYPSRLLGRLPKCLWDKVHPLRLNVEAQLVMAYPVIPRWTTVVKCVDPDRACSRQ

SEQ ID NO: 1001179 - protein, 251 aa, Homo sapiens
GFTGFPRGSGKKNPGFLACPPRVVKKEFRPLKRGKLSNHFLSKQRVHRKYKNAASKRGGGPVPFTWVDLVTLPACAQSGQRLSKCGCSRRATKKSPGDPTCVEKTQRRGGSLRLIERRRKISSPNGVVGTPRARREKIREKGFVETDSPPLRGGGVELSSAGGWSVFPAESVCSPVWWRHSNFLKQTKEVVEIRNTRFKPPENRGGDKQRGDSGGEKARCRVTHTAKTTREGGPPPTKTSGGAQRGDNTPP

SEQ ID NO: 1001180 - protein, 240 aa, Homo sapiens
HKLCSIMVRQEQRPELPVDPLAAAPSAMAAAAAMAITPAVELVSTLVRVCSIPHQGPLREEMKSSPVNVDRSRIALMVVEPSSFEKVGRAEGTMRAGMLVRRFAPRQRECGSVATLTGLAIRSRSSLPHHSLVVRPPVGLLPCREPNLPPRHHDSLNFHPYEYIYPGVTNRGCPRGVTVQCAGYTARDCEVARGGTPESCEPCFPSDQTGGREKATWEHEDAYGPLKTIRYIFCVPRAYE

SEQ ID NO: 1001181 - protein, 103 aa, Homo sapiens
MGAGPKALSRRVKVFFKLVQHGRWVHEATPCQGRRCFKTEKKLGLGRYEGSFVLHYGKANLRVFFQKVGCLTTPGTEIFGWRGRDGKSVGRNRKPSKCVAQRG

SEQ ID NO: 1001182 - protein, 493 aa, Homo sapiens
ADLVLSGSAAVSRLTQSVPAEPYVPRPVLARCCLVGRSLVPEVGTSFVEEGGDSLELETVWESLRCVLVYSVGRYVYKTIAGSLAVGVACHDGGRSWVSLHELSYVWSHALSGDDCLALRSWIEEGIGRTKRMRDFQVLGALKNLYRDAKGRRGKSMPCGISSRKEMTSTNVAVIAGDTIVIEERTSVVLVLLGAPRHEPHGDMGASRCTILSGISLVRRSEATFSVRLIARGTYNDCVLGTSPGKSGGRRSLLRNSMEWCDPGSGRPVITGCLFTFSLYCDDRVTGARSLVPRFWPRGALGPFLRSIGVAARAPLGTCVSLRHNLARVFSQDGRGIRVDSDFGGWVRRPPGWAALVCGSRREEFPRYGPGPGEFRLGGVELLGERIRGEGGQSCFATDHLRWFEITRAIDRVWRDLNALAFAGTTSYTIHPHKGKSPVEKQRRFREPCASTNFFGGHRLENATIVCSIRSPEALVEKAAFTPFVKPYKVCVA

SEQ ID NO: 1001183 - protein, 254 aa, Homo sapiens
APASARRGGRSGEAAAAAGIRRSHVVRSPTGVCSGESRSFMVGTCRGTLAEVALVCILELENIPPASMPTVDGKRGPSYLPNIGYQAGLVMWPGFSAAGHKLSGAMVMSQHPLSEQVEKLKEVAGLPDDVVLYAERLAVLVLLNLYLSICRKQRWTKEDLELINKWAFQGERMIHGKPLREWTMLSVPGEEPSDSITGRFQSLTRSPGLQILVTNTKSLAIPGPCGWRQKQAAHVPSRSWPHPEARVDGHLLGV

SEQ ID NO: 1001184 - protein, 307 aa, Homo sapiens
GRRRPASVRCSNCSTRQCRYMSARWNLSCHCLWLLKTNLVTSSRSRWCGVTCRVRTAVHCVCSSWLTVGAYWSSVYACSSSRSGPFLLSCGFFIVRAFILVAVAVGLRSHTSVFDQLRKLPDVKSPEFKLKAKESSRRSRDCLPQKAEPPIDCKLVVGSSLYNPIPCPFKGFRSMGRPSRFGGVEEFRISFKLVTLLTYVQKVKRTYAYTQRNVRCRHSLSIEKVMVIADIANVRPPMRREICCDPNKVGRYTHRWERTTGKEETLAAQGIYPKQLSYILTVIEKKYANPRVRKGGRQTTRLFSSGS

SEQ ID NO: 1001185 - protein, 53 aa, Homo sapiens
AAWVPYSCDASIYPCDLSYYSPNLLQAFRFVKQTRLTGLAVTSSSSFFTHGNI

SEQ ID NO: 1001186 - protein, 184 aa, Homo sapiens
MVGGQTSMEPNADCCLPVAGVERHFRYQMALLAISALSSRQNLYVTEGCHMSCIAPEISLEGFIDSLIVTLQNVIPIRRSTILAVRTTVSDPGNRDGLPPWCAFADTKASEMVMMWPILQQMVEWSVCALMEERVGERRYPTPRRKAHGLSRNKVERDKGTRSTSITNVTGELTGKQLGYSDRA

SEQ ID NO: 1001187 - protein, 152 aa, Homo sapiens
MEDLDQSPLGLCPRTSPSRRARPSFKYHFREASPRTRDGRPMDGREEDDEEMKTIVGSGAGAMSSRIARVGDPGGPHDVVLRRFAGGPVAARGPEELSQFAVYKCLFLVQGLVVIAREDNSSLIRHVFPPVGIAQVAPGAGSSLGSAPRSRA

SEQ ID NO: 1001188 - protein, 87 aa, Homo sapiens
MSSSREVPAPEDPASWLLRVNGNSGRQYTGIKKGGVSRTITSYFMFSPVAPTRDFRGLPTCTPGYNLNTAWSGFRTLIGAEAEEDWK

SEQ ID NO: 1001189 - protein, 91 aa, Homo sapiens
MPTRRQGRVDPSTSAPKRVPQSFVRIPKPKIRQNRFGGCLSLELGGEKAARKGPESFSPVRRRKIPVPRRGVPGGRIGEEPKFQTYSGGID

SEQ ID NO: 1001190 - protein, 286 aa, Homo sapiens
VPHYAEADIVTLQAVTGGNTYAVPSNCPQVQSGMGPPVVDLPLDLDSRFTRSKLVEGQFGEVHLCAVSTRRLKIYGLRLRFPHLNVRYRDYPLLVAVTILRSDATQRSCQGQMIYPSKSRLQRIHVAGLEGTQTIIRRLLGALVSLQRNESPLLAVRINLEINVSKDTGENAFETQRFPHQVGRQPKCLENGTKIGQMPQNGLVGPPFVRGTVVRSGPLAAKEGPPLAQFRETDIPQNMLWRWQIGSGQGARTGIPVPPRGALCAPYFLRDTSKSSTWSLGSNPGE

SEQ ID NO: 1001191 - protein, 272 aa, Homo sapiens
MPWSYKPSPFTPVDCIATGCRIYSEAACTSCGSSSVVHVEGLPQASYRVSASRCGQTSPSLECVPTGMKDHVMHVMLRGIKALLPLRSLACARSSISSSYLQTGDMKQMRRKAGALDGPTSLHDTGPSVVRRKLGDKGVISVATKTRSSLIESPRGGKVGETQGSRESDLIHWGRILLSHGTPMTEGNEGLNFDSKPNTTSHGQPEIPLAQFCRNKSRVWADTARSPSVLRLSLTVESDSVQKFAPMNYSLNVGVHPLKNRNFAPIHVSDHV

SEQ ID NO: 1001192 - protein, 179 aa, Homo sapiens
MTAALIAPRTLLEASLFSRAKRCALSWHTMITCESEDRMDRRVDASGTVDVAEETKTQRAQRFERDALEYLDQLYGAALRMTRNPADAEDVVQEAYAKAFSSFHQFRPGTNLKAWLYRILTNTYINSYRKAQRRPQTSDDQDVEDWQIAKAASHDSNGLRSAELEALDGLPDQQILDAL

SEQ ID NO: 1001193 - protein, 199 aa, Homo sapiens
MHCVAGRRRGAGGAQDNFSHGRGLASSQRSFLPITHTGGRKGAQCSPLRSVVSYQDAHMHFVDDKCFHEGRLESSDGSAFPLSRERVCVTTSKDVGFLPQEVRARYNAYNIQGGLFNHTRGSPAGCETQKSLGDTGAGFDEGVGESYSDASSAFHYLFPKSTQFFRNHMCCDGPACSFKSTFTRRRGQQAEAFHGRPQC

SEQ ID NO: 1001194 - protein, 121 aa, Homo sapiens
MLNVHAKDQVFTKNHGHEAKLGKDFTEGNDAVKVEEAKSVCTDMHSMDVPGIERHSDTTLLARCSIEEDAKEYLRGTFPGLEGNLDTREESPLRRSASWRHLFESRGCAKITKRLCGCNLS

SEQ ID NO: 1001195 - protein, 433 aa, Homo sapiens
GVQVPVQGASDPADRWRWQREDTRSGCDRPGAPFRAPVAACRWCYGDACGRTMKGGSPKGRGLALTAPDRGDEKGKEKQAGKRKEKGEKTEKRRRTKGEPKSRCTVRHNKRGKNNKNGPAANRGREKRKERKAETQRSKRKEKDKRRNEHTRETRADTNITEEEETQNKTTGKEKGKTNQRRGNRTKREKRSKERAREERAGRRPPRERRTATGIEQQNETPTTKAPTERAKADNQPNTTTPHTTHTTHKEDKQQNREPRKKTERQRQDAKNTRRRKKNRKNNQGRDQTEEDNRPHKRENQHTHTTEGTEGKRRKKRGENKRGGKQTRKTREKKKGQASKKEEENRRDQTEGENEKETEKRERAKTSDTEEANRKREEKRQKEKTANEGSKKQRDGQQEKRDEEENQHATAATQRTANNTKRKARKKHNRQQE

SEQ ID NO: 1001196 - protein, 143 aa, Homo sapiens
MKETTVPISGWAHRSALFGLIDQRGLSCIPCVMALIRAVIPMMLSLIPFGCAFPRYASCVSPSALVFKPFPQGALEQFLCEAEQLGPPVDVGRNRIGDPTLLGSPFTHSDYGNETIPKVYLEEHPQEFATLENGIQGEVNRNS

SEQ ID NO: 1001197 - protein, 85 aa, Homo sapiens
VLDDLARMRLGGRYQRLGGSYMWSAHSIFPADIILAPGTPETLKIVLVQSPSCLLMPRGYATLDSRPVDLASSLEADGPYKRLAR

SEQ ID NO: 1001198 - protein, 153 aa, Homo sapiens
MCQAVELGDSRFGGICQPFSTVDMSTREEQSPERQTDFKQLGTSQSTEKVDGDTQTTVEKRWLSTVTLVGTHSRGLTEPFGFIGGIIVRVMRNNVGKGYRPKELKGYALVTNVLKKKTVLDLCTVPELVGKMTRGPIGWPIRIHGGTLRCQNN

SEQ ID NO: 1001199 - protein, 184 aa, Homo sapiens
AASIRSSAVPSPLWTSTIPSVEASFGSVMGAYQTIFTVFANVHSMVTDPATRQSVTSQKNHSVCCGCDEGVCQGCIYRAIGAPLGKKNGLSMAFVTQVKRVCFEWTYRRCHRTKLVLEVTWSGGRAFHGLTLPNPQYTWNGPGPSGLRYPVRPSITHQQERTMQLIVKRAEEKFDWRELKISVK

SEQ ID NO: 1001200 - protein, 158 aa, Homo sapiens
MRAPRTREWKKVHGLRTHPTTTVCKYRDLSQWLHNVTCVETKSSLGNEKHHGGSGPVRTSRDDPGDTHHCEVFALLTPGRGGYPLGARREGAHEKLTLHSERRRRTLATFIWARGRSATIKEFVDPRKELQWSHTTTMSCVADKQWTGTLADERDTVC

SEQ ID NO: 1001201 - protein, 206 aa, Homo sapiens
YKVQFPYNDPNFPCKGRVQAARVSGKRVFTLKILPGYEGLAHMCVEGPLPRKSTSRTSVVGLLVCQDPVFRRVVFVTRSSTVPIVDFRGKRQASRGLEKEPENSEKSGAVLCGGSPKERDCTTVAGKARILLLSEVVFPRIRCGKHFSECVLREMGGGLYEEASEGEVPFEGKSPKIICERFTQQGDNRDAAPFLIKSVAPRRENI

SEQ ID NO: 1001202 - protein, 132 aa, Homo sapiens
MERADFLCRPTSRCMCCREQAAGSKSCGVEGWACDVGQELGNVPDSPRALSRWYCGSRAVPFNVSIGRRPGRRTDDQCIQAVPMGGQSVHYSLRYGTEVLDETIRTKIDWNFWMAVADALPGTPKLAKLLNP

SEQ ID NO: 1001203 - protein, 105 aa, Homo sapiens
MVAQGEPQVHVQDLYWSGDGGTGQNDLRDRQSMMTGRIETNEVMSADRLGGEEGSIPVVGSHDSDETDAMSAVKCYLRDHSARSEGRNSVRGEDMEWNGPYCSSR

SEQ ID NO: 1001204 - protein, 70 aa, Homo sapiens
RRRTVELLWARPVCGAWSSGTPTSQRDILLAMLWRTISKGPHCWTPWMVGYARMTALEWDAGQQRYCCMH

SEQ ID NO: 1001205 - protein, 209 aa, Homo sapiens
GFLRDARQAEGVLSSQEYVLSHTEMPGTLQAADAAIKKLEELHMMGQEKAKDELSAQAEVKKHQVLEQALADYAQLVSEGNIHADKIREKADSIERRHKKNQDAAQQFLGRLRDNREQQHFLQDCHELKLWIDEKMLTAQDVSYDEARNLHTKWQKHQAFMAELAANKDWLDKVDKEGRELTLEKPELKALVSEKLRDLHRRWDELESS

SEQ ID NO: 1001206 - protein, 196 aa, Homo sapiens
MSFSRLASRMRHPPKSSDFLRYGTVAWLDRRNSVCTCVRVPLTWARDPRDQARIGKAEAKERPPLARNVFRPGGHSYGGGATNANARTKGGTGQTGGLTQPKKDEPKKLPPDGRPEPKPGHPPQTREATARTVTPKGQLPGGKAPPKAGSWPQLLPADEGQGARAPREPKSRFATRDRPRSKLLYVYRTLTMLEER

SEQ ID NO: 1001207 - protein, 235 aa, Homo sapiens
APISDHPECFVPYTIGSCATQREGMRASTGVFSNAHGMRGATHGGRPRIVSPCRPRQLVKPVDDYLRNVCRCTHRMKRRLLLMSLFSVIIVLRERSHSWPALYIIADGPHMWLGLIRGLMEVHYSLHKYVKGGSKWNVVIEHLCLCCACCEKRPSSRALDGEGTKHGILVLGRLVCLKCSEWIRACSSRPDKVEESSRIGDMGLHGMYIDSYDQISTSWQYIVLKRDIPEKKDNL

SEQ ID NO: 1001208 - protein, 355 aa, Homo sapiens
QDGGTCSAGVELFYDVAVAHKSWVGFGDPVPVSGISGKHQSLLGVLAVPGLNKHGDHSENDQSENREPYSRFQLTRDEEGHIAMAKNDVTVSCRQRYSRLTPSTTFCANGTVLARDVMGIVQNVRGISRGTWRYSLNRAHDIVCDVNLQKYLCVERNGVTGSYVRLVAYHDVYRGIVKWIHYSRKPYTKASHGGRPAWQKGPGISVMTDTNGPTWDLRVRRGLRLDPSLEGVNETPRLYNGKHPTGKRRALAKTNGEALGGAGPTYKRLGASGERMRDKTAQLWVEYVGILDPGLGARRRLSDGDRDFVRKTRVERGSPVNERILNARVKIGPRLFHTECWPPPKWKGQIPRIRV

SEQ ID NO: 1001209 - protein, 388 aa, Homo sapiens
MSHLLLRRQPSHIAQTPWEKVEGRSQRIWSYGAPGHLGLLLNSILVTVDIDAIKDPLSVDLQAILVACTCLPSIDAYHMDTIPLDTCHRHEQLGSICHSNGTSHSPVFQRARSLTIKVRAYAWTTDVRLVRCPAWTSSTHAWRMVLEGSCCKWSGRPTEVVIHTTDPPLSRCTAIVAPWDDERNDEVMNNQSSEDAIRQMAVLHPATVVSTPGQGHPMTSLEKSWNGLMTHRSMPIHCIQEELVDGPSGKRVAVMAAGHLQSIIPDFYWRCKGWWARFIPELKRKLTWHWPSVSPTATLSVVDLNLRLEKLGKYDDIQEGGEAGRRRAPSGIPGYNWSTRGPSDFTAKPSLHLDAGLDGPQDHWQRTRMNTMVTNKWGPAKGPENRTS

SEQ ID NO: 1001210 - protein, 249 aa, Homo sapiens
VAVGRVILEHEEWAPGSRVRRGTLMTPYQALRAWAAGISECSRPSVTSPMGNQLPGRSSDEPRIARAARVARGLCSFSEESQLSEASKRALESCSISRPVRFACISRARSLMFLDGERKVSGSDQLAKLCLLLMCELTEHGGVPNSVMHVPEGRTDLEESVGIYCARGALGGTLLPFAFNASPSRHPVGPEQSSHDGGKDSSHSRSTHRNGIFVPVDSAKQDSVVRSVVLEMGFSDEVVASTFPLTESW

SEQ ID NO: 1001211 - protein, 194 aa, Homo sapiens
MCKIFNVNRVVYTKGLSNLTAAGTIEVLTGGGGLATLMLDVGSQAPSVKAGADLRPKWLPPPSPVSRRQRLAAHQKQLLSVPRHPGQPQPPVTGGVLQGKCQGQKPRLLHAGLFPCGAGPPQWPSNVLLVRQSSGKSWPETGVLANASSPCSPVPGSGPSSRGCFSRAGGFTRSPSPRLSGCLKFSGAISSGFG

SEQ ID NO: 1001212 - protein, 246 aa, Homo sapiens
GHRGRLWLHARDADEGIVEAFLAGAVTSVSLLVNGAATVETRRSLARYGDSIPTGPPRQPVRGPPRVGSGAAVAPLIACVGPRKASSLGKMGIPGGRLADGDCGFASGADAASYRRMARRGPAMSSARRVREELRGPTKLLPGAAGQGPRGTRTGTSERARAPRRVPGVRRGAARPYGVRVYATCRVERGVGGCMLAGGPPRVLRLRAWSCDARADVGPFSARAAGGQTPRVLALAAGQVPFPVFG

SEQ ID NO: 1001213 - protein, 315 aa, Homo sapiens
GPVAGACDGGTRTRTRAPGWVSSPRRRQHVAPICLKYLCVLPYRLLAILAGLSHGMSWTVEQSVTAGPSRSDIHRVLAWRSVHSYLADSPTSLGVARWHMLRYTGYDLRGSLWLACAKRIRTGRGLEALHAAHVAFILCCPQSILFLRGRSIAWLSLGRTHYLASKHETLERQMETPARTSSDQSAIDQLGAMQDCDSAQCGRSCASKEIPAAVASHNSQDWRRHVKWNPLTSEVPWPVWSQTRLHAKTVDGSIDGQAKSMPPKIYKVAGECITKLENFIQEQRRVIGAVGSALLCAGLEMISSAAVHESQVEHY

SEQ ID NO: 1001214 - protein, 153 aa, Homo sapiens
MSLLTGAVPGPSGPRVTAGGTLRVLAAVPRGFTAAERAVVHVKRSDVTQPVPVPAGQCVMSRGYLHVPHVLRPGFVAHLGSHRSCSAGSCSFLRRASNWCQEERLREQNLRALELEPLEVEGTLAGSPPGPGAASQHQTDSAWRRRLTRTRHR

SEQ ID NO: 1001215 - protein, 339 aa, Homo sapiens
MARFKKNKTKTFRNCPQPHAYLPLPSDLEMGLTIMPNPSFPQRLVATGWMKRDSTKRGRSQEKPLDSTVGSRGKTRGWQRWTWTTAAGGEHRRHDTDKEKKDTDAQDTSPNLIGQSNCHPPRTKQITTARDRAIHDSDERGAKKGEAQHKMRQTQRAHEKHRTQRPPTDIRSEQAPPKHTPERQHGEQHKRPPTEPHNGINKSTNAPHDKKRAAQGHVNTTHKLRPTRRTPNEAGTKICRMSPKRMKRTHTHRETANQQTTDYNEPNTETTTQQTNRPIKQATNAEIRTRNEHQRTTKHRQTGKRQKETPDTRQTPKHTDAEKDTAKNKQQHHTPHQKQ

SEQ ID NO: 1001216 - protein, 351 aa, Homo sapiens
MVGPEYRYSDARLGSVVEPRNMSPTVDIERREVADRRAWRWADLQGPSVDRRLNRVSRSGCLCRDLERVKCYFLCEELNVSGTHTQCLYSVQLAIPQRMKRPMRAMLGMDNLLEVSLQKNCAQHNCIRAKMAGRGHSHMDAPVRRIRKYQVDEACRMRRLALNADRVVNGHIGGEVTMRDIRYLSSRWDGGDNNPHRALDSVALGKGNFATGLGIAGLSTRCTSSPNARWLTGFSMGFAADYSAPDEVHTSGDTLKASTTGSRLQGARFMVHEAADEVNEELALWSARDIACHPSPLISTKRVVAGWTNPGVPSRELACFLQGWLVNSRGDQLKNFAGLNCPRVGRYCGHR

SEQ ID NO: 1001217 - protein, 31 aa, Homo sapiens
MGEHTEVLKGSCRSFLASTIPVPEPQILIDG

SEQ ID NO: 1001218 - protein, 146 aa, Homo sapiens
MWAHFSSPKGPNEAKSGVCKALLNLKRAPGTLYLPLEKCSVRTKTCGALCTSGRGFSLSLFFQEGGFSSPANSQFPDIPFTTREHSAARGVCFPQRGAPQRGKERPPKTPGWGFFPEKSLPQRQHKMWAKFLRVLGRPHKSREEQI

SEQ ID NO: 1001219 - protein, 265 aa, Homo sapiens
MSGNAQWGPMSNIVHHRESDGKVGVALPREIEREESAFATPSPLTRKRSGVDTILPYLLSVEQNSNQTHLQYLGLATVMLLAGDRMDQDRQRPNPLGCNALGTGPVELTMSCYRPLLVSNAPRTRWATCKGLAVVRRPELSMVPCPLRGGPSEGNGNLTKLVPFSSYVGNYMRPAEVAGPVMWAPERPVNHQSEGINGDHSGTPTWFGIGPDPHLSTRRAIPVVQTHSFGVMHCPTRLCSPIHVMATRVIEHNRVFAASWFNPGG

SEQ ID NO: 1001220 - protein, 114 aa, Homo sapiens
RGMRSRPSCCRSWKETHRFIEAARAQGTHVLVHCKMWRQPLSGHPVLAYAMKQYEMLVWMQALLPLCRSFSAQSPCLRTLAFLRQLQIIPGLVLTAEAAIAMSGSRNVGGVSPE

SEQ ID NO: 1001221 - protein, 330 aa, Homo sapiens
MTGGNALLHRKHKQQQTTQTGESRTKQKSNSKQQKPRDERESTTKQNHKTQATEETSETEDRHKDDKKKDRRREKEPQGSEQRSSREAEEKEKKARSTEHSEARTGDRKLKQKPTSTGDTTKRKEDKESKTERREQQQGKKERRPRTKENSNEEHKRTEHKDKTSKEQKRHRADEPRGRRETSKQGRSKDEGGKREEDEQETRGREGRRETKRETNKTDHPENTERKKRKNEKGSEPRPKKTPAQQTQEQEGNTGKKRGNKRKQEESRHKTHDRKETRDKEKSTHRNRRTEREARKKERQEHHTQTQKHTATKPNREENTTHKNDREQTG

SEQ ID NO: 1001222 - protein, 218 aa, Homo sapiens
MLCMNAFPGQMAEREARQGLESRGVVRDWCHNLTVSRCSPECPWTLKDHERKDPHPKGLRGMPYVDTNGATMVGSIQQATGTRRLGHIVRQSMANVRCSKMVLGEAPLLTLGWGLTLRGPCPKGPPNDECITPCARPTFEPSVSRFSQRTGPMSPGSMAIIAFQAPRWANGCARFPVVPRRSAILSCCRKEAFRWAPLRLFFHPFFWVKSRAPFPLCR

SEQ ID NO: 1001223 - protein, 101 aa, Homo sapiens
MREYTFIKEAKRETQEAAKGTRRPPQKQKNARPSYPAGAKDSLSSQEGEADPERYQRQHRGAPTTREQNNHRHWSGHVNQHKKGGIKEVATTWRTGDPGKT

SEQ ID NO: 1001224 - protein, 294 aa, Homo sapiens
SARRTLLLLLLLLLLGLMHCASAAMFMVKNGNGTACIMANFSAAFSVNYDTKSGPKNMTILHLPITIATSCVTSSQHASMMATQSNDITRTTELYARLAIRETGHTLTLNFTRNATRYSVQLMSPVHNLSDTHLLPNASSKEIKTVELYNYIRADIDKNYRCVSGTQVHMTNVTVTLHDATIQAYLSNSSFSTGQTRCEQDRPYPTTAHPAPPSPLAHHPGPKSPSVNQYNVSRHQRQPACRTSTGAATRTSPYQRKDNKTATKDNQPEKPHKTPTTKRKQPEPTPGDTQNNCT

SEQ ID NO: 1001225 - protein, 143 aa, Homo sapiens
VSSVHRCHGVLCVYHRAVMEPTYQLFVRDGSLQPVLRQKSCRGMIWLVWAPYMCPMGSTGLSCVLSMPLSLSRSGTLGHTRKLHIVNCWCEVHRSGGHSLILTSWPWSLLTSRMWGCHAVQGLCGWLASRSLNSDISEAVCLT

SEQ ID NO: 1001226 - protein, 227 aa, Homo sapiens
MGTRKIDKYVGCCSRACRTSLGARLSGLVTVSHEVDPFRNMTAPDHSFLLDESGVADYREHLLSRMHVATALTVRVSICLYGALSSRTRGDANRCKEVPDVLRHHRALDLVENGPGGDCSEQSKERAWDKSLAGWKGDGRYQDICRIKRYVVESRVNSDRRRLANGHEFFVPMTPEDDDSNGIGEWTRIYPNSHGIGKLNSQSTPKEMITLLKMLIDLLPRRDKDLT

SEQ ID NO: 1001227 - protein, 315 aa, Homo sapiens
GGRSHEYAQASERGSHSSVLRCESMKIGLVKTPMRTNEICQLPTSRQHQSRIASVLGDHVVVIIQLKVAVIRCQFPVARIAVRNQHLARPDRAGTMRTLGIHCEQGVIMLEMSPIVTHKKVSPIGSLGDEVKCTFVAPLLLMKDYRDHLTKHRTRPENRLFIHERKAKHLEHGLGNGGDTGLLCERKRKEREIWRAIEERGTNFHHKEVGHGPEKNHEGFSPSHMDTPCACVSWNPRDRWDVATADKAFVKTECPIAGTGPPGPTRPAAGWKRDRAVPIPNGGRTTEKRRDGGGKSKSDKRKPFLISLKGAQGKM

SEQ ID NO: 1001228 - protein, 69 aa, Homo sapiens
VHGDQVFITDWKSFCKGYDPAPGEDYMRSAIETLLSAPSETQSVIAVNLDVDATTNSRRFRIADLLFTA

SEQ ID NO: 1001229 - protein, 67 aa, Homo sapiens
RFFWSRRHRRIAYHMCAINKRISNRTGKEWHGSRLPHNKCFARDCTNEFQNMSSVELYGRNRNLLST

SEQ ID NO: 1001230 - protein, 220 aa, Homo sapiens
MMPSTQEGALVCEIRSVHRSSSVGPFEMCGDNARKHIIVKNSLSKDRGSHRWAAVVALHTAAIKKTEGSIELTERLSFLCPPIGGYTCLRRHYSTAEWCTIPADIGRAMYVAQLGQYALGCVRTLATRPPKERKSVHKTGNEAFGSHVISRPAIETAICAASHCVATHHIGNDGLPSIPLRTNRLGEYDQRRNDAAKGERSVQFPENYHAVQLHRSRPPE

SEQ ID NO: 1001231 - protein, 71 aa, Homo sapiens
ARLSLFVSLAAHCAGWAQSLSLSQRGAAVSRRVQTESGGSVIHRPFPRQSAHKYQLRLLSDLATNSRLVGH

SEQ ID NO: 1001232 - protein, 205 aa, Homo sapiens
MGPLMVGPLVRRKMNRFQFTFGLVSKLGGFPPAHFLIAQFQREHESGNGKPSLNGLVVCGSKCSQNPGLELIRSRGLWIGALILKNGVCCLGPLFWGGDQVPPTKGPSKKWYECTPLEKPAINRRRRALWLIRCPDAACAEGDKHMQGGYIAAPGWWGHTVWVLSSKVAMVIIARCVTHRGFYLLLCVTRKRRWCYETLPCGVLH

SEQ ID NO: 1001233 - protein, 143 aa, Homo sapiens
MHAEELGSKLRLAAHRDAPTTLIHYPAQASCNDRGHVRWRQAQRGPAAMDGEGEADAMLADDWEPQSHSIDAWTHRCPGKSVPAVQTPPAGSKISVDRSKGFQLVQDRQVNYRALGTFARGLARLSSLSQRAWGQICDIGASL

SEQ ID NO: 1001234 - protein, 82 aa, Homo sapiens
GGYVLHTGPCCPLRPPGDGTHDASGESHNQGTISRGRFVRAIINGFCLMYEPASFMELTRHDLFYSCSLPRIKYSIHKTIGR

SEQ ID NO: 1001235 - protein, 143 aa, Homo sapiens
LRLEMIDPRDSIVSSPGILIRLLGDIEETANFYFDPPKVPYWSRLVQRGLTIVCLYYIRITRLICDLCHMLDLKGELKLLITRVPEETPIHELSLCAPAKAQANASPWGQCITARQNGVNCRCLAQNKTDPEHVRKGTTTVAP

SEQ ID NO: 1001236 - protein, 108 aa, Homo sapiens
KQVCHDIHECKLMATMVAVNQTSICTNTVGYFTSVCPLTSPGVFLGNQIQGCLPGLGSCHHGTQEPTVPMTDIALHHLSSLELQVSADDPDQMTLAGLRRRADNRDIC

SEQ ID NO: 1001237 - protein, 173 aa, Homo sapiens
PGLRGAVAVSSLRRYGVVLDPLTIGVTPREGGVHLAKMSTLPACYSRPSLFEPDIVKLCFDYATCAKKTNRRARIAGGGHLARLHRVLDDDALGWLLVRRLLCLETCPKHGSDGLRVCTSSSCWSMRVLIGDTTVFVVRDRYCFAIAKHIILWAARFGNSDKASGDLAYGSTR

SEQ ID NO: 1001238 - protein, 297 aa, Homo sapiens
MTFPLSSTSLLLRMRRCIGWSGIAFPRAGCLNKSPVAACMDARIASHTCPYVKKDASEVATSRIELFGTVKDDLSIYWSTRRHLSVHVRHLPAVTSAERELQQIRDETMVNDHEISVESKHQTLQGLAFPLQPEAQRALQQLKQKMVNYIQMKLDLERETIELVHTEPTDCGPDALPGAPRCCPLATFFLYKHTHEGDPLSLSVFIYSMPGYKCSIKERMLYSILQEASSSDSVEQEFPSGDRPETLGGLADGAELTGKDPSYDEGAPKANGLQAGLLAKAKGAQGGKRCHKRSSRV

SEQ ID NO: 1001239 - protein, 105 aa, Homo sapiens
ARQHGPRSQPNTVKKAARVIYEETYYTRLEQAGSSSTNKARVSREIRHYSPPTKLREAMHSKVTVIVTRDRRRYFRTKAQAIDGILPINAAMDGGRREMRGRSTY

SEQ ID NO: 1001240 - protein, 189 aa, Homo sapiens
GRLGPCTRILNRLEGLQGSHRCSVQRRHRSACSPAPFRPLPFWLKVQAAAPAISRDNIVPARSKVPSPILARVTEWIAVVFEKHSGHMSHSYCAASAGSCVCEVLRDAQQSPGGRQWRLSLCLIPDIVDPSWPYTWCCYRRPCGSYVNLQSKRLVPTMNTVATGNWEHVDGGHFLGGRSRSAIALTLVH

SEQ ID NO: 1001241 - protein, 354 aa, Homo sapiens
ANMEPRSHPKPCKKAALLVIDIKVTSTRLGNDFHTNNARVRGWSSITSPSAKHSSDRTKPGYAHRTLYEANSESVPDKMVSSDPLLQDARQRKAESPIMFLRVVSPWHHEPVTREIASLTGDGNSCNAYLNLRAGLMHLGQGLPQARKPIRDWRSSRIRPFGGPSLLELCFLVTCLLIDFSCRLSWGQITLRTNTSQVTRHKLRTHCQWTLVCCKGFLREMKCGFSRYMSRSQNVFVVDRLYHSCAHQSLWCISKTLWVDIFTCGHSPVIRQKAMYEDRRKEGSRMSPVDLLKPRGKTCYLTHHPTVGPPPTGLNLHLWNTGSLPTTMYVHPKSMMNCRTTIFTIATEITTLYT

SEQ ID NO: 1001242 - protein, 70 aa, Homo sapiens
DRDERELVVKDEYLTKTLQRCEERIVSSFKKDVDEAYNDKHRVDAGMSAALETGLEPEQRSDLSLMAHVY

SEQ ID NO: 1001243 - protein, 121 aa, Homo sapiens
GGGGSAGGFRLRGPAAAMILLRGEQPHHRGRRSRSRFENAAAGNKPEAVEVTICRFRWGPLSYFTVLSGAQIHKVMVSISLKFYIRNFRHMVLIELLKTGVPRTFLGKVQESGVHSVSCAI

SEQ ID NO: 1001244 - protein, 218 aa, Homo sapiens
MDSLSRNSSGASVRRRAFLMHACESASTFRSGAYLTILPQGQFRDCTHLPVSAPVASFLQCTRTDVIVICTFQGQMNRLTPSGLPGEPGSRVAQQPTHLVCTAHYCVEFSRMELVILVWAQRSSQKSALEVAEVGHGPRTLPAPHPLQSTEITSEEEPVAMWPLSGAPQCKGEDSPRKGWASAQTGLPEKAGDQVPGGQDSALVGPEDRGGQEHRGGT

SEQ ID NO: 1001245 - protein, 174 aa, Homo sapiens
VPHYPTTSSLWHCCLGLLLMVRFHVITISPEDAKGSVVKVNIVWRSLVGSSSYSSRASDAAHGIDEALSACGWWYGHDLVTCQSMALARTDSVCPLALAPGAGGQPRALPRGLRTWARAFMALHLVQRPSPYLRLYVASRGSVRSCSCIRPIGFPLSLPRGTHTRLVRLLCGCT

SEQ ID NO: 1001246 - protein, 106 aa, Homo sapiens
MAQKVTGIQRLVSLRGFKSRKGLTLSEDYPVVPLKRALQGGKRRDGNSKTNRKLNSQKVHIPTSSEVLYNLGNNPSKKQTCLHVLKGDTFHDNCWGTNPYIFLIKR

SEQ ID NO: 1001247 - protein, 100 aa, Homo sapiens
GKSHGGQGVGLKPAWGGFRFLLLLLCLEFYCYIRVLLSKCVWWLGVGGASPLLVSTSEVLVEGFSLLFRNFLAFSESAKGLFSQISFETFYYNILYVRVL

SEQ ID NO: 1001248 - protein, 206 aa, Homo sapiens
ENKGFLRNVVSGEHYRFVSMWMARTSYLAAFAIMVIFTLSVSMLLRYSHHQIFVFIAPLLTVILALVGEDPHSVLRPSCEKLALVKKAVDSARSCIVFEGIMSDFFNDTTISFYIILIVWLADQYDAICCHTSNSKRHWLRFFYSLAFAFYAYHYRFNGQYSSLGLVTSWLFIQHSMIYFFQHYELAAILQQSQIQEMLLQATHWD

SEQ ID NO: 1001249 - protein, 399 aa, Homo sapiens
LDFLAVGVHPGGFFSLAWLGSQALSHGRRRLVPAWGWKRLDVCCLKGLAHGALGECSCLMTRSKRSEPGRGSSWAHDKSPTMPMTCIDSIAWKYGRFAFLTSPKNGLVAVLIPLALTLRWRKLILCVAHQLSHDACNESTFVHRADTYVTTGENPATNGTTMSLRSLAVGLSAGTCYKLLSLYALVFTNVDTVQIQPKIGCESVTRANGGTLTRDIGTCGLGSQRATRLLPTDEVPTAGRSAQCSVPNLLARRIDGVPTLSVHWDCPLSACGASGLYGRRDPLVAAGFPHHAFRIDLLRGSQRGRRCAVSFSLYVDAVIPVLKASGFPSWVRVVRCGLYAAFVYYQVRHVAFLVGPDGRCLVMPRYTQCFKRPVWYIVTMGRSPTDRVDVIDSAERYGR

SEQ ID NO: 1001250 - protein, 53 aa, Homo sapiens
MSGLFITLLGVGLGLWRGGAPRGFCDRLRFLSGVLISTHFCVVVVLGAVVVFN

SEQ ID NO: 1001251 - protein, 646 aa, Homo sapiens
GPRSKRNRTQVFPTIGIDFKIRTIELDGNADINTARTMGTQPASRTRLLATHSPTRPTYSGACHTAATHCLRSYRTTPPQPQQSSLSHDTTPANPGHSRHTTLTATPPAPSLPTTPLPHTPQLHYPLRATHHAACTACTLPPNARTPRSPPTAQTRAPTSKPTPCAPPSATLTRRPLPPASPPAPRNPTRARHTRPHNHFKLALRHTQLATFSPPNPPSLPPNATPLTSHTTAPPTTTCAHHHTTTTSPRTRGPKPHGTPPPNAGRETPKTPHSAPTPFPASPPPEPHPPAATPKPPQRQTPNPGTPRQAPMCFSLPQRNAGLGHLPFLPLGLGPRPGAPTPTAQGPPFFTPSPLPSPPPSRPPSHRAPSPSGLLATPLGPAPPRCPLSPFGTAALATRPPPHRLSLNTLSTRAPPAAAAAPPPSLRPPEPPPLLPSYGPVAPPPSRRVAPSLQPAGHPAVARAATVPAIHARPKRHLPPQNRGVRPPNNPPPNRPTHTLAAPHTRLSRPRPQTSPCRPLPANFSSRSHAPTTPLGAPPPRANPPRLLPLTPPTHPPSPPRAPRHTFARPPSPTPPLPHPPHPPPRRPPPPPPPFPPLAPPPPPLPLRPPAHTPPALPPRPPPRPPAPAPSRAHLLPSPPTRHSHR

SEQ ID NO: 1001252 - protein, 155 aa, Homo sapiens
VIRNKYECELQEAKQHLESEKLLLYDTLQEELFERIHVVLEEDRQSLVPQLCMVGRSKLARQEAAPWSWDSLPTMLRGRIAPLVSGPYIVYIASRDRHPGGLDSHQNMARAAVSPQEEKIGCDLDPAVHMSVGTLQSSLALHPGILWSSLLQTRR

SEQ ID NO: 1001253 - protein, 227 aa, Homo sapiens
MRSRTIIEWPRYVNRRMECGRGATHVRVARCRRVGSPRLMGTIVEFLSSQALPRRVHRKFRACLHAKGWMATRFLMMHCEHCCSHWACPRERSARSLAWRWRAHGPFGSPPGYGFGRGVYRPGLATYVPWGTQLVVGEAADHCPFGGNSWGPKGGGQRCLEIPRFLGATDLVPPILWLPVGKPPWFDVAHCLRVELHRPKGTSREFGPRKATYQGAKKAPINVQGIV

SEQ ID NO: 1001254 - protein, 114 aa, Homo sapiens
GRQNTGVVKTTPVSQNWDRNRIISAVVVHLDSVDYGQGPHYYWPSDLVKIAGGHSTKEPYAKTLEEGGVLRWERASFKVCLGSVDTTEPAESCNGGITMCISPGGRFETKQGTM

SEQ ID NO: 1001255 - protein, 323 aa, Homo sapiens
MDDPSLFSSPGGGGGPRGRGEQGRMDDPSVGPKIPQALDEDPARCNGEPPREGDELLSRRKRRMVTEQMARSSLGQSASETEEDTCVLYLINGERYPAMRRNRREEEKQPQLVCVGGWSSVESLGDRVEYDFNARSRGSDSPAADVEIEYVTEEPEIYEPNFIFFKRIFEAFKLTDDVKKETEKEPEKLDKLENSADPKKKGSEEEHKDSDDDSSDDEQEKKPESPKLSKKKLRRMNRFTVAATQAAGGSADVVEMHDVTAQDPKLLVQLKGTRNSCALCTPLVFKRNTCRQRGIEKPPFEPGRLHQSTGSKRITRPASNENR

SEQ ID NO: 1001256 - protein, 80 aa, Homo sapiens
GKGPARAEQCKMCDFTLINQTAVDSTESLPRCLTETRVMDKNPVNRPSVGDCDLKGPVVQESTSQTLDDAHMAPGETLEE

SEQ ID NO: 1001257 - protein, 143 aa, Homo sapiens
MLVVYPHAGFPRTVRSYRYWDAEKKTDWMLRGFLRWSGESDPEFSHGWPPRPVRMSTGMDPEIRSRWKPDAAVVTDRVAVPRSLTQTIRASVWKPGGEMRGALRYIGGLKASKFILGPSPFFQETFGVYNDKRRDLGWWLDKS

SEQ ID NO: 1001258 - protein, 168 aa, Homo sapiens
GRYGPGFGQPRLRAASSPASSAAVHAAELRPRKPEHHMQKTDMQDQKTNNDKKNQRHNTIKKERHNTVKINTTKKEKNKNKKTYNRQKNQENQRMTQQTSTTHNNQNKTHTKKEHIYQKTPKQDNKKHQANTTQNAIHEKKDKKNNKKNQKNTTNGHNKHRARHKKQN

SEQ ID NO: 1001259 - protein, 171 aa, Homo sapiens
GSPSWQWLMQLSNEYSPATCAYCRAMEMMRTPSIRRSYIQAASNIVTLMRGYVASEVSPCSFASGDMGGRVLVVSLEDTSSGLTLSLSIRSAPYVNHMLRRHHPFHGTFPHRNSEIVRRISSVVAFSIVLFPSWPSLAKEGMLVNRSSCSSNAPTRAHRFQVSFQMAEVAL

SEQ ID NO: 1001260 - protein, 290 aa, Homo sapiens
GPEACTGLPRLPPAMPAAPMPRALWLAHAPCVREGQADAPGEWRSWQCWTWLGGIEICITFPNEYVKTQLQLDERSAPACGTWGIGDCVRQTVLQTMDVLVPVPQAISITCIYVFHPQMDWTYRLGMFRVPQANTCGDAQWTAGQHCVGLLCWTGQLDCGQRTGGGLCDPMETIKVKVHPRPDLPKSTKYRGYFHGDKGDCAGNKELKGTEQGHNTRTRDKEDKGYERRHIQKKKRRPPLRQLGTRRGKQTKKREGKRAEYMRSDQEEEEERDKEEGNRHQMDDRETRGN

SEQ ID NO: 1001261 - protein, 147 aa, Homo sapiens
MPSVRTGTDGKLGPGLNGPTDWRVGHLPLEHLNTQTDVWPLVAPRLATNVPLTLVRWPARVCFCHGHNLQNLILERGPQEDTQGSGSLKGQDEQIDLLQDLISMSLTKGPIWETGIHPYPRLASGAPAPARARKAGPGPMPCELREP

SEQ ID NO: 1001262 - protein, 114 aa, Homo sapiens
MDDRAFGNYEIDCPRICVVHPTYLTSLFIWGHWVLPESSFYGARGCRFWPHVGPFNDLCETAPSQVDNFTGSQVSSFTIAWSIHCNEEDRRASSIDSRLGRDRCEYKYCTGWLT

SEQ ID NO: 1001263 - protein, 386 aa, Homo sapiens
RSTSGLQGQLMSSEPPPATTVSPPIMLQSVLLDDHSREPVMRFTITSSARCLTVVPYAHLITASTGSSDLSFGQTGAGAYTRDSLSYRRRSVKWLLTRLLMGPWPSFTLLGMYGQVPPKHSFRVHYSSEVVSKVEHGSVHSGHMLLDCRSSLIQCCARILKPIRIEKHARSGVMSLSTPRAALVSITWVIPCTRGLWVLEHCSSGSLRQIGWEATPFVAVALVAKTFRAGRSAARTLGMSDNSFHTETGASSRALVPSQSISWRTGYGGPGDVGLWGVPGPSGTAVLTIWQRNRLTILKSIYKHLPKEKNRTPHTHTAHPKGTSNCREMPAHTQRVRQTGAHVAIRAVFPGTQQGFWGATGAVQTRPRTPIYVRPILSLPDKARVN

SEQ ID NO: 1001264 - protein, 106 aa, Homo sapiens
MAWNGWRDIDLRPQSLRGLSLGRYRQDIKCRRRNVLWPSKYWGVCASVILVGAILFGSVAYQQAHLAKPFSQSEEDCPLLARKVGLISDRRTGRLRGTRLCSDKEN

SEQ ID NO: 1001265 - protein, 118 aa, Homo sapiens
MVVVLPRVCPRFLRSVLCFSLLPYDVALAETPWGSSEGAGGGRRGGALGLRCCVIFPLLSLYFRHLVQLQCVLLCIPSVLALLTCMLSSVLLGLPTKTMSHCQREQQRPCVVFSCDGY

SEQ ID NO: 1001266 - protein, 113 aa, Homo sapiens
CRLNPFNPWPHCVQFRVVVSQATQTRRPSGSIAVTVINLNSRKQMKSRISTSYKRRVPVWSPHRLLEFIAYALMTSIVTAESSVGRVSSHAPHCVLGETSIAQKRVLIDMSVK

SEQ ID NO: 1001267 - protein, 105 aa, Homo sapiens
MWAPKWKASRPGGPVENGGNFTPRDQGIPPTHKRTTAEKATIIYDGVRQTQQRDTSYHGAQWVTRGGVSQPRSFVCSRTEGGNAAGDAPHKKRDAITLQQARVTG

SEQ ID NO: 1001268 - protein, 407 aa, Homo sapiens
APIMGRVRTCSVKNGGAVFITVNSDYMRLGKEFHSNKSRCARRLAIIPLVNEAPEDHTIARLTSKASRMKATLHETAQIPQVSSSQACRQEDDENRKTHTYMYPGRGLGASVIHGRLYRMLRIMTTYTDILSRNVVCRTLRSASFVPKHFHASTSRLLDEEIDLFAKPDTSEGSACFSRMCIDLLMFVSLIELYIQNHTFPGEKQSEGIDMEIRKRHSRHRFPVRPCVNCIRSAPSEHKDRDEDGLPNGELGARFFAGAINGRGGKLPKYPAKGVVTVRRVPKKEKRRGKTLVSEKAFVPRGWTNPAVKRRTLYEHSSLGHKSFQGWLGPKGAFPSNISRRRYNKKEKGPLGARKERGTRINQELELEKAWGKPQGRCAPGVPGMVSSLKPMSPPTKMPSGTPGPPL

SEQ ID NO: 1001269 - protein, 280 aa, Homo sapiens
MDLRRLLGKLQSKLLYSAYSKLCRMDFSVQRPWTSASKTNLHHNRGGISQHKGLRKVGVKLSTPAFIPFEVQTSEISISWELKMPQGQELRMVCSELIFRHHFPGTLVTEEHFFVVEFWIKKCRTIKKKHKNKKKRPPGATYMSGGRKKGGLCERATWPTTSGFRDPSFSWYHKAGKLCAGSPPIIGGRPGIKTFGIKAPGLPPGSRKRGGSNKRGESTSRRSRRRAGRTGSGREKADVIPMVMPAHTTTGCDDAVQSRSVRQRHTAATGGDQRLDEPTR

SEQ ID NO: 1001270 - protein, 182 aa, Homo sapiens
MQLTSLEQVDVEGLPVRVIAISFEAIWQLFTSVSYDACSFSSITCPRDKEILDRRDMDLCRNHFARIIPIRDGPNILCDLSRVVLPSNAPVGKTPRLLAMGLNLSGEHIPAPAPVSLTDHFLWIMTVELKEGDHSIARQGCSPVASKQDRTLGWKHNVRWDCQVVSSHVYPHGSQFNHCSSV

SEQ ID NO: 1001271 - protein, 467 aa, Homo sapiens
PNGKNANGKRRWHPVRQLSVTKQEAQNSVCRSLSLRNKVHCELVGRCGSHGTSPGPLKQRLMRAFGEDGPLLISGVATAREQHASIQVRDVETRLTVRGQNIDPTFPSPSGTPVHLRPRSNGVSVQGLVVLEGLVLTNNRVTKEPFEEPKRSRRTYTETPGRNSCSGGPPVSPLEGTGKMCFAIADHIRGVDPLLKNGIGRTHPVVLFRDAKRRFHTHPFYTILGLRDEPESYKAFKFMSVRKPIGNSPEPFGNPQIRKPGVGPFYLPLGPPLYWIGLQKWGAVPHFNVAYLIPSRRDKSGPKKGHFVLDTVPKGLPKPMCNMEPFSKPKHWFLPRFPANQDGLKTVSGGKTDHKMGPASFLGPLKRPLGMEENGLITGEAREKIFTQTFGPTRNLPWNLNGNSLSPGVNLLGGGLVPQFGFPFVRVPLKRVPLVGVLRSNFRPQRAFGKNQGGQQAWLNKCENHFG

SEQ ID NO: 1001272 - protein, 342 aa, Homo sapiens
MKDGCVSTELGGNIVTVEAYGTGTISFILTDVDRRAVNKSIPRGTERHGKGRPGKCKGLPWVQDEIYHDVSGRGCNKYAEERKEGINLESHLFDAEGKHHEELNVEVAGMGVGRQGTFTYHGGYIRKARGDRYLEGRENTPLDKERKATSPVEYKGRRGVKQPGKGVGRRRLGKAATTKRSHSGEYVPIAASTGSNGERHGDAVACNNSRKMLPPHQTAGDTARRRTQHTQEKASSNDAGQTGTMVVPNRDHSEDALWEVTTGETAPQEREDQVGEQENNLEDTSSCRINKPKNEIAGNGAACRADRRRHRQREPDHKKRQTVTETERPPMVTRTRGQREQP

SEQ ID NO: 1001273 - protein, 234 aa, Homo sapiens
ARAGGGCPALRVLRTNGSALHLRDSRMLLSPARGLVARVAARMTAWAPALSPLVLLLLLLLLSGHWPSIWSCAPPQSVTQGVYYHPARLGAAAVGPHAVDLLCWPDPTRSLAASARADAGVHQTMTLMRQEDEHGHMTMTIVAGCVACRRDPGEGEQQHVERRPAQSRSPCGLRKPETRDTEVDLVLGSPGPASARGSAEAPAELTCTSFAGSGILGMTAPGQLGGQGLHVTAL

SEQ ID NO: 1001274 - protein, 234 aa, Homo sapiens
MGWIIMMLAMHFRPALCPKTPSLGRVLLPRLVALYVLTYLQFMTVLGLKSDGALESHRSALYDSRSFIKGPPSVPNQDSPILLPSEEVIQTWRTLTSRTHDMTRAPKNLVREQVRRAYPSSKGPNVIVEAPAILGSCPPARKGRRWPHRFNSVGTHGWDWGLNVHAYVSFGAPVNNKSNTTGETSRECNKYRGGSGRRRRVILPVRPLGLLELLLGNADCCVCTHGGRNLAEST

SEQ ID NO: 1001275 - protein, 125 aa, Homo sapiens
GLSQAPQFGLKVQLPSFLSITHTMEKALSDRVSPGLGLPDIFPLTHERLAVIGFPIPKVPVHAPFVTSYKGLANTAKFGMNSLQNPTAPENSLTCLLPLGSGRLQMTCFLSVPGRHRTRRRVNPK

SEQ ID NO: 1001276 - protein, 74 aa, Homo sapiens
MPPSGYRQVVRRHNRALLEALCNHNKRPDVSVSPRDEQFNRDIEYEAMRECEIADKPTRLGRISLCASNTDTVS

SEQ ID NO: 1001277 - protein, 374 aa, Homo sapiens
MTEVGPVSHHISCPNITRDTKLSSEGFIPKSSLATRYFFNFFSTTSWRGLRENGEIGACGGPLSYNSPVSRSLRNVLCRLAGRKQGYTFESCAPSREHSKRVSTHYSVEALVGALRGRTGAWWLSGAARSVCDAPNRNAVQTIVCQEPRITKGVAFPHISLPRPDFRPRLSLLSNLTRRIRGGTTRGAIKHYIQPSPLPRGGNALGGTKKAPAPEKLATAETVGWATEGITDQHCCSRKPKLSQAHTSSACPKTKAPQRLEAPPKIKKHQKCVTPSIPRGTETANNRLAARRLFGNPRHGTPAGVEREAPNYAQPLKVNTRGYPKGPQAGRLAKGSTFREKPRRANDYPIPTRGVSKSPSRRSRAPETRGTHIR

SEQ ID NO: 1001278 - protein, 155 aa, Homo sapiens
MSTVERNDCADFEPGELALDARILDRHARMCTKSGAVSAWNTRCTRRLYKIVADSKAKVLRAALTEEGRREDASSTLSSYHKPCLGPLWCPQFWKTRILISKKGLADMLCWVQSGEPSRSSLWGLKNIVVRSVVRKKGAVNRTSEADVCGSKVGD

SEQ ID NO: 1001279 - protein, 101 aa, Homo sapiens
MASMRTSMMRGDLYHRLADVGPELELSTDLLRGGSCSRWTRVSSIHKHTHMPEATHVDVETHWCCQVERESREGRGRSYARGQYGIEKPIDSFMKITLGGC

SEQ ID NO: 1001280 - protein, 130 aa, Homo sapiens
MSEMSLSGAVSAGGNSDIELDYGLVQILFDACMEKSHEGTFLREIGKERCKKVSPEAIKMGRTLWVNTRMHEGRRRDPRCAREKQQEDTNAERDLDSWVDIGRCDLLTFGQCTLDTFTRGDEETEARKRQ

SEQ ID NO: 1001281 - protein, 152 aa, Homo sapiens
GVEQRTRVSVPQDAGPGVKVVDNKAYFNRYQCDTLKTTTDEGKQLLVVYARENGIALTTYDEEDKLANLSRRRVQDCNSSGVDQTRAYSIVSDLGVCPVYDAGTMISLAQRYCHDGKPRLDSYSVLDTVWDLENIDRSQVYLYIGLACCGTW

SEQ ID NO: 1001282 - protein, 201 aa, Homo sapiens
MSTGTFSWKLEIIYTIVIDNNTHYWCCNVLSIDYAVETRHQPAVRAVSLCHEQAGDLAFIRTPQVHVWYTEQIILFYSYVHILTEAALKQHLSQHCAACNAGIHKSTGTRTLATDVCRQECHDYCSHRIHVILLTRISALDTILARKLLPNSYSQNSTHVNTTTNDPIARTASTVDFVIPNSNFPLADKAYAHPRCTLLRR

SEQ ID NO: 1001283 - protein, 413 aa, Homo sapiens
GERVEHAFRLTSGHAYDAASRVVAVSCLPGPKCYMLPLYTPWESFQLPLHSLVRSDEIDPCFVVRFVVVTYKTTYEIKSYQWDEWSSCWAMRCMTKIPPPAGMKNYQSEFSVIAALWYIRWIQGSLANIVLGVDMRGGALYQRCRGSANHQLLTRAPLGGATANRRPDAPGPSPRTQCNGVWMEHLLRATVTTVTERVRDMITQQVYGTWTSDTLVTRCALSSPQAEDLCGWMMGEEPTGFHPGKKKGLKKDLYCPYRGRRGAPFPYRGVGGSFSQLLNNVQGNSRPLRGLKEAKGFGGKAKRGKQVIYFHWLPRWNWPVERGLPWQTEALVSIATGRGHEGRPSPLVSSRAGYTLDMFVCTRGPGREAPPCLRPRGASFRRGCRAPGREFGLGKPVTAALGYKYIRAGGGAR

SEQ ID NO: 1001284 - protein, 183 aa, Homo sapiens
AALWTEVNRYGQNGDFMRALKTVNKILTDQRRDDVTDHALYKWYALSRMAEFQGSFECHQYSHLKCNANNSLSFAKAYREYRLNRIENASEDKWKRANQQYRQTEGAFMDKCYTVWNAYDEVLSSVVEISSEPPKMIMMRRGKTNPFSSCCEAQSQFGKKSVPENLGLHRRHYMSCATTLHVH

SEQ ID NO: 1001285 - protein, 204 aa, Homo sapiens
MEANQSSTDKRTPEKTLNTVGISLLMQIGQAVGSDRCGYLILSQMNSLEPIKRDPGDVPSHVGCNVEWPPSSVTSSSDSQQWCCVNAQPVKHIRKTISIQGFILTNLGCTSHSSKHISQESNLLTGRCIVRRVREPTGGFHGALWAKSDVRGPPDFTCGNHKAVPIATGCTIKGGGDKKPRKREETRIRTRRTNWHKRHTGATV

SEQ ID NO: 1001286 - protein, 184 aa, Homo sapiens
MDSGRPVVRPTTSSPSRKKGAYDTITLRRQFPAIVGTLDLAEDLDRKYLMERFLICMRGLQASPPPAERRQSCADIQGEASAYRRPWTFEQGDWPTWPHTSSFSGKKKLTKPARCARLITHWAMRRVPGDPEGPWFPSLPFLGYGNLWRHSTQDPFTSLHDMVTWTFRKDLLGQTGLSGGPPCI

SEQ ID NO: 1001287 - protein, 375 aa, Homo sapiens
MKCDSGPIRTETCYLTYTETSCCSEPVNSKLIVSPGNLTLNKRIATKRRRIHLDALCIAMVPHGKIQDTLSPTCRQLQYSVLESVWVLFLSHVLTMIRDTSLETRNACGNRSQTVPGQQLNRRSRGHISNPVPYPGRQGHVLSVRRTSMHLEEEAVSTNPYFLCENHIEPIIAYDWTSRDETYKYLQECRVNWPFSKYIRFYVSFGCFNLGFGLRDISIFPSLNKRALSHTATTVINVKNLPFGGNYGVIKKCSVENKPRDEPSVVVPSAQSPAKFTLRQTEVFTARIVVEVFTSHVVNANGKANGRTAAKMAFWENNSYNINNNQEGAKLLSRNHNLIVAHENIPYVMVFTQTEERMVILPLLDRPQTLAPIQI

SEQ ID NO: 1001288 - protein, 101 aa, Homo sapiens
ILGRQSVSFWHCSKIHHQVSVTQTQQLMERKLKLVVVDTPWHFRLQRCPMLQTSKEIIRLRFFCPPQGLMLCVLVVPLGRYTEEEHKATETILNHVWDEEG

SEQ ID NO: 1001289 - protein, 85 aa, Homo sapiens
WKITLVNYGFRYIYNALCVLLGARGTIKLCSEACCFWCLLDLNRMMPVMPAGTQQQGSEGDDIVTVTIIKSMTYNTYCMSATVAL

SEQ ID NO: 1001290 - protein, 392 aa, Homo sapiens
GKNTLSKIKSRVMVGQLCSPLPSTGPKKYKRATFIAQKEEQKENTLLSWALLYPSHTTQLLIAPARVPYTKRVTVKVLEIKNGFTVVCDNVVAFFFTQRFYYYSSMWKNSILNTVAPPPTELRVQKVEDKEKHASKKAGIGANPKISYINKVRCAPLKQYCVSQNHLLTHGAPLYNKYHQQNISPFFNELPLYKKKKRARGPLETSFEGTTYIITSPPVCGTKFSHSGIGRHGGDGLKNRRACATHTEQRSGTTVAPRRLGQARAPLLNTSKSGKPTGKKHSSNKRGQWPTRANNTAAPPPAPHTRSTVARHKGNTNNCTRCQEAKNDDGNEQLGAKRGKTAGYQRDPQRPPRHPPTGGHTLAGYPPQTASSPQTPPNNPRVQPVKKHAYDT

SEQ ID NO: 1001291 - protein, 509 aa, Homo sapiens
SLPKWNNFFFKFQQNSFSPSPQPVARAAPPSLSHPPLHPPSLKPRAEEGIVENVKKAQERSPSVQGKGLPHNIVVVEATSPRAPAVVAVGHSTGVPHRGSPLPLIKYKAFILCTAPTSCVVENKSSLNLCDRNRHRAATSIHRLLSQERHREARTHSQREDYSPPTPPVWGASDNTVRRGHNTEKTLLQKRRPPDHYSRVAQQGGGDTKQRRERRTRKVERPEGHKYRGRENRRALVSAPPKYNMTGRSHQAGHTPEQKHRALQRSVTPHTDFVAESSAHMREEEQGTTGWRTLTQTQPTVVGGAATKTANSRPLLTSGGPPHSSKKPRDVTPQSRFTRSCLSDNNPAPLPTHTPAGWMMQARPPRTRAHLLTDRQQNDTPCRVGGQPPPMLTEVGHATLAPSATSRRAYTTEHHYHLLSSPRASPTLLVLLYCLTDHRPTRSPPLLAQAEHGCTPHSLCVSTLSRVAPPRLCALWLERTHHSHRQERATTFSRGRAAQSVTAPPSPAA

SEQ ID NO: 1001292 - protein, 227 aa, Homo sapiens
MAGLLEEALTEKVQKQEDLDKDKYTSYRITKTGQAVSRSQGEGLESGLQEAAQSRVLAKKFGPPTSDRIGPFWTLFEPGNEHGVAPPNGGDEFPAAVSVSTGSLPHDLPGVWAHDRFGQPITALAQGEAPKNAVTPSTDRDTFPLTPFGEIWQLSMGAPISTHKAKGPYEDCLSITGAPRKRKGIIPTKEPFRSLGFSQTQARKSVIRKHSDWAPPPTRHPTVNGAT

SEQ ID NO: 1001293 - protein, 111 aa, Homo sapiens
MGNTSYSGDPPHLWQRFCAIQGHTGRSSNPIKGQFIEAAKSGSQHGEPYRMEIVQTERQLRAHYIPIVKGAATCLVTVSGNMTAQRKGTIKVTKGVGSSRTVTFPIFESRA

SEQ ID NO: 1001294 - protein, 319 aa, Homo sapiens
MRDLVDCCRVLIASLESTSSVGRAYVTSLDAAYGGAIVHGVARIIAGHASYSSLTGASSRIRQYLQGFLDLLSCTYYHTIRTVAWDGLLRSSDACLPEVTLMSSELSTVDRPFSSPMGPDASAIALHSRRECIVVFLCHPSGFTYLTVDGRFLLELERRCECFLEHGINGTYVTTQGDRGIPKPPRVRSKVYRLTRCWAPSSGVGPLRNFTQAFTFAQPAHGTIPRFKGARSIRFFFPQQLCPPRYINALVAPSGPFSSFDGVGHLTSGTYAHVPAFHVGVTLYVVPPFHSEGTFTDQFYAVVVANNPPGIQDLPGWNL

SEQ ID NO: 1001295 - protein, 152 aa, Homo sapiens
MEYRWLLCCQHLSLMALICEASWGRGLPGACPLGKTGIGVDRRHAPTGDCGTHKPHMMTENIALVTPQQGTIVTLGQMELTKRNEQFKGVGRIPKTGGDLRAWPLSVNAPSPTNLGKGQDQKRVKTNDGPGREQNGQNREAQCKVVDQRDRW

SEQ ID NO: 1001296 - protein, 139 aa, Homo sapiens
RRIRTSAYSLTGSQGEEEIAALVIDNVLRACAKLVLHGDDAPRAFFPIQSGQGCPRHQEDVTGGAMGQNVISYVGDEAPETMRGHPDPEVPPYEAWTSDNPNWDRPLGREAFWQTEHLLRNEALQLLGTPETRSHTQVD

SEQ ID NO: 1001297 - protein, 183 aa, Homo sapiens
MSQPLAHNGKPYSQWLDPSMDSRCHQINLTDWGDTDSRRSPVLPESVMTTMESVLLTRCGGGPIDINMILIGHRLQIDTQEAPPVEELSSSVFHMYTDVKSPLGKRIVHAPGLLRIGREASPIRGKHNRSARRTLFHTYTTSQMRQLTDDVATCPMVPSWDSRHGGHVPNTEKRGVLYGPRHR

SEQ ID NO: 1001298 - protein, 70 aa, Homo sapiens
MFVGARLNLSWKNVGRTRCATWAWRSEFGDVVQFVIPKEVHRWQDEIIPPGESNAGTAWQQKSAWRDSNR

SEQ ID NO: 1001299 - protein, 205 aa, Homo sapiens
MRIVKAKAGSLSYERSISDYGPREYEADVQNLKFVMAEDGQEKQWITFYVARRKNPKVGRLSLRNSDGITSDVSRQHGVRRGVARLLRPIVKIFNENLVKLNKASNLDNAWRDVSEPIMISNGGDPESGSRVKMESSIITTAVGHSGPEHLHSEHTQNLTLWRRIHAVAFGVDSPVGKTHGHPICHGGIRMSMTNPSTGREQTDF

SEQ ID NO: 1001300 - protein, 82 aa, Homo sapiens
EELTGEITRPVMDDQRELISNNESLPDAVSRGPGVPTEHAEIGKHRGSTLLLRGRCIHWRDELCIFDMARTTSGIHSLYAGT

SEQ ID NO: 1001301 - protein, 342 aa, Homo sapiens
RSRATASKRMLLLARFPRGVHARNTKSLLPTVSGSPSPSCRKLLALQRPLRSTALTQSLLQETPQPTEAPMKHHLDPVPPAGNSSPTEALNEAAALSRANVSLLNPAHSLCCPSSPLLPLTVAEGCSVGTVAGEDNTRDPPEPCLTVSPLMQLGNSDPPKEWEYTSRSSGDWVMHGLVFRDSMQGALRLLLSLPLSLCCPVRKLGSGGLDQIRGVPPLGHVLESCDSQPLPIHVLLLSLTEGSNQKRKHPNADPARGPQTPSTSVGPWWHYTPANARGPPELQAGKPGDVKATNRTRDTPHYERHHIYSLTRTRHHARRATRPTNRLTKIRNTTTHIRAAIP

SEQ ID NO: 1001302 - protein, 45 aa, Homo sapiens
MSVAQTDMTHGTLPPSHPEPNALSRPTLLSPRPDLMTRIQLNPCA

SEQ ID NO: 1001303 - protein, 379 aa, Homo sapiens
MVAAEHGQVHETWRSVVLVLCLDATPDSKLSSGEEHSMHGTSKIARYRPCSEVAGHLTATPRQSDELAMGKKKIAKRSRRENLCVIVYNYNHLMPTRYSVDIPLDNTVCHITDVVHEILLLKRNGSDREAKVKFEGEIHKTGNERSRFFQEYWRSYRLLRLSDRFKTIHTTDTHKEILRNNKTRGDSLLGVECRITHLRVNLKCAQLGVRTLRVESHGDPQWFILWFTARRKVENFCRAGGSPSYKGKSWNYTCSRMSAGDALTPWEGLKENAGRHKNCGNGCPTTGKFLVTASAAMTAHWQSVTCGGKRHEHKRTALQGALPRELNPPTGWSTKGTALERGAVKTLGPPTYTRVIKRYREALSGANPYTWDTAVYHIA

SEQ ID NO: 1001304 - protein, 327 aa, Homo sapiens
AYAHRTTCLLCKGSLVHPIVRARGEVGRQQRRNAVVQSPRSTYFSMDVCHTCPVMLERSTTVSCSLVHKTGLPFVLCGCSTGPSGQAYKGAIQGKVLHQETRWLSLQRRNARHLKCHSAVPTTELRKDHSGNYTAALSATTQQESRDKVRTAPPSDPEAGALDKGDNAEKWDLFRLQLAGDGPSDPRMSSGVDRNWREKNVVTSGAALLNTKDDRYMTSCYKYMPCGLTSLQLTRRVGNTPWVERKRLIVSFPLGTPPPLAWGWPVKQKEPQWVELPWGGQGRPRSATNALGLWNRPPLLFHNPRQRKGRKPRLGKPTQVVPQGEKL

SEQ ID NO: 1001305 - protein, 121 aa, Homo sapiens
ALLSGPSQYDPLGPQRISWKSPLTLDELFGTPQTVLEERWTETLLGHALCVVLSGATVIIDNNALPLHPGNWGRVGSGYVDLMEGLHDGHFYALKLNPVSLSSRTEEEARSMKPDHVIALF

SEQ ID NO: 1001306 - protein, 103 aa, Homo sapiens
MAPLPLPPKGATLAGSLPPMGLPTGSPDHNERLYPQGSANPRMRDHRPSACPGVTQRQLERSQIIVSPSSAQYSDCGIVRLHHLSSLSTLPGTTVVIMTQQEV

SEQ ID NO: 1001307 - protein, 134 aa, Homo sapiens
MMIVCTERKTQNDQTKGQLRWYPVPFESGCNRTEDNTPTQDLNSNGVSRKAEDWGSGITDLVVPRGFQGRSLESFRNIMNMGLYRHVNGVAGSGSPEALDRRVYVYSTWAYSQKCIVGTQRNTPSGDVHVLEEA

SEQ ID NO: 1001308 - protein, 171 aa, Homo sapiens
MTEGKKQQDAEHIDDGMRCILAGNRRHLHRHLQGLKTSAVNMILCDCDDVPERDQRPPELQHRARREGRRKRVLGLVLLRAREEVWSQMSEVRRDPPSQRYLRYCIEVPHCLEACPGETHSEVRGTVRCWATTVNSAACGFPHCPKASVHRTLLGQDPMRLGGGQSPNRVK

SEQ ID NO: 1001309 - protein, 110 aa, Homo sapiens
MVYDVNCVSRLLLQAALSTKNSRHYSEQTRPHIQHHTPNTPTRVGHSQLPTCSPEGFTSSRVTKMWQSCKSVQTQESSHTVLRRVYYHRVFLILMTPALIDEPLISPWFQ

SEQ ID NO: 1001310 - protein, 322 aa, Homo sapiens
MTKRGRIAAASVHAGIAERNRYLEGIAAELSRCTSCGYRAGRKARVGRLPRGGRSAADGGALVRAGALHVARRVGVGRGLQPHSTSGSAVLQIDGMPCVRPALPDDGMEDRRLACDENRSVGLLDFLEVISRILIPPWRDARTRASRVEVTTKNMGLRRHREGNSCFGGDSLDKVAGHSRGGPGRGLGARPGGERGPVVSEVALAFGQGAPLGFGPRASMGPGRGRRRHRCGAPGTAPRSATLLAQPSGTYFFTFGFGPQGGGTKGPLVDCWDNFRGHGIRKAPWNKVKHIGEGTGFPETAGASLMRGVPSNNFSCSCQTVF

SEQ ID NO: 1001311 - protein, 313 aa, Homo sapiens
MRRAQNACRKDLLARSFSPRIDTHDDIGISLSPAYNTMNLLCAHVNSLEAYVRGMERARLPALASAHAGPDDIGDRVIADHREVARPTRVPLVGLITNVSPLMASGTIASCAENATIPDITFTLHMVRISRCNLEHRSTQMLRENPRDLRGVLWIRLPSPRAERPRSGPNPCAMGTQALQNGDSWGSMSLRHIGPQAPTWPYVHRLAMDCHVGTRSRFAPTRVALPLAVGWVSPVWRRQPLRERPERTHLAYEPTLSRERVKVNAQPRMNPENFLTPVRLSILAAGPGTNWVPPLANKSVVLPLARVELTGAE

SEQ ID NO: 1001312 - protein, 269 aa, Homo sapiens
MTNDGSLSLLSILCETKVYSETIGKWTPYANFDNVAKMHPFGHEYFDVTSRERKRPRVGHQNEKLIDWKALGPEDVNIAKFKSCFGCESVRNLPQAIKDHLDIVPVLLSHQPNVNEALQTACELGKRNSTKEFDEQDVPMFVWDPAPNTTSGFVWRSPLSEGKRHSPVGPRQPCQALRSYTCKGGVQAGPRPIGTELAFATRSPSRNVLRSTPRRQKSAPLARQEGLCERRYGIRSPTSLPPKGFGTPATEKRPIFSIGSLCGPNLLVA

SEQ ID NO: 1001313 - protein, 336 aa, Homo sapiens
MRLTKGGTKGSQEEMWLIHFSYRGDCVTDVNSTMHTVLEYYTKIIREGNGSVSATDSNGNPEIGTLHGLIGVRVFDSDVSSDLRDMNERLHLGTQFPQSDLLHSTVHGIHRHCPDLICPWPLRCITRVVINKLVFPLAQERTGPELREFDTLTVDRQALTCMVHLASVFVSGVRVVHSKRTAEQSRYRKTYLSARCQSGPPKSGRMMMEIYVPREVQTNDLKEVVNKLIPDSIGKRHRKGLPIYFILSMMSSVRNSTHCLKKPKFCLWEQLMELHGDNGHVVPGKKALGDEDRVLKVERSLTGILNPPVPRNLFKASGPSNQWANNKRCSFVNTPI

SEQ ID NO: 1001314 - protein, 194 aa, Homo sapiens
QPLTYSADALCVCVCVCVCVCVCVGERVVAQGLGYRQCGKCEASLIIIISATVMSLHVERATRVPASGLEGFITTRVFFTVVSCVSISSTLCLVSLMKGLVCSQAGASQETLKGTWLRLGSREYLLGHSLSKKDLVSILQLRQVLLVCASWEDLLIGGSACRILLPQGDVASPMRPEGPHLWGPNISVLHQVCH

SEQ ID NO: 1001315 - protein, 296 aa, Homo sapiens
VSTSIGRLAMNKSDRYQWCGEYRVPHGTQELAVDSPLYLEEESWIVSAYSSAWTYVRGSHDNIGSHSVDPSPAPKESRDLESDWLVMGLRLMMEDDRRSSPEYCQQFDAQVADSSREVSQSPVCDSERTWLSWDLISTCPFGSIRSRLTQSGVLRSGGRNHTRVVAFTWISTQTQLWAEPKNWTLANAIDRFGNASTGHLPSGIGDFHHFGRKPNSLDARRLVGAVTMLGTRDRTQPRMRGTTRGEWIGFRVIGFKDKRIPKGTPGLIVRQCRWRGNGTLGDLYHCKPPEGRAMGE

SEQ ID NO: 1001316 - protein, 283 aa, Homo sapiens
MAWSCKPHFALRTGKRAAWPTGGFTSQAGSCMDSLQTCNGPRLANGAPHSAPLPLGRVLSPVPVGGGCASTSSCYHTGMVAASRGLPGLQARVSDASGVALDMFSYTNRLASDLTSSTFIVDLREGWRRVTVHGRSLVMIPERCHAVPEWTYTDPRIQSIFTPHGKGPRSPLKERRCASSLARSETKIERGVIAYGFDAGPGFDAPVREPVYSRTDERLVITDVNENEVSKRLRIVSVWPVPTPGLVRRYGARNRAKEAAEQDVDRRTTIKPILGALGSQEPR

SEQ ID NO: 1001317 - protein, 163 aa, Homo sapiens
MTGGNWMTRVTQLIPKTKIPGQGLLSAHAVSGSAPIARLLANLARADSDVLKIWRTSNLRPCMTGARRDEKSGNPGESSRGWMWGCAFSGDSQYIVTASSDNLARLWCVETGEIKREYGGTQKAVSALAFNDQCAGLACDPSGLLVQVGGSWRDPCSTQVRAD

SEQ ID NO: 1001318 - protein, 152 aa, Homo sapiens
GGTSRKPTAGRTSATAVDRDDIQDHILWALKGMTLRYKKKDDVVLSEAVKVAGIVKPRLARYIEPMGWQLNQPTWPLVDKGEDAHLFVRTHCQFYDGEELFATSLMPSLKVNLGRARLKPAVAALETVMSRMYLRGYPVIFASPGWSSLPAK

SEQ ID NO: 1001319 - protein, 295 aa, Homo sapiens
MEMPITSDAIVGQGSKWTLTYGAGAYGRIELYTVTHWTHFEHTHTIHIGVSPRKDHERTQIKTECRISRNSLTILIPWVDRDGYKVCTNMGCHRTTQSLKIKGERVSLSKTRGDIKPTEVYGSRGAVTVPHGGNSAFVGAPLKIGPLVRAPSTANSIFAWARCVEKGGRTLGNRRDGSGFCMIFGVLRVLQRLRPPMKDASPFEEILHLKVGGRGTQTFGEHIREERGDRKGRPRRGGRVGEYPASWDMVHGWESIGRASTVGRWETHSGVRSGQNRDSPGRGFTGDGGMTANTH

SEQ ID NO: 1001320 - protein, 292 aa, Homo sapiens
SIAPPTFQHSAGRSLTGQGTEPMMAAADGDDSLYPIAVLKTNLRNEDGSASPQTAVKEAVHPSPWPLAVEYGIADSEHSARLPYSSTIYDEDEVLLALAEQLGTFTTLVGGPEYVHCLLPPLELAWTTVARRHVCARSKAVVGPYRAIITSCVTRASDLVAHFSGLLVKRLAGGDWFASRLLGLRTLSPSAVPECSSAVRAGCFEHVLPDTCAQMTPAMVRRAAVSKLGEFAEVLELDKVQSEIIPMFSNWALTSPDSVRCGGGGVRLTRASSAPGGSGGLVMPTLGPGVED

SEQ ID NO: 1001321 - protein, 254 aa, Homo sapiens
MAPSRNGMVLKPHFHNGLAGRRCVPQCVQSMRGRVQDSAARNGLGYCRMCAARHRSLRSRCQASLVRAQSVSHASTGFLCSHIEMAAAAWPACVQALDGRSRGVPGYFTTDTVCLGPYRDILLVRIPAMEGLEHRRPNVQRPLGKDRTSVGKDALERASSSAPEIILCVHPMRQVRFSAPNKKRGKTTYRGVESEPNLVRKPQALDAWNRGPIALPEDMSNYMQTGREGVGKSINVAETSTAHFRKTLALSSSR

SEQ ID NO: 1001322 - protein, 419 aa, Homo sapiens
MPNTRSMSSKPDHFSAVTSSAICLRWQYAVSSVDPLAKLRTSTYQPWSFSNEIHPAVATLLVVEKCSETVTRTAWKPSSTSSRNTDYPSNTTDTLPWFETEDRSLLWHYVPPAVVHAREEALTLKYRLGVRSYQYSVCYVCVNAQADAVLQTTPARAGRLAWEVLAPHQRPNTCGIMRTHNGNMQHRVAENAAYTGSQSCLPLELQGRNGWATVKASVLDVRTDKPYQSGWEVDPDWILRVTRSQENLERTNVTAEYTADTLVSVTAVSFSPHVTLWVGWKNPVIEGQIPLFSLVNRGGDTICLRQVPKWTCKPVARITGPRCTLCPGTYIRDCTNDRPARKCVRDTLPGISRPSPGVREIDRAIHKLSNRGFARVDWPPSVAETSRGFHFACGAPVLPNRHMWSAPIFGEAKNTVFGR

SEQ ID NO: 1001323 - protein, 171 aa, Homo sapiens
MSFEQYRCDYNFGERGDAFMSAWGENTSAREILSLSGNTRAAFVPVFVEKLLPCFGHRGRRVVDKDHFFLLVRISTPGAPAPILSHRGVRGVSEKPAAPLCVGRGGSLTEVAGRTPMEKGREEIWARIHPRCPPEKGRGGLFPPPKEERRIPPGVPKRKRLIEEPGPLGPY

SEQ ID NO: 1001324 - protein, 229 aa, Homo sapiens
MLQLKGGVHTNVALESALSRLSCDSGISTRPRSSQSCVENYKRHMYPHQGHSQIPRDYTRYNEQGATSPNRWRHGLFLRNVPKQIHETDSCASPFGHSPKVLPAAPSTEPLQHSYGDPWTQPGPPVNTAHGHHHADIKAPRAIKRTIPQSAIQPRTIQHGQETHIGAQTPQPTPNPHHPAHEQQTPPRPPNHPRAAPPPTHPRSQHTAPPRQASNRQEPNTPDTNTAHD

SEQ ID NO: 1001325 - protein, 356 aa, Homo sapiens
GFPSLLKPVSKMRMATPLLSIALPMGALPRVGPMLECQLSMDIHDQRTMCMHLAPRMSDPPARCTRSREGGASRHEPADTVKNTDGMTIVLLKVFEESWIATRSASVHVMKIEAVLTSLLAVKHALVAQSPTEDMVTCSQSAQERRLYAIDSLIVHPGFISGPKLSTRTREHNLATLSAYGTAIWLTCLVVSFPQWVTGGSPKSQVSPWATYRLLVSSRVNLEDPRHIWCLRVWIHIQDPRAQFPIIVIKRVMHGPVVTTQFLCRDATQDYAVTTLYYFSFPIKGTPKGPVPTQILSSRGPFVTPFNSPRIEGTSLAECPVGIILFSVRTPPFGEAERNLRHPLRVQAHNQRPKSY

SEQ ID NO: 1001326 - protein, 225 aa, Homo sapiens
MPWTGAPGQGKEKTMSYPALVSGVLWGWNLPRGPPGKIRCWPGPPSDLGPSKGTPCTKRAMTERNEVVAKKPSLLGRRGVPRRVGCTPEALSKETPTWFVPPNSRRIRCDRKAKRAPIIRYSRAHFPIKPTQGENKEGRVPSDEGGLSSLAQTPLGRPEGTPLAGALFCLPGGMAPTDHRGGSQLEKGEVLARHNENRYNSKRPPQPFSPWTQETGRHTTGPDFH

SEQ ID NO: 1001327 - protein, 97 aa, Homo sapiens
RVAPRAQSLSFADPTSVHTRRQLTMDDDIAALGRSTTGSGDVHMPAFVGLTECPPGSVSSPSDRGALTYGCQAAMHGRAWSQQGIPMWADVGPRTQR

SEQ ID NO: 1001328 - protein, 350 aa, Homo sapiens
MVENEIAALVIRSKWLQSSDAHSVVIAWGRAAPLSRCSPFHSCGRFQYNLGAVMVEAVLAIQELHNDRAELVPRGKAMGITEPMTVTSIVRHGESSTKLGTTDGRHDTVHQHSFLRIGGQLQWLPVQEAAASCLTDSEGHPLKHTQRAYINEQTDDVSSYVIEDRSNTPGRMITDGQSRSSACSSSTPSGAAFDWDTCHWTSWTTGVTHNGDPVYKKGYRHLAPQRAVLTSWTLGLAWEPDQTTLMKDPHLIEAYRLQHHGRAGTSWRDIHRRKLCYVGPLELRAGEWPTRRNPSSSSARRSYKAVRMGRSITIGNDAVPGGPGGRGSKHYIPWVMDILRESTESHVQVP

SEQ ID NO: 1001329 - protein, 401 aa, Homo sapiens
AEVKDTGAGPARSCEREPGTPGAMDGLGAPDLLSQPETECAGHEGDHPMDNAWGKLLNVTLRIGPSDAARLHQALAGGGSTFFEIPYPCELSRQDDRTGVHEGVNELTPTNPPLPNVPTCREETVPSGGSCTRADGRQRALSSRAYSPVASPVVSPATERHAAGAIEHHPKLVLMGQTPCPPFRLPDTKCSDLATPPTVLWRVRRTWPPFHSAPCPESPFAPPFGPFRPTPPAPPCHLNFPWPRRTLRPCRFGGASGMSGPKLAILLAALEPRLVESEHGRTPLRGSVLPTSWGRLDPSSLTPPRNNSDLGAHRRFVPHELGESGSSAHPLRSGHYRTTLRLVAHTTHPLGYPPIFLYVTTGNALVSTIIARVSNDHPSPRPLLVSRISPLLLPHTVGQSS

SEQ ID NO: 1001330 - protein, 96 aa, Homo sapiens
VKSVPCDLRRVGDKRFLVGYNESSQHCLVTSISRMTYERVCIRVKSHELNTESLFLTRATCTMSRHSSCRDQAFMLPNRACTQMYKSSYDHVLKLT

SEQ ID NO: 1001331 - protein, 276 aa, Homo sapiens
AYGEALGLASLGGPEDSPWSTCPEHSGMHRHRPTGSVLLGLGEGSWSLDEEARMAWLPYNHLRVIGYGYRLSACSCDREGRSSWAKAYDPTTRIRPKAVVLPISSVQALPVDVDRIPESLTSSMFLGVFTLVSNSQEIGLAQQWTLAIVDCVASRRETSIVFGAMDPFVFPSLNAPMGALSAKRYDLQRLVGVGLLCSLLHAYPYLANVRLVRSYSYPTKRARGGPWRDVTPEHERTMRVDRKLHKRARWAVAHVNACALAKPYTSSASSAYKRQP

SEQ ID NO: 1001332 - protein, 67 aa, Homo sapiens
GPANMGRVRTENRERRSARVSHRISNYTRQGTRFPHEQARWCVGESPYSPQTKRLRLTRLAGYAHAL

SEQ ID NO: 1001333 - protein, 345 aa, Homo sapiens
SGRRCEGSRGMSCDICRWMVVRNCITVFLDHTRNKQTYSDVVRPNNLEWSPAEVRLPLLDATVVLQHRYCVDVEPASRTGDTVSVEWSTYRRKDPCQTETHCRDAALMVAGTTNAEHSNCFVAYRSSERCRTHGVRKRQVTERRPGALGQGQSPARVAWRPTSLRCNDAGTGPSELGVKGKEKGGKHGSPIPHEACHARRTRMLPQEVDTKRFKHGLVSFRGASERMKISWTRTHHIKKTDTTGPGHKIVPKPPRSPLPHREPAQSIYGGEERENQNMTGAWDTQPTYKDPVMGKGLASAQGMIDKPAKTLEGGLGKKGTNRNPWGPGDWAVNTLGPDQPPWAKP

SEQ ID NO: 1001334 - protein, 89 aa, Homo sapiens
EEKQELSGHRINNPVVDDQTLILISKQVQLNLPEWLGPAPWGPVNGANAARTVAQAACCHTACCNHSRRMKLCIIFVVDTGASNGLTSV

SEQ ID NO: 1001335 - protein, 110 aa, Homo sapiens
MKSEHTWGWGGTTHRASYHPAQTRKIIKRFSHAHGGNTHKGGLAPTERTQKERAKRHRKQIAALKETHNGASTKLRGRPRTGQAISCPHHTLQITARQTVRAEAPYTPAG

SEQ ID NO: 1001336 - protein, 315 aa, Homo sapiens
LFMLLRGHSPFRQHKINDKHEIERVMLTMAVGAAPSSFSPELQTPMLEGLLQRDVKPEIGLPGPRGSGGEREPLVSAPWTGRWSSMPKYPPPTDPPSEGTVNAAARLSYHWLRYECSEVTSINGTQGLAVIMLSHGGSYAQAFPAHTLSGAAGSKEVGQRACALRSTTQPACRQDPGMVGIGKEEPGTKHAGASDGRHTPLGKGRAFSSGYDVRTIGQASFADPSGRRLSSIRTCTRNAPRVGGGEALRPRGDLVTMEEIQIVGETRITERTVAAPQDPRRGNGNKQCDSDPSWVQRKKECARLREAQELGQRVT

SEQ ID NO: 1001337 - protein, 533 aa, Homo sapiens
AEDGGGAASWGLMVEAISWDAMGGQLMGSNRYVLGPEWWLARTPVTGINHFVAMCLLEDQAREIILALVTLEKTVSVTPESLTECPTTLTSSGLQTGIMSGRERGRRHGYSLSRKHNTLQAKGLTSAGLHEYPFLRLDFGAGAIPRARSHIRTKGKKMPSMWCVSIACPVQEGSVGGLEKVANREGESLSPCDPRASRHWGLPTVGGCVGSAHKVDPQVQWGGQMRQPHWEKRGWNRKGHKKPRTKARTDNSPKEKPGAHGTGQRTQDIRVGKDAYTDEETKKTRPGYTDTDRTGTANNILGGKRDTPKEEFPITETQTRTEAHFPGGMPLGRPAIWKKAGGVQIPRAKTKAEPSGKRAQQEEATTRRKTNSTHAQWGRHKHGGARHQKWVGRGGQAISMAALNGSEHHGEKLQHQDKVGPKTPGGEATTNREQRTEERQGEVGDTLEHQCGCLQKPRGLYEQQCGDKNNTLPGDKGGSEQSTRAAFREGRPPLPEGGTPQRTIQTCENTNRREETTRPERIQHRLKTHTFNP

SEQ ID NO: 1001338 - protein, 116 aa, Homo sapiens
PQEPVGYGTPVRAGACAGLWLWDDQRRPPGLLSRFLLLVLLRGDASAPVSIACLSSRVRALFLFELAVFSFEPGSFSCTALHVLKPRDRISCHRPPLRQPRRARLTLLDGHFAHSI

SEQ ID NO: 1001339 - protein, 66 aa, Homo sapiens
QAARWQCKIIQEEEVCQRRVASFNRLRLNEDSHLALLMLAEDELMSWKMEVWRLTHKAGDMKVNYH

SEQ ID NO: 1001340 - protein, 327 aa, Homo sapiens
GSCHLAILSSSMNGSAGFCGPPDSGSDGVTDGAAHICGPGKVPLHDELSCNRDYWHGIATRSRWDTVASCEKIRSTTREEFGALRQRRGGVPGGDWSWGGPDEDDWNSQKDIRGGGAGRCRTGCADTTTSWTEADDPCSCRVQPRVNVSPIQEGAHWSYSQNCFVWSRLTDLLAMACIQSPDWCLIWTRSETRLGVVSNILNPYLETVRFQILVMLAIDPPAGRCLHLASGGITMAVTVLFPVEWKAQSDAARSEGIDRELEASCWGLITLSEWASSCTGGMQKVHEDLGNRVPELLKRHGLRTSLRVRDNWPRQTLVPVVRCRIAD

SEQ ID NO: 1001341 - protein, 272 aa, Homo sapiens
MTSRTKVDVRIRWSGLGLWPCTVQNRTKAEVLRGLAHACLPGQGTVHGATLLLMLDEPHQTHRGPRTLSIWLNKYLQGWREDLAVIVSHEQGFLDDVCTDIIHLDAQRLHLLKGGNYTIDASKKDVRSENAERTAETGMRTQEKKLKELKAGGKSSQARRKNKRRKPCLGSSRNADGEIKMRKSQEAPELLKRPKEYTVRFTLPEPPSESASKCWVCMVVNIRATTEENHFFKNWECGSTWIQDLRCGPNGGGQSTQPGETVHTDTTMAECE

SEQ ID NO: 1001342 - protein, 254 aa, Homo sapiens
MTLSLDFCCSCHRLLLLLAVPTDGGARRPSASVRLLQGMGHQLTTRTGNLYLRGPLKKSNAPLVNVTLYYEGTVRWLDDTLPDPESIFRQHGCVVMEILNVTLDALRKTQQEQNVRCAGGSSSASMDKRSAICKQGGGLRCRDELDMVAELFLTIVCMEVVRVTWREVCHVCPVSLYSSPGRVAETLSLECANWRDRRTVRGISDNAQRPCRTDALQSTDDEYVPLRSSRHSGKALGRSDSSSFSLVCQLYQGK

SEQ ID NO: 1001343 - protein, 158 aa, Homo sapiens
MGRVRTITVKKAVRVIIEYVSTLRLGNDFHSEQCACARRSAIIPSKKAPQQRYRGYVTASDEANSERPSDEVSPVKLQEAGRENMDETTIMFLRFSAYGSSETYLKYDPDTTAKSAATLVGLRHVLYSSLHGHSSLLVEVVNFQIAPRGDHVSKFMSC

SEQ ID NO: 1001344 - protein, 159 aa, Homo sapiens
MVLSLTFSLCPWILPYLLLLILYDARCLHTLLIVVFGSTYSNTLRIAPTRRKAVMFMRNGSCVVDIVPSVDLTVEDERFISPLLTIVVQCGHLVGAWRHEARFGWTPGSFTGSFCVAPTQLFTLGKSDVTLFPSVAFFFPNFGRVPGGHPRSSAGTFLV

SEQ ID NO: 1001345 - protein, 198 aa, Homo sapiens
MLTTGYRKMKMMVFCAFGNRNMQKKLSSRTLVETVAQAKHEQGSVLATRTKRKRRREEGGIMIQDSMLPLPKRSQDDGTAVRGTIRRGRQAAYFPCSIDRHDIDAAREEIEDGLVRRKKMELLQKYASETLQAQSEETRRLLLRIRTQLGLSLRDSSIPQVVPQDPGAADSMAVCCEGLPGPISQASLPLLVLMLTGG

SEQ ID NO: 1001346 - protein, 235 aa, Homo sapiens
TGLVLFSRRWLCLESLPCEAPVLAASDSDIDGAELPTGVWLGTPKPRLLESRLTCECHFLNWDGSECGTLYHDTSITNEEYALHRTVTCGEYLGRVIGAGAVPDAEYWNSQKGTFLERRLIRGCTPTVRYNYGVVEIFTVHAADSNLTVTVYPSKDPDPEHASNLLVCVCELVSIQAALESRWFPEQVRNEKAAVVSTGLSPEWSTGPSETLVHAGTHVPRSAEVYSCQVVASSL

SEQ ID NO: 1001347 - protein, 426 aa, Homo sapiens
TLHRRHIGYFRTYRLSSLGETYVLAARHAWPAGIRYSSVLMDVTMLSLSITARDMQTDSTRPPSYQCRSTILDCCSLSITRHHATLGATYLCCDFPTVVAHDRVMVDWRPPDTARVCLGAMMPLTTSIPLAVLERRELVNTCFMFVVSLLRGSGVSTRSLGPASSTPSNPANSSRYTWFETLVSRLGHVSQFCSRSPFAACNIAHDVHRHSHCCSIFPEKPGEKTKTHVRRWPPHNVFCSACELCGTASCERHSAQAVRATIVRCAFDPVVFLPVKATEPFFSVWCGRQDVASKTMRAPRFLVTPYLFHLRGFPGIFIVFPDNISARTRGSPPLFGGFLMILCGRGEKRSLAPTATASGLGTHTILEFSPMVLYFGTPRGVTVIRARLTRRNRALGNLVSNNHGPFGSVHLNTHWSGAFDKPRQQL

SEQ ID NO: 1001348 - protein, 214 aa, Homo sapiens
MRASARANYTRGSTSLPSWAPPFLGPCIGPPPKLAFRVNWSELLGTPPICKQRASLASKIQGPLPPGKFQFKGTINGPYPWASPSGKTPWAVFIGQTPPHLASTKHGGPNYAKLEPKSFFLGDYIPARWKTGNPFNLGHPNQWCAANWAPTSEALGSNAPQVNREPLAVRTFAGPPGFPGGKKTLGIDARLEPCCPPDRCGAPFPFANGKTLVS

SEQ ID NO: 1001349 - protein, 257 aa, Homo sapiens
MSAPPQEYYHPARREEEAVAFLLGEKNLLITTETCGVGGLPTHTHTECGWRDERPAGGRDTPPLRGGGPPRRGVFLPRAPTPPGGCHQLLLIQRLWWKRRPLILCPPPRWLVWTPPPQKGGCSLLGSASPLNVAVVVERRRCRTGCWCVFSLLRAATPLLCCGGLPLDGGALLLLLTPLLLLVGEEGGRPVFPPVVGGPPPRRGATTIYGGSSTCSATTKPPRRWVLCLPPTPAERSAVGVLFGVCAITPRCVVAPR

SEQ ID NO: 1001350 - protein, 140 aa, Homo sapiens
AAWMRRRGSTFYTPEKPLKAIAPDPTAVLLSEKEENYACIRHLSIMITHAAKAEHGNVPSGSDAVLSPLHAAGSMKLPCDVVVLEEVQGWGVSTVDVTLNRCSSCPPTIANNFLTGSNRFEDTSKTKDTSHIARLRGHTT

SEQ ID NO: 1001351 - protein, 167 aa, Homo sapiens
RTEGEVGTRWWLSRRQLLPTPRPLWAQLSGGLRRPCEPAQTQALAPCPSRAGCRRGPGTGPGDPARRPSRPSTQWLSKSPGRRRPPAPVARCHCCDRPVAASPSVRPWHRFPLVPSTAVPSRQGLAPPGSLLPAVPAVRASCPCPSSLPPSPSVPHAGRLSTHAVRI

SEQ ID NO: 1001352 - protein, 192 aa, Homo sapiens
MIRRGPRLKVRARNSFLILLDVHRATDARNIRWPNRWYAGREVAAIQGSIDERRVSIVLALWTCMGQQLQRIDHDPKWKLCCQLNHSTLCLSSILWGVHLLKEKTGQKCPLAYEYRVKHHGGKAPRRLIVSKGHHWAIDIAYLRQLDEANATVRTHRLASKASGLAIPNNPTRPTDNMPFGPAVSQDGAANE

SEQ ID NO: 1001353 - protein, 111 aa, Homo sapiens
MSADSGFHRQAFVVGVPLVLPPVPRFGTWCRAIRVLEVGVEMLMSPLLLVWPSGPVPGSERATGTSPRSALRGTRAVCARPLGSLGPAGPLLSRRLEGSYTYKTKSRGPRS

SEQ ID NO: 1001354 - protein, 121 aa, Homo sapiens
MSDCSQCCSPESLEEVLSDDLYVTRLGREDALITNDVLCSHTRVSHLHVCRLIEHYWPVAALTSWSPPSIATEYANKTEQVLPCTQSTGMLWDDIHDVHFKKTVCPKSYAQENAGARAHVT

SEQ ID NO: 1001355 - protein, 258 aa, Homo sapiens
MNVIFCLYDKDAFYVADLGDILKKHLRVVEKLSLVSPPFMQSNVNDSKAIVKTLAATGDRHLTVDQQGLKYMSGSTEVWEVPPREDFIYANPCKQVSQIKYAASDKLDVQMMTFDTFKLSDGRVGETAIRNEQSGRCGCLLMIPEASSVVSDVKIRSPRSEHAGSFWNGRSELNIDVVGVSFHVRKRCTDPETFVQAISDARVCFDHGGLEVGFQHVIVDIGGGFLDLRMWKLKFEEITGGNPPSVDNYFRSESWMRI

SEQ ID NO: 1001356 - protein, 153 aa, Homo sapiens
MENAARPGGGGKAVGHTLDMCEIPMPGILMAKSVSPQYWVPWRVPYACPSTQLLNPTLFSRGVMILFSADEWRILTHIYPHIEDMSISCRWSHEEEHRIARKWSPALILCAVMSLAVLNEVRLIIDITFGMLTIASRSGERIASTREKSRVQQ

SEQ ID NO: 1001357 - protein, 304 aa, Homo sapiens
MAPRTLILLLSGALVLSRYLGLLPLHGGIVYTRRCSRSRTRGGAPRSSLVGYRWTYTQFRAVSSVDAVSPRRGAAWRRGWSRRGRSIGTGKTHEVQMRHVQQICPSELCGILQRVYVLILELRPVLTPFQEGTVLCLANLVVPDWAASSCGYNQFDLRRTKDYIDPELRTCCYLDRRRTRRLMISPCASGRLARDGGCSGEPTWRAQCVEWLRRYLENGKKTLQQRGTPKRHDVTHTSLSDHEGNLRCWAPGLLPWRRSHLTWQREWRRTKIQDTELVETQASRSMEPSRSGQLWWLPSGKEQR

SEQ ID NO: 1001358 - protein, 43 aa, Homo sapiens
KRDILSFDKIKEQEERESARGSGNGQIRETERRREREQREREQ

SEQ ID NO: 1001359 - protein, 314 aa, Homo sapiens
MRSHASLSTRYAPIQCEFRVVTGLGISLYEDLVTSEAPHLQCMTPGKASHGLQCEHGMNRRIEKEPYALRSTRSTYSTDAHYIEAGMRDFEEWGDGLKVVQYSCSARLDYWNWPVVTVVHQVEVAEARLVRRQRVSPPLLNASHATRKFPSSQKHDFTTRVGNRGPWPRDYNLDRPVAGQCSDLKSRARHASARPLVALLSTGREVPSGPLYPGQQPSRNAVKADREGQGGWLGQQVGVAGLGRVRFGGKGTPGPFQGASEDGQGNVSLGTTPIRIPSIGLKRLECGFAHTCGSVKGKDGYAKHGGDFTSRKTI

SEQ ID NO: 1001360 - protein, 107 aa, Homo sapiens
MISEYRSSSDERYILAITHCCSSIEITRSATETLFQSSIKKIQEAALPGSVIQLACYSRQYAFRLVNLRMAMRVASGRRTMATSDASDSHEIAKKHARTGIYDVTWQ

SEQ ID NO: 1001361 - protein, 253 aa, Homo sapiens
VLIVVFGGATIVLGDSRFIMWKPTVLFWCGALFLLGSHLAGKNGLKASIGREIQLPDAVWAKLTYMWVGFLIFMGIANWFVFTRFEAQWVNYKMFGSTALMLVFFIIQGIYLSTYLKKEDVTVEYFMLLATDGENVHEARMAARPEHLKRLEVLKSEGRLLTAGPNPLPEDPNRVSGSLIVAQFESLDAAQAWAEDDPYVHAGVYSEVLIKPFKAVFKLMPAVDLIRERLQTLDPLVLENGDEESSAQGHAGN

SEQ ID NO: 1001362 - protein, 271 aa, Homo sapiens
MEAGACALPDGGGCGGRRVDDGPARGPGSGPEAPLDEAVCGCCTPTYNEEEEERRYATARKRLGLLNERAEFASAGGMLTYVRLPGGLLQIQLILHYDETYREVKYGNMGLPDIDMQNADGYLNVTPDRRPALHTCAHQVFWNEVCMMFLAVGIYALFVSTNYWELLLHRLLPSACGPVGMAIVPLWASMGNYITRMAQKYHELLPITRSSDGQGMKQRAPRGSHAPYLPGLPSHLLQLLPSELRLRPVAHDLFPGTTTCMTLNHTLYNVA

SEQ ID NO: 1001363 - protein, 41 aa, Homo sapiens
FAPQVAVGRLNRFFAEQTAETLRCRAHLFVESAFASRFDHS

SEQ ID NO: 1001364 - protein, 344 aa, Homo sapiens
ERGQFGSERLSPSTRVLKPPSRQFCLSAAAPYKAATQTAAAPVKCCLPDCLLPLSLCLPLLLRGCWCAFLVPGLGACAELAVPCELAVSEVALSLHFPWLLPLDAPGLCCMNACVRRGAGRIVTYWTRSDVSLQTSDALSMSFHRSDGLPQTVSDPCMRTRARACIVSSCTMRHKELSTDHSLPVDHHVLARVVTISLVAVEPQTGLVTLFTKARLDSLRGQYELITAPIAGMKSPEGSIFTVPCKDDHCAKTNGSSTLSIETPELGNPVLTDGSFFLTPTFRNWLLASKEDYPLGVETVGESHSPLGIQNTAPTFSILRKPVLIEVAVLSMNLPSGSRLLHHP

SEQ ID NO: 1001365 - protein, 244 aa, Homo sapiens
MGYSRRDAGVCQKLWGHKGFLRQGELLEKSGPIDPGGSRCSGPERPQGAMWPNIGDNYRGGGGATPSFGEGAPGAASLYRGKDGGAHHARGDHAANCLRHWRLMGTLDARVVPNAPLAIENWRGQRIPLYSKGELGGERSVGEPPNHKGVISNENLGANQACGGPSENTWKTHYRRSGRNLGNTPRPRGGMRCPSHEERRYVGHLHTIDPRTSPRGRGSPHTAGMGEHQKQRGQEDTPLQEGSR

SEQ ID NO: 1001366 - protein, 224 aa, Homo sapiens
MLHVVLRKRETLTSPRGREQVTEELTVEHRSCIDHACEQSHANPMIPECVLERHTKGMSKGMAENTQSRSYTPIRVIGTTTPPDVDDLAAGLGENDSGPNQRDCFQLSRMPISCPQARYYRRPTCPPWRATVGVVAAHGPKVAEALSCHYLVESPCNWQDPVFVGLWCDGLGGDSGAQEPRCERQPEGGPTPFLVRPPGGVHGWVAPFRPPGHFPQSSQALARI

SEQ ID NO: 1001367 - protein, 207 aa, Homo sapiens
MKESKSLRGMIYLILPVPSYRHTQTHHLIVLPWGPLLQRDEVSREHYCSRCHEYARTRRVPEPTPGNTTCFRQGQFLGFCLYYLRGTVTKMVRNRYGVASWGGIRGVSYPTRVGARRPHSGPNSPDGGGHLLLFPVGPQQGVRSPFPIPPPVRPNIERALTQWVRNPDGLCGKTSPLRRTLVQPFATKGLRIRRASVLGSGLTLVCP

SEQ ID NO: 1001368 - protein, 283 aa, Homo sapiens
ESVTTHDTVLDSSSSSSVLTPRDSQARRNSLGGSKVVEERRIDACCMLGAIQGGTLLRMALEVMAVSEPGSQWSHPDYKIALRYKHQSMCGLVPGSLGVHSRQLDVLTMDRFLVLFRFLSTLFLPSQLELCVALSYRIGPTPRGGPPPASYVTWPRAKLFVHCVATIHIVAHGRQAAVDALYPRVGKLVSLADHKVGSLGVLVVGVERETYEYLQGTRAPLGYSPYTLVNRAFNWDAPPKRRCVIASREAPTQDTGPRCQVVLRAKGGARNAPSSVGYVRPIR

SEQ ID NO: 1001369 - protein, 318 aa, Homo sapiens
AAGIVASRKLRDLREPGDLTGSNYPGLNISLHLDWLLLHKREASGVVPRVRGPMTTGYEGPFDVTSAAEDMVLRMVQRQSAQQEELPMKQGLSESRTIGDDAAFNLTIYRDALLDLSGVRVWCTPHGSQGYNMFLQGIDPDGHGFVEILLGQTEMNVARYSELEYPTVKHHSLDTMETYQTSIERCPKARDRCRPWGLHLAEVLDLVTGCDIRYCAQDAFFQVKGGGTVGIGWPDVGNSCMRLRKVIGETMSLVNELAFTDRQDDGCQKRPGIVGLVSRGVPKNKRGHAGCLPLSAGRAEISKQEPRGGAQTQRSPGV

SEQ ID NO: 1001370 - protein, 283 aa, Homo sapiens
ESSDSSSSSDGEGALRRRSLRSHARRRRRTGADQRRAKRGGGASETACTEKFRTGLKRVHVVSSEGEVEGPERSRGRSEGKPCRTYTVTDHGCSERGKGKSTGVDGLVQSKQHQRRNVSDLEWSIESASTKSAWRRIALREEDRPVDPAARVPPDVERSWAQQARGKGQSLEKRTVCFQSTAGQTGDRAINRGPTSSKDDRRQREGTGGTKSVSAIDAKRVSLAPERTLRREQRSESGIGEVGGTGLGKRDAQTRRRRRTKTERMDLGTEEDDPAKDERGARP

SEQ ID NO: 1001371 - protein, 109 aa, Homo sapiens
LQLLSFGHPLPDSMMVLQVAAAPRTVALTAYLMVAAQDLWSRRRDHSSRINLLTMGRASECLRVLIVETQSTYLDDDTSTSRETDVAVLHSDRRSVGGEVASVPVDGDA

SEQ ID NO: 1001372 - protein, 128 aa, Homo sapiens
MIAVAVIILCVLGLIEPSCHWSFDDEPSSARMLEGEARFILEGPRVRCCQVWPDPGLDTLGRVPRDHLVRKVTIHSRPNKFRPMYLHTPSRLESPNYGRPYSRPSGPAFSCQSSSTPSYTVGDVVGTF

SEQ ID NO: 1001373 - protein, 134 aa, Homo sapiens
MLVDAGRAKRSTLCASKVVVDETFVLSRLNQSSGFCGEVFVENIPFRTTYYWAKVFTGKSGGAKSDNSVVDSLVVRQRHQDTYLKFNNQGFRRVIFSSATIGLINLHGIGPGITSFPPSHSTPPTAQREGGGRY

SEQ ID NO: 1001374 - protein, 260 aa, Homo sapiens
ALDRRPHLGLQGVGWGARQLDVRQLTRGGASHGQRMMSSSSAPSEIAVSMGQLDGRHSKVKANEHMPPSCSAAARYLFVAAGPNEEVLCKCGGRSTNVRLRTQIEDRDIAMDFSGSVSSSSLIEAGDGDCMVRVLGAGRNDCWMVVNQHASVGAVAEALQRTLRGLGLVRARHWKSEVDQSRLQTLTARKDGSSPKERPSRERTSRITKVWRPLGHVSANRGFDLNNWMGIIAELKTRLNLRSADPKGVHAKGRAWLTRA

SEQ ID NO: 1001375 - protein, 165 aa, Homo sapiens
MGTAGPDMGHSRSNERPRGERTGGGQTREATRDGPPSRYGTWTITNTAIRHADGPIRLPGTAIPRSRVRGEPCEARVALPLSNWKRDFPCHSMTARTWHDHGLFRTRRDRGPGIRSETYSRWPAEPIRRAKENGLGCTVARFLLAPLVKLFGRGHTVEGTCGAQT

SEQ ID NO: 1001376 - protein, 239 aa, Homo sapiens
ERARLYRVKVESPKVMAKHLKFIARTVMVQEGNVESAYRTLNRILTMDGLIEDIKHRRYYGASHAARRTRGKADETVPADLTNMAEWSRKITSLLALRRESGRSVAGLLRPVGGSTQCETLIQFSLHLFSLCTDPNFSYVATSRCKYNCNISMSARNNTRIEKTNCDGGYNVAGGGQEKGSDADKEAQLGTEAWVLPENPILPGGTRRGGKQTGRARPTREGQAAREWAEERPGFTPDF

SEQ ID NO: 1001377 - protein, 221 aa, Homo sapiens
PNLGNPSCAAPLRIDCPRLARLVRTRPPPVQIDSSAEQLACRVLPVCSDTLYDHLGVAVSTTPLFYEKIIGRSRGHDIQWQALTEIGITFKVTLILDASAVRPYKAGFRYSCLYLVLFADLKGAPGLQIFSPLSWDCCLKSRILVRVKAPDVPPMCHCEVSRGLAQLACIAYLITFSSEYLLKSGYSILRQKCQGPVRATASAQYRGVMGTILTMVRTEGP

SEQ ID NO: 1001378 - protein, 93 aa, Homo sapiens
GHNGWVTQYRYIPRMFPAMILSGLSRIRRIDHVDRLTRDETNYGIPQRVVLLVVTPTLFSDVVISSDGQLALSRLPGMDTLTPTGISQGAATN

SEQ ID NO: 1001379 - protein, 249 aa, Homo sapiens
EGMSNGVAVGQQPSTGLSGHHAPSVQAEYHANLWDAVSRASRCTSRELDLQGKVLPEGVGPGDIKAFQVLYREHCEAIVDVMVNLQFTLVETLWRTFWRYNRRASPVRRQRGWYMTEAEKRLAQGHPGAPSPKFEPCAPNGPMHCDKVLYLGLVEILIPDVLRTIPSGLTQASWSFANEPGELGHRDAMVNIPEEMLRVKVACGGAFAQTLRLLLRRVNQLAQAGARWCCKNNGTRSSQMAERPPSRRG

SEQ ID NO: 1001380 - protein, 127 aa, Homo sapiens
MTSPPLCENGTGRSVRPKGLLAARMLKASWVQVPKCLHCTWGSNAKLARFPYIRCTTGRAWNVCMVHVMSHTSQVCERRGSYFEGGAPIGSEITPFSPGNATFVINPLFQPTYGEMTTPVYRISGTS

SEQ ID NO: 1001381 - protein, 138 aa, Homo sapiens
MWVVHRALHTGAVALIRSFAIPRRNQEVPGMRHSWPCSDYEEQDWFVLCPVYPVPYRKSFLSRHDKSQAPFFPMTLLKLDLSSPLYLPEERGPCCINTCVATHTSLPTQCKISGDENPWWPWVKPINKQGTPKQARRH

SEQ ID NO: 1001382 - protein, 109 aa, Homo sapiens
MRALKKWISLTNFISVSHTWQKLLARENLSRSCAYLLDGATLCISMKHTKGTALGHEFYPGCWHCSVKRLTKERHWAPVVTKRLKAQDARDQEDSRVHHETVPATVLFP

SEQ ID NO: 1001383 - protein, 148 aa, Homo sapiens
VLDITEETLHSRFLEGVRKCCQCLSADWLPNCVHSDTPVLSIQRGYKLRSLVRGVLWQDWHYDHIHTLACTQRSNGRILIWSRRNRIYLGPGVWGWGSRRATWYYPRQLSLGGPIGPWVPPQCSKSLKYPFGPFSTLWGPFRCPFGGL

SEQ ID NO: 1001384 - protein, 139 aa, Homo sapiens
MGEQSGGIATVALQLMHRALTDVDSRATTRLTSTTTTPRTRTTTDTATRGTQCDSERQQQHGTPSSQLASWTFPLTAVYQQPIEVDLRVTAPAHDVHLGEREDCASTPRRPTSSTKFVDIRDAKMHLTRRFTMGATASE

SEQ ID NO: 1001385 - protein, 113 aa, Homo sapiens
MAGPWDSQCARSRRRYQAAFVRCGGRLSCGCLSGSALQGPVYLGLAHVLAPCHVLEYGRAHCALPRLGHRFPTFKPARRCDQALWNPQDTYGLEVGALYLRCNGLGPLPPVCV

SEQ ID NO: 1001386 - protein, 238 aa, Homo sapiens
SGRAPVPTLPELSFSHRPLGGMVCKALAVAFLPGLSHLALSAVRGSAAFLSISLVGGPPWQQYCNGATRQRVMKGAHAQPVAPLTSVTLTHIAPLEGPPTCGPSSGNGSMGPLSQDLLAPKLILPSIIVLVLRSTTVIASSVMKCWPLAPGIPIAAVGSHVPGAVSAGAGKWSANERECLHINLLNPHTWRVLGRCTSPFTTHFALAGPVRPSDELKREGCSGDPAQTVLNAPHLFAH

SEQ ID NO: 1001387 - protein, 89 aa, Homo sapiens
RKRRPSKGFGPKPRALNNNEPYYTVYYELVLIAEAVFGRHLYTTQRERLHVTPSAASTYSVLSRYLSDMITFDQRGRWTHLRKPENSEM

SEQ ID NO: 1001388 - protein, 128 aa, Homo sapiens
PGPKPPSRPKWCEKIPAEAGCKDDACPDSSPNSSQKPLDDARLTFTVCVFRCNGRSERPVLHPSLCVQTHFMSTPHKECHQSDSGQMEVSSMNERTSRKHQSCHPVVANQVQKYPTFHGPARESTPQG

SEQ ID NO: 1001389 - protein, 120 aa, Homo sapiens
MPLLQWLGRPPTTCEAGQGDYALRALHGYGCHPRLSTSVQDRPYPLTSYTMDKLTKNPNINKQFAQTQEPVKPRSSLDNHRKSISPITDEKAPDHAHGKRSRKKRADSKHNAELYNVPTK

SEQ ID NO: 1001390 - protein, 102 aa, Homo sapiens
CPARRRVAEPLAAGRDGTWLVLVLRPPWPRRGHWLHWPGAAACMPLHGPVCILTAADPGAWPPAALHCIDPSVVACGHGTRVVAPTTGTLGPHAERHWPDRA

SEQ ID NO: 1001391 - protein, 423 aa, Homo sapiens
PSPAFRLLIEEAVRPPETMRPVQTHCRLREPAALEMELLASLCSAWDFHFLTCGLEEQKRNRHSKTPKESAKLLGESRMTARGQRHRLYGAPWQTHPRAPQAPDCVDHLELTKALLKDTCWKSTSHHRTLPLLTGKKPSDTARGVDPTIGKTAIQDRQDRTFRRARKGFNPLKAQNLDTIEEGNTDVAYYKKKLTERRHGRDQHRPTDQLDERPLPGKGMDTLDAGEIVPLEQERVQLDTGTSNYIPENHTLLPHVGITMFPVMEWYTTPLHAGSGNRTFRYFQRGTCYCVVPSAALRLLDGGANYTIVSKESKVREAYYENETHVDVEAVDEEPRSNHLVTIKRRRPTLQIEGEPIRGINSGNRRGSPNTIKATQTVSWKRGTPQQNPGIKRMKIKDTGEERLTPGNTQKRWNILTGVAYPQ

SEQ ID NO: 1001392 - protein, 107 aa, Homo sapiens
VSERRVPGSGLWVAGGCERTALRAQAAEASGAAVWRLALSGRWDEEADLSPVCLVSMSCCCLPAGLVLLRLWPAAGAGRRLPPEAEPTPDVARACCAEAAAAQPTRE

SEQ ID NO: 1001393 - protein, 300 aa, Homo sapiens
TKFGRGDSASPAPATTPAQPQQSQSQTHHTAQQPFVNPALPPGYSYTGLPYYTGMPSAFQYGPTMFVPPASAKQHGVNLSTPTPPFQQASGLMAKTGFTDNECIVERSGPRDDSKRGRLLQEVGYAWIIRQAPNKSAGSGPGKGVSVSSSTTGLPDMTGSVYNKTQTFDKAGISCRDASTFQPDLGLGLHWDPGSGAALAMSHQHFYTSCQPPAAPLTAAEQHFRRMHKRGSGQAQPARSMQHKSQSLQTCYGKSPILDNLNPRRDRVGWGQVTLGRRDTRAPFGSQCPFLESRHVSAIH

SEQ ID NO: 1001394 - protein, 272 aa, Homo sapiens
MGSRRGGPGKTQRRFPGVFGPQAAGVVKSSRAGGLLNSHCFAREKEGDKPRRHHPRQRAHMPFLSLSQPRRQTAVESFQGSSLPRAVDNPGSGAFGWVPPWMPLHHTPEKISQGGPKGILVREGIHNSFRLNLILLPNESGVKVVTGGNLSVQANKERGIFLKQFQLQDLTEKRTKRLLTVGANRCLSVAGKTLYTFGEIRGGGRRPCPEGGKRKRGPSFCDKDLLPVEKIIALKRQPPGFARVRRPHVFHLNVRHLPTQKTPQKGPEAPPV

SEQ ID NO: 1001395 - protein, 475 aa, Homo sapiens
STVHCAQQWIKYGDTTTSEGVLFAHLLRPALGESQCRTDRHRTRLRADPCDWMWGEGHSECAVEYDVSSELSATPKQCLAPNKDWCKACARTMQEQKHGPMCACVGLRHSAHKVTIMKPSGHHASNIEARLMEVIIGELTGKQHYTREQIGDEVTMQTTQYRDQRGDVREDPSGKRNRKRPKWRNHMEKGIPRTRQNRNNVQDQQDTSDSQKNKYTYTGGQDKNTVTPEKIRQRNRKFTPAYENTHDDTIIRKDSKIHKQKHQTRQRHQEEMNEGPQKGAPKGDNSDYGYPKAKEEWDIGTMRQVQGDLMQKSQESPKGSPRWRREEDPQARHRASREETNTNREDDEPCHKENTYSEMTNTGASTNREIQAQENVDRVHQGTARQKRQDIERQKNQKNDRKSNKSERGNEQRDTQQQQKDERQQTDRKNRKKKERQKTRKSAPHTTHIKQTHKGQQRKGTIKTQNTQKHARKAK

SEQ ID NO: 1001396 - protein, 285 aa, Homo sapiens
AAALAPSVLACAFPPGLDTGSTPVTSCVRAVHTCSHSCSPLCQEIHTEAASVATSPQSTPVDTCDTLATLTCGRGPGVCCDQEPLPHPDYNYLTATYLPLTEGAMALDPESGRTHACCSEKWLLGEIRQRLLMSGLQWRGRGPNLLSACPGRHFARKDLSEDDARIFKAWACGPTGRWPTSSRGGGPDHPRAETAETRRVGKPTFRCALGQTQTSDIVMLRDKLGVTRPEPRQQRLERARSRPGKHVAWDEGTQGHGHKNKKARQAPEKQGHNNQRGGKPRGKTR

SEQ ID NO: 1001397 - protein, 146 aa, Homo sapiens
MPAGVWPHHMTGTQCFLPKSRQRYHGNLPGLTINLIWSTSFANAAGLHTVWQRYLTPSVSPVGDHTVLLLTTKGKNLVTRPPIHTSMTTPPEPSGHGLVHTNPFPPSNWCEHCHDIKYSLPHEVELQLAIFTLPTPPSPMRQHNGI

SEQ ID NO: 1001398 - protein, 388 aa, Homo sapiens
KTLAEGLGGLSDDLNDSMYTVHSPAVALHSQGSGAWILGALHCRRRGWTNADTPSALWPQRRSHRRSLSVLGGDIPNLCGCIRWHHEGGCPILVTCWYSAEQFDPGDGASGGPCAVSCACGGLYTIGCLGKESVVASKPPRVQRATSHVLDHSFPFVCLTFPPAGGPSNVNARVEALELVARSMPLFPQKASTPQGHAPQSFAPIRKAKTYVTQRMSLKVCGQANGKRIPRFGTKFREGPGGAHLGKNRFVGEPKGAFLGNSWNPWGVGGTVWGPFHKTPIGERLRLGGHRTEETKFRYTTLRLGALVLTVRGTTRASPRDQNTRLGEETIGRRDDHWGARIGGNRPVGAPLFGVSQYSPRGEPPGRTCRATHMCGHTMGTPNRGWRR

SEQ ID NO: 1001399 - protein, 116 aa, Homo sapiens
KTTEFLINLNSDVFPVVVILRLDHIIRSWPPRHSVKTVPVSGPTSLQPSRYILCPCTFSEVARGFPRGVTSIAKVFIRGFSCALYSGLGQISPSHQFEKCIGGSLGGPSRLSERAV

SEQ ID NO: 1001400 - protein, 228 aa, Homo sapiens
DNSLSPHELQEQTVSYSTPVLKVLAFRSNSPDSDPVTILASLFLSLSRGHPVWRVPSVQMNEHDAPCTPCLHCRCHDRDGAPHRWCQLSWKASLYTLRRAMIDYGSEHILAWKHVVFERPWGAGLLHRNRYTIRSSATRKSHLQLRAQVINHSTVHACLAAEMGVSHVEAYPKEVVRYYTLMKRLPLIRSPHGMGFSRGYRVRGLTRMGYASGLPSYDIDVVILSGRR

SEQ ID NO: 1001401 - protein, 129 aa, Homo sapiens
WLLRELWEDPTSGLRDYVSVRKRPEFSRVCAGSGRLRCPPPFLVSDRASFPGLVVPVPDTAGVLPRDAPARTSSQEVPGASLLSQRTCRPSLSLTVHRVRSVAISQVAEAVLTSQVKAHQDEYQISITQ

SEQ ID NO: 1001402 - protein, 264 aa, Homo sapiens
MYFQCYVPHSVVLVVLRWCGGVCVVWRPGVASLTISSLTWSKHGVPLMVWIACVETRDFLCLTAIGTWGPRQQVLGSYELALTNNWLQGQPSILASRSNEWDAASFSVAYVVFSHPGLQWLARAGGVQQSPGVARVRAVAWASFAYPCWAVTLMPVGPALGCPCFFLHCLLLAWSRSAMCCMVVGGRSSPALLDLLPGSYYFRFQREISVALCVPSAFVIDLSMVTDGGMYVFQLFDYYSASGTTLLWQAFWECVVVVWVSGAD

SEQ ID NO: 1001403 - protein, 148 aa, Homo sapiens
RRSWNRAAHGNASAAMGQVRRSRERRACSRRNTWPSDNSMMQASSHHACMSHRDRVYKPGKEILQSLNKMGGCQDMGRLPFSIRVSSGKAADSGISDEFKVKNTGYWTDIATWECRRSTRDIESAHVKPARCHPAGLVLVCARLLVLT

SEQ ID NO: 1001404 - protein, 374 aa, Homo sapiens
MRPGHPLRAQGWEAGGRRPARWPRRGSPKRHPGPIAKGVSNLKGKEITTPPFIDRSLGSGAYEGAYERCAHKKHARDTESHDRRGPDHQERELQRQGPESQEQDPPTNAHTNVGGLMDDPSTELGVLHILWRGTGRKICSEEQKYKDALRILYARRRTIVELSYGGHAQTEAYYSPSGKRGGPRLITKPIPSFQRATTVGTAVVIRSLTSHAGFKHEKEKPFLRRICETPPRFPRSGFFTEPTFCVVVSPQNHPRGVVLRMLECPQATRSMRSKHPAAYQKTTARRTIETSTGEGYPPDGPFGGGHCDESRGTPHGGETRLLLRCGEYDATEKEAAVWIETTPQEKGVTIGKNCRPLISGAPQEHRPLIGRGGQ

SEQ ID NO: 1001405 - protein, 252 aa, Homo sapiens
PAAGYESATDSGLSQAPRNAEFPDAGEAMDDRATEIRLGEDPDVSDVEARKITNELRRHICLSERHVPWIVTSYRVHVVRARPDGEEVGVIKEWSERNSASLLVLGEDTKVSDVSSRYCAVHMDASGRIQDFLLIIEAWNSLVRSRRCSLDNQIDCLELKVKRLARLRISHREDKLSPNVRREKGNEKKGDRAYMGHRLCELFGASTNPCGRRLSPVYGRTELDTAEHRRPGMNTIRDGKFLFVNPKDLPAK

SEQ ID NO: 1001406 - protein, 250 aa, Homo sapiens
MTGALSQHPRAAPRCILADPCFIPFASLPYWVESCPALVCLSGLHVVRPSAAWGHYTLWRGPVGAPRELPRGRDAMAWVSRATWGAGFGDAVCAVPYMVEMFTKPQRSRRDSRMYHITKIAMIPPGYRTALQPPINSHTRTESIPQAGVAEQERVSDDREVRTSMYSPYCLSKIRNCEIPGGYSRGDWIAKAKSHDIVQELEHTSARVHSHCDSVPSTGMRALVYYPWCLWHGVTVHSDLKVPPKTATVR

SEQ ID NO: 1001407 - protein, 174 aa, Homo sapiens
MVRRELATARLRAHRAPTRCLGACAPFLHPFLELQGDPERSQANAHSALGDVVYLREPGSALRRVVILKGMHMAWVQAAEPYFHSGCPGLSLHGSAEGDRLRGAPGSVLRGKKLVGSLLCATPTLNPVLPVDIWAIGHLDQETRLPLKWVGSSIRHLTPCCRGKGGWGTGEGQL

SEQ ID NO: 1001408 - protein, 169 aa, Homo sapiens
MRRPEGRKRCDRIDTLEDTTSRHLRLVSKSKRRLRKGVVGWQQAIRWIRNLATMEPPKRSFRTCIDIAAVVYRQHEKTHWAFAEIERIRQCRYKIASRLGVHEMPRRGLWSRMERMAGGPALQCCAHVVTGSTRRGLRPESWCLWVSWRNVLSRTLAGCDPILGGGPIS

SEQ ID NO: 1001409 - protein, 126 aa, Homo sapiens
MIQTHPQLSRLVLRPRDISTDITEFMTPHYFEGIQAVSHKGENTHHKQRFSKLHTTPSSTSGSTQMFLGDSFGRYKTPGLREHILKKLPIPINEKFKISGGTPPQQNCTVAPLRDRHKIPTDTSTT

SEQ ID NO: 1001410 - protein, 289 aa, Homo sapiens
LSFQSACIQTLKTAARGVCHQPGPAAAAAATAGSSSSRCRMMEAEVSGLRLQPSCSSPGVLHVPLGYLDHAASLYEQVKSPQSRELAVWVIQKLAKTSQRRGIQGFRADVSATHGCHREWPTQKQGVTSRKHMAPPLDLEERLDRPDGLPMRCPRQWQGSHKTTRDHDLSTQKRKHKRAEGPDSPKLDTTGIEMATGKGPIGTVRQNWIAMCREGLRIDGVGKRTQAVNSGNPGGKGSDDIEPGPPSVEFIGTPLEGNTWTLAAKAPIGDDPNGSNRVLPGYERSQHHK

SEQ ID NO: 1001411 - protein, 180 aa, Homo sapiens
GRRRGDAGSLPPSLPPTRSNDAKGENFAHTVCVAVKKLLSGHVTPDTSGAGSLQLFNKVDYDRIRDVAPVSRVGIQTQVAATCGAMSAAYSSGLREKRGNAQVISKIQRVPRSDGTHSCGATISNSNYHGRTTSRHSRISYGNQLIALGTVSQSLVAIALRESECWCGDLDARVHLPREA

SEQ ID NO: 1001412 - protein, 424 aa, Homo sapiens
ESACLSLSRRASCQNAELVEECQKCGVCQKTCLLCRRGSVRRRTSFHKSCFLCMVCTEESGQYHCGLCMVVKIYCKSLLQAKKVCGPEGYGYLGEGSSAPFRYLTKWGVAWVSKHVGSRRGPTGPDAVESPNASEICPGRSEWLQSAAPRMQTRQVILLLEKVIGRWERPGHKACFQIVTNVWEMALTSSTLAIKDGEGINWHQGMSMLKKTFVAKGRRRVSGGKGAVLPLVQLLSEDNIEPTRPMAYLPALYQSPMPIPPASSVRTLRGTNLSCADPATVLHYIDLKPCGNMGFPYGVWARYLLGRSRAQNKKSYHTMLGMIDTNPTRNEDQQRVNGGTKELKTAQAPVIHQNELKPDKAGTCNIRRYTVSGDDTHNTDEPRKPERRQKLREPHKEERQQVQRNRDTQPTSERGKDEEAQQET

SEQ ID NO: 1001413 - protein, 504 aa, Homo sapiens
MSTDAGGCACRVPPDASHVCRYTSDAVVLLLVSSGWVRATVLSVELRGSRIERSLADSHSNHCMIIPIVNTASVQSRSTAETGSLSCVALSLIMMRAPVAIVVVFEEAYAFRYSTDPELEVSPFVLRVRDYEKVTPHLARHAVWLNPYRGYLYGKVRDYPSRGKGTYRSVSANSTTIPCWHRYIARDLGLRLCRPIALNRLGRIELSRSENERSTHGAHWNLERLSVGTLNERTVATVAQMVSPIEHRTAFIASHMIGAIHAVLNCLAKNARSTERFRRGDHYRLTPIFERHWLNVGTTGRLFTNVTKYKYKPHVEEFGSPTPKNRGHSEGLPTYTRLVPYELNIGFVDCAPVQGDFMEGSVVSLIHELIHNGWPTNGTKKVRDGFELHASSEQALGSMRKVQCVCVNTVGAPPVHTFYYEGFLGPRCIPSMWAPCPKGLGSWEKPLPEIILNPFLESRDNVRHKCRSLSQGEKLRLTVCAPLPNVKTAFSEAPMRNSLGRPMG

SEQ ID NO: 1001414 - protein, 197 aa, Homo sapiens
MDPMEHFVTERSEQTVAVHSLVGTAYSYSPETVGFHEKWSTSTSEEVRETRVANDLRAMRTPEECPETPSQRDQVQVAFVKDLRRLLENDPQRRAQNSTCAAKGGHTDKHMGSKHWEDTRRIMLAREAQKFGWNAGCTHDLIIPGQPRERLRAGESHVTWDAGSRTGSPEKRGNVTQRGGRRRRDWLKHKKNKHTSA

SEQ ID NO: 1001415 - protein, 190 aa, Homo sapiens
GGIQDAIVYRGEAVDEKVSDPLLCVNCFSCAGPMSVQQPSSRPIGLRRFTLDHTSQGPMALDGPPSCDGDEVMTELLAMLHGSVNDDTLHMWKGQYALVDCKGTCTLTYQKYLCIAMGGQTIVRYVASLGTPLGRFSTGRYALAFVFALALSGRPILRRFYSFMQDAPKTLLSRETPASSLRQTIHKYGV

SEQ ID NO: 1001416 - protein, 100 aa, Homo sapiens
EAHALGQFRGPAGMRREFLVCRSCHQWYDGKHVYTKRIANIWSPPTCNMPSSKSKKVKVSTQVSYRGREPGLVADTEVPGSNVGPVVVCCVCRDVYGMEA

SEQ ID NO: 1001417 - protein, 116 aa, Homo sapiens
MYAVSLVGSTSISLTPSYPRADYCLRKEVTIRDPRVQFIRYFVDYHVEDNTQHPRPEDIVVAVIAHTSLFASDGEKLRRMEPYAPYIVINRLSNDIDGHSVPYGVHAKNLDSNLQN

SEQ ID NO: 1001418 - protein, 153 aa, Homo sapiens
MSHIVDWGGSQNTGKSGADISYILYSKLPSGKRKWVSTRQWAKCNSVTDSSGLQPADSNTGLLGALCTSLGAKVLRGAHEASFVPLSLCGNASRDSVVGALDFEARGRPQIDRPKVYQGATETESLAQKRTPSKWAQVRAPYEEKVMHPSVEF

SEQ ID NO: 1001419 - protein, 68 aa, Homo sapiens
MMGTHEPGDLGGTLMAERGGLPALSPTTVPSNYRQAGIAGSRTGPGETEPRLQLDAAMLNATRLTLGR

SEQ ID NO: 1001420 - protein, 98 aa, Homo sapiens
GLLLLSGALRGHELYAFPVAAHPCSASLCALHCLSTIVPAVSRRAPLPDPAHYRERVKGMFYQRLRQLPGGMPFPSMSCDLSPVTGHDTWGKFFSDSN

SEQ ID NO: 1001421 - protein, 336 aa, Homo sapiens
AGAIIFTVVQRLKQPTKGHTKVAYTFDSGPNASIFTLDDTVALSYVGLQCDVKDCPARWFELRRQQLTVEGGSQGRRPGPPLFTLDASLACSLGHQDGQTSHGWGVQDTIIRTLKVGGIDLIQSLGIEPLVCRPVAAVLVSWRCCRKPSVAFDVVLESVEPAFALRSVTYTGGLSTSALVSLRGKPGDCCGWGPLGPEKHLVGGPCVGRSLLEFMQGPCGAHNCESRTYRRLLGVSSWASEDDSHCRNPVARSSSVRKVPPAPSLAFKGAPLNAWNHPTVLHRRIGDKRNGGGNEENCAVTHTEQRHRAFKGVTDRQNLFRYILSSPYERNFLDED

SEQ ID NO: 1001422 - protein, 139 aa, Homo sapiens
KRKEEELVSERTEAFTIARNLLTAAADAIERIMSSYKEVTDAVLCYTCPGARDCSRYLNDVQLLSLQDVPGCYEADRFKGEGVLWGNPVGRSGVRVEGPSENPMCQGVGLGLWNRGSSAENIPIVTPSGEVVVASLNIR

SEQ ID NO: 1001423 - protein, 313 aa, Homo sapiens
PLRPGSWWGQPQRRAAAAWCWLRPRGRRPTAAGGAGLPDLCWRATWQAILCCWDAVGPGRTARLASVRTPWLRAREPGGLKRENSQASSGQCFGGSPGDRRATGTPRWRATPGSLEDGQARSRSGKKDSGQRGRSRASPRALEGPDFEKLGRPCTAGPLLQACTSSSGDHVLSGGTRRMQASYREPRSPAFRFPGTFGSPSCAPWLVARGPAMPGEEGGSLEAGALPSFRFPGYPPDLAATALWPRSLCPAGLPFGAYGVPFPGPSQVGHFPGGGGLGPSRFGWTGSSWRCKGPLQGPSPHLSEFPLPSCPRG

SEQ ID NO: 1001424 - protein, 39 aa, Homo sapiens
MVIRDRSCRGAPTTMRRVVFLERLTSACSHVVVRRIASW

SEQ ID NO: 1001425 - protein, 276 aa, Homo sapiens
MLSAHDRSPSCTRSTVQPVSSTPVSPIDAGLAKKSPLALLAQTVLRKIWLSLDHVRPTYLNCELVLDGERAKRGCQELAECDHRPATAPEAPGSGETSGAPRRQARGDSTVARRDERPCVQGPEASKGGFRAGRASSQQKTKRASVLRVSVLPAIPPYVPSLRAPRDDRSGAFHGVPPQGARSLRRPLFTLGIGARRVLATLPPVLRSVRPRAGGFPRRAGRPLVNASFLYLGQPKRCETEGFGRGGGTRGIERKHHPWGRPPKAPMTPGGPGHPP

SEQ ID NO: 1001426 - protein, 125 aa, Homo sapiens
MCVRLHVWRIEKLELVPVPQKRYGDFYVGDAYLVLHSANDEPRSFTYRLQLLARKGVFPGSKHSLLPIFTVQMDDYLGWQRQCRIENFKDMSLMTLLAISKCGLKYKAGGVASGLNHVLTNRPDS

SEQ ID NO: 1001427 - protein, 131 aa, Homo sapiens
MQLVATPLSSYLRLRLESYRESPGEPVPCHPFRVDALTGSLMPLIWGPCTFSRLSLVPECAVSDGAIRLAEPTFARAFLLVCCAVHGILCLNRDTAAPFLLPLRSMSAIGDNCERHIARVVCVCGTGDNCA

SEQ ID NO: 1001428 - protein, 286 aa, Homo sapiens
GGIAAEQKAETLQQQLQLVLGAAWSESEVFRQSRVGALTASQDDQEIDTALGGDMLARSVRGRRLLWSWLVMVPRAGVRLTAHSAACDKDGRTDSAGDKEISRQEDKQIGLGPNMSQPPLTLGWHENLSSVRPINEPEDSWTAQEVGPAPQKPGEPYYPQSREVSPVGPPQLPIMSSLCQRKLGLGAPGPVRAQTGDEVISPDNDPPSGLSSPMASAVENHPSEEEFLVYRNDCSFPGAGSELCSPGKQVASQQRLFQTRNSKVPFKTGRWHNLVLSGALSQRDSS

SEQ ID NO: 1001429 - protein, 282 aa, Homo sapiens
RERTSLEFCDYFFIPSYATFFGVPQLPGAPMWLDFGHMWLTGASCGLSYRGLAAVVWVKHFCALCVEKRAEAMCPGPQSYSVRRLLWLQLRELGEVAEGQALEVCHTCGGPVGLCGNLPRHHVCGGVCSCRPKALCERRPLCVSQGERTPRRGVSPLRATAVFSPGTPRGCRVTCGVACRIPVPTCGTFCALHRRLCTHQGFQRRGPIVGSLCTELSQRDPIRGRKNEAHVVCRERLTTTFRAQVGLEGVPPPRDESLDTNSEGILRREFLPGTQSLFRGGG

SEQ ID NO: 1001430 - protein, 438 aa, Homo sapiens
GTCFWGWVPRQPGRPGLTSTSAVRARPVSPCPGMSAGTLLPVSLSRPHSSLAPRLPCCCGLALVLCGCAVCALMCCVHWLAVLPRWPGVLCRCFGLMGLLDSDASKKLRELQSVSEADLGQRKASGFEHSGFAWGQVLRLGLQKGPARCFGESYINFVDPWVCSQGLGIPPGFFAIVPPRKRSPSYNPLGIERAIRACTKTEIGVQRKRAYPNSRSNSIPLTLVPPKLVAKPVKENGAKPNVNAMAQPIFSAFTQHFGCATLGRQPLVRAEFYDTARVVPTRLGLKLGRYIRDYRADNTRTARVWTRESCVRHSFLLVLSRQHIIDAEREKPPYHYAGEPKFGGHIGLDTITVSYSITSRATGYTFYQVQSSNWIGAEQAHISPQEYVAHRAIPGHEFNTAREHAYTGPPAWAPLGGLLQRYTPYGPSQLVATSIYEG

SEQ ID NO: 1001431 - protein, 275 aa, Homo sapiens
RCPDEAEPCVIYLHTCRHDCPKRRLKCEFSGCDLQLGEAYVEPLEGYVAPHSEECLTCDEYSVSARCMNAASCVHGPTSMPASRDAPMPHSVLHLLRLRSSVFEQLYPEAQPDTKCADRLLVLALGRKPIVVWALWLGEDLPGPSEGRAVTTALCASAHSEDIRAAKSLGGALSVAMATAMCEESVKPHRGHDVCPGGAGNGRTLQEASREDLVRSSSGGHVTGVLIWTIGRVWTVATGGQGQSPDLSASVQASTDISMVTPLQVSGFLDGNWQW

SEQ ID NO: 1001432 - protein, 106 aa, Homo sapiens
MHAKRVRASFASVVICLCRNPFLKQPDVALCERTNVPLLLDLDERWRTRFDKAVKIVSCLACIPVTVDVVDATRYGRTHQASHSEKGRARFESYIDILTTNRNILT

SEQ ID NO: 1001433 - protein, 235 aa, Homo sapiens
MKAACGSKTEPLLVQLSYLGTKFRVSPPLYPIVVPVPERMPSLRRILCLAQRILAHRAERFLRGIPHYESSMLATLDTDLQIALTSHRYMLERVRKTWLLELSCAKCYARYSYCNQRPGLVSEWTRVLLLRLPPVLGPIEVGKVPCLNSKGSIELVLVPRFDRERLLQPSLGPPRLTSLSSEGNAISKISATRSAFVYAHEPPDFFEVCSLESAFEGRNSGGTQEEIILKRKIRS

SEQ ID NO: 1001434 - protein, 303 aa, Homo sapiens
LRQGGHQRENLLDFHLNTIQLPLVIDVTEQSVSDYDRQTDVNFKTGAESFKEAKILVQSIIRHADHTDNQTHSSRFFGLNEGKSARPCASSPLEEEMTKCTYALNQEELDWHACGSQSSATGFLEGKIKPQPDEPSELASEDCGQGSLSTAALCRVQNFSKYVSVFDEKHQQSLVGVLCPMVMVTATQPRARHSWDTHLVTGPYKGTHCTNHSLTRPKIRNSYCGKRGLGVPVRRCQHDSPRAQRSFRCHVPDQGRSSSNNVWNDTLDCVLRKFLRQQVRQDWWQGHDGRSIEGHLEESTRSQ

SEQ ID NO: 1001435 - protein, 295 aa, Homo sapiens
TTVRAGPRRRLCCCNLITPSSTFLSDRCGVRYEREPRWRQVRELLSPRRKAVAERPPEISGMQSGSQKLLRRTRPDVSFSSSRGLHSASTLHFRRFRTSPLSGRGHPVLRYTVCQSNNLGGTLAFTCTGLTRTVQCPDIPAHKYGRDKSANHKVCLDLIVGLRHAIERVLHIRRHSRSMPWVLGQLCITCALPMSTFRRIFKPLVHLHPCAKRYPSTVIRSPPGRHIPPFLAPCWWGTAFRELWVIPGQTEQAPKNQDPITPLIQCPMATFGPMGKRKPSSEYAGTKGPWVCGSL

SEQ ID NO: 1001436 - protein, 168 aa, Homo sapiens
GCGRGLLLQCRAQEPFAAPRTCCWRGTRGRGSRGHSVRRGPAWTHALAVCDGSGGPGLICCARCTVHAHSISDSPGYHWLLSVIYLHLLISHAQWANSSQVARRDPTGLAESGPMALSIRIREEFSEFNSIVPHEEGRTEYAPSGRQVHIARWVPIDLALTYTCNRSE

SEQ ID NO: 1001437 - protein, 236 aa, Homo sapiens
MWHRPPKKWEPGKRNVRRSVYRSNHRFPRWLQSGEEARFHVPRDDFQPCLTELGIALSCPQWPALAAWFNLVTQSKIAKPAHGSTRVSSDGNGLLHLGLFGGFQEVKTGQPVKSLRQGNTKANPWQTLGTKHGLDASHGQRNRLGVAKDFLREGLLLLNIRQRSFEPKGRLPPFSNSESEVALMAGASRLMATGHTQKKRSTTPGSLTKDNPRPQGRTGKKPGKPGPVPVGGRGEI

SEQ ID NO: 1001438 - protein, 335 aa, Homo sapiens
MRDYLLHAQPARASVCGGTVYVFSLPMRKRRCVGISVGALSQQKSPFRAIRPFKDMSPVLPLRHVAAVPKLPHVLRKPPRCQLATVGAFPHWRTLSDKRGRINKGGALGGALPPCSGLEESSRPIMVAIMHSVAPVCRGFSWGSPQGVPRPLPPKKPITKRGHNTGGSVEVPPPFIVPPGLWRPKGNFLPVATSGDSGEKAEKSNNLREGSVSTWLPDHWRRKTSLSTGTLLLEGDDFFARPPVVGDDKEGGRVKTLGVKHSDIRTCLACDQNKRRPRISARLKGRTLGKPPRLCPYWKTAPQAVGFSGGKLLVQPKSLFGGGENMRFRLAFMTP

SEQ ID NO: 1001439 - protein, 78 aa, Homo sapiens
GFAVSLDHCTMCASSDVPGALRRPAHDRVYAFSGAATLDRARVACEPGAPCGAKVATSEKLWASLLKATDWSRDYTSV

SEQ ID NO: 1001440 - protein, 146 aa, Homo sapiens
MLAWVTSGSQLIVRVTEISARQDIIGPSILHLDYAVRVDQVTWDYGVHVEILSFIVHRKLTASSLGCSMQGWTFPWAHRDSRPKTISEDDNEASHNHNRKCPLVKLDSPLDPTAYLFNMRMISRGIGRKYFLGALSEPKPTLPRGT

SEQ ID NO: 1001441 - protein, 218 aa, Homo sapiens
MCVGAQSLSKCARTFSRVTCYIILYYQMWRRFYNARKVTIPSHCGYTRLREKSPKCFRRGFSSGNTYSGGGTQFFLSSATSLSAQDKLPRPSTARVSAPQTCGDTLRKQGLTQDLHPHMLSVAPLHILYTTYRPRKRLTTQRRSDDNRLTAPSTLHVAYSSYSKSRQFAVHKEEDTSCHTVHVKYALTLRPHIKRALITLSRRASSQVVTYSTPTTTH

SEQ ID NO: 1001442 - protein, 332 aa, Homo sapiens
MLEDNYMLPVLILTERHARGGGRWTWLWSQEACWMIVGREGVSLSRCADHPPIIVDLASGTHPEAGRRLRPGLAGAWALDDVAVCLCVTAQSWSATGHGCCWVVDARLPGEGQAGGAAPRVLLEPDHFTMATGRLLLPCDTIQGAPVPAGRDCASVTDARVHIACGPITVGLPFHVGRGPDWPLYPSLTVFPRVRTAVDRGGPGWLASGALWMCASGPQSGLLANEVLWAQSRGVTPLDPPRRNRKGWFIGGTTGSTNGFRKPWEVVPQNKWEPPDKRTTVEKPQGWSWGYEGGDEEIDVTHLMPSELLGEEAALRTPFLTGGKGSRLRKFN

SEQ ID NO: 1001443 - protein, 286 aa, Homo sapiens
MTSGNRKPQKHKVPDLCRDRLFHSSGETHLPWLRTRPGSRGHTCGRAAGRAASWLSPWKVLGEGFQQILLLQTTLQPEAREASLQHGPSELAQGTLADVGLQIRLRNTPPVGLWLPEPSIYSGITHGPTLALQEAHSWGDKQAPLNSSTKEPSLIIHGLQPWAMSGPLHCHRIHQIQGQGLQVPEMLLQHGVLKAAHPDVKRRFSRIAYIWPTCREVGLVTKEQTQLTETSHLAATWQGTSSPEENSSGKDPGTESPRKITGWEEPEAGTSTQKPGPVAHKENTRG

SEQ ID NO: 1001444 - protein, 121 aa, Homo sapiens
MMATTIAGDEENLEIVPVDLQKIMLAGGLWPEHRMGNEDVKRSVYISDIVKGGAADLDGRVDSGMIRSLSAEVGRTVRKMPHRMTDGTHSTSMCGTRGGIVAWHRRIWTRVPRLRYRGILL

SEQ ID NO: 1001445 - protein, 242 aa, Homo sapiens
GAGPLMLDRWHRVCGVCSRVSLDMGDGRGWLLCCLGRAWRQALEAEVVNAAALPVRPVRAGRTCSAVRVCAGTCWLLTWLLEPVPARLFGWGQAGCLLQGADLGAWAPGPLPLALVTAFTAACSVTLGLPDPGALHETICLGWPDPWCLPCGCLIGGLRRMGTPASWGPLGGPRAWAGHGTGWQYGAKPFKGTAEAWAGPDWCHGVAYKLAWRLHCGWTSWEARAENYWGALGNDRGRLGVS

SEQ ID NO: 1001446 - protein, 244 aa, Homo sapiens
RLQRGERRRAVGDPGAMGRARDAILDALENLTAEELKKFKLKLLSVPLREGYGRVPRGALLSMDALDLIRRSRGQSFYLETVWCLSFYRYTCCCDMVPVRRWAGQDCMACQRTEGSGDRSQLGIQGPVLSLAAQARPARYIRSMHLGCSLSRGSTNVEWLLDALYGKVLTDEQYQAVRAEPTKPSEDAEALQFHTQAGTGPARDLLLLGPKGVPVADLVEDLERRLRSPYPVKHSGQPLVNRTE

SEQ ID NO: 1001447 - protein, 72 aa, Homo sapiens
GLRGDKYGKWRRGPCVQSESQRTLYKRHVQMTFATGGRRAKAQRGVSGTFVHLGHPWRPVAGNSRSCVLAIV

SEQ ID NO: 1001448 - protein, 159 aa, Homo sapiens
MALVPLGEESKTACWKRVDDLEGRNGRCSRSRANAVMLIAIGLVWSAFLGRESHVGRKSLGGTISPSILSVRSQRGREPPQNSARYMPLSIGALVRPSDKRAVGESKIIFSRGARRSNRGGGQGKKVFPGHSRSGDITLARFLRGGPVVVGVYENPHIS

SEQ ID NO: 1001449 - protein, 419 aa, Homo sapiens
LSVYVQGEDGPGSQPGTHPHPDAQRSCRETAEARRTDTIASAGENEAGRRSERQQREGDREDRTEAKQKRQREDETTPRATQRQRKRESAQEERKGRGERKKTRKEEENEGQEERKKHERAAREKEAERGEGECRQEGGTRRRERARGTETRDASTRRGDRGSESERERSEAGQKGGEEANDGRRRDEREEEGEGRKRRPEERAERKKEREDDETEGGEETRGKREREKHRRNETRGESNSRGEKEESEKREENERQDDEAGREQSEGAEEASDDTRREATTEKRERGERRRGRGEQKRETRNETNNRDKERETRLKERGEKKKQDKQAGERAGHGRAATSGERQTTQTGTQKKTTGQRTDKRQKDRKETKQTQRRTAREQERQSARTRETAQEPDEREKREKRKRRTEHRGEKTKRGE

SEQ ID NO: 1001450 - protein, 325 aa, Homo sapiens
AGPYAAMGAQPECAWSGSPSFHKDWQWRVATWFKHAGRCKIAQTDKARQAKAAPGSTRALASGSHPVHHTLRLPQGIRVRTQKCCAPGPQCFGMDGSVRGLWLVSFIERKVLALGNRILRYFSLCESRTERCEQRSHWELPCKDPSCDMTWLTRDVLWIHRLHSPRSTMEKRRRAPARQGRDQLSWLTVTCKTWSIAQSLTVTWSMPQSRQALVLQRGENTLPSSIDIDAKTEESYPIALSPKIVTIMGPRCPKRSAASFRRIPGTERETKGHAAEAGMLEKLNLTWKAPLWGTLEIEVGRVKRKRKQNSAGGFKGQVVRKKGGN

SEQ ID NO: 1001451 - protein, 91 aa, Homo sapiens
VMKTYRQREKQGTKVADSSKGPDEAKIKALLERTGYTLDVTTGQRKYGGPPPDSVYSGQQPSVGTEIFVGKIPRDLFEDELVPLFEEKPGT

SEQ ID NO: 1001452 - protein, 102 aa, Homo sapiens
MGLEVPGMFDTLQMILCATAMPSHDLSGGRITHLVECGIICASCQNTSLVSKGVHVTPDGCFRLGYPLMARRYDASPGERMTERSAYIARKGVLKWARCTMV

SEQ ID NO: 1001453 - protein, 358 aa, Homo sapiens
GSPGPPRAGRGGPIGARGTPAQTWGGVGKAVSSPAPGPSAPCLPQLSRLAGVPDRPPRHSPEAAFREAADAEDSPCPSRGQKPDDSTAARRAADSRRNHEHVSEKSSESPSKTRRNRKDQMRKKQQASEASQSSSNAMTGWKQPRHTKDVKITIWCNQPSHSRYESHRKQGCKKQEPEKKSQSSKLSDGTHEKKVPRRTARRTHRAKSLPKKGSDHRQAAMLSERKQYQNQMNQTRHHEKSNRTKEINHRTRIMLVERVAGPQANPGHGGLQGKHETDAYNTAWPGRINAESSPSGNRPGREVLDNEGHKEALRDARKTRRRNQVRRPQGQCHSTPPRTTAKDEHDQKIGSGTTKSQN

SEQ ID NO: 1001454 - protein, 195 aa, Homo sapiens
MFWWGPLAPLCVARTKKSRREPRYEAGGLARRTFTKNLAHERSHARANGPGGGTGGGVVFTYSAMLTEEPYCKEPQSPGENRFREHEAYRDEPGIFLSRFAGEFVRPNWGPNWPGVTVGKTIWHRGCPRIGGLGPLGAKAKRLVIFLKPRATAGKPQFGPPGFPLKYGSPLARRKGTGPLGEPPKWAIGAFERPG

SEQ ID NO: 1001455 - protein, 96 aa, Homo sapiens
MLKAATGSGRPRLVVYIVRKCWRFSSEEKKVDAETSWESEEVYCMENVFVVRDSHEWFSPLSNRGSDPIETSCLSGDDGAAACCGDSNRIRIPNAV

SEQ ID NO: 1001456 - protein, 215 aa, Homo sapiens
SSVLLSRVRGLGVAIAKNIILVGVEGVTLRDQAAVSQLELIFPRSFYLREEDIGENTVAGELSQALRATPWVSKQSHDACRLHSAMRPWSYEGSIAYNGLSKVVCSLPPTGATLGGPYCRGGVECLFIKTWELIAGVWQDNAGGCLWSHVSFWLDLSRDGQLESIQQSFPDWCEGKTYFYVGIIEVLLLGYNAKGTTIAHWLIGLPVTRGIEGTG

SEQ ID NO: 1001457 - protein, 525 aa, Homo sapiens
RAGAEPVSPQRLSPGPARLWREGAHSQTRARSRQARHQAHVEINQWHITQRDRPKLAADQMRYTPQRTPDSTTETQRHTQIRDAPAGTTTLTNTTKIQITGRDTQDNSSTQPLTARNITRLGHTERPPPDVLNHHSHYTHNSARYGPHPRLTLHPRRKGNRTQPEQDNDSNTTAASPQSLIQPHNATQDSRPHRSAPSPRLLRPPPLLTPHPSSPTHPSMRRPHKQALHGPHLPRTSRIHRSRRQTKPTTPPHTAPPHSVAAIGSARHTDAAAVDSLIPLVLPPSLRPHSRPPDASHRHETELKRKLMSARTQTTRTQTRVADSTTAQLTPAIPPPVTLARPLYLVPFISKSHPSLHIPMSSINHVLTSTSSSTQHNINTHHKPTIHSSLLLYSHTINLHIPLPLLSYYNMTSHPLTTPIQSRSASAATASLTSCTRARTAPCAPAQTRLALDSSSTSCKAPQYSRGPPVGIYTYSTSTLQLELAGALSCQLVALSNQRPREPVRETVVRADVARDHIRRRHSKE

SEQ ID NO: 1001458 - protein, 128 aa, Homo sapiens
MEARRHKPILLRKRLSSNLGNKTMRLLEQKALGTLHEHEIESQFSSIAALDTGEATRKEIPPIGELCAKAREGTVVNCTFHSGVGYEKFQERRGLKLTVDPRLPIPVKRNVGSEIGKQPSICAHCDMV

SEQ ID NO: 1001459 - protein, 207 aa, Homo sapiens
AEVPVPDMQSGLPIHSTPICALCSPLLREPVRASAAVLGAQSLSLRQTGVHYGLRAPRSSYLRHVRAGPRGVLEPAGLLPRGDWLTLQFHALLPYPLVASRRVSPLSFSDHSLAFVSAPQSPRRAALVAIALGASIVVALDWPLLGPSRRLPRVRLLGLPLARGSLRCLCSVCRRALRPGTWHHLLHLSVTISHGEPFPDHLRPSRP

SEQ ID NO: 1001460 - protein, 37 aa, Homo sapiens
MCPPQPAPHKLGPVHNPMEVPHPWIVAESELHTEDRI

SEQ ID NO: 1001461 - protein, 120 aa, Homo sapiens
MMPCVGCSAVVVTLRSSIGRVVVLIRLMKRRSFEAIYHAYALLAFSDRIEYRLQARDKFFWYLPTSASRILTGGRQFCQSICGVTVNGQVVRESTIGRPVMRCQVAPENSASLYLSASGG

SEQ ID NO: 1001462 - protein, 56 aa, Homo sapiens
REKMTQTYAFETFNYPAMYVAIQAVLSLYASGPLPTGICHWTLETGSPTLVPIYER

SEQ ID NO: 1001463 - protein, 104 aa, Homo sapiens
MPEVEMAEGGCYRARSEHKCERDDTTREDPARFVLLNLLLHMPEPQSLRIGPCDRREIQVPKGNMRDRMLMLAMDGHSACRKLEMPGRQTRHEKRCNGAGSMPM

SEQ ID NO: 1001464 - protein, 284 aa, Homo sapiens
MIRSARSAPDSPLFALAEGTSRSGSPAQQPWLFKGYRTNHPWSRRWQFTAHSNHPNKPPTYHILGHQVCALTCYRGCTTEQELLTRETDPRFELPTKTIGELTYRDKSVLDGDRSLRPWDSESTTDELHKADSLRACNQIPSRDIVKAALLYHQDIDAKGVQRVEDQGNRQMRKDTSTKNKIDAPTIVKPQKTNNNKQNTREGTTQHQRERRQTKTDNNNRDTQQRNQKPKRTPHTQRTKTVNQSRKTTHAPGNHKTKREQTKKNKKTETAQQNTTTKTRTTPN

SEQ ID NO: 1001465 - protein, 155 aa, Homo sapiens
GRPDERDLAAVTCCFTVRRIVPGGAGTSKMTPRVNLERVGVLVQPTRAFRSTESQTDGTDVILRPSLCGLSPNRGPVIDRILFYPSQYGLVFEEEPDGDLIGGPGRVIRSQTELSVHCPRVACSLAGGQRLDGAYPACQECCVGRTQDAEESSPR

SEQ ID NO: 1001466 - protein, 144 aa, Homo sapiens
QKVDEVMYAYEQKEYRKPMKVDDWCANGACRGSLESHGAHRKGVSLNSLDSTSLSLMFGGQYEVMVIRLYVAIVIPRKGHQSLEMERHFEICVDIREGLVHKAIHMKVEVHGFFESTSFYKNIQVVEMGLEIRNGEGLARWVGY

SEQ ID NO: 1001467 - protein, 82 aa, Homo sapiens
EKTVDITLKGRTRFIVKGPSRNPVVRSVKSHQCTNSAFSVDSEEKKRGSGSDKLVRGNKNRERCDLTSAVHVLSQDTIVRET

SEQ ID NO: 1001468 - protein, 132 aa, Homo sapiens
MYDRDSYLAVCAENYLPRTSGGARIQPPRSTLELYASYVYLVHVLLLMTADDVALNELLREILCFTNLSERRREPAAKLIEAAESNEVARILPFRHINETETGDDWESGLNCTLECALHLGLEHVNSVQYWK

SEQ ID NO: 1001469 - protein, 255 aa, Homo sapiens
MVMGALSLCPMENCIAPLTLVLRNSFSARTDGNKKWRSLRFAPNHPKGSSFPRRVVGVAFASPSWSDILVTSLEFPSRTPSTRNDTYPSTEDLHFGRVSAMANKVACQKNLAIVGGERIVGKPEFQEVEDSPCVCSPHIAFAPKRQVKREPPYVIPFFALFGVADQKALGRNGLLRTTLWGLDLGNALKRKLITNNLGTSNQGLTLETNGLELGIGFTRDSRVPLLDCLFLGSGKVDLVPGAIGSWGNLQKRNGK

SEQ ID NO: 1001470 - protein, 136 aa, Homo sapiens
MAGLALLRWADVLAAQKSARLGRQESLGGLLALSCRWAVWRPCRGPTGRLGFGLGFFGDRRGWFLLFLPLLGGLHQLPAVGLEVVEFIELHADILDGQLEQVPKPCQVLGCGAWVGIRVQVWLTEAPELLESRGHQ

SEQ ID NO: 1001471 - protein, 122 aa, Homo sapiens
MIEGAIRWSDTSTKLTSEWNRIIVQRYAQSNVSTDTLRNHGDGLCPFVWPCAYRVPSCLQDPELQTDVEYVSETECDAAGATYLLVPTHVVISKVSAVPPWGRVPPHFEDPILRERQANQNN

SEQ ID NO: 1001472 - protein, 222 aa, Homo sapiens
MNAVSCARLGVDRNRRGQKYQPSEMRDGDRGGQHAPVRPVARMGSPFLGLSRMFFPPTSGPGDKLSCGGSLMSHCMGAHWRRVSAHYRELREYRYEYTNMACPLTPNCHCFPRCVGLGSSLREQATTVPYTITTCLHNALVKTDSAVKKVGAHTEQEQVGRDPVNQEENDKRARTAPIEWYQTTDRWSTDSTIVHERLGDEQRPPVKSGSELTGSTGCSEQM

SEQ ID NO: 1001473 - protein, 193 aa, Homo sapiens
VSLTFFDGVSHRVRSQKIAEPRFLERRLCGLGALLLPQSQSFSCRGVGYRNLYPSSKLDAITIILSPVLVAPHGDAVINVPNRAIVAKPEDNPGPVRPADALSQSYRYYESLGPSPYVECCKRFPAVEKEVVVRKSSPKPPWPGRKGNGGCHRGRSAAGPSTSFSTLGSSPSLSGARCCAMLNPGTACGVPRR

SEQ ID NO: 1001474 - protein, 106 aa, Homo sapiens
MVALSVSSGARLSFRRLKLETVSINTDVIGALGVTGTELLCRNSSQVLEARLRDINTASWARGGAWVVKTTDVAEWCDSVMDHNTESASPLVRSMICRNGVPEKIE

SEQ ID NO: 1001475 - protein, 411 aa, Homo sapiens
LAHNSPGATLQRPPRRTPTVAYTFDCCASAMPVSSPLRATHLCAEVCVLLCWSRISRSMVSNSPDRQALIFDGARRVTARPLLSSMTLSLALAARPTWNARLPGLGGSNYSRLRRLKGSGSPSYRHQFPWGSGAPLSVRQPSAAGSSLQLALVLRSPALPLSVGARVRGTRHLRCVVPQRWLALALRATGCQRDSWLGALEPETILLGTFVESLEGVSSLRAHTIAVRPMAFAAFLLEAGRHIAGLPSHGVVKRRSRPSTEPKGQSSARLLRCDPSLAIGRKIWRVKPRGRVLGVRASEALETHTGIAKSTGPFRGVVKLAEPKAWLRMSSIKLRPFPRRKNFRMGGDRIGFPYPKNGGHAGEKGEVPVGWLWGEDKGIAFEEPSGEMRPNVLPPVIRWACAKLFLSRNEK

SEQ ID NO: 1001476 - protein, 338 aa, Homo sapiens
MRAKGLTGLSEEVCGSTLWVHQSSCGGFPVRMSLPQSLQVFTVFFSCEPLPSPPRALQLLTPAQNFSVTPGSAVDPVVHLQGFSVQFSGLTSVFGTKISERPPLCSSQALWDLTAQVCQSPHCGLKGPVCVAHRAPSQGALFLCVADLCVCSGGGTEMLLLGRILAVLIPPYLENGAPFGLIKGAPGDKQGAHNFLPCGLGPPGGFQERHPFPRVGSDQSCCPSNNIPGGTHRGGESGKLPLRVELAERNKTPQGPQNLFMHIGTNRRLEDDTPESLVSSRQREARGPTPNQREGRCSPHGTAEVSTTPCCIENQVVFGWKHHPRMCLRETMIVRLTH

SEQ ID NO: 1001477 - protein, 274 aa, Homo sapiens
MAMAGQLWDGNPGATMFWHTPFATGVLYMGKNLSSPFIGSSMTPALSSKYKRNTAYSFPTVMDLSLVRLDPLAGYVSSFFLDALGFGLFLDWVGLSTLCPPQPEQRGKVSVFRAAPFWYSPFKRENELSEVCGASVCVVLEHTICDITELSLKRKAPKGRKLAEIISPTEEGHPHTNVSLAFFETTRGGPAWNGKGAGPKAERDAGTVNSGGGPSQTFVSPPPLWRWPGFPPIGCISHGGGGRIDAGHGGPCATSKAVGGGAPPGRVPPGQWLS

SEQ ID NO: 1001478 - protein, 237 aa, Homo sapiens
WEQNFTGQQALRGHGFFRNTGLARPPLRLSIIISILNSNLYPPTGYCPTEVPIGAYVVPRGLGPMKVWVLKRQRGLPVCTKVLRPQRKRRRDGVSGGQSDAGSITSRILGLSPRGRLMSQGLPMSPVSAVPGGRGWGPRGCGGYCRGLHGHWRWCCPSQTPVPRSIRGVQWQSQGGLHRGILRGPPMPGQGLPLTRRTWKRAWATGAQEAHWASPAKVPKVVANICHPGRMRDKKED

SEQ ID NO: 1001479 - protein, 69 aa, Homo sapiens
ARGELESLRGVERSAAVRASRLPGPLRPVRLMLDPGVQTISPGSGLPDYRGIRVPYARVSEFDCLLRGV

SEQ ID NO: 1001480 - protein, 305 aa, Homo sapiens
PRTTSKPFISVTVQSSTESAQDTYLDSQDHNERGDYASGPDATRSDSLDSSTRPPSVTRGGVAPAPEAPEPPPKHAGSDKCHNGTADQLLSPTPEVRPQHMVIAVIDRNTSGLLSDQCQKRSPAPRYQNFHVQSGFTVEDDCAKAVVLALTVCPPERDTDSDTQDADDFIAVKSSDRSLPDCTPQPNSISIDAGPRKAPKIGQYQAQRLLMETTADLSLEASSAAPPEPLARDLLQLPSRAGTARGLPRDGYWFLKLLQAENRSGLQRLVPARWTRRPQENRLSGRSLSEKSSDAVGKCPSTDCP

SEQ ID NO: 1001481 - protein, 178 aa, Homo sapiens
PRGPGGLFFWTKKPRGFSPGAPRGNNQEGSTMDLLKPRGGTCVEAEKKTLAWGAISPRCGKSKMAAPNRGPPGDSGVLCVRMSIGERGTDPPRGGGGGLTLEPGGHLRGVLWLGGAFESVPCRPVHPRGGEGVLCLFPQEGVAPKSGLCPVAHKFLLWEPPGGVLRRKVTPVARTQLL

SEQ ID NO: 1001482 - protein, 298 aa, Homo sapiens
RSGDQNGYQLAEQSSPLQNLAALQTGSLKNIVLPMIHGGEIQQTPNTVAASPAASVSQPDNCVPMEAVGDPHTVTVSMDSSEISMIINFYQRRVFSIRGSRGSCWIKGSQHRWERKNEIWLTKTGILAVSYTGEARWTSEHSSDDHHWPSSDGQRYMIILNAAGMWHARGQQHCHSREAHTADPQSLPGPWEHPIQQERDKPVPLPAPHTGRLQARSTTRTSDAQPDHTRELHDTGGPQGAPDAEITRGTLPQPEPPHSTAAGNRHLAAAQAPKSAPHPHSTHSDPPRRTGQALPRPT

SEQ ID NO: 1001483 - protein, 174 aa, Homo sapiens
MRGIIEGIKGPRGTRPEVPRTRCYAQYYPITCLPEGGGNTRVWGQEERAKGPNKLSQPRYNQWGEPKGRQRPQKQGENLEERPKKGAHTNKLLTGEKENVGDPKANNKVDLPKLDNTHRDTNGRFDTQTREIPPAIQWGKTESQKFEAAPPVTVGKKGQEDQGTQGYSDQDYLL

SEQ ID NO: 1001484 - protein, 352 aa, Homo sapiens
RNCCGCPSDLLLSAHSTLQLALGPGPVRALETWTVTAQGGSWVKGVVVPQNVCEKMRRRKKRMTEESVQKSMPGGSVAVPVWAPRVVAVPGWWYQLMQSSQSLHRLCSIEGFQCSLVVAATRQQQKKKKWGMEVRWTIPQDSNRPERALKWERSGWTGLAALPLLNDVPLGRPERHGGLETSPASLGRQPPPMSIMIHEPRRLEVAPPTVSQKGDKGAHAQVHQSDAKRTTEEMDAEARGTEQKGATRHGGEQTRHGQGHDVLMETLAEQREHREANGGRGSKRRRSGATTIRAKRDSEEHSGTRESQLGTHQHGRPGQTKQSDSTQRTGERRERAQKEEADHRTENPPEVT

SEQ ID NO: 1001485 - protein, 342 aa, Homo sapiens
MRAWIFFLLCLCRVGPWHALSNEALPDETEVVDRILVAWRCELRLSVGQLESLSTVEEAEFDALVHEEDRKRTRWWRRNPCQNHHCKHGQWVCELDDESTIAPVMRCAREPPADACPVPHWASLENGVQLMTNKDLSNLFLATSLANEKLHPGAATKREATMLPPGSTSGLAYTSPLALDSELTEFPLGHAGTVFKNVLVIACNDEGLRTRQGFWLKIARSLQGDMTDPMHELENGGLRRARRSTKVSMASLLGSWRVSVDTKVISNVTVFRCYNWARYSSRWLGTPGDARFGLAITRLLHTEAGNRGHSRPGPVGSHAFTIPNKGNAIGNYTPDAIEPEDT

SEQ ID NO: 1001486 - protein, 151 aa, Homo sapiens
GLPWALAMPGQPPSSPHAALAVVLASLAAPPCACGPCPPWCPGQSPRCEAMDCLMLACSCQRAARTWAGFKCGQLEGRTCGAIYQCFVWSGTAEARKRKAKSCICHVLWRYHTQQDCIPASTVSSYGCYHEQQAYSEHAKAKRNNLAIDLM

SEQ ID NO: 1001487 - protein, 312 aa, Homo sapiens
GDARGAIVLVASEQPSLSIWSYYWYAFGPESPSNRLYRTVMLQDTLYDYFWMGTSVRLAIDYTSDLLGPYSINDRMMDVVYSQKAQDLYIRLPLALLLRSLDIDYVSFEAVSSGYTNWLALIEHIRRKRRLRGTSQRHPWKHFYLTSGKHAQSQVEVELLSLCKLGSLAASVARWFPSSVRLTMDLVPVSSMKVPRSQLEIHILPDCRSLPGMAVIVDKPWFYDMKKVGRDIPYSSTIPSQYWYYMIGTFLLLVLLFSIASDVRREDFKEQIITMWTPSFFISFLVCHYVRAGILIMGLLDSSDNAVESARV

SEQ ID NO: 1001488 - protein, 64 aa, Homo sapiens
MISPKGSASHKLTRKYPKGQVSYNVGAPRENYYSGEKRFLVADISWLPRSEPDRALVHPRCLAS

SEQ ID NO: 1001489 - protein, 130 aa, Homo sapiens
KERDFFRVSRSLLKPGLAQLQTPPARKRERKTDRGRWEERIKKGTKSSRRTFHIVQQRDLGAGREIPWDAGLEVSIVEPQAVRASGASRDPARLLSLLKPSVQERLFKNRKAQGRSPGRLCWLIFRLAPL

SEQ ID NO: 1001490 - protein, 152 aa, Homo sapiens
MTVAAGLASRGSVGAQRGAGLPERACPGVCWCSARPRGHVPATGHLQAIGLVRRQVWAFPVGPGNSDAVMRWAMLAAGWLRGLDLWGFVTISELLSCPSWTVADLRSASPGYTRCGLDRLGLPSPSLGEPRTTVTLGEWASSQWVLINRKSW

SEQ ID NO: 1001491 - protein, 75 aa, Homo sapiens
AADAGTLARSLRTSLDRSNDAKGENFPRQFVWRKEKLPWSCDSRYFWGWLNAVFNKVDDDRHQECRPVYRVGNPE

SEQ ID NO: 1001492 - protein, 60 aa, Homo sapiens
MWDTVITLAGAIRQLGRDPRDCENADEYDKCDWSSHVVGENNDEGTQINRCGTFWCYTVK

SEQ ID NO: 1001493 - protein, 224 aa, Homo sapiens
KTLINKWKLTKIFKPLLQNASISRGLRKPKVYVGYVTVNIIKWADESKYVRKRLSQYMHVKSVEPCGSQTPCCPVNACRKLGDEGEDFESTLEGFVRRCVKEEDPGKHFVHTACGLELIGVPELFSIIKTYCGDAYRCDLDNPPEVCENKQTEDGDHTRTVATTQGGQFNPGSVNDPQWESTTRRHPNNGEREYRDIGPRTSAHQKGVSKKKSSCVSRNRNIFS

SEQ ID NO: 1001494 - protein, 474 aa, Homo sapiens
GRALLDYNIQKESTHGAGAPYTKVGYADLAVKTSDYGKDAVMLLEGGAECHQYDEVLKGKENPRTMERQSRPLTEQRKSPRAEKNKPGRLDGTRDHDDTRQSQDKRSNMCTHGHASRTCKHAWGMHEYVCRGRERTESVGERGTQSPSCDAQGRPELTKREQDENVPQGGRRVHKGTKGERASRASLGNRQANESVGITYGCVSVHTPTQWAQVIVGQQPLMVTLEPKGTIRQGKSKVPDRVGERIGIGLPGRYKELVWGIAKKIRSRQRGKPGTKGVKGQQRANSINATEIATGAEGETSQVVNEPGTEGTKGIRKSNEREKGKYSGRVKREAQRGVGTQSEAVGGEHTTAEGKREIGQRDTHHGYRGTYTKSRSQETEAGPDTAVENTHREWHGRATIKRKGEGRNDQGIQIAGREEEAPRVKTWGADRHTLDRKHTNRDTEGKGRKRGEDTQSESTSGNEGHERERPVGKQ

SEQ ID NO: 1001495 - protein, 301 aa, Homo sapiens
AKAVDRVGSPSLGLGIQAVAADYQYIGAYPEGPDRSCGGVFRVAAAPTKELLVKHNPYRSKPLAVLADICCWKLYKCLSEHAVKQKHDSEPLGLKRRFMKFVTEGRNKGSWYLAGDTLPIDGILPSPEIMCEDRNFALCLYPRLRRTWCARRQAPSRPTCVIMVKSPVRRYQEAYDDVPGGMLQSLVPTPMRGSGRTWSTCRLEAIGLAVSDDWLSSSHPNDGIFPSSPNGTAFFPGSSNSPCMKGNANSFLSNQVPKFRVEPKGLFQELLGGEHVTAATRSAGTISTKSQDGQEKQGGRT

SEQ ID NO: 1001496 - protein, 103 aa, Homo sapiens
MHTIHSFVERLWKYVRTYTRNPLLDGSARKMEAVRAKPCFATPCCDPHISPLLEKELPPYYTTAIVGNSQIPWFEPTVFPIQKAISLVRNPLGNCFGEFGPTH

SEQ ID NO: 1001497 - protein, 68 aa, Homo sapiens
SFIRRLSDLTKAGTELKIDPIDMTCHRVLGGCVCRLRGIPNGCLVITENGITRQVNYSREILAQRVLR

SEQ ID NO: 1001498 - protein, 414 aa, Homo sapiens
PSGIDHCGGQAKVALMVHGPHPRCWLSSNLVDLAGHVRESRTRQVPNTCGSVASRDQSVVVGRVEVASRRQWMVRCWVAAVGHICNGSPIKSKLLNDLGPEANVDCLALCRQQQGEAALDYFAVSQGALRQKAVDALSIGVPKWNYHVGVAGEHCTRRSTSTNRDRTPLELGGTSLSSNLRRIELHARLVLSQQLWADFFGHLKTVSPKGITIFHRDTSKSATRGLNIRRGPPKWESTHMVSAAGKILRNDSGGLLLTGPREKGSPHGRVRMKERQAVLVKLTLVVGKQPALAPRLQRGPTGTGQSDLETIVATKSTQTEREYDQAGHNMLTHLAGTNTHIGRREHPEVVNSKDKRHHVEAATKATERASGHVDTEEKSQTPEHEAENTERDEAPAKYPWQKFHARSNKKERAN

SEQ ID NO: 1001499 - protein, 474 aa, Homo sapiens
PQATNLCLSPHDSQSGPYPFSPFPANQWSIRCSCCTAPHATVVKTALADNGQAHTSRNDRRPKTRPTCTNNTRPKTNQQPRTKHTPQNTPYTRQPAPPNKKKTQAKNQKRHNNHTPQQERDEQRSKQARSAHPATQREQGTERTKGNNNTQRAGPNKKGSKPRGRGTEKKNQAGKKKKKQRERKKKTRQAQGEGTARHRGQPRGAEERDKTPNGQRGQGKEGKERGSSKRANERGQPRGPSETTDKGDKGKETEGHSHQGPRPGTVRGAPRARAETPRKQTESQATETKEKRQKASRQARENTPRATRPAGAHADDRERGQPAQGPLHEPSSRADSNNSPQQPPDAASNAAPPGRTPGGGRKTEVQKRRDEQMEPQRESGPEPGGTGGPKKKRGRGAKTERKRPKRAKGNDAKHTPKAEDESQGSTSTPKGAERKRRGKTTRRNKAAGRREETQEANVKNENETEKKRKKRGKA

SEQ ID NO: 1001500 - protein, 181 aa, Homo sapiens
LEWNERMNTLQAHLDDAYPKDVGEYGNMEDVRTVYVAHGITEQCAPLTSRVRTMRDGSSAAYNIPDRQSSSGVAARVRTSPVVCMCRPGELGDSQTGCNMDNKTSRKRPSNRYETKVHSEHRVHSISVRAGLSVRRFVGWYRCTDDSPCNLQVREPGDKGESHLNQVNTFLRDVSNHAMTG

SEQ ID NO: 1001501 - protein, 113 aa, Homo sapiens
MHRATGSHKEREDTSTTGDHVAKSHKVEHDDIETLGVEGNTAQPYENSHKHVSRMTKHETREEWAHEHTTALSREQEQTGTETIDNGTTRAESLPKRGNGGAIGDTTTDKQAQ

SEQ ID NO: 1001502 - protein, 252 aa, Homo sapiens
ILCAPCTTLRGPAPPACPSAACQAQIISRLLGRHCHRSALHHPEPVPADTGSQQRIQDVWTATLYADDTPGAADFLAKNSNRTPHSGRRETGVRGTRACTQDTRQAAHVHCRDGHVEADKTRLAAKGYRGTDSATLVENPRHTVGRSPRMPCNGTHRRTPSIKRQLNVIFRQYEGEEEKQESRLGTEYRRTSRRVHPVKPQRYPPQYRDGSIQNDRVSETNQFGYPSQITQRITERHKRAMGATTALSTENA

SEQ ID NO: 1001503 - protein, 368 aa, Homo sapiens
MTHRHMKDRETAASRTTLCCTWRRGEDNQQWSCGHLGRILRCNSVVGPIEAAPLCFRGATPGADRGPGHCAPPSMIPGRGKKERSCKDRKASASATHGVIRARTPCGNRKRNGTYPEEKQSKAEPGPGKEESPFTNTKAQDWNGGAGAFTKEKGHANRKMALEVDPGHYGQDEPPTETGAPWRGPKSTSTWTNRQGLRKTAMAQQGKRRPNRIAPRWFATQARRRHGLGRNTFHQNDTGQTQGNKGRGTPMPPSKSPKNNRLQSENVRPTQQTIRKQKWPTPQEMVLAKGTQEGRKGLTKSAPGKGDILQPGGQRPPHTIGHKPWAGKGDQGRDRCAMRATEGKKRAIGLPPGSRVMASERAAKQQTT

SEQ ID NO: 1001504 - protein, 176 aa, Homo sapiens
RSEYSRLVLLRGDEIWSRMTVEWTSSQRYLVLLEFHLLELRVGSQGIWQGMLGIGILDAVGSHVAHGSCDGTCMWSMSCGCWKGHPQQVMTLARRKRYCRHASVASKHGYQSKYLHVVRSETRKLIHVAVGGAPYAPEPYGARGSTPATKALMWPHLSGYVELSIGSPQLAESPLV

SEQ ID NO: 1001505 - protein, 461 aa, Homo sapiens
SAPVGGVIERYDPVLVIPSCGEEIDCELLVPILRSSWGHHEPSVVPGALGWTLGTLNFLLVPPDARASRRQTGLDDSAMEYRTQWVVGLVAWLIGVQSGGPLHLALRLRMCVLLASWRDRYRCCIETAEFLTPETDSEDNIRLKAVLKKGRTYVAELGEGKKVKSSHGSSQGTQGARGGGVGTHWAALGTGAPSNSPAGASKAQERARLPSLRDATVEVGAFRSRGNRWNVPGGQGRHWTARACMGAWRLNPHGGWDRLDYNDRCLGAKNLSLANPGGLGTAAYRRWHQGEESNGKPTGMNPGVESPIGDEREAKGPYLTRPQRQRTPNEPRRHAGVNRLNPQGGHGGNITGAGEHQHKWGDSQWEQLEKGDDRGHAVYARNETCAAVKQTRSEKPYHKNAHQEATYNLAEMPHCWNTRTLYTGTTELGKTKWAEKPRPLPPVRHYLERGEREKRKRSTLK

SEQ ID NO: 1001506 - protein, 308 aa, Homo sapiens
MKRGLYKQAHDQLVPGDDHVSSRHCVSPIPGPRVALNEASANKRTKTGGTRGPQILVANPVRNTLGTSSGAQLDLAGEATLKPGTTPGNAEAQDTGGLQGNINGEAYRTEHKKNGAWAQGTRPVLLTHLLATPRSTHRRLGPPLNPSEEPRQGLGTLLTMKRDARTQRGTQEMTNDWGARTTPEKCPRERRQDNRDDRSNWIDKTGATRSPPNRRKPGETPREKPHRFEEPRRGKAEAHKEGEVNTDRGTRPPCVKREEQGGDKKGRPCKHQKENKRPQRVNSYRQAGHGHRNAKNNYCKRGLATAYE

SEQ ID NO: 1001507 - protein, 287 aa, Homo sapiens
GEPQPRRPSVASARDAETPLNDHGIVPDELTFHEFEEATNLLADTTMMQPPPAEADQLTPQWARGCGRGLMVASYGAEDEVEEESDKAALLQVQQQQQQTGFWTFSYYQSFFDVDNLTGPGPGSKAHCCPGLDNNFVRATICGNRPDLYGPLLDLCHVWTLSMAVNLGTDAWLLSQRRDPYIHYKTPVPPRLNRGRHQQSTAIAWLVPRGPCGGFLTVAQGCPGAHGAITISCRLCASTGVLPLWLHPHGGPCWSIPVPWVAVGLWERLALGPVSAGLVFTLLTRGP

SEQ ID NO: 1001508 - protein, 280 aa, Homo sapiens
SHSVLPSLRASRFSAGERPVPGPELDVAGLCPPSPGWPRFKLPDGLVAAFPGDREGVGRNGKKRSTRCVIDNGSGMCKAGLAGDDAPRSAVSFQSSGAPDDLMGVMCVAVGQKDSYSGATICLSMQCVAIVTREVPHVSYGIVDQLWTDMDEDLATTPSTTSCRVAPEEHPVLLTEDPPVTPRPTEQKMTQTYVLRPSIIHVACTWPSRALLSLYASWAHHWHCHGLWRRGQQHWCPSTRATPRQAILRLGPGWPGPDRLPHDDSSLNRGYRFTNYVRSG

SEQ ID NO: 1001509 - protein, 297 aa, Homo sapiens
MAEEIAGWSVDNGSGLCYGWFCWGRRSPSRVSFHRRAPQTPGRHGEAWSHERTPTVGDVRALEQACVILTLIVPHCCMRIFTNVVTDIGMNASGTHTRVYQIERCLRRPARGRTPMSLADPDGPPRETPRWANREDERDDVETYGSDEPSIDPRLDVSMCSSMARCRVTIYARLGRIQLALRRWSFWMSGVDRTTGAHSSEGLSPLTPAPISAILEPVLVPVHLSQTYQSLKDPSLESEAYSRCTDARAVARYNRCRDSLRQKASAYRSPWDSRGTEHWPPCRIRPSFSVTKSYEAW

SEQ ID NO: 1001510 - protein, 172 aa, Homo sapiens
WAPRGAPQVVRSPVRPPRRCPALPAQPCLSYMPAWLLVTWGQQVASGVGPSLLRTCVRHVLLRATGSRCIHLAAGDLLCCCVCPLGRGPVAQGQAFAHCGLRNRGAPIRLIPADLARFPPEAPDKPLGRNPRFSVEPPRKPVYFGPNVEDGPKVSPDGRRPTTRFLARGPWR

SEQ ID NO: 1001511 - protein, 317 aa, Homo sapiens
GALHDSPVTHVEAALKDAAACDGARLRREYLYPAMARGGGCMRSAQEQEGSGCGARWKKTALIPNVSLRPERLLCLYEGVPWSLMYAGGECVTMPCWMMNTGMGKAVRRYPKVVMYPHKLPRTTPKFPAPLKMFAKAIVQAGCSQGALRNEAEVDLTVGALVRACRCLTVVDRVLLVVHGALGGTPVGRLIVSHRAPFWFAISATFRRRAVRVLRSCGRFDDPSTLGTMSEAKPRPHLHIGFAVPALGKRVLLTSFRIPYFPVADRCQATGSSRFDKPVTTYRYPSGNHVVIEDRTNRNVEGFTVRFGAPFELKAVM

SEQ ID NO: 1001512 - protein, 217 aa, Homo sapiens
RQAAGAPDRFSSSSCSSVLLLSYAGRPPVEYLTRAPRSCALRAIPSRRATSEGSAAGGKGLNRTALAELSDGYAGLEQTRRSARRATYGRRRACSARKRRERAVKMNAPFGVRSLPYRASLEAEVDALAGGHVSSPKGRCHNDSDHRDTPRDVLALTKRPELNTVNARRPKGLAAGDTKRLRIQCKAVRVREKGASRSNQFERHDLIAWYPPGFDSK

SEQ ID NO: 1001513 - protein, 280 aa, Homo sapiens
EDFRSPAQGAPRNEVVGQHVYKKAFPGTGLGERKRLDVTLFAGVSVTQGGGESELLQGLVQPRITRLVGFRDRYSAEAMLGRLFSKKIATRKPQKPAEKGSSLEQCVYLEKREMARLKSRDLLLGNVSVAEIVELEEWILKNLAQTRSASTTWPSPPDWRAEMKINEDPSLMRRQTLHLSMCTVELSKETLDTMLDGLGRIRDQLSAVASEMIQPAARATAMTQLVMSDKCLPSMQAALAAAADNRQDGGDSSAALGIREDDRGTGKKAADPPLFVTRSW

SEQ ID NO: 1001514 - protein, 210 aa, Homo sapiens
MELKGRREFYEFYLLVILVKAYNLWADVRGFQTDGRYIEANPWKNLCRALALEAGCPRHNQSRQEVPVGSQGTPLGVSPSRGRLLYSPGLQERHKDMGEGLFRPRGYPLSNPQWTEVPSKLVGQEHKHQTRHFNAEIGRRRAILRKCDGRFQREQRFAKESPRIKTPNWFENFEATAHAGNNTQMELENARPCKRYMARQQLRDIPTTLI

SEQ ID NO: 1001515 - protein, 109 aa, Homo sapiens
MTVSEWGVASLACQGPFVQSQPGLDRRAFPSFFQSDRATCAALGGFRPPASLDPQEEIRPRWHWNVVGMRALVCDAPRLGGSPSLCPSPFRDSAVPWAPFCIVVPCVQR

SEQ ID NO: 1001516 - protein, 163 aa, Homo sapiens
MAWCRGPVLLCLRAKGWNQFIPARLGQEPLRGSSVTVLQVLAYDLRDGEREHEDRHEEESPRSRVLPISPSEHLGHWDWMSFVTWINAHGTALTLREESSPRRARRTRAETRSGACPTHSGIRGSFDALARPSPLPRSKSVTSPLLVQSSRERPFQAGELINS

SEQ ID NO: 1001517 - protein, 240 aa, Homo sapiens
GWQCVGRSMPGVTVKDVNQQAVSSTRLWPCLPQESPGEGCNRSPSYGDVIPVKACAHTTSKRVLLPVPMRHWFLRSRRLRIHSRRAPCTIQVAARMSGLASYMTNDRMWATVSRKRAVSGPATSALMDFQGVVARPWSSKALGGVLTPWWTMDQDGRPQNLTSLQGDIRRSWTRIAVIRWQAAQLEEAVRSKTMLGLINLPHFVDPDKDKASYSGYDKRSSTTTRSPQRRIKRRGEEEDA

SEQ ID NO: 1001518 - protein, 278 aa, Homo sapiens
ERTSLEFHIIYLRRKNKKLYSCSETAKQEAQGIMTAPVSHFPLHVEGTGGEVGSRWDWAGQRKQKASCSYMAPRHSGAVSTDPKRYVLSHRVHERRRTFSGGSHVKEGLRIEAPWTWETKLCGLRRTLTFPGSLSSHLWCPAGATQPLADKRGLVSPTNACQCSEPFDNWPVALVPRTFGPERPAPLKTQASTRHPPFSKRVSESPDGKFPPRVPQCAGVGNALFPPLGIPTPFGGPERRESEGALRGTLWPIQQLGGCFGDSPKKPHYTRAPTKDWK

SEQ ID NO: 1001519 - protein, 285 aa, Homo sapiens
MVYRTRGLGLRDINLVGLSALSVGWVLAATRMLPVWPPGVSCGPSWSRLVAGGLRGLVAGSTAAVEYLALRLHLGDLGARCVFLTTCLTSISGGLPPVCQAVEALRWERVPCELHARYPSDRTSLLARSPVTLARVLGACRGAVELGNPGLSKLVLNKKRPGKSAWNILWTNRGKQCGQLGAQTDSWRELLRLKTSGFKEKKGLGLPSKVGPPDMVPNSVGRHPQGYPPAARYRETAWPLTKKGIVRDNQNKRRTRGGREAHDSNVTPRLLQREEPYKEEVIRSP

SEQ ID NO: 1001520 - protein, 198 aa, Homo sapiens
MRGHNVGSKGENSSGQYSGSQYVGANKRRPRYTAAGRAETHSPIARSKADSGLRKYGHTNKRGAEYTAHNVYYTPAGAIPPHGAAPPQTMTVHHTAATPNERAREARPTRRLPKHVTSTRRNTRPQAQPQPNTAGTYHKHQHQLAAKPQTSRPNHVEAPNPGHQRGGATARRGRQTHNHRRGDHHNTYTHNQPTPERV

SEQ ID NO: 1001521 - protein, 119 aa, Homo sapiens
GGVEAETTERLYGGAGQCLRGSSVLATGYSYSVVLDVDHAVECRQLVLDEARRQSEPGKYTYVCIDPYHIEDKSECYTGTARFHALFHVSVTSKTARFAGGHTEMLPASDKAAPVTMAA

SEQ ID NO: 1001522 - protein, 103 aa, Homo sapiens
DSAALRLLGADELARTTCCSVAAESRMKGGLESAGLQRRLLAEPAADGTQLYMGAFMLSELFVLILCELIELDRDVHLRILSSEASLGRMLLRRGICVVMSGH

SEQ ID NO: 1001523 - protein, 200 aa, Homo sapiens
MGDTALGSGYEWFRLQSLRNPLKKPMDKRELRMFAATRDPWGVFMGCMPYPGVDAQGGASQHLQRPREMGKDPYVVRASYLVIGEALAVNFSRGESGKNKRSWIKWIETSGGHTFGSQYRWGARKLRTGRLKTWHRTSYKGSAHTGKKLDKTQVSVGPCNGKRGFGQNDGLREPFFQYDKFEYRRKLEKVRQNYVTHHIA

SEQ ID NO: 1001524 - protein, 71 aa, Homo sapiens
ATPVQEVEGGVPDKKSKRGGLKRSSTAVVRTQVKRGIPAAWHRWAMIDVLQCCADDAEADKTQNSRLMRRV

SEQ ID NO: 1001525 - protein, 173 aa, Homo sapiens
MAGFSVPVVARSNLRVVISDRHPRGLARFWLDGCLPHVAQSVGAAMTPDSCQGTWPRDWTLVPGLDSGHRDYATVALVPESNVRLLEAPDPAGAHAAGEAGPGASGPGVGGWAWPPLQLAASPPQRRPGQERIVISHARPRSSAWVGPHVLGSAAALGYHVQFGPLRGGEAQR

SEQ ID NO: 1001526 - protein, 171 aa, Homo sapiens
QAPSLGSFHMVLSLQVHRSQELRFGNLCLDLEDVWKYLDAQSKVCCRGGALMEKLCWAVWKGNVGLEPPHRVPTGTLPSGAVRRGPPSSRPQNSRCTNSFTMYLEKAVDTQHQLVKVAGREAVPCKATGMELPKTMGTYLLHHCDLDVRPGVKGDHSGTLKFDCPLDFRLA

SEQ ID NO: 1001527 - protein, 284 aa, Homo sapiens
MGEAIIPRRKQCALCEEIAHYPRAKSSAYKIAGYVTDLMKRTSESAHYRGISIKLHEEERRKERQFCFLKPLSRLASGRLLQASILMTTGNAERLIGLRTVMSRTVSVHSAYRLVMKFRETASRDPVLKLFLWKLASITSQSNLVTTKENAQNELRRGSYHIDLVVRRNRGVAFDILVSPWRHNALYPMSAVPFPWRLTRGGCTTFDRSFPTIFSVGYATESKRNSLEYKPRWRFISCGQFDEQLSGEKNPKTGGALLGGINSAWLAKPPYPTEPKLTKLEPGI

SEQ ID NO: 1001528 - protein, 222 aa, Homo sapiens
MLKPDFVFHVQLHMTLVGKHEANESPWAIVEENEANATAQRIAQHHRDECDNNTGSTATDPVTTHATTNNQSRTTPQAPTSNQNRTGTQENTTNRQENTKTHAATQTTPHTRGLQTAQEGARNRAPASSNDRGAHTSATATKRSTRQREGEHTRTTENHDHTHQQQPVQRTSTQHVHAQEKQHTPGTPHQDERTNDNPKQRHGPSRGVGTPTHPHTPTHIHR

SEQ ID NO: 1001529 - protein, 152 aa, Homo sapiens
MAFTRILSIWFFIKMPLHGIDRWIGLQYKSYTHWGVWSTFYRVQSLGRRHPVLGRSPTVREGRETVNPVDRAAVRAWRGAREEPREVGSRGEWTEEGSRHCETAGTQKAHVTGCREGQEGQTSVGGYPEKHIPPSPSNPEECRVACPQRVGD

SEQ ID NO: 1001530 - protein, 123 aa, Homo sapiens
GTQEEEKKPPPALPPPPPLAKFPPPSQHTATTNPHPQPGQLLKSIGPPLTGGTQVLIIEGTWRQNDIHNQELGTIETHTSDIPTGNTRVRMHTRTMNDNTIKPDTRKTSHTGKSPRTRHHYMT

SEQ ID NO: 1001531 - protein, 431 aa, Homo sapiens
EPYNATALRASVVTMNTDDTYVLRRRRRAVTGPRKDFSGSIHWGGGTGIRASGHVILYLHKMSEKELHMIQHVMLKELCSDVVAYQAKRWSDTWGCRWPVTSDFLNPITCSQTIHVWVVNTTSWSRCVPVVPSVELAASSANNVGAKSKRWGRPVSPDVSYFPCDALDVLARISTQRSWYRTHVESFRGFFQQVAEKNYNLRPVFFLIDQRSIDDDLACDPTGTELDIRHRWVACLAGGRDGPMERTGRMEPDVLMVPGNNEGSQANFCWEPGIPQKIVQRIRPVLGGRIPNLRWGVKQGQVLTLSSLGKGEANRPIPPWKPYLSKAADPSGGQVLTALPNVFHWLGTGALPFQAWLTHTRAETVQWTRQDEQVTNGKGLEEGNRVEPESCLTPGEVINTLGTPQGSPTPVENKEGEHKRVEREGPTKGQA

SEQ ID NO: 1001532 - protein, 275 aa, Homo sapiens
MAYYEKKEKQMEQQKKEAELYQVGMNQGETQSPQSKEMTCMTDLAKMKQNRDSGKVVNKIATRDQGLRDGLVLQGGYQYLEPRVMVGGRKQDFPLVEAAVQKAHSYVRKLRTKNGCRCSTVTQESSCLKDIAGGVGDSIMEIGKIKGLPKPGKAGSEHIRPRQSEAGTSGEQWEVQMSNHGRREGTKSHPGERQDGRQAPQAVMARSDWTGGNTKSEETWSCGRAYPSYNRPRQRDMAADKVEHQTKRPRQGSTSRTIGPKMVTTQTGDKEHRTS

SEQ ID NO: 1001533 - protein, 177 aa, Homo sapiens
APEEEEEAAVRAIAAVVCGGCGCVRGDRRSCRCAGLYLCGLVLRVLQPAALVCLVVLLCHPAACFAQFFPVLPLARVPALSGGAADGSGVVGRVPELQCQPFLRPLPATRIQLAAAGVMTQLAFEVPALEKRSDISEAARWGIPRQGDSYSTLVVRTRKTRIAFGGTTRSCDTERFT

SEQ ID NO: 1001534 - protein, 231 aa, Homo sapiens
LRSTDLKTSMYTCQFPRRWLSSQCSAARIRGLACCELRMCRMLDSLAAIVSADEIHEDGSSLHTRGDFAYRKFACKQLVGSDVHARVCALVRTLVSVLRAPSTCASPLCALDWQVACASRLCCSRSLPPSKSRLAWGRSSGLWRATGRRVGKGELKSCHISSMIDYTFHAAERLSTLLTAQCSVDGKISLFTLRTHPTSETPSLAYHTNTLTEVERWNARTFACHSDAARI

SEQ ID NO: 1001535 - protein, 303 aa, Homo sapiens
GPAAPAESLSRGCRTGRDRLVLVLRPPGPAVGIVRTGPGRCCCLCWPSGSCAPAPGCLAPAALHAAPPGGLLAQNRVVAPTPGTRDPLSELPRPTCLVRSPCEPCPWRSPAGRPATFFGQWYEQPAGWDFWPAVLLPWRMLIGDPPGEATDFSYDTGSSKLLPWQETPHSYIKHRTLTQRRSSQHYRSNGPLTFTSEVPHKGTLDRRFDWGKTSSPSPKASILLYLSTFATIFELREFLLAWDYNWNWNYFVLALCQDFAKPSSTMETFFDFPGDTSKIPNRFLPADVLSRMPVAGSGTTEVA

SEQ ID NO: 1001536 - protein, 150 aa, Homo sapiens
MRRETSCGRGLDKSAQPLWDRYTAVGSRPFGGLDSAIAVTHCGGIPRPTITEFNFTCQEYPFSFVQSPQGTRCEIAGEKGIPLAYYTAHEGNPSTSTEGVGPLPQERTSPPRLALVFSEASPMDTCGEHRKDPKRPKYNVQGTSPNSYFT

SEQ ID NO: 1001537 - protein, 116 aa, Homo sapiens
MPCKCTNLGQQCTRKERLLIPGSVRPLIAEGPDVALTCGPNGNGPGFPGQRHVRGGISYKSPRESIPHLCSPADAKSPSRSSKYPGPVNPCGRRHVTTCAEEGLGTFGLHLLRTGP

SEQ ID NO: 1001538 - protein, 414 aa, Homo sapiens
EPAHWDWEGGPTAMGPATSPLTNSCATPAKLAGMHACMLTQACDRSRAVDGRSHLRGLAWMLVHAPSAPLPCVHPAFYATPLFAWGPSMSPPLPAELTACLLNPWNGGQLLLRVRTACACLQYGRQWRVISQTGATLCGGQNAEGTVETIRTIRSAILVAKTDRSESQGRSPPGQKYISPMKTLSTMEWCHRTAKAARAVPADSRGQRDQPHCGEGRDSQHTTARLQPASDHSPSPSGDPDTPHDEYTPPFTHTSTLVQKGTTTETKGDTSDTRKRQDPPATCTTSRTTWKPGNWLAVRPYGHRALIHDPRRSRSPGASHGLTHNSVYRKPELSTTHTTQHHHSQRHRNTPHTFKHTLKHPPQPTNSETNTLTHGPTLIIIIPYTHYPPTHTSTINNQPPPIHHLSSLLTYSRN

SEQ ID NO: 1001539 - protein, 230 aa, Homo sapiens
MCTLRVSVYCFRFFTVPGWPEIGLRRKERHVCPWSVQRPHNADNTGRLAHIESQMNSDVGVKRSSTLECTTIRWQQRMYSELESSLNVCKHNVDMSTCKSTASFAMRDNAVGAPRSCTPDVLMQTTDMQLRDLTLDRSMRHLDLLIATCKKVKPLQRSFNFSTIFNSERLTGRWTVNGTAYSTKGILARLGQPWALTKDINGGFGQCRLGSPRQSLFFSPGGAPKMAVVR

SEQ ID NO: 1001540 - protein, 36 aa, Homo sapiens
MPLRNRKALGEVPVVLGPKGFPQTPGMWLCSPPQNF

SEQ ID NO: 1001541 - protein, 132 aa, Homo sapiens
MVSHRMDYLERSSGHYFSLGQADARGCKHQGGLTLTLTRQKSIFYSIVNASMSEGIAMPSISTCVAARMDIAPPFIFNVFVERFPTFVWYLTTRTIWGAKGGAWVGDLLYGTWSRGKVAPTKGVVSIATSSH

SEQ ID NO: 1001542 - protein, 273 aa, Homo sapiens
SFFYKREKAVGDKVYWTCRDHALHGCREPGHHPGQRVTVMLWALPPALIWRAWKPWLAACEKLPVETLHGWAWTALWSQVDTLAPRLWIVLLYLHGGPGSPDSHQASAQKCEQKVEDQEAANPGPEAPDEHQDMDADPGGLEFLKTPLGGSFLVYESFLYLSGDKCGWRDEGVLGPAGHQCPAFVPAAIAVPSLPRVRSGGLSCVVTVSLPDWGGLRALRPSGDTSPNSGASGGGPGGPELLKMPPVVPPSCCPSPSSTPGDGAGDKVHGPAG

SEQ ID NO: 1001543 - protein, 105 aa, Homo sapiens
PLSRSISTGQLRVRRRPVRRHKYQQHSSSEQRLARIILLPPGLFADGIIRVATKILSSSPGELKSHWSQDDFGALHAYRCQLTCGKVQCKEVTYPKASAQQTGIW

SEQ ID NO: 1001544 - protein, 230 aa, Homo sapiens
APVHDLRTVPEGASATRLLQLGTMREICVISRWASCGRTMYRAPTGFCVSVIKLMKQLGLEPHRQITMEYRDLSELERIMRVSYTVMAAGNQSMSLGDHSWMCICAVPGAPWNLLLQDAGSLSATGCLQYPEQTYAMFRERRSWETGGTRAGAEGTTELHVVDARKPCGLTSGSLGTCCVMGTTCGSRRMALLNLLPSEEALSPGVATHDLHTLCGVGRGTRGDSPREWA

SEQ ID NO: 1001545 - protein, 215 aa, Homo sapiens
MGFWRLLSLRTALIVDALCMTWLCLTLEKMACDCACVVPCQWMMPAAAAVYMECRRRKHWLGSGLCSSRQRIGVSGEEGPSLTTEKDAVTGVQAANLPLWEAPAALHLSGGRWRWDGGRQAGVAGENPSESAGQRPGHQWGREGCLSADTFYPRLIVAHQPNWSGLEMTITRLAKGVGLEPKTQFDFPGMTPGRVAELACSEELRDDSGLSGRFS

SEQ ID NO: 1001546 - protein, 165 aa, Homo sapiens
VCHVTCMYSWVNAEAQCWSLVEALVLACKLPPELTAVESAAQNDVVSGLEMSWLEKIVFHIVWPLCAPSDGTSPDLSCGKFCALSRGQPRSVSAVISAASVQGGPGRRGRYRVAFPDCRSYGGPPESGAVSPEVHCQGKPRKPAEELRVLSDLLSTVVPTRTGAT

SEQ ID NO: 1001547 - protein, 329 aa, Homo sapiens
RPPATDNTSPLSLSFIDVYASRRVKRVHLRRASSEPFTATYAAMFQIDAHYVMLSIEGSAIETVGEAGSQVTGADCRRRRERERRRRTLCHRSGHYVPPPLARSRTTDVHVRGVVVGIAEAFERLLRRTVEAEPIFAALIGRSDCHGLKGIANVDSKITTRFLTTKQFESRVWPPLVHSRAFEFTLFSAKDTQQVSSDYGIRGMFTRGESRVVLASVRPKVSKVPSHKGFLYKTNCLRSIMFGPRENAVKKAAVNTGGGVPDESPKRVSQLRTRHDRGDLGAGCRLRLRLAVTACSQAVGPRGVVPLGPVASLAGNFIPRRRDGYRVGF

SEQ ID NO: 1001548 - protein, 177 aa, Homo sapiens
GGLSNAGCHLRLGCWGGLQAAYISPPEPELPGLWAQGAGQSGLSLLPSFFPAWRIHLLRLALLQSPAAQCVNSVATRRDCRTPRRTPCSGRAWPELLLRASPSPVRSREQAPTSGLLEDGTRYRIGLEAAPEKDTVVRCLRTRTRMDEEVSDPTSAAAQLRQLRDHLPPPSSASPSS

SEQ ID NO: 1001549 - protein, 98 aa, Homo sapiens
MGPTLFWFHPHFYLVKILRTSDFGQVTGTRFPLKRSVPGFEHSLFGFVDRFRCDHKLTSETAKTLFGAVPLLPGPWLLAGSNDNSTVAATLVAFSVDM

SEQ ID NO: 1001550 - protein, 200 aa, Homo sapiens
MEKRLRDLENQYRKEEEEADLLLVSADVLSAVLETAEDDSDKRISVNESLEAHSPPLQEQLATTMAMIIVKLLWSAQQCEAQGPSQGLSDPPVDREAARAERPSVCGHQWSDLKMQVVNEICYEVVLADFRHGRAEIEALAALKMRELCRTYGKPDGPETPGGLLCRDVWDTVGEEEGGGAGNGGGCDAGARGVMWDSVP

SEQ ID NO: 1001551 - protein, 94 aa, Homo sapiens
DLAGFTFTLGVCSTLRYPLLVRRDPVLLEVSPESDSQRIACQGSIVLTLLRESHCMRLHLQPREQVVFSVVLCATLVSSNLVSRTVWPVNASGS

SEQ ID NO: 1001552 - protein, 402 aa, Homo sapiens
GGVRELSEEPNHLDYYSQTLRVTKLTEYLKIQDCLECSWRTIPKVAFTDMAIGKVVCAGGYHFRWPYSDSVIELVVETRPHGHGNFVAVSSPWWVHKDSWLVEAHCTRRLGVGHFIWTPGPPLVEGFWVLGRPPLWVGPMPFFTSLTLTSFSNVASPYCTGPVQTSTRTLCKGECVAMGREAPFLTHVIIHSSLGVRIALKLKAGNNPSHCQALQRTEPFYSKMALVGHLEKFGETFLELRFGLPQIFDPPGGTEVSGPPPQRMKGGLGTKPVFHEGLTIGDIFNPRKEGNTFRFRISQGGKTLFRFEGKPLGIHFEGFTHMGEKQSTKVCPPKGIPIVFNLFQVFFHKGKGPQCTTGLRCHSEMGPPRVERLERGKKVGKRRVTATCGILGKANQGTVVHR

SEQ ID NO: 1001553 - protein, 265 aa, Homo sapiens
MLESVIQRPRPTRVVKEEIVVDKLASSCVVDRADVSHFVVVRRKRDKVEDLLLVEVVCQLVGASVILPLMTSETCCYHNSVQFVMRVNLRRRVAPNITETTIQETPTRLLLRLEEAPLPEDVAYAMLGTNNSASHLMSLVVFLHPRRVGQNSGAVGCPTIISVGDDHMNNQQEDSFGSGPTLSRGLFLCVVLQATQLQGVVFVLRYVPLLVVNVLPCSFGQRPGGFLREGDTGGFCCCNLLWPLCSPGSHQSRCVVFVLLVACSG

SEQ ID NO: 1001554 - protein, 103 aa, Homo sapiens
MGGGPFVPPEWCISENLPGEPVARPVGSRWGQRIEGQIPVEAEVSSAGEHQVGGKNLSRFHSKHYSGNLPERPLHTRKKFPPVWSRKERGRRERVLSHTLSQR

SEQ ID NO: 1001555 - protein, 109 aa, Homo sapiens
MLGEALQCATGHVVPEVMGIHRRHEPQWQDTSLGAWMHWTSGMRDQSIVHGATRGELHARQNSCTHMPDVETHREETGDSGTLTWGLGLSAHSDSVTWPIWWTAKLKNP

SEQ ID NO: 1001556 - protein, 182 aa, Homo sapiens
MHNAPRRGRRVEVSVPPNWKDLTWTAYLTRCALADCLPPRFPGLVRRRGGGDAPCWLWEEEPRVLRGSRVRTVASWMAVRTGGPRPGLPSGTWLENAGPRGGQQLSRADAQAAPSPVRKGEEGQAQVPVVILSPNSLTRSFQRESGPRRGLTLGIRVHSGSSVDLGAKRKRCRGTARVPKPF

SEQ ID NO: 1001557 - protein, 487 aa, Homo sapiens
GLIRARVAAVELTLQCPDPRGVPSRGDVRDLICEPCVDATRSRVVTVPGENIEMTPFREYDTRGHLRLETSKVTIELFTTRSGNTHGLLDPHWPKKYLETENRLDVAPRNPVEIVGATFADWGEICADSKAIACAHSRFQYRSSLVAYHQIAIGFRSVAGIFPLWGPATKRMPPSCFLGNWGKASPSPLGASYGATIGPQNTLKRLRDNLRNYAGKRYRKCKCGTDARRSGCVGAHEEHRRQLCPSNSPFGYDGSPTEHYTLRPFGKNRRQSPASRNRRLSSGYRELLAVQPVGDTTRTIGKGITALTVGNFNGHTTAEARLRTGRYTLFHHASKGGQQHICSNRSICWGAIAEPHFHVGTLAPVVKDGKPQPTPLAARHKRWEYPTFRRECWGTHETQLCILARVNIRPYWVGNTPMERVSMEVRKFRLETKADRPIDSAPGAITQASVVQTNSAPHKKRRKTHLGLESKFAVARQPYQPGGGGKN

SEQ ID NO: 1001558 - protein, 251 aa, Homo sapiens
GGAGPGMKLGRAVLWTCQVLVAVPVVQAVEPIMPWDLALAGVLTGYSLTRVVYCSLRRDAAGRSGALAGKALQKDLDDNLRLDSILSIVNIILKCRALDFTKADPMSPEKPLHDSPCKRAGQAPAKISSAMIIAENYLRRVDLTQVTIVHLLSGHSCTFPRCFKDHPCTRQGWKFGIPFWMSSGLGSLRKWDEIWRSSMLKLIEAPVHTGSCSQGSLFGQRVVASLQTFCTSRLDAKFTYPVAKHLVRGVY

SEQ ID NO: 1001559 - protein, 315 aa, Homo sapiens
MPGGQHAQAWASRGTNVKDSQSHLVAASCTHGNRETEPRERGILKVPLLLCRRTWFKKGLEPPAQAGNSTGGSCINARFRVAFEAAHQDREQQGMSYKHESLGVGKVLGGVPRFYSTDAERVKIGSSRALTGKVEGWLSLRKYFEVRMRREARTIWKRRGGTPFQKVERPLPWGSPHSSGRFRSTNKKIVAPHRGCKVHWKQNEGDELRAGTLYAPQAKGPQVVSVSAWIEWGLWGTNVACGGPHLWNLRDHYGASHVGTMYFTPPLVGRPHRCSYASVTFCESLSHRRVPSYRLCRNIIGDVTRQIWTSKVMKG

SEQ ID NO: 1001560 - protein, 128 aa, Homo sapiens
MFLYANKRARVCRAQVTFGPRAKESFSMGLPNWQPLQRERREQAAFMYHQREIPNFRPSDTDCIGALALRHKGVCTFVAHTKREKTRRQPPEQLDDHSIERDQLIPLKADADNLARPLHQDHTLKATR

SEQ ID NO: 1001561 - protein, 378 aa, Homo sapiens
MQIPLMRKQEVTCDYRTSDDSKRPHTSPGQGKTSRASTPNRAVLHTPSMQEQWCLGGSGHACMTWTLAWRLWHKHDRAKRSMRGALHTVAGQLHPWTTQKPPVQGRLHNRGVPGPRRGYGSQWSKKVPQASCRRQDDNVLEERDRGVTRVGNGQLGAKKGNGSIGHGMSWGLEDVSHTDTDPGGIGSTELAPLEPRSKGPYPGGAKQERNPKKRAGVRWVEFEERNTTWREPPPFDRAHLGRHRNIAMGIGNWLTHSPGKGPRKPPVREETKSAVRETRPGHGQGISPRGQPKVKTHCGVVNTNLRTKSADRATARCNFQREEIDTTHWVEATENKGISDIAGLHHTDGTYTVRWGTLRKDKLGTHRGSPQRGREETR

SEQ ID NO: 1001562 - protein, 97 aa, Homo sapiens
DGQCSWDAVGLQGFSPHYYVVVQKLRLLRSLYGAGSGAACYPVRVRRSWVPDVAVFRVKTWLYCGLLCVLAVTTETPRQTAHRSCVTVRAQGPPQHG

SEQ ID NO: 1001563 - protein, 440 aa, Homo sapiens
GCSYLHCYIHLLVSPGLRSQHGNCNEFSHHGSHRTYRIVSMLLDQNSNVSRRGGRAEKSYIRATDNESGTVLPPVTHVAEPLHHQGSTYLQHAENKHLCSSRKCPGGLGIDLALNSTDKGQGSQSMSDHPPGTPTEGFPCLGRPWRPLYRTVVHHKREGKTGKEGVTIQATRRRVHGIEPPTSAPKAKHDGAFTSTKERRWRRPSGPQLAEDYIGQCGTHRHRGAAARTAHVHAPVKTVCHRARVENPRAHTASDKICRTRSAPPRVPGPCRCRHASTDHSARPPLSHSRRLMPETHARSVTEAQTAYTREGSTRRNERNLRRGLTPIAANPAARHRDNPRGAGTHGAEQSPQVGASSPATTTTQPSRRGAFHPLPHPNAGTSPRQPDGTRHHTPSTPPHGPSSHDRHRGPDRLEPGRHTRTKRTKEPNHYPGSYSAALT

SEQ ID NO: 1001564 - protein, 393 aa, Homo sapiens
GPLGLRGPAGRMFTSSGLQWALQGGLWSKSLRASPDDPLPSGIDPSSQARQRGAVKVSCCLIMKPYQRRGARESGDMPGISGRGWTEWVGAKEKVIVCGLGLYETCMTYLHGEGQVRVVCVCSTVWYEGINFGKTEKDEWGNAMETELCANNSLERCLARFACGVPWVPGAIDSSEPVSNTFNGKGVMGYGQFCCRAQLQLGPRPKHYTCGGIYCAANLHLGHDALRGYHRANLAVYRSNHKFNCKLGTWHYFRPQQRRISPEEVGADRIGVSHMGGLPLVVRFTEFRAIGQEGELGFGNFVNFTGIGGERSGLKASNCTTKSTLPRGGYTAVKRNSMWREIYGLKAPNSKGVGRQPLGCGITAGGALDCASTGNHGQPRTGFRPKGLGPISK

SEQ ID NO: 1001565 - protein, 81 aa, Homo sapiens
RDSRVERGGVGSQKPTFWHGSVSIFRQLYSPRLLGCAWFELDRWETMTWTQVRPRTARGNPNDACTNALVWTLVTGLRVAW

SEQ ID NO: 1001566 - protein, 171 aa, Homo sapiens
ALRRACSVPAVGSRAGSSSRVGGSHEAYEVEILDAEDNGEAVCVDKVEHQPPLRRSRSIFTKSHPQWYPARQIPPRWTPKGKSRERMRMFYRSCPLGTRATLYFRELGAQISWADGHSVTEDTTGTPVDQSYRVIMSYVAELPLHTMDQQSMNFRVQVGRYKLDASVDLDI

SEQ ID NO: 1001567 - protein, 534 aa, Homo sapiens
GRAMVPHEEASRQLNASTTAAEGTTHASTRFDGAAGLPSEAGPGLRGGPGKWRGTCAMSGTWSMVPYPACGGELGPPAGSRTQRVGLYAREEEGPSHEPETRHVRGPPEGATERARESDTDVRIAPRHMRARQRGHRRRRDLRALTRLSRGYLTLEDGTAGRSNGISELPAQRGRSIITPAGNYSGPQPIFSPACNANSQASTRATQPTGAPVGHAQRSGAKDPTLASLTLSALQPTPRERNTHGPIGSGRLNAPWGQRVTQGPRAWRPHREGNIAQVAGPPPWQNRGNAAGRRRQHSRRGALGLREPKRPAVTYAGNLRATLGKRNRQLPEGQENGQRRNSHNPQRQGPHANPLPQMPSCPCRAAPRIVCRNLHPLPLPTFGTHPLGHPHPTTGARYAQSDNLSEPVTWIAILPYPAANLDPTLGHLRTTYLSRTAWQMTNRLTRRGATPNTRPPTTPPSGRAGTPARTNRPPPRHSPLRRTRPTAHSGTHLACGAPLHPNGRHAPTHQPVPSPHASHTTPAHPTAAHDRSAD

SEQ ID NO: 1001568 - protein, 385 aa, Homo sapiens
KTRVIQVYYRKNATITLYGMQRQHGPLSLQSTGGTAGQGGTKGQGASAPLWPESARENRLGAPLYHIHHTGQETPPSERPVGAPESRLCVSTTLSVSLHRGKRLFTLCERGVCARLFVVTTHPLWTLLMKDKLSHQEAEKSVCATQNHACLKNRAANKSVVPRVLTQKVSPHHLWSLWWAPPHNKRPLLMIAGRNTKEGPPPGGALPGCGAPTRKNARPRWGGEKPTQQGSFHVGVVLVCRSTNQPCSNCLFLRPPPNNNQVSFSNKEGPPLTFFLTVKAAHNIFLHYSPHYWIDKVCRLLSIRQVGRSPYTAEGEGRRYLHPPLISSPQHKNWLCVSQPRQGERGGENEFTFRTPQADVINIRRGRSILYSQHNNKQQYLFLRF

SEQ ID NO: 1001569 - protein, 165 aa, Homo sapiens
MPIVVSWGCGHFGGPSAEAGVRQSAPRNEKRGWVRLLRSRWVLEVDQYPWKTCGYRSALSGGLCVMMAPNEKLFFVDTVLQVKQGADKEENHSPEEVTASQMKALRVELILENTSKSLAPIDVSPTGPQAKKLRRMEQLWEKLAKQWRAAPGGAQVPGAVLLKPF

SEQ ID NO: 1001570 - protein, 118 aa, Homo sapiens
MLHAPGPEQHLPGPELDHYEPCRDNCRSHVHSPRATVGTQWLLTRSSPGLQVSIHVQRAHDTHCYARGVLVQQLNRHKWCNTAQSEQERNTDKTDSYTNESFQRLPEDLDKVHRAPIY

SEQ ID NO: 1001571 - protein, 398 aa, Homo sapiens
IFATLPYVACNRRQRPLTDQCLTPPLGERPRELTLTYLTRKPSVVGYTTKAWYHLVFPWEPTVIDAVPADLLCNCSPRARVRARPAVRTYWGTRIRVERSVSTQRHCTPKYYIGTHRIAAIETSHSVVWCTVRNLVEIPLHMDTVSPLRVGETYSLASDTVQHGKNRIFPYMIASRQCRLCESHVAYREPQFRMLTRTRGYALGESSYERLQKVTLSRMPDYHCETPSRKGTFEDLGKEGDAVRMKGTGGRPILHSETHFQSDRVDTYTLPSPIRGTQKVVCKRHVEIDLRMVWGVGKPLTPLRNNLTSPRLISGFGRVCRNTVSRLCKGYRGDILVMEDWRKLGTLDADHRQIFPFKFSKGASQIGANRETPRLGAGYTLCHVLVSNLRKQFDSQKR

SEQ ID NO: 1001572 - protein, 332 aa, Homo sapiens
MKQKIPCKMYVHQCWDEIDLRIAQLYGVQMVRSIHYEKVYGLEELDCISTRRHGKTSRDTVNTPKQKKRIEHVLEHNNASPEDTSHACATSRGRAHGEAVYITPGHNERSSFSEPTPKKPMRNPTTPWRKAHGQRDPEETREGQYAVKGKGPCAQTHRWGCSASPRKHPWGAQKEYAHEAKLPKSKGERTRLGVDHEGDGIALEPVGWTRKRTLKSKGKWDSHGKPKGRVERDVGSHLQPYKETSPGGTSAPCINTAGGKDRMGAPPMAPIIENAHLATDNREVEDGTFNREQRVRKHELRPLGDGAPTESVAAKRHPEPPCGTDNDRRVKR

SEQ ID NO: 1001573 - protein, 241 aa, Homo sapiens
RHRACCCAQYVVGIRAGPGLGSQGMDLDVECVVRKVRYTGQGSLPLSDHGIVVDMAQEGRDGSRRRLICNCDERIRLQRYALNRITVWRSMAGKRTPSGQLAYLLARPDTRVKLLDVTGGLGTDELRLLYGMALVRFVNSYLEQTTDKKLPRSPSKVLDIKRVDYSGLGIGEPMAHVSGPTRENGPHNTLHGGQRSEPCALDWAPRKTYLAPTPGEPTDRALESREEYRKRESGRGPQGTK

SEQ ID NO: 1001574 - protein, 220 aa, Homo sapiens
MGASGAERARDPEPRAIDVADCAGDSAMCRVACAWIDVEAPYLPYSPSSSCYGGLAGMGATVFVQTLDLAEEPDAVELGTGAKTREYTTSFHALTSILQAEGLRGNLHRAVGLACCVRPATPLPDLDIYTVLFERLTGADGTPHWPFCCKAVIGHDRRCHWVPYVENTSRSGLFIRMTADGRITDDQTPWTTHNVSNALIRIHPGKRVSSHCERGCHPYH

SEQ ID NO: 1001575 - protein, 375 aa, Homo sapiens
EQLRRHGGGSGVMSLVPDLELADRERGEELLLIGARAGVSDVLWQAVAGQSADAGFSPVACCLHYLEVERFAASLLLQRGALRLSAMACLSVAQPRCCGLRLLCVCPYLMPLASCRLLALRDARTCRGKRRLDGAVVRAKALGPSGRMPARGRILGSRARSSFNSSSRANPCLPRSFAQVRPLVGDLSGLTGSLRGGTRELRHWAEFCPLERSHFTPPESLIFRAPPVGLVVAHPLLSELKPCRGLPLNEIVDPFAEGDLSRRLAEQFSGADTFGAPSVPPKGNVVGEPLHPEDSDLRGFEGEEVSLAMEGLLRVERLPPQEVFEEWQALPQVVTRVGENTKGLLAVGEPKAVLVRRNLDLGSQGGGLWPKESAK

SEQ ID NO: 1001576 - protein, 175 aa, Homo sapiens
MVMMAQCETEDVMQCLLCVDVDIGASYEPGTLNGTGCMIVPVTYWLCAPNCCRFGGAGTTKHDHVLLWMCDCLCRCSLRLWTVLRIAPWSSKRSPSRPNWRGHLTVDTHWCPRGAVVAFSFQSPTFVVPTPRRLLTPRELHWPAVALEADRGTRPSDYREGSLPKGKRIGEVEKR

SEQ ID NO: 1001577 - protein, 270 aa, Homo sapiens
MSPTLCVEGGVCSLHIYTAVRGHLSVESSVCLSSHTHKRVLRCVLLTTTEILSVCLCVAPLLTRDTLCGPAVLFEKAENLSHGRHTVEKRRSRPKYVAGGVEKPRGLTTCGGRRQRRSAPSDEEARNTKSVVRPPRERKTSSAAAEGKTSPAKRDDEAHTPRRRGHHPRRKHPLRVAQNHPERRQLCSPPPEWVPLSSTPSGGGLLTLHAAEGKKHPPEQQVGAAYTNRRRRVGGGTTEHGPLHTHHPRLRKSTGQTTPEEERRTIVLPA

SEQ ID NO: 1001578 - protein, 425 aa, Homo sapiens
GKKNLLIMRGKGQKGATQAGRFEGRKLPPFIGFSKKPAAQPENVGPGRAQGLQHILHKGLSKTSRRFHTSLQTTKVCLSGPHQSVGVRAPWCVIGSSIFSRAFAAGEHRFVSCVCRQLAGHSGGASSRCGPPCVLMWAYTEILPYKLLNQCGPFSPSVEGLNSQGRILAVGFDEMAPHKQQDKDSRGADEELTRGITVWQTPINEEVGSKKYRSSPQITSGVSYNTFSTGGSVMFFPQMCLAAEKEIGHIPSGKHSVERARKSGHSLTGKCSPDNPRKVVAPHQVWASNVGPPEICGNRRAHTLALYKNKYLTRGGTHTFVVIVCHHTPEQHLHHEVVSTTSGPPAAARNQTHLCWGVRTPPRSKKHPRRRGGAPRGAHKTTAGAPTYEASELWRKPPGGGGPHYRKGEQLTPLKRALVCVWLKT

SEQ ID NO: 1001579 - protein, 299 aa, Homo sapiens
PLYTGGVAQHEGIVVGLADGLVILVHAESGQVHGLAVDEEAGAVDTDSSDAEDLLVSIDYLITVDKGDFGLVKIPVAWLPEMDRRDAGMGVRTGSLSDHVALGVENCHPSRYRFSIVRKNRPGDDSVISVNVSGDGDVLNVGLGAATQPHVAVDAGVIEEVVPVLLLRGPREIDDNPRRNGLEGQPIVDTNCEPTFFCPGRTDSVIRLRKGGTRQACLTNLDVVDPKRGLGMSRRIEMDDERDPSGSSPGRKWRNLHGGLPRPGDQHVNAGGRGTTGEENPWGTKGPGNRANLSGGAAY

SEQ ID NO: 1001580 - protein, 287 aa, Homo sapiens
PGSPYLSAWLPEFPTVSVSVAVPSPDQARSPVSRGGPQVRISCAVPQSALGCGALGVWGYCALLLGAVMIVMVPVGSSSSRSLRTCASDPSSLFFNNVEGDPLSLLSRPSYFFDVMKPSRDPEGARSSQVLGARCPTCTGSSGTKATVEAFKKRTDTVSFLEYRTFQFQPSKSHGRRARYIVMPNILVLGAAVMMENKPMTLKLIMTVVHFTNSSGERCRFMNPALWVDDHVRATRTPLVILIKKYFPGMFPFKDQIGIIADSKLQNSGLLQRCHGGSNIRGSLVPV

SEQ ID NO: 1001581 - protein, 126 aa, Homo sapiens
GGWKTWPLQLGVEHCDAVVTAFSDDELKVVSCGLEKLRHVKTRSSIQVLKAVEDLISDEISCEMVQSASVFQKPEQDPLDKATVWHAALNQDLEPDQSAMSFKCIVSSVRMPGWDSVSSSLTSCCT

SEQ ID NO: 1001582 - protein, 105 aa, Homo sapiens
MTSHRGVNNTSPDGGKEAKRLKCQRPCREGLRLRPREAEAGGREPVEAYGSSRSAEINLPLLCRRAKFEEVERALVHLAGVKPLGFASVIASLFQCGASMREHPL

SEQ ID NO: 1001583 - protein, 67 aa, Homo sapiens
VLLSPENWASPCLGVLDLLQSLVLRSRAVVPEALGDSACCYSDLSAFGWCCWALLRELVAWGTQLCT

SEQ ID NO: 1001584 - protein, 192 aa, Homo sapiens
MTGLTLLYVLSEKPWLKGARTHQAAQYGRGDEAEQLNPTSHFRMTPTGGVALTSPGVLAVGEEQQSAREVKIGNAPAADDSDGRRRLVVRELKHQTGTSVEMKGGMSHGHRSEHLKGVSSKRSEVERGEGVLTLVHKRLALELLLGGPRQEVQSSQSGGDPHGQGKYYLVEHGPRGHRSTFTSATGGHISGS

SEQ ID NO: 1001585 - protein, 180 aa, Homo sapiens
AESGPACRLGGPVPRRPAHLRARIPECQGRACTWKVPAPVPSLQPVRDLSPNSTIFRSVQGPRWTMLGHCCGTLRSPDRSQVPAQPATMVAHECLVQQIQGGLKGSECSACWVWRRGSLGLSPAAMAGGPSLTPHCCFSSLTEKQAKTFTRGGSYTMEQAGEWEVQIGRRIEGGKRGEGH

SEQ ID NO: 1001586 - protein, 250 aa, Homo sapiens
ARVKFSHGETAYVAACDVGAPASVGEHRDGRRNARYGFRRAGYLRTLYYGGARTEPSWTLPRDSSLHGTPAILHVTSVTWRELERLVRWSGTQLSLRVCYPRFRRIVKIYSTMDPNAPASSCEVGDQVHVGSMSSVSRARGEIAVISQNSRKGRTENQSKSVARSRTSDTLCPDAMRLRELGLRQERKSCGGEAESGVKLDGIRLIKASFGTKRQQNNVEHKGLKSLCSGVYKKLTGEGCEIVEFPEFQL

SEQ ID NO: 1001587 - protein, 331 aa, Homo sapiens
GNGRAGGAAAGGREGRSVAAAVVVPASAEARALRACVHVPAVLFPPSCGRRSMTPRSASSFTTGMDGRVVGPSRGEPPIPPLLYSLDRLTSHGWEEEHWLLCLNRIRMSREELHDDVHLLDGRRCNEAGNCVDESDLADYTCDRDCRLEQYREMQAAKLVGFQEFHNPKGMSVRITICRSHGRVRSSRSELGSDGFLTNMTGTCPELSCPHDVDRNARRTSNTGERRLHSVQHPEGGRMNGEGELAGGLWGHQPGVGLGKADEQRSGPGLRGRLFGRWSEGFPRKESPQPQEPDSLNELGQAGRKLERDLGPRRVRGSGASGFEGTDRKGP

SEQ ID NO: 1001588 - protein, 411 aa, Homo sapiens
LALSGNLQWPRLSGSADLPRPSLLASESLAEPMLSGLGWSWVWSPWLGLQLCLCQCSCGDPGAIVSVCESLSILHEVVSEALSPEVLELRNESGVQRVSLPGTVRLTSCVAVCELLWFLTVTEPPHTSDEPDMVPRQALCQRELGRSVSMRWAHPGTDPRPVERELVSWTTSPANCHGWEQGKPLGNPLNPKEREDQDPNGLGEHELPEVLPFGYSPGFVRDERARGAPNSAWAYNTVLLRSTSNTCVYSVQQMIPDAEMSTAIERHVNLLLCPLVPYFQDTWPRRDCIRMLQTRVNRTSNQDTCMEVVNTHPNSPFKLGKKLKQFITHKDNDDENKRHRLAETQDVGRVGMIMWERYRQERRRAPRAPLAPYCRHGHTLVRMGGRQRKRRKAHGRWLAVVTNRRQQVTPG

SEQ ID NO: 1001589 - protein, 42 aa, Homo sapiens
MKHKKFITAEGIQGPFKIPSGRGLRGQERKIGKPTLRRRRGS

SEQ ID NO: 1001590 - protein, 174 aa, Homo sapiens
AEYIAPEVIFRQAMGSQWTGGRMGVVLYEFLVGCVPFFGDTPEELFGQVVSDDDHVAMREMSALPADAHDLIIMVAPGIARWTVWALVVHSRGEAATPFCWPGLGQGFSDTKPSSCARSKPRIDTSYFDARTEGYRHLVLRGYEETNDRTNRPHDDPPVLLLLPPVQARSTGMF

SEQ ID NO: 1001591 - protein, 184 aa, Homo sapiens
MEEEIAALVIDNGSGMCKAGLAGDEVSPSRVSLPSLGRLAVHREASCDVSMGARTGLPYVGADVGHRDKAVGACLDLVKVTAYVETMAISRPNVGTNNGARSWTSKSNYTTIEGLQACWSPREGCQRQWLARTEGPSLEALHSAKQMRKDDSGFSLQRTLTINRPGPCNVGHSKAVAGPFYRPL

SEQ ID NO: 1001592 - protein, 206 aa, Homo sapiens
LWGDICINGRTKVEEGSNVGVGWGRNGRDWGQGLRTRKVCKTPQPPRGLPLQVLCSCARAGGYRELRLSEAGWDNTLPLPKIWAPKKPASVALHCGIWGPPSVTQAGHIYPPNLDTGSPLGETLCVRLCVPWGDLGSLRCDVRPCKRSPRGEHPTVPLSERFPPRGEVCNITFTSRKNVEGHVWAPIWGARRHGALGRPVGGWQGC

SEQ ID NO: 1001593 - protein, 285 aa, Homo sapiens
MAKKDLGEQQDEAELIREDIHGGSAQFTASGRGERRAAALRATQEELQREPLCPTLRPTVPGSADRSSTCAVISTGRAVARAADDPEAEDPIPEARGGARRPEHGRGPTKSDAESDHPRILVSPWVLTWPVLVMAEAGKWITPEPTCSEDVDELRTRRAAHNVGREAGQGMLGCNRVNCGPAGSLGAGRGGGGALRDSLQVPNGGPRAGAKYSRRCCRKDQRTPFSLLAWVAAGKQSPNPILIREDLLHLPFLGASGSIIGEHGQGRAGSFDDPVCVIAASRPSA

SEQ ID NO: 1001594 - protein, 233 aa, Homo sapiens
QAAGRVSDAGPPSGSPRGASGASVICRSATESRLARCWRSVWASWSHLVWGDRQESSLLVRTSPEALASAHSRHVVVGTRRLLVDQSLYQPSWLLTSIVQIGLLLLCTHRASPIVRLRYHRMSCATHEARGLLDTEVSTQEPTLLVYVRDMVHTLQAALLDHLALQCETVRSDSLRGHQYNVARPLRLSACVETQLRETPAIARMRKRGGLALMTLCVVYYSDLLTLLRRFRH

SEQ ID NO: 1001595 - protein, 125 aa, Homo sapiens
MAPCQFFPHEVGWEPFGTNRGTFLGSSRTRKAFLLSLSLGKDSWKSPSYLVPQFLREEPQVCLRLRGIWATSARGQCLGDNTTTNGTVGLVVTHSAVGGFPGTPTWWPFHGRPICTRDPRPFQAM

SEQ ID NO: 1001596 - protein, 109 aa, Homo sapiens
MKQRVSAIGMTQTLAVSSCDPGIHVLERELASNEQYIYVSVCVCDLALSSVCMSHVYVLLRRREDKLLLAGFPSFSWPKVFPYPLATARALNSDQKRQPRLIERSKKCY

SEQ ID NO: 1001597 - protein, 60 aa, Homo sapiens
MCARSSTVSLSLYRIRAWVDRLDSRAESTVFDAFDLFISQTVSLQELLVPELVLRYVVIY

SEQ ID NO: 1001598 - protein, 273 aa, Homo sapiens
MLTLEVAIGPRDDALSGKDLALGLHCACLMCTLPCCCPDQIHRASLSRVRSCYCRCVKRGLCRAQMERPWDLVGAQCSLLLSEHEAASSSSTLVEVTLGEVPAARVTMILPRVLRDASRTPHYHELPSLEPILGGLQQIAMNEDGAKTFPDLESEFQAALSRNGGRVGSFSAPQVSSQEPVTKAEIAGECRRKLAVFLSCDLQTKLPVPCSWSLGIELMEVEPDRPLVHLCTCLGLSYEWLLGDNQIMPKVKPPDNRPGIIAERPTVPLRRNL

SEQ ID NO: 1001599 - protein, 33 aa, Homo sapiens
MVDPTRCTTGSPPLLPFPWVGTKHSVLGEAPMI

SEQ ID NO: 1001600 - protein, 121 aa, Homo sapiens
MPSLRSIQSLRIVSLSPFSLIGKCGSGGVIHAQGPSSCSRDLAGLLGTGLKSSSEPALLRPRCNPGQAAHRCGDSSMTHCITAYWRMDCQDQARVRGRQRCGEGDSLSRSPGVLSDICNTD

SEQ ID NO: 1001601 - protein, 96 aa, Homo sapiens
MYYIETPVELLRLKYWLHLTRTGTSTANGVETSLRIPEETHRCPSVEKPRSLRFLCETPIRCRFIRARPVRDDAARPWKAKDVHEGDICQERLDRP

SEQ ID NO: 1001602 - protein, 107 aa, Homo sapiens
MGTLHPFMCLVRMGVLFTHVTVLHFKAVCQGVDHARLAPAVSGGHRLGLTLATTGDPSALPSAPPAWVRRHQRGGLAATRLSVVGHLPTLRIAVPALFFGPPFDACG

SEQ ID NO: 1001603 - protein, 223 aa, Homo sapiens
MGKEAEREESKRRKSRRRQARREQQETTEEKRDEREEKRREGERAEQGERRREEETTPGARRRRERDEEKEKGKEATHSTAKTRTDRRQRTKTEAHKDRRSERPATADREPDTEETRAAGRNSRRSERTDESPEARAAEPAPRGEENAPGTKETPGRTEPSTKERGRNSNTRRDESAERGPKATRPYRDRKKKHEKKEQEQIQQTERRRADAAAATETRDTGK

SEQ ID NO: 1001604 - protein, 141 aa, Homo sapiens
IRWCDVITEEFSGSQTVGYPSVFLTYGKLQHPGIAGKVKSLPKDDPSKDGPRLHSRFLGVYKGLWHDITVCDEGTFDTCRRSEGCHSNNAHQWLVRTVKQFSGDTRRQGCALCGQVRARIADGETHVEGPSRNFNEMVVLA

SEQ ID NO: 1001605 - protein, 344 aa, Homo sapiens
KGIQETEEMVKCGGHPSRGWRSCVLDNKLCPLQPRQIKGMQILSKQAGLRQPAAVGRSRASGSGKVLALVFGIATCATLFFILRKQYLQQEERLRLKQMQEEFQEHEAQLLSRAKPEDRESLKSACVVCLSSFKSCVFLEIVGTFVPEPECYTLPCHEPKTCALSAEHGDHPGDTPVATANSREASTGLTVECTPMCPFIRAFVSRGLWTEQWWGVAVTIRYDREECIGYKGCGTQAIPSRLRRENVHPALEPASRGPKGPAVRFKRPEHTREETNARRKILPTTGRNAELQETGRGELQDGRRGTPKDTRKTGGTEEPTRVRRATNSVTQRGTTVLPRLEPGE

SEQ ID NO: 1001606 - protein, 107 aa, Homo sapiens
VWSCLDLQLRHRGPAFCPQQQTALSRPGSSARQRLEREPWGLCTPGVWSLFHQVDLMFGGLRRMKLNMLKFEPEAKQEILENKDVVCINHVHFLMDLEGLKIDIIDL

SEQ ID NO: 1001607 - protein, 294 aa, Homo sapiens
GNDRDGLTEHDTAPLCVQQLGPTESWDPAASRVASRQSAAVRWARDVTLRSRWTNMYTRFTTSAYFDVPDLVRVLLKGAEAAELVNSTVHVTSIQRAQTLHIAASMPVPGAPPKVLCWMPAVPTLSLMDIDTGLVCRPRERVPGSYCDMSLGQRQKAGTLVAQTAACGRFWQEARCHYLASLPKVHAYPTMTASQGNLMLSALGPCSWGRPGAAWIGHEDRPHCRTLCGPRNSCPAAQMALPVGAATNPEGQRTDSASTRGPYGNFILPSQAKDLFGSVSNISKAVTPPTCYVT

SEQ ID NO: 1001608 - protein, 305 aa, Homo sapiens
MTPRGVVGAPHHGRMLVPPGELAETTQSSAESASYQRGFVESRVAERRHVVADNAILDLPQDSSVHKDRRKDQKTSPSDKPPPSGKTPPSITAVRETLSLPRAENSLYLFTPPEKNVLTPNELCVFFYLTPPLFSSEAVAAITDVGLLKIYQPVVSTPTTTCIFTATKNDDSCSPQKTSLYHIQSSPKWSVLSPKMEEDPPVYTWMKLLRRGRRDKKSPPPLLRLWLLKRTIAVSNQSCWRNTTAVHYTGAVVSAYIDNTNWACPIHIHSNMSNIDTSPVAPRTKKHIFLGDNPPPLSVHQFSID

SEQ ID NO: 1001609 - protein, 292 aa, Homo sapiens
EKVMNFQADVFTLGRSPKSRSQTLLMVQKFLMVHEILNTLPADGGGGPMPARGEKRGETQDMYQSIMMGNRAGRDGNHDIHDQTNHREEHRQGMDHHTRGGGKTDTDKTGMQDKTQNPVDRRGERAKNDAKEMMEETGRKRNPQEQNKDKGRTRQQTQETQQEKKKHQKAPKYKIKRTRRETTNTGNTQKEERARTRNTTHTQRSTQVRNKNPRQKTKKQKDTQQNKSMGAHRRHDREREINKHDPMTQKKQTKDNTVTSERHGTTQETQDAGETQKRGTRPPHDKEDNTTN

SEQ ID NO: 1001610 - protein, 179 aa, Homo sapiens
KRMHQIIRMNPRLGLKDLQVLDVMSYARLIFKEHRYTYESSFTQHRRADAMLTLIMRIHGLTICNGFCHLCCKPQDAYFQYELLSSRFDIESNGWERLFLLIAYISILLGNCWRLISYWKCIEIIIYRETWNQYADDDDEDLLQFDTNGVNKERFVWLSYEIALEINSTKTTTADYRSS

SEQ ID NO: 1001611 - protein, 168 aa, Homo sapiens
MLTRQSWLGCYDYISLIRLAGHRMREAIPSEYGPKDRYSISNDELQKGYGMTGRGYRAQFAYQYVCRIQNEAIESQRGQCRSRSCMRYERTYNSTTVRDSRGSASRTCSSTIAQVECEYNVLHGTTTFSAREQSNRDSLSTQSYRGTDPASCVNMTVQWVMSRHEQNI

SEQ ID NO: 1001612 - protein, 152 aa, Homo sapiens
MALGGSVTRTSPHVTHPSWPCGERQLYVATDLLGIEKITGRIVWWTANPSSVVRNAIMLSCNSLSQPCRSSREPGCKVAPYGLMVGPAIRRQSTVEIDQHWVAYQLTCARRHDSDLRLWQSIDWLSHQNPGMVLDVYVQAGTFGGGDCGPVQ

SEQ ID NO: 1001613 - protein, 142 aa, Homo sapiens
METRIGLAAVDWRTTLRTEENFFRTSFTWPVFQPSGIEMVAPQRNSRARSHSWVPLLLGGLSVWFWPPLVDGPFRSDPRDGAVPPRSANRERFPGACYVSRMPQTLCLWVATGTRVCPPARFRVSIRLVHTIGVRDGAMAIV

SEQ ID NO: 1001614 - protein, 113 aa, Homo sapiens
ASVLRSISLALRPTSGLLATWQTQLTETHQPSVIVVFLVTHSHADQNLFEEQKKEILPEQTTEASERLKRKIRKLEKATQGANSYSNDSYYPSYRVAWHEEQESWALRWSLTL

SEQ ID NO: 1001615 - protein, 121 aa, Homo sapiens
MPTCRHMVGVAHSYVAVSVIRKQRPCRRPKGHVGICGFPIPAFVVPASDFGFPPPLAVFTTQFHLFLDQDEDNEERWDPMSWLGVRTPHPVWNRSCVLTECCTTKWLSPSVANTLVEGTRI

SEQ ID NO: 1001616 - protein, 162 aa, Homo sapiens
MLTPKRQYTYTPEERQSYCHNSNAPGVDPPVPSPSFTFIGGHPHCGGTYARGCIVYGRGQHVKLENPRKRMRGPSTIRWEPGLLLSRGPVTHRKVGPHPRIAKGREVLCSANPYGARAPWELSDSGLGYGMACSNSQRPVGNGENPAKGPTCNGAMPHGAPP

SEQ ID NO: 1001617 - protein, 153 aa, Homo sapiens
AYSCQSTPGIPMNSSLQGTGRIAGVLCIVVGGSVIIALDWVDSRACQPHGSYCLTFLQTAEYPLVHELCSFRSRRDEGLMDWSAIHANVVVQSERWRAWYGRAAHMQASCLNIRLVRPHVVAVSAWAFVDTRTRKDRHGHVIGGPFVSGFGDG

SEQ ID NO: 1001618 - protein, 223 aa, Homo sapiens
DKLPYKVAEVGLGALGDARPWTLLRTRCRVLMRMREAVLGSKPLKGARIAGCLRMTVETAVLIETLVSLGAEVQWSSCKIFSTQDHACGCSLPRLAIPSVCLERGGKRTREYPVVHVSDDPCSVQVIVAPSKHEFWTDMGGEPSIQNSSTSKVPRQSSCQGILGISDETTSGVHNLYKMMAHGILKVPAIKGQLTPSAKSKFEQTSMGCRDSLIDGIKRATFM

SEQ ID NO: 1001619 - protein, 296 aa, Homo sapiens
MVREVLTCETTSWYRVTPLLNRSSGIAWTNIREMRKVVVCDDAYYESVTQTWMNDLRVICPWPKDRSFERDFRWPTVLIDEMNMVERLGWRTLSGGESWVGLPLLGTPRDVQSTHMCRFIPCVRLPSFRISCPVRCARPPVWRVRRLVTTLYKCTVFRIHSTCLCASNGTRRRRRRISRGTGRWRGPEASTSLSSNCLNAWRSAEPKRRPMVGYRANPQWFRWHHDNQNDPVGPSWVAMEKRKNCHGTPFAPGKPADGSDPKSPWHQIAWKTGKGETGATRGPEPERPLERNGLGR

SEQ ID NO: 1001620 - protein, 209 aa, Homo sapiens
MLKEDDELTVNPVMADELTVVAVFRGRMSMKEVDEQMFNVRRRKADTLWNGSPQQCHRQPSCVRSRSLVDRRRWSSHLHLCIVAETSRQHLQELSSASVQCHVPPEGLPPLVHQAKVLCAQRIGSSNPQRVVISHNMNRSSSSELIYAVSGMPHAEAMEDGFQDEEAEEESLKVMRAPSQLQCFLEVPVKVGYLLKPGPISIVHFQTLS

SEQ ID NO: 1001621 - protein, 88 aa, Homo sapiens
MVDGPGVYGADRFNGRHCLYDRVPTFAPGVNMVLGPSSPRWSAWASSSSKYVYYEPLVYNNTYVYPWWGEAMGWAFALSSMLCVPLHL

SEQ ID NO: 1001622 - protein, 284 aa, Homo sapiens
RELSRFFREWMFIINSILNPLSKISQSMKIQVGKGQSEHRTLSGSGGISTLTYRLVLQFFVFPAKGKEKALVGAKPVLEAPGKAKCGSSPLSHEGKMCEPLSYVPVYTTRDGKEGTYKGACDRTNGGGGPPQIVALGPPGKVVPRDTGGHTEKALKETPNYKWARRETHKRGSPETLRGPPYARATYHTAWTKSNHHTHKAQEKGLQNTCVCNRGAPKKRSLRVPHEASYAAAPFTKRSYSIEHKGTQDNGVTRGGHHTRVCGALNRNKPWEVVFALRKCPPGG

SEQ ID NO: 1001623 - protein, 101 aa, Homo sapiens
AEQATKSVLVVCLGNICRSPIDEAVFREELVEPIINDLSRIGRVDDASGNLPGLVRYGNTRAERTDEAGRLALKDGHSDIIPGGAHGYAPGRAYTQRRMTC

SEQ ID NO: 1001624 - protein, 39 aa, Homo sapiens
GQEEGAQEPRVAEMKKNRMWTDDCRKECFCDIAQRSGAG

SEQ ID NO: 1001625 - protein, 214 aa, Homo sapiens
FDAKNMMAACDPRHGRYLTVAAVFRGRMSMNGGQMSQDVFNVQNKNSSYFVRHGSPNNVTTAVCDIPTVVASRWQSPFIGNSTAIQELFSRISRAVFTVHCFRREGLPSIWYTGEGMDEMEFHRGCRANMNDLSSLSISSTRMPAHERGGGFRVSEAEAARPTGQRPPYTSGFSGSLSASLLKDGPFPSSRQKYDLGVTIYLDHWFNTSWEEGL

SEQ ID NO: 1001626 - protein, 155 aa, Homo sapiens
VSIPGSSATCQPFTPRTGSPSSSASACSPGGMLSSAGGAPECKDDKKDTYVVLAEWQGHQGGASCPKGCDPRGWHNGRISCVTSVDLMWPCEPAIRHGGPGEGTGFESVGDIAVTGYQSGGRPSFQGFLGRTGLRPNHYLPQDDRGSGGHGWLPG

SEQ ID NO: 1001627 - protein, 144 aa, Homo sapiens
SSLPHSYPPPRVDPTAKLQDQLYANRAGSYGQQSYIPTGPPQYAWSCILGTESGGFSGTRKRTGGMSWTSDKPGQGNEGDLESVEDMKARCVGRVRGRTAASELEARRRAMDAAALGFKLHVLVGNPNGIERIQDLMILMTRTV

SEQ ID NO: 1001628 - protein, 226 aa, Homo sapiens
LWVRRFSHEALAVLFSGALLWLLAAQGQAMTVLTKNQLFAAILHGDTHGYREHWNNQPQDYQEPKTPLTGQPPQAPPATDPRMPLNKPKHTNSHGNVNSSSNKAKPCHQPGPLNCHSQSCHAHSHGNCHGSSNKANRHLPPAQDSPVLPTPENSSKPLRVLAQSSKETIGRLHVDQMVPKPCVHLKPRFKFEVMYTTQGGGRGLGHLCTEPQTKTRSRKLVRVPNP

SEQ ID NO: 1001629 - protein, 81 aa, Homo sapiens
FDAKNMMGACDPRHGRYLTVAAVFRGRMSLKEVDEQMLKVQNKKQQLLGGMRSRNRMSKTGRYVCHLQLRGLLMMAVDPFD

SEQ ID NO: 1001630 - protein, 345 aa, Homo sapiens
VWAWAVRGLQGYLGWLHAALPLTTQTLQRRRTSRKMPEAERAELALTLLAEADSLLVQAGSGLELAAVADILVPWSTFVDQQRFSRPRKLGRACASCLDTQPSEYYQSTYVYVFLGLILYCVVTSPMLLVGSRLVLYAAPVTFSICAPLESKLVLLWTEEVSTDASVCSGLEASPSPFYPWPGAECGARTYVSWVAGTRHHMVGSHQESPRIDLPTTKLTDMWTGEGGLQDLATAQDVYRVCSYRRGTPWPGAIPSEEPKAVYHKTTTGPPNWPYVPIGNQGVNGSGYQGRQSIAEATAPQFSNRPQGGEEESPGPYMGDKYERVDHSEGVTISRDKEYSTQNSE

SEQ ID NO: 1001631 - protein, 189 aa, Homo sapiens
PSLSVAGPDPRPAGRLAEPPGAPGPCDPCTQLRRTGGRARGSGGHGHDASGPGVGLSSLPCYWLPQHPSTMLALFPDKSAWCEAKNITQIVGHGGCEAKSIHEQGCAQDMLLQRTCCPPSTVPNSPHESLVSLGTTCIARPMSSVGRFVTAGGARATTEVPSGGQRWVEERSLHCRLPGLLARQPRSRR

SEQ ID NO: 1001632 - protein, 373 aa, Homo sapiens
MNVRKVLCESKGKNIKDYQQNRESGGVVRRFDEILGRPVMWYPGGSVVDLEHSTIPASEKVFLAQKMMIVHGANRAGKACRSSELARYCLVEHASRRPRTTIPWLEGECMLAQVQACDGADCIIAVWRNLAKGTYPLEGLCRLSVHLNCHVEAEGLAFSPRLCECIMEGYIPALCVVGPHLAQLKLRHERPSRPKGLPGEKAFPLQQLSCNVGVPNNIRYRLHNMFLGKRSASSLGLGLRITGTNVGRHQSHLLVRPPDNPPMNKARTRAPTLVHQLTITYALFAWWAQEHHGREVRPWWLQGTVGPSLGLETFLGVCNLLGTGARRLALQWKGGDLVGPLGGLPRNVVAPSPSRVFTLGPHGVLCPSAGMCP

SEQ ID NO: 1001633 - protein, 39 aa, Homo sapiens
MSTRPGYVLLAQDFGLNSRGSKNLDVYTQISRTLPDVGA

SEQ ID NO: 1001634 - protein, 104 aa, Homo sapiens
MDPSEINETFKYINTVVSCLVFVLWIIGNSILLRIIYENQVHAKRSQYLDLPACVLGDLSAINQSLTSRINVYTSAWLEDWPLGAEMCKRDAFHTERLRWESLC

SEQ ID NO: 1001635 - protein, 107 aa, Homo sapiens
MVDTCITSSQTMPLLQERDEDCGLRIMVTPRSHPTQGVTLTLSVLNAARTVIFVSNWRRQGSCSEAHSWKDQEENPLAAGLVQPRHRETVRGSWTRRLPPPDRALRE

SEQ ID NO: 1001636 - protein, 123 aa, Homo sapiens
LTLSDKALMKRLREQVLREFLAGAGQMLHIENLNMRGRPLASTWCNWHHAPMELLTRPSSRIRVRRSPWTPSGPSVGIVADGAGCWSPIIFIYEKRPEALRTSWMMTTAGSAPREEQRDSTRK

SEQ ID NO: 1001637 - protein, 242 aa, Homo sapiens
RGTKPAPQAADPRTTIREYARRFRPSSAVPFARAGRPISRMADAWNMGPYYKRGSRRRQIGTPKPECLSCLMSTSRRSHGPDGRMNCGTRWINASYTTPNSRSVGISYVPSQREPARVMMQHGKPKFPREGLGSVQVRSEGPHGVPTRGGVLTSFPPNHAIPYETYVRNGNCPFAVTKGLTGTTQRCNPTKRILAPIGISPIGEVMAFGSGFAQKELATKPYGGHIPTIRLVRSEGFGTPTA

SEQ ID NO: 1001638 - protein, 117 aa, Homo sapiens
MSAVTDERLSYTAAAQCGAVVTTATVPAAPASCLDCPQADLPWPAESRSPWRSWCSSQGHGLMPLALPGLRGGPDLPSRRVRRMNVCRKFLGQGTRLAVCMTSHSVGPQPNVERASS

SEQ ID NO: 1001639 - protein, 151 aa, Homo sapiens
QTSRKLCASARSARSAFLCSGRQLERRGVCLGLVQLDQMCITAMFALAWVCMPSGYRPTSRTKTQMVCPYRIAQVRTPPIKKRQGQLTGCKSTGVQLGRTRYVARTAEPKSIAGGDLLNSHERNPSIRMLWTIVLPKVGGTARCHGKYAGQ

SEQ ID NO: 1001640 - protein, 298 aa, Homo sapiens
MKIKLAKGTSSPGASGQEAKHADLTLYCTRSLSHERKEEAYWGKARVAGPGKANVGLTVSTQGKVYPFIFPVINTGGKKATEGCHAEPKEGGPPKVASSPVKGAPEWGPPRRFQAPLSGPPRHLKRSHRKSGPDGAHSHAEKRGHTVKAREGTTTCVCESATKSLHHMDHSGPFWALSQERLYDNASGIPRNSPWSAGEPKECGSYGDTTGGVPYRRRVENTQPGRESKTPGEEKRRTMVGNNNDTRAREKSLPILGPNTRHKTQKPPHIQRTKNNNHMWGEPEDTKSSLRKINTGKI

SEQ ID NO: 1001641 - protein, 457 aa, Homo sapiens
MALDTDVMHMTMVVRMNGSVAPGEVGVHRKLRRRMSKCSTGWRYSPRKGVISVLMRSHTHYLSEDIKLRTRRWSGRLREVPYNAAYFEIPCSSSLLESLLNQEESLVDPQGLCLVRPYVSYYTRMLIYDTHVAGMAEPPDSRLVEDDPRDMSGQRYVGLTWLGAVLIESGPGQAAIVVYHSITCVPPHVLACSCLRASSAHRGVGRRTSILACDWGQATVPDSVQVTPTNVLRMHHGLGRRTKRDMYTFDTLVVSQEGLTNSQLRNKKAPFVVSPDLKNRGDRTKSVTLSTMAPLVPSAIPVGETLHEEGERSYVGLGYPPLTSGEKTTHRTVRLELADALARGFYRPRKNWTSTSPFCPYLSVGARLGHYGGLMDSRQNRGQSAPRGERSLVQPVSYPGLPKLWDTHVDAIHGMRFSPTPLDPQRAENKSIGWYGTPVDILYANARHYWYTSECPI

SEQ ID NO: 1001642 - protein, 113 aa, Homo sapiens
LRCQLTLMAVCDPRHGRYLTVAAVFRVLYCPMNGGQMSQDSLNSACISEHAATLCDMRSHNNATTVRLVDIRDRRGRLMMASHLSSWQVVQPIQVSSSSHSSEQVYVPMFAGG

SEQ ID NO: 1001643 - protein, 593 aa, Homo sapiens
MSTCLTPCLWTCLLLPACLQSFVGPTATALHLPKPRLLLRGSPHTSDRPYLNQSGALHATAHFHATHSLYTRATLGRKPATVARPGRTHNGTEPWPPHFEPDKPPRHVRPDPHLPEDRRPPFGTAQGLNPATARSRQFLTNISLIRAFPHSGPPDDPFLPTTPSGGPTTRASPSIVTTRLGRNTGQHQTYTQHFRAIPFKAHKRRAKAQGARGLATAPWARKRYRGRGNLWALTHLHPVWVRTQPTFHTCAIAEASRKRDSAENGLFVPSPTAHIRLKCPSDTPLDVTKMLQTFSQPTTLSPPFPPQHSTKALNIHTTQKLPPQQYSQRVVSPRHPPLSPTTPPSFPHTTTLGRISPPLEQRPAPLLVDANKESSTKTNWQLTTREYHSFGSRCDPPTGRQDTAGHNQYTRAFSPPLHVLDTTAPQIVVTARPKELPVLHYWRTGLHHTPSMQIKHAPPSNYIGDGHAHINPPHLTNDETAPTVRATPHFERHMSKKRAFQTLRACPFVVSTPRNRQARFTPWTQPNTVAVAKHRPHTAHEVSDPPPHSHTHVDDRTATQQPLLMRQQTVTPHQQPTMTRLPPTLKTVQAPVA

SEQ ID NO: 1001644 - protein, 82 aa, Homo sapiens
APTPHGTHSNRNGIPNAVTERKILGYINYDKGPQRVDRPLRGYYNPFDWTPNSNVFTRNEPPTNPAIIYAIHPSSSHRPRDT

SEQ ID NO: 1001645 - protein, 122 aa, Homo sapiens
GATPLRTVRQHPGARRALRPPGDPPPRLDPGPGAQERVGVSVGGCERVRAWAWERPRDCATVAALPSPPPSPFRTFSTPSLSHSLDEGLGDLERGSHIVFPQKQNLVSVLLCGIHCLYALNE

SEQ ID NO: 1001646 - protein, 339 aa, Homo sapiens
PPLAHPGLYAVLPADDSETGRSRVQVTVWWAPSQRSRSSGCCILASQGRCLSRELLFCTCNFSESVQLSTQGASDAGAKVTNRITLKHTFNPHASELLSDRKGPVSIARTPAFHLAISAELPHYPLGLFNLLPFQDAKLAEGRTLTLETQAALGEPELDDQRDQKNHVQRMNCEETTTSAKVRSGLPKPVEGTLIFETGLQERMICPERLSIMGTQTTNVGTAPPFRKKGWYFPEVDCPCKVVGRQKTARRGTQITFGNTWENPQTPWGYSHEEQVQEFGPHSWKLKLGIVYTTEATTWNLGEGAFIEMVAEAQGNLPKLGDRLAMALPNTWAFPEGQP

SEQ ID NO: 1001647 - protein, 165 aa, Homo sapiens
GETAAWFQLDCTVLCAWLECLRADLLHPQLSCCLVNEEAMVCSEINMEDIEKLMLISTGEDSMDGSARMRVPEGALLEASEASVVKCPEYSIFGATVWVNHNGPVELHRARSPKLALIGQKRHRAQNLSGVTELIVIRLRNTTNRSSCKERVPYACVTDGAHLVP

SEQ ID NO: 1001648 - protein, 146 aa, Homo sapiens
DFSQTVLEQWAHRHNDTYFPNLKPDLWQDDMAYRMNIASCSRYQLPQAGSLDDDYSPILSDLLSTHGVMTWQPNGRTCPFINDHRHSTELREFQGTLLNGRLDLGTIRNAWHLFNQKRGLLNIGQQESLHKKTNQALNNDSRSHAN

SEQ ID NO: 1001649 - protein, 166 aa, Homo sapiens
MRLATGLPFVNLSSARWGVGRVNFEALIITMSRELGGTLLLGIAICCCCCSQEEEEPEAWTMEMRRRPCVSGRRGGYWQRGNRDVRPEHDARRTTADHAEQSCTAPVPEIGPVCYHAKQGNGAPTNSVAMSLPDEVHTVEDQSQTGNTKLGICGFWTRPMNLAPTT

SEQ ID NO: 1001650 - protein, 246 aa, Homo sapiens
MAFERIMERFDHVIDQQFFLGNADPYRKLVNAVSRGCKHTQEYCNTLFYIRHMLHRKPPPHTIAQLPRSSQALVIGCSIPFAERHTYKQVMVARQRIAGVYEPSRGLGNCGIAIAMGGRDTGYKGREANPTASTPFKQPPCVVELLSCKSFGSTYAIPHWPTYPQLLAQSLRNPVNTVRPEHPTSSHNRDTQTSQRAAGERTLCGRHAPSLTHSTAEHLWHTTRASTRSRAVITPQESITSRTRKR

SEQ ID NO: 1001651 - protein, 220 aa, Homo sapiens
MGPLAKLTPPIKLPLHRYFALAQHGRPHRGPKTPIGFSPRTVVASRRHLARPTPRGGVPFYTGPPSELPRALPHSVRLAPQSPLSLGTRIGASTALALSSQCGRGTQVRLLKPRLPKVLSLVPKRCTFLYLGGTPCGRFPPRVFPTASQLCAPLPEHAPAAYNQARAPFPPFPPFPRAFPLTREAWLYFPSSLTQLRIASPRAPLFSGRPPMARRHALSL

SEQ ID NO: 1001652 - protein, 237 aa, Homo sapiens
KFWNAVRRFEIGPTIKKNMTGGHEDINRHMAKKDLGEDASQGRRLELDPKHGSSRGLFGQLPARGLQGSCKAGCVAQKVTHEEFAMADRSHRQHAVSPGTMTGGRNAVKLSAYVDSSNTDSMLVAAVSQEENVTRAGGDMSRIHSKDTKVVRLDGPCIRGAEILRMRHCVELLRSSFLVISWGVPTRWSLDPKAVFLALAGGSGNVGASLGAPCWLRSDSRMPPYWITLALLDIPGR

SEQ ID NO: 1001653 - protein, 186 aa, Homo sapiens
MGRTASASIFLYDRPPCTDQRPPRQVRQNYHQDSDAAINRLNQTLERLRRSVSGRSLLHVLTIFDPQIDSGLFDTNLLTMIPFPFSQVSVKDEAKPLSEAHNCCDRSCQESQNAVLVPAQSVPCSEGINAREPIPSNLVRWPLGANTRASLDSGNTGAGLFASIVLSSANDPLFDHSPMPRTFGTA

SEQ ID NO: 1001654 - protein, 66 aa, Homo sapiens
ENRRFWRMKLLRPQSWLHLPHTEIVLPSEKKAHEYQVHRVCAVEKYAYTLKNHKGVHACANFEIAK

SEQ ID NO: 1001655 - protein, 216 aa, Homo sapiens
MRKSVACSVILRLRPISLALLLVSSYLVRDPILLSSCGPYLVSVLNVRYGPPPAITRSCESRRLSSGKDRSTYEMWGINNTRKTDIGKAKLIQQLLTDQSAKNGQRGTAPREYVRDYGGKTCVTTTRSQRRCNLIDQPKKDLQGSGASAPVVPGMMCPQRQAFMGRLHQTYARRIWEFFANVAQQIGPVVTPFKVWGLFPNRLIGATGGHGPAENP

SEQ ID NO: 1001656 - protein, 81 aa, Homo sapiens
MPTRTRVLVLPSASRHACFKPVAPVRMCRYVPRRSLSGTIPWELCIASERMAPSPETGMGRQTQDGKEALIRKTRGKDDMR

SEQ ID NO: 1001657 - protein, 119 aa, Homo sapiens
MMLCVHTNACVQMRGPHKLSYTGSQHEVVFTTCCGVGPLPKRGRYMSGDKNNAPPLGSPVGATKRTLCCGVTPRDIFCRAVVSPPKILIISSPTTIILSKGLFHSQHNIFYPEKRPRYL

SEQ ID NO: 1001658 - protein, 81 aa, Homo sapiens
MPVGQSSPAGSGQTAAVPEQLTITVGFEPSPGPLTCCSTAHCCCAGVVAPSGAALRERWPRAPRCFSFLSVACGYVSDVDI

SEQ ID NO: 1001659 - protein, 266 aa, Homo sapiens
AELEELGVGCVAAVWRMCLVWVQDSCLIELVSVLRGTAPGSSGREYLSCDEAQSFHRGPQTRSRSILRLHGDGVTIPVITADSRIDTEVTVNQAQVSESCPGNGWQLVGTHSLGNVAPSEYLMETSSKCVTSGSEGEVKPCPHRYLASVDHSRERLENENNEACDESIVRSMWKVRWVLTCFPCSGVIGDGAWDRMSTQTMALTQRPKEIGGVKFSLCRGQCGIDLLASRRGYLPKSIGKPSVSMRWKGPKPNQGDERLWATQHNL

SEQ ID NO: 1001660 - protein, 138 aa, Homo sapiens
MISVGHLKPVLSGPYPMCKFSPVCCVTIGTGLYAPLGKRLPFVLSRYGSSRCVKRAHRSYTISMVPPKERDTWACDIVPKGGARRRILTQSEAAKRKDTCCHEKVVVVDPQGGFQTTTFVAPPKRKGERPPYSGVVPK

SEQ ID NO: 1001661 - protein, 291 aa, Homo sapiens
DGLRLLDSWVCGRRDCGSWIPGSVGREECLREEGLGQTSRSLAFLANAPRGLDFPDPASIEDLMLRPHGALEVKEAQSRERGEIDVHGDGYGEPPMPGKVCGFDPGVRAATQSSTGIVRAFDEQRAPRWLSAHKDDVWGPVALGDIESSWKLSVSSVMWLMEDDVEDPGFPETFRRFWPEWNRVVKKRLDTPHLGIEAGETLCPRDYRHGACQLNLLGTYTLHEIRYSPYLRKTSGNRHRSSPACGDNCGQCPRHFPIVGTKGADNRHDPTLWPWTDSPHGVRVTVSPQEA

SEQ ID NO: 1001662 - protein, 338 aa, Homo sapiens
MPWRLCWRCSFGWAFTTLSRLQSNEDYFKDLCGPDAGAIGNAIGQADCKAQDERFSAHLAPWGSFMKNFLTFPSGYIFDRFKTTVALLIDHTIFVQPSVTSSFNSLYTVLTRLQARGWILHCAMLNVLNAIGGELRDSLQYSQDLDEIGEPYESHTLFEPSSTTSTDGSNYDFISFAYVFRYQLTLSLMKEVHQPSEALLHPSIYCRDSTLGIVDTALFHPECPRGSHPITTDPPTTAIGSVPWEWHHKSEAQGTQLSIEQQGAKGHKELPFQLKEETPWAGAMKQELPLLSGSFRFLSGALPWHLGVGACAFHVGGPTVFIWALLSPFLTQPWPVVP

SEQ ID NO: 1001663 - protein, 222 aa, Homo sapiens
REPADVSMPGWLSVTIVPSSGTYPVLGSALSPSTTPQLLRLVPRASCMTRGSSAVAPSGASSAPGLRTIARISGGLLAGRRHQDRVQGIPATKEKAGAATELEMTGVRPNLTSDEGVRISPGVSNDIMILAAPERHSEVKWAKAKFRLVGTFYEGRRLRGSCARDIVGTSRNQSSKAPRMKCESVDNLEPGTIIQAIRRDQTLAREAKNGLSTRKQRTVGTP

SEQ ID NO: 1001664 - protein, 226 aa, Homo sapiens
ARLLSLMTKGRIDPGRHRTYGPGYAEKYNAEDENAEGQGVIQEFHFESYCLPTVRQHTVDQMSHFKARLTDEDKHEDPWNEAEVRRLIDLRLICNQELLAKADISSNQSKDNELAKVKRHTQSSTQCIVTKKLHERAMPYRRKVRCVRYFSWGGMVRIRSPFLRVTVCVSPSRGLQPNIELHAFEFYMPERHNVCQEEYMPCSDANGRILPDTPISRKVTLKQVIR

SEQ ID NO: 1001665 - protein, 267 aa, Homo sapiens
MAFLSAYRTKNSRLYSNSTRKAPTLVGPYGRTSKTLRRDRRVKTLQPKEHPKEAAQIYASASTSPPRCLALSIVSTSMNPRSPVPKPPGQPRSLRTPIVVLSHLVDLRRLLKSSDQGCCIKLKATHLIWCTCEGKLGRHKPIVHMEESTRSAVIQYVVKALGNQVASCVHHLTTRYRRTRRRHRRGMIVAGPNSNEHHWCPIRLLEFLVVADKYGKKNQKTKTSHFGDLWPEGGTSRQLSSQGLSEPIQQLTARQGPPFSTRIMSFN

SEQ ID NO: 1001666 - protein, 300 aa, Homo sapiens
MTLEGFGTFNPGVAILETPTPCAKTSPKQTTSLGTMGQLPLRDDLERARTKMLGENYRGSMAKRGEKFLYPEKSVFPLLRYALPPTKGGHTFFDDVEQRAAAICPCVKTHSCVPPDFNSPVLSRPVATNGFWVPPNLFRPGHRLPPIFGAETTLLLDSLREEAPTGRHTARQHNRYTSFLTTETRSGYYPHALGQETPPRGVKKSLRAITTIACRKKHPSAGRKNRGTGPRKTLFQTAAEFYRRDKQSKQYPPRGAYIFFSHAPLISSGRGHRGSDYYQSETPPQAISDAEAGGIITQRA

SEQ ID NO: 1001667 - protein, 211 aa, Homo sapiens
MLWYLRQQLSHWRFEHRVLTPFLLDEPASTNNRQRNSVNGDCTTCLWPKLWPKFCAPSVAHSHRHVKALHLGGTPVDSDQSQRAERAFSTHTNVQLNDAGNHRMPDVAEMPDWTAGAAPKHPGELHSLHKPRTQAAQSEGTRPDTRVAATQQNSIRTKGPRALRTAARTQHPGTTASHTSNRHKGILLKITLRLPLGPMLRTAYTGPELFD

SEQ ID NO: 1001668 - protein, 90 aa, Homo sapiens
GFGCMGTPRGLQTDCEALLSRFQETDSVRFEDFTELLEKHEVRDYLLWQNEKFRKEQLLTQEALAWAWRYFIPPYTFLIRVVLVSAIWII

SEQ ID NO: 1001669 - protein, 134 aa, Homo sapiens
MDFAPKRISRASSNMGNREQKLYIPQGRATARNGEIGLEDKWAPCTKFRREPCRNTPLRAQPLRLWRNKPLWTSLSRTTASGNGGNLDDMTCGAGPQDNPGGAEPHVRRPLRRYRRQKEFGFLVGPRPTLLNLG

SEQ ID NO: 1001670 - protein, 90 aa, Homo sapiens
MALAGAQKDPQWPQGCAVACKGTDPRAHCLPPSWVEQGPAFISKARGLRHLDAASGDTGNRETEASPSRSQCDHTWHLTSPKSTCSEPVS

SEQ ID NO: 1001671 - protein, 187 aa, Homo sapiens
MASRIDEFTRRGPQGAPRVSNADLPLSPKTLPRLSRAGPGRICETREESGTRLKGLNRGECEVGSLGSQDWNRPRQVETRMGTTQEIDCGAYTPRRLRLCADGKGPDRALGPSANIHRCEPQKLVAARTTFHPQVKPPRMTVIIHIDRIPGRWPKVSKDPSSVNIVPIYGGRQQEKAPKVVSTGRID

SEQ ID NO: 1001672 - protein, 360 aa, Homo sapiens
TIKDQLKQRTRILQAIYPVATVKSSIKIQEQLCLVQDSNVHDVPAMTEADCIPESSAASSDLRLMQSVIEQEVRLHVTQAPARGGPPTFQGRSPLALGLQARAPCVYRDHSDEYRTRGSLNAMQKHHIAKCEDAQLVLTRGDADLGVPSVARSATSSNCSSTAQMSLEFQILQGLHSHHRQWMRRRSSLDTIAQDVSCHRFGHVLEGMFALMPDSIQPNVCPGVLVDGKWLCPTGKYTQGRGPAKSKYTPNEPASCFKQCMTHTSGAIRHDMCSLSAPSLLMGAVRWCHPMVPLACEAVAPCLPATVARPVSPTVRRYPAGFLGTIVLGRTGHGDHVPRVGFADGLPFVIGFVDPRESRL

SEQ ID NO: 1001673 - protein, 180 aa, Homo sapiens
MAHRDPFRGDPCPRKHTVGKTLITRLNTESRRATEELEESQNTPPRTKRHGRVNGASKKLGSIQGGALWSPKQPISLALITNKRRKGAQYTKGIEEPPTITVPNENHPHKSTPKDRRDPPHKRMTLLQQGTRQNDGRTTQRDHRSQEQTPAIQGSDGHTAPNRAHGGKIEESKWETGTAP

SEQ ID NO: 1001674 - protein, 109 aa, Homo sapiens
WLKEAEVALRCSGVWWQAGSSLRQWRHATFPEYELPELNTRAFHVGAFGGAVRVWPVLRWGPVGLCPLEWMPPGILRLPCGAMARLTSRPGWMPAGGQGILDCSLEAVA

SEQ ID NO: 1001675 - protein, 255 aa, Homo sapiens
MDHKAEQNVGRARNRRKDKTTTWIDKQRLAGDIQPHMQTTEHKRDKKTRGIDTAAKSGRREPIDRDQSSSDTRSTLKTQRDVTQGKTIADEERTRSIGTKMGSTTIGAQAEQRASSPTSRRDERHTEEEVRHKHKQTVESDRAKAQGTSGRGSPQIGSKGKRGTQHKPEEDHREKRETRELYTSRGVRAGRKKDNTRAIARAAYATARAEDIPGEGAKTGRRQPEQREQPGSSKKGINMEPGRVNEESNTWERRQ

SEQ ID NO: 1001676 - protein, 276 aa, Homo sapiens
MSCYQDWWALSVEIANQNIILGGSSCYPIMTRALPTWAASFLPQFYLRGGQDHLVKTWAEVYTARSLSSTAMCLSLLHWTLVEDFLSGFQVVLLTKTLPVRTSMLSGWVLSIHRGIKLVVAEHCGACWAGSFCDFRRGNAPHQIPLGEQSPQCYGFYGYQGPPPVLVPACTEGPDDGVLRRGGGLLCSSFRSPRGMVRNGQPEESAQWQDQQLLRPYTFETSVTVSAILRLDSWRQSSSQGRDVPTDDSALNSLGGPHSREPDLVCRTCAKVVALL

SEQ ID NO: 1001677 - protein, 584 aa, Homo sapiens
GTMADEYTRHDAVTLECLKKSATCTQTDATGRMSCTQTDGLSEWSKPGDVPYNLRCARSTSSARDKTFMRCVNLRVHWSRHVHTRGPYTIGVDLRSYDTLRMPLRNAVIFVSLRAHNLTSRDHSVSGLSTHSAHCALVTSSSHAHGREPLPRRHHLGSHVIGPRSLGHRELRRCILGCGYTYEFVAPEFGPVVRRSSLEICPFKTVRLRQYRTSNTVMCTPQGVRTRPVKNFADTRQGTYRSLTRNNMLRSSGKTWRNAQIGLEPLYSDNVLIPHERRYIRTFRIMRERHTYGRQALGFAIFGIVVSKLPQATFVLYRDINNIATYLQRRTTQAQCRNTAISMCHPHEPIGLILTHPAYSLYMRTHTRLCSTQLSGYIVRSSPINGKGLNNIAGCTNGLARTNGTSRRGNQLRGQGHTVGVTISIPQGCGPAPHCQTKLLRWVVTLESHPGYDTSSRCPIAEGRKAWPWRDATHSTELLSKPGEARNHNVILPPAALTLTRTGTYGGGHDIVAHFANGMPLNRTSARLVDDPTMSSVYPPRHKRRYNPVLKLPAYSNGTQDYISAMLQTPTRANRPAHHLVTIA

SEQ ID NO: 1001678 - protein, 74 aa, Homo sapiens
GSNSLIFVLPRGLASNLSKSHTELCKKLILGGNLKKSMMRRANVASKSSPASPGCAIEHDSPGTPGSGRTPMYL

SEQ ID NO: 1001679 - protein, 344 aa, Homo sapiens
LFPAPAPPGGSSLCSPSQSPLPGAELHLGSLFLSPQTQLPVQTSSLGGAPPLPACLPPGCSPAQGSSGMNLFRYLGDLIPPPTHIILLLLNNLEVPLVRPEFQRHEPGSCIAVRAPLSPTSSWHPSLSRTAYSLRLLTNPRSTERVSSTSRPCIPFSHRLLGPHCIGQRLTQRPNLYRSWRNRDVDAPGTRQRCEASPCSTVVRQQGPTFHGDQMTTRAPKYHWTFRTHPSIGAGNVASMRNAYSVRNSVTLVKAPRPGAQVPLAHRPNPLAPQRGWDSAKRHAGVGNGAVARIPRLTPKYADHTELLFRRALTVAPLHHPDNLPCLKYLSLPHLGSPWGRSLP

SEQ ID NO: 1001680 - protein, 105 aa, Homo sapiens
MVDGILHNTVRRRAKPMPSTGYTVNTEGYAKVSCGKSIAIQRGLTKLREPYPPCRCEDRCHYRCATRRPLCGEHANLCLEYPQWYEENLCTKTLHNRQDAIHNIA

SEQ ID NO: 1001681 - protein, 259 aa, Homo sapiens
MPYSGRKLPKVIAALTQSTYRVVCPSQRENCTMSWRLTRHNCCREMACDRRFRYESLTDPFDTLDSGEMTLKIDIIAPRPQERTLTSVDSRHWHEQRLISEVIWEPIAKSWYSKHCMEALQAEVQTSPVIGQCGVGFYSGYCGGRDTVGVITKRQRVTEQYAVRSLLRGGSLQLCVLTMVSPWTEGTQRDTSSLKRKIETEYLRRAGGSPRPSVQRTAYRKCLRLTRIHPVPGTKGHPNNGEYETMRARGDRTAQEHTG

SEQ ID NO: 1001682 - protein, 55 aa, Homo sapiens
MCGPPNKLLAQSHYFTPVSTTPFGVLTYTFGNIRSLVEQRRKEETGLYRGVGNTY

SEQ ID NO: 1001683 - protein, 492 aa, Homo sapiens
GPSTCPCHVLVAVHGPCVSLYASGPHQWRLSWTHGDVGHTTSVTRVYRGLLPSLHSRSVALWTLSCGRGTLYRLYRYDEQHPSTGAEASLGVSPTKRPEPGRHQLRDDQTGKAVPQRSPRAASRPGRWATERIPPCFLWQDGDYRGMSPNGPQVRVDPIGSTMDAGVHLVVLGSTSPHRFSRKPPFSPLPLGGSTSGKFHIAEGSPSTQKEPPYTLVQSMPHYHSDTVSLNSARDTELRKGGEKESGIGLTGHPKGLKQRLGIGYTTRTRGRNPTRRSGLNFSRGAPTLWAFRHHTGHLAQRKHGGKANSKTRGPPIVAGPLIMGQPPKFVTHAKFPKHGTIPSFLGRSSPTAQRKRAGHNRASTLSRTAYSFGDTFPGRLGGAFLPRFPRLGSDPPSQASLDFQQAHLFFPPEGAWGKWGLGAHLFYNRTKAVQTQDKGFNPEKPGTGSFRAGGAPPRFTPLVFEDVHRDPRVSNTIGSFFLLTRPGETLF

SEQ ID NO: 1001684 - protein, 144 aa, Homo sapiens
GFPLPNGRARETGVRVSEECGRCGLFAEGPRAGLVPVWCCAVPECCAVLVLCVPVLCADYGCEVSMGLYRSVEREPLCGSGMDAPACPSPLVELRPLLVCPDCAVQCVRDLGPSEAKSLGGQCELGCKFNATGRKHVTADGCDR

SEQ ID NO: 1001685 - protein, 455 aa, Homo sapiens
MRGKGQKGATQAGRLRAGQCRLHRAPPEKACVQAEDVGPGKGPRAAATFYTRGSAKFSRRFPHSLADNKRVAHWASLKSCGGLCPVVFVRVQVLFSRATLARRCDPGSCSACARTVWRGHSVGASCEMWALPVWGLMGPYIRENLSFDKALNLQVWGKYLSLSEEGASISNKARIICASEGRLVICGAPHRHTKGHNIFSRGGGDKRRSPGEGRPPCGGGTSIHLYTKGVRGEEKHYIEDLLPRNTQGEVTPIKDTRINKGCRGGCFPQKVWRPPGGKKDVASDSPPIEENFFGVAAGGKQIGGALFREDVSREHPEMWGPPPVVGSSPCGGPRRILVDQRGRQIAVSSQRHLPCGGGDTLVVVSGPHHSGAILTTVAVCHPEVVRPRGSEAHTSGWGEKLPFPGKALQHAGVAPRVGRKTFPGGPSLLAAGCGGNTSGGEPLHVERGQSSPSWE

SEQ ID NO: 1001686 - protein, 255 aa, Homo sapiens
PSPPPRGSERMTGAFTVVSFSDSELNEVSSLMSPCSHYWYRLQDMSYQQRRGCPILQFPKQRGDVVNDLQGATEERGKNEESLDEYRRLPVLQEQGVHEAMLRRKTPVSACIPGKDLSIQSHPVGMGTKRGLLVPWCSHKVWTFTPMGGMPEPELLTRDSIWAYLLLHYMMQRCNSAILLQLCALESLDLTPKTLTTARSPKPRSWGAYAFDSQLAYSCQWTRNTRKNLSKLSLRSPGINGCIGYRCHVTGNTTG

SEQ ID NO: 1001687 - protein, 345 aa, Homo sapiens
MEEADRRGWSLIDGSGMVKAGLAVGASAPRARVSFHRRAPQMIQGRHGGAWATKDSYVSRQGPEQAWHPDPEVTPLSMVIVQANRGYDVVSKIWQPHRIYNELRVDPEEQPVLRDRGPPEANANEREDDFRLKSETFYDTPCMYCGLCMAVACPSYALWAASTGNCRCDSGDRGHPNYGAPILRRLLPFRASRIHAVMDRGWSEDHEGTTSMNDPPMSDGYEVRRPRSERGNRARHRRSKLVLQSSSVTSRQEMGNVRIRPLSLEKSYRACPDGRVDQALAIEPVPVVRKAPVPSLPSWGMEILRGSMRTTFNSMLGVVPVTFRKDLEATPVLVGGHTKVSRMVK

SEQ ID NO: 1001688 - protein, 320 aa, Homo sapiens
VHRLDGTIPVIPYLLEAVTEKDSSSMEGAPSGRIHGKWVMDTYPCGMQTINSTECASPDCSYGLRMSGFDGILHASGGIDIAEQMLPPVMLTGDPTDDTVTDEALQEAAQGTPGPQELVTADVQAANKPVTDDILELLLWSPMRVTGCPEAPAPFTHYSLTRIRTWHPPHDRALKEVTFHETRSHHEHQHLYETCAETTRGNPHEPIRASNHGVPGTSTRTTRQCTRPGTRLIPFPNERGDTLGNSNLLRGPGYHSNDVTVRGVWGAYGFGRCVEPRPRVKVKSLEPGNDRHAVGRTHGNANRAPAGKKWTTKQKNQERK

SEQ ID NO: 1001689 - protein, 72 aa, Homo sapiens
CSARAAPTPRCARFLPSTWACCPEALLPDNKCIRGLHMLRPNSSTVDDTSGTHERACTTIALDDMSKTAGKT

SEQ ID NO: 1001690 - protein, 120 aa, Homo sapiens
MVIFFVGIKKNLLGALRIYFFFSCKVWVPGKTVTVGGAGIGRPIFGGQTGGTFFWGDGVGGACQIVAGVGCAISPKGYGSQRDYDGPTPAYNSCGAQKCSPLFGALIYIVGGVTAAGTSS

SEQ ID NO: 1001691 - protein, 75 aa, Homo sapiens
LGVVQEVEVFAGAGVPWSVGELHELPASIGAQNLSPRYDEEEEQKMRGDKVVRRERGLLSVNEEMIVVEEADDEK

SEQ ID NO: 1001692 - protein, 180 aa, Homo sapiens
VLVQNFIKGLIEEQLPNSKIQLPGRTRLYAWWGRGCGACGRAASWLSHPFVSVKVGGGWADTPHLGVPTSASRVAQARGSLEGQSLPVWGLPGAAVIFTFDAQKTRVVSNRVAHSSGSQVVSITRAPPGVVGINSERQSNKIFRVEFIALLCSLGRVFPREETKKTSLQSLFVAPNLSPK

SEQ ID NO: 1001693 - protein, 326 aa, Homo sapiens
MASETTLSVLLTAGITRRYRAMAIGPRKAGTTMREDLGTKCLLTNAGCRVVPVERSTQCAVLQLQRTALKAPKGLQLEHEASPLQHCIVLEYPCHRNAALIVTVGPIQGSWLYPFISLLGGRTKCQSGPWYFLRGPADPARHVLPHRSSRCLTLASLPTVPVPASLDPGFVPAHLRPGSLHFREGISYSLTQTGIPSVSTRAQLVPMPGTLPVATHYSKGRKAWLPYRQHPGTLLKRGSIEATQPGSSFRYISSMARTTAYAEACARMRSPEFRLRHFGSDLTPGYPEVFPGWAAMCPTPVRVPCAFRQLLAAALPPCTRHFHFPL

SEQ ID NO: 1001694 - protein, 115 aa, Homo sapiens
YKWSSFLKGPTISLKGRCRQLGEGKKCPFENLARDVKALAQHVLWKGPLPEEKVTLETERSGLSSAAEDSKFLRQWVSDLVAPPCTIVDFEGKEAKLSCGLRKEPKNSPRNVGAC

SEQ ID NO: 1001695 - protein, 43 aa, Homo sapiens
MGMKGAFHIPGLPMGHTRPTVIPCLHGGPWGAGAYVHCGPPGP

SEQ ID NO: 1001696 - protein, 234 aa, Homo sapiens
DHENELETNSEEQNSQFQKPGAGEASAQVHLMVPPAATWPCRFEPEDTLLLLSCDADMLGSLGPKEAKKAFLDVYHSFLEQDTRVLRVPVPPNVSLGSLTSTRADLISEDVQTCRLRARRWCKSTAEETVEPGMLEGHSSSKRLMGMTPWEQQLAQLEARVGRDRASYEARERHVAERIAHAPGGDATYHLYRRRTMSAAVVNAIGLYMRHLGVLDQEWTTRKSGEERTSGKKV

SEQ ID NO: 1001697 - protein, 167 aa, Homo sapiens
MGATHKGRPTPRTHSSFDRSHLVVHFEGKNTRRQCESLFFFDFGYPKSFARPPATLGYHVLEGETPKGPSIEGVGNGRCALWCPCPHGGRRGPYLNSAQSEAFPERHQGRLWGAPGRTGQYARHKLCLPLGGPKLSCRVCGSPQKTEEKTRMLKSGNVRRRGIAVTH

SEQ ID NO: 1001698 - protein, 327 aa, Homo sapiens
FLGFSLVLSLPETVLPVPPALGTRRLHRVAYVVGHRPVRRAQPETQKPLNPGDEEVSNLRASKWRATDVWQISSEACLGPKSSDEDAFGPKLRGIVMTNEWQMPFFERFKSTHPSGQGPIERLCRTQDEEVGDGTTSQIIEFLHGTMLSVAEHFLVKQQMQPNSGDQCLPLRHRMIMIRTLREESSIPVDISDSDMMLNDHQRVVYYYQSHQSVVHLWLASIALDAVKDGTVLRRMVGKEIAVQHKYCHVVGKDNPDASLHGPGPSSRPEYQGVNLQSMQGSSGTSAWSSGLPRRESRKPLKAHGTGDTRRGSPAAISQRCPITQTL

SEQ ID NO: 1001699 - protein, 352 aa, Homo sapiens
WDTKVFPPKRGPVFWKKNLGPFKKPPLGIPGPPWGVPGFKKKKKKRHTREKITPQRGCWRRPHLKSGGGGTLATIIIVAITATKTIKPGDSVALCRPREFFFGDAMSPPRAGFPPYYTHSLSVSLSNSPESSADPLKQTSSWCVSFQKQKRVAPQKRLPLLSIKTTTHVIQSLCEIYINAAAPRHNGGASSSHLPLIGPPSLIYKPGFILHHRNNKEPSSKIIREVRPLKNGWEEKQAPPHLLGGEVKKKRGPLLTNGGNIPPQSWGGGSAQSVCAHQPVGSPGIRGRSSHGRVHLVVHDQQEETVVVEKKPSVVAPGGGKHMMWGATTRRGRPLERRGALFKSWSRHKRVP

SEQ ID NO: 1001700 - protein, 85 aa, Homo sapiens
DRGGCRGVSGGRHEQQLHSRRTQGAASTRIPQSDTIGQDSYRLSAEAGEIIMETMGIQNMLMEMVLKEPMDTDVRAVITILGKFS

SEQ ID NO: 1001701 - protein, 311 aa, Homo sapiens
MRLCPRGLTGAACGHLRRVVGVLWRGVRSLRRPAPAMVPPVWTRVLPCARSPCLVLAPQRAVVQCLSYWWLWHPPGSWRWFSRLLTQLHLTLSGGTCLGSIMVEEQFARRRPVPGLLPGTSPPTCKKSGALPVAWLERTMRSDRAGGLHAEFLPETCPSQIETHERYMVSGTNVVRDPCGPRVADSTESLVLTRALVALTLPTDRLLGLLLGTWLAHFRGQDILRQRYRLPWYQTMTFWALRAWLEGLPRCQCHLALQSSSPCRSELVPFRQTVDLEAEQLNVGTKLDVDVEGLTGKVPNLNMPNLFRPSC

SEQ ID NO: 1001702 - protein, 275 aa, Homo sapiens
MPFKVCIRSGVAKAMGANQEDMRSLLTGLVMENTLSPIATKTMCAPPETSRAQVCVSHLVTPVQHPTGVYQQGTERIHMISPLVLRHSGNVYPRVETPPVSPRSYVSPVGKTMWARHKSVCETPRLERFYPTGEDNPLLSSPASATEKSTPPHKEGDTESSAPIYYSSQPPPRKKRVVRGDTCLLGPRPKIVVGGAKDTSPTGCRPMEQRTKGCDRIAIAHTGDRVVVAAHDDTSRRERPHHNGGDDNESTIRREHSLFAQEEGQPAGGGSTSTQ

SEQ ID NO: 1001703 - protein, 283 aa, Homo sapiens
RELVSRFSWFIFSGFRPSPNSKPSPAAAEAGCDSSGWLSLCRCSPLSSFGDVQTLSRGGPPASLRTSSCPPIELLSCSRCLLLLLPHLALPLPLPFLTCLQGGPFSSPWKCLPLPIFPFSLVVFSHFRGELYPWFFSSAVSDVSVPPLSLFSFSLHSMCFPPLSCVNVAYEWPTVPSLSPLFSPLFVVSEPLSFLPSTFVLGEWFRVAKRNHLSSPRDLPYESLSSIRGSPLWVNLHAGISPSPPPQGNPALESRLNQTATILRRSNENFSAKKRVVPYWQNT

SEQ ID NO: 1001704 - protein, 256 aa, Homo sapiens
GYVPLENRRLALLCVWSWAKCLGALPRSGAMKLLGDSAGALGTLRLAFRRAAGSEVLGQHGGAGKLRTGPSPVADLDWTATLPASLRTPVGRYAPHAANRRREGSGGGVRAEAGRAGQTSPFGTRTIMADGQRVPGDWLLDVARSGLGHRSSGAAREWYAIGMNGTRFVRKGDPGNGVMYPGCLVGRKHQTVKDETTVVTVEQYSERDRNVETDRDDESEAGNSVHQYDTGKREPMYPMGLQATKTDKRDRHDDHK

SEQ ID NO: 1001705 - protein, 231 aa, Homo sapiens
MVDKKMKMLRDELDVAKRKTALHDVTERKTGQTHGADAATRGGLTPNLRTTNNDITLKMAGPHHLSQRRIVARHCRKRTPTGEGEWQRCRPRTERLGKTSTKKGSGQIMSDHATQQRRNANERDKQDRAWAPKRAGDTSAEKKELEEHLAGRTNDVVDAGDYHRGRPQRTRARVSLDKYRGSHPRGGWHRTDRVHNTAASTQVGRSERRCTTKGGRNGAAVPTRPCPLGVP

SEQ ID NO: 1001706 - protein, 223 aa, Homo sapiens
ERTRLEFFEGFGLEGECWKLYMGMETFHISNARVSGRKFFHRRCMSGPYRNRGYAVRIHKNREVKSRVWVTTICCVKFQGSSASYVVPRKMVAGEGVNNNNCRCIRLMNNRAKGPAGYPMLERLSTSPESHFGKARKGSFRMGSLANVDNNIIYMGPKGGPLAVDKSTVTSKTPCTIARAKVDITAECKQRCKTATPAFIPRGKCWNSTRKRIAHRRDSTPMQ

SEQ ID NO: 1001707 - protein, 123 aa, Homo sapiens
MGSYSIRKRFRQSTRNSLIAAASIGCSRDSFRIFAAIGALRPFGALLIWHATIVGPPTIGSLAVVPSYGGLRVAQLEGVTRCFGARAPKAYGRPPLSRGYGRLCPSGQPPRMRLASLSIGVTQ

SEQ ID NO: 1001708 - protein, 321 aa, Homo sapiens
AIFIIIVVAVHANVALMASDHIRVGQCSTSMELVCASESARTRQAPMQREEAALPSSGGGGVRCDGKWCVVLVVTMAYMEALLWSVSLFILAWVNVIACLGGANRHCHPSIHPSAGDSEGVTPACLQGLPWRAVNCQSSHQWYAQHLGSQTLPHQTTGVEQASFIPRIVRLFVSTRCKTTGKPLQSETNVPQRLNLWNPPYGTSNLGMAAGRFPHGRVSSFGLDSLYGGTDAVVQGEEVRGIGLGVEKWFAPLELEKKQANAGLRAIVMAQRAYRPSVPLRSTRVAGGLGGLYLRVTMALGRRKEAPENDLTLAEKEVTGT

SEQ ID NO: 1001709 - protein, 172 aa, Homo sapiens
MVGYAHKKGGPLLTKEVLAVAQSGGNIGEAPLMARPVPGPCSGAQVWCSEDTVPEGLALHPSQWGHGPHASGTGVPADRIPDALVPRGCPRVLRRNAVRIEAHCWRGADSHFMGQAFPQKGSLCPGFARLPRGCAPPLPKRKLNPIPCDQRIPMVVFKGVPKCPPGVLRRTE

SEQ ID NO: 1001710 - protein, 141 aa, Homo sapiens
GTGAAGWSTLCAADVRRQLWELELGPPVGLSMWPAAVQQYGPPPPCRLAPERNCMDTCGGLGCGIPCLTLCPVISGMAPLILSNCCDVLSLNRSICPLTSNPLSHCDWSIPSYQRLFASRPNCHHRSLSSSLLPFIWVPIS

SEQ ID NO: 1001711 - protein, 345 aa, Homo sapiens
MSAAANCGPRARTMLLPSLAGLRPLPDSWTDGKCSLTPCDPCDNPSRLGVPVAGSLSSFWDIAHTQTCIRLTGTNRAYRTHALCSDLATSVTPPNYPNDYTRKDTSNDYTLPLFLTLSGVSDCAHVSTLHLPSHYSPHCKVHVELHHRLMPFSPTPRALTNFTHTGRACAKDQLIGTIAKPVGRLLHPIGPVLTTYRGIFGTARVRVRRQLHGGKKRLFTAWPTTREVNAREAVKLPGTSWGYNTSSWCYMAHSAFHPRIAYGAMAYISPIGPPLNHCKRLLDPTEVSISETHASPGYWNLHLTLRHSYIPCRLALSPRRETRNSKEAYYAQCVHHRRPKAFLLG

SEQ ID NO: 1001712 - protein, 107 aa, Homo sapiens
MRYPRMMSGPGCGRSAGVRCALRVIVDEAQAMRLGTRPELKSQSSGEWRPLLLTVIVLSETLLPTVELFDAETPTFPNGSLTPRLRSNDRKGSVRALRGYNLVKRPS

SEQ ID NO: 1001713 - protein, 229 aa, Homo sapiens
EGGVKGGQRDFRLLELSVSGPQGHLESGSGKVTFPKMKIPNLLSLAVELVGREMGVGVHFPKAEASIQAGAGDGEWEESEVKLNKSKIKMPKFNFFQNLTGERCFHWFTEKLHFFGSKRWTVKAVQSAEPSASPLEERQRPKLFPEGKFSLFKSKKPRDRQIHSSDEREFSGASTPTGTLESEGGEVSLERCRTRYRVNTGQLKLQVPFWWTWGQEQGSLMNGDWDRID

SEQ ID NO: 1001714 - protein, 258 aa, Homo sapiens
EIREEGKSGVWKKLAALPNKWQAAQVMELLVIPEGQRVSALEQLKKGPVTVSGPALNEALERYIRLRSLEFSRLNFSGLPAIQLRNLARYAGMASVKYIARMPQQRKLAVLTAFVKAQEITALDDAVDVLDMLILDIIREAKKKRAKKKTQAPLKDLDQAALLLARACALLLDDNTDVPDLRQVIFKCVPKNQTGESESKVNELARPQNNIFHDEMVEQTVGLNRFFRPVLRDLHFLRHRQVTMYWCDSLSGRTEWVR

SEQ ID NO: 1001715 - protein, 114 aa, Homo sapiens
MLWALLPNPLGGHAPKKPPVGGVVILLPCATPLGILGLSLLRALPAQNSRPRKGPPVGPLGLLVFFIKEQPSRPGNFARFFPNSSLALGGLKAIQPRLFPHRLVGLGSNRGLGQ

SEQ ID NO: 1001716 - protein, 159 aa, Homo sapiens
MPVLRTVLNLDTHLGSAGRLNIAISRVPPRRPYRNWAARCQRRTHGRRPERMFISCARRGLRVFESGAGFAWAFGKSGVPQGTRISGPIIVNHFRNVRSEGIAGRNHRKSGWEAPQWAFRRGETTYLSTCVFRAEIPSLVPRPPGTDGKTSRIRGILSA

SEQ ID NO: 1001717 - protein, 206 aa, Homo sapiens
MLAAVCWAALDQESCQWQCERNESSAVSLVELQIVLIGLGESQREESKWALLGGTMLDDTKVHEGMPGRNELSAQAIRELEKELQNVVVAYLSSWRATLQALTGLITMVFAAAGISHPGLLGPSLEAEQVSIRYLGDQDGGELAGCKKAKEAMKAQMAEKEAILQSKEGECQQLREEVEQGSNVAEARHRELQGSREPVQQQIQLN

SEQ ID NO: 1001718 - protein, 144 aa, Homo sapiens
MQSCDSWHVNVQCISHACCVYPRERVCSTIVQLGRRPEYMVKVPYHVSLVQCVHPRLLGRTRMTELELPIHETSMLRHVTSSWKSLDTSRGEIAMYDRIGRGSWHVGPRMNAPSKWLDLKESRSDTLIIPFTDSNGHEASEAVW

SEQ ID NO: 1001719 - protein, 316 aa, Homo sapiens
GTPGGSVVSGGGAYAFGLRGSALAVCLDSAGPWNHVPRPAGTGSAALCVFPFCCWQCCRCSGRGIRDYAPITCTSRAVLNCATADFSTAVIDVGLASNIPLVPAIFKCESENDHSMHVRMMHETVHGCSGQVSSLCMARSQPYASYYVEIAYLLSGMDGTKSGQDSSHTRKVVARPLCAQGASMEVQASGGWADELMRARHPTTGAILWTKDDYLVLALTWKDTFGNDGEPDVRLALLSPSGPLSRMQAIAVCAEWGFDGFFIWRAVELSTITRVPMQDTWKDGSIPRYVPGTSSEVSERRNRFPEMVGTLATRPG

SEQ ID NO: 1001720 - protein, 322 aa, Homo sapiens
CALCMALCRTPREAVSTSSAPQCGWWPVQLLVRGSEKKECGPGAGEEWDVCLMACGPGKVVGACCCDVKGLPVLRSCSCGGPAMGPAGTQTKPGDAAGLPALGGPSLPGPVRPNAPERPCAPALGKAGSAVPWAALALWWEVCDVGTRTEGSLGRRGLGGCRGPGSRPWQREAILLVGDCAWKRSGRVPGLSRSSVKTSKTLLPPAETFNPEDFPGVAEIYIRGRTLVDPLGGQLPGRPTLNGTREVHVGLCPRKASRVMHLGGYDPPKNGRDREFNREKRALTGIRDRGDGETKPIWKELEAFDVDDFGNDCGEYEALISV

SEQ ID NO: 1001721 - protein, 85 aa, Homo sapiens
MQSILRASSRGHLPASFSLVNTRRRKLRDTFDLPRNLIHRNTKTLLREAHAATIQDKGERTPRERGDWPTTKVGGTACGKRLRAA

SEQ ID NO: 1001722 - protein, 117 aa, Homo sapiens
MALFREGNPRAWVFAPQNTLREEKCFWKGGVAYRGRAGWSRCAMFFTERVCQIAKASVCANFYSDTPTPPVEEETTSRHLDLWLSPRVVRISNRPDYHVGGQPPKWCGVPIDTTAFA

SEQ ID NO: 1001723 - protein, 112 aa, Homo sapiens
MGPNQTPDLCPSPWPCGPVVSKRPKRRPRRELVGFTPQVKADQWSRVDLWCKNTKVLIWASEGPALRKRRGNPRVTAQPRGHRNRYGIQRPRGQGDKGGSCRANERQDTKTH

SEQ ID NO: 1001724 - protein, 254 aa, Homo sapiens
RKEEGSKISTTAEAAQALGPVPRLPAARLLAPAPTTGAQASRRRPGSRADAGLIYYSPSPGAAGFPVLKIPRTSGEGYPLFAVTTPFPQPGWRLCRRYPADHELSTGSQTVHEHSCKVCREPARQRAPTPPVTLRTPGEDGEEKDADPSESPTSRNRLGDVYTKAEVGLMKQGVMSVSVLCDCDDRDSSVFNQSRYSWSSTPSDRTWTKVLLKYTEYNEPQERPPSADIIENLRKKGFNGWTGPSRREDSREQS

SEQ ID NO: 1001725 - protein, 112 aa, Homo sapiens
MATSWWLSQKVNSHVEKSPAEVHVTAGILLLTEGTYTPDSEFVGHPLDLRSPPMTTHAQTLLEMDEHNILILRQTSLQNWRCAVYGVERVACLWEITFPCRETSDVVKATVA

SEQ ID NO: 1001726 - protein, 337 aa, Homo sapiens
ESEGPRSALLRHLAPPQMLPSWAATRRRGAAAAGSRGLSRRRPATARSQREPILLRSGGLPGAPHARQRSYARVELSASLGGLGGGRSGGRVARPQWAPCGLAARGSACSSDFRPAEQLEATQATIDATSAGFLHFHSVVPHTYVLALTSPQRPCKYATLRRETPGDPSPRRIHRVDVFPFAEPRHCGSATVVATPLASDEARTQVNWCGLSPGVLPITQARFPVTHTHRTFVVPRRYNRCGFHAPCNLTTTFAVGEHRLRKQVIVNEVEGGSTHSPFVEEETCEPTRRVALGENAALATWYKVESKSLTRELRCGPAIGLPPYHPALCTAWGPHVS

SEQ ID NO: 1001727 - protein, 123 aa, Homo sapiens
GVFPSSVFLCSPRQPLSPAPVSYLRDSRLYALLGLAMPGATSSKWSGPSCRLAYEVRIDVERASNPSCTVTYVLGAGSVGDELGQKCVDAHTPGVNAIDSNQHFTLGLVLTSCAMLLYNVCVR

SEQ ID NO: 1001728 - protein, 335 aa, Homo sapiens
AAGGESRRGSGDSARGRWLCSAREWSCGPGLLGARARPGVLPAPAVSAPLVRLRLCCSEGSAGGQWSRGPCAIAGIAAAVSVLLARMGPVAGGQSSLWLRALRPAQRRPGLEEPCWSQARPKPGGRLELACRCWLTSKRLDGALAPDLRCKARERILRRKPGAPGDRPTGGRDVGSRGAPLRHYATAANSARLHRSVLTIVPVLGILDLAILGSGTSLCSIQWIRMSSLACDGCPVPRLRNSPAVVPGPPCGRVAPLGPRVAAWGGTPGLAHAGVALAPVARAPPRCGLQPRVAPPKPLVPLGPRCGCGPGVRVRKGKACSTTVVGIQPIWQHVA

SEQ ID NO: 1001729 - protein, 56 aa, Homo sapiens
MNRDGLVEGTRTVNTHMYNLALCVAGETQRRPCTIQVTRPIRPQIETFLEPLPVWR

SEQ ID NO: 1001730 - protein, 212 aa, Homo sapiens
MCLLYILIFLFILYYFFFILLFIRERERERERERERAEREREREREEREREREIFSYIYRDTSDATRERRDERARERESISHTTERECVCARETSDARRDKRRERRDAGRERSRTRAARRHTLLHNNNTTHAPQRRRQKNKTSEARRHSAGDETTQQKRRAGRVDERHRSIAEEERRTSSRGAAHKKKRQMLLVPPADEEDEKQKRRRRKRR

SEQ ID NO: 1001731 - protein, 116 aa, Homo sapiens
MCTWVGPLQENDYQDFSVVSHDSLDQWRAPMVHVTIARSTKCSYALPSYYCLYAGEDDPEHNNTLAHRIVIGDEASMVKSWIVANLRRRKRMRDGYHPIRFSGRPFRKIEQVASLI

SEQ ID NO: 1001732 - protein, 138 aa, Homo sapiens
MAIKVNWYQTFYHKTCICGQRRSGPFKKKYLGRKTEVSNKCYDAWRPSNQGLTAATTVSKHTGGRKKKETAGAEHEKKDRAGEIFPPNGKKGGPGGGKPWPASSDEANSRREREKYVKSENKTGGPTHTGGIPTDRRY

SEQ ID NO: 1001733 - protein, 67 aa, Homo sapiens
CTCFTSLCTMCRWRDSWGKITVLLLPHMRDTSYRNAGGVSRNSKSCYKDREDDRIRSCELLNSPNMA

SEQ ID NO: 1001734 - protein, 83 aa, Homo sapiens
MDWASPRGRVAVARSTARASELQGLRSRVLGTGTVRWLLTERENRLASPVTEVLDGGRGGTRRMLTCADCRFDLRGCGFLGTL

SEQ ID NO: 1001735 - protein, 95 aa, Homo sapiens
DRNYSSIRILFLLVVLSIKISTADFMRIDRIERSRTPRMYNILTDVDPDRQCCLFIQFMSSHYCSYISIERWSARQLNRRVEEPDQTQLPRATVL

SEQ ID NO: 1001736 - protein, 158 aa, Homo sapiens
PGVCRRAKSWLTEETKCGLRDDMNVKEFRAERRTLPRMSSQLMNSGSSTTGQRRRLTSASTATVNYRAHEHDWHSATNNVSTSSQLLRHRRPALPYYNTRHNYLLFSRRTQPLLAPDTRTSPPPRTTLGSTLSTYRTTAYLLHDQGRKLTTSFPISSQ

SEQ ID NO: 1001737 - protein, 117 aa, Homo sapiens
IRRKLLQCANRDVDVSFEYCCSFIFSCASPDELMHPMALKLLDIHLAVTNWKVCMPLLSRALSFSKLRASTHARCHVIYATIWGTTLCWDFMQDSTYRLAMNAYCSVLTLAYRLSTT

SEQ ID NO: 1001738 - protein, 143 aa, Homo sapiens
MSSFPGLNYSCLYHHRAGMRESEKSFYRLNENYNEKTKRFYKEKSEKDLEHKEQQLEQVLEPANLLAEENGRRIFYLNNLSCSGSLRNPNTGFILIHSVYAFDFRVAIDFFSSLHELLTSASYTHFYLALLYFTGHLLFARTH

SEQ ID NO: 1001739 - protein, 96 aa, Homo sapiens
TIRLERGPGRKVKHGHRLLCLGESWYSELVWNFISKKYITEERGVAERNARVEILRVHYLECYQQESKRLEGIVLIEEVYPTYRHHGTGPHDPRGN

SEQ ID NO: 1001740 - protein, 185 aa, Homo sapiens
EVCAVITKKNEEESTCSVIQYRVFVVVSLYKKQIRDFSCGATAIVPDGHQRFNKLIWIHHYYVHIHLTNQLRDDCSQCFSRLDTDVHPLDNFAQQKGATTAFIHDTGPRAQKPSKESKITPYQLLDAIELQPSTHQPPHIEASLQVHSNVLLDVARVMLLLLTHYYYFISFLLTRKRPPTTINNH

SEQ ID NO: 1001741 - protein, 102 aa, Homo sapiens
MRPLRVLFSWLSFCRPCCITRHHLVAMTQYVSFGTRCMPRLQQRTCPGLGAHEAFYPIIALCLGRHCMNVHHLAFTSVVLRVHLPNTGSLSRKRHSWIYPYA

SEQ ID NO: 1001742 - protein, 102 aa, Homo sapiens
AAPEPRKGDVACRHRRPRYVCHFQFFTSLLTVILLLICTCAYIRSLATRLLDREFYWIVARIFRKCASNSVERKSPYVAVCCIVTGLQHPLHISSWGNCQQV

SEQ ID NO: 1001743 - protein, 235 aa, Homo sapiens
ERRRRKGGGETRLVVLLPECRRRSCCCQQSCAAVLTMSVPPSLSRLRPLRQQQQQLLRKMAVICSPPAGLKQFPGVELPMNMACNGNDHGNGKTGGLRTRTILILHPQWRHGERYFWMHNIESRTDVVPDARSHCDSPSPQDRWARSCPRLWKCTPAGTTSSQSRRRRRRMTRRTVSGFDRQVPDWRITTGPRETRNRVPPQGSFHFSTPYTALLSRSTEENVHALTKGGITSAT

SEQ ID NO: 1001744 - protein, 77 aa, Homo sapiens
RAWSPALSPRRALVEFWEDGRRSHQSLRTDHIEAKLPNEFDGHALRYARLYGNIITYRGCIDMNIPDYFSYSHERID

SEQ ID NO: 1001745 - protein, 358 aa, Homo sapiens
AGGSRSPRLRGAKLLDLFLSSFAYTEYIESSQHSYIRLRYRLVTPTFYSTDKLYLAHQSRLQEKHVLVYQWFTQQVTLQVTLPAHSGTTQLTPYPMCDLELSAQRIAMRGYHSGNNGCTPQYRYSNPHGRYNTHTATIPITNQPPSLPPATCTQPTAARHLRLTLNARQPHPFRLHNTSTDLTEPKTEPTLNHGTPPRNMSTQRTCTRAHTHPMARALSQSQPPRDVPFNNDRPTVTARGLYTQLQAPTPPMSVPNGCRDTVGRPGPTPLDARLPVTRYAARPLLEHSHRLPHPLPAKLQSPGVPNRVTIHRQNTTAPITEGTVIRGPELHTLHERAVTRAPASRPSQQTSNDVAQRR

SEQ ID NO: 1001746 - protein, 72 aa, Homo sapiens
MTALYSECDAGTFIRSPGYNVSTLCTHCIICPRAIRSDCIDVCSGCCQWTNRAAYEENRGFHCMDYDREHIL

SEQ ID NO: 1001747 - protein, 344 aa, Homo sapiens
MRTDFSIVREGCYFRTREHCVSSTRLTPLSSAYPLTLSRIRTMLQLTFNTLCVTGTTLRNCADDPSSTLRDFTSLLIGLRVYSGNSTLWRPGVLPRSTDVELAELTHRHTLTLLRRASLRIPAATYQPCAAPTMLAHHSATRMHLNFSNSFPTNRPHQALPHYHFLPCPALLSLLSTAPLKLPLLPLLCQLLLQPNLLFTDPCNPPPMRSPSILTRHIFLQRCARTAHPLGKGLLCTNHQQAPVDRQFLVPLPEPHFCGRDLSSTPGAPGHAFPYSRSFLHSGPAAAWEPPLPSSSSPGRCASRLLSISPQDSYFFLQPRGVWLVSPLDPARDCLYYKPPQGPT

SEQ ID NO: 1001748 - protein, 239 aa, Homo sapiens
SGVGRVRHCRALRGLVRGGWQRRPRPPGSRVVCPQLFSRPVSRLDETGSRVPCASVATLWLGRLGPEGTMSTLRPDARLPILGRIRPLVTAERESLVRPRSNPAGRGRQPQPNVTGKDGGEGRRRAVRTAQLALGRRGAAQVEPASWELGDADDDHQCGCSTRLQVPGRLAHLSRNKGSCYGARGPFRQWETPTVKRRSTDRQYDGRMTEWIRPAGGTDPAKEVGKLGPCRKRRKSADA

SEQ ID NO: 1001749 - protein, 116 aa, Homo sapiens
MTTREDLGLEEDQFEVPLREKVWKRSSPCMDCEEKRSELKGACLPSIISLRAIHDGSTRKSDGVTNWVGLFEFLNVGNQWYTGHFASGKRDLPKGFLLRFFQGPLMVWGKQLKAQT

SEQ ID NO: 1001750 - protein, 245 aa, Homo sapiens
RRVSSRWEGSYDSREVVEDTEGTEGRLRSAHKNSSEYTIRGKMNWAAFGGSEFFIPDRHSDRFEMPTKQRISRNGTMTMALQCTESSQYDDVMYSKKGAAWVTLQHGQEEVMQYRLVDHIHPGPNSETHAAYEFPNVKRSSICQTCLPEEKVATLSCMMSQNTTVREYWTTCNKSQHLTEVSNDFLSCYILCHRQCRSHMTALVLGSSTAGEHRRRVVTTILYKAILRGADASCAAGIPGQLNIS

SEQ ID NO: 1001751 - protein, 81 aa, Homo sapiens
SGREIILRLLEKIAPSSADMTSTVRDKRVGHDHGSARVMSLRHEPDGRGKHTPVNAAIEQLGATTWPVGWLRASEPMEPGT

SEQ ID NO: 1001752 - protein, 244 aa, Homo sapiens
ERSVKSKPSHEAEGRLRGADATAGEGDGALARGLGRTTVTLVARLLELQMTEVHGQLYWHIQTDLRRGGSPHRPDEGGDQEAGNDDERVGIGANKQLQPCTEAGREATGECEACRPATRAPIRPADLLVGRGRRRTRVITTERHTLRAQQRQYQHVAEYQEEGIVARGHQGLLRPLYNTRNHHAVNAIHIYYRKGSIFTSYKQQCKGDNNTGTLQFMEFPEHRIHATTTILCNMQRLLTLETRR

SEQ ID NO: 1001753 - protein, 116 aa, Homo sapiens
MLALSCVVCFGPFLLGGFRLAWKSLVSASLYGGPIEGLHRKIVTGWLEALVIGSGGDRVLQRLGTIPQHFTLMSLAPGELKLTSAQCTRKVGWDSWRNATIGRPFRDKLLWLQAIM

SEQ ID NO: 1001754 - protein, 88 aa, Homo sapiens
MIFIIIATEAFPGWRRGPVCRLPVDRPFAVVACPDPRSACVCALVLFAHVCVCVYACVCQAQDAVHDWLFFLPQELTEKPGHCVPGPG

SEQ ID NO: 1001755 - protein, 192 aa, Homo sapiens
AERGPRNMRRERGPGGTPELVLLPPRSGAGPRRAASFLPSSRPARPEAAAEGRGAAPPSAAPPPRAGAGGAGPASASRGGSMRSCGAAGSELRIRTSLAKDSLRPTMHRGRAAFEKAARLVQDGGARPSCLTRALQPKSPCQFTPEGNAYLTRGTLTQYSSLQKTPVLERQDYKLCCGNAFSEISKRKSTFI

SEQ ID NO: 1001756 - protein, 362 aa, Homo sapiens
SGVRRKGRCRAVWRLACCADADVPARRSLETSRAAAAMLPMDSAHVSLGRSRPMNAGSAPCPAGGSCWRTRRRDAGERYGRSWRRSWCRLAVVRLAVRFAARELPAALTECRSGERAGGWLARLRSKCGRALGVSRGRCRAACPQGRWHGGNREALRIRGSMLRRATGRPDARRDMRCKQGMRCDPGKPRTGRWDARPMPWEDLRILTLVWGPKGEASRFDTRGDPTGESRPDVCAVADRVYPRALQRRQLVLALTPEDDLRGPTFVLGTTLSRGGNAIARWAGHFAGFRSCHGPGGRGPRFGNGVPRDLDSRFRDSHSLGPPFSRVWAPPEVLLAWDHSVKPPQRPVCALSTCGMKPRMPP

SEQ ID NO: 1001757 - protein, 199 aa, Homo sapiens
SGGSRDLVLRLGHLHSHCLPVLACLDQGPPDCPMSPCSEECCILCPAWRARPEATVVRGADRMLLRVWCLTVAGAKSKRLTRAPGGAERRRSALVGLLGDSVESSARQSPGGPKGGVATLSFQCMVLPDAGPLLAAVLLAKRTAAVPVRQCGAGTQDTPQAGCELLHAPLRYNAWGEGELIAGRGAYSRAGVPALARHP

SEQ ID NO: 1001758 - protein, 74 aa, Homo sapiens
ERRDAVRRPKMAGGGGSRKARGGVPAAKAGPTRLAADRSGSYCAVDVTWRQRASAAVPWAGSVRPGSGRQWDCS

SEQ ID NO: 1001759 - protein, 104 aa, Homo sapiens
MVVPRDAEPKLDCTAAIIGSLLTSLPDSPASAVPSAWDCRRAPTRLTGFRIFLVETGFRCVGRAGLQLLTASDLPASDSRGAGIADRVSFTSVRQCCPGWSAVA

SEQ ID NO: 1001760 - protein, 142 aa, Homo sapiens
MNSEYQPTRRKKKKLWTRLNSWRKELQVLHSLRAVTLPARIGGFVLEVRETNNLLLSGERSREHVLVKETVDKLLKGYDIRLRPDFGGPPVCVGMNFDIASIDMVSEVNMPSYCGRCLASGIQSKGVKTQAEEEIEEQTGTR

SEQ ID NO: 1001761 - protein, 113 aa, Homo sapiens
MEEQGLYSRRPAFLLLCHLPLQLLLAGVVWGYAIDRIFDVLLPRDWQMVPGRGLPNLLTFYRRSSRKPSSHRNACPPMPSELWLWLWGLQELTTSLDPCEQAPRPTVWQTSTS

SEQ ID NO: 1001762 - protein, 153 aa, Homo sapiens
SGLGAGGRPGGLEQDGRTTWSSGCVFTQTLTAMRLSAPRPPLWRLLPLLLLSAWPCLDGSARSLTCLVSIRVPGGLVDNVSTQGYGGSPQKQLSADADITGLRAYAREMQRLVTHIYRCSHSRNIGLAWMTTCGGCCRDEARRIYREWRTSMT

SEQ ID NO: 1001763 - protein, 110 aa, Homo sapiens
MRTLILLGFNSYYVPALELVDSERCMALTGAVPGVVYVGCRELEGMDEEMSPWNKEAIKLGRCVYTRRGENREERHGSSPAEDVTLQQERRLNRQIKVLLRTRLSKSVFE

SEQ ID NO: 1001764 - protein, 192 aa, Homo sapiens
ERTFLMLRPAPHPQEAPHSGVISPESTSPQAETAPRSRRPRSLPPWPLTLDGLPPALQVLVCPSRVRSMGALSVPWTGYWLLPGSLLGSALLDRLPVGDLSPSVWSPHNTERGLAGMGAHIEFNWHPVLMVTRVRPSSEGIGHSSSYRLTVDLGNAASLLMKSIHAGLNAGCCHSCNNLCGGRVMRTTMLTI

SEQ ID NO: 1001765 - protein, 169 aa, Homo sapiens
RATRFRGRGGGGGEGAVRPAGWGGGEAGELCPGCSHSPAAAANPRVRSSGHLLVPGPVWDPRDAQERMAVLRCVESLTGPRPRRQESQAGQPGGGGGAETRPSVASQVFPREREARLAEATDPSQPRVSELLQQSPVFFLAEGCFQRGGSSEDSSSPGVSVSGKGLDGR

SEQ ID NO: 1001766 - protein, 94 aa, Homo sapiens
MKLDQFGLTGSSYSREESSSRDHEATFLTICVLLKLVLREPWYPWEESSMSSWDETSCHILGVETRTHAIGFIWIDPGEADRRGFALNRLGPVG

SEQ ID NO: 1001767 - protein, 98 aa, Homo sapiens
RLPFSLCILSDAGHSSARGPTRAHLDPTLGQPWCGGGRCRRGQVTVGTRSLADLSEAVSLHFLVTESHSVARLEYNGAILTHCNLRLPGSSYSPASAS

SEQ ID NO: 1001768 - protein, 283 aa, Homo sapiens
MLRKLTIEQINDWFTIGKTGDQVWMLLVRCQPAIPCAGVRAMCEEVAEAKDCGHTGSQVTADHGLTDSRTKRLLALCQRLIAVPDTVVTSSTNMGSVHATYDAHYITTKGNTEHCIRQAHKGRVALYVGQHVCTETQKHKWRTKVFQQAHVHISAVNFTRHVSTVSFPTVTNRYLQAIAALIAILQLGLRKDRRIDDLMDRQVNFPMVDISHVGPPENAAIKEANSELPDRYYSRDTHTDTRGYTTKLDSTEEGQPQNTEKAYGGKRGTRHTEASRTRSRCLD

SEQ ID NO: 1001769 - protein, 297 aa, Homo sapiens
MGLSFFSKHVPHPGRPARGCIEDSRLSIISTGWRFSTQRESCVADRLIRAGGSLIFQRESESVKMQPTQSQELKIRLLYRIVVLELDGVRSLELLLKGCLRCIEGSMIVGIKWLPQHERRPLTPCPPKRIQTYQSNWKITERRYQGPKEYNLRERRGETERTVSTVTLSCEVPVLNAQGSDGGKVSPRRIFASGHNYHINSISVNSDCETYYVGDDLRIKLWAAGHHRTRSFNIVDIKPGQEWRDLRERDHQVSEVSMPEPLEPSWCTRSQQGPLGVWDMWAGCLCDTASRALRAVE

SEQ ID NO: 1001770 - protein, 105 aa, Homo sapiens
RRAGHGPRSAGLCPVCVVDPCGLTVCSSRSWRHPVAGKLGDLLLTCERLALRACEALIASLLVVLGGHQLPAASVPSFIVAMGVVAVPYGMKHARDKVDKQVGGE

SEQ ID NO: 1001771 - protein, 271 aa, Homo sapiens
MVPGNVTAVKRRHWLAIYCIAGPGVTTRRCSHYSATALPRALLTYPTLNYALVYISRLQRDPIRALSTLCTAPPRLSGTAPSPCVVSSSGNLPFLFTYDGVLNHCAHATRSPPTCRAQLFNVTLQLASTSWTTLGYHHRALSCYNREPIIVPQYLPPPKCERPLSRQPASRRRRPRGRVHPPRREEHHKRYLTHMHLWVPAKHLSNAIWAPLSPRPPATPSHCSSSLLPLSYPALFTLSAGIAVPVSSEATCALSPCGPSSTNQILKQHAF

SEQ ID NO: 1001772 - protein, 135 aa, Homo sapiens
RRSDGEGGATDSWRAEEAAAGCPVLDHECRSRTAGDPERCSFRRALHASGHSQLPDSRPEFPAVVWRHRIDTCYASVERTQFELSNNLYAEAREARGQSYLEGCPACLTAYTIGSYAWKLIHEKVLKKVSTSTFK

SEQ ID NO: 1001773 - protein, 117 aa, Homo sapiens
MRSRGDVHAKRWECASGDRYSENADVVQYEVDVKKDWGDEVVSLVFPPKNVANDRNKLRRWMKLRREIRGSGTAVSAGSLARLTGRLRKCRGCHTFTTKSVLCDVLVQTRGRSPRGN

SEQ ID NO: 1001774 - protein, 118 aa, Homo sapiens
SGTCKGTGVGRSAPQPVTSCYRPSNLGAFRSLLLRSCLGLPVIGGIDSGPSASMALGSLAPSPFPPRGDSLPGEAVTPARSVTEGGIQADITYLIKCSDMRLRGDGLVEAERTHQEEA

SEQ ID NO: 1001775 - protein, 215 aa, Homo sapiens
LDDVKAGDEIETRVSVGTTAMKRILWIVSYGDYPMRPLLCVDSLCILLGPVSRGSKRASGTYYRQWSRSACECLEEAVLDVLQAGHPSSHPDVVERSTRVGAMGRGGAGTFARGVPTAVASGGPTDPGAGHAMRTEGEIHSKPVKEPMRKISQASAQRLTKHYLALVVQQWLSARPNYRLNLSKVCFLLKTTVSSIASTGNVPFTTPATRCDLRC

SEQ ID NO: 1001776 - protein, 238 aa, Homo sapiens
ACTHVRKNDSRTPLSFLRNHMRTPIEWHRSVGQKQRLLAYRLWQQVVQRRSQRRVVQVHAGRRASCHRPLRRESCSGLCGVPYFGRIIESANLSDLTKVRKPTGNCFLSHQQRADRTLSTRRELPDPRGRTYHDRCVQALETINLYPENVEESLVKDGYFPTVIGSRFGRNALPVTCGQPLWRYPPKAKEHGMHNNMTLNATLVKGYTYRRRLEGQKGECRARNETRNRKLQMDFPGA

SEQ ID NO: 1001777 - protein, 73 aa, Homo sapiens
SGVPSEEVAAAMVALSVSAAPISGPGHSRGHRVPVGQMRQSPPSKIDAGLYSSILSLLWWAVWLLDMLLLGAL

SEQ ID NO: 1001778 - protein, 171 aa, Homo sapiens
AESSSRPGNTSSSSRPPPPPPPPRLPSSSSCRSPLSPPPAPARPCAPEPEHQLLGEAAQQREATCHQRRRRRRTSTRGQQAADSQQQGQDQQSYILTRLSVWSGLTDAGLTTILNEPTLVYHLKERNDNSHQQRAKLSQLTVPYRPSSTHSIAAVTCTCTQDNGKSQHMPM

SEQ ID NO: 1001779 - protein, 129 aa, Homo sapiens
MVVGECLVRSIKALKDYTLELWHIGIKMWLILLSPSQITCIAVELLLPGVLHYTRIEVGIVIVSVWKRLGVLFAWSASDAHPQMAPGGLNQRISNRSSEDDEVASGQEPVQIPVWDIQKEPKRPVTSEL

SEQ ID NO: 1001780 - protein, 115 aa, Homo sapiens
MHKRDPFASSAANPNIDRFLLRPGTNHNSWQHFYNKGRLHDKRDHADQRKLNILSASSGTKGQHKDNTTNFPNTAYLRSPGKISDHYPREDINNDIFTNKRVLALKRTKHPNSDP

SEQ ID NO: 1001781 - protein, 469 aa, Homo sapiens
RRARLSPIVTPPEDPSVSAPSIAVLPDTPYPRHTRKRSLPAIHQRDCISLIQVKKSIAITFSSPQFLFLGCMHIAILGTSPNVESSLSNRCHMQQVMGALDSIYGVLRTRMKSYMTLVAYHTYSGHVMLSCYVALVKIGQTTGQDLAHAKERIGRTRYAGDQSYPVACLYGDSGERLPITDLSSLTLPMGLSLIGDGTRRTTSVDRQTVGTLLEASHGDHVSKKPKPLVSSHKLHTLAQDEGEHRPKYALHIPLVSGKLNDFRGEPGDTERRARPTTHSTIGKISSDTRPFPFLSHCECRNPIENLLKNIAPTPSPLVGILGRMVQHHGVHSSYRKRNPQPFEKCHHKRGYAEKNVGNLTSNFTGELLDGFFTSAPMGPVPHAASYGAQNRYMQRKAPVMPLNRIAPNERGHSADTPRKGLPNTPAGKKSHKRGLPLPGTCNQKGGPTIPPVKTPGPNNQGTTQRATQF

SEQ ID NO: 1001782 - protein, 340 aa, Homo sapiens
MPLTQTRLHVDASGCGGSCPGCACDIWMTDAAVPLGFLLHVLGSTQCCKLEATLRSYLAYHSHHLISENHWDDGLDVTLTRGTEARPRLAPSSTTIRKRELTHLHPDGYTSYTLLILSLHAPSLLLCSTLASTTPTLQPLPTDSLVDLVRASTRNLLHAFTHPKRYFFLQSLQNSWTITIEYSRDNLVTHGWDIPSGAHTHIPSPRCTVNFTFGNPWRRDFPGGSQGKNQYWTGLSHTATPCTQGMWAQLFGDNQRCINSGEEIWQLVLVLDLYKWPPRAQKAIGQAHTRERHHIAEHPVDLCGVSAVVLVNRRASKVYTWREAQCGSDRSQMMQKQRRQ

SEQ ID NO: 1001783 - protein, 427 aa, Homo sapiens
ADIQAARAGGRSENTLFSFTKMADGACFRFTSLLTSLLMHSVCVLDAGHLEDLGIEGTDSLGQDVHQSRKVLDRTVTVSGVTGPGSRVTGSCPVLRVILYVMSQTHCRYRCAYVIGLPHDDVLCVNGQKVWRMVFPDRLIRQDSYASSYQCAVTTEDAMLIHNSLPKGTAALTLRNYYTLSDYTLCLCALRRVCPIGERTGSGQAPLWVEIHRIQQTNARLKKDGSSVHSIGSSRIGSTSVARHASFVERGTKRKEQVAKRGTYLDSRTVCTGEQTRLDLEAKANRYGHYASTSNGPAIDTVGVGLQSYAGSTHATVSEASQSRELLEETAFYQQSHNVWSFRTRGNWGHMCVTLAGCVLSLKKNVIRMYTVRPSLSLRTHERKPSVEAKLTKSALTKDHTSCVTDTLVIATIIRNTRPQEWRSGML

SEQ ID NO: 1001784 - protein, 219 aa, Homo sapiens
DRVASPHRLAPPSVAAASARWPCPPAAAAAPERGAPAAPRAVSAGPSCRSPAPGPPCISDAAATPCGFGAPAEPPPPPAGEGGRERSPDTAPGPRDAGHSHTETTALIHQNRPALTTEPERSKTQAMRRRDEAEQSKAPEPAASALQHTARASPPPTGPDTACSGAHERQRLAEQTYSWAYSLVDSSQVSTFLISILLIVYGSNRSLNMDFENQDKEKE

SEQ ID NO: 1001785 - protein, 60 aa, Homo sapiens
MCAHTGSVNTEHKSVLVDTAWYCVHTAHVCELKECSWTPGASAKCVYAGPVWCQGELERR

SEQ ID NO: 1001786 - protein, 120 aa, Homo sapiens
MGTVSIPQWGCLWGCLYPTISLFLRGWDLSVESVSRGKKRSAAAAAQAAVGIWGILIRGKKRLSIEPLSAGFSLLSGAQYLGGKKKRGSPTRLFQESPIFLSGGSKIYRKPPEKKESVKV

SEQ ID NO: 1001787 - protein, 268 aa, Homo sapiens
AGLAVETRQLGDADARALRMLRKLTIEQINDWFTIGKTVTNVELLGAPPDIARKGQAGMEVQKPGRWTPALGPAEPGSGSGPSSGPSGRCVRKVTSAKGAQKYEYINKYRQHRSTRSLMCVASVQPTSWARSKAISGYITQCDLCIPGTPYKYPEFAYNVDTRKRKSLLIQKVIPLVDYPWGPREAAKKHSDPAEYLGPLRTEHPTTADKRNTQTRTDRRQAASDRRIRKRACLDPWAGATETPGRAQETSNRGTKRNILTQKSWCEN

SEQ ID NO: 1001788 - protein, 47 aa, Homo sapiens
SGWSGPLPAGPPPPSTGLCQAQEPDDSLPASTEPCFGSSRARGLSED

SEQ ID NO: 1001789 - protein, 399 aa, Homo sapiens
TAATLIFPYTRTCGWGPNGPHLTVKTPKIVVCSLFFSREISRNCALQKNTFTLNLRKCDSLSRALKCNPFSNLKSRVNEPSGCLSWPKETPLELREQRNTRGSPIAAVGHLSTPVTRDTPARDTKHTTAWSLFVPSLFEREKISRENHSRAPVNARYNSPEAEPSLYTSPIHQRLQHISSTPEFSTNLPSVREYSRIHQALSEEHILSFSEGRLYSQVSRERAITHVRVLSPFCAQGGKFSHNLPQIITPNVQHNVHTAILAGGPPVIEDAFGPGGNTVDRRPPELSAQKPPVYGHEISPQFVLVQTRGCHTPYEAPSAHGAPPTRISPTTRKHNFASPPRRGLHETNTLRKLPKGTAVATAPKPRADILPAIGPNPGSGTQGPREYHNGRGTHAPKKP

SEQ ID NO: 1001790 - protein, 105 aa, Homo sapiens
RGGQCLLGNRGGWPEAGIPRLRRRWPAVEPLGRAWLGVTAGLRLAGGRPCDVYRRSSLLAGYYWSASLALHMSSAMLIGFSSGTTSDKTSRVHPVGPSVDTLPSY

SEQ ID NO: 1001791 - protein, 138 aa, Homo sapiens
ASKGDFFSKKKIDKMCSISLPPFPFPPSCAVPPSAPRDLTPWRGAWVWQDSPFRCEAQHHCEGHFPQVEGVVLEEAPQVFSRKRVSLVSLLFSCSTECLIPTTFIGANTAPPSNANLVVDIYSFPPVLGCAGRGSHKL

SEQ ID NO: 1001792 - protein, 183 aa, Homo sapiens
RGAEGARAEGRGAARSRAVGPERAAAGSSRALTTSSPRADDDHGTRRRSWRSTNPARTLAPPMERDEPPPSGGGGGGVGGMRGVPGRCRRGAAVSVRDELGELGPGDVNDRTVSNEPVSVWGPRDEACTMGSSPVRAARGCKRSIATDGYIDASDQNCVMSRKPRNRCQYCVCSNASNGDEPK

SEQ ID NO: 1001793 - protein, 414 aa, Homo sapiens
QWKILFFGNPTNLQNLSLAFKPPFFSFVQFSALLFSGGLPCECAFLLLLSSGLVERGHVRQTLRGWCSSEPLRLNSLLQRNPRRYLVSVPPSKRTLLRRGCESHPRFSVWFSPTPHNRALSRAYDTKESHMWSPLLHTNECATQKTPHPERGVSGESLSVCLRDIRLIEVSEVGERICVSLCDTSEAVGPGSLCELRACKPPRVANILLYNKISSHHLCIVENLSTKCGARENSRDRAPPISRALNKKRVVLPPHEKKKEALLNPRRAPEENICAKLSPPPQYYTTRGGAKPLCLVQKNGRAEEKGEDTEEEGRPHRWVGKQHAKAACGGSSPGGRTPGRVVVGRRKHTTAGEKGRYYKDEHHRCGGVGESSPPRVVVFYEDKTQEGRPSYSNNTLFVAGPIFVVHPSGEPHFP

SEQ ID NO: 1001794 - protein, 162 aa, Homo sapiens
MVPFVRAGWTKVPEDHQRHIRVKAGEDRPGGGACGLAPVAEYGRKQVFSKKFRGGSFVRAGGDRVEQLRMAPEGHLDRTEMNPKTDWRIQQGLGRRKARAGIAEARPHANRGDRESRQGGPGGQSLAARPRKTRAPEGTHSRPSNPDHPPARGCTASGTNPE

SEQ ID NO: 1001795 - protein, 122 aa, Homo sapiens
PKRDFFFFQVPAIGNPKGDPRVGPILGSPFPNKPGGGGCAPYHPFCGLDFGPPLLSSCVQHLPIGAGPHLSLWNVGISRLTHPVHMSPTPPSSPTHKERFLLWGEGRSRGHREPGEGQCERE

SEQ ID NO: 1001796 - protein, 131 aa, Homo sapiens
ADGKAQTGRLRSAQTTEFSDYTIHGKTELWLTFVRRLQLLHSHDRQFSIEFDDDPPTRHEHTHRNWVTHYIMRNLQAAHSTTLPTLFMHAACSFLQTHRTPGPVRLTLDETRHTHHRNTLTAHTQDHACDT

SEQ ID NO: 1001797 - protein, 144 aa, Homo sapiens
MALVAAGPGGGLCAFAARAGSSSSYVLSPTCEPLGCVRGGVFARSAHARSDSRVLLFRVGIRSVPPWLAPGYLFYRQELRRAQAIRTPREAHVGIDRSPASSDGGEGCFPSPVLSDNYRYLIIDIQAVGWGCGPFKPSGCAGFH

SEQ ID NO: 1001798 - protein, 234 aa, Homo sapiens
ERGWRLHWLAAGGVIVRVCGFVRMFLRRRVCACVSDKDSWNLRPQGYCLLTMPDHVDGRFTLQIIVHPSDLMPTARQRCCHASTMHALVTRCTTLRTGCCTTAGYVTRTTSRLYATPSTLLTFTAQLSSLQAISLSTHTSGLTILATPKMTPCLAPVLGAGTAHACSLLFPDRSTGQTLNGKLALQTFRRTLARTHTRFPLHVWASITTLKRRSNHNSCLRNHAMQPSCLVTRF

SEQ ID NO: 1001799 - protein, 170 aa, Homo sapiens
AGDGGAGRIRGSGAGGRDGPGRGRAPRGRVANQIPPEILKNPQLQAAIRVLPSNYNFEIPKTIWRIQQAQAKKVALQMPEGLLLFACTIVDILERFTEAEVMVMGWTWNLRGLGLGLGCFPSKAPGNADSLWCHYGTQCAVIPKWTHSSPKTSGMLYVFVDIRIDTTHLL

SEQ ID NO: 1001800 - protein, 106 aa, Homo sapiens
MTPQTSTAKTELPHEKDNHDANEPELSIAQEHRPKRQRMAAHTIILIEQARPSNSEDPDDTCSTREHHNSECNMLPHNTQTPYTANIDKDDPTYKKARATNTINDQ

SEQ ID NO: 1001801 - protein, 145 aa, Homo sapiens
MSGAPRHEMEGMLLQWLSPCLVMENVSDGAEGDQGWTDDFNRMTGPNERWTVSQPYGLVIMKLLGPRIQSEYLLGPKPLGHFSSELKRLNLAFKQLCGSQMNPSGALGVGSNPPGSYRQSRSADGGISCGDVAVESLPLGNGMLG

SEQ ID NO: 1001802 - protein, 116 aa, Homo sapiens
MKVTRERPPPTDYPSRSFGFKPSQNVGPLAKVKEKPVPCWLILGYLNKKRRRGNTKWKTHTLYRETKGRGPAKLIAYYNLFVGPKRTKLTRDGPTREKEKVRPMERRQQHLGRKRQ

SEQ ID NO: 1001803 - protein, 153 aa, Homo sapiens
MWPRVGRKPGATPGENWGGSPAGRGWASGADLVLYGQVRKRWYYKGLNPPGPQMAKGMCLGPVYPRGWDSTPCVDALWAQVPWLSVAHLGLWRVALKLGPCRQGRVVGTSLITPPIRHPGWVSGTLKPLHLSEGRTPQARENTTRVPTHHSSL

SEQ ID NO: 1001804 - protein, 104 aa, Homo sapiens
MDPSARVEKRRHKRGDGRHSRASIHDSSPHSTLAGLRCLAQPPCPGYGGRTCGVDVARSVTGAGDLTGGDYDGRCTIACAKRPGLKQRSADRLNTVRHRRLGTM

SEQ ID NO: 1001805 - protein, 173 aa, Homo sapiens
LLVGVPANKRDRAGIRIWDSEWSGDSAIRDVYAHMKSRISCQYFSQIVMGAELRMRWGSPEIRRCYCPGQGGPGVQCHLDGEYKPGLTVVVAFRELVEPTETRMLSSASSGPGAVGCLCGELLLSLTVHGGTMTSWHSLLLTGVASRWWLANQGRGVVVLDAIQWMTKASQVS

SEQ ID NO: 1001806 - protein, 367 aa, Homo sapiens
RAPGSRLTSERLSVQRGQWRTLACAHESARRCPGTGPAILGPLSLPTLVISMRALLARCTDALCGLPGHGRRAGSYVVQDLPPSSGSVQRELTAGCCGEPVGSACCLALLQASPAQYSVGDLRGLSRTLTCPLTRQQFLGGLTRTHSTHVSALQALCNEHQKYPRARRRLHLTLPHGTSRLEPHSWWHNELSRSPVTPRPVTGAGCFLTVPHGKAHATVPFLRTLSATPPDTIPSEGAASIHLGHPYNGPTVTYFPVQGTRRKYATETCSRIRREATAVTAGSIRTPRWQTPMSTGGFLYNTTLVDPSATALNATTYSPHPLGSTNAFCSATHCALANQSARAAFDTLCTLYTRGSLHTLVQRVPPR

SEQ ID NO: 1001807 - protein, 233 aa, Homo sapiens
EPRSLSFRLDPASWEPRGSCPDVEDWGLLKVQSSALAPSVPKSSMQVPQEEKTLLANLGTTASCPARRLKLFFSKMATSWFCASGSRGGNPVISCRWRGSALHFEVFRVALRPRPGRPTALFQLEDEQFPSIPALVHSYMTGRRPLSQATGAVVSRPVTWQGPLRRSFSEDTLMDGPARIEPLRARKWSNSQPADLAIWGGQEKTPLGWKPPTCPYLACPERAVTLVLLKAPA

SEQ ID NO: 1001808 - protein, 108 aa, Homo sapiens
METVALQGKQLTSEARGHHQGNGMEHRRHSIEGRDNVKLSYGHDEGELGTVTSQYKTKTLLAARTEYRYTGQAARAQPKYVTTITRECSVHTENLEERDSGKQRQERE

SEQ ID NO: 1001809 - protein, 102 aa, Homo sapiens
KKGRFFFNLVKFAPGPPRGGGGGAPGFFWALKPPTGFLFPPPFSSCERGKICPRGGLSRFGSWRLPSWGVLGEAACVRMLSGPQGSSMCFPPCWVDEPPGVF

SEQ ID NO: 1001810 - protein, 82 aa, Homo sapiens
REDGDQRVYGGIAVAVAIFRHTAQLRRTGAHFGTVSVHSDDSPQGRPWQMQAEQLQRLHQLLQRTAAVHHVTRSQLDDSSNK

SEQ ID NO: 1001811 - protein, 106 aa, Homo sapiens
MGVGILFVYVAFLEWIGPLACSDTPRCILLPRCNVGESTGHTRISPGKLYKIECLKHKVEYHHEQCAIAVDYHTVLLLARRFQRPVSLEAHGTSSCAEHLVYQDVT

SEQ ID NO: 1001812 - protein, 303 aa, Homo sapiens
RSAQKGALQATGDSCCRKLMGVRQYRVMARQILCAIGPEGGDEVHYVSPTEIHSDDDLLEKNINIVRKGLNRTVTLSEKTGGMEHLVSPERRRRKSRGECKLSSWRIASAERAGGPNGRNGERAQYVGKSSRYASGRRRWSIEVACAIPANPAGDLTREWNAPGVGGRGKGTVRTRAREEHVKPGERVVKCMRWARRGEGGAKSSGQFEASLESRGDRGRSMYEATIDYWARTHGGTTEGFFLIWPHELYILTLNGWTDIAGQYCIGVGGLPEWLWTVYGIGDTAGGAERGTQGLIGGERLEG

SEQ ID NO: 1001813 - protein, 157 aa, Homo sapiens
MWRRETSGRSQEKQHHTQRLCGRPQCVCGLSPKGQECARTKNLPKCVSPYTRPEKPRRELDGAVGCAGQKKNHPCENVRAIGCHISREGCAAPLWWRKRRSPNGPSWGQNNTLCVGPLTKLTPRGAGQTTLLCGALLSVGSPPNRVEGDPYTLGEHL

SEQ ID NO: 1001814 - protein, 203 aa, Homo sapiens
RGRAAAQRLNRCGPPRTTLPTLAIMTCLQNSLLRLSCSSAAFVSWSSAVLAGRPEESPSPTRSRFPHGTEAAANFEHRFHPIWLVSQNGRLHRPAGRPGMRTRTPRITLQDAAERRPADTPRRTHHRQALGPETPAFDRPPSLLDRCTKTRRTLPAGGGTDRTQTQTQDGDGRVDCLSVPELGSECNYGLTVGAEKGEIRTLS

SEQ ID NO: 1001815 - protein, 77 aa, Homo sapiens
RVFGWQSGVGRSPDGSGREVVGAIAVMTKLDSPCGRDKCSHRLKGRDRNSESNMARTHIEQEYYKLRTIDAESVKRV

SEQ ID NO: 1001816 - protein, 297 aa, Homo sapiens
RESESKSEPPKDGYSKMAPEAQVEEAGTDAVIWLQMEHVRHLVLRDADPDQEHMIYPRWLHEILMQAIKDVNERESFLTGVMRNKPSSCIVPSSESGGVHAPSRTSRHSVGFKVDIDCGGIIRTESCCARLYPVIKGKDEALACLLQSDFVLWISLGGREMTGSVVVWSIAKRDAILWQAVQLASSVGNATNVIFSRCRDEMFMTAMEVGQFEYGNWIFQIEKSGQRESQTGTVEKNSHEYVEWMMTDSLMLALEASNGDVLKNEAPGRKRGDRWLGLRNGQIAGWGVSGIMWLKMG

SEQ ID NO: 1001817 - protein, 56 aa, Homo sapiens
MNKRERILERKAKDTNNSIHTENGQHPETAKQQKETATEQKQEKRKRERHKDKRQQ

SEQ ID NO: 1001818 - protein, 102 aa, Homo sapiens
AGRGHVSDGAGRRVKLTVGVSGRAELSSNPACSACWHRWSRRQLLAPWRMTTPACGAEGGCWCCVCRGRAVSGLCARSLCVCEVEVDFIGRAWVMEHEKRTL

SEQ ID NO: 1001819 - protein, 50 aa, Homo sapiens
RETLAGPENARSGGGRSVSSRLPDEPLRCGTPRWEDDEAGGGFTTRRTDG

SEQ ID NO: 1001820 - protein, 174 aa, Homo sapiens
AELLNQRQMREGEESGAGAAFQAHGAAPLFFGLGYLWAEMETAARDSGTMKQYYDEEINLDALVKFSHITPSTQLAPDRLVYASFSPFSMLCEAAVRVAYGPYGALICIQAGLVCSAFGSSLEYLMTYGVSGNTVIAIDNLNQNTDVETSLAGLCHSVYSELGPGSHAPGRSSY

SEQ ID NO: 1001821 - protein, 71 aa, Homo sapiens
GSGVLPAASMMRGKVQPFRPAYELMEQPPLKVSKWTSQRCQSVEGIQNNIIGGVYTLCDIESHIILFRSGY

SEQ ID NO: 1001822 - protein, 143 aa, Homo sapiens
AEIRSARSPGSSRATHAPEAELQQREGEESGASHMAARVSSIAAIQRLATVKFKHPSHLLRRDLSGKRLQLLRRLDTPRRRRGGRRAGPFSELAYHYGQPAERREAAPIGASSWSPAEQLAELLQLFSKAGFPGRSQAVTEWS

SEQ ID NO: 1001823 - protein, 124 aa, Homo sapiens
RWQAGSFGHSRCFVRLAWGWPNATITTSLKSEGEEEEEEEEEEEEEEGEGEEEEEDGEEEEEEGGEGEDLGEERRWRRRVMLIVMKRGGNEGAPRGLELRTGQEYAAVTSAYGAQRPCLLCFLK

SEQ ID NO: 1001824 - protein, 124 aa, Homo sapiens
MVVWRHKSRLYFALSCRDRSRRDRPCNLSNVPLSIPINMCLKTASAPGRTPVGRGNKHAPTFTISVHSNWRSEIRHATTDRRKTETTDTQPRETREQRHRHSDRARKVARGLVQTDTRVNAKVA

SEQ ID NO: 1001825 - protein, 162 aa, Homo sapiens
MVSTGIGRNMALFLVVQLLIGLGPHEWGIACRWRFRSVLLVCGCDVANSLRWCESYLKNCRPSYCRLRDVTQVDIVPRAILNNVSIPTGQSSHSSCRGEALRSQGPSHVSVDSRGKGNFTLQVDPLKVLPHPLATYERRKLLRRKPDVLITLCVTSCRTRRN

SEQ ID NO: 1001826 - protein, 89 aa, Homo sapiens
MDRKNHNTSKTPREKTTRVRKQVAGDTTEKRRSTGALHRTNWGRYQEKPEGGHRNRGSMGATRHPGGKNTVARWGNNKGPRASGVATEE

SEQ ID NO: 1001827 - protein, 284 aa, Homo sapiens
RKIFLYSEKKNPKKQKFPNPHRGGFWVGGGVCPSSPGPQPRWLGSKKGVRGVRAQTNKQGRVCDTRERKGVQTLSGERGTASTEPRRGSERGQTPKGGEANYQNIVMESNQHHGDKQRIGHKKTREHKRSGENKLVDDWRNTNGGGPHRGSDYEETRKNSSEYNITPVTGTAPGEDHADTKQKKITGTPQKRDSSHSTRKKTWNAGKLDQNESEKPQTLQTSEMKKRCEQNKGSTRGGQKGGNTQKREKAGNPIEQGPKRMRPQIHHDNRRTADPRKTRNIAKK

SEQ ID NO: 1001828 - protein, 433 aa, Homo sapiens
GPVRAHTSSEPSGDMQMSWLQVSAKSLSGPQLLRMRHPLDARARLTIRPLPRGYGNRNHHGTLIVTSLVPPSRHVLRGRVDALWGMPPRHIEQSGTTSTALSLHPSVIGWRPSATLPKGHRDTGARHDMIASVACVSSTKRRKVRATASKRLGKLGASIAMSGVGFQGCSFDTPHSTAIRSRTRDIHDRVVGGTRRTRAFRVFSPGNHVAPTSLLPCPQGVVSPELGVTRCQRTVIRIHSTGSSVRKGPDSKLSTNYISGQTDAKAQDRGNTTRRNAKRLTQRGFLTGNKTGHPLFQHGRDGSPNSAPNGVSSVEPLGGTVRSKPKFPKVGTPGDAGLREEGAPIFRQRLLRRPVVSYDGRAPATREPRNFSSTGSELWRQVEHRKAVYGGKGEGTVAAYYSMAMVSRTVTGRSEEEERRPHHELTSQTVLGA

SEQ ID NO: 1001829 - protein, 182 aa, Homo sapiens
DNLCFVGLIFHALSLHGRVVPVCLNGQMSQVLELTVIMFHRRPSNHKSKANLPKVWVRSSQNVPMTYLGGTIAARLNIPVSQVNLLRMPKPAYVHWQVIYMDMSSEQLDDILKYHTEIVFARTSPQQKLIIVEGCQRQGAIVAVTGDGVNDSPALKKAHIGVAMGIAGSDVSKQAADHDSSG

SEQ ID NO: 1001830 - protein, 162 aa, Homo sapiens
GEGRSHLSKVLSDWEALLHAGLSGWGGLVAHQSRPPRSVRSISPPCRSERDTSECWEGICSTEIIAPGERLKAVGLLLVYSSFLCSVCVFDNCKLSASMFGPGAWHAASWLTIVARSAVLSALDLAQGSRGDFVRGTLDCPKDSMRMYWAVSHTDSRKLIVC

SEQ ID NO: 1001831 - protein, 310 aa, Homo sapiens
VHGTQTCSVLKPEDGTDDNVGFGLGMNSLRGSSPGPLVWLFPVAMAPEIYREQLFVRGCSVDAGIQEESLSGRSYFETHLYVRTHAYQCTPVEFERHSLQRYPTWSEDIKEIARLFARERMSPERSVASAGRSLGEAWTPVRARVPSWSQARLVGPEGCPPVASPHSLLSLACRLRLRAERHHGPWRDGSSAFERAPVSPRARVVARLVQRLANTSSSVACRSRSRLVVTRRLFESVHCFRLAEVIPAMGPPRPRRTWAILCLAIPWHQGIETRAERPAIELGISLDPRKNFKGTSSFERTVWRTIRKEV

SEQ ID NO: 1001832 - protein, 127 aa, Homo sapiens
RAGPQSVRPAQPSPASRRYPSRVRSRYYGQPRLLPTARVPTVEVITKGQMCPTDAHSSFLLDCSSRTMRIIILEDMHLRASDILCFAQYYTAMFSLDPTGDPTIVDSWYEGSSLRSMRVNTNYVYPS

SEQ ID NO: 1001833 - protein, 155 aa, Homo sapiens
MQYQGTLSGHGTCGLLLPSPCSLPRTQYCPGTPSGSMNTETSSPWDDRQRPPHQLDAAPPNDPAHAPRLDTDWQQSGYSLLLPALEMSFQVQVMTAKQSPGAGHYCPESRGGGELRRDCRSMSDLATTLGTAISALWTMSFSREKPALEMDHQFL

SEQ ID NO: 1001834 - protein, 165 aa, Homo sapiens
MICPCGASVILGNNGFIWIYPTPEHKEEEAGGFIANLEPVSLADREVISRLRNCIISLVTQRMMLYDTSILYCYEASLPHQIKDILKPEIMEEIVMETRQRLLEQEGEGGAPDARDCGPCRSDDCDVWSPYRGSAIDSRDHPFVCIDGPVTASLATHGSRFTPCL

SEQ ID NO: 1001835 - protein, 110 aa, Homo sapiens
MSEIGYIDLLYVKSENSEWIESSKDTVYHGCYDSSSIKHVAPRELTESSGRAEGTCPSKVELLENVSVDRLFGKSWMQQGLDPAFRPRETLASRQESIYVITWTLCCCEK

SEQ ID NO: 1001836 - protein, 168 aa, Homo sapiens
ERENKSRVLWVFFFHAKFINFPGIKTLCGTHEAGALIPVHGNSGGGLGRGWFSELPVIGRLGLEYSLLSQKARGFRYRDRLYRNGIQGVALWERLPRVWQLHAPGAEGESSFIEYQPISEQQSLRPQGDGNDCQLPLGDDKGMRRYQTKRAAGAVITMERKREWWGRI

SEQ ID NO: 1001837 - protein, 423 aa, Homo sapiens
SGVAGRERELGGRLAARVAVARLVPAQPCADEAPRKGSFSAARVCLHQRPHPYALLALGRSCPAQCLVGRLCAASNECWSSMNFLRHDLVLALTIFTICMGTTLGRKGLPTECRLLVPVAKHASNLFRLHVVNEKRIPEVGRPSLSTREAVVCCQEVHTVGSSYTTKSNGSYTPRNDIGLSLSKMGRDLFARVSIGGPIVVSDRLDTPQEGVSSEWWPNTYGRFPRYFLLWVMLHTQRGNKRQTFPSRVQGDVNAYVGFILVYGFICVISVPVGTQRETFVEHKPTECFSRELGRPTARANATRTPFGPLREQTQAPSFWEHFPQPLDKGFPKAATEGAAHFSLFFPHLVSSSPLTQAEQPPQWAKTPHPIYKMFGFEGRCWRTRGAQTTVYRQDTCAPSYGPTPYFPPKSFLFMGSRGKNFF

SEQ ID NO: 1001838 - protein, 158 aa, Homo sapiens
MVRYMHLGAGETHEIDANQAGSNLRCSLEEQHRETAQAIKGYAYTKKPRNVQSGNDAHRCSRRLVCTIPMFPKGGSWTRCAQAKTMGAGHEVVGQKEVLNVGCTCIRNKRERECMNYKGLDVDSLVIEHIQCEQGTVMMRRLDLQELMVGLTQYMSSP

SEQ ID NO: 1001839 - protein, 112 aa, Homo sapiens
MRLTADWCLWVFPLTWTGTVYAPFPFVRILLPFSPLAARGMAVLFGLAFSCWCSCLDQSFHDPSSISFFGVLYLISSSPSSPRDARVMVASCGRARWYSTRLTCSRFGILPK

SEQ ID NO: 1001840 - protein, 241 aa, Homo sapiens
AGGSCLAVGRGERGVPKLARHAPRPSEAWLPHAPCSLLCPVGPECSAALPLSRCPAASTALRSYWSEELAPEGGERDVVGGHGRIKPPFQLNHEERLKVSPDYNCVYEGTKFPLKRIIVDDDDRKDMVDSMTRAHPESIQGVPHHNSLAPWRLATAQQVTSNPRKDFITAASYELALPRLNRRKTRRYSDGNPKPKYREHQYIDSSCWTAISEQKYKNPFTSSHTGFQYVIKEQHIHKRKT

SEQ ID NO: 1001841 - protein, 226 aa, Homo sapiens
AGSQVAFRLPCLLCACAVSTDFDQERVQRQPRPQRLELLVIDDTGRGSGSLRRLLSKADRERSELARLGESIMECARHKGAIATWCSQSTRRASPRCTCRVADLATIIYPRTRNSNRRRMPVVMIGVSISCDWKLAKSDGTIRDWSHEERVDSRRSGDGVHGDTIEYIVTGYNTPPSSQCKGPVILWEEFQSCLHCMVGQGVLFSLKNAKCGHDSNEFVRVGGCGS

SEQ ID NO: 1001842 - protein, 155 aa, Homo sapiens
MQVSAPVLGPLLVNSMLATGCLKKPENSFPRTWAAPFVMHMKRKRRMGSRQPSVSRPVIRVVLGAICNSGLSGARGCLVTGPVPGGSPPPAGVGKDPCPVCSAAEEALAAPRLEPCNPEESRAPSPHREGPQGPGPRPPSFVPSRCGGTSDSPPT

SEQ ID NO: 1001843 - protein, 268 aa, Homo sapiens
SGGVEAPAGGRGYRHGARGSRSRFLASTSDRASPAREVELTQELNKRVARRGHAGRDAEHAGPDAGIRSPGLRRLGTRTRQAGWGRVDRSSCYSPVVGGATSHAARKHRNKSHTATSCVASPEEDLRAIAPGALEEPASVGTALTLGILWQLSLERNYFAQSLGQKLIDIRVWYIDVMILQHCSVRPRAQELGKAIEWPRLSGKRRIVVLGDSDDLLLYTIPTKEANSTILIHQSSSLRIALYLRGRGKPTTGILWVGLRKKSFTGRP

SEQ ID NO: 1001844 - protein, 225 aa, Homo sapiens
MRSFCALELPGLGKIDKGDEDGTNICWLGPKQGASNLLGVRHEHTSQSWTSSACHVRRDEYLNGGRTGGLSPVKGGPLQLGPDPKSMNASRYTTHGVHEMRYFGSKKVSGGGEYTVPTRVYGNTLNHVRFGIRRHLGIGETGTLRDEFPTMNTTRSRRCWERHHSKGGKMTHKREPVAVMKFTYQRDSVWTSCTHGDNSEAFSRTGPMAWRNWASTLWFETRVTP

SEQ ID NO: 1001845 - protein, 220 aa, Homo sapiens
SARGLPPTAPRSGRCRLHPDPEPAPPAMEVAPGAARAWTGCTLADAELRRHPDSTSLGLAHNYMEPAQLLPPDEDGRLLQSARLAGQSHTMPSPAHARARVSYRPAHARLSGGQMCRHTLVAQPGFALGWTGAKPALSADAAQQHKPVDREAPSPKNASEPPSACWRALEAQSLCSQGLVRDWDAEGDGHAEGSTRWGHHPYRPQKRESGRATWTKPRND

SEQ ID NO: 1001846 - protein, 337 aa, Homo sapiens
MECCPCSACDQLAGQRESPQGYRATLKPTDQPKALWRAVEDGLAVLLGSFIPKGLVLPRADGHLVEQTVSVSFVAFLALQYSPVWRTVVNWNLGIQAPCVGNIPHDRDSPCHIAYSDDAGTCSYQRRMFLSTTRLASEVHEFLMSLLMCLGKSPRVVPSAQRHRSTTVRRLLRPSLCHVMTTSQKHYSQIRDASRRDQCRRGEPNISIGQTSVQRRMGTQELALPRQGPIRSPWAIGSNMTRSGRAQTEHTGPVRHTQQGDCPLRDLRGKEEPDEKTSSHSQLLDLLDREIHHESQGTTVLPEPEASGLPYSGDARDLNSTNRANPCRWTLCGDAPG

SEQ ID NO: 1001847 - protein, 72 aa, Homo sapiens
RKLSLTSAHFGPGRGKVRVVAEASLWTRARRCTGGQDRLARRTERIPVKRVAQTTNLSLPEPTNTREYVRSD

SEQ ID NO: 1001848 - protein, 132 aa, Homo sapiens
MRTGRPRLGQFVYKTAACIQDATSLARLGVILLLLGQILWPETLFSFSHWCRPGTPKWQSVGLWLAKTAFQEPQERTLRIEEWEKVAATPDDRTPYRRADRDNRGRPQDIRQEKESTEEDTPPKGTRERESA

SEQ ID NO: 1001849 - protein, 47 aa, Homo sapiens
MLRVPHRASTHAFCGKGPSGSPETCVRTRGHERRLVVGRHLVHVAVR

SEQ ID NO: 1001850 - protein, 423 aa, Homo sapiens
AWGCAALAGIWRTAGETRRLPRDSCSRTEGGGRAGARIAAREGLEAAGRSPVTPRVLYTERLNGLPSWYPRTRTTPRILNAVKHAPVRLTDLHVNHGLVEHRGRLRCVQLPFRNQVIALACCYSKDVTRSLIWGVKEDRRNPRNLKAGLEGVGHALSAGLSVSKQTTVRYGSPSIKDMASTRMTYLSDDSEWQIGSTSAQGSLVHYDSRSYLGVHQPYWFAPSLYERTTIVESRYVHLPQGTTIWAVREAPRIGVASKDHCKRYSLDEFLVGNRLFQPKRIGYDSYSASNQGNLGLTLAERGQDLAKRTKGEPTASPNLGNGVVWSADAHPLSEIGVYIQLWGREVNSQTSEEGKRHRDIKDKGTVQWRHPKDKGVPVGKATGIGHVGQILGGGRQISRLIGRVKPLLELGYYKNGVSSVEKP

SEQ ID NO: 1001851 - protein, 91 aa, Homo sapiens
MSGALDVLQMKEEECPKVLAARNPLSVAPIVDLPDVTSTSIKGTREGIYIITSQEDLGKSFCWQLVALLPLKTLSDVRKISSRNTGQRAVP

SEQ ID NO: 1001852 - protein, 235 aa, Homo sapiens
HSGGANVCWEQQSLTRRKEAAQLHLPKVIIPEPPGAKLAPCISTPVHENCQHSPHRRGKFAVTEGDKIDRRSGKKLEDNPKYLKSGDAAIVGDGARESPCALESILPVPASLAEFAVRDMRQTVAVGVIKNVEKKERQDAGKRHQARRRRRTKRGQVEDAGARGATLPGGAALRTPATAPAPPRTRSAAQRRPEPPQEMSDLSLQRPSVATDARHKVQCKFFKRKGAQKPQASAP

SEQ ID NO: 1001853 - protein, 194 aa, Homo sapiens
AVGEPGAPSGTARLPRLAYPAASACDSGAADARLTRLRASADLRGRKESPGGMGGEAGCAAAVGAEGRVKSLGLVFEDERKGCYSSGETVAGHVRAGGVLSRWPCCALRHCEAQGLRQLRLGPRAPDPEASGQPPMSLGCHISEGGRTCTCASAMREPPSGEGIILLHAWKNMNFHFAFNFHHEPMVTIVYWEI

SEQ ID NO: 1001854 - protein, 198 aa, Homo sapiens
YQGNKTGKGSRHYSGPLIICGANTGDSYVKRFSIYVDVVPHTCRGHPRGDSLDHIWAHGRGEASCITWNRAHVSHNSSFSHELLTVEEWNTHVWAPPKKACVGPHTPLGTQAPHLAWPVATVSHLAPLVHISHINISATQRNMREDKNISISQNRVCPASNRVEHSRESIYPLKWDTRQVTFPRGHTLPRAQRACPSL

SEQ ID NO: 1001855 - protein, 132 aa, Homo sapiens
REILLVSGYGWTVRVSLISCVDWTRQRLVCFPSYIVIADALSPPEVPGIGRDCATYVTGSQFSAIAPCDDSSKALVDRVSLSSARLFDPCEWKFVSRMYLYVDGLIYVGVCKLQCHFVLSLLILIVYCSPFY

SEQ ID NO: 1001856 - protein, 37 aa, Homo sapiens
RAARARAFKKMFSEHSVFSIERHFLIGFAVKSCGTSQ

SEQ ID NO: 1001857 - protein, 185 aa, Homo sapiens
MATLREKLIAPSERKKRHQFQMDKITVVGVDKSVWGCAISILGQSLADELALDGVFRKIRLEKEHYVTAESSKQSGAINSPVRNRALIQFLVRHLVTMNCSVLAGARLIVPHRIMSGSCSIWARDVSVHAKERCGKGPRVTCWMSDDPVNVVFHNILFELPVLWMLVIPYRSDLEIEVTLNRMGL

SEQ ID NO: 1001858 - protein, 82 aa, Homo sapiens
REDCGLGHAEGLPWGRSVESRMGVWVDGMGESSTAVMGKSSQLGPGGEDAVELLEDDEAELWSPLWTDEGKGGLSNALVLEQ

SEQ ID NO: 1001859 - protein, 508 aa, Homo sapiens
GNFLLRVCVPPIVSRSDGYQGHDGVLGRSICLENQFGSSADAPGDGSNRGVWQAETPPTMALTTHVLLSLACITSKRDSMHVKSDTITDTLYDNVTLQRFPTDLRKTGGEPVREYTGETWEALRLGSQAEGLVRLQGATFGNSARSVYERPARDCKPRGLDTEDTTPKRFMHVPHSSLTRSARAGAQRRQTFSKEWLAICGECTPLGHDNTKGIKRRPRGGTQVPRNHVEACWCPVELRNWDENLVGSEEKGDRCPTRNGGPRGATNVRTGPNWPRFFPFPPGEGSPQRNFSGGMLTSRRMSTHGTAGTSSSQNTGDTLSGDKVKGQLGFPLLFFGGINLLGRSNASVVGHLHPRLFAPKMRTGGTHPFCTYRHPTTLALYGGTSDTHTALWGIVNIFAVDIFIVAPPPASVYNTSSATKSSGYKPTPHLDTFYDSDANKAYPQPHSNTQTCGVWQTHLRHNTDQDDVSHKVTFAPQKGEHTRAFLVIVRDKLQLDTHRRDITNRGLL

SEQ ID NO: 1001860 - protein, 152 aa, Homo sapiens
MAPREASRCHLTCLNQCTFDLPVKTVGMTQQDVEDPMETLIFIQCRQYLTNSIRSRKADTNRAIIKFTVVVRLCGARTQRSEQYMRKTSPVKANYYTRIDPITSPTEQVTSRDNSSNPILESISNNRVYDLRCLDQDIPMVQPLLKVCLFND

SEQ ID NO: 1001861 - protein, 114 aa, Homo sapiens
MRVSTESLVLLATVILSDYSPTTVTPRGCFSFASSYCTQGSSQRIISHISSARVRATCRINVDYGYTQVRLWFQIMNIFQGIFMSSIECFDIPLSPLNRQLESRLVPTRSRRTT

SEQ ID NO: 1001862 - protein, 227 aa, Homo sapiens
MPIHPPHGCQRKVLSHPCSRRGALVSSLIHLIDNHTSGEQLTDGKWGFLHEKADLTMIERRWVYAPDANGLPQSTLKGPHMAGLAAEADGGQRSGSTGHTIGTTWEGSCCMVDSNPARSCDRRGTSLVFPTIGNSTLGLHSVWTGHGFSLHMPRELYQSSRGQTWQDNRGEGSQVEGEFGCYHIAKRKGGWKYTFRDEKLHDDKATMPRRDAVVANESAKAKKGWYR

SEQ ID NO: 1001863 - protein, 268 aa, Homo sapiens
AKGEEIETELAHYGKRVKAQGYMHGLWVTGRGYHGGSDATLAWLAMTIFVAVCQSLSSVCFTLLLLASLYKDVAATTSGCHRHLASTTCGCSAPYPQSSKMCRPSANPGTKLTRATSTMTASARGCQQSAYPTAVPMHLTQSSPWAHRATTETLAGLSMLRPSPPASLLTTRYYMDAPKAASEHSLAVSGCHLVMSCVCVSGVQARFLTRPVCAVCVQVRFLTPHVCCVCPRLYMWLPSGADKDGEQSLARVGWDQSALSSSAEGSAS

SEQ ID NO: 1001864 - protein, 86 aa, Homo sapiens
RGSRNPLGSASTVWELNSFALLHNDSCCQSLFGSAVPLSAVILTARVCGFIPEVSETTNPPGGTNNSRRTTFKNCNTHCKGLQLHS

SEQ ID NO: 1001865 - protein, 83 aa, Homo sapiens
MHWCSLHVPSPWPLPSLRVLPGLGSPGEQSLRLGNRDAGVQAPTSVAAARAVVQSHSGMDWAGGRTSHFGEDAEEQIIQSINC

SEQ ID NO: 1001866 - protein, 151 aa, Homo sapiens
MTGGDGRAENPGRQQDQEGGEGRLRQDPGGDPKKRDTLKADSGGSHCQGTQLEQPARASTGERTGTQTAEDRLDETQTAGPQESMDNTAQGRNTGPQIITPNRDEKEKTRTPRRTTDTSTNRITPASETGTQTDPATDPHERHKITRGTRK

SEQ ID NO: 1001867 - protein, 43 aa, Homo sapiens
MPECRPFAEARVGIKNGLLAGIKMRFGHRPRECAEAKTAQNVI

SEQ ID NO: 1001868 - protein, 513 aa, Homo sapiens
VHSTARPVASTTTCRSPPFMLRVGYTPSSIRWDDDCITISVSRKVGSLDASLDQLALWSMARCWRHKHGPHLAPGHCRFASPAWGLPCPCCHSISVPRGTVLDLFSPTYNDRLSRRLEAHGLRYVALLSYMSSRITKVKRPGGSRRSSHRPKAMSDASRPRLTQTETLLLPAGARVSTSAKSIRCSAYQYRSRDDLWRPSYFEGASRSQACRGGHSAHAPDGTPHHRGQGAWLDHPGAEDPLFPKFGRGPGGLAGLPTGRLGRFGPFRLAKGLGGALLEHWAFGEVEPFGGVLHPGICCNGRGLWGLGAPRITCGAVWPVPMCPVAVAGHGFDLGGASPFLAFPPRNSCCPETPGLRQGDTLLKKRCSTLGSTGLAGVGGTNQPCDLSTPDSGVCMRIGHALGKDSGSGIGVAYCNRNLTVQVVITEGSPLVTKVGWRDPSPCIGITGLDTYPGEAKHTPGPRMKALGNGHGTTEPTTYHTQVGAVTHKRRRDPEKRQAHTRIFTIGHTIRTS

SEQ ID NO: 1001869 - protein, 187 aa, Homo sapiens
MLRRWLRWDRDRNGRYVQVCQMNSGLRNEQRLVTRTKWLKEASNGLYRLVILDINEVCTLGRYKFIRLVREARLGPTSHHSLEGLQHLPKSHRAQGDGDCSNIGVDGGYKLASLYILGRLTLQSFDYVRVVLVEIASSGKIASTKWHSQALIKRYSSSRTGSAFDDDLCHIASVGRLDKEGTRYFHH

SEQ ID NO: 1001870 - protein, 294 aa, Homo sapiens
PWCDSVLRGCSLEQRSFISVPAHSLATYSCSVAVIRDCERIRCDDVTMKASRAVALVTDLCRIDDTRGLTEDYFTVYMAGTQMSGRYMDASTMCNIFFHSKARYTVSTGVTCAGKHGSRCLPRLDVDMTLSGTLHLHRRGPRIPPLLETVKATVVAKPLFAHKVVHCLEGPTTGMSPPSVGEALCREENETKTKDWLPLTGFRALVGISEGSHDATYLRWGSHGDLFHASAMVSESADGIGEVSFQVQELDTEEYVAEDLLVENLLLIRSFISLATKLAVVPWPLVSKRLPVRP

SEQ ID NO: 1001871 - protein, 103 aa, Homo sapiens
MAWLKVPIGAWKNPSVPLYFDSFVHFDLRFLRGYVTNGAAKFLGLERGKKTGYLGGYAETKSTTMICGPVEVSWEDWILSILGWATMNHVREIPLWKKNIGLG

SEQ ID NO: 1001872 - protein, 253 aa, Homo sapiens
MAGAVANARAVSGAAGLWGCSSRDVDRRTGMCGRAHPPSVVLRRLESREKQQHGGVRYNRLRTQPSQESQLWRLNCVFQHRQTYSDPFESVDIACACKNTSRLRYYAYLFTHLYEFQRDSYSSTGQTRCYMKSYLVKSANLLGLGLGQSTRRIGVESVTPSMVAFNGLQNRLTSYTKSPSCELYPVGTRRDSETVHSRTFTGQERHVFSWDGSKVVHPNAGFCFSPLAAYSKLPTRGNSLVAAMRTPYTNNVS

SEQ ID NO: 1001873 - protein, 115 aa, Homo sapiens
MVCSFTQEASETTSPRRTNNSRHTALRAVTLTGKVCSFTPEPARPRTNQKEETPNTSEHQKEQTPDTLPLRTVTLTARVRGFILEVSETKNPPIPDTILVHEMIGFSWTSNYGSF

SEQ ID NO: 1001874 - protein, 194 aa, Homo sapiens
SGVQANCRANRWAQSEWMESRNREGQTQMIVVRDLGPQCREPSRAKTIREAKDVALLLVRKTRLLHPTHPLAPVSASRIVPEGNVGEGWNHQTEAGDTSGLFCPSKASIGTSRSDIMHSLARRAQEHLLRASHIQSWSFAGCIENAARAVTSNVRFRCRVNPESMATYWPMMDIRDSGRIIRSNKRPAYAAIDL

SEQ ID NO: 1001875 - protein, 342 aa, Homo sapiens
MVLDLTYSPPAEAFSCLPPYFSSLAPLLPGRRPRASVPAVCTPRRPQADLCGPSSHPVAAHIKLQVRCWTEHCLRLCLHRVWPALPSGRDCWDGPLCERGGSWLGGCSRCGLMRDPLSGPSLSPVRPKAPSSDHRPYERDTSLPLNDAEGTWFFLLVRCKRSCEEQACQRSRVNHYAHKGCAWAPCGSDVCLSWRLTYALGHAQPLGPVALSRGAPPSVDQAWGVPVGQFATWPPLLDRPSSVPHRLVDMGGYPGSVPSFLWTFGANPITGGLKVGDPETPFEQFPAEEAPGFGPPKEGFKENVPWEKRPQWFSFNAGHPPGRFFTCVEASTGGSAPKQPPR

SEQ ID NO: 1001876 - protein, 65 aa, Homo sapiens
MVYYRLKPRRTTLDSAFRQYPAHVHVQGPPYLSWSSVARGIMEEMVWSVLDTSKLFGYEPTIYYP

SEQ ID NO: 1001877 - protein, 189 aa, Homo sapiens
MAAAVRAEAEPERLSALSGDRCSSLGLLCWPDPRKRMRLPLIFCLCVLNGGWADAWASIAYGGGYMCHCRIPCQLFVYGGCDGKQGKENYPDQEDAHNVPVTENARVTWHTECTILCPSAPEGRSETLSDSQYKICRNASLACRIFQLVLDVEESCIISWRCGNKTVRLRALSCSQRNLLPGQVVSRVR

SEQ ID NO: 1001878 - protein, 233 aa, Homo sapiens
SGPVPSPGGRLGATSPERNQTEAALGLTRGLGAVLPGLGHARGAGEAAPGHSLCPLRLITSKPGCKTTPQTRSLRGTWSGTPSGPGPRCQCYGRGRVLLGIVPFVYCALLHAVPICTVSMSQDFGWNTEGGRHRAQSASSGCYCLTQVVGGHLGDRIGGEKVILLSVLCLGLHHGRHPTARPAEQCPPGLHDLLTILMGLLQGVYFPALTSLLSQKVRESELSFTYSIVGAGP

SEQ ID NO: 1001879 - protein, 132 aa, Homo sapiens
MTEEELTDRTSAEDRRCQNCRDRTHTSRSSKPVSDKSCARPGVTPWTECWQQVHCLAWCTDNQQTLTPGKGLTTALRRRNTGLFDIALSAHDDPLFMERIVSELITDSQAWIQPKWDQTEKGNIRVVFKLEI

SEQ ID NO: 1001880 - protein, 119 aa, Homo sapiens
AELGRCRRNERERRGGRIRRRAPPWARTRPPPRRPPALDSGLSRRRPGTAGMWAAVPDCCCLLLLLLPTTASCLPTLRTSPAVWHAPWGVWTGVLWTRCHNGSRQWSFKAATKCRPVEP

SEQ ID NO: 1001881 - protein, 101 aa, Homo sapiens
MGCEKREGPNGWQDPAFAKPRTDLRSMREAPVTGEVSCGLTNGRRDCGVGTTQGVGQERGHCSEPLRGHRESHGTETVTVPRRVYPCGEDSRAGMASHRQP

SEQ ID NO: 1001882 - protein, 132 aa, Homo sapiens
MTRDRPPTQIQRADSTSMCSTTSTLDEAARAEAMGPRLRAATEDESYTLEGNMIYHWSRHGDLHTAGIAAHNLCIPDMVDANGEQLGTRTTSGSLSNLGNPCNWFPEARRITRNEVTNSRLNDSGQTMRTLY

SEQ ID NO: 1001883 - protein, 97 aa, Homo sapiens
YKNFLFNQGFITGTDSLELKGKVLQYTETYIRKFTTLYNTGRGKTQKQQVYSDSRGNSQWLSNLRVLSLTFVAKVVFSWIYKSHHLGGFSVGLHTSI

SEQ ID NO: 1001884 - protein, 279 aa, Homo sapiens
MCNLGCRGLFMATWGVYPWLFPSPGPGILVPPQSGPASGRHGLEDPRPGRRRTLVWHRGAGSGLARRTREGHRAVYSLGTTGGGGQGKGDRVYSLLSWGSESPRGQGAQAQQEVALMYKAHVVGSTGKAWLSGFTNSTSPYTRTALMWGKNPPGNLPEHKYYTQSFQWIEIPETLVTQCVCGFITHSCGFTEKCRETKGYVAESSLPWARGKNQIWEGESELYSHHTGISSPSTPPEEDFGNTTKAAGRKKHNTEYNKTTKGPDATTGIRDIGTHGGER

SEQ ID NO: 1001885 - protein, 110 aa, Homo sapiens
TKGVSLGYPGLDSQGRNLGSLATFGLPGFQGDFSVPQPLKAAGDYGRLCHLRRAIIWGYFKIEDGVSPYGAKLGSGNFCEPWCNSGHSYTAFSKVAGDLPGHWSSPCAQA

SEQ ID NO: 1001886 - protein, 499 aa, Homo sapiens
GKGFPLLAAQVEVLVGSISGQWKQLAPPGSRLIRSVPLRASCVVVRRGIYQGCLYQQVLRDNSVRYSIELRIKGIFPHCVGPGVLVINTSVGAHLHPVAVRALPKVGWKFYTEALKPSQRRGHPLDKMSCIVESGEGSSSPTGGITVRGTEELGPTGGKERERTLSKCTTSGKHWGCAPTEHRRESSLGDPLRRGAKPSDAMDIQIIWTRGKTYLSTTLNQVGDKHPLTGGAGHCNGSTNGSTYVTIGGTVGYNTPREGAGVTTQPPFVRESPLVGTTSDKESLSSRGWHIQPWESVRGKRGRMHPKAKDVGETRWEANTGNSSVGGSVGRQRLNNVINHPLRTVERAHQTEERGVHPRHLFERPSMTTIRVGRKKITPLSKVRRAKTHGVTTYQASATIGSPRMTGKRTEEERRAPPPSLPEARVCDTQRRQRPERRRRQTRGKQQHKTEKMGNAPTSCRTGGTSDTRLYKRGWPNMHRLNQQCEVVTRDNTDNKSQK

SEQ ID NO: 1001887 - protein, 73 aa, Homo sapiens
MGPKGLGGGHLLGDTVTPRTERGHGSPPMSNKGLETGSAGRQGSAQATGNNLKTYILEKRAPGRNQGSLITYK

SEQ ID NO: 1001888 - protein, 141 aa, Homo sapiens
LTNKKSFIGGGLLKHQRWSPKKILPVADKEEEIPVKLCRHATLFHLLSEVWVRLVDVFAEYHQRTTEKRKHNQRGLDNCALHLCSAKFAQISTPRAHPFTTISPYKRNKRQISPRYNTSISKHQKLSPIILVVLQPTNVEL

SEQ ID NO: 1001889 - protein, 217 aa, Homo sapiens
MPSFLPSGFSTGYKNPKFLYIVPKKGTPLHGGVGREEEEVLPLIPRFVVRRLRHRGGNDNVEPLTSGVQSRFPGTLWVLAPQPLWCRGVCGQTWGSTLRHHRDDTTTEVWPREKLVPLVDCPLWQIGREKEPYRGGPMPCGATQGGVSQRGQRITRAGVLPLTRKGLVHTKRDKSLYQPIRADRSHGGTKPRRQGGQTNQSEHIAPDQNGNTGITKD

SEQ ID NO: 1001890 - protein, 324 aa, Homo sapiens
GKFFFFQKKKPPKTQSFSPPPRGGICVGGGGCSVPLSPLWAPAPCVWFGAPQWGVCGVSGAPKTIKSGVAVCVCCVARENREVCVTTPARVRERARARERRRESVRTRETRGSPRQKCGETRPPDERGVVAREAPPLLSLRQPHLLSVVMVGRRASFINQHPTGRSGEMKTTTFLSVGGAGPPLIMSEERTIKSSRLLLWCPEYCRCRRDENSSSRTPILVEEDAEVEDAAAPPTPGARWEGGSSRLVGGVRAMRGEEGKIYPPSHWSASSNTNIHSFLPPSYHPYYPASLLIAHTMISTIEMKHTYRTGTDNKYLSPSDRIIQ

SEQ ID NO: 1001891 - protein, 105 aa, Homo sapiens
MCNVLHRPHTIVTNPMHPRSDSCEMHRQAWQDVLLAILVAVAVRISDSVYFHQQFCMTDALSDRAECTDSDLMREYNCETGKVVTRRSHQRRYTSSGRTGTGGRT

SEQ ID NO: 1001892 - protein, 69 aa, Homo sapiens
MAKQGETLRIKINKDRGDRCNEPVCKFPTGDHRFVDPMPMQAEGDIGTTHIEDGWYLHIPKRHGGTRHF

SEQ ID NO: 1001893 - protein, 246 aa, Homo sapiens
ALRDDLDAERSVQSDSCSRCSPVPPPYSAGAYLSASPLFAPDFVYHRYSSVYGFRYGPGAPSLGVWALLCDLNMARCARALFVELSSSFPLRLYSASRGGPVCPAFGAVCYESAARGLCPVDFAEPWRAAFWLRISGAPGSVEAVTHGLIMEQVNVQIAVANAQELLQRMTDKCFRKCIGKPGGSLDNRPSMKCIAMCMDRYMDAWNTVSRAYNSRSAAGTSQHVTGGAGHPDLFISSKRALRGGV

SEQ ID NO: 1001894 - protein, 138 aa, Homo sapiens
MLSIHDSKMDFGYTLARVPKMLRCRDRHQPQVTYAWTAEKFLKHGEYLYVEAKGLRTPARSSIAEAIPGERPSHAGQLTKSPKTLRVTSERKRLDFQSDAAGKLAGIHRCRPMNPFLHATRQGWHSFPSLAKGVYFVA

SEQ ID NO: 1001895 - protein, 45 aa, Homo sapiens
MVVTSPSIRFPLPLLLTGTSELAPLIGRKSERHAGGVPDGRVGQP

SEQ ID NO: 1001896 - protein, 159 aa, Homo sapiens
MHLNICPCWLAEEFRGSRRVLSYARNVRAKYSLSGGPSRDSVLRSITVLLIYVESEVLDAAGFSLDWQHADFGSTKAGCRVLLALIFAWSWIAQFRPVTRWEHKRALGNNGPESIIGVPNKYISTLCFPGSQKTLFPKVKVNIGCIEHLVFRGLCGHPF

SEQ ID NO: 1001897 - protein, 247 aa, Homo sapiens
SRVHLAAPGSGAHSSLPACELREKRNITVFILCPHDITVEAERTKIQILTHEGNRAHPGWSVWQPRSVPSSGEVISDEHGSRPRSATYHGDSDHGAGRAISVYYNVKPQVANMCLVPSWWIVEPGTMDSVRSGPFGQIFRPRQLLYLVSLGQVTSGPKATYTEGAELVDSVLDVVRKEAESCDCLLGFQLTQSLGGGTGSGMGTLLISKIREEYPDRIMNTFSVVPSPRVSDTVVEPYNANLSVHQW

SEQ ID NO: 1001898 - protein, 108 aa, Homo sapiens
MQSSDEAPILVARATVSMRPPGCCGCPPGSAFFTHPPEFEGRVSKLGFERTGEALRVEQSRGHVSSGVRDMRVSRRKLPRNVRRSLHTRFVRWQGERRALHLTKLRHP

SEQ ID NO: 1001899 - protein, 424 aa, Homo sapiens
MWTRRYYVGSRVEPNIAAGYRRCMEPESSETPRDRRVIATSGHSSLTGPNPCHLAVDFEPGRSPVSQRLSCLWAHPRHRPRPCVARTRTREGDYDRPLQAGSSLGRRTSQHGDAPLVGRRERPIGPGVRLDVAPWDQYRTWCAVVRARSIAEAPSAIAYDKQALRSKGYPHLPSHLLSELQITGPRSTFVTPSIVSSPFRAPNAGAQSPSVAKRVVRQRHVESVVSSLLYVSSSLQLGAFYALSSHKATQCPRMGVTAFGTFTSAFQLYPHFALKDTTHRGFWWQRPRPGFHPQDKRGRPTKLWGKGSPTRCREGRCHTPSYISVATQDQQTNGPPINALKRTGRIWTPAENGERVGTWKEPGAPSRIKDSPRASGGHSPQRVYQRAQRGHPRDTQAREPSRRGAKKHPRGLVLKQDGGDPAHH

SEQ ID NO: 1001900 - protein, 193 aa, Homo sapiens
MPRRSSGRWRRGNPTCGRPFVFSVNGGVEFEATWLMPYVLWPEGNRHLKVFSSRVQLVEVGNLGVRARHIGEESQEEYRGSCCVRLQHVSRLYGTGGATFSVGSAWRNVGGAAPISGDELSQRLFKFGEARRSGNVSTVTIRMVDPQMECKRPETLDRRSCRIRQRVVFRGMCHANGVSKLACSLRYEDYEPI

SEQ ID NO: 1001901 - protein, 73 aa, Homo sapiens
AQTSGDVLSGVSVDMILVCVLLSVSVTLSPWRADDHSLIFITFMLVSSWEQTSQYEKNQYLKIGKGERMVVLC

SEQ ID NO: 1001902 - protein, 331 aa, Homo sapiens
VFTPEDLHICRTRQDEKKKSRDRDEDPRWRTVDLVYRLLAARPMCDGISCCKFLATMICGMLPERYYDEHAVLENFTHPPCVVGQTGDYPVNCLLLLRLCLRGLPPVERGAHLSHLRVWSVDLKGDPKTWLISTTKYPSYPSVMVSFLVSYSCLLNLRRRGRLSIVNKAVSTSYDCLNEYFVCDYAHHSIHACGAPQKTFASVTKLRILVLVCTRGTTCYIPPPDLRGDYNSMRAGLDIRPHVLRLPADRYSKRTTLHAFETSGSLVQNHILPLIGVSMATCVLSSSIQRAPLDVGGQAPPNVSLPCPFVPSAAKLSKPPPIILGVRVRRA

SEQ ID NO: 1001903 - protein, 321 aa, Homo sapiens
ASDCPLDWPQEYRSFLQMAVSFTVPTPGHSSQTSWLQSGSGDKHHFKEYSYVRFQSCQPSPGASLPKHDASWLQARFLGRQWHDELPVCRRTLVQKVVRDRSVVLLIATLEEHSKLRCSWIEVSSYPGLLSRLSTRGVLCSLTPRESYTYGSILAHEGFREQAKQQVNIFLEIGRSNGTHVGRLLLGRLKKGSMSTRRSPRQRATAVRIAGQIRASLGRELTLVPGASKVPFEGKHATLSNSHEHCQARSPAPGSCAPFGKVYPLGQDLPTRTGFVNIVSGHPGVVIQVPGTGRVYTVRIPGSPIAQYKQVTIQVLLDTVV

SEQ ID NO: 1001904 - protein, 150 aa, Homo sapiens
MVGRCHKAFKPDVIDSSYGSCQMDVCNIPLIASDPSVEKPHEHCRFTGIRYAPLAFRLVTLGLNPPAGEGVEDPSMAILAALEVCVTSHSRTFLSNHTVLDSCVHMQALGTVASKACRQLLQHLYVEHLFDVHNDDKDGNDPRSLKETRE

SEQ ID NO: 1001905 - protein, 158 aa, Homo sapiens
ADVSVYAPPVVRLLFGKLRAGYAVLEADLADRGSIRRFREDVLATTGGTDHRWRVVYIGMDYYVSWSHDYNAAKTDTVMCCIADEGTVSNTYTFDISINILVDLCVAWRHDVRGQQDQLTTPRRRIVRVPHLAGSRLSIFTLCRSFRSRFADEPIQDA

SEQ ID NO: 1001906 - protein, 286 aa, Homo sapiens
GSPRGPCARPRLGGPCPAAAQAAAPWLPDLSCPRLVRAIDGGCGRRSARAEPLRLQTSCRGYRQHSHLPPKGGLGRWISRPLPQRSSGPVSRAGGVQAQARKRPARWCMLMVLGAVRIICTVDTRCLFWKRASEIVILCARIARTTISGCCQGRAGPRRMGVIALPWGKFRVGTRTPSALTGLSPGQGKRVPGRALRSPGRTTRGARKGAQQGWEETGALGAGAKRQRRTPYGQHEQRRPGCHRNKCPVQKQTPVAAPGEKLGPEASIRAIPKEVHKGTHGRPGYQ

SEQ ID NO: 1001907 - protein, 187 aa, Homo sapiens
SAFVVHYGVCAAFPLVLYHVSFHNVREPLMSLTLLKEDDVLNIPCWHVTSTEDGTKSLTFQNVDNSYIPSKAGKMVTGDRISTNISSTDLETKCVLAWASTVAHIVASLANAHVCVYVEELIIASRENSTWRIRVWCLNWHALPTLGAHVTNSLARVHLLERFSNRMIAPRMPFLWNASWLAVVRVD

SEQ ID NO: 1001908 - protein, 271 aa, Homo sapiens
MDGGAELRMSGACDEECGLQSGPPREPWRSSVAILASVGMEFVGQPRRVAGRLVVGCEPWLLHVGIELDRSCWIVATHAMAPEGRGRRLVYAEGAQRHSVHGIILRPLRVGPRDLLAGPVRRRARILELVPSQVCSQADRHACKAGRHAMGTHGAQGCTHTVKGAGSSLPRARPSRHEWFNLGHSSVQAREKTMKGEWVRLLWEKHLERRFASERGSPGSDERGGSHVHSCGHVPSRGKAAWSRCTRVHFGLASLRGEPGLRPGWVVPLVG

SEQ ID NO: 1001909 - protein, 103 aa, Homo sapiens
MNHVVLRGALRPPSHSGLHNKNALVLTLSRGQFRIRNRSRSRFLWGRPGRYKITSQNVLFYKRISSVKAKAMYVLPEVLAATIVVAGKGKTSSHSDLTRNALT

SEQ ID NO: 1001910 - protein, 270 aa, Homo sapiens
QRMQRSRLLRFSEPSPFRFRKSWPPVLAVFVMVSSLEDVRTDMRGAVESSDARKAGDRSVKQGRCLLLSMSEGQRRTIILVGRARNDPGWAEYGSRAGRTESRTAHLCQACMPVVSDVPSIARTMDATLLSQTPMEEPETREDSGEFYPSVGLRAVVLAHSPVSEQQLHSDDALPPYGNVLVRRNAYARPAGLESHWNLANAEADYRARLNGTCCEPLASRQPRVGQCAAQIVALAGPSLSDGAAFLVPTGLGAIMGEPRTVGLGRDRKG

SEQ ID NO: 1001911 - protein, 104 aa, Homo sapiens
MWNFPGRFCFRRNRAGAGLDGFADQGGIGFHTRPRRMSRFTPRFKEKAKGPDYRESNTGALWGVKSRGLRPHENIMFRFYREGSSGQPSLWAISLGADTFPPQV

SEQ ID NO: 1001912 - protein, 301 aa, Homo sapiens
MADDAGAAGGPGGPGGPGDGEPRVASARGFRLVAIRGPEFRCRWIVGRGTEAAELAECKAEAERSAMPDHTKLCRLVKDMKIKSLEEIYLFSLPFNGISRSLTFFLVGLSQRMRFRRIMPRAEGRSRDRLSATRFQGSLFRIIGCTTKGPRWVMGVNVLHTVGGHPSSVAVQSSWASSSIRPRAHDGYWGNKIGKPQTVPCNGDRPVRHLCWYASSLSPRGTGIGLRTCVPKNAVHDGWYRVTVYTIEPGLALAPWGSFANATFDAISKTYRYLNPDLWKDDCIHQGLPIQSSLTTSLRPK

SEQ ID NO: 1001913 - protein, 172 aa, Homo sapiens
GVSADVLVLLLGGRGAADGRRHSGPRRSPSPSAPSPCRCPGGAVAMRHTRGACAVDRVGREDEDGWETRRGPQRPVSPLVEKEVGRARIQRRSLARSLRACLPGRRADGLQGQAWQERPAECLEALTGVGRGSQGVVAWAGGPGERRGEVAPRLCTLSPEDESEHREPDEEE

SEQ ID NO: 1001914 - protein, 462 aa, Homo sapiens
GKYMGDQSSSMKLMPQHHRRDATCPQQALVPLAGTRVSSLAVVFGRYKTRPDARRRCSLASVCGDVDPRGRKLPTVGYICPREERCQNRERISTDDKSPMDEGIQLDDIDRGAVTGDDRFVSQALASQPGVSSGISSTLTSDEPTLKGVLALTIQGFAWVSGAPMGRRGRNATIPRGPGSSVRQDKTIPWKKAFDGKPIPNRVPRGISRYRYTPIGVPWVTRHSPVVGILCSWRDLLRCNALAGAHCRLGGHPTVEFVVGSHGIGREEAPTATMCPARPQCGTPKRCPRYPLLFQCKLLRRWCPFLRNPNFDFMPSESSLTVRHYVRQCTPSRGVPIGKLEKAPYVSPIIVAANYPKGGWSDAPWFVDSHYWCDVCNHGTLVALTDMQELDLAFLISSYNNGLLPNPFTATLPLERYMSLSSETSIRERQRIDGYHPSISTPELGPFGTWDTYYSLFHGKQL

SEQ ID NO: 1001915 - protein, 196 aa, Homo sapiens
VSERLCSLSRFHIRICYQRRPRRSQAGPQCPAAPLPATSERRSRQAGWPSLGHPRASLFHLLLREGKMSESSSIVQSALGPPSRTRTASEKRGPGQAAQCMTSEGSPAEVVQTALRRPQGGLTKRDTQQINGCLPKTPGETAEFQEGNHRGQTRKETGRKDAKEGGHLAGVPRRDGPMMQPMAAAGPCFAQAGRVG

SEQ ID NO: 1001916 - protein, 302 aa, Homo sapiens
MYMLVHKEATIPPTLALSGHPDTETHHAPPPAPPHTPRPPPHAPPPPPHHTPHSQENDQMRTEKEYTSEERDTQKNTKTTRTTEKTERQAKEQASTAELENRVRQEKAPGSIGRSKKKSHHRRHTDQTTPQRTSMTISWKAGREKDRPQERTGATRRKKNNRRTKELEETKTNEQRTHESVPNRREKQWNKKTNKHKEATSKSRHQDTSTEHQERSETRKKMAKQKQTVTTTSNQQSHTRLRKSQAIGRHNEWDTNHKRQKREHSKSNHHALQNEQKRKDKHTQATPTQAKQEEDTRKMNAK

SEQ ID NO: 1001917 - protein, 212 aa, Homo sapiens
MAEKFLEGEVPLETFLENFSSMRMLSHLRRVRVEKLQEVVRKPRASQELAGDAPPAIQQALGAPSPAGEHALWCEEQAQPPSAMPPIPLCAYSPSPQTAVWAQLPMEPLTADPFPSSVPDLLLQRGLWAPLSPERPRLGPRGADGLPPGSTERSMSNPDGAILGTPMGWLLGQGYPFAGKAWGPPSTLVSFNKSPYPRKQEETLPNAYCLRS

SEQ ID NO: 1001918 - protein, 295 aa, Homo sapiens
AKEENFNDSWYVTNTQKTIFFTPFMVPVNFWVDIFTYNVVKSPRRASGSLTPYENRCQCLEAPSYFCAPPHEVQKAWRELRDRNRASVVGPQVSPSAKCQKAWLNLRGTRGFWAPSSIEGPNLPSEQSGTFKKAACFGGCPRGSQGSLTETGVVCGSRVFIARVRVSQGLKPKKVVSQNLRGGPMAMMCRSSGKNPVGCKQTGLPGVRLLLGVLKPKGQRAVYRPGPESRRRVRRPHEESGPRGPTPSQRNANHDSIRLQQNRGKSSGRGRPRCTSGPKGLQVTRGTTDYIQAKR

SEQ ID NO: 1001919 - protein, 401 aa, Homo sapiens
MRDNSPKRTGGETKTRGPKGTQREEPLINETPTISPHEGRVCENAPQEDKDRGKHLWTQQHGRPLLMNQNPEGRTITPEKGPPKERNFLGEKDNHRETTIGAGETKSTRIPTSGRRKSKRLQLARTPHQKDLSGKSTHIGRDTSHKTLDTNQEALHTRTAEWTTPHSRHGQTSDDNITTKRRHATQPRRPRRERTHTPAGRNNIHGKKKHNNTTDNQITATQTTKHSKNNNRKYNKHRENKTTHGETPTMKRATNTRITDNIHNGTKGRGDPTRTSHHQHKTTDTLSTKEDETTHTEDKNTPLPEENVRQTTEPITSDQKRTTQYHSRKSTQRREKTKDNQNRPHRWTTEKRPRKLTGRTSVEHKYPENTMEEEMTETKHNKRAKGPTDQYNKRAKRPEEP

SEQ ID NO: 1001920 - protein, 361 aa, Homo sapiens
VAKCPGQRECPLVHGSDAVSTTGSPLLESGHYWVTKGKVQVVIRFLTESYRLPSQDPTVRMSIPICTLNEASLMPSSTPCSGLGMSLKASSGRQQKDVQAHGTSADAHSLCGDEALTAGYGTQVPGMVAGWSVQGEPGVCRATTEPGSDCVTMGLCSHLDSTQNSNKIRQLLHNFPPDAAQQAQESPFWSGPNAVHILLTFDVNNPLHLDYVMAAANLFAKNYGLTGSQDRAAVVTFLQSVQVPRIHPQSLASRSMVLEPGAGEAPMALVMTVVSEELKGHLPGQEKSLDQNVPIDFGKGLLSRDFPMGFIRVDPAPAENLKSFWERPEQTCCAESPRMVRTQNGCSLLGCTVQGATCSPK

SEQ ID NO: 1001921 - protein, 103 aa, Homo sapiens
SERKGLRLTELEASPLPVVRLRQKRSRHHDEARVQVGSCESEKASGVPVSVSEPWSGSAKNSALSGDCRRGWCSFLPERKLDCRLASTLGTRLVVDYMARVHV

SEQ ID NO: 1001922 - protein, 323 aa, Homo sapiens
MHEPYHVRAAGLLDGQTTTGWGGSKLLVYFVHIKGGGHVYRHSVPASERRCQIANRRWGSRELALCEKPSVPERCRSSQWNAALRCVCEEPGSALRTGRIGDARMLGSGDSSRGQSRGEDLVDGRSVVEFVSQPSRGHNHLVRFRTLRRWLGGWPRWQGGGRLHIDRDSGRQWVLKSCHGRRRPRKGTLAWSRRSRRSIAVGNPSLAMNGHGERYCGEESVNGAPGSLGLEHSRNEDRIRDRQRAPRPVQKGVGECWQEPKGLGRREWEATFQFAVLSTERKESFGDGTGTRCLLRSRKRGKPTAGTSGAPRVDVLGSESTEA

SEQ ID NO: 1001923 - protein, 139 aa, Homo sapiens
ASCFVPLLARSCDPLEEKGCQVFGIFSFCALVSPHLCGFIYPWSLMMATYRWGFGVDVFFVDVDAIPFCVLVFLLTVRSLSFRSVGVCWKSTPDPQTGISWCCLFSPMCLNPGRGVYMLSSYLLVVCWLVFLQEKKLKK

SEQ ID NO: 1001924 - protein, 256 aa, Homo sapiens
GGGHLQRQVVHAQGYAGAWARARTRLPLANCHLIGALQLARGRSRRQQRLPASRFVGRQRLPELSIVSYSRACAFIVPDTDWSAVDIITAKMHRTRDKWLCIRDAGRHMAGVRCAGIPRSEQPTGSVLPSRQKDRLRHVERAIGIDFSWETLPPPIRVTPFPGARRGSIGEVSARNPYRGATWLSGEQEIEGSNTALDSRVSGGVGQATNLLHVRTHVPIDRWVAALGLACTEGNRKGIRHRRRMSLDPGNLPKSF

SEQ ID NO: 1001925 - protein, 239 aa, Homo sapiens
RRGAVLSGCRIAAPSTSASCCLLLLSNMCVNTPPSFCWGPHPLDTVFGGYYFVGANIVSLRNGATIRLLSGGIPLVGVFLLPTGECFWGLWRSPCALCYSLACSPLRVSGLWEMMVRVGKKWHVPREEEYERLRLILREASEKCFNAVLCMRQAVGYSGACPALSRHPSANVTSTALSPSDLPVMPYPLRKHGVPYTLVPWHLDRPWSGPRPLGRVLPQLPTCLLNMRVPVCWMSVAVS

SEQ ID NO: 1001926 - protein, 218 aa, Homo sapiens
SLLVEAHHVSLKSPPFIDKTEVVQRALIATRGRAVYDSRSLRCEDAGRTSSILAFGPQRSFSLSSHIEGDIVGPPLGAVHQGRSDSFYVQHLSCPPSSRSSCRPPVHSVGAHFLIGLTMHGDWTVLVSYELVWDPNGAVVISLFFLRSGICCKRSVIYDVLSQLWRLRSPISSRDVFLLVYVVLEEMIGLRSAPLSRHFTPALGSGGCPFLILLASDR

SEQ ID NO: 1001927 - protein, 309 aa, Homo sapiens
CLEKALWSDDQIQSLGLSSSRIPSLVSLVSALRLVPPVISSAVSPVKYDHSRDERIASTYSSLGIPAPMLSDLYESIRASIVAHESNAGVTVHALLGEYSASPALMPDITLHGTERLTPTCDLDSSGPSSSTSSPGIIPPGDQLEGHKAHTAVASTTRELLSAPLDGHMPISPQVKSGLLSYQATLKFIFPTVFFILICMPNILPVLLFTQHDTLDMRLKPLRLWRETGSEMDNLASCRVPCFLTSSLIGICKQLRVPQYHGVLADQGHLGQWAIWTKGWGVGALDGSLLAQSMNTSCASSLNYCFTRA

SEQ ID NO: 1001928 - protein, 251 aa, Homo sapiens
MRYLWIDHGVRNVHVSIQPSVVNCLKTATLVTNKTYQEHCLGQGREEYDPLRALRALPRKRLSTWAHTLRRNVCTQSLGPGSELLQGKNVLARNHIPGKESPYYPIPVHVPECAEGAPVSDTTGKGIIMLKAGGLTGYSRNFNLLGKHAVEEPPLAVGTRGVDRPLRAGQCYGPAEAPFQPTCSRLALFVRDGAPERGSFPKGCVPRLGRLGVRLLVPELPPVFSRVDRGLYCRALVVGSPRRRSVSAGSF

SEQ ID NO: 1001929 - protein, 321 aa, Homo sapiens
MPLLQERPPAYNLEAGQGDYACGPHGYGAIPAAPPRRYLSLPRHRDTHPAIAMGSTNIQQTDRHPYIHANSIVVVEMAVLSSMGWECMERLLHLSWGIFSGHSSSFPLGGIIMPVKRLEGKRRMHPICASHPYAEREHHDRNIPTTQLIYIPYCYNCSGTSKIYYDLTPFTGLDYRKSRRCVTLNGGTNGHADGESPGAAGHNAKLCHCPHQTPKSSNHTNLQITRHLTTELILATSYTFSYNGILNNHCSFNSPCNNSDTHFNTTNNNEHPHITANHTTTTTNKHTRTNFHMLRPRLHTPYTINHKHHVPKPVYHPGRLP

SEQ ID NO: 1001930 - protein, 346 aa, Homo sapiens
QASPQRALDPSPALLTAWPSSEELELGPVPSAPEERCKWFECQQTAVTPEVPAGEWAAPVAWVPPWLRTSNNRLSEEIEQEVAGAGEAAPAWRIMRWCPSLPCLKPIAAESAEWPPSDWPRGTGVRRFRLFGPSLYGCGVSKGRLLRSCTEIPRRTGHIPTVATFFTWRHVELQPLSMQMEFLCTSTGEWKELPGRATNRCREPCTPPCTCSEERDVGSLGLSAARGTRTVSLKPFAMPIDSKGPIHRNTGSDALAARLEGHSQSRRDSSSQGQGVYPVEVGSHPPGTVASHPKLTDLLVDPATLEWPHEGLEKRLRLSSGARSLVSLRHSTAAVAYGHEFSGRLL

SEQ ID NO: 1001931 - protein, 202 aa, Homo sapiens
MRCSRPSRQAAAFSDRSNDSGVRQGRPGGTGCPAAATGIYSKSPQTRGGPGPGEKTANRGQAGAPAPGRRQPTRPTRSQQAQHQAQAAQAAGKRPISVGHRWQPALAAQPGPPARQRRPVSGPGAPRRQPRGAAGTRKSSLSHLNSSGSEYGTMSMTPPCYTVGTLGEKDTRAGPRPKRSASPLHLSARKYRPPSTRCYTRL

SEQ ID NO: 1001932 - protein, 31 aa, Homo sapiens
MTRATPICVHHGRPAHTLTVAPTKRTTPRDM

SEQ ID NO: 1001933 - protein, 148 aa, Homo sapiens
MVYRAAFLANVVRIVRHPVYLQCQDGGSKASPSMLLDCLSRGTQELSTLSLGVRYAVHVALAFCLIALCIVGNAQTQMCPSRTRCPWLIHSKLRPNRKPTFSVHSVLLVSLIVSEIGTPPHLQAPQAMKRGHNANVAPAWRAQSPQLA

SEQ ID NO: 1001934 - protein, 449 aa, Homo sapiens
ERTSLKFLWYISLFFFVAPPSPPNLRAPQNCFFYKNCTKRGVFPFFQGGWTHGVLVAQTPGGPGCPLSLGQAIAFACTARGVSPPLMRTDGCPSRQGGVPYRGALSRGGLPPPHVVWRSLTPQIQRCGAPLSQISCDRYILCGECAGGILDLMCLILGVDTRGPTCGMQELPCGMIAPVLSRPRGNSLPPTGYNSRYEKKATPTEINTSNSFVRAAYLSRSSWSPPVCHNTPAAAPSTLAVSITPRSVSGCHSTPTAWWGQTAPPIRPADKTVCDQLKGANLLPRLINPQSGQTWLDAVMRVGHKEVTKRKCTVRPQHIVVFPPRQGETPIPVITAVCGTQHVGRTHTICVMAGPPRWFAVSTTPVASTAMMLYHTKHANRCATLADHNRYNVVTLNSAPQTHTRGFCAADPATTDVYSGAMMKLLLHGGPITWPHYQNCASYMHGTTT

SEQ ID NO: 1001935 - protein, 237 aa, Homo sapiens
MGKFGPLFPSLWQPQWNSLTQQATLLGRRKSPLAPFWRCIMALFYAICGPHNCAIGAVCRLGVRKLSTTCGDHCPCSIPNQAPRMCENASTPLSGLVGTCGPCVGARDISNSGNPRHRGAPELTVTGSEPSLATEHCEETPPFPNIWEAWVICQPRGALQRYARGYQPAAALGHIGGSSTFPNFITPPVGPKFNSTHRPHDFEQLRDPQIGVGFANSSGHLVSPFQVGIFNPRIQSA

SEQ ID NO: 1001936 - protein, 118 aa, Homo sapiens
AHATIIPKVFAHAPETPSTLHRMTTLFCINVLSEVFGQDITTIAHATHVFCACAGDPVANVRFNAATKSLPEDEGPSLDYSTLQSEVKPILEKLTQDQDVDLKYICPGGSDMFCLSPR

SEQ ID NO: 1001937 - protein, 126 aa, Homo sapiens
MCHRFFHISREDAMHYMSRSTVPYDTSRYNGLLACWVTSSHIANCLKCFQRLRSNPKSAKGYEPIKFRLDLAVGFSIPVSVMGINILALYSIVCDCVLRLRNVIILGETICRICMRDGEHAKDEIW

SEQ ID NO: 1001938 - protein, 229 aa, Homo sapiens
MKHKISLVPEMCAHELLPLIEAQGRVVNVSSIMSSHDALKKLADQSCYAEVPPGETITEEEPGGAHLNKVVGGYQEGAAPKGEVLAQQVSIRWLTEKFGVTEFCSRIPALGTPDFKHKDKGYRGFLPGMPSGPGGVRTDHAGPSASKKPLTQSGGENPRVYQCGLFGPQNAERVPSGAFCFDKQVYRDDGSCSRPSECRNLAPFSSVPKGVYRATNTLFADKVSFLSHT

SEQ ID NO: 1001939 - protein, 101 aa, Homo sapiens
MVAPWDLLVRYNLLGTLNMSSRMEESRSWEDPITRRYDVTIRNPIDADCIQSNKRHQEYGMRRTTLNWYRTEWRIYKRICPGEGMLLIRNFGMFGDPVDYG

SEQ ID NO: 1001940 - protein, 227 aa, Homo sapiens
SCWRGIEARLRGTFGSGRWLCSAGEGAGPAAVALSPSCDCPARLLVTAALCETPSVLALEGSAVACGPAGPGLPIAGHRLRCLVGALRTAWALCALCGSRPRVGLSARMRLLRQDRFNLGGWKGSPCPCAHGPQGPKSLVGTLEALPGHAAGPTPGTQPVPERPLYTPTVFERLTEAPCEWLGEFSLNESAPLWWAPAGGKQRQPLCAGMDHLRRNVLSETSTSWDQ

SEQ ID NO: 1001941 - protein, 228 aa, Homo sapiens
MSLCYSCPRPPVCRTVLECPSCSTPQCAADSQEALLVDPWPDSSRDSPYTKRSTTDQVRARVIEVVTPRWFGLARKSEQRVLMHNNRPLTRKVGTSTRQGSTMSSLRVPPDLAWTERCRPGSRVPLLLLRGAPVASHPLAFHLAHIAPLTACLGSMANSFMALGPQAFLAPMRVLALAPRPFLSLFMDSQPWSCSAPISLEDMVVPTDVAIAFVKPCAIWGIIGAPVS

SEQ ID NO: 1001942 - protein, 109 aa, Homo sapiens
MSPLSEYNEQGGTYSYRRTANETRWEYPVNSETGHGSRRSYRIPTFSIGNAFSERNTASYSGSVVQHNMVQHTTPVFPVNSFIAQQITQNYDPTSYGMTYFPVSPTFSL

SEQ ID NO: 1001943 - protein, 119 aa, Homo sapiens
SKIPILDSRECGPYAMSGHGCPVCDLTESTCAAKVIGVVPAERQRREKVICEHQVTCLQRSVRSHTLGLNLDGLMEQDILPKVQLKSIPKRNGPDSYVVYESHQGRNHCCRQPGAWTHV

SEQ ID NO: 1001944 - protein, 200 aa, Homo sapiens
ELQVTWTLQSAVSLPRDDQLKVIECNVRVSRSFPFVSKTLGVDLVALGTRDHHGGRSGTCGGLSDVGSGVCGSNRCLMFSFSRLGVVHDVVLGVVNDQYWESVGRLWGDALGGISPKGMSKSVAKDPQGRNNPVVTIESFYNFKRVVPMDVLAIVEEAWDYMTLVPGLEYKSDFYTETWLSKVTKLWTDTLEEAVDGEMT

SEQ ID NO: 1001945 - protein, 243 aa, Homo sapiens
EAFAKVICNSFTICNAEMMRSGCEGYIPDISLLNARVCDPKCSMVVQLGAKLVTAEARSREHQQVVVEELTDLRLRWVSLRDEPSAGSAVRASLQGPDTALWNVHWLSVRLQSEDKVCVDHAYNVCSIEGEKVMVEQGKSLPDEYFPRVDHTYGWNKKSIVEGATNIAKKSREGHGSPWPIVGTRRQKSITRYDKVSGNWTVPPSDSTNLFMAERRCVQSRRPCGVDCNLQLQGLVGSERLWF

SEQ ID NO: 1001946 - protein, 252 aa, Homo sapiens
EIEVEIIPVDTIETTVVGEEEEEDDDDEDVRAVAYTRVWSVGVPSGTPARPNTTSIITSSYPPMIVLAARLSLTDGSLTPRVHAPASEDDPGCSTREEVGAAGVPTLWTGLSRLMRTVLLRHLDSFLPVASRLARLADSSEHTTLNEGLLGQPWLAVPAIDAGSAGWTSSLFCATCRTAVKERGRGAHQESARTSYLSRPWAVLRRERSCRRRPAAHKRGGIENAGCSIKTPGGLNVLASCSVGPQHDPGCC

SEQ ID NO: 1001947 - protein, 179 aa, Homo sapiens
MKSEFDESWKESTLQPLSKKAYYACGNSADALSSSAKDRAVRASSALVRHLQNSVITSLDHAYNTEPCDCSLVTMSLWSCTSSWNCDSHVLGSRGDKLGSPMRSTTYKSTYNHGIFSQSDRLEIYDRRVVTRGITDEIARPLTSKLRHGHRERSLYLAFFVKQLRLDIDTSAFLGKRRR

SEQ ID NO: 1001948 - protein, 177 aa, Homo sapiens
AVSRVHQPDEQRWRSGAMVKMAAVAVTTAAAVRAAGPPNACSTTDYAGEQHGGGGWWRCEEPWSEGGGERLGRTTMTRTKSLSSPVVHIQELIDGVVEADLDGGLAGVWNLISYVVVMPNEETSTGGVCRCVGGLHLMDVGRRGPDIRLVDRAQRAVQNSSRQSEKDRPSDRGVPRE

SEQ ID NO: 1001949 - protein, 93 aa, Homo sapiens
MARHFPGRATYCGISAYAGVRATVFAHSCSKFRILDLYCACRFHQCVQSISYCHEAKYFSSVCHPRSTFVPLPQIFFPNPSWLDFAGSHGSRS

SEQ ID NO: 1001950 - protein, 78 aa, Homo sapiens
MYWTKTFRALYGLSKNPRGKRKSSGRNEEGFKAEFVKSPSYKATEVEGLFEERRKLASVEDGTKRLCERLVRTILVVR

SEQ ID NO: 1001951 - protein, 258 aa, Homo sapiens
MGESRKVKLKKVQDQYAQVLMSPNARREQVVSAGLTRRHHIVLGPEGDLIEVQRRSRGASRGRRGQTAESTLAPRRRNSPYWNKVRSHGHRCRRFESQVTENEEFSTCPPPSGGRLEAVKVGESSLWDTAGTRLGRAHDGRRLRVTGPLGVAWARSNQPQVDNRDSRLGEQQCMQHCAKGPWGAMGGYRLGPTRNDNGTHESRTRITVLLSEPKSMDGGGHSVPRVVNDIAPRHVASQEVRNGMDARTGPKQKRENEE

SEQ ID NO: 1001952 - protein, 265 aa, Homo sapiens
MHSFTHCTRPCLRPYRHWLCRNYAQSFTQSAGTRSSGRARVWRCWQTVLMLADPSGPCKPCTGRTYFTGRHGHTVRSCKTSSQLMETDNAAAMSLLTTVTGHTEVASHGVKMPGAVPGHSGARDKLRTRRTLEYGQEPVQSTPRGIQWAIRSQVRPFRQCVTSTVLDPEKVTEHTGQAAGHPGISELTLGYLKSKGEVDDETLFQGHKGRTMRIRCPTAGYLDDPWRTKPFKQVANVPYSPGSLGTDNPSQPRWRAGIPSNAESE

SEQ ID NO: 1001953 - protein, 182 aa, Homo sapiens
MPPCGGIGHWPLWEHLGGWGHVTPRTHGPRRRDIFTAFVSAGLETARHNGNSSSLAYKINFGPPYVGAIQRKTFGTPRAGTISLPTEAITKAVPRYRSPRSSWQFSNTSSGGVYSARSNSANLGARDYVTQRERVAFDTLKGTVGAAPRTLESRHFCGHGFGVESCPHDRGALYKRRCDSPQ

SEQ ID NO: 1001954 - protein, 211 aa, Homo sapiens
MAAVKASTSEELPGLLGILIRYMQDSGNMIIRAIGLDARANHDAYRQGRGIHGVNLPWYLPSALIPQSSYDNEAAYPQCFYDHHVAVAGRTPCEDRVTFQKIWADIHVRAVGVQACMKEDRAWSKEEEMETERDAEVECDLSDVEISEELRQYFAETERHRRRTTAGSEQLDAELLDSYVNADDELYVTDRRSVEAQTERLVSGARRDERW

SEQ ID NO: 1001955 - protein, 66 aa, Homo sapiens
GEATAAVESAGVGEEEEEEDGGGDGPGEGEMLRLAQTPRRLTSPFRVTYRLWGHLIEFRRRRLIKA

SEQ ID NO: 1001956 - protein, 94 aa, Homo sapiens
MAKFPTSPRTRKRCNQPTNGERGWMAKEIKTGDRTTMGRRKVIGEWTDIGGKTGGRKSCEKLLGEQRGLVNEGNTLGGRSGGFRGNVFYRPGAC

SEQ ID NO: 1001957 - protein, 229 aa, Homo sapiens
GELVAGPPATSDVAMLYFSWWWAARPSAEMWAAWIRMAIAGSCTDETQPETQTGEANRGWTGQESLSDSDPEMWEWLQREKEQAVSLAVEASLPSENCLAAERARGRPVGSCLNNKYSEGDPGKRYYGGAEVVDEIELLCQRRALEAFDLDPCTVGSQCPSLIRVPSQAGRLHSTFCNLTNGSWRLDLADGGQSQTKATCLNVERISARPSIYESMPYKLNPKNWAHWS

SEQ ID NO: 1001958 - protein, 375 aa, Homo sapiens
GPGCFGVCRRHRCLFPDCDSIDRQPLQLLSFRTPLRLPETMCIPAPVAAAPAHPLAAPMGIQQSAGRPYGGKRSQMTPWQSFTTPTIPDLFQQFHYGGNPIPLAWKPAPLAPLYPKFVDIHPNFQRSHSIESYVPERRNNPLREAPIFPAQEYKARQKATTMASIQRCATKFFHPKSGEGVTSMRTPEKTDFPKRGQPFMRASQKQMGFSLAHAGPPSIPKLCGNQYDSLQFPYGIRHNIRYLIYDHHPEIYEDDHIFERPKNFTMSGNSPPHIGTTRPRQLLRTPLSFPENGASTTNLERPTTTNDRCSESPEPHPTQEERETNPHGKVAPPPTTEPGAHKAPHPHKDTKPGAATNKTTVAAPPKSEAHAQIYP

SEQ ID NO: 1001959 - protein, 205 aa, Homo sapiens
MVVTGVSQCALAHLMKPRCQNDDDATVDIAGGISALNHALDLGLGLLAQFVDPLSVPTLRHYAFPIARLLREIRLSKADLRPIRGLCEEFTSVPRADSYRGGDARRELTPFPKNIFPRLGFGLFCPGSCWPSMVGLGPVSWGGYTPGVFLPGGVALRTLCSQRGALYGRWQRVSPLWRGFSWACAPFVVTSPPVVGRYWSRGGLW

SEQ ID NO: 1001960 - protein, 68 aa, Homo sapiens
SPSGESDLSGCVVVVSESGSALSSMCLSQLTVRAGLRWNFKGELLSHYSDKDGDGTSHESYIMEVGNV

SEQ ID NO: 1001961 - protein, 74 aa, Homo sapiens
MREQDQAVHLWRYERRLSEPSQKVTDLELRDKYTEIFGHSVRHEVYMLLSRKNRLPVGASVLDWACAQIRTVVS

SEQ ID NO: 1001962 - protein, 53 aa, Homo sapiens
MGAPQRAVGLSPHLREFRTRPPKGEAQHSVEFRHGRMSDRTRSGHTRFPLVER

SEQ ID NO: 1001963 - protein, 206 aa, Homo sapiens
MYTAIPQSGSPFPGSVQDPGLHVWRVEKLKPVPVAQENQAVFFSGDSYLVLHNGPEEVSHLHLWIGQQSSRDEQGGWLRVAWVGAPENSRRVVEERRLCAAPRGAGANESDLFMSYFPRGLKYQEGGVESAFHKTSTGAPAAIKKLYPGGKGKKEHPCHRAGTLNLRQFQQLGTASFWELVGQNIFAWCGGKSNILERNKARDLAL

SEQ ID NO: 1001964 - protein, 335 aa, Homo sapiens
ASSGYPALRRGPSDVGHSSRCSCSARTQSVNPEEKYTSGNQSSAVKTIADIIRTCLWTLESSDEDDFVDANGIALCVMQLMAMPVLRELQVQASSWSNVHDLTLAWTQDERGWTTGTSIRNYSCEGKCCLELSSFLEQRDAPNSGDHVLSREGMDDYDQHPKENKYPSLTSVTVIWLLNIIKQLYYYQSHQSVVIFALCNIALDAVKHGYSLEENGRAQQIDIGPLVRKKLGTVTYTDESTHMKDLSELTSVQVCDLTGIVISIHSYPGANNQEALRTFEACVDSILLELTVKRRKAGWPLQHYTDDEGSTPEIPQLGDEVIQPYAARNNPTEPV

SEQ ID NO: 1001965 - protein, 274 aa, Homo sapiens
MTSSPVSRVVYNGKRTSSPRSPPSSSEIFTPGHEENVRFIYEAWQGVERDCEAGAGWRAGLAGWSMWMKVPGPEPETTFKPIDLSELKRRKPRQDAKEVLERTRAPSHGTPEDKGSRGENEGASELTSRAAGTGLDMGSLKWSGLQDNGQRQHLSSTWQLHTRAGTTFAWHRRWALGTNSLEEHHVKEQYRLTRTQAPGPSIRTREIKALRELDTITVIVGARGRIHGREGPTPTWGYTKGSPKAIGHPMGWYTGGLRTVDHIVHEQPHKGIDE

SEQ ID NO: 1001966 - protein, 105 aa, Homo sapiens
MWKDSVHVASGLQWSQRPYALTASGNARFSHLNSRNGNALGEHVTNDALCEDSLWRKFCIIRHITVVIQGLKQGEHIDQSKVKLGTWMRYYAGLCALEMDASEWA

SEQ ID NO: 1001967 - protein, 160 aa, Homo sapiens
MRTKLGGAGTREQRELMDTRTLQRRVMTTQYIISVPSKSNKKLCAGPTVPTLGGLVFLVEHVESLRGDPYSYPIHSVERYLGQKQRKSSGIPDQNRVVMHLFDRRTLAISQSHLKARNVRGSIRYDAMRRRPHRTYGKIPICWSSTWSRTQTRSFEIHSR

SEQ ID NO: 1001968 - protein, 107 aa, Homo sapiens
MRDSDYLQLIARRTRGKLRPLGQDQAFIEAAYGPTQALTPQELPGPPFRGWEPFSPSEGPQTVGTSKELLVDRLASMVWNNLRGTEEARFGANHEPPSYTYKGKAVG

SEQ ID NO: 1001969 - protein, 236 aa, Homo sapiens
MAWTHVAPNICRTPRVEPSPKQSGGVLPYPVGGQRVPPAKRGSLTISVGTTKVPLGNLQRPLAQTRNSLTRKKEDPNNGTREVTQANNPLKRSDTWDTELFLRRHQVLVLGAHTGKGPLGPMAQRPGGTFPRGAPEGGRQQRLSKVPRRIPPKGPNNRKAQGPFMETNKAFRAQRRHTANGVAQAITGKHEKGERLSTGTEGNPLCGTGLFRVDPRPIGKVAAPFYVGAAHTIGRE

SEQ ID NO: 1001970 - protein, 282 aa, Homo sapiens
MREGIVGGEANVTNFLEPQRVLSSSLTVPSAAEVTELHPVWLEAVVPAMTFARNSPGGPTRYLSVAPFCQTTIDQSSTSSRFLQCECGLERQLSDQYTPSGNTESWRKRWLRGGVRPAQVRATWYRLYCLQKKAYDDKQRIKKRTRGGHGAETRSTILDEPRDTMPGVYVSYGPYTRLVSTQWEQAAAWVVCSTVLNRGRTVNVVPRSTHMAPNADFPPESLRAPGLLGPSGRILLVSRGREPSYTGIAPSMYRGSYEGTDRHSCLAIEPTGSEFRISDLGT

SEQ ID NO: 1001971 - protein, 250 aa, Homo sapiens
FKMKRTSLCCPGWIAWCNLSSLKPLATRGSKRFSWPQFLEYAGDYRAPATGARANFGILSGKIGFTILPRLGLEPLDLVIQPALRPSQKGAWGIHERYEPTTTARFCFVVFLNNKREMCQEAGQGRQASCEPIKSGDFWKFFFSFYFSGEKGSSWPLVFQRGWECRKVGYGSVKAQLAEPYGIPPVGFQEFEFVLPVPLGARVVDSIRYREIYNVGDTPGPTERGPTRYKSFGENSPQHGLNTPGRVLEN

SEQ ID NO: 1001972 - protein, 58 aa, Homo sapiens
MGDDETDSDVQACALGATGDLTHQSGVKRQSSPEKPAETGALCNEVQLTPYFAKVSGD

SEQ ID NO: 1001973 - protein, 192 aa, Homo sapiens
KDYNMNGQRVDEKYRAEHVLLTCSSEEIVCMIMRSSTLKLALEVCKQSVENVVTDVSIRGSLARRFHSRRGLGSMEEFRDKHRLRMRKRQSLIMDAIHNTKESYNSRITMDAKKNYEQKCRDKDERRRRPSVRSAKLVNPKATRKASQVKVGTSKTAVDGRQTEAYMVQDSGAWYKVREEWQSEHDQGLRGI

SEQ ID NO: 1001974 - protein, 209 aa, Homo sapiens
MTSQRRRPQQVQSRAATQLSSWVSGGKRAEEGHVPSAWGRGPVMLHVAFSQQGATREGLVRENNGRGDLLKENREERERFESALHSHGGSVLSYLASALKGQILSAVLTFGKRPLSQCHLSVSSSSVLKAVDIQWLRIPSPLVLRIPGSSETGQEQGWWGQWLCESREGHVLLDYVVIAPYNRFSRRFSEEEMLLVRDEAAAGAPWELC

SEQ ID NO: 1001975 - protein, 248 aa, Homo sapiens
MPGCVTVNTDVDTTAVHASVKSLLLTSTFPSSNVREKLEEVPSELGSDTRTNRMDQSTYKKFASTMTEEDLSSYELRILASRQDCEYAVTILWVGCFGVFRTFSIEAIGSLVECEYRYQERKQVVSNDSRRVTVSMSRRSHPQKEVVEVHVASGVPVPKAPHAVWGGIANRFGFGKYTVRKGNCASGRSAKPLDRHSPSGDTKNGGISLGNEGKSSRVYQWVVAMCVRHKKRYGKGAIFSRNRNSYWC

SEQ ID NO: 1001976 - protein, 98 aa, Homo sapiens
TEVSDEWGCEKLQESRNVLLVNRMLMKRQNVEIPGYPMIGWPKSMWLNDWRICDSFENSKTSSSMRQILNSCRITTGLLDQKSVSDDPNQLVNPNKTI

SEQ ID NO: 1001977 - protein, 93 aa, Homo sapiens
AARISHGGHEFVAAGFGNCGGNSVWPVPLRHSPRIPRGLYLRAQVGCIQTGLAASLVYRTQVDDAMEKRRRMSVQYMTVSRILSTRRSWWISY

SEQ ID NO: 1001978 - protein, 157 aa, Homo sapiens
MAPRARGAPSWAPREWPTESAGDTTARGHEETKKTREERDNSMKRKKQERRNEKEQEETHKKHRRDEENNDEKRRGKKGRTQRKKERKRKKEQTQRTEKEQDKRNGRKKRQQKERKKEKTRANKKETKETEQKKNKTERETRRSDSAKTRKEGDKEE

SEQ ID NO: 1001979 - protein, 421 aa, Homo sapiens
MSFTKRFLPGIDERREDSSFERYGNQVGFGLASSGAHRMAHDMWTMDDVDRRMTSEFGSDINLCAELPRQHTLNGSIADDQSQRRLASATRYQYGEREGRKTNKGLSAGYRVYDCGCLVRLDMNGYAGQGRSARTTVALCSPAKTLAMYTYVSRGLVNVYSSDEGNSAMAEVHSFGNQWTPNEVQARKPENVTYQLDRNARGKHMVCRGNFWDLFLGLGVQRKPWWAFGHTVALTRVGHAVGSAIDEPTAVSHSVGEKCSPIKGTTTWSFEDVEEHEETRQTVEKLCHVGVVQTQMGWWGCPQRGQPRLSSPRWLGSVAEVCPFLPLIRCWPQCGACARRSVQSRMGPHQGALGRKRMGPGKGTTNGTDTQEGKGERERTGGQEHLRGRNTTWGAAIAPKEMWPVAKDIAAKRVPKSGDNG

SEQ ID NO: 1001980 - protein, 409 aa, Homo sapiens
ATADERRCGSRRVRADQGTMTSERLWTASSIQKASSRRGDDPRVDRSASSCVTTTFMSHSLLMEASVLEVAESSCSRGRSVLWTFYPRESVEIRAASKHTCRDTDKEQEMSSRDGTGPVLGVVDCAETGVPWSGAMDVTLTAKGPVGRADEPKGLHMAGGRLRLERARYPWHGGLSALSEGAQVDQLKAYDLLKGAICPTIFPAYVCQVSHNRTSITGFRVDPFLRRHELGVFNFVVVEETTALADFLGTIAELKLTYADRALRGSYWCDRQRGKVAFGSARVARQRGIGLGRLSPGLGGNMERTGGPFDRHTGGATFPGRGVGIGGTHPSLGKGRRLVPIPLGILPLFNRQQWQRFTFGSTFVAQNPEYPMACHFGTQNVKGMSFILWVTTPTSPWDIHTCIGFIDHG

SEQ ID NO: 1001981 - protein, 274 aa, Homo sapiens
GQFSHSGSSADPPSCYSAGRKWTEEIAALVIENGSGMCISWLAGDDALRIVLSFHRQGAPYTQGDQWWCMEPRNGRTYSGRQRPHDANAVVNPGACKYPRLEHWHRAANCGTTMVRKILAEHSTVSINGACVVGLREDATQCVLTEDPAVENPEGPDRGDDDLRLCLRPSITRFMYVAIQAVAVRLYAILWLQPLVIVMDSAETWVSHIGAHLARCYAHRPYVRDPCVWDPGLARDLTRGTSMNDPQLSEGYELHRPTAEREIVREDQGEACCY

SEQ ID NO: 1001982 - protein, 272 aa, Homo sapiens
KRKSAEKDRLMVSTKENECSVFQLVESSKQSMTEKEKRKLLNKLTKSTDESWKQDEMNKSLPKRAWLVLILPRLHIGNNTREAATESIVELGEGQEFNFNVNKLNQYSQHISLFGQTLTGMPHARFTGAISEDVTLTQDIQAGNGRNGNDIYGKTELEFRVNGITSKKILKSAVDKERRKSLVKPELWRLAVEELGESLKKTRKAWNELLKTYSSDLLLCSDAKSQKETAALMDDEQFETMTFGKQNSYKTVINVSRNLSKDLNPAILGSKF

SEQ ID NO: 1001983 - protein, 190 aa, Homo sapiens
RTSLEFYYVYWRPQVIEMGHFIEAPGPRGPGQDGCPSRKRTTLLDLLLGTQVVGVTTLLLAAVDSTEGEKASIALAGDHLVAVVFLEQRWLEKEGLRLMPPRRRKTMVQGETLPGCGSRDKKMCGILQLLAGKYQTLLVRWDTLLYLEIWAYDILNGVTGLDLKGEWFCQGGIYTKDRAMLAVRRDLSPN

SEQ ID NO: 1001984 - protein, 295 aa, Homo sapiens
GHRRSAKSESCAFSLPEYSMSFTYSSPPSPSSTGPWALSRRPRYCRPERVPAAAGPAVYAKALGCSWFPDSPCPAPAWLQWVGMGSGGLGRAGKRGGLGGIGMRPSNDDRRACRALVERLALFHSRTGVDRSLADRESDWLGEQTDSPGALLEKGQGPTGSTRLGDHELLRCYAEWTLDGLRIYLPRVTVGQIVLGISTLEHCSGALSCMLDEIPWSPVMRHELADAARSVDELTSMVVRHRIVDDAKCHRVKLEDRRIAALKEELLFIEEEPEEDVKRGKRPKWQVWVDRKEDG

SEQ ID NO: 1001985 - protein, 548 aa, Homo sapiens
DPILNSKDTRGRIHKSLRSWTAIRCRWDEGHEKTRVGSNYSGWSPWKAWQAQLRSRDSRRRLQLRTRTSRHYAEHTPHRVTLKSHVSFRLLARGKPCVRRAFTGGRRNDRREVHVTPRFHASRHVLPPRTVKPLHVRRHRILHRIIHRIRGDKGRALTNMVPRVLAWRKTWGGRTPVARSSKGSTLVPVPQAEGSRCSESTPKAVDGGGKERNTGSTEGPGRPSGKDLCGGGVTLFAWPGEADSVGNCANWGSRAFVRKGRMGIEAGVKGNRCTLRNEHQPKEKVLDGRKGRLFRAFLRPKKVGASEFLVVRYTRSGPPGPRKGIRLPVCKQPISLARGVFLSALDWLETIRGPGGRGAEQGMGVRALWRKAVAALTRRKPAIFPRKGERTDTYGSRWPTRIVHGVTTTVCGTRLYVRPAWTTRHTNNGKPDNCQLTRERARAPEVIRKRCNTCLEQPRGVSTRSRLMGVRPQLPSVLRATLTAPRDWKEVGTKVSRRGIVNPAERPKQDQNCTWATEGIPQGGRDKRENHAGERERANGELREGGDH

SEQ ID NO: 1001986 - protein, 420 aa, Homo sapiens
DAHTSIIVDRAALRLRMMEQLKLSYRMQLDLDYIQGHVWALWCNTCSSIARVQHREAYALALGPVVCSRLACAPVGLQSTLVRLGLCLAEGGDVDYDTRVDGLTCSYYQGVQPAHWEQPQSKDLSGYLHNYGRSIVPFLRPLPNVFIGPRFLNVRKKSTRTEGSGTSIGHTEIDCWRPVHIGGERVEAIKVTRKARPCVLRNSCLKGARIDSISLDIGHGIDIGLLHNGVPTIVSTALVRRQLEIELQGKDFGQGVSISPRSGALMDHQGPEIGNKFLTERHNLGEFRSNLGVDPTKDPLTLDGGPFEYLTPGGKNDRTSEDGFGHMTWLIFPPAIWKTFLKVAFRVVWRPQKLVPQEFEPEWNGPFNKFLFLFAGGQQNTKGNAPVRRGERGRCVKPHGPRNSVVTGRKPCSPLWFLAD

SEQ ID NO: 1001987 - protein, 112 aa, Homo sapiens
DSALLLSRRCWLLSLDPYHWRRPSQDPPHSQLVLLGSLVIFSQHLLTVGESSYIPLARGTSTIVHFIHPFPRPSRFLQFPLQIRKQEIWGSWAILYQKGGGVGQEETPVAVI

SEQ ID NO: 1001988 - protein, 32 aa, Homo sapiens
MKPPGHKPNTKRPLFVVIRRNHSSGIRSPYVS

SEQ ID NO: 1001989 - protein, 283 aa, Homo sapiens
MPKGRDMERRWSDMLSAGGPDRMLFKFLGERLPSSEHRYGSQNNAWATQRTALSSLLIQRAGPYEGHYAKMRLLKGSGYIENYREEYASGVRRVYERYNVDWSMGNSHAKASCKVPQNGSRMGLVIPWKFKKTRNGPRENEREGLDSLGSTWVAKVGYGRESRVDKVTQMSTTTVSIRARQPCRPPSWLYRNNWIGPWSPYAWGESNQGLGTTKKGKARTLDNRKRKAIHKDLGVLHQERQTFLKHPSWRKANTKEFPKKLPHFKGQKKPGRRGSRDIPILGL

SEQ ID NO: 1001990 - protein, 105 aa, Homo sapiens
MRAFPMNWKHFGRQGRFSRKAQGHSNTVQDLSRLKGNQFVDNVEEELPFTRNKLTVNCRLLMIPTAVCVGARIGLEIGFQYLAHWRPVLLAVPPCYAGGTVRERR

SEQ ID NO: 1001991 - protein, 368 aa, Homo sapiens
GSAAPTPDQDQIPEVLTAPGQIPTPARSNAESHAGLATPDSEQSLSFDPEPLLPFPGTPAPCGQLLVNQCLAMADPCPSCAAAYPACCGPHGLAPLQHVAHRASPVHAVTKVTDHAGASNDPLARVYRSDTCCSYAWTNLDELHVALRPFSINPSLDRAWSSLRRVSRTSKARTNEARRSRDACKNRFELRYDQRKQQPRPCKAARLSQKRCGCTEFQGTLRNAAANNQKAQDGVRPCIETDSNGLRAWHRDPLSRDYCIDTFAQGRSRQREDNCLIKMHNDDTPCESACVQSNSLNRGDTSDGNTKPYGTSQHTLEREMANSKAKLFHGDSENGLDGQRFAEMHGQTSDVTSNTIHERVDTLDTLSA

SEQ ID NO: 1001992 - protein, 257 aa, Homo sapiens
MTTIGYTDRTYEQIGQDNTQAHKHGHSREESEQKEAQKKYIRKDKRGEKQDETTEYNHDQRQRAPATRTTTYVKKQGKRNIKNRSRNDGTDKQIEELREEDEAKSTHDASHTQTADREKTKQDEPRKDTNANMKTKNTRTNAETTTSIKTHNETKQKKPTSQNPEGGHNEETDTQQNDTPTAPHPTQNHRPNKTMNKTTEHMTKRRTHPAQRTSAKQRTTNMRRVNQPEQKEERPRHTDHSTRQTRNTKARKTQRNE

SEQ ID NO: 1001993 - protein, 359 aa, Homo sapiens
CGKWAAEPVSLEWLETLSGLGDSGAAGAVALSVRLRSRLPCDGGSLSDLRDASTLQGGTLDGTRNVDSERQTKRRNEDGQPADRKANLTAVHSVGQSMHEHICRINTSRRADKPRQHQCRQEEIQRTQRATATAPRSAHEASWLRKRYTGADGTGKQTFHGRHIGHQRAAPHIGKEPQNLGREKTWTQRTELRHQITRGAVDQRKGCQRARDKRPKETGRGESKMRENTTRPKQKTIKGRLRQQTKTEKRSTYPKKYRATSPDRGMERITDRVVYEELQVKKKREEKTGTYACSHRPRRREKPHIRAEEARRISLEVAGQDEATQRERHDRAERHTESKRARHSSIQTEALSRTSKHTG

SEQ ID NO: 1001994 - protein, 139 aa, Homo sapiens
RRNMAAPMTGPQKKKSVLWSSTLMRCSLYRSCMGSHMRSSSGPQSSECGSAELKRPEFHAAHQDAELCRLKVLPGYSTGSRRAYKRCMPMLREYSLVVAEPLKLSAQLHILDFYAKYKHNFHFHVALGHIMSNNLQRIP

SEQ ID NO: 1001995 - protein, 158 aa, Homo sapiens
KSQANNYPVHKVTVTKQPARAWSGNPGGQFFIHGSCGGDVCNTEQLGVTLQSQGPQGWGMDKALDAGPLQKGVLPPSGKGACQSVQPCGGSAQVRGLLRDRASVPQEPLREGWFLVRRNPEGPRSFSKSVFERGSPFLPWPHSEAPGGSRGGPSSRAP

SEQ ID NO: 1001996 - protein, 163 aa, Homo sapiens
MPLELSLSGLELFDPSELLEQAVSGLWLSGQEPSGLEPFYSGGDLFCWNFSSSSSSSSFFTLSTRCFFGRSFHESCLLKLLNFILDYSVFLCLHNFKTIKRHLGFFSGFNLLGPSWGPFIDVCLLPGLEDIGPGRKLEDEISELHALGKDMAWSPHLSARSID

SEQ ID NO: 1001997 - protein, 111 aa, Homo sapiens
MWERTRTCGMCFGGNGRPICVEEKPGPRGPSPKGAPHYRRNSYSTGRFLGKLGFTQEARSFPWDFFWADFPSHIGRSLLNLREHSESNSYITGVGNHPMDLKFPIGWGLGS

SEQ ID NO: 1001998 - protein, 118 aa, Homo sapiens
MRTAMPGLGRTVASGPEADWLLHISRTLGFAHRIMVLSVIDRQKVTYKRMWPETGLEDAEYGSDVKKQIATLVVRVGKQSRGYQGTGKVNGGRSRSSCAVETDRSLARTTRRYRAEET

SEQ ID NO: 1001999 - protein, 94 aa, Homo sapiens
DNILSDSVTRICRHWALYSLWTSAADIELCVHALWRHFTRCTGGLNAHTGQRHLDKPPDLNLPYARGVRVHSIEPSCARIVHGTGSPCMTVEPI

SEQ ID NO: 1002000 - protein, 260 aa, Homo sapiens
MKIKFGKGQSSTGASGQEAKHADLHLCTLFLSHDGERGLWGKSPVLQSGKANVGGFSVSTGKVYPFSFPCYTGGKKPLRVPAKQGGGPPKSGSAPGRCPDWATRRLSHHSVAARLYRAQNSGPFGRFHRKGTQQPTGSNLVGAPKAPLCHLPFGLSKAFEPEDKNAARGTKRGLNEPGVLRPGNTGSIAWKCDLVGQVSRNSSLGVPSRAKIASDPSGERCKAREFPRHWARIWGALVPRACFTLWSSGLSLPSMDPFIA

SEQ ID NO: 1002001 - protein, 190 aa, Homo sapiens
MRIEGVLFLFGGPSILDTAMMFVRNLIATVVCKILCITQNVIHKSLKKKRNPRKVRWTIAFPESMLDDRSVTIAHNLQYLEFDRNVEDEPNQSTSESYGLKLLMRRSSSRTKFKHEAPSLTFTKVTQDFERKPHTELPDKFTDYLQKSTANTVHLIRAPLAGNTGNSWKMNMVQQLRRGCGHGRCSLNNL

SEQ ID NO: 1002002 - protein, 184 aa, Homo sapiens
LFRPSLSSLQWEQLLLCHSSFTPCENCSPCFQVWSSTSLPCGSRKHLQQLAVSRFRFCSVVAETDREDYLTGLEEPSGSLWQALHVVPLIPYTCVFLGRQAFHKPGRHFSRGTFGTTSKPKCSIGDVWGLANKLAGALGISWGAWEICENLGVSRRERLSFHLRVYLPKEKPPFSSVKRQNKLL

SEQ ID NO: 1002003 - protein, 360 aa, Homo sapiens
MEGSLYYTTIPELFPKMFGRRRGKTQAEAHKIMRLKVALGGTHCPLGSILELSWMPLAVDGSTLGPRECPFPFGAVVRPLAWVFGPAIFPGPLEAKPLFNLVALVGTHGKRRRLTGEWKPIPSVLIPQVPVWPTLAYRTGLGEPFAFLGGEREPQRFTAPKGVLQEPANGNLRGGFQFQRKGWYLVPSPLFPKTPTPKIFKWQGKTPQRIMGYVSPFPARFFSPKRVCKPPAYDHIGMPIILGGNNFVCGPNAEKYRGGVATRDNPCGLSYFGPFGGATRLGGSDWRRKTHRAGDSVSISLNVGNTPVDNNGPQTRTTRDSFRSLGLGNTFPNINFTNWGAQNTFGAPQEKIPLWLLPFW

SEQ ID NO: 1002004 - protein, 85 aa, Homo sapiens
MRRGAPFITQPTKTNGGRKQKLLLPGGPEGFPRDEKYSHQSSPHSVIVDKHHGPPQDIHKGAPRVSACVDHSSIDNHSPSPPLFK

SEQ ID NO: 1002005 - protein, 151 aa, Homo sapiens
EKILLDAQHESGRSSSKSSHCDSPPRSQTPQDTNRASETDTHSIGEKNSSQSEEDDIERRKEVESILKKNSDWIWDWSSRPENIPPKEFLFKHPKRTATLSMRNTSVMKKGGIFSAEFLKVFLPSLLLSHLLAIGLGIYIGRRLTTSTSTF

SEQ ID NO: 1002006 - protein, 360 aa, Homo sapiens
ERSVIMRESALEPVACALRRRRGVPVHACDGGRPCQEKLASMLGDSAVGAVQWRPGSKCREAWQWSVRPHPELACGCSESQHTITTMQHLEQQNAGQWPERVSSARQTAAQERAVRLGSPGAAGLRVPNALELAWIGRAGNASSGICVFKRRSGCKSQSMRFYREQGQPRSAVWGPGSGTKIAEPWGPEKASALGGPDYRYGNDSSIVDAQGRPEGGTVHVEPKYVYIALGRQRGNWPGTVGTSDAHSRNAVPRITATPRENRVRRCQGGHQRCHTNAPVGHKCPVVSIRATLVGRPGLGPVGTCRPWHKATKDPGEKATQCHDGRAIEAGHQSAALWKRRRKEGPYAAQGENNAAERGK

SEQ ID NO: 1002007 - protein, 110 aa, Homo sapiens
MLFRSHCAIQNPNECQPSSFRSVDDVVVLGMNLSKFNKLTQFFICVAGVFVFYLTLWVFTGIDIFSGGFQVLWLDLTLVQFAFYSIFGLIELQLIQDEPEENTRKNLHDK

SEQ ID NO: 1002008 - protein, 126 aa, Homo sapiens
LPYLYTVLITDQPLLVKSAKQLSQALSIHARIPSHIPLQSLSSSHEQVDIVDYNGLFKYTQPTPSINHQSSNTGTASMLLFNFSYYSRTYLAMYLTNLLSHRTTVPVIHDSLVYESTTLCLLDVLP

SEQ ID NO: 1002009 - protein, 325 aa, Homo sapiens
WLLAQQLRAPVAPDLFVPLQRSPSRSAPGGSRVESMSKPPLVKTGTAFSSDRRQTGSAVMAATFLGAHVPAWTLIHHPSQPGNTGIICTIGPASRIQWQTLARQMALSLDINVGSSDTSLMDTHEYTCGRPIRGNCAGTVASGHMRSAFVVAPESFYLGRQISFGGYKDDLQGPLENPVDPGPSYTMVPAEHMHDRCGSLTGKRDSAHLRQQSPAWEYTALHMAPDVVTADTLPCMTVGKLTNTKALLGKGVGVGDTVGGHRQTELRSGLGGGKWGELGIYYIAVPNGRGKLATEEEGVVPRETLPQVEIGNRWRGDWDENRRSR

SEQ ID NO: 1002010 - protein, 102 aa, Homo sapiens
ETGFCFCPGGLRLQSTLIGSFDLQGLKGSSCLSLPTNGGLQGTVPPYSVFFWFGLRQRCLACVAPRLGLRIPGLNAIFPPQPPKVLKITGLNPCAPTPSKLL

SEQ ID NO: 1002011 - protein, 398 aa, Homo sapiens
MASTFAVNPYISMSLTSLRMPSFGISCLGSRREDLGLAFGPLVLPYVEIVNPTCELERASHCDEAFTAGSAALPGNTNLCMSSHNEGASDTSGSSNRTLFSEGAIPTGGIEGADGALLFPPADGTQGIGGPGKQEAVHSRFRFCLSIILWLGGAQVFSVRSPPGTGSVFWQPFGFACFEGVPYPISCGNPMWCALGYNLNGRPPTLIFVPPKRGDDPVPPNLTFLGAFCAFDINMRHLTARNHSFGGKRDTVRWAQTRSYYRIDRLEEAVSPPSALEISQKGGRTCPNSLNRPIGNLPRANQKELSYCEWPAFYGGNLRAMFMELFSAQHFEDRIFLGEITPPVKCKAKADKRLQICTQVGATLRRTSGAEPDTLGREAKILREHCVTESATSTSNDA

SEQ ID NO: 1002012 - protein, 142 aa, Homo sapiens
MVRTKATRGLIALCPENTEVGDPLVTRRTFASQYCRISRRLVILGDNYVFHCALACCKPLFPIAPYFGISLWLELHPNQEVNAKVYWGSLGRANGIPKGISGATLGVFELSLFPRGLDTCYTQILQNFGLRPMVWSPIVKSV

SEQ ID NO: 1002013 - protein, 272 aa, Homo sapiens
MSNNTCSCSERAWTEYFASRTMMKTRDTMLGGARTWVHRMCILAVMVNPVFTERHRIPCHVAEDAIESDGAICLITHRAPVVNALSLHNSMSSFADRATGLSSVTESRCSRESERSPGDSTLKVPGPMPVIWPPEGRRGANLADYRLGLRISCGFQRNRSSLSPPSFEWNTSCTRERIPSNKLGKPGGRRDTLNEGIGAVVPESPGGFRLPVGGKPPGMEVSQASIVDLRGVSFGRVKGFHSVGTDIVAQVHEKASEQENLQWGRILGFSNK

SEQ ID NO: 1002014 - protein, 280 aa, Homo sapiens
MIYEVNTAYQYGENSQHRLYPRINMGARLPERFLIGLSRGHQAEWCTIAPVACLFRRLPSNIYESLSCTHKQTRKPTYNSTALGDYLLTRKKDATNSKEGDAMNMRNPLVAGLKGARPDVHGGITYSYMFVINPVQGKTCPVEELSDHAEVMCSMGKPPMCDRMAHEEPMRRSLLTWPLLTAHESRVPHAGRPPRNNPGGGVGFPPGTSIMSRPIQNMGDPQKIPIKQKGHITLDKVTNSVPRPRCNGGTRLVPRLAQLLRKGEVAIRHWRRFRPYLTRQ

SEQ ID NO: 1002015 - protein, 121 aa, Homo sapiens
MLACVDCGSKRKPYQGTGITSRGEVAKSEEEPDGTGGEGPRQDEEKKIQEKDQIRKTHGQEGRQKMNCRGDEEIWGEEYRSTWGGIQSMVPNEYTQDKKSEEIKRERQQGKYGNPEGTEAT

SEQ ID NO: 1002016 - protein, 96 aa, Homo sapiens
PGCEFRSARIVLCEHSVLLYAPFTSSSSVALNGAVAVRATNGNEFRSCAALVALTVSSLEVALHENILLYMHGMLYIVETGSRTEALIILFKVGST

SEQ ID NO: 1002017 - protein, 106 aa, Homo sapiens
MGTLMQIIMDIRAPGTSEVIILFLVCIDMTSSDVFIVHPPPMSDVAAELEYWFIRDGLLSMISLLCMTVGLLVGLCKNLRRVDFRTMLLPFPKDCWIRLWFNGVIY

SEQ ID NO: 1002018 - protein, 110 aa, Homo sapiens
MLVLRLPRYTPREANGRTRLARTASLDDIRSSPPCGTLVGSMSMWRWSAMEPTDMVVQGSACQDGTSCAGIKDNGCTQSETTEEEIKNTRDHHGLMDMELFTTGNKRHTT

SEQ ID NO: 1002019 - protein, 172 aa, Homo sapiens
MANSFRQECESKSSADGLLDTMATRGMKANQTRVRKLVAPEASGKSARKTWISPGNIEGLKTTGKQNPPESARESVLDISRGWKAESKEDGLKKRTEGGKVRAKSAQRKHRGKLVTLRKVSEPKVDLGKSNVGPSEEPRRQEQGIEGKRKVEQQGVDEKQFNPSCQMKCKCE

SEQ ID NO: 1002020 - protein, 125 aa, Homo sapiens
MPRLLSLVALQIVRLSSLLFLLVRNTEEGVPMRITEVPDLMSTLLCISGHEKRTDCEAPWRLMGRRTPMGRSKDVLGAVSPSSSVVVNRESSTPVSLTGSPPGAMSWTRKYCEAILSGMDGSNMK

SEQ ID NO: 1002021 - protein, 306 aa, Homo sapiens
GKGGAGGGVGKDAGGVFRVSDPRGRRVKSSRAGDSSIATCFARREGEGINPSATIHASRTSAAPKPAQPRRQKQLRVPGSPSTGCSNPGSGAIGGCLRECPFTQPCEDSQGGEGNSQRDSQSFSYTYSTPSESADVLTEELRSNDKTRILKVPVQAHRAPKRFNGRTVLSGGSLYIENPGGERCPRGSRDSLAVLLEFAEEQLQATMFFIGFHKNREDRAAFSETFSFGGLEMWENGGSLVPKRPELASGLHVREESLREKTAGMMAELGDWEIGPGAHACTRVGENRKVVIRRDWPHVYRGNYVT

SEQ ID NO: 1002022 - protein, 72 aa, Homo sapiens
AAASGLQENDGRSPQELKFLDNFRLLEELEEGQKGVGLKCTVELACLGRLMKYIDTYKVERHDYWGHHRYKL

SEQ ID NO: 1002023 - protein, 399 aa, Homo sapiens
GSGREEICFILGTFGPGQGTRTEPVFDELERVQCCQPSRKPGVPDAWSVKVSSGQDYFVAQEVATTSELWDVVAYGELSWRYVVVLHAVVSPDVALRVIADACDIVNTKDNDIPDTGQVDPSFSRETFRTQQTLGMASLEKRHPPSPSAGTVVDEKTTVVSRGSVTMVDRAGVRRDLLPWIYLWAAALWNAKLTTGGPVRLWPISNSLPPMTLKQGQLWKPCEKRVEGPGPQNPFSTRATQTGENRAALWTPFVGVVVSTGKREVEPSYEDTHGCQEVIKKVASRILGQNVDTGGWVPALEERRARVPCAPPVSSPTAIVDGSDHAFVWNLVKLKGRDPDRWDDGGQANETGPMGKGHGSHGARHGPQAMSPKKQQGPRRTATGGPIIASVAGPKNATQ

SEQ ID NO: 1002024 - protein, 307 aa, Homo sapiens
GRLPFRKDVVPFISKGLRSNVLLSLDDDPREKDSFRARSTSLNERAKSRIQTSLTSASVGGLQMRTPWARLTIACKKLHLELTEILSGHDGSIQSSPFSGCPEEVSCGAEFLLRVAGPKPWLVGNKLVTVTTRRGNREPVVTEAWSSGEHEGRARRSSSSPGVHVRQNKEAPDKRGVPGWASRCPVGPGIGSSSMSGGHGLRVGALDVPCSQFLGSAASPGPRTGPDAKPEKVSRWHRVPVQEKTNQASYVALLNQGLGGDPWTGGPQGTPVSCLKLENRSSLSPRTSTNSPAGAANGLMGVTLRRT

SEQ ID NO: 1002025 - protein, 117 aa, Homo sapiens
MNISNNRNQYTGGNNWSKNIGGKLQGKCSCFHRIGNTRLPDRNETPQNYTVSVTVDLRWTQLLQGPTVRTPSHIFMQVQFLHLQSNTPMQKSLPPSGQPQGILYSVQTRNITFVDIN

SEQ ID NO: 1002026 - protein, 30 aa, Homo sapiens
MHEQGQQIRTKKDAGDKDNPYRLQTVTTQW

SEQ ID NO: 1002027 - protein, 443 aa, Homo sapiens
MLRSSRSWASTKSRIWYCYVDRRMGLQGGRGQGMKRLIRSEYKPRIAWNAMVVLGPSFVARMLPFVSLLRPGRPYIWHALVACAGLRTFVLSLGGLPQDRPSRTSGLTSGLYGMRSEDVCGGRHCVPCHGWCPSKQVTCNGRQRERKENCASGLLTGVGQAVARPTRAIPLVGLVPTPGSVRDVRVVALGHCGKRPCFPLATPINSPVSLQIPYVISGGSKLVDRRVNMPRQVPVDMRSVAAVTTHRGVLPVKNTPLGEANELPFVPTLRTGRTRCNSASAPDFGRHPTGPLIKAPWVGSPSPALSEQGGGTRPDVQPEMRDAPRAKWDRRTPGWVRRRGWVGQGARLAVPGKPAEGFGFPEQIIGAWVQHGAAVIYGGVYASRNVSPDKTFLCSLKVAERGPLVHRPDGRSFTHGRGTPRPCRLLNGDHLESTHFGFREVFP

SEQ ID NO: 1002028 - protein, 232 aa, Homo sapiens
EEVGSSHLTSPTLEWLDPCWALWGSAPATVTNLLVGTPGVWGAPAPPAVQFIAHGWPLVVGPLRGSGAVCWELAQLGQYPWASCKQCALVQGWWESPSVQYILPTLTQTASCVAPAPSTMPLGPMAAGSLLARAPHHQHPFHPPTLGTSTELGKVLGLPLGTPKGPLGQIPPNSFGMSFVTRFPGHGESRRGASNRKHLGATEQKAKNRTAQDEREGEGEAEKGRERERRQG

SEQ ID NO: 1002029 - protein, 342 aa, Homo sapiens
GFPEQSARRTGRKKKPPCGPGAWSWSLRCLPACRWPVLDAPSCCWYDALPVPVPGALGRLMASGLLRVVAYCATGIMRWSSGCRLVQSVEPLAGGWRGAALYGQGVGNGVLADALRQVMAPAKKLGSMYSSIEYAVCTSRCPRSHAPVAFLVCRSDWDEEHHAWGSPTGLPRDSLSGCCLLGTCTSAGGLDMNEEGLAEATPGEGAERALRRDLIRLLAWTGPQTTRLLGEVVAPGDHKLVRQGRPLACVAYRFSGAFQCYTGRHSPRGVSPRCQRCVHCRKSRDLASKVPSPWFRQDPYFADWPLGGPSTSEAQRAFPSDWLGQMQKVDSLPSGMSIDEDT

SEQ ID NO: 1002030 - protein, 103 aa, Homo sapiens
MATRKRPRIYAFCFVIGSFEFRQCGTLEILVIERRWLNERYSEPRGWCSQFAKRRSQVGNFPEIPSHWQLTPIPAGEPVNYGRSQPGTTAEANMLGEYFGPEK

SEQ ID NO: 1002031 - protein, 74 aa, Homo sapiens
MRPKCSPYWFHNGPLLRLAVELGSPLVNAEQFLYLSQYTTINSGHFRFHPHFERQFLARYHRYSNIHIFYTHTL

SEQ ID NO: 1002032 - protein, 123 aa, Homo sapiens
ARLVSGWTGSEAIVSQRYFALLAGNAGCYSGCDLMHAYPRSRERRKRNGVVHRVPRSLSFCRDMNADVAPLAPQESGVLETYVTKTAVCIHRLGARMTTFTWTTHGFTFDSWNAWMRRRGSPD

SEQ ID NO: 1002033 - protein, 107 aa, Homo sapiens
SEILRRTLPPNVPSAKPEYPIGYPWTVLLVASRGPLDGIPGVYALAENFCVCQFYDLLGDMLASVPSRMSNSGLRTSTPRNKPEWPKLLRIARVHTLALTSIRNICR

SEQ ID NO: 1002034 - protein, 172 aa, Homo sapiens
TRMKYALEYSILSYLFSVRYTICFTTHILIDYAILVSSSPDNAIFSLITLNTKCAHCIPMIRSTTDIVIWYHECTYGICLELSSNLITLSRNLYKTYILITIASSLTGHDDSNDELNELHRYRYSDDTPLCVLPRCICEMCIGLLLTVPYMHLSDEPRFDYSDNEYISSPSH

SEQ ID NO: 1002035 - protein, 114 aa, Homo sapiens
MGRRKNREGYWRQSPERCSEPGRWRQRFCWPRNNSNESDTTLNGSDVEGVSNAPMYRPLKKTATGALGRTISRLKAQGTLLGNLSVAAVVVVAPTPGRANHHPGEAFLRELTSP

SEQ ID NO: 1002036 - protein, 287 aa, Homo sapiens
MVLCFELGNQEPPILDYELVITFMNITTFDQEDVRKISIHMYRNAVSAGPYGVHARTASRNLLNTDSFIRLRYWLIRLVNSESGRLRPLGILVTIATEVVYKNQTYRHSTNRVSQCPLASLSRFPPHHVKLRRDLGSYLTLDVSDSKDLELEIPKTSSELMPKLKARVGNPHLTIWQLFERTYQYSLKTLPQKRERENNMWGEQNKCVSRSREQHSRGAARKKRMVLKKNPSRMRKQTAAPRVKTQGRALGTKNLRVSRKSKKRRHNKRTFAEEGLSPEKTSAREVT

SEQ ID NO: 1002037 - protein, 216 aa, Homo sapiens
AALGDAPDPVPWLRSAGSPGLLSGMGAVSYTQGQSPEPRTREYFYYCGPTMGPSFPWMIPKVKKFHHLASKTRRFLDHRSFITALRPRPLVVRYEGPPLPLSPLDPCWQESRKLPVCCRGTGTVDLHSTLLNRGPGCLRRTLLLTDGGRRPWHVPHKKHRSCNGMPPEPGTKRGMPFVAKHGEAGEQLPEQDDVAHWLRFTAPGTIGKHTEPLVTK

SEQ ID NO: 1002038 - protein, 105 aa, Homo sapiens
MKGSGPQECIVYPLESPNEVFNAIVISVLTCRIYDVSTSSLSSAIGHRYEKGSLKESKVIIISNRAFINHIYYWRVVIFLNHIAYERRIKKHFPRSCHVSSQIDR

SEQ ID NO: 1002039 - protein, 117 aa, Homo sapiens
MVQCKPRLIGRLPIGSWYSEALLEAPVTHLYSACERIGRLMIITLRCDQLMHTVSTQLSLDERLILRAGAQGCSCTLVASYRPMNYECTSNYSNDWQSFDTLSVLGQSGFPWGALRE

SEQ ID NO: 1002040 - protein, 77 aa, Homo sapiens
SVSPAENITKYGQMISVKMSEKSRNVIICFCFDGGLVVGENIRRTTQMSSLSYRSPSLLMYCALYESSVRASDSAYT

SEQ ID NO: 1002041 - protein, 69 aa, Homo sapiens
DVTLYQNAGPNMPQVPDYNLTSSTLPQARMAAEQATLSHEQSILLEKASAYKDPGVPTLRGKIPCINAN

SEQ ID NO: 1002042 - protein, 140 aa, Homo sapiens
MSHGRIDFLNKNFCSHQNGPNRLRGSNDILPTATLVAPQRLETCGRYLGAPGDSFPQLIGIGPRGNYLFFIAKFYTRFHTGVVHSPFLEGDYTERLHFNDTFRQAAVQKHTKVFIFVLAQDFATFVRSLKHNGFPRGKHL

SEQ ID NO: 1002043 - protein, 121 aa, Homo sapiens
MSSLDNCITKNPIQQSQAGTTHQTTQQHKHVSDGQSAPKKKYEATTAGGTRAPQDREGHNTGATEKDTRRDNTGLTQNRQGHSADNNKPRGHNETLDKTTQQRRETNSGINKKKQANRDKC

SEQ ID NO: 1002044 - protein, 119 aa, Homo sapiens
GWRRVELFEDSRVCRHLYMCLEIGVKRSVRMNECLSIRAYISQKRRWKNNRFKICGKLKQVTNYFHSFRRSPSNTYVLSISRSSSEKAQQSGRSKCLKCGGSRMFYCYTCYVPVEECTY

SEQ ID NO: 1002045 - protein, 147 aa, Homo sapiens
MILTTQQLYQISYILQLMHHHDTRSYTSPIDQTLYTRFRYQHDETHALITRSPYDNNTVATHDDVPKLLHTTLAERHNNAANHIKEQRFNASHIPSTLHTTNHKNQQHTNTSKAPCAPSQARSERRYYRVPSETAPEGTPEGKETKG

SEQ ID NO: 1002046 - protein, 81 aa, Homo sapiens
LFTDGDEPTAHENSASRQKDSPSSPSPRMRTRDGEQLERDALDAMSPKCPIFMDVEIVPYAQCYKNSCDGLVVVTNANESG

SEQ ID NO: 1002047 - protein, 220 aa, Homo sapiens
MANLRWNVRRLITRVLLKSWYWVPRGNSILETRCAIPETFPIDAETWLLEMKRTLTGTERIFRQQYTAYKYADRDVTVCISARFTPTYLQKKMLNPSKTPEHIWVEILGRKPRKTFRTVGHFGSMELSTLGARILRHSNIFQGDPIKLWITETYHMGAFKGKLQPVLFLLKGPYIDNRGLLRHLKKVVVLREKTPRTRDRGTRSLRCKFCKRNCHVTLIV

SEQ ID NO: 1002048 - protein, 111 aa, Homo sapiens
MAPLLPLPPTEVSLGQISTSHALGASPPLEAGQTTTQFTPRTELALPTCNWRGDRITQPHFVLFLPNRASLGVWGTPFAGAPFCKDLGTPSLRTSWTLLRAKVNAHYIWLA

SEQ ID NO: 1002049 - protein, 108 aa, Homo sapiens
MPHQGTTADEVSEILACAPLCPDGMMTRVLKDFLVRHTRGLQTGSISTYDSWVVRKYWLHLILVFVSGGNLNNFHFYISNQSTSRRSDRRARLEYLSHFRITCRDMTY

SEQ ID NO: 1002050 - protein, 159 aa, Homo sapiens
MQILVKNPHGKPSPLRSSPVTPLRNVKAKYSRTRRVIPPDQQRLILAGETVWRMAALSQDLQLPERMSTSGTWGLFAPAKGGHLLEAFLSPVFGPRNITIWADKDGSGPQVWLMASGPFTTTSVAWSHIWAGKRHDMWVGSNTQTNPGRVPKEKEGVTQ

SEQ ID NO: 1002051 - protein, 67 aa, Homo sapiens
WNSVMGKHVLKNVNDMRTRSYMTDGKLILNKRMGRRDATAGGAEKSHMLKFESTPVKQSRWRLLLKI

SEQ ID NO: 1002052 - protein, 194 aa, Homo sapiens
MNDTVSYPHKKVHDPIRSTSEEHKWSLMSFTPGRRQMPKTEISRNKTRPKCTRPHRMSSLYLDSELILGGGKTTGFGMIYDSLALMHREDMNAITVDFVHMDLSGLYEKKKDLKIKQANKERKNRMKKVRGICQEANVGAGKKPRSQGAAMMLAVATVDYCARTLINLYRLLNGDPILAIDTFCHRFPYDPLDQ

SEQ ID NO: 1002053 - protein, 299 aa, Homo sapiens
MRSLVLSVIAMITYLVSRVECSSVLSLSTYRLSRFVYHPVAVRSYFSLYLSLLFVLVFYLLLACISLLFSDIVLVVLSVCSLSLHRSVCFYRLLLLELLALLSLCSVLSSLRLSRLLVSLVVVSGSYFAVSYFRCILPLLLVSILCCAFTLPATDSMFVLFVAYYFDCGVLFLVFSVSWFVFLKFSISTCRVIVCLDPFSLGCGVFFLTVFSRYYCLFCFVSSSRSSLVSRVGLVDLVPSARFSVSFFALVLCWSCLLLFLGVRSCLFSLCMSLFLAVVLFLGRSIFFLLLFVVRVSLA

SEQ ID NO: 1002054 - protein, 96 aa, Homo sapiens
MIKDEWGPNSLCCQMSTYWSKDAAQKAIMMSTQCLIQSQRTGVSHCAQGYVGGSVVGREYSELLQQVASGVVKTKLRLVCLLFCLVPAWFHETICG

SEQ ID NO: 1002055 - protein, 68 aa, Homo sapiens
HMSLMVKFHKSFLHTVVDNLSWVIMGRWFNQPAGALLISWICTCESCQGSSSSSDLYYRLTARAGDLT

SEQ ID NO: 1002056 - protein, 88 aa, Homo sapiens
MRTDDKTQEDDIARRTYRDLYTGMSMYCSYVPPRSTERTLAGILYTLGHVYICVVRWIANSPISYVPNIFWTIQCRIDPRRVAHGCKA

SEQ ID NO: 1002057 - protein, 68 aa, Homo sapiens
AKFTINLYIIATRLALTIDLSTMKLIGDRNRNLVQYDDMIAVNGEDDEKIYKQSMIYQGLMTPNMHSA

SEQ ID NO: 1002058 - protein, 81 aa, Homo sapiens
DKTPCIPIAKGSNLTVYTCKNPCILCILLYSCIELLECKTVPSFLSTPIYWWILIGISYLFVLSRLGSKAHWRHLCSTSGC

SEQ ID NO: 1002059 - protein, 220 aa, Homo sapiens
GLNPGAGGEHGRSGVVVTHIFAVTGCHARYSVLAEKDGVSKLAKVDCWRVCAEHVIHWPRSHEDKALCRVVDGDSPPGDAKILDNAHSQQKDPSASGLLRIQDSFGLMMVKETFNGQPVPSLFKSALSCKLPLSDPGTTYTQELAEKLQISRLRSHYPDANQKPEMVIGLSPFQGLVWLPAERGSMYPFYSKVPEVSVPDRQLRQQHTWKQSMSHDSQAV

SEQ ID NO: 1002060 - protein, 162 aa, Homo sapiens
MRSLIIHHQLEDYDERSLFAYGLDSLTLKNPHVLSSLPVRGTPSGHFELCGCEQAGNSCKRIVLKNHQSRFLTVNTAILIALNKREYEIPSNLTPADVFLREVSQVDTICECLLEPEEQVSRDAPMDSIEWADSGVINVNKNLKDMLQAARSLSQNRKSRIE

SEQ ID NO: 1002061 - protein, 67 aa, Homo sapiens
LRVKMVERGYCFALTTFSPSVNLVQIEYASAAVAGGAPSVGIKDMTNGVRISNLRNKTVISMAVVMS

SEQ ID NO: 1002062 - protein, 88 aa, Homo sapiens
KFKQSHCVAQDGVQGQQSVAQWQTLCLASSVGLQALLHGCPVKFYLGDSLSGDDNGFPAMVGKGWTRRSDLKRIIHHNEGTKKREDNK

SEQ ID NO: 1002063 - protein, 155 aa, Homo sapiens
MRRLYSTTLVTDYYAILTSCLTLLETSNPIYHYQLTTRSRISFLMYAYPIYASRTQMLNTVACLEAPKCLLNRQSESRNASKYKYDLPRELLLDLAKAQCTRQRVIPSLTSQSHHTGRGRNEEKHIANEASIGYTECCQNEIVYSGIICSVELFV

SEQ ID NO: 1002064 - protein, 199 aa, Homo sapiens
MPSSQQDMGRPRTPGCGSLDTTYFQVLVHLQCTRYKSRRQRDLLERQRGPAEASDWVTTIMARIISSNSLPVPMRKEPCGPKSSILVLRSFVTHDPTPRAGKAPGGFPQSNQVPGEAGARKGTDREGKTENERGRGSENRTGTGNGKRRTKQTETLGGTGKPWKGIASGEGRSTGPPGHSSGGLGPRQGTPRWPPNRDP

SEQ ID NO: 1002065 - protein, 190 aa, Homo sapiens
VVRRSRGCVLLLHECLGGKDQWTLFQPWSDLRCILIRYVSIAGTYLHRAVYVLLRPASAIWWLASFIDERTMSSLDSSELFHRGARRPVHETGVIIGTCHGPAYIVPSYFMELSTYKKTGDSMCAHGNGVEPSLACDRCSAGRKRCWRPGSKRRSSLHRVTKRGQEYARCAVVFSLVTGEPHTMGKADTM

SEQ ID NO: 1002066 - protein, 41 aa, Homo sapiens
MDCPRDLTTQFERTQYTITTLDNSRIGTRTAPTSWVSSPKR

SEQ ID NO: 1002067 - protein, 137 aa, Homo sapiens
WRGVSLWSPRLEWQWARSRFHWQARSPGVHGHSPASASRVVPGVAGDYRGAHHHTQLNLLWYFIVEQWGSHQCYTPGVVWTLRDLGESARLGLPKVCGEYIGRKATRRGQISGIFQIESGVHTGVGPGRGPQLVNPG

SEQ ID NO: 1002068 - protein, 32 aa, Homo sapiens
RRRANRSVERIYLIWRLLLTNDERSEVVSEEA

SEQ ID NO: 1002069 - protein, 104 aa, Homo sapiens
MGKSNPTSWAFAVRTHPRGPQLFSTLGNPLPFVPHGTIGGKQGNGTKTRQAIFTIATEEGVEDTRDQTNSCMEPRHWKGTYQGESSKIPSTWQRRLEQGPLGYA

SEQ ID NO: 1002070 - protein, 287 aa, Homo sapiens
LSSRVRTGTQHPWLLPPPRNCTPAGSCRAIENRSPVEALSMPGRLTWWCRYYAAQEHDVSAGAASSSSTTTSSSHKPVSPHAAGLVAMGRLSGPDARGIWHNDNKTFLVWVNCGGPPAGHLHADGGPHDMARCSPDSDNPAITQIENSLQTSNGTTEATLLGHALHPWIHTITRPAAYHTLGPTLGACETQGVHIITGLNPDRGATAMHAHVLRRRAGTITARVTGAIISSNSPTGAKHEVRDCCDHEYMPRDDGWTHLGPLSPNGAMTPAKLGHSHQEPMARLRPA

SEQ ID NO: 1002071 - protein, 182 aa, Homo sapiens
PESGSRPNGDRGPQVHRAPQEALAGWSCAPLREGTSVGHQGLLAPWAPAPVGPPYARISQHGDPLLSDTFTESNNRLALEGPNWASEALPGPMGPLWASVAPTGVPGSSWSHRTPQAHTGTLKESLATQERRARAGLRGEPGPRRLCWSSGGNPGPKGDPGEKSHWGQRVAPDYARLRKMLP

SEQ ID NO: 1002072 - protein, 31 aa, Homo sapiens
MGQETRPLRTNNLSGGEPLLVLTNPGLAIYE

SEQ ID NO: 1002073 - protein, 131 aa, Homo sapiens
MVFPRGHWSFKGEGKRSEKAVGQSGWKGDLGTPKIGRNLAIYSSMVFMPERRSAQTPLRQTCVQQAPSGYTRTYTGALHPGGSTNGHSRSKRPPHRGPYERSRDRAHGDVNNNTGCRGLCPPPGAIPFVTR

SEQ ID NO: 1002074 - protein, 187 aa, Homo sapiens
MAEHKHQQQSINRLLQFGAPTTTQGRTPPCNTPRHQAGPHATSTAHQVRARTPPQERSDHIYNDSTKKQKNRNADNTTRRNHRPQREIPKTMRRHHAQNTCSPTQTVPNKKGAPPKILASGRHQKRHGALQHRGLKRPHTHLQLEKTLYTERDTPAETEKAGDIHREENTNWRQTPPHAAQTKNNDK

SEQ ID NO: 1002075 - protein, 229 aa, Homo sapiens
MRSGACSGAARTGPELGVGGAGGSAGRESADPGLGRGRALNAAGLTPGYPFVPVSAQESSYASPVSRVRQKLVLSSASAWAPKALSCRDRASARSGRARCSRGARAQSSWARMPGTSKYADGKRRGTHLRDGMLELAGTERRGITAEAGLPRSSPAGAKTVYVCHRNPIGGYYIEGQQGDPGATGARCTTPMGQEKARILIIYPGDDRLGIKVPEDIRSSQRINSRVGY

SEQ ID NO: 1002076 - protein, 263 aa, Homo sapiens
TTAGDGGLGARVSQLVLVSRGAIRHLLHCALLSVLGVRASPVPAVSSPVAPVGLTLKSEALSRTGKFTRLVTRSFVYENPISLFCRRYHHLALWLAILERTVEHRADQVLLHRDLFAIFSAIIVPVIRGCVITVKAGEKWRMPEVAPQWTFAMLGRSTTVRSRMRRDLVLGMVSALQCAGYRWAPAGCHRGSFPRPLSSVMVCGLSIGHGLWAHLVLFHRPLRASGAEARSDLPLQPDEEDIRVQVRLRVFSREGGEDQSRKL

SEQ ID NO: 1002077 - protein, 115 aa, Homo sapiens
EEKKPHLQGKPVRPLSLPASTFVSEWIRNEFERRQTLKTDGKNRSQGARQYRTTRTTRDESTVTTVRPQAHTHEQTEEPLTQQRDNRHHRPRDMNKHRQNTIVTTREQHLQEGQN

SEQ ID NO: 1002078 - protein, 359 aa, Homo sapiens
WKGSLPRWPRRECRGAISLTAISASRGSSDSPVSASRRWRGTTRVVHHQPVPWATFGHLNRRSGVLSSGVPPGVVFNLREPSEVIVRCASADLSPKMWRGKYTGPCDSTTVVFAAPDISCVIILKSPSTTGVICHYRGEKPRSNIRGTITQFARETLVGALVGEEVKVWVYVAHNDMRYIEGAKSAFYRVSHNKLRKRDNRGKKLHDTCVRKHKCSTIEKKKAVPPLPGAAAGGQAPQVGGPHNAKNRDVTPAGGQHQAIPYTMRGEEDHKTIPLLTHPMMGGPSPIHAVGRSTIQQRASLEKSCRQLIRPPKEKHSLVGNPTNGGGGYKLSPHPNARRDAHTTMWRTKQRRGVFNSKT

SEQ ID NO: 1002079 - protein, 127 aa, Homo sapiens
GQSRCCPAGPHLVLSASSYINKESVVMAYLFTTFKRLPGGLHLASLHCCLTEEGAQGVQLSACVTSYCCSPHPLDRGGTSRILLNDSSAHAKSTPATTLGDPEPNSAGCGMTTVRNTDGCSRRFMGG

SEQ ID NO: 1002080 - protein, 73 aa, Homo sapiens
RKEDRFDVHQLANDPYLLPTHEKIKFFRKPTHGWADSIPYTPFFKHNYLLTFLQDWHDIFEFASRCTLKFESI

SEQ ID NO: 1002081 - protein, 117 aa, Homo sapiens
MHMFALAPVCERVYRCVRVDTRMMALCCDHPVNPPRVSRYLLRGTCVSDIYVSTEPIYVDVYAESQGTRSHDVLADHDIALDLRTSDNVIRGPNSSSATKTYSRTTSLGDCHYPPST

SEQ ID NO: 1002082 - protein, 167 aa, Homo sapiens
MAVAGKDVPSWLRSLRLHKYAALFSQMSYEEIDDTCLSSTWSLTNVTKGARHKIALSIQKLRERQSVLNVPEKDVLERREPTKLLCTELQQIIITPIMAYSVLQATVAAVYHDPYCQGWGPGEPPVTRAEPSPSPTRDRTIGTERQGPSSCGERNQLQQLQLPLDGT

SEQ ID NO: 1002083 - protein, 242 aa, Homo sapiens
MSAQSELMHYPRCPINCRLRYVVGPTPVERTPPRPNCENPPSPSDVNSFPPLATNRPNRPPPQALSGIAVRPHFAPHGADTAYVAVGTHLSRAHSVIQDPGFTKHGPSARRTLRNWSDRNPSYMLPPRNPSPLEHYYCLRVTHPKYSWHCGAPNNGVAPRTVHIYSHSDVTHIAAAKLLGRKLPTQKDDSPGDSCPKTSFDTQGMRNTTDLDAHQQRLTRASLPPIRDGIHAMPSTTDTYMS

SEQ ID NO: 1002084 - protein, 281 aa, Homo sapiens
SRRSPPPSPAMVRPPVPLGARGGRAGPGAEPCRPGAPGLLPRLASLMVTVPTMGMSDGNPELLSSQSRPTIGQSENIRETMRVPPITSSPSSRSHPSCTWGTTKGQLSTRLCHGLSPQGSGTLGLISLSGLWTSQPSSVSKHASTGQPTDSRDRLPTDAREMVHSGSGHAYDSEPCPGPCMGLPEQVLGPTHIEMPISQDPAASRRMGNPRDRNSPTRSHIHRPEHAKSGEHPLSQSSIPTPSDKRSRTSAIEHRILGQNQDDPSSRDPKNKKGPGDPKNT

SEQ ID NO: 1002085 - protein, 414 aa, Homo sapiens
IINTKLLKHYYLLTVQQWLDYGNLIIGFYEGEDYCICDHYLPCTIHDFQIDLTAVTEGLEAQGEKDDWSIAKAMRLKISKRRVSVAARQCQKITQLGTHVPIPTALQTSTQTAWTKQEADYHRRMLSRQGVYGCNHRHWLVPTSVLPFLNYCIDHSKTVRRNGCASHPETLPRNTTRGTARRNRKTPIRTIQTRFEPNPKLVADNHMQTQTTPHPHTAQAKQKQQRHTATTRGQQTTQSNNRHSKHTKQHTAQHKNTTHKQKQKPGTKQPTPRRGTQQTHTKPNARKQHQQEKADNNQPKQRRTQPRPPRRTKHDTQGTPKHPAPPQATQDPMARNAEAQERTNHHWPPYIKKNERTPERARLQLTCQTRTRQTTALDYPTTHHTSTQGRNHPQNQRTPAHKRQHQHREQAAND

SEQ ID NO: 1002086 - protein, 378 aa, Homo sapiens
PRVADAWAAIVHYAYFESDSRCPKASQRRTCAAAGTGRRVSGVRKDRALLADPVFRFQPPISEREPTESKGPGMAQSRGDRHRPGHNYSLRGGCPNREGWENQSPTNQGNRNHPRYVAFTDNRAELIGDAAKNQVALNPRTPVFDAKRMIGRKLRANPGGARSDPCTHVGLYQVDTQTEHKPKGARELQGGRPRDILSPKGDLRAMVAEPTMTGRIGRRTYLGLPPGGPNAVIHRFRHYLHTDSAATRATKGCRVLNRGGSQRCCGYHHKGGPTRTRTTQMAYRRLVRATPREPGRHACNTAGRTPYGGLEIQGAPTYRSGVPQYRERTYRHTTLFSSEKDSTGQGQPPTGKGSRPHETKAGSETDNTEKELENNNKK

SEQ ID NO: 1002087 - protein, 115 aa, Homo sapiens
MDAGTSGYGAHISSSWVGVENSVTCPSAEPWLGHESLYTLKSIAAMGAPSSDQADSTKPSHPKNPPNSTSGCGPCHRVDRTLLRLTSFHWPTDSPAKMIGFEIPYSFKLPSSLTL

SEQ ID NO: 1002088 - protein, 148 aa, Homo sapiens
MIRSGSGRYLGQGTLRANARVNESASPFYCDLMLNGLTTDDLTRYTTKNQLRKSTLLTNEALKVCFGTLVGHWLLAYKVRQLKGEVELYATVLNKEVLLVTSTFGKNSYSGGHDNLGPRPVRIGPYDVERQLFKRITRYMLAFQAIRT

SEQ ID NO: 1002089 - protein, 293 aa, Homo sapiens
MSLIDCSSTVPGPWFDTAGTPTDSASCETLSRYCNVTAAQRPLAAQRSPKHTLDTIPATGSHGTNDSTTGGSRQRTISTTLNFTGTFGKRYAHVGNGAKPTKGPPIGRTYQKSHRKISQNRHRLGQGNNAEQQEAKSRETTYIRRERNNGTRNARQTKKTTETKENKRAHEKRHTITGDEDQKNAKKAKQKKRRDKHEKRIQPNREEGKKTEKRATAQRDAHKTREAEERERQEKRGRQRAENPNRRTKRRKKDDETERQETRSRQTTKQDAERGKNKKGRGKREQKKEESRS

SEQ ID NO: 1002090 - protein, 79 aa, Homo sapiens
AFFRKASDLAYRRRLQESEAFFRKADGREPCPVVPGSGGTDPGAWVRELMKGSIEERKTRKAHTKKKKREKHMYGELRR

SEQ ID NO: 1002091 - protein, 115 aa, Homo sapiens
MKGRTVRINRYTPTYNDTRIHDAFVRPPEVAANRIPNKLKGDKVEPPNTKGVKGWETDHRRGHTIDRGRENTEGKHTSGERTKKRRVTQRKGEMGEAWNKRKKSPSEEKDVRKGR

SEQ ID NO: 1002092 - protein, 690 aa, Homo sapiens
MAPHQTDAVTCQAHGLHRETRVRTTDSPAYTLSHRRTPGIISLTLGLHTTRARGDTPHPELYPRPRPPPGHQRTTNNTNTHNTRATRHRTTQTTATPTPHAKRSTPHTRPPPAPPTTPSHDTRAPNTPQARRHPPTPTAPASASISTKQSHKQPPPDRTDANPPQPPHTTAPPPTTTERDTHADCAPTAHSRAHNPQHTRAPPPRPPTPHTPAHHTQERKPHAGTNKAKTKPATYNQQHTTTTHRHNNNNKTTQPTTPRRHNTDEQPHNEQPRRAPSHPRTTHPDNTPPAPHTPRTRGHAPHTSTQQPGAPAAPATTTPPPRHRRHPTQPTTTHTTRQHHPKKSNERNAHTKSRPPPTAPNHPPPHPQHTTTKPTENTRPKTKQDTTPQMKRSQTETTHNPPQLTNNNHTRRPAPTQTTDPPQRPDAPQPDAAGHDPPAATEAWRTATHRQHPCPTPAPAPRSPPDTPTRHTPAPDPAAAATAPNPDTDSLTGPRRPRGARRTATGNDRDPATRNGANGARDGGAARGEGEEHDGTSQLQQPRAGPSRTDETAASSPDNRSGRQRRHGHAPTRPHTTRNRTTRKRQQTQTQTPSQALTNSERSGTAGAKRRTGKEDQESRDSDEAQTAASAKPGDTGSDARQERDHRAARSRRQQQEPAPRPRRQPSQSRNGDAQKNRSASRTSRRATTA

SEQ ID NO: 1002093 - protein, 431 aa, Homo sapiens
GRAGGRGGVWWHMPVVPATREAWAGESLESGRRRHACEPRSRHCTPAWADVMRDSCRQKTHTTNAKWGHSRTRKQGTPIARRAKAPNITTFQKSPEDVVHRTHKSAVIRVSSERPAPRSTNARRTSRPAGTNTRQRSGQEAPRENPKRALAGPYTATPLARDEPVTPNQQTDTARGIIGPAAPIANRAQRGPYAPTNDMRDPPPQLHAAANTAGAAHEGNQRGTPPSIATTQLATDPSRNGNDHARPALLRRRPHPGASPTHHTGPDVPGTVTANVWPWCGAAQPPQGLGSQRCAPAHTVNRYRPPQRAQAHREEDHYTRPTPWTAATPRDNHRDRGGHPHPTPLRAHNFDHGHQLATSHHCRTGYRETIHSAIKPPHPTGAIIPTTTTVAIAATRRATAATPTTTRPPDAPHTTAARTTPARDTVGAAHT

SEQ ID NO: 1002094 - protein, 375 aa, Homo sapiens
CGIQPGPSVNRVFLLPRLATGWEQGLKSLGRAARVSRQNRMRVTAIWFPSHAGMDPMKDPVSCMMNAQAHGQSVIQARVGGRTNRRALTLMALSRQAPCPRLWRGSRVSTMPASKGPVEPTYTCFGLLGSLVSSFPRNSVTHRLEARLRISTSPGAENGRTYTARARIEHPQCQVTDVRRATKPAPSTIPCTGVPPQGPRTPTAQYRPAPRENHPPRGHSAHIRSASRDDHRWHSSPQQRADEPGSLQPVPRQDAQHPVTASACTPLTPRPLTGSSAVHREAGPAHVPRTTGPRPRRNDATRLKRREETIPPIPSPPLARPLEAQPARTSTPQPVPALDAPTRTRHSAQRRRTSVRTRHGIAGHTTLRAPTRRTP

SEQ ID NO: 1002095 - protein, 312 aa, Homo sapiens
VLPAEVLVVWSGVWSVRVADPGRGPCGVPGGGRAGGRRDGLHRERLEDKAAAERSKMIDKNLRDGRTRTAARDVKLLLLGAGDVREEHHRQCTTDEIIHEDGYSEERMPGSTAAVVLQQHHPVHQWPFVHSHWATLHIDFARPLQSARRPGSLFALSCTADAGTAVLHLHRTLFRAAQCRTRSWALTHGVVARPCHMAPLKRTLPSFHSTSSLPLRYPWNTQAGTPVLRPNEGEPQRPPSHHPVRCRTTVGNPQPLLTSQPSGAHIRLAADIKNHSAPFSTRTPEHTLSHSKAYHEHRYRVLAFTHRRPCTV

SEQ ID NO: 1002096 - protein, 126 aa, Homo sapiens
STTGSHPTCVRCERPSDNYMTSTNMQRHTYTYLPSVCHSPLGLVSINGQALIKRCELVQHLVDGGDDTTTPESGLLKHLFMGEGIIVMRHSVLSFWALDERNSKSGRETYGQCQAYEPKDACCTYL

SEQ ID NO: 1002097 - protein, 236 aa, Homo sapiens
AQRVLPRTPGQRPPTRKPPGADPRSTARLTADIVEVVRTEYVYTRPRHGPTTLPTIHVVTPTYSRPVQKAELTRMARHRLLLRDPISTGWWWRMRRAGRRGSSRLLRDTGLNYTHLHVETPREYKLLTETSREPRIPRGTMQRNLALRWLRETFPRNSSQPGVVYFARLTTNNLHAWSSSTEMPHVTSEGVRVARAFVGDLRYEGPTGDRGRQGGGWYDGVDAHRAYAETLRGYAV

SEQ ID NO: 1002098 - protein, 270 aa, Homo sapiens
VILGYGQATGVTRLSWFPRTWNFQCYNWDSTQQVGMVGPLPGEGLGSLASRERLWLEGTLTALVLRYLAPTFSLIVWSKPDLSAPDPTLICILVWRSPETPEAPELEAKPGLSMSPVCRGRVVTYTTPKATMSRAQTTAQSRNPCVRMLRSSLVPARRSLVSWEGTDRSGHGLGLVTESALVSRRDSVHSARIPNGLVGQTLGNRVYQDEEVKTGCAELPSSSGGCPGAQWGLMSVQAVLARTALFPGVGYSLLKEEDPSLIVRIHMYDQ

SEQ ID NO: 1002099 - protein, 118 aa, Homo sapiens
ADARCELELLQLAGVAGRNLDPCAPDTAGLAMDLNQPDLDRAELQSSRRPSPSSDKDVRWHLSGTQGVGGHVTDDSLRITNPHPERYEADCDIDRYSRLDCPIGATVEPLALSSVKYL

SEQ ID NO: 1002100 - protein, 118 aa, Homo sapiens
VSYVRDKHSDDSRNVLKSLVRNKHLDHSRSFLESYVRDKHSDIDKSVLQSYVTYIQTLVAVFWKSYVREKHSEPSNSVLESYVRDNHSDHRWGVLDSYVWGKRPDPRIIVLESYVRDI

SEQ ID NO: 1002101 - protein, 271 aa, Homo sapiens
SRRMLLEPEAEKAAGPLSVPRAPCSRPVWRGACPWEWLGQVRVEERGFMCCAGRDGPSSECLRTQALLTLAQSPTQSQLQLQELSRAPGGDPTEEADKHSQMPRHQTQNLACQHGPDCYLALMADLVLCQAPADFSRCSGRRQLRGPSYISQCASRATAPLQGVASDGDHQHHLDQITNNLRDTRAEADGTVTWDSSSGIQDGITLDTEGQERPEGAWMAPETVERSKGEQKGPKPGSRDGNKTCGNHREWLTPDRVPLGRSESMDPKESG

SEQ ID NO: 1002102 - protein, 88 aa, Homo sapiens
HLVPATCKDLVVHEAGLRHPCNCAGPLCSGEGRPLRFEPDPVAAKMGMEAGDGAAGMPRPDTRGLRMVTALGEPSQCGCPVMECVQMT

SEQ ID NO: 1002103 - protein, 234 aa, Homo sapiens
HASEENTNISLVQDWTWRVSVAKTVQDSDRDDFAVDDFGSENEGELRARETEITPLTQQPGNEGGEGGSRCRAQDMRQADQELDSRGWAGLTRDTRNEESSEHTTLAGGQKATELHTRAREDHAQVGLTRRKPVQSRDLSHMQQWNLILLEQEGRQGLRERGRELTGTNSRIEGDTEARETEATPEEKERVHTSGRKRGARLRTAILNRRGPYSEGATEHLRGSTRKQETQEPG

SEQ ID NO: 1002104 - protein, 216 aa, Homo sapiens
FACAWRLLPVCARVRLGWGSLAAVAGVRRCDACRELFGVHNGPQGVKALGPADRAYCRARRDDTGDRRAGPWDLQCYEADLSADSPKETKWQQAFDPNLEHGARLPYGCGAPSWDALRCYSAKDGPELWQQDARMHDCVADLETNMSYDQQLDVLHWLHTTSGSHGKSIPSHLQEIPERNIILALQAVVGRYPRVTLPGHTPAEPQSRGLTVALLV

SEQ ID NO: 1002105 - protein, 208 aa, Homo sapiens
IEPVVLPLLWFAESGAMEGETLHTFYTQLVMPKVMHYAQYVLLALGCVLLLVPVICQIRSQGPEDTVSQPGLAAGPDRPAEALRRRVSRISQRREHQTHRLSHPSRPCALKDTLKHTPHGRHRQHAVQAMVQTLRDGAGAEGTCRERLVNKHCSGTFISTWPTGLTTGSCESSVTLPQGEPGLSRIRRWAQAYSTSKVKHCKSGVEVP

SEQ ID NO: 1002106 - protein, 140 aa, Homo sapiens
MGKKSRVTNSEIWHWCYSNCVTKGNLEPGPVSCCRNAGKSRLPGPGKQTWEEYVQILDSGLKTHTAPQAKRGLSVTLFEWHHTTQIYFSIDLMEHWGLCKHGASVEGLESGLHLSTDRRGFWVYENAKQGEYSRQYSKYV

SEQ ID NO: 1002107 - protein, 375 aa, Homo sapiens
STGPQSQLSPNAKEFVYNGGGSPSLFFDAADGQGSGTPGPVMEAVGAGTCNQPASFAPWPRYFGRLVAKQHSSMAEDDPYVAGLKLINLQHHAVIPASQFQHRECMANMTHHTCPVGPWSTPSNTATQQQRHTGQTKQQAHQQTMYKQDFRIYLTLTSRTTRSSPGTGMGGPCKPHPSAVPLTTLTASPTGAMMKYPSPGIREPGATQLLTHLNTSHPTHYTYKRDPLPPYYTHTYAKTSSWHPPMAPTDTVGTTNIDKHLELTPARDSTTQNHTHTTNDTPTNPDTKKLTAHHTRIQYRRTDPRPPAPTQKRTINHPSPPRHNKREQQDAAHRGHTSPPLSQPPSSITQHEPTEQTIHRPSRHERHNNTTRAHP

SEQ ID NO: 1002108 - protein, 41 aa, Homo sapiens
MVTYMKNGLFLQFHGAFTDSLLNEVSHEKGKPGFTGLGKNL

SEQ ID NO: 1002109 - protein, 147 aa, Homo sapiens
HAIGPTHHECEAGPPHDTLRLTALPDYTLTLRRSPDDMPLMTPEHHHYDPQLPGRAARHCTPYNTFAAGFNSTGLTHSHSTYPGYSSILRSTDLISSAHLSSQSPWNTLHTTLHTSRRRHTQHTAHILYTTLHPQPILAVSHHDTTH

SEQ ID NO: 1002110 - protein, 120 aa, Homo sapiens
MRVMAPRALLLLLSGGLALTETWACSHSMRYFEHRLCPWPGPREKPQTSSQWGLTVDEQFVPGSTRRRPRSPNEGKPAWRPWGGSKEGARKYWGPGDTEVQAPGTELTVSLRNLRGIQQS

SEQ ID NO: 1002111 - protein, 58 aa, Homo sapiens
LGDEGLYTCSFETRHESYTYIRVYLIVHVPARIGELSRSPCDRRMMGGDVNLAIAWTV

SEQ ID NO: 1002112 - protein, 53 aa, Homo sapiens
MAKTIYFSSLRQPRATPRYKTFAKGHQAIMEDNSRAMQSAVKEDTINDEAKEP

SEQ ID NO: 1002113 - protein, 77 aa, Homo sapiens
MRKKLQRTNVKRGPDTAKRKGSRVKEKARSPEAAADGRQNKGGWPLLLKGGEGRTVEQAPGAGTQRPGTPCSPAQDY

SEQ ID NO: 1002114 - protein, 209 aa, Homo sapiens
MVRAPVVLAIKRLRQEKHLNLGGGGCIELRSCHCTPGWVTERDYHLKKKKREEKKIGLAYPGRLALVGEREAQGRSLWDRWPGPGPRFSRPSKAQSPNLERERSLQGGFWDSITFWIGYRMDTIPGGEPGPINPENHLAIYRVPKLGAYWSHSNGYRGTEGHSRMKGPHRLSPYIPGSKVAQGSPGTTPGGAYGNLRSHVAQFYDGAIR

SEQ ID NO: 1002115 - protein, 243 aa, Homo sapiens
HACGYIGPAMESRGKKQNNLSSSARVISVGSREAGVMRECDLASTVALGGVLGIGNALLGSSSAWNIGYPATIGQMPSEQDHLEARYMIRFNMLLQWRRGLASMCPGVESNVRLWIPTVLVDESSASMAPTAMTLLDPEQIINTAPEDAANNYARGALASQCGKGGVTGPSMSDPDISATRGSIEVPGSPRGFRVVFLAASVGELVLGFSSLLMERRRQLIMARSPSWSSRIYPEPQVFHSCS

SEQ ID NO: 1002116 - protein, 82 aa, Homo sapiens
QRRRVAATPPPCGGGCQQTRCNGKRVSEMPDAKRLRLDTGPQMPVWEVDIPSHHQARQHLNHAATVQCDLSDAVRRYLTRKP

SEQ ID NO: 1002117 - protein, 109 aa, Homo sapiens
MHLRLISLDDGEEPHRLPLSTTICLCIPVPPTDVQRGRSDRVCSFALRPQARTSHPPPTSIVAYSTNVAWVLPFACLSHTCFPYCILVRDHEPGVLGSDALRTLVALPL

SEQ ID NO: 1002118 - protein, 240 aa, Homo sapiens
MGRSVLEHGDGNPITIFQRARYPSNRSHVVGLMLSARVASVRVHWPSFTTMEKAGAHLHAGEPKGVIISCAPLLMPPMCVYGCEPGEVLTTASRSSSNAFLCHQLLSTPWPKVIHDNILRISGRTHEHRPCHHWQPEDVWMVPSGKLWRDGRGGSTQERSIPVAHTGGCQRHVGKGHPSELNGKLTCAWPSVSPIVNRVQWWDLELPSRTQPANICMTSRRWMKAEVEGPVKGIPGTKLS

SEQ ID NO: 1002119 - protein, 104 aa, Homo sapiens
MEGLVDTARIVTDRRRTRCRSFGHVKNEREEGGWEQRDDRLCSRNGNPMDALCGCNLDGAYGGVKPSRKALRTVSRDLGHYRLVGYQSMVALTMHKASAVILSQ

SEQ ID NO: 1002120 - protein, 135 aa, Homo sapiens
HASAPVRAGRTPCALVLPVRSSTRSGAASVSPTQRAPLREVVGSGAAAGPKCGARVAGSRAAVARDVAGGVSGSGLRRARGRSLPRAAPHAVSVVRSPVARRLRVEPVIPFLCRGDVFGIPGAQAPPPQPLASGS

SEQ ID NO: 1002121 - protein, 222 aa, Homo sapiens
LKSARYGGWCEFLWWEGERTSLLVRHLRSDSKKSSGSFPQEKGDRVTLGSGSEMRQRTQAVICPGRGPGGIGVGITCQCADSGTACCLRTIRVGAGVVRDHGSQGMIWNSGLTVYGCPQGCGAASSACGEQTASDVTGSSWARNARHERRFTCKDFPLYCTQGRRVSVSPTDESPHGVSGTPGGRQVEGGWLGGIVFKELFRCCICGVPLCLSHCTPLQTTN

SEQ ID NO: 1002122 - protein, 197 aa, Homo sapiens
GVPSELIFWIVTTYSSSVLEHSHPALRVVPGVSCGRADFLRVQLRGNRELLLSLATFPSVCRLLLGDAVETVPGFAGDYHALRSRASRMPPGERWTLRRPEPNHSQQFPSTDSDLHGPFLAAWGPRLQFNLAGFPDSSPGEISVVCNLGQVTGVLSTRECLENFNPQLSCSPIRGQLSTQRPGACSEIAGLPQLGDK

SEQ ID NO: 1002123 - protein, 236 aa, Homo sapiens
PRTPGQDCKALRADAASKPIYDRHVIRTVLSDSLPPLCSCGKRGLANEVSGGVMCDCRVTATGVAVAVEDGGGKPEHAVDALARDCLLGYPSWTWRGHRREPIRDVSKASPSTTVVVGNTCRYSRKSMCRAGRVAQRSSRCAGAPTVRADQALYTMRRVDSPPINEAEEVEEGVEVAIIGDEQDNAMPREAIAQQCQHLQHGDLGVAQVGKEVTCRMRLPASSRSRCQWLCHQRAL

SEQ ID NO: 1002124 - protein, 146 aa, Homo sapiens
MRARPIIHAQPLDANTQAPEPPPLRQRHPRPTRHGQRRTGTITAPTSPRPSTPPANPHHREAHTPDAEADWVDRTEKRQEGEEDDPPTQPQLTGAPARADEQQRPPRDATHRTPHDHPQRHSTTARDRTAQPHDRGRNQHRCDDRD

SEQ ID NO: 1002125 - protein, 124 aa, Homo sapiens
MIHSLRGAGAIRGRGVTRQTLQSPVGNAGSAEAAGTERRKHVEEFTIGVNRGKEVNQNSRKAGLDSDGAGSPREQHSFSMGHFTLIMDNIYTFQKSKICKKPKRNPQINAKGGFHEQRGLLISW

SEQ ID NO: 1002126 - protein, 228 aa, Homo sapiens
GDLNQFLSAHQLEDKAAEGAPVDGQAAQGPTINYPMLLHVACQIGSGMRYLATLNFCTSGTWLTLELPIVGAKRYSTRSMHPQHVWSMKHGDSLMAAVSYLHVLQGPVDRCLPILVEAWECILMGKFTTASDVWAFGVTLWEVLMRLQGPGPLVQHHSTEQVIGERRGEFFLGPWARPVYLSLARLPARWAYMRLMASGARKPGDVWRQRAPFSRAASVPVPEDAVNT

SEQ ID NO: 1002127 - protein, 192 aa, Homo sapiens
RLWAPACLCGDERVPRPSCGGSAPLGARRGRRWPLGSGRAGGGSGASVGSSGTLDALVRRTGVRLPQWDAGAAQCGFSNAVVQILRHARSPRITRPTTCWTTRSSDKALKTIPNWPPSRKCVPVNGEFVGGCDILLQDAPRMGTWLEELKKLGDHSGPFKMKRKTKTPSEGGKSSLSREGAVHVRDSLPEKP

SEQ ID NO: 1002128 - protein, 206 aa, Homo sapiens
APETQPRSHHHTTGPRSPLLREPVRATAAGQAIAALLQTMYSQVRVLDPPTGRMFGGPGTVSRPSSSRSYVDYVHPELQPGQRAGAPSSQAQTSTPRTPGGVYMPRAPSGVRLREPACPGVPAPCKDSRGLSRWPSPSTPSAKEQPGTKTEDGWKLAGSWHCTAIASTSPKDAHTLGRSKLRILLGRARSSSRAQASRAWGNINRR

SEQ ID NO: 1002129 - protein, 137 aa, Homo sapiens
MAFLIAYRTKDSRLYTTYAEGPNVVSPLRDYYNPFHDAYKTLHLKSPLKPARHLPVTLYITRPPYLALTIVVFYYESLNPTYANPVVFDLNPEGSVAYIGVLRRYSNVKRMMASLLNVHSTSCIRADVGHADTCDTP

SEQ ID NO: 1002130 - protein, 50 aa, Homo sapiens
MAIGARSGPSAVMGSSKHKREDALVLIQPARTLHCRDLAGTEMSRCREPY

SEQ ID NO: 1002131 - protein, 109 aa, Homo sapiens
MAVQDLSPQHGYAPDNDYCALPTRHPGPTDAHLGGPHTTARWPLDTLNYYPDAYPVSLPEQALAQLLPLTRTIHADAPQGSYRQRSLAFHSPQATKGSWNPPDHHRAPS

SEQ ID NO: 1002132 - protein, 67 aa, Homo sapiens
AHGVGKPFSTGMDKENTPVKNYTGIAAFISGVCGSDSLTDIKSRSTEKNLIFEPVDVKMCCQISECE

SEQ ID NO: 1002133 - protein, 245 aa, Homo sapiens
VIPEQRAKAKRVPVQCIDPVRMQCAPQSPQLRAQPASTRRCPSGLLNRKQSSPARIVGASPDHCLAWSPVQMAMLTTAVSSGTRLSEDHGVVLPIYVGPLDGIHATTVHNISMSYPPRGPELTNAFSGARLGSCGQSPRLLSRLDCVREYAEQVYRRAVFVEGRKPFPLTGRRLRDEGPPRPKTAGRQRTRTWEYITGTVKKGPRWAPYCLTTSNNPIGFAYNVAHLVGRNELSPSFEKSPFKEN

SEQ ID NO: 1002134 - protein, 284 aa, Homo sapiens
MLLLTKARRGKSPILPSLDWPPLQCLLLRGCCPAVVCTCGTIKSAISVETCCPHNSRDNAFTFERMCATNPVAGTTTTWRKLFLTPNCTAPISLQHYVSNSHRRQFPHNRVASLLRIGVVLSGHHILMTPQAEWARENEGSSILSNTKVGAGPPITKQIISAPHQWRGTSYPTPETRNPQTLCVCANRNVVLVATQTRFVVGSPQHTLAARETAKGSYPANLHFECGAPVGTRRHYQRSVFNPPPFTPLSDQQMSHTVVVLMSTNHRPGWSTPNICCPRATTHS

SEQ ID NO: 1002135 - protein, 152 aa, Homo sapiens
MVLVLCSISVTALVLLGSRGPRAGDVAVCGLRRVFYSKDNEGSWFLLPLSITNVDPRDTDAAVLSCCPRRQTMQAPIRSRFHNVKPEYLDAYNSLYGRLLLPKPSPGLTTYPVLTRAATGNTVRVWGAWTRHVTPCGRFFKVATPVPPWICT

SEQ ID NO: 1002136 - protein, 90 aa, Homo sapiens
MTPYSILNNNKHKTRDTTQLLESLLTPAKERPPNGITRRHTPECVAYGHSKIGVPLNYIGRLEQFTYSAYVCPRVAPLCFLHNVRAQLGA

SEQ ID NO: 1002137 - protein, 115 aa, Homo sapiens
PPPSPAIGCWTPMMAGGMAVRFTALDLGFGDAVHVYDEALGPLRAPDYCVVSPHFSNGNGCHCGDICLGPGVSVSITTHVACEHMVAGFNAAPTMCGAIACLWDQTLCAYGSGPA

SEQ ID NO: 1002138 - protein, 253 aa, Homo sapiens
MGTSTGKTEAEKDKPTGAITPVQHNPRTSNNNTELENNPEGATDLITQTVQTQKKTKRKTNKRDNTDAQHKRLHHPPQEERHQKENPARLTPTARRRDNHTGRDHTYKRRQTRAPINQQRDQIHPDTKTPTTTLKTRPRTNTKGQDPHPQQHKRDSNTHHNNNNTAAAGEQKPKKMSQDTQQPPKRHKNNTRTTARKHRNNTTRNEATNTAEQNHNRSKHGGSGTTEHKQEPQREEHSREKQTPSNPERATQR

SEQ ID NO: 1002139 - protein, 411 aa, Homo sapiens
GTRCVRAARRISASGEWFVCSARRGPAATPAAPRYPGHGRTVLASSFLGEERRPGRYCSSVVWHDHLEAKHHSSAWPLTAYLGRQKMPKGRRFLRVLRYTSSVREWSNIVTHSKNHWTLLIERSHVGRTSQEPRVNNACVHIISLGFNAERDRRSRQHRGTQTLPRTSTYSYTAKTETFVLGHIALCVLRAGLEVVTMALSRSAMISQYHLGPFPTGKPFSGHTPDRLLARKRKNASATPCGEMQYARFKFRRFKPSGVGAISRKGNPPRKKIPKAHTYISTNQGFYGVQVSETIQGRLPPLRAGDTGSTRETPLFKHILTVGFAEELDRLGPINPKADTAKTMIMNHSAKHTESSQRSNWKAPHTLEFLGTETVIGSPLLLLYRIDAEHTYVGEHPPIVRLISETPQTQA

SEQ ID NO: 1002140 - protein, 134 aa, Homo sapiens
RSQGLIPEARRAKGREIGAEWKQMPAQGQCVSLLDLYKLIEGPSAWNPGAPELVRFAVVESFVGTRAQVRMERERVQGLPYSAAAITCRTRCSFKMTGGSCSLASKSTKQNCADFTCLNELARSFGLRVLLAPR

SEQ ID NO: 1002141 - protein, 74 aa, Homo sapiens
VELQPVYFPSVKHPFWTQSGAIDLLVRPSLKMRSREAGAKLRRIQEPANVAAPELRSLKLADYRARTGFSDAAA

SEQ ID NO: 1002142 - protein, 70 aa, Homo sapiens
MRHHDKRRQGGTTQPVRTRADTRQNNQPRSTYQVQHRDNNKQTRREPTPTRGAKDDDDPPKATENAPRQT

SEQ ID NO: 1002143 - protein, 146 aa, Homo sapiens
KGRARGVSTASRLARWSKMADISLDELIRKRGAAGKGRVNARPGVGGVRSRVGIQPRPSQPSQHCTCTFQPEIMMPGEKIGLSDALAQTGQSRMPGRSFSSKDARFRITGKLQDARPDVELSPSSQSTDAPEAPHRYADAQGDRSA

SEQ ID NO: 1002144 - protein, 82 aa, Homo sapiens
MNRESKPPSQAGTHNYSEDNKAVAGPTRHLPPQISDSSTASCAPTSESTNMRGSHHVVPPESRYCPATGAAGYHGLPSRLTR

SEQ ID NO: 1002145 - protein, 340 aa, Homo sapiens
CGCRTTALSVLAPEALAWPARPETGSAITPQLMLQCSALGLSCTQALWPGPVCDARCHNTCYTYLTGAMEDVACAADLCRAGSLLLDVRVAPAGPMVSQGTYRHTLYRRLATTPRNLPPWETQARAPLAPRFCIGPCGPACGRGLRRCQGAITNRGLQACQGQRYPLTIEAWALGMPGVREQIAPYRTRSPMHPRGGPPETPICARYESPFKDSDPMRCPLGATLDSLTHWGLQSVRKREGSKEEAVNAKTGASIGPVETLEDTHHGVPAAYRTTGANSSNDPGGKTQAISTNQQNQKNNQKPKRHPRQKEKSGDRRTRKQEKREGTAHRQGKQPEREQR

SEQ ID NO: 1002146 - protein, 286 aa, Homo sapiens
MVPRRANTTSCLMGPLLLLQSPLPGDMPTMDQDLVHRPWVSTHCAGQQPGLGHGRSDTSALRAVIVACPSGTHYQIQTHRDMDGMLRCSDASKYPCDMLSAGPLEAQPERPHKNLTSIGTRIGTPPLDPSKTPGTRPHAGVHTRRAPHRPGPWPTDPPSTTEGARTTGRDHWWTQRTTPTRRQEHTTRTTPDAPPPRKPEPHGNPQDHTRRTHRQTTHTTTPKPTLPAQAQTDDTQRSTLRQPTKREPQRLPQTHSDKPTGHRTKANRNERHEQETPTQTNSSKAP

SEQ ID NO: 1002147 - protein, 210 aa, Homo sapiens
RRRLSSSGSRGSRSGSAVAPPTSVGSGCGSSLDYYFIYYGSCTSLSACSPASSGRGPPPLAPEPQNRSSSIREPQTPAAAASLRCWNLVSGCLLGGFWFPRHFCYPAQERILVIFPPLSPGSCSLGRGAGALQAGEARARRVVRAVEAEGATMGCTLSAEERADLERSKAIDTKPKEDGISAAKRREIYSIARGLENSGTQAPCVKQHER

SEQ ID NO: 1002148 - protein, 126 aa, Homo sapiens
IGAVEGPNAQAEHAEKEKERLLQERMRSREDEDALEQARRAHEEARRRQDQQQQHAPGATCMHAATCNADCGVLASRTPLYGPRAPKPQVHCLWTTQMGVWPVKRGSRQRRRREAMAATIDMNFQE

SEQ ID NO: 1002149 - protein, 333 aa, Homo sapiens
YGTRWLFELSISETGAGHSEARGRARRTLVVVRPGEAEVARSLARLADSPERSVAVGGRSVARAGSVEGGDGYVAVAARMGRHGPGVTGRRRGAFFPRIQCGPSGWPRRRPPILKSRAARSPVPCCAPERSGATSQPDRAGAADLSQAGRRILGPLEHGAPSPKTMNAIGELRALKPINSQLTCGDRRCPHSFGRIESYSMEDGQENDEHLFKQFCQEGSPTLWRHFLRPQTSGTEPQAELSKDARRVRKEVPLRWQLTPENLFLPDWGASLSPSGLDYSILRKAAGMVQPEATASGGWNCRANWRVLFTTVDGGEFPGGLEAPPFWDCTVCT

SEQ ID NO: 1002150 - protein, 56 aa, Homo sapiens
MEAVKFRDGGDDALSEYEQEVTAEKIDEGRDYDAAKTKSCDEPSHVMMKFEHAERV

SEQ ID NO: 1002151 - protein, 165 aa, Homo sapiens
MSTFKSYEATYPMLIYEDGCLRDMWNVDSPVGPRKLCDHITTLVVCRETPLGVPNGFPAVVHPSGWGYPVLLAKGAIRLTRPSEGHFALYLLERVLDTFAHARVENTHAIGIQYFHQYGALFPEDRHMRHNPSFMAPGWDLAYAQDDVRVGSKGPFPFRKRNARR

SEQ ID NO: 1002152 - protein, 292 aa, Homo sapiens
MRGFGYVTQEAILWTYFTYTDTTWHESRRSFTDAYKVPLRAKDRQLLTLQRTDIDGPSYRTRPDSEGLTDGHACLLRDCQHETYNDCHSRATLGLTDDTMPQLHDSCASRTQLSPDAPRCVGQHYPMTALPSADPGKADIIEGKPSGQLSMKHACWYLLPEEPRHRRLTVHVRRRNPEIPTTGTVPGTRTTASQGATSQHSRETRLHTPRHTRHNYVCTQTSASANAREFLNGNWNGTDLSVIHDNEPQAASNPLTWQSPSPYRREQPMTYDPTPSPTTLQAQAPNLDIVII

SEQ ID NO: 1002153 - protein, 73 aa, Homo sapiens
AATTGSSQGISVGEAERLQIPSRVQMPVSSPAKTDRSQEEDGKQRVMSAAESEIGEEEREVRRSRSREVHDMK

SEQ ID NO: 1002154 - protein, 188 aa, Homo sapiens
AEVARSLDRLADSPERSVAVGGRSVARAGSVEGGEAMSRWQPGWAGRAGSNGTSPRSFFPRIQCVPELEGRWRLPPDLEEPCAAAEPLPPPAHPGTRRGSDPAQGQTRPGCGLILNPAQAGNTSPSGARSSFPKDMKLWDELSFEAIKRHQLTCGRTGDAHFIGQDEKLPHVRWQEHDETHVKQFCQE

SEQ ID NO: 1002155 - protein, 265 aa, Homo sapiens
MQEIMLATLQRMEKNLERRVSSESIVHSDHGHSAVRMSQRIKDTRFGDERRPTDRRMERKKDGRDRYDATDRSDMTRDMEAQAGIGCDDETDNPPAPSHVPKERSMIDNSESAEMGASAPPLTKTVCAQEFDIPKGLLTDHHVWEAITEGGSGLAPRVARTQKCVGHSVCMLYIWREATTLVLAAAPELGSSRNIQPQVQQPEGRLNRLVPEPEDGQCARNSPVMPRCQWTRNDNLSDQGHQARCNTPQTPPAIKDTGGKASRKK

SEQ ID NO: 1002156 - protein, 171 aa, Homo sapiens
MHALVLSPPVTFECGWRGRRGARGGLHAPCVAAPSRPFFLWASPRTVCGYGKGTAVDWAPQNFEQPAGGKHGPCTGCAKKAPFPRRPNGALHKAQAKPTDSSRDPQEGNPWHDNHGGEPGHGGVREQGHTWVHKQPLKEHPCDPLKNNRRAQIVPNKPWLGEPLLVENSSR

SEQ ID NO: 1002157 - protein, 121 aa, Homo sapiens
DRVWSLMRFLIKGSVVVGSVYLVYDQEHAVGPSEKRPGSPTEGWGGGPRPHMYQFSQIRVSADYGLRDTPGTYGPGTRPRSLAWMVSVWRGPSQSLSTIVVRPLLSADREFSGPVHPPSVI

SEQ ID NO: 1002158 - protein, 161 aa, Homo sapiens
AGVCACLLLSWAWAFCCYRCAWYGQRTLTSSVRIFLSRARQLSVCRARSCFRLSCQLDSEHARRRSSLTSSALRCTIMVFVSGALICVVLQRSHSEEWVVLQESCESGRSVIMHSIHCLNVELSAIAHNTNLDERCGDTVTLSFPCPRIMGEKWLQMRTYQ

SEQ ID NO: 1002159 - protein, 372 aa, Homo sapiens
NTETVPRVLRFPWSVKLTTARSPPEALMAALVRQAIAAALLPGALPCPHQPVLCRGLSCRGWLLVRAPSPLSREFQMESLPDCPGAGLRGMSSFRPYVAGYRCLDLTWDPPVTPTSRQGTASKLMRRKHGYLRGCLNVLSISPLFALSTFYQGRGRTGGVAMARGALSSHICYLPSYFQIIAPLVGLYYSCESSVQQAFAYARFRVRASLTCCRDPGGSRNYKAIVYQRQLNGGSAVQCQLRAEVPWEQPIFTLRKSRFAKGPRASRWFTYSLTDAPITPETSTAAPPSLWPRGNENHIVGGRNQKVWTTQRRGTKDGQRGDTTTFATSENTIRCSPKLSPFRPKIDVHFRETKLYSEPPFGGNQRVADQCG

SEQ ID NO: 1002160 - protein, 36 aa, Homo sapiens
MYARVQVFHTECYAYYRPFQTSLVQRPNRVSDGTHD

SEQ ID NO: 1002161 - protein, 34 aa, Homo sapiens
MYIPPRCLKTLAGPCTTDISYRLLAEVRNLEKCK

SEQ ID NO: 1002162 - protein, 199 aa, Homo sapiens
DCRVHLWSIYKPNCIMSLTVAHYPQCRASVSTRPEGAHLVAGSQSGSIRVWRPGICHRILCATLMVTSIESAYILHSLGFASRTGRVCPPLVPRITSFKLWDIRRNGCVFRYRGHMPGRVGCLRFSALMWPCGCAVVPAHDHIRADALWISLPAEDDALSSLVHTGVLVDVVELSLPYEGTSWTSGSSDRTHPLLVTWK

SEQ ID NO: 1002163 - protein, 68 aa, Homo sapiens
LSFSIAQRFRLVLEALGNAENSECCERVSTHLEKARRGLEDTTSGDDRSFQIDGQVQCNPVTRKTLFK

SEQ ID NO: 1002164 - protein, 426 aa, Homo sapiens
VGLIGGAWAGSADASLRASDPGARGGRRDCELLCPRSLRPVAWGHKSPSGVPGDWDWSAGHCTYRIASAHHGPVGTSTRHRESHKRGKNQSRDASSDSERWSGMAVASGWRVRHATVAPGTCRWGATSWGITWARTSALVIIEDVASWRLARVHDLQSGPTVGSRSQLRPNNGVSGGKWRTPVGPLEEPGLYNRRGVDKLWQKWGPGATPSRFRTGYLHRASRGKKIHYNTWMRANRGQHVGDPLGKILEDTWDVASRAAKVERQEYGRMSHGGAQGTKAFGTPREAIPFVIWAGGGKLAGTLVRRGSGSRPLEKTGTSKWWTPEGWVQGLGEPRGLEEAVAPGESQGGKMPTDEGSTPQPTSHTPGQSRRYVGEKTGNHERIKRYTSDSRCRKGEEGPRVSKGAIGRRIGRDVNDAVRICALEQS

SEQ ID NO: 1002165 - protein, 352 aa, Homo sapiens
MCGGGGGGDDAFAAFGGARIGHRRCVADVSTLLFDCDGVLWLAGRPAVPWRAFEVLVRVLQMPAAMRLGLLSHSYHISSHKTQRCHTPEDEAAAPVASSSPVGSTRVPVTRDGSSSTGLLALGASYLRLLTQPCPERPPDGPRGRYGCVGSRHARDPARRLCEARLATIARRLLARVGRPKSHLLIGGRESLATDVGLCHVRLCLEWPRNGCLAAGWVALGTFMDARTNLFKVNHLERPSGPEGRSMAVLPLAGGSPRDVGRFVFGWGHPEAHWDHNPGGHSLGFERTGSREYSTSGRGVYPGGVWLLGSHERPRWEEIWLQAAKDRPMVGPERSPLPERKRPTKGADIYSF

SEQ ID NO: 1002166 - protein, 220 aa, Homo sapiens
VGAWAEAAVRCRGWYWEGGREGRGRKMATSGANGPGSATASDSIPRKFSEKMAAAMKQQNQADGDWRSFEEVIMDIGSTPVTGPKKLRLAIHKAALIHAVGYYCPNVNRDWPLSPGPSFRGGHPYQLNPFGIPSREPPRTPIGLGGNPGARRDPSKTWCYPYFAGLPPRPQIVTRLIPYKSMPYIIFLPPKKFLAGPKAHRQGPCGAKFSTCQHDKGGND

SEQ ID NO: 1002167 - protein, 75 aa, Homo sapiens
AVVQRTSSLERGCPVWSSNAHVRIHIRSYAGIVVRIFGHPMGAGPMIPPPRRGALPCEMLCCVGLARQPHGDGRN

SEQ ID NO: 1002168 - protein, 150 aa, Homo sapiens
AETVVSGSREDGGDGLRRGQCPVDSRVSGGPDWFPGISVDAGTRAVPRSGGRKRVGQRKTGGTRRWSLIVRQSKVYLGVLRSTHGKSPDLRADACSATTMSPSGGHALLVMIADVTVSKGRLHVLYLDSTLSAEAIIITETGGARAEKHS

SEQ ID NO: 1002169 - protein, 96 aa, Homo sapiens
GFGGQLSSPLSRLLLMSERYTSVYQFNASAYVSVCGRVYGTGYMGQADDDVIMDAQLRRADEMYCANAVASRLELGAGCVCRRVGEADWTLGGSSA

SEQ ID NO: 1002170 - protein, 159 aa, Homo sapiens
MGGKHADRDGYITSFNSTTRDTNAGLLGCLDIKRAQRPGLGTTSLSFALQRTPHKNAKETAYYGNQSTVHVTPQCETRHQSTTTVQDIDPSGAPTMQAATSTKASTLNQETYKPWWYLAKGYHMPDRRVATREPTVPLHADRRKPCDTKWSCRFHEKKN

SEQ ID NO: 1002171 - protein, 372 aa, Homo sapiens
MFHAPKKKQDVRCQQVRPQIVRVLTEDEDGAPQKIRDEANGPGIERTVAWQVTTVATRHGIRYYIQWRYTTVSGHVGEFPGRVWMGLHRKHWDDWIDHRRTEALGILVKTGMASGKPAVDKETSAMAWAVQGMEALPLGISNSPYNTRAREGPTKKSWTVGSDSMRRGPVVPCEGVPGGMAPPSKHGIDMYNASLGEKGTTWVIAVKTPAKLEPLGKDATWRYRLTGRDKDKAHYTSIFNPPVRKRTVGGSQKRGFENQAWGGLETALLPEKFDAEAEGTASLVEATQRKPHFGETTLSRLSGHNREPHTAVEVGEHLRAGDCCLMAYEEHHGTTIGGNYRQGGSTLPATVGVGHTDEDDAKKGTPEGGKHH

SEQ ID NO: 1002172 - protein, 31 aa, Homo sapiens
MTRQFNLSLFARLPAAIPSSKPNKTPVNARK

SEQ ID NO: 1002173 - protein, 111 aa, Homo sapiens
MGPLPLCAGLRDDKKTGDSCVRTANAAIGLIKVNGRPLENDMTPAPRLHCNEGCWRPDLVLSRPKGKPSFACVYDTPMLPWYKRLGAFTVAPVFDAYPVYVHSHYKPLWWA

SEQ ID NO: 1002174 - protein, 200 aa, Homo sapiens
HASLFLVDYEVHNSVTLNTQCLAIEPTEIENSSGTVFITPRSGNSHYPPDHILQFIPFRHRRTVRAATKFVLVRGLVMRTSAVVLGVFTRLTRGYLQSGTNILCDLLCEVVAGAHCLHLCSVLQWVCCAPIMSPLKWCCREAYSTNIVCCHTRWCHNSQTCGKARRDICTNTALRICLFPYNVGRVAIVALNSPPYVMCL

SEQ ID NO: 1002175 - protein, 216 aa, Homo sapiens
MVSIDDSGHEKTLSSVVKDFLKGNIKKELFKLATHWTLYFDSIVRPSQEEHGAQEGPSSLSPFVLPQWSCHRKEALTKDMEYFFGENWEEQVQCPKAAKKYVERIHYIGQNEPELLVAHAYTRYMGDLSEGARVLKEGGQGALKLPSNRGRDQFYLLRMWTMPSRFKQLYRGQDVNAWDLNFEDQERIGTEANKVLEYNMRDIAMNLGHAVPMAED

SEQ ID NO: 1002176 - protein, 51 aa, Homo sapiens
MTERKQNTKEVLRDGEHNTNGDTTDIRTQPNPCSYNSHTHTTLEEHDHPHT

SEQ ID NO: 1002177 - protein, 66 aa, Homo sapiens
TAQVCTMAARLVRRCGAVRAAPLSVPVVGVLVARCVRRLTQTPCDDVVCVGAGGLVGAAMACALGY

SEQ ID NO: 1002178 - protein, 278 aa, Homo sapiens
CPEALFQPSFLGMESCGSGKRYIANVYWNVCSAPTQINLDVHLRCAVLGPDDMDEDGTFASIRLNERCRSSTFGNIELVMHNIAAMSLRCASNREVTLVIGIDEASQHMSITVSMGIQRRIVRLHHTISDVIDPIDAANGYLTVVATREVLSTYRARIYWISTLLPFNRPRWDSDQKACGRYLTAKHPEDKIAKLGAQLVHIMSLLMWRERIELLRCSRFNIPVSWALKRSDKTLAARIVTQDLKNVGQLEVRITWERSRKIMVHPDRYWIQMWLSTN

SEQ ID NO: 1002179 - protein, 408 aa, Homo sapiens
MAVCPRQPLATSPTTSRSLPYLPRPSPSGAGSSVRLSVLPPGELAREHSRLGFFAEALVGRAVITVALTIALRLPSPPAFEPGMCDQGLASFTLRVDTGRVTDAGQYEGTTKAGSNCPFNPGVMTRHPLILEHFLSASMRVTRLNHGWVGYNLAILLRYLLATTNAALPVYTRITEWLTTHTLQRQELGDSCQPFTPQTSNPSLRRGPTCPLSGPLEWQITPVIRWLNPFSPMCPTGTIRHHRSKAWNQSLRGEPIGNVTPRKHFSSPPPVDVTVITRGKGIRKEREPHHGLDKKTNQFYSMGAYMLPIPNNDNAGQGYSELPKDCGIRTPAHNMASMPTINVAPPDGRTTGYAPGVPGKHRSFPGTWTTRWERNSEGEEVTTEIHAQDSPISRAAAHHEQHLVSPRH

SEQ ID NO: 1002180 - protein, 180 aa, Homo sapiens
VLDLRVAIAVASADPGLTGPRCDQCQLRLLQSLPGVRGLPPLRPDLLTADRPGAGPERFGRLRNATCQHCRSRALGMEDRGLASLDPRMQRVRLTHDPEDSFSDKDHRTSQEPGGWLQVDQMPFLYPQRETTPGAMQKTEIHAPLGSERRTMWSHYPAEGPLGRKYLDRGQAFSDWGRRL

SEQ ID NO: 1002181 - protein, 84 aa, Homo sapiens
MARQKKTKGVVDTTEGQYSIQDTHTATHKEENPKVGGTSARNRDPPNTRRRPGPPAPVARHIARVGHGARHEQDAQTHHRHTDG

SEQ ID NO: 1002182 - protein, 435 aa, Homo sapiens
EGPRAEGGRGASGARIVLILAENFSRSVKITFKVTSASAHRSERCIKVSRDWRTDVRDTRVSGLASSYHSTGASYSARQKAVEGPSPPRSNPRYTMRSSCPRRRASGTRQSRGKTVTYSRAAADTCGVWYGRRTCKACPRLLPILRRAAHGAAARTPGRGKCTRAHAPIRAQRYPHSRQTEGETGRVEGHLKTALSGHSGQLSWTAKRVPPGGKSPECGHWYSPLGGEDEATQYAKPGYRRRTVCNWTPPDLEGTPHWSGRPPANEEATPNWRPPLCGLTPFFLRGDGQNQNTKVSQGPERGTLRGGERKEAVEPPDDKREKGAVGKKTDTPPLDLRKKSGPQDRIKRPNNPEERAIDMEAATPITPPNEVIPIYTGPQWTEDTGGGATRGIRGSFHTGGGAVGHPKQNTRLDGNGTGARRGGLGGADGGAHTGK

SEQ ID NO: 1002183 - protein, 93 aa, Homo sapiens
TRRHASPLHSRPHSLDNGCTGSRRQDRPGPHSAESPCTQGHIPSINRLHGLSGIRGVCPQTGMSLLDASPETCLSDLRCLLDWQSCAHAEGWL

SEQ ID NO: 1002184 - protein, 191 aa, Homo sapiens
MLEAEGMRVVTNVSIPLEALEQDSKTVLMKCRMSGELSKTLSAARNWNARGQSSSQVPMLLEVIQHVNIQNLVEQQKRNHVGPVLNHNRLYRQIIPFPSLFTSKPKYTSTDRAVTRLSVPCFPLTTQRKTPLTPFYYKTRIAFGQCLQFLAFRSSLSVRVQTDNRRKRYPALCSTATVVLCRGVDPQGVVR

SEQ ID NO: 1002185 - protein, 207 aa, Homo sapiens
PRVAHASRCAGPAAQTFSRPLPDPTAEPGGCNGSMGGGGVVAPRPILQCELTHSTDQYHVMHRTMCAGSIARVRTGRAATMLRRLCIAGHGRPTRLGVGQGQDTARCQRRPRSAKGSTCRRYTYPSSHASKQVACFGINVGVIPVRAYGPLDSQRELGTRSRGSWDPHTGWPTGSESYGASTQSAMCHARGARANGWQNEGVPSVKP

SEQ ID NO: 1002186 - protein, 450 aa, Homo sapiens
MAVLGSAVCIAQWQSGTHASMPAIWRARNGWHHPSEEAGACWRGWLAATDAVRGGEGLHVQGVWSTELAPLSSLQGVVQPRPLANQASCDPVSFGSGVLSTVATNGGAERRAEGRHHSTVSSKQVLGKSCWAVVPAGLTSLVKSPRQLFGEGHRGDWDRNRWDGPRYGSKDPTLNGGQALTDDPVVVLPTTQSFVCRTLIYWPWTDGNAATALIEIPQGIGYALQWASKATGRDSSLNWPLAGRCFWTSAWHALDGSMLRTLVLSHHLTHFTLKDAVRCVCTSPDRPMTCNARLAIHLPENRHVNAQTRTPFGAMTPEQVRYTVTFGAFGYQRRSFTIRATIAHVSPAQTALTSAHSPAVAYQSSRWGQVETSQFRTRYFGGAFPAWNASGSTASEASSPDTSLVSARARTRLGISLIIQSALLYPYPSWNAEHHCVSCRSHGSALTTCL

SEQ ID NO: 1002187 - protein, 179 aa, Homo sapiens
ERSSALGARPSFHKNVYGTLNPVQAQLWQSVDPPLHATKMHSGVCLEPKYLYLGLLHDGIASYNKLIKQDSARPQGVVDESHQWIEHVVIRKSEQLVTRDRYIDLTSYQRKVPRDRKFVELSVTESSGLIVGHLESRVNLGSAIERHLTQLMNDVSESVMSSVPVTRGVVKPDEALSSS

SEQ ID NO: 1002188 - protein, 337 aa, Homo sapiens
DVFLQPRTLTAPCPDQESSERQGTEVHGSSCSLVDPRASNSEMLRWDEKKIIMTPGDYMIVLRTEADGTTEGGVETVMAGVGIKRDEDDASSCVDVRGSLEEEGTICAPRHKETTSNVDDVHSRAELLRRTRTALIKGELLNEDSRCTLREGQIVDSKKPHMNKLRSPRGTNSNCVGATSFNYVALLLIRLRGRMALDARARRGVLKDTLYGTQQGKHKGRNGNRTWLDLLRKHGVGFPKGIGGDTQSSESRMGRSSDPRDQDTVEDTGRPLNGQNRTKPERKKIKQQGGGPPEGTNGRPEVRGPGVTVNPQKHERNDERTRGNHGERARGTGETEA

SEQ ID NO: 1002189 - protein, 213 aa, Homo sapiens
GRVGEPRPPLLDPKSLTKEEYYRKTLEEGDIRGCILGEAGKKDVSIRGTGLLEAELVTSLMVGTHSEGIRMVADEAMLVKLEYEMNGGGKWHGKWGPGKKYHHPSGEQTKTGQYSALTPRNPSYERHNMEHHPHDHPPGNILSKAHHSAPTPSPHYIKNQTPTNPRSNQASVRTRTRLIPTAQHPPPITPPHARPPTAAPLKKPTARHNHQTT

SEQ ID NO: 1002190 - protein, 103 aa, Homo sapiens
EEILSERRYQPRLSGQQASCRFCTWRRIMPCTYRPRRGSCFAEIPTSKRMPETDLVQEHYVDATLLHNMYAHSHHTTWDGVAFANRLTLCLAYILYWKKMDSL

SEQ ID NO: 1002191 - protein, 202 aa, Homo sapiens
MEWWSRMLYDVYLSMLEYLNGELFLGDPPEKLTLEEARGTAESGVHRLPHGQLYAAGMVAWTLQSMMATDGSVLLPHRDTQPVHVVGAVPGVKTLFLFPNQTGFPNKHSRFNVYCFRDSASLLSIPEASKPCSNQPLMDQRLSSQLTDDLEELQLPQDATESDSRGGHLDPSPSVEEDGGGSSIQKTKRGALRTLLELNQNP

SEQ ID NO: 1002192 - protein, 169 aa, Homo sapiens
MGGPPFVRGLQSVETLTQWGPHGALGRHSRPWGPHDKRIAAHSEKPRSISAPNTKGDASGYVRKPISGCEPETQGGPKTYTTLGYPYWETQCTHHYRTARRRTQGDPLTPGGLASQESRPQKRQATGTGKGAYNGTVRGYPHIVAEKTTQNREPPVNPHTVRCSEQTPA

SEQ ID NO: 1002193 - protein, 107 aa, Homo sapiens
MSGRDVSLRGLSCARANSLFLVAGGYPAYSKDSGLLTSIHAENGISRNSLNAMCLGFIHADLEVRLTDEWRENCNSGAFRLVLQTRTGLVYLLYYTEFTPTEKDEYA

SEQ ID NO: 1002194 - protein, 390 aa, Homo sapiens
TALAQSDRIGTEPRWRRTTDDDSAVYPIVGAHMTNSASEEYSFALNSIKEAVPPVCLVPLWVERSRSELLPFRYRYHRMMRDEVAPGPAQNMLGKPFSIAPGWEAQQLRDTCTCLTARSGVRLGPISLRRQTRWVRVASARWHAPLTGGHSSAIGASTLARDPWEGRTFVCSRAGKARVGRGLADLCFEPSPVDARTLQACYLRSGLPPGGCPRCLVQGAGTVSQQITFATPGASSIDATIGVTCVCSTRPIHSCGAVMRIGSLGDWDHTFQRRGESSPACNSKALAFCTKQGTRVADGMGRVGGRCVEHYAQLTGPKEGILGRALGDGPTHAPQDRWKNKSMGDVLVTMVADKFKGGPDKPGAARNHHNDLDQHPEPENDGKRRKAEHS

SEQ ID NO: 1002195 - protein, 147 aa, Homo sapiens
AEELTTILRQSDCRHSTNTCRHYSEGSRTVLVKERQEEPCAQGLPFIESTVELSLLCDMTTKAGSGLTNGGVNRKATGYRSDYLSVMYENMIKGVTLGLPVLQDEGLDVMLISPIYIVVIQAEWVSLLTISDNPLWVRTNIIQHGFG

SEQ ID NO: 1002196 - protein, 236 aa, Homo sapiens
MIDWCKRKTEDGGVWRKNPVSEAHTAETAVKGVQELGRDKLTLTQCCDDAQVARHAVCAQHSPFWRLSEKGAADNGQAKTFRASCLGSYLLANKSVERMEERTQMKGTIAINLGIYNRELYAKRSIMPSTFSSMDVVSHEPKFHPWRNAGDVAHKKRPESTRVMRQGTEGATILTALRRQEALRGETKDPVTNDEGSLECRRSTRVAAAGPALRERTYYHVPSSLYRGAAGQVDQG

SEQ ID NO: 1002197 - protein, 105 aa, Homo sapiens
MGDAEMLLRLPGADDDRPRRQQALTSVARPIRCTENGQRVKSEWRFIPRDGVKRESPPLEILVDRMRQPGALATANRGQQRSRSQVCMMAHGLEVSRNGRPPHEE

SEQ ID NO: 1002198 - protein, 142 aa, Homo sapiens
MAPVACFQKLAEYHARYVMAWSQATQRCKGFSPLTGMEHPFSRLSQTWDLLSSAKASREWTRCSPNQQFSGLTIQDGLDSEYRNMPARMAASVSSDSAPRVRRRENRMLDRPPKELKALQRLRACVWASPALLQVIRDTEVS

SEQ ID NO: 1002199 - protein, 120 aa, Homo sapiens
CAVRPEYGRCRTRLSVPLWGSPTSDWVKVCGNSMLEREASSREIGPEPQLSPHRCRRCPQALQQLVMRTTCSQQFLDEAEACSSYSVGKILTKTGELPRQPQHHPEETEEELTEQTGGLA

SEQ ID NO: 1002200 - protein, 253 aa, Homo sapiens
MVLAGRRGMVERCPCGVGPGGYAVLGLLEASLGGLSLSRCDPAGLATVALGGTLRDSVTSAEEVGSMLEDGEGRIDDSMGTLEPRLESGGRTPREDMDRGNHHTRGDPREQRGVVHRMRHGAPGGWAIELKDSWEAQLARTLRDGKARGGSIVWRERLGAGDKHLAAPGKQSAPQTTRNGTRQKDERFDQGRRVTLSLPSGRVQKSRAQLGSGGIAHETNSSEPRKGVDARPQWEEGGSGGQQFVGKRGDLKR

SEQ ID NO: 1002201 - protein, 132 aa, Homo sapiens
MIAVMNDTYLLRTREYMSNRLFQRKHMVIAVLSHRKPRALRRNRENYLNVKSTGCHLDEDRIIGGGKTSGFGLIYDSLDVCIEQGTKHRLTRHGLYEKKKTSRKQRKERKNRLTDQSGGLQKANVGAGNTKV

SEQ ID NO: 1002202 - protein, 295 aa, Homo sapiens
GRVLVSLCSFSNSLLRFATGSRRRRKRESVAKMIFRAAVNADDRPLLLGKATVFARGNSVRSIRFRAELSGGETLDCISSRVTLERRSCLCPGKVSSDDELSDSTRMKLSESPSEAALKDWEKAPEQADLTGGALDRSELERERTMMLALERGWRKQKEGAAAPQPKVLSSDRRVVSTAGARRGQRIAVPVRKLYRPERTRPSGLGHGGTVSKRTYRKRIDRFVKRQIEDMDDHRPFFTLAGLPYVHSLITHPKAVCIYGASRPVELLADMRPVDSGAGGTRGVTRETCKYVQAG

SEQ ID NO: 1002203 - protein, 430 aa, Homo sapiens
QKTCGGRRTRQSEMAWQPPSLVGEHLAPPPRAPDLSVVAPECPQPQPRGVHHGSQLCHQEEQEDGGVWLNATRSRTVGPMSTIHRVLGALPLMGHARKKKKHTAAPRAEHARERDKEAAGRAEREAGRETRGGGEERAEGGGERRGRSEGRGESQRGERGGSGGERQERGQREEKRGRGEESRRGEEQRTRTRSEKRRAEGEAGRERRRRGGGRRGPAAEERTAANSGAAERRGEAQEKGREGPRRRRRKRRNAGTGARPTKDRQGDEQEGRQAKNNKERNRKQDRRGKKTGREKDARERAVQRRGRSGATGEKDRGERKRRREEEKHADTQTKEETGRTGDRDARDRRGTAGSRSAQTHKEETDRQDKAGDKAERSEEKEDGRTDKKEGREGRTRERNERGEEKREGRRAGSPTRGEQRGRTRTKTDGV

SEQ ID NO: 1002204 - protein, 203 aa, Homo sapiens
GHNDEDDIGTEAMEAAEYMSSRPSRQNYAVVVPSCDHSYMAISIQERKILYRAFTATVCVLVTNKRTCSQQGGYRMCRRLERFYICCPGMLSGISYVHTKLYMLDGAKILCPRRHLTWCVMDAHLSALRARGRSYPCNTSLERDHHDFMESTEQQAHTEETVTLGVSERKRRRAMDLVIPRQEKRQHFVVARNSKWWSQRMPL

SEQ ID NO: 1002205 - protein, 40 aa, Homo sapiens
MALAFGPKIDRPLCSVAPFCGGGQGPPKVEYIDIITRNPH

SEQ ID NO: 1002206 - protein, 146 aa, Homo sapiens
VWLGSSVDGLECYQIWYGIWRLGPARRALAGSCGSSCLVWCFGAPQTAVAYEWGLCCSTAECREPPPLDRVYEIPGLEPITFAGGNDALSCPVLAAGRIYILPLVTSWIQWTRRVLPARPLFTTHPLYKDQACIISFTTVPDFSRV

SEQ ID NO: 1002207 - protein, 257 aa, Homo sapiens
PPGRRTGGHLLSLEVAVACEAWWRVQNLCWLPGPSGPPGPEAGAGVCGAQVVEKAGSRRGASWTRLAEGGFVPLDVRLQAFTSSQDAHRDGRSLPLACGAFQWPSSHIGPHSGIRMHLSAVYNALLVSVLEAGPVEALCGSAVEHAATLAARKLALSRKANRGQPQQLKDRIAERALADPDWRAWNTTLVLHGARHATQDRHLAGFKWLLQTSNGGLRMFHISHWANNLMSWLAKLGATRRTSKTSPSRPIHRWRTT

SEQ ID NO: 1002208 - protein, 116 aa, Homo sapiens
MKRGPSEDIRRTKRCPNEQRGTHSNPYRHTVYPVETPDSYSVMAPQGTLLKGMVHRLRTQQVHSNQRIGGTDGDHERIKKAERSQKANTRATRTQLTDPEDARPGGKDDKRVAQRI

SEQ ID NO: 1002209 - protein, 321 aa, Homo sapiens
CCMQRVLRAAQLFLVTALPPWLPQEDAGGGVCAELCLLPVCWCEPDACVHVPLLCELPLVLEVVACTGSAALPRVAPPELCCLWPPCCCLIALNEALALAEIGACDSGQLPRCPDSRAPQPGPDILQAPARGELPVSRAPWQLRPGRPCRQDAPWRRLRRARLLRMQKLEHGFSGASSMPVSAGSMPVLPKRMRPVMARLRGEQEEAGPSSSQAGASNGVAPLPRSALLVQLGHCQASTGQARHLDLAVSSLKTGPRPACLPTSCATVSTENLWERGFFLQCGWQVGGDFLVYPGDPSDTRHYIVHAGPKNIQSRLLCDAE

SEQ ID NO: 1002210 - protein, 149 aa, Homo sapiens
MPGPGTDAGKIPFCDAKERNPCRGSKALRGGGGTGEAQARAGSWRNIVWRNVVLMSLLHVLGGPVYYPGGNRPIGKPFNSALGAVHSGLLSLGRLWGGDKVVSNSDYVEAKGILSGDKAAFWRNIPWLYASLHGFPRTDIFKWPGNTGP

SEQ ID NO: 1002211 - protein, 193 aa, Homo sapiens
PLASPTRSGLRRSGSCRLDGAPPARDLSEPTVAAMHRSSEQPKRHDMTVYPDRSDDGDHDSVTQHQNEKQSGHSVLEITRRPMSLARSDGPQQEAQPTTEIQPPGSGQVQVRHETQRRTSQKTPGDQPTSTLPVDTRRGAWRTRTSDRNDKSRYREERKGGITQRNEHHIQKAEIKCGSDTTGNRAAHNRQTT

SEQ ID NO: 1002212 - protein, 205 aa, Homo sapiens
MNKKKKPFLGMPAPLGHTMPGLGRGATGFTTRSDIGPVRDANDPVDDRYMTPHRQENRWGPDEENIMAADDDDEDLNCHPITMSLHGYCWETSYSSGPYDEPMTDGTQMLSMQPWNQHRMADNEENEQTGAHRETRHTHYEELSYGNAPTIQQEFQNIKEENGWPARSTARTEHGIEPIPPKDMRRRNRNTTQTRGNPNANRRND

SEQ ID NO: 1002213 - protein, 385 aa, Homo sapiens
LGPGLRVVWGCCAPGVLLLLSYRSSFAHFPLPAVVGAEKTCRTPWKDERWSAFANERWTNDGARTKHAGWTHLDLCYNASLTTTSYDPVELTCRVPPTTLATLSLSLAYFANARTYHDLTGHVNPSFGPTVLYHSPLLGPTPLSLRLGGQFNLLTNADPFETDRIDPETRQPLANRYPLPGTTTMTLLTAHPGLTSQHRTLPMACAPHLIHCRHPRHTRALDVNQQLPLVRTSPSQLRVSDHLHCFPLAWRPDPETCPPPFPLATYPFVWPRGSTHAGLAHGGVQCPFGSLLGPCVSLPFSYSRHHPHARCGPLDTGTPHSYGTTHLVGHGPCAPGHAGTTAHRFSRWHLPSPTPFVHRRIHAPYTSISFRHADNPLSHAHHLPD

SEQ ID NO: 1002214 - protein, 140 aa, Homo sapiens
MGECCLPDTVLEAWQSPTLRPGGGRMWPPGCQGRRPGLWPLSAVAANAPNRPCFGAHRQHTRGAGSRLDGALLALCDDRMLCPIRHPDISNRFCDRSLTAPSGRGIDELTLWNHKWGKFTYSQPVTILPFELCTPSPCGT

SEQ ID NO: 1002215 - protein, 70 aa, Homo sapiens
LYTNLPKNLLNDNIHSHENSVDIYDLLRRTTVIPTLVSSPDEANQPERLIAGTYFLDSTPYRLRYPYSSQ

SEQ ID NO: 1002216 - protein, 283 aa, Homo sapiens
LALASEPSWLVPFSAVVPAPGGPEDVWARAAPKLGSGGGAVCRSAGLSVAAAAPRVKNPEEETATTRPRSNWSPNEELAANNLNGENAQPRKRTRGEQAPTQNEEESRHSGRRAEGQKPGRHISGGGELEAHLSLIFDGPYLIGTIEHNEAEQMTVQTGPQRQTDWTTPAERLRNSTMRHYMPLSKTPETLTTHYDFSLITLQPPTSFRCTVTRDHWLYQLAIPVTHIFCYSPYRRLHTFNPGFYLAHLATLLDSSLPVLSLTRYGHLLRFHPIPGNTTLASY

SEQ ID NO: 1002217 - protein, 306 aa, Homo sapiens
LKAKEGEEAGPGDHYWKLFPRLGDEKDVSVVTCPDYRRSCFQAPICPVFRLTDEMPSRPLLTFLYLRCSGQPGGPAQPSLASPLLSTLQRPFNVSASDVTRASTALHDPPIQHHAQSPRRSPAAHGNKVTQARLYTGSSGEGLHQTKADTRLSRYTLGPPVSPTRYPPACSRVLPTPGQPNPPDSSHITRIHQTCSQHNPTHTPPTTRTTQKQIYPQKPHTNHTNKDNTTGKPTTNTNQSQGKTRTARREERERTRSTEYNRRTDGLPAPAPELTPRKRKRRRDGTSGGSAPLGSRQDREQGREEG

SEQ ID NO: 1002218 - protein, 308 aa, Homo sapiens
MEAEALVPLAMIVTIFLLLVDLMHRHQQLALHSITRQVPCHCPGLGNHCCMWTNQNTPYCFEQLRRRLRGHVYTPAAVPWTPSGRAPWAGGVREAMVTRGRGHGRPPHAAHLTGPGHSGRVPKQRDPSRKHNGPDVALSKSADYPPTSPHYDAKLGVHCGTRKDRHWSHDGADTQRKCQTLRIMDEPRITAGTQGPRTGPQYTAPNRETPNGTNKDRLDSHNAADTTDTIPQSNHWRRCQPTLASAGVNGNDNPHPNYSPHAHLHLDPIRRSKAQRATFATGRASYQRTLPIRRQQRAHLTNDMGPRD

SEQ ID NO: 1002219 - protein, 185 aa, Homo sapiens
LTHRADPRAATPSTTPRPELQHGGRKPELKLEGRRPVDSVAPEHLTSDNVDIVESSAARLMGTMDAVRRPRVLTRYLPLGGPARTPSRSRPNGERPTFHDRRRSHTMWAHRDVTPDRNSDRETHTRRESPHGTAGTHRRRRRPTKPGTQYRENKTPEGTRPRTKRKHCHRDTINETSPRQHHGRA

SEQ ID NO: 1002220 - protein, 209 aa, Homo sapiens
ASCRSFRLTGACTPCLAQVLFQGLLVEFSDYPAVPRKGCPKPSLEVPIGHGIHFEGLMVFPQEVTLPPGAGCILPGALLDPNCLSPLEGSEHLSSGTSPAWGQTDMLSSSRLHPGQIDQQNLCPRLLAVYPGSGVCQATRRSHREGPFLPAGGTPKITCWMPSRQDTACGCQAAGRRLDRGSPVTVSFAQSGPNKPLWDLPDITLRIRL

SEQ ID NO: 1002221 - protein, 73 aa, Homo sapiens
DDTLICLEEVVVFRLRQHNITPYVMLLEGILTIAATSIAYVLPNPIPRPDFHHIVRDSVVAHRADSIAHIVPH

SEQ ID NO: 1002222 - protein, 274 aa, Homo sapiens
AYAPVSAPAAERRLWNVEVRAESSPRRSGGSVSGALAASLGAEAPDCLCALDGHHQQYGRPISRTGAALECVPEGTVEGMENIRILPASMPVLVIHWNGWERHVGGVSAEGNPVQGPSKSVCGGTREREGTTGLEATTRECSFAFAERRHLCGKQPWVALGANRASGAGGDRGARLGDGHEEGMKPKVVPVGATRIPWGGATSHTGTSPWGVTRPRVPTQCTDGCWSIKGPHCESMRSGHHWGITAKNDGTLGWARLGHLKFGTVATCTPLGNN

SEQ ID NO: 1002223 - protein, 228 aa, Homo sapiens
MAILAMGSYTYCLGHTSARSPLNSDLYPMQQRTGLTTSVTLRPRLQRETMTSYIAATYYLSTSELSTEERSAIDQHTHCRSQIKPKQTISGLYHHFSPDLSLKGSKPFDNGGAAHQYRGFLTINTVCTTSWAIKPQLQNNIKLVSNDRTHDKSVKRTRSGQFTHHNIPNCGPQQMLYVTSPLQHEKDLRNYKGATTNEVTTTRSMLHQCICSAWDKHNQHRYLSNDTR

SEQ ID NO: 1002224 - protein, 227 aa, Homo sapiens
ALLWSSYKQAAWHGGTESPAPGLGDSPPDVGLPKGASVSGDVMGSVVSLSFTRKCKPGDPRQLVRTWCCMSAAETDGSVRAPNEELANSKVKSSSEVSDKFQAVFHQKSDFYWFHATEANPEAVRPFSGVNKAAQTAAGSGKVSGETPVVKDLRAAVLVWNVNQGTQSRCYGGPWLQGKVQTNSIVVRNYIGRDHGEGIRQTAKYPWKTIGEFLGDELHGGHLKGFL

SEQ ID NO: 1002225 - protein, 283 aa, Homo sapiens
MFKQWAPSYGLSAEVNEPAPVHNMTPTDEEAELRTWIEGLTGLSIGPDFQKGREGWNYLMQHSVSELIAGHPVPKIKRSMQNVAAMLEIAVRTSILRAMVRLLGIEPWWTCSRPRTCLRSGNMTQVQVSLLALAGKAKTKGLQSGVDIGVKYSEKQERNFDDATMKAGQCVIGLQMGTNKCASQSGHDCVRHEEDLYDPKNHILTPMDHSTIRLQMGTKQVRQTGGHDRVPGNRRTIYAYASLGTGQVLTNSSHVPCRCGYTQGRQTRSGQVFRPVAADYIEH

SEQ ID NO: 1002226 - protein, 309 aa, Homo sapiens
AWPVSNWLCWPCAELCEHSPVQLAAARAVPAALRRSAVDVASAIQLPGAFDAAALAPVTWVLSSGPPVARRRDAVGAERHLLVLDLRCLEPEGAAELRAVTRTLCLAGDVLAVLLLAGELALARTEPGLRDALFDASYTAAASLPLMAMALDAMSYPDRTVPPSDRAAIQGCLGHLNRRSGEGTPGGFCMVWLPEADPARETTEAHTDVHPKGGQGLDPYNLGRYIPPLTYRSSRHCIVQSTNSNYRLGYEEGSQDWRLSPGPWVHERVAKANPWGKAHDDGCPTNKRLPYTYPTALGDQGPRIPPDTR

SEQ ID NO: 1002227 - protein, 121 aa, Homo sapiens
MRTHEDATMKTLFRPDGTGDKPVHERDAQTLSCTTTTQHPPKPYFDQSASTNRASRRRCPRERAHSTPTVHSNINAERIRTCHDLVWTGTHDVQTATASYSDRQPLPVARQHRTSGSNDKL

SEQ ID NO: 1002228 - protein, 321 aa, Homo sapiens
AEAGSHRRGACRRKPLRGVKMRTTEDYLTLCAVDGGDRQHTDSMKLSAREARHRELLEEGAARDMTRSESPVVELRDAHSPSRPSVPNGSSPSVASRTQRPLREKWKTRIRGLTNGERMLKGTRRERSLDDVLMPDGTGAIDGMVTGDDWRAEGKLPSSYSDIEYERPWAFGKMRGVLGKVGGEEAHCPWSEAAPLKASTLAVSKQTYQQLAWLADGDRSRNPPYHRSTSNRCILKGRLLEHIFHGDAGAFHSRRQCAPWNRTTAGEGTYSTNRHGADRFQRVAKGAIPPRPNIQILRPVPLVAYWSIPEKRRVPSRGPEG

SEQ ID NO: 1002229 - protein, 279 aa, Homo sapiens
DYVSRSRADDLVEKVRREAGAGSGEEEERERERERETERDREKERELEGSVKLGLTDGAVLRRGSAAVSGPSCRHRASSVNTGSCVGLQVSPYLGPDTPACGALSVNMPGHHCPCRPVQVANRSPIAYCAPCGQVRPGGSWGYKCPGVHVLASRSSSAGQREREARERDLRDRLKPGFEVKPSELEPLHGVPGPGSVIPFPDMGAWLCSLGPPGLHPFPFHPSLGPWSENSLALAAGPALRPDHVLMLSGWQLRGSTQTRVAALGNEPLGRVQMLNVTP

SEQ ID NO: 1002230 - protein, 80 aa, Homo sapiens
AVKILVSPWAGDRGVVTGVCKNKTRTQSLAVCARCAVDANDSAVIDSERGWREKGDTQVDACLRFGGHYGCSDDYEQQSL

SEQ ID NO: 1002231 - protein, 413 aa, Homo sapiens
MRRPKMLVISGGDGYEDFRFISSEECGYPRKSRLVGARDVTRDEETHAHSWWSGVDPCHALLGAEGPSATDHDSCLVQSVPEPFLHVDSLQTARSSMQRDGTVFARPGDALAMIAHDVGDFVRSDHSAVEDRFLRVTKDTNMETSSDDHWRLLPTEPASCALDTRGCLSHSSIDVANWGGTNCWYLNNMRDLQRITPCKVRFRVTDQWSEPRHLKVSYGRTLGEHGCVARQGNVEPHIALAENYFFLDADAFVPFRIGAWPRGPLGILDGKVLRAKLVTPPCFHHDSRCDVGTQIGYHVYSRRDTIDSRCRARWISVWCETMAQFESIPELSEGREQATTSKESVREDSNVACAEARVSASPCVDPLCAADASYVWACEATPGGLALNGSFSPLVRLGVQLGTRSERKCAYGI

SEQ ID NO: 1002232 - protein, 131 aa, Homo sapiens
RGAPAVVISQDRVALEDGKMFVTPGAGRFVPRKTFPGDFSSTNDGIQQRRQARLVLCRSHVCATVWLYDWALSTTVKVPAKPGSGAPARASCPGKISVPPVRNLHQSGFSLSGSQADDHIARRTAQKIMAP

SEQ ID NO: 1002233 - protein, 297 aa, Homo sapiens
MQTVLPPVQSVPVCHYPMMPYGGAVKHGTVCKLFPELWPLRAHGCGCFELVAPVHTAQSRDALRVPLASPSPRATQRGARVLAFKLPRCASGVFVSRALPCGARRSEHGPRLRGWCWALWPGGMRLGLDGWECRPKPLLPTAEPGLASLGACGRPETPEGCTLVTGKPAGCWELPALGLGGEPWGCTTRGRWQPCAPRSIHAEAAQDGASLPWSRPACRLNPVNRVQGTCPFWRKVPEPFLELSMACPTRVVEVNPGPRAEIKVVSREAVPILVGRGRETREDNESVVTKGVELPGS

SEQ ID NO: 1002234 - protein, 128 aa, Homo sapiens
MIPWRQRHKRGRHKHHPYGIHETHETHTTKHPALEETHRNHTPEQNIHKAVTSVVKLQWLRKTPHHGQISLASTAKSKGHGHRNEAQKSAWKTTWLIPRLRLRDKRVTPTVHYFAHTMCYASQRRGAN

SEQ ID NO: 1002235 - protein, 171 aa, Homo sapiens
MPRVLVSFALSVLLLSLPGPSSRMQFLVSPTGSGRFPHSGLRLHLSQTVCRRNTACVSYCMSALLQHSTQSPPCPARRPACLPSWLDAIVAASNLRRKQRRRTRRTARVLWSGPWRGQAGWLPGHGGTAERCKPNDPSIPSGTSSVQREETELGEVEIREPVTLSDMRIDE

SEQ ID NO: 1002236 - protein, 120 aa, Homo sapiens
MSEAALYGKEYGTHLSEKYEKTLCLQDILAINVHFMGSIGAIKKLVLPLLGLILPGDAIPHPSMSREEKITYTLPYCLFGWSQGPCENKLIAYRRLLPVFIVMPYELVYMRVRVRIHEVY

SEQ ID NO: 1002237 - protein, 153 aa, Homo sapiens
EGIGPVPWCQSMCSLAGSIALCHSDACSVPRAAGVPPRPVGALVTSAGPAKESTPAKARALRVLRCGAVLGTCCDGVGHMMMQQSAKLLEPKHERVPRDDVSELPRWYLDQSFGGNGILSKSLKKARSDAGGKKALTCINGYQGLPGMDREKN

SEQ ID NO: 1002238 - protein, 248 aa, Homo sapiens
GDAKWSGKASFMKPIFLRPFGDLRETQLLTDCIRDKYEKKKYMDRSLDIMPLRKEKDDKWKRGSEASSRTTKLEPVVFEKVTNATRTKEDPPATSANSSPKSTAPVTASVGASDAPVGLLHWHIVQTSNSLQNASDLSASVPSPSSSGPSKGRRFHANCQGVPALFLTNLNLFPGARAATPDANTARNQLSTDSTSFTGMDPRRLKMPNSKHMSHRHSRLKHGIFPKAKPKLTPGITPPNQHNCGRMN

SEQ ID NO: 1002239 - protein, 174 aa, Homo sapiens
MAPGHLYNIARAYPTSERSFPMGQRGCLAVGLLNMDVNLQQVPSGRVRPTTDPVNCDSHRICHRGVVDLGCNFPGSSQTSPGRRKGERIWHRLASKKYDLPYENGMVHQYGDPLPSRSTPLDKWKKVNMNHLPFSAQTQNGEPPCNASERGVPPCWSYGRHRSELNGLTQFSLS

SEQ ID NO: 1002240 - protein, 370 aa, Homo sapiens
GCSPGSGQESRSTFDKRSERPVPDPCLPERRCCVLLPLFSPAPDGVPGAGGPRCHQLLLLLLLGDLGMAAALCAGPVAPTLELADSELCRFCALTDVPCATCAACWRLSVLLPIYCVATFSRPAQKFRPPAYDHDGLHLLTLSSSLRDNRTCVTPPGHCDPTGIFGPATCRPFNHPHARRSLRRRALSHRHKHASAPYTAHTLHTARFPLGLLEYPPPHTLNGGLPLLCSGTLSALRTNFAGNFTFDQVPKGASKEFATRLPITHTAHATRTFMPPYRRNPNSPHGVAPCDSLCAAQPVKPHRLPHTTPWHTRSLAAAVPRVNPSLGSPVTEPVTAFHAKPSRARFLTPRHLIATHHAYTCWTADNSWRR

SEQ ID NO: 1002241 - protein, 143 aa, Homo sapiens
ISLNCKKSYKDCVKIAEAYSNLIEITDVQTDYSSSTARGYVTSCSRRPYIKGFSSVNDAASLCRLQSVTARVTAGHLLKIEQGCEQRLMNHVLATSSQHDPVLGSSTMRPVINPRAIWPVTVVNVSKNNKNAKFSKDSEDGHR

SEQ ID NO: 1002242 - protein, 428 aa, Homo sapiens
CLGPHISAIAGFPRTSYSCVYSWSDRSLAPGIRANSLSRWTGGVEPSRFRDRVDNDSRGSGPMITRKAEAKEQHLNDRVLQKLPRIEGKTLLTPSPKRLLENGTKLEVPTSTVWLLSGLVDDACRVAGGGPAKWVAVCLTVEDSSALVSPNGYTVKPIVPHSIGLWLLSFSMPWCPEVAGSFSCLLIRSSSSTLTAKDMSVLVRPDLTPEGTNATLYVPTCGSSCPKTLFVPTQMLGPFCSFGYQESQRTGLDAYSCFAICPQFRLCPVETPLTLGVAPFLCGAPCDSPDRTPASSWGREPSCVPQTFFHFNVLHYPTLFIPLMNPLASGHKSPPLFQNGVEPFAVQIHAPFPQLGAFYPSCLPQEASFELAYGPTKPVRSQALGSLRVCGDFNDWPLGNLPLVHPFLSVIRNEGPNILLFNGGAHIH

SEQ ID NO: 1002243 - protein, 92 aa, Homo sapiens
MVNTWLCCLMYRWCVVPNRCQCLPLTPIKTKAQQSRSVDWLPQLASTVGIKLTSLTLQVTGGAPGQRTEELCACSSKTTSIGEAALPGPQVD

SEQ ID NO: 1002244 - protein, 180 aa, Homo sapiens
RGRRIRIRVPRHLVGPPWTWTGGGGGAPETPVVRHIPSPKRIEPPRGKARSGQTVGCQLPVTMACPPCPHPSEVVPGLHAFMPQDALAMRALAIGRATGCWPPRARATCTTCHLTVWSDWRNADRGLSEHSSFIASQPLSTPPNCAHLNGVLDCFMAYRGAARDPCSTTQDTTPPVPGVQ

SEQ ID NO: 1002245 - protein, 183 aa, Homo sapiens
AKLVLHAHRKELEVPPACDASNELILGMQLQEEEGKPEEPIDLFENLLVLSPVCGHPHMRPLFTQEARWADRGAGAFALVLCSRVMTLLTVSSSHYSPVPGPAERLCLSVSSSPCPQAVRPVRWSSSVCIPAMATRPCYDAPSDACRDGTGAHRDPRTRTRQQLEGLESEAILSDSSFLLWHQ

SEQ ID NO: 1002246 - protein, 312 aa, Homo sapiens
AHARTHAHTHTVRAQPLRACGRSGGLLCGAAEVAMCPGVAGAAVLCTVLRDSARARAGCAPAVDGRRGCWPRVSRARGSRLCCAVTAEGCCGCVCMQSMRCCPREAWNPHGVLPLCALAAWPFKLPLTAQARGFTGSSTLWEANLKQNFAWIWQLSPFNTNALLNQLLTLAGNGVPRQRLCYFPFRMCQWLDGAEREKPRYRGNSGHNRTNLFWRSWPISLENECQAKRSRSRKNLSSREATWPWPRFLRWRTRVLKSQTFPKPLARKGGFPWLDALFPTFPFCKTAPKFLNRRPPREGKKAAQAAEKFFPR

SEQ ID NO: 1002247 - protein, 205 aa, Homo sapiens
GDTAVPSGSSLIFWHLSEKMMQGYLDPFWSRICEPCEQESSGWLNPTSCTSEIVSLRILQEQTRKRVSIYALDLSDRNIYNIYEHYLAFIMYRTGLTVVTTGALSTTEDLVNYADDAEDYVAQDGGNLIPSKLGMWALYRHHMPRVQMTDFRHIVVVLGPNYDAHRHSSRIVDIRGKIGLIARRRWQIWIDHNALVGPCQLHLGP

SEQ ID NO: 1002248 - protein, 338 aa, Homo sapiens
GAGGYADNDIGAVSTTGHGESILKVNLARLTLFHTSNKEQTATNEAADLSLGLYEVKGNTVLGGLTRGYANTGDCGAHQLDPPTPCPAAKPPKAPASCNFGIDSLTDTTNQPSTIPKAAWKNLYFPDCLRLSQGPTVTKSSLDSGHKPLIHTKIFSNFATQLASPVPCHFVSRPPFNYSILEHGLWLCCGEPGFPRTAHCSKHTLTPGYLSGRHSPLQTPCGQRVQTACRLQSPSGNFTVPDLGQHPQGTLCSPHADTPPGEPPGLISKPPHRHPQTRAANPHRTSNGKQADATANGNVPFGTIIDTHEHALRKRPPNKDPLQRKPPCQRPAKTDRHH

SEQ ID NO: 1002249 - protein, 95 aa, Homo sapiens
DFYVIGSSYENELMLMAVLNCLFDSLSQMLRKNVEKRALLENMEGLFLAVDEIVDGGVILESDPQQVVHRVAINGVEGLVPPLREARNRWFFRLP

SEQ ID NO: 1002250 - protein, 138 aa, Homo sapiens
MYDHAGLTTLPGLENENSMPNDMTFLAAKLNIKAFSTRITSPIGLLPFVTLPDCLTGTGVDTGSCMGRLRLNDTLQLQLYLFSVLLAELILTESDFVFISFQGLGCLWASPGGLEVGNRERNQTHDCCPGWFCGLEAQ

SEQ ID NO: 1002251 - protein, 216 aa, Homo sapiens
RQWWRNGSRPRPPATCSRLGLPRPSPDLAANLLLYQTEGSGGEPGTAPFVSASLPFTLRLLAETLVAGACARYAAAAVTGSGCHWNNCLDRTGSGLAVPCHVCAGVCGACAGGHLLDLLSDFTFSLTHGLQQSWSPGGALDLGARRRCLHGPGHTRNTHRRQSTNTDYSPYLGYQEMGYVSSSALVTDLDTELLRTHFMSLITKIDAGQDDQSRLL

SEQ ID NO: 1002252 - protein, 69 aa, Homo sapiens
PGTGPRTFWICRPTLSAGLPGRVTAMVVLPPRSPRCTDTASASGRRQELLSEPMARGPADSESNSMTTS

SEQ ID NO: 1002253 - protein, 103 aa, Homo sapiens
MSDWPDVENYSGESSWNYVPTNGYNTGSYMISDSENACPAEHFGQQRISPLNLINLMTITIRLKWHLVTDIYIEKQETHHKGSSNLGYATRRKRVGLGIPGTD

SEQ ID NO: 1002254 - protein, 176 aa, Homo sapiens
MEGGPDVIFQEDTSQHLCRRRPLSSGAQNHPDPKPEVLCYCGGPALDDDKDEDTESRQSTVTDESEMQDMMTRGNLGLLEQAIALKAEQVQHSHASRAARLPSRASCAWAEPSGRQQRPLDNCAGRDSLQVTRSFKSCEAVSIKVSNTKAVDGTGPRYRACTLNTPTTFWTVHPKD

SEQ ID NO: 1002255 - protein, 230 aa, Homo sapiens
MSDGAAHALALHRLTSHLDLLAQEPCLALPPLCCGTQHTAFQPGGRTTHTSKTHRKIPGQEDRKQATGRHAQHTHGTPPQSGRTSIREGASDRKQPPRKRKTHTPSKGKQTHPSTFSNASTGKERDTAAPHPNTKLPKTTSSTIYQNESGGTITYITTLTPRNHNRANKTQASAEPNRYGVRRAATQTKRESRTELGQGRDEKYTSPNHYYDVEWQAVSIRNHVTLPRAY

SEQ ID NO: 1002256 - protein, 514 aa, Homo sapiens
TLFPVHQYSWPSLQGPVDLHGEQVLCQTLVSLFPGSLSSFQHATEGLAWASGASLIESGDSAASRSGPVRCQGSLDERMKGVLERQTSRRDRAALRTPYSHVTGDEACLRRTSRNAGTCFGRSLTDPGDMHVAPTMVTSKDEDECVSQSYVSTDHRHGPLERPSRSLIGLRVPYRKRTCSLLVRFRCKHLDENSPRYVLADLALAPYLKDAPKSTEEPEGVVGEWRPRSSCCEAMGPYAIGCFQKRFPLESNHSGVIHRSSNLRTLWGHRLQDLQIDASSHLVEVDSICFRYQIGDEIENTSTKTWDTVNREGPLPTGAHRNFDPGTSLQRIYGHQVWKRKAIGRPTTEFFTRVTLRAQENFDWGRDQFPRGPYIQFDLNGLGLSGKRKHRVNGRPRTQQVTLGSYRGQGFWTGRHANQPVGSTTQDEDHGRGRGIGDRLGFVASRNGFHPRRLWTKTDNTVPQATICARTFRHRVEHPSDRQILESGPSFGSKQASHGEEVKKGRGIAAYHEL

SEQ ID NO: 1002257 - protein, 107 aa, Homo sapiens
MRRAAVTSIWTDDCSGTCLAGDGHGGHLESDSARKGGPDRAAEGRVSRVSVSTGGQTNAGTKTQAPVTCTLIEMNQTRHQIPRQGSVTSSMLQVHSEGVVHASLTSG

SEQ ID NO: 1002258 - protein, 412 aa, Homo sapiens
MIPWDVGIAGITRRLDKRICIHLCREEAARCSDVTWFASCGEPFPHKLTDADSISGDWAPETIGEGLARGWQEHPSTSVDDADLVSNACPDDENGDKVLSQHSVEENESSEPPPSAPYPPEALNECALNHYTGELTRGLQLQERIAPVEIRLGQYCIVWSHWEIRVPLRGDSKEAAVDVGPWDGDKEVGNMGTRETRVSTFDAVIPYMWGHRNASPNSGAHRTRGSRHTLGPQASARNPLCAMGKHDRLRTIARRIFTTYRKGATLWLGEAAEWGKATAFLIGPWWHMAPVYPSIILDSGATNSVVRPKDDGIGGAATDATNGQIPPDSVSPKRQASSGVTITPVSMPHPPKGCAQERGGRPVRQRHPRVEQGSHPKDAVLAPTPPRLSHGLKAPTNTDVRDDTRPTGTYQT

SEQ ID NO: 1002259 - protein, 221 aa, Homo sapiens
ETIKVRQWHVIDTQFHVNFSKQDKDRSSEDRQFIRVDRRSGVGSRIWRGMDELPVESLLPLVVVTVRSDQCQPSLCLLLEQNSSFPCLGTRVTCCADAGCPEEQEVSKKTICRVQKPVTVQIGLPFNIWAGLAPGQGGENESEELTEREVGLRARTEADRRLWRVDEKRAGQKQSEREQEEGGTRGRDQQAKNKDDTPRRGGERQRTKVKGQGDKEQNGKP

SEQ ID NO: 1002260 - protein, 174 aa, Homo sapiens
MGVHPNTDAPFYLSGYDLSRHRPFLVVWTLVVVLGPCSRQPHDRSSLSEAYSFTSTVQSGNRARHQVRSCGYVALDFEQEMGTAASSSFSGRTSYGACRMGQVITIGNGAVPVVPDALFQASFPGSGTCGFHDTPLTPPDVDLTSNTCSHTSVADPQYSGLPRNPREPALPALI

SEQ ID NO: 1002261 - protein, 134 aa, Homo sapiens
MGCSRLFRSATYTGTYVYLNVRVRIQGTIYALNMDVRLLDQWKPLCGGEIRNDCAKVTTKPSLETLMVAEGRARIVVDGAILPDEARKRETMMRTVPEHWWNSSSGVTATADCMQAKRACDVASTLGYLLMVSV

SEQ ID NO: 1002262 - protein, 342 aa, Homo sapiens
EQVEFAGIDPVLSISLLGRLREAEEGGKKIEELFPTPGVTFYKEAHHSCDSHDPCLADGFSVGTVEDPGLGELSDLGLILVDLIIGLIRQGKENLSQLFSFIDSDDSIYLLATVGPQFSINVVIYECPMGPGAGSKIFLHLADRPLGLTCARYHERQENTWETKSEKNTADSPSCTTATDSWIENREPPLTRLRVGHREKGRTPKEQGPRRRKYRQHHSKKCENPKKLNALRNGTYTRAEIRAKLKREENRRENKRWQRAHGRQPGDPNRRNSPRGPSIQDDQLQCTRYTDTPDLRYGQVTHDDIEEQLSKTNDKQTTTHGTKQKEQNKTTTEAQVDDTAAG

SEQ ID NO: 1002263 - protein, 205 aa, Homo sapiens
MSAYQLWECPTTITSSLTGYAHLIDPINGEDTQFARPPVRLGIQEVTRDDASDVTMSSSQEVTHCHVGPRYDGFKVTDGSLHGGRKDPFGQILLDRSRRRTRERNVVVHSRQGTNDVQRTSSFDYLASCPGYLVALWPKVLLGQLETFLNADQPPVLGDTTTEEMFVPQAYLTRFGAGMSSQRGRPLTKLLLIPYLEIGASSRHA

SEQ ID NO: 1002264 - protein, 172 aa, Homo sapiens
MGLICRWVSGLSLSCSQTIILGLCPELYVIVQWSVIAVGVFLFLVAFRWRLLAGSSARENYCLMITFASLTSPHHVGGGSAQHMCMAYVFRDKVMSRRRNEANFQDMQHRTNLSTRMEECNSGLVSSWVQRCTGRNVTLLVGIGKLGEDLGRSIPYHVEETEVPRLCACINR

SEQ ID NO: 1002265 - protein, 39 aa, Homo sapiens
MRYHASDHIQLPMESVSTSMTLSEGNRIIDVNNAAFPVD

SEQ ID NO: 1002266 - protein, 233 aa, Homo sapiens
RSCNAPLTDRAIGRPWRPGVARGPDAVLEVAPRVAPRCLLLLIPLVAASIEPSRSCLFSEAQMKPVTSDLKNVSVSLVQRYQGLSGLPSSQSVSATGLPFVTCSVCTLGSTCWVNFELLLIIYHVGTLGEPSSWALPILLACLAARRAGQSEPVKAGSRHVEETVPIAVFWDGEAEYFAREGHVRHIAGTTSAVPKHTSMRCKPLRDITRHYQRQFVFTSRLNHIPLIGIVNL

SEQ ID NO: 1002267 - protein, 303 aa, Homo sapiens
SAIHLPKKMQEVVKDWYQDADHQPVEMLSPAMRGETCPSSGQMPCECPGEREGTAMGALVVHSHVTGPVANTDEAMAPETDETRALKTKACSLDIDEGPVDISHQWTCQGPMLKCSQKQCAVDAQWLRAGRTVRFMPQPKTHFLEQLGGPPERLERQGPDSAERAASPKYKRRQWRGVLWKKPPSVFGIARQRGGGTVAVPAEPVNAMTLDPYRGAVKNRTPNICTFRQRDKYNSTMEGPKRPKLTRPEITSSCMTRPGYSWYTVDDSASKTGCFTQILGRARGQGTPCSTSRTLHGTGPPPN

SEQ ID NO: 1002268 - protein, 66 aa, Homo sapiens
NEWYIQHHRRDIGRALVVEHWRIPYAVIIQRAKYEGMRLNHKMKKDMNDRDSKSLLDIVIYPDGKT

SEQ ID NO: 1002269 - protein, 496 aa, Homo sapiens
MLAVKIALNPNDYLDFHAEETEVQHSRDLGEIAHMTHWVTIGARRDESDLTLLASRTCGISLLHSASQEIERSLGVKERVVAMQEREAMRRKRSAQAREVERTDARGSRTLTPSISTPLVGHVEDVLHPLCQPGKGTHLPFTIEWRLFESPPRTPGRVGGTLLQLPRTCALTLCLLHLGPLGKKHSLGTLGGYTYYFVIKATSGQNSAFGELGPPVDEGNHKRRSPSSYNPPVLPRLAGNADWSWSLPYFWKATMPRDSNLPTPSTGQTLAPCTHCEVWSPVHEPRSANPPLRRGLTALSWVTGSPRTSRRPNPLSPKECPACPPRFRQFDTAEEVWPIRPGGTEHVGWPTAPNAPPPPGAPHNRLAYKDSTLRPYLLRYRHLADAKYEVAHHLNRYVSERVLHMQALVGFALCPSSLRLFASQRDCVSWCIPSLRLLWRLQTHSLLAVDRGGFSPAVVVSGPPDVLPPCAAEYRTRIIFTTLDRARDLRSGLHTP

SEQ ID NO: 1002270 - protein, 170 aa, Homo sapiens
ARADSQRAQGLSSWESEGSKKAGGHGLPAPAGLPLRVAFLPRGAPARPLVERLLRRAEIIVIGSREWACVLLSLSLSPRAPLLIRCPVGSRHSDVLGRSYLTQVPSVETGQAYATNSVAIAFISLSRTRVALILLVAWWGNLYSWYHVHPISPDYPRDLVTLIAGGRGAS

SEQ ID NO: 1002271 - protein, 166 aa, Homo sapiens
LVSERRREPRPSRASKRQSRVQGGPAWGGWGEPGGLLVAPALLRSGPSGPCCCLPAACLSPALATMCPGAGPRLSCSPSPCIPAGPPPGGHPQSRVLGGLQVFVPTLSSSACSGVPRSMPDVYLPVVLSCKQLSQHYHMRVPSYYQEDNIARERGWHSCANEPGEM

SEQ ID NO: 1002272 - protein, 268 aa, Homo sapiens
QNTKWLDDCRCMRVGALGALCVPCGWGTAVGFRGVFRHVVHPVGLLVCRPVDWGLCVPIACWMLCCDVHMAGGLTDVDVPVTRVGPVGQLTIEDQCPLDGGSSLVLPMAYLSAKLMNNSLDVFITLGGASSQIGLRVSDTIYIAHGCNERPWTPVAGVQGASQCFKWADFWLGLVLAAGTLSIFGPNSSATYGRMVKMFAFPRSVHGVVASPWTQFHLFGRSRSQTSTCGAKGFLPRFRFTALFVLPSKVAFSLLLCASLDSGRSGAR

SEQ ID NO: 1002273 - protein, 211 aa, Homo sapiens
YRTQIMSRGLPKQKPIEGVKQVIVVASGQGWSRKTSTSSSESCTCTSSETDSSKAMDWLDCGLCMDLQIPRDDCHSDKDNPDTYHRDNANEASLLNLCVLGVALVYWGSSGSDRHDEPTARIRTDAPYLVTLSCEPVRTNRRGGQSEVLSTDGEGTTRRASNAGRHDKHDVPAVQGNTVAASDMQARKPDTGTDRTEPTHNNTGKGLDAHK

SEQ ID NO: 1002274 - protein, 329 aa, Homo sapiens
LCAADVGVQRWSWSVWPPWASPGPQRACSCVPPAPCRRDLKNARDWGPVGTRPPAGRSHELQRGEPTPATSSCLGVQRTVTDTDRRPTQTGINGSLPKRREDLTEPPGHPLERPWAGTPNTAARYLYSCIEHLLAWRNVTSLSLPTPTGLLSLTTHSIHPDTVAAAHWPTILPQPVLNERTWTVLTPGSIRINVPASTINAALPDLIPKPPSSALHLTASAAARPWHSEGRNLTDGTLMPPLRGPRPGSPDNSQRECQPGRWPSAACGPTRSASGPPAPNDAPLPPHYPRKPSARAGPPSGVPPANAACRGPQWPNDSDAKRTAPQTAP

SEQ ID NO: 1002275 - protein, 169 aa, Homo sapiens
MSDGKPIVLTSVSRCSAPMRHESRMARAMAVVERALGAVPVTPGGNHTVACRGDHYTLADGREPLVALWDLSNMRGQTQSNAGSFSHARVRMMNIIVVDHRLNGRGAGRGPVVQRNHGVPPGHKPVETVRSRGDQRNAQSRDGAHGPRDPSEVQTSGKPTVTMDGGSHQ

SEQ ID NO: 1002276 - protein, 296 aa, Homo sapiens
GCLLVFMSQTMTTVCAPRCLSPAASGALRQPDMALAHGLCRERLVSRGPCAWLACAAVCALPCDSYPGGESDYLRPLVIFLFVQTTVPLETPPDNPESTLLEVYIPGKKPALHLPSVRLDFCRPWASADSSYAKFNLRWPRSCNRRLTASLGGSALLPVVPGPMTSMSWGPTLTVDPLAANTLWDTGSLRLPVPRRHPWPSTDIHLHGDTPLPFKMFHLACSLPIDVATPRTGASAGRNRGKLNPALSREGPTDRSSTGPFLSTQCCCNQMSHRDPYPLPGTLCADWQFGDLGALV

SEQ ID NO: 1002277 - protein, 253 aa, Homo sapiens
MSFRLGVVHGCDLSRLGEAEAVEDHCVGQALESSRGQGWARSRVSSTRRRRSVCHHGCISQKLMAALALNLSKTAGVKTTRRMCRLTHEHVLCPGHGLHGAQGETALHRWPRILFFALKVGGRDGDDPTRGFQTLLHRSEQEWARKYLLKGGQEALWGKVLVNFLSSCQQIRVPRKVLTKAEMEELDYYQGPVEKSRKHIDTWVAEKTEGKIAELALSGLSGIHRQGWILVNACLFPERNWDRTVDTDDHRGA

SEQ ID NO: 1002278 - protein, 412 aa, Homo sapiens
VPGGCAPAAAGAGAPVPAAPRAKVFRTGLVLCGLRLELVPVPDQTTLVGCLARAGCMPVWRCPAAAATKKEAGPSRAVLRCQYKIFRLVRDFYFSGGCIPLQSFRLLGDLARIVDPCEPGTFQVVYSPAHRLQSRPWGKTFRVSAIRCPGTSKGSCRELRAGTFWLCALCALCSPPKPFLARVLNLPSGPLVDRVGGIGDFTICVAVESGPTPSPFAAGNFWAQVPNGSRSRSVLLCVVPPVCVCPPFGGRRLLAHFARHFRLSRCCLWTHPFGVAPAGAVPPVPLWAREWVPARLWRGRQGVRPPLLWRIGCHSRDHKRDNGLSAACAPGHPLLLDDEPCWGSPNRAFGSATPALRLWASATNVSNPNRDSPQARVPWPWAHNSDPEDPVCNPPVIATPVVDLQPGNRTQH

SEQ ID NO: 1002279 - protein, 200 aa, Homo sapiens
MPGKGHDESEVCGPNTIFVIRGYILDRGGIVGTKDGPKKPRGGIPVVDFYDQFFRQNGFLSTPPGDIFAPPRVAPPGTETRSPRITQLKERNTVGEKQDCFLHAKNPLLCTDRTSVTPDKKGYGFQNEWALDPRMAENMQALGIPEQLEPRMCALGAQVSIGISVSASTHTWGESYRQGTLYSGHPHFEFDTIYRGIQFA

SEQ ID NO: 1002280 - protein, 225 aa, Homo sapiens
MEPSADGYLSYFQVHVYYFLLLSSSDASFSTGDPSSRFLCASLLGVHSNSTQVAAHCVADLFPQIINPSKSWSPIRLWRLGVCVRYIRAWTRSSVEHDMLLFFGPWGLLFSSSFTDSFGLSAGVPSPKGLGICCLGLSGLVLGVAGPFSCMGERPSGGLILVPGFHFRLLWGRQVSCVPPGDMVNPGLAFTPPRERLPPLPWQLRVPFAPWAPCVYLAPLWALDP

SEQ ID NO: 1002281 - protein, 267 aa, Homo sapiens
ELSGHFENQKVMYGFCSCRRTPKTALPKYVPHQHGWAEDVPDARNVQLCQSSVDLWPGKRGKGPPHSRVSPGPPRTASGTESHPGRVCPLLGIEGGSGSPLGWPSKAKGCAYPFSTFEMSCLSLAATFCDPQRKWKGEPPESDPSESLNSDPSGHLHGSWEPKTRGMAVKPKQLDKGRCAEGPKPDNVQGDPRPNVEGGTSKIQSLHVQGRDLLPQIRERSLLVAKRGITVRSMVIRNIINVLPIEAKSDAFIHCHVRTARNPQFTE

SEQ ID NO: 1002282 - protein, 183 aa, Homo sapiens
VDGRADQSGGDMGARMTRTDSFSSSCGTIAAGVVLMIQSGRPGRPGLCARDLWRLLEVQTQRPELASGLRTSAAPGWLLWQHTDALDSHLQCVLPRRKAWLSDATIRWCVARVQVWLAAGERMGRQRQTESRYWATREKHHRQNTYTTGAESLAQETLRRIVAPQREEGLSCRDLVVQGLSFI

SEQ ID NO: 1002283 - protein, 32 aa, Homo sapiens
MAQQTPRPPTWHHISPHTPHGTTLAALTSPPQ

SEQ ID NO: 1002284 - protein, 354 aa, Homo sapiens
MLEQVRHMSITTALFLCNVGRGGAVRRSTQMLQDQPSQNVVVKNAASSEALARTSALSYHEKHGKNYLTRLMGEDSRDPMALGLVHKERQLIKHVLVRAFARKSVGRQQHEKDKVSKGKSPLSGNPQEERERIAYRGGFHFPVISLASWKVQSGPINNFNKWTNTFHGGALIAILADEIVFAEQEIPEERRSGGESRPSIVVRQRYIDLRRTWPPVHVQHHMEKRAMVCTQPIAEGRPKDRIAEKKTGYLIEASTFSAERPIKGVPTAPWEVVERPEKPPRGGKFPDSGKGGPGHTDPKGEKQKTKGHLAKARGTGKNGKGDLPEPNGPAQQGNVEREKDHGARELEISNNRER

SEQ ID NO: 1002285 - protein, 111 aa, Homo sapiens
MGATVHVDAAGGNEECPSRCPVSATSQEVILSPACVAVNAAALHLIKGHSTSIMDWSGRHPCYDGRPLLGILPMTGREEFMAACACSQYCMGRGLYNAEGTVVTSLPRHYP

SEQ ID NO: 1002286 - protein, 256 aa, Homo sapiens
SLRRAREPGAACWFQTESYSLSRSGVQWRDLSVNVTSTLTGSRGSPASDLPSSWDRRDEHHHGWLHITRYIYVETGFSRDCPGLRSTQIHGLQATMTRVSPKSCVENSLSAVRDQQDIPRTQESRIRHKITTPHKHNHYWRKQDPDDETTHNTTYKPYINATNPQTEPHNGQLSPSTTARNARRKHGYNHKKITTNKKQHRHQEGHPPRAHSETTTNTDLQGTNNMAHPRQNAQTETHLIETPAKTPTYKAPNTWQ

SEQ ID NO: 1002287 - protein, 354 aa, Homo sapiens
EPREDMRGCYEGLPAASAIILPTACTGRVLSMLQTAHTNCACCVKSPAGPNMKPAWCALSWRTTNADGQTGPKATRNCLAQRPNRCDAGPNIIDAQPHDCHFYWLPPTNTLPSAAGSYANPTALVKPTNRISKLCLPTRASTQGWRQGVPSWPGLPINLWPGQPNPTDFWTHQRGWPPHMVFRIRPLARVWLPHTRGLSHWGLCKLRNCHQCQLPLSPRTRPRPFLSGHTPFNLGELTFCYAMFHTWLRKRLPIGTTHENTRGPPLRPLWPIGPSINRHQVPVYYGPRNRKQLPLYHMGHLTSQVILPPGPLVATVIRFPKGQLSLGLVILFHCASSHTFNLLGPVCSTTPPHT

SEQ ID NO: 1002288 - protein, 118 aa, Homo sapiens
SVVAAAVSGWHCCAHAAEASWCACRRAGPVGRGMSEAGPSPSALEHERCAAAGSILLRLGTPRVLDADCRLKAEPTPDRARRRHEPAQLQQRDAGMTAGAGQANGRVVAPEARYFSLK

SEQ ID NO: 1002289 - protein, 270 aa, Homo sapiens
MRRNVQRKSQVLYCCGVHCPISGPSSPNTSQVYNTCKEGGLHSLLRSPRVWLIYYANYNSYLRWEPVTRSECSSWSYPHAILAIHGSSHDVQSLMEILLETSHTHTWKTMLAHYRTAMHDSHGLHCKKPARRFGKNQSTQDHVTSDLADLTAIKPLGLPPNFSFQNMGNPGRVTNYYRGEDSDSEKPVTSRPNYVCAHGHGVPMNDVVLTIQLEKIECRNPPKFYATTRVRYNGVESTPLSRFDGLYKPPEFAAKISSRHMCSDMPKRIR

SEQ ID NO: 1002290 - protein, 249 aa, Homo sapiens
LMAMEKSKATLACARQQEDTAALSPASCSVMQVPVRTGAEVTFGEDLFPEAGCTCFTESGSLNHLERGHGPVVEFYEEIKKYEKLETEEERVARSREIFYSYIMTVSCWPARIPSRRVPLRHVQGHLWGTKQVPPDLFQPYIEETLSKPPRGTCSRQFIAERISSTRLLPVRRNVELTIHLTMNDFSAASQSIDARGAFGRGSIEGARDTAVIHSDKRCYRQCKWPVNSKAASKHDSQAENLGPEPKRI

SEQ ID NO: 1002291 - protein, 286 aa, Homo sapiens
VWSFGVLLWELLTGEVPYRGIDCLAVAMAELLTMLTLPIPIHLPRALRTAYGDCWAQDPHRRPDFASILQSWRRLRHRSYGKCRGLLPIPCRKAGSRDPGLFDELRAKEKELLSREEELTRAAREQLVKAEQLRGASTCFGQWELEVSERELTLLLQQVGTGSDARCAAPPGQSKRSKLRARDGGERIRHAIIDFKSRITVQASPRLDREEKTVFEVGPGDSGHFPRFRAITSWSPAEPGQALWGAISPDVWRTPAMRRGKACWDVVPVPQPAEARMDAKVRIASH

SEQ ID NO: 1002292 - protein, 326 aa, Homo sapiens
DRSERAVSSSSSCSVSSMTSLSYRQSSGTVVPFRECLRLAAPCRWGASGVALTLLPEAFIGGLRWAAGVSRVLLPAFVSSSVLGGAYPRRLQGEQIHEPAFRTVSAWRGNEESVTQCQESFKRRDMRSPYLGTTVVAPCEGGPNRDILRGAEDEFRKVWLPERARGGQWCPFAVRNYKSLVTYTRHKSKVTPARESVEFYEMASDRGTFQVELGALWRNRHPYGAAVLGCTIARFPEPRSFDPRENKGLRARQLTCWKGPGRITPGAHAADGLPLGHESVALPWGHRNQNHGRIASNSKRAHWRREKHAWAKPLNETQPMREGKLK

SEQ ID NO: 1002293 - protein, 237 aa, Homo sapiens
MSSGIFAALKLHRRWPTRYGIHPRGSTTILIGPAGRRQRCDNYCAEGRAGTQADTGGITERKTIPQREHQGAAPPNTNTGGGKRRAAATAGGPQNRLTERPQRGDQSVSEAKKGGSHTHIVIAARGIYTKQSQQQTIYKTRGIEEPKTGRQGATKRKGDSGHPVGAETAELWRPQHITEKKDSRRRGGHKPDNPDMRRNDRAGRTKSPEVGHTAEKSEHPSKNRKKLRQERTKRKKA

SEQ ID NO: 1002294 - protein, 111 aa, Homo sapiens
MILPPKPITLDAVGRSIRVNTKPKRDAYSHHVLTLDMPSARTSRLCQCLRGQSIYAGKVNLKTYLYAEVERYTVETGYQRTGPQGTARKCIAESTTLKQTMGTRINRTQET

SEQ ID NO: 1002295 - protein, 77 aa, Homo sapiens
GPDVDGGPFEQQSPYSLLIPPASPSRAKPSARFAAFSLLSHNPCPLMRVMLTPAARLHRFKNRGDKRTVQKLSASRE

SEQ ID NO: 1002296 - protein, 228 aa, Homo sapiens
ALSWVRLGPLRSWTSSPQRLGGDPQCALGFKCALCDGMFHAHSVGWRGMADVGVCCTNAMKMPWDHSLCQLLRRDGQLRSDKFIDLPASQLPVPGAVGDCMLMLNLAWPSKPHTSLDGATARLVPRDTMLPVSRATNAGRIPPVSCVPPCGRDLRVSMEAGWLCCAPFYQGCFTMVGTVPEPGKGIISVGHFWTSPKGSLREQLPWSQGCMTCARFGSPKRQPHQTLV

SEQ ID NO: 1002297 - protein, 49 aa, Homo sapiens
MDLKTKLTPRTCTYRMSSLEAGGEGQERGRKQAKNQHANTQTLDGEEPR

SEQ ID NO: 1002298 - protein, 222 aa, Homo sapiens
MGEGRVGQQTEGSAAAAVAEPSITVRSPSRPARDQASAPGGGRGLGTEAGGSGPKEGSAAGIALGKWVHLHLEATFPEAKHLRSPFTEIHLDSLWSLERELPCMNVGAGGVKRAGSPDSHSLLLGKTHFAGHSGFRWPPSGQARFPPWGALFPRGEFPCVRGPCSSGKDVEFPHLFWSFVPLFWFGSPPPGWVWPPRRPILPPPVGEHANAPPRGVFVLPSA

SEQ ID NO: 1002299 - protein, 313 aa, Homo sapiens
GNTTDDEEEEEVEEEEDDDEDSGAEIEDDDEEGFDDEDDFDDEHDDDLWILRIYDIRQTFSSESRKLSATKKLAATNGLQAALLMLELGSNADPDRPAEGWAQLYRSTWHYMGTLESTPDENWIQMPYPDSNAMSAYLIILTYSLGSVDPTHAGLLASIAALSPRRYTSHIHRQRIPMDTDVDSEISHKTRRPRSIESSKHAHAPATPPHTNPRRHAYGNQDRNTDSKSIRPPGPRKQTAHRNTTTQHDTLGKGPDDHAPRGAHPPPLAHTKPEQRREQHNCAQPGEGHTAGVAQTPPPNAPVAAPQPENGNP

SEQ ID NO: 1002300 - protein, 106 aa, Homo sapiens
MEGPSTACAQLEFTHALWEQRLKEVHCDVSRRMERRPSISKGRQQGRTYKVFDDTPVRNAGELTRPLRFGFVGKCRGTKALIPEDLTEGSPDGLLRDGNLVLSFLA

SEQ ID NO: 1002301 - protein, 249 aa, Homo sapiens
APLPLVPTCTDATDAFPPLSPLSRSIRGVGATGGVNRCRGPAIRRRQGDRSTKCRAETDDRGRNEREREDVRARTEQGKKEKQDMQDEKRRKKAKEKETRTRRKAREDRNEEKQTKQRRKKSQGTQQEKRTEEEQEQEDRDDRTKTKNKTKERNKTKKRKKKDKKKTKREEQDKTEERRATKRTRNTKHKKQATQTKTQKKKRQKKEKRKKNTPKEEKRDEKKKQTKSDKRRKNKKKKTQEKKKHKKKR

SEQ ID NO: 1002302 - protein, 227 aa, Homo sapiens
VQYGDLHVVGGFSSGLHYSASSGKRPAASSRGPPATTTLLLPYPQRARAPSSRDCTRVRARNPAELDELASRLLAIPGAGVSGAVRTFVSVAFQCTARWPGQLDAGPLMPLAAILARMAETPVLRHRASCDRRKTDAPTVVGDGAGRPNCRVAQNGGSSAMNSGEAWVNVVSDERRVSSSGGLHERAVRDPPLTGPWSPGYLSEEEVLDTENPFVQLLSGVVWLIRN

SEQ ID NO: 1002303 - protein, 193 aa, Homo sapiens
MGHIGGTGKKEGRQGRQGSGGACGLDTQGPGHTCLEEEGVGRGQGDSRYARGWVGCLVRAVGLPLLVLELMGQPVQAFVQPVPVGWHRWPELSQSRGTDRGMQAQLVGRLSAGSIAKGKIRRLAKDKGGTGIRELVLGQFSFELFRRGPTLSCSRIIGVSEPADFSDPCGVYRRRRWSPKGGQNLAPWPPKIP

SEQ ID NO: 1002304 - protein, 243 aa, Homo sapiens
MCGIRALLAVDDCLILLQLYWQVSMKDCGSKEFHDDIRACETVNRIQPNLLNLELHSAERLVETLLVWNCEPNNACEATSIRIEELCNNRLKIIENIKKDATRAICEIVNTQSQKWMVEISPIILDRRKEEVEQSKYELLAHGEDKRVEDRTRDQLRKYRKRDTEEINETQKEIKKNTRNNPKDKPQKEKRQARGKQKQSSGQKQKYEGENDKINKKKRRNKNNRRKEKKKRRKEEERNRRQN

SEQ ID NO: 1002305 - protein, 145 aa, Homo sapiens
AGHGPSMEDSSAVLMESLKSIWSSSMMHPGPSASGAAVNAALSRNSNGATRHHEPSHTEAKVATWNEGSINHGMLGSRDWTTQYPLQVDRPSYLLSRCQEGCKYTTRPAECARTMYARATKKKKSIRNYYTDPPGTIRTGEERGK

SEQ ID NO: 1002306 - protein, 334 aa, Homo sapiens
EEPAEHRGLGRSHPPLLESPRPLSLRAPRQPPASVPRQHGEVCSRTLATMYVSYLLDKDVSMYPSSVRHSGVLNLAPKNFVSPPQYPDYGRLPRGVRSCSGSELGQRAVPGAILAGSYGAPLREDWNGYAPGGAESADNAVAHGLNGGSPDADMGYSRPADYHPQQQPHHHPRQPDDEPSLRFTGLVKTLKPGPPGTATHDDDEQMSTGGQRRKLCEWMRKPAQQSLGQASENQDDRTKYRVEYTGPPDGWKLEKELHYRTIKSPHPGAKKPGGKPDNDRGDYSEKAGVQHLGSETGRSTRRRNTHTARQWKKKKRDNTRASPRHNAPSTAEPE

SEQ ID NO: 1002307 - protein, 103 aa, Homo sapiens
ALFVAFGQCVGSGPVDKPPEERLGSRARSPRMPPAISLVSRGVARHRYPAGYMDFAFPFIVLRSVEGASASKAGASHGGQPCREDIARGRDSPMEGRLAALKR

SEQ ID NO: 1002308 - protein, 143 aa, Homo sapiens
MANKRSRCTRGSSGSGVGSSGSSAGVVAEQGTEVASACEGLYSPQPRVCELPLWHGWKGASLDLGLQPWATSTEGDQEPEGTNPVGLDCVALSQCLPILGLGKRLDVTVPCRLVGGAQAGHTLNLSKGVNLFENARPRCCKRN

SEQ ID NO: 1002309 - protein, 83 aa, Homo sapiens
MVGTRVVCHLPLRRTPIEWIPSISPGLYWPSRIPLCPGPMGGLAHFPVRPFPVRAPLRPYPFSPADARSSGRRNAFVPFGGTP

SEQ ID NO: 1002310 - protein, 149 aa, Homo sapiens
LIFMTYNGYLCIAVAAGAGTGYFLFSWKKAVVSGYHRRMPLTSNSMAWPYRQWEVVEELEDVIPAPIIPSCSSLCTYTHTHTHTQHTPAVSSRGMSISMLLLNLDGSNPPKVVFSNKAEIPISLREKTTREYVFSFSIILRARVIVLRV

SEQ ID NO: 1002311 - protein, 206 aa, Homo sapiens
LTPVSAPNNLDGYVLPKANLSFRLLLLLASLSLKSCELPWPVLPESDQSSILLLLLLLLRVFRGSRTIRVSAMRRPSPRDDCHAVFAYVPGPMRLTSRHASAVRSRATGRGTEPALVRCLIRLPGVTRAPLCASSVVSYDPNLGGRSAPDLAAMALASGHSDDLRARKSSEGVGRDVGAPRVLCPDVGARVEGAAPYLTGFSGCRI

SEQ ID NO: 1002312 - protein, 292 aa, Homo sapiens
MERFRTVTDETTIPPGTQRPESSTFTTEPVALARVSSAPKSDIVIPLRRFNSLEISHKRGGAAYTEKIACQAKREAIFGHGFVAPRFLRAPTLLPPLRRATFALPALRTMTEITDLRDYGANQGGRYPQTGAAILPPGFHIYQFTAVVHDSVLYPHPNVKFTLALSRVPLDAPTVYQQLDFSPSPIFRQCSPKHHPKVPTFSCGGHFSSAKQLPCALGGGVTVGERVVCGSRQLAEEQHWDFKLYALAYIGYFRRIAYILALEVGAPSRTVDRPERNNRADPTQADKHRERY

SEQ ID NO: 1002313 - protein, 134 aa, Homo sapiens
MTSTNQCAGNGKQTELRASFVCCPVLYSGPRQEGGSMSLVSRADEPVTSAFEPLSVVSLSESVRFLAGDDRILYADMYRGEPYNHYCKIPPTSLRTLMCPGTGSFQTLSSPGNMSSELQRRVLKEKVSWVSGLT

SEQ ID NO: 1002314 - protein, 110 aa, Homo sapiens
LVLGELRVAPVFLGLACVLLPRVCHWPMMSPLADCACGAMCPVVLCACPDVWCLRAAPVWCILLCCALAWLLRQHCVPARCSTVSALLTPLSEYLCVGRPPCVEPLIHQA

SEQ ID NO: 1002315 - protein, 284 aa, Homo sapiens
MLQAASRTIDACNVAGSAEARNGRIASTTHPCRARSVALRRKKEPRRRGESAGRPRTSRHHRADQLRQMGLGAVSEPRAEGRSVVGSRTQRCHDERSAGVGTRRRWFQCRRLLATVAGASNARVCGQALFYREQLAVPIVYIPEMLDTETFGQKATAVFDWASEVDTGTETASTCVVLFLYYPCGYPGSTKLQGLALCPSNLPVNSHWTLVSGLVPYVPAWTIVDLEQRLESYRSSAMEPLDLATTLQSHRQPVQGVRGGPAALSLCLALPPSRSPSNVARAVT

SEQ ID NO: 1002316 - protein, 67 aa, Homo sapiens
DELSLSVSSRRKLSQVSGPLACPVNKGPKMFLRVTLAARTSRLQRGDHMLMFHYAQQLTYYYIDGNT

SEQ ID NO: 1002317 - protein, 228 aa, Homo sapiens
LFRQYLRIRTCPAQGLTMELLWLSLRTTARQLGLGCQKVEVAPGYVVDRVDTGQATYTPYSVIHHIFGFNLLSTSGSDRLRMCVHMVEPYGKSTASPVLHESHTAYLEWSTIYATGAQDLKCGSAFQYLEVCDGRLNVWTGHPVSPGTIHMTCVPDEDGSGVTKGMELFVQRPEFHALRAGFALAEGIANPTDAFTVFYSERSPWWVRVTSTGRPGHASRFMEDTAAE

SEQ ID NO: 1002318 - protein, 481 aa, Homo sapiens
LTSTYGGLARTSAFTERRHNKGAKKNSVLIQIFRKQEQLAHDAATATLAMLPHDQAYIIAIERTLDRPSDPKGNQIELPSAWVSTGFRDVVKIGARVPRIGASKCSCTGFATFYDDIVREAWSITLHHWIVSSWVKHSVAFDLKGFHNRASRNTLTRGCTKENGSLPTEGSHTKDNGAKANETRNSSTPDAPSRIVALRFRNGIVNPGTCGVHRLGLFSCFDLPWLFWGVLLTVYIPDTQAKNEESTGEINARTQGTAVRFKFVPSECARTPKNRKVWFPGARKMKFPPCATAGNTGTAQIWGTPTFAVGNPRREESGLAQRYTDNEVGHLLVQPMANNSLGGSPQIVQNRFCATFSADVKTQGVHVLRAHRPATVNLTFEAKRHKCGLMAPKKRSAYSCFNFSRYLSPSLKLGSFIRDCNVKTDGFTKQTCGAWTTRTQARPKEVSRRHFLGATQQGRFQCVRQRPFFHSCALCNNGGPR

SEQ ID NO: 1002319 - protein, 186 aa, Homo sapiens
VALWPFSPSDGALCVAKRRQGRCQVLVTSDRKLVTGLLDLEVTTLGAFVIHVRTGRHGDTLLWEASSWDTNSQARPGDVRYKGACELTSTRLGSVDRALYLEAWLMVSAGAQLVHARKHERRTTWDQYQHRPVAICPYPLASHNSLRSQPACCLSQEEHTMARPMCPLVAHYSRYVARRSVVPFAS

SEQ ID NO: 1002320 - protein, 269 aa, Homo sapiens
VCCENHELLHVTSRVTSDCYLCDYSYMLDMLRVVLTAQCRRVGSARKSAAAEALQGVPAAVPSGHLTARASPSNTGMNSSWHYNLGEYWIDGGDGGSGTALMRTCATTCTSMPAEHLQLLELKLPREVADECDPCPGLLGKEVLQDIQCHAQVGRQALTGIRSPERLDMIVTPGERSLGIIIAGLLRYRCQRPTQHSLCRWPQHGCKEALTQPLPVRPLGLRGVMPMADGTVLTQESLLGRTPEMPNLDPEAYIMARDNWTNCLDFQEP

SEQ ID NO: 1002321 - protein, 95 aa, Homo sapiens
APSWRRVRINHRWITNAVRRSLIEMMFYRSLGTTESHYCQQILRVQNRRTRSCSQRQTHTAYRYGHGIRAGFTVIDSLTESRELLKQAHHSTVSS

SEQ ID NO: 1002322 - protein, 134 aa, Homo sapiens
MRHVDQAPKAIILDKVTPTRLQAKTIEDLMRPRFLEGKISFMPIALVQPRSEAREHSGDKMVEQSSWLTWLARIYSYQMALTPVVVHSGTELRRSSVVQYSSTCGLWSVDWIFAEMFAKLSCGESEPTSGEILD

SEQ ID NO: 1002323 - protein, 239 aa, Homo sapiens
MKTETCETPTGKPATRSSDPATKHPPLQENTWNSPMGRSKITWRVERHRNRGRCDDAQEVSSRQNLSGPQSAPRNLKSRPPIAESDNPATPCTRRESPRAEKRKNMRELCEAQLRESCAHVSQPHTVFNLETGNNCAPITHRGTRVQTPSDNAINERLRREPLSRPENQPGTEDKYIARTQLYTRAHVRRDRNKGDMCDLKRRTQWRHTPPISSEHYDPTCTTHARPLVDQVTTNDAPD

SEQ ID NO: 1002324 - protein, 291 aa, Homo sapiens
MEAVLRGALEDAGQAPTLMRVDTPVFAGPVCCVDGADVASESTGGCGACGLHQAWNRMFTHVQSHSQKALRRCGEHLDWMQAQIAESIVACMHCRKPWRTQQDAVHVKATLVTTITVERGTEWGRMHTVGWTEKRQRSWDSRRYSEHRALRCCMELGAYCGYSAVRHGPPAVTSGLRLITIEINPDCAAITQRMVDFAGVKDKVTLVVGASQDIIPQVKKKYDVDTLEHGLPRPLEGTGTCRNTLLLGGMWLLRKGDQCYWADNVICPGAPEYLDTCAGAVLGVHTYNRPG

SEQ ID NO: 1002325 - protein, 79 aa, Homo sapiens
AHARRLTRSARSDIHDPYRTCHRCTDASVMVPGISLTNCILDSQWSSGYIVIDVYGGDKVDDVVMVDVWLVESKREGLF

SEQ ID NO: 1002326 - protein, 355 aa, Homo sapiens
RRSSKRSSPVIQKTNADINCHQMSRLHMQQCDPFIRAMQHYHPGCEAVGSLSALERKQTNQEERAATIRQDMHKHRQRETSVNPGKQRQSTDKPCNDTGTAQPRAQGQRSAYRRERPHEEGQHVGQPRSQKGDDTGAAMKVATDEQRNDKAREKKHKEQHAEQERRETEGETKNRTTKRRLEGSEPGRKETNRRTARRLKRRRERRRKEGKEREAKRNDTEKRQEREKRQDQGKERQQTQGRKREEETEEAQTVGASDSGERRRREKKEGESSGRARAEEGGGEGRARAGGAPRERGGQAGRTRGARAERGERERGRERARGRERERAEAQQEKGGGPEESEEHEGARGKRRKDR

SEQ ID NO: 1002327 - protein, 99 aa, Homo sapiens
MTGKRAEERMPEKVGKYNMRQRREKEEYQNRAVPPQHARLEKTQQTPEYGTLQSAYRQTVTAGRQGAPHVTDKTLATHSNVALEQTVRACLPLTGPCRT

SEQ ID NO: 1002328 - protein, 253 aa, Homo sapiens
ELRVVAIAGQRGCGTMCPPVGLPSAPVCPAPVPAPAPDHLSGHQAEDEEQQPTEIESRMHERVTCNGDDAPSVLTKIPFFREIIVSSVIPARHVCAGTTRRSSLAVQDPWTREVLRTTFVVSVTLLSDHDTEDSWLQDLTRDFANKGSALRHRTLAEKLRVARFKSQENGSIREHSVKEREVESAPDALSRHWATWGRRATTRAPVRAEQAVLKAQHRQLDDSHGLLTHTTTLDVDRFRVWVAKPLGTSGSAY

SEQ ID NO: 1002329 - protein, 197 aa, Homo sapiens
MVHLLRYVTRLRCPRIRQVLCWRAPNVTVVHHVRVASSRLAQDDLEVTHDHCGEEDDFSFEHTFVHVYDRGAWRMQTLPQVHDVMYDLETLSDQSDESFCNVVNRYQTSVFATLMQDCIQQRKEERIDLTTNYNILTLELGPTLANTNIVRTGTHSTLYPIDGLGERRDIPDKGPVALQPWLQRGGSISRTAYPMRV

SEQ ID NO: 1002330 - protein, 250 aa, Homo sapiens
GNAQASRWQAQVRELMAVEGWNDMCEVLRLRASLSWPFAAVCTLWTDSPWVSGDSLFLSLTIFQGAYPLALCCAMWIINRTLGVSPSFLVAFCGLLRGHARMNLVVLLINGLPTLSVSYSCWGTVAAGHVSGYAVYETTGDVQEVYITRLHGSRLEELTRTNQSISMLRILEQECMARLLTCVCGHARLRRDWRGNIACPVSHSSRAPSTSLLALNCLLVRHVEDVLVIRSKGRCLIMDGLVLRDRSGRL

SEQ ID NO: 1002331 - protein, 260 aa, Homo sapiens
GGDMETGAAELYDHGPLGHPVSTWVTGPGFPVAFSVASSIGRQTSYRLLRHPSERMGFPAGAAQALVLQVFKTLDHMARQDDENEKAGTSREQIRMTQEEEEAATVSAAAAEKEPVPVPGHGHSRLTSDQENWDGHQEVEKVQPPGPVKEMALWFTGGKKLQEQLLDAAEVPREPPILPRIQERFQKIPDEYDGAVRENYSWSQDYTDLEVRVPVPKHVVKGQRRSQWALAAAPLRVDMTGGRWGSAVSWKGTLTDKDQH

SEQ ID NO: 1002332 - protein, 136 aa, Homo sapiens
LICMTSNGYLCIAARQRGAGTATTSSSARIARHVRYVDTHKKHLLTCSIQTFLLDVAVTSRLQAGNDVLRKMLNDRDIPGSNVNPVLASVVLLTAVIQRAPRNTYHRATANNERSARVPLELRTVVEPYYKVLMET

SEQ ID NO: 1002333 - protein, 178 aa, Homo sapiens
MAIPERECPKRQSSTDATEGVRRIPRIPRSHEDKKIAHSVGRGIHGPPFYDLERRDTRVGRRGKREVTLTKELRTCTWYTLRGLRLDTHAKLAMVTREVRPARVVVLGSANRRTKEATPSAAWNLRPAEDSSRRTSLSPRIYMNKHRRRHADPVHSSVTCSRAEARPWSFSWHTRVNP

SEQ ID NO: 1002334 - protein, 134 aa, Homo sapiens
MTALVYHKHLKRVLPDRSQLVHTAAYLGVTIRLEASQALSNIPIDSSGSHIGSHPYKGHTALRDEVLRTSCSSVLVNREIDERLGWHDAMDRHFRGSLNSGRHSQRDGEYVSSRLELAQDVANQLVPKNSAGSC

SEQ ID NO: 1002335 - protein, 195 aa, Homo sapiens
MPNYSRTGHTYSDYFPGIVYVELLHCLSIPSTMRSSAQEQRPITVWTTWCSIPRPSYANGLSPLSGYSSSLGRVSPPPPSDTSSKDHSGSESPISDEEERLQSKLSDPHAIEAEQFQCNLCHMTYSTFSGLAKHYQLHCDAQSRKSFSCKYCDKEYVSLGALKMHIRTHTLPCVCNDLRQGVFQTLVCFTDTLEL

SEQ ID NO: 1002336 - protein, 43 aa, Homo sapiens
MDERWGQLLGSQLNGNRLVSTNVAWEIRVEHLWAPNAAGGKGA

SEQ ID NO: 1002337 - protein, 198 aa, Homo sapiens
GERERTSLEVFISSIFNLGNRLHSGSELGPWGCSGELGVPLEGRLQRQAVDAGTGWPMLARAARRHYKPELSAAESPCTTTSFTVKRRGHKGAQIAARLKGWGMPRGVRKAGFEARAVEPDRRLVEHLSQKRRSSKWGRSLDSWRHRAPCRGRVTVVGPGNSTKPRERPGVRPDKGRDRPVTAALRGDCMYLCNKPRS

SEQ ID NO: 1002338 - protein, 279 aa, Homo sapiens
MPQDPKLASCAGATSLSACLRHRAPRGTSWRGFWSDDSLKLHASASEGVRCAASKREVPSYVRRGLVVYHNRRGCDPEGVRRKNDTCRYVAHMVYSSSTEELSVLRSLEASAYEAEILEDSHTVNLALCLEIIKMLGAEWRKLLAKRKQQRYLDEAERDEAAVHERSCGRTSSLKPIRCARSKIQEKKIKTECTRALAAHERSPEWTPGVGDCEWLLQPYDSSPYFHLTDFLGTKITRRVEAAANGCLRESMNVALSRRQNARTDEGTRQSMSKGARSV

SEQ ID NO: 1002339 - protein, 54 aa, Homo sapiens
MRNAAPHLQSGATRCDSDDTRALHPHNPRCASTTRTNGRTHYLLDHICGKTTRW

SEQ ID NO: 1002340 - protein, 176 aa, Homo sapiens
MSVCSVAICLSAGKRLAAACARGVGKPRRVGDASLARAVQTRGRCPALSHACVPQCYFGGHERPWATLCRLRDIGKHSILGLPVKAWLQHQHQRSVLRLKPYEQTELDRQYPIEAHCCFLTWDMRQVYHVTHNSQSWKYVIEWCLSPETQVRGSYNDFRQDLRRSPKGCLTRNVAR

SEQ ID NO: 1002341 - protein, 177 aa, Homo sapiens
MWHFGAVYGLWPPTCGATPREQLLGANTPRCKENAPRVSPPHMQEHQRPNITSQETLFETVSTATHSGDPPDITRPLIPNVSTHREGLRPQEVPLYRRGAHTTIERPPREHISTGRPPPHKPHLCDPREFHRQFQYSPFDEFIFIPQIGCERRNRTNDISRGMRPTGVTVECIKCGR

SEQ ID NO: 1002342 - protein, 137 aa, Homo sapiens
GKTQLTLLALGAGGSETSWWGRAPFPLHHHRLLAAQDGRWPCGLAAMPRSGRYLSLADHVSDAARAWPRAFLLDGGSRTIGGGQVFRRAGISVLYDPPATLFAVVCRFHAHESCGESARLYREGIGGAFKLIGAQWL

SEQ ID NO: 1002343 - protein, 168 aa, Homo sapiens
MKACPGNTISPEVSPREAREEAALRGFPEKVNNLCPRSPPEENSLLWEDNRPRESFRKISRYRGSIFLPPPIVEGLFYQQKSLWGRGSPKPLETQFGALYPLPREGEKTCCGRPPRKCLLGTGLAPSLLSTGRARGEKKKHRGGNPHATPCGQDPQRLLAKTTDPLYG

SEQ ID NO: 1002344 - protein, 360 aa, Homo sapiens
TKWRMTPVQRGGARGPWWPWCWGNRGGFLRSVSAVCILVAVGLRAVDVGLGPECPLELRRQGLRISEWKPVTKLGRLVKDIEEIKVPWEEIYRLSPLALLERIRRFIDFLPGGAFSRRHEAFEALCQVQNGMDPDCQARRTQCFKALSFATLRDYTWANGQVLGVLQVASKWTVEPTAHSQVGCQSVTCAQTQHSNSVQRQLAAKDVLTLGRKPKDRAKDSTTTCSPLATAFDPCAQLGRASWCLWLAALQFRPLQPAWGPTLGHLRVPSRHTPVVALSGKQQPLSFNFGSWRHWSITSRHGDRLALSTAHFKERTQEAGTFGNIFEYQNHPMCAPKRFSEPRRGGTNPSYRNVDPKYLR

SEQ ID NO: 1002345 - protein, 264 aa, Homo sapiens
RCCVLEAGIELIIDDDIRSREARSRNAWAAVDPDNQSPEVSGSCTLVDEDVKLNDVSTTGQVVCSIGQRGLGSRINSLSRPRRADQGTHEDMQQTGLTANRGAVLDDDQARDDQAEGTWAHEGPVKPSYTDTTAPYCPSALLDHGALCRGVTEGHSQAYFRCELTDIGAVRAPCGRAWNAPWPSTFIVEPSYFVLGAVFDRVSTDALILDRYTRACFAGVARGRGRWDILKQSLRGRILALPGGMLSLVWQGPFDPRGLEVGGA

SEQ ID NO: 1002346 - protein, 182 aa, Homo sapiens
MSDEDGLGSAITQIGRLTWLVFGFMRNHKLYILDISMAHIDTFRKSDRIYELGYFINRNPLWGPQAPRRIAVAWDVNLRAKEPRPCVSCRYSRITRHMAGVAEPHWLGITRPPGGHLHYSQRARNSDLLIVGRRIVRKRERNCAGKPLAEAFTTTAGELKVLPVHASNREKLVPSSNSSRIE

SEQ ID NO: 1002347 - protein, 209 aa, Homo sapiens
MDCLVASVGGPGSAGPQTFLLLGLRELSRPRRLAALQCFPHCVGRSLPALWPSWPVASLAACIVTCCVLHPLRWWPGGGWWVEGGARRGDRRRQLRRNRTLESRTRTPTPTGTGERPRGTHTEREPVKQESHVKQVGVPAPARGGAPQRTAPTSLARRAHKQKRKGHTHTGNAAAGRAGYRQERRAEEPEDPRRGGQEGGGNVAAANER

SEQ ID NO: 1002348 - protein, 83 aa, Homo sapiens
MPHIYDQRLRGEQNIYVCHTRPPQSENNRLVRHLVLSLPEEEGVSQKRNLRCVGEKHPLHEGGEHNKEESGTCNEKSPGGDQM

SEQ ID NO: 1002349 - protein, 203 aa, Homo sapiens
MGTFQRSSLGEWAGSASPCEAQSSWPSAPSSPPCVKPDAPSEDDPWSKCQRMSRVLVLSRSNVNISSRGRPFLMTLHVPSLDRVDVSHVAYGDRCITAFHTVSHALLYGLSSHCWTLTVTSGVMVDGREHSASKAQGVLLRHEEHCQDFLAGHSRAMEPLPRWIHAEPADQDDRAQHVPHVCASFVCLLPWCPFNVCLSVGIG

SEQ ID NO: 1002350 - protein, 129 aa, Homo sapiens
MRRDQNERASRGWFPVATRGGAHQERSFTGRNLGYEPAESYGFGGGPDSDAARRTALSADLETTGSRSRSAGGTDKTAATRSGQNSRAPEARAHSTSDSGGVPRKGATKWGGGRRVRTAECRRIAERST

SEQ ID NO: 1002351 - protein, 189 aa, Homo sapiens
MWAFARNLSSKSSFSVINICMRRTGTMLDESVTRESCINATEGLARSLSHYRNSAIVIGENCGLTGGMNAVGMDNAEWGGGGIYQLCGKKRSGEIQVQINWEIGGKAWDQTWIHMKSETRTNYGAEHIHIGGTDSYTWNLTVTGSNDVPISGGPLGEFDPKRCRPKPIWPATAKLGTAAPEAPWGLWAR

SEQ ID NO: 1002352 - protein, 307 aa, Homo sapiens
MCMAEEHWRCPDVRATRVRYCVDTPTTQQSSRWSMARRYLRIEGQWAAGVNPLCTKLHYSLTHRLVSVALRHCTYQTSLPWKRYAWERRALRDPLRLGDIVMCTCEMRIVKSHDVKAWRSNAQMEVEACVCGPTCVCGACARYRIQGTFPITGSYSGERNALHSSSFAFLPMPPYSIRRYEVVATDVEKSDWISSIEVPRPPWWGAIENKFEIDTLTRGQFFHSHRSSLCHQIQNKCRSKCVRFQTDTSRSTGNEGGRTGVSYCTHVETSLPASADRIAPEHYSGFSQGHPGRSYFAPEWLEYKGTS

SEQ ID NO: 1002353 - protein, 309 aa, Homo sapiens
PSLAHREADTLEKNVLVVSVVTPGCNQLSYLESVEQLYRVTDKVSDHVFSSSSETVWWSSPRIWRLLDQDVVRKSAEGTFFINKTEIEDFRPAFLTGALLLDTVSAITCHSLVILDTLDVDGRYNKLKRCSTGLSDVDDPSFPYESFTISRAHENMGSYKPVSHMYTAQDVKEVIESRTGPGYPCACRVGQSWPHFVLEDQVSLDYYSLLLGDLSPLGTFGPSESQSSNNTYEFMSHMLLEKSALSSQNLILHLGRRMTVGLSPCWQVKPRDQDFMKERKGFGDGLPSSWESFINPDACCTYDSSYGQG

SEQ ID NO: 1002354 - protein, 187 aa, Homo sapiens
TPPLFFAPKNKLKPPPLFKGGGGKKKKPKTPGETPGFGAPRFLCPWMVYWGFTSCPVLVWGVGLGGWDPLWGAMGNCEAPFGKISGGMWTEGALCRAGCWGDSGCGSKKSREGEEEGGVVEEQGSPEGCQQRGGLPRGAPPRGGAHEGAQEMCARRTTGVNQVGCHQKSVPHRGEKRGRRPQTREKR

SEQ ID NO: 1002355 - protein, 400 aa, Homo sapiens
VARPRDGVTWLDTAGGAGHALRQPSARHTRTTTVNIHAAVVRQGLPTSSQLQDFNCGRLHRGGPGPGTWRENSLQGPVIPNEEAFFDGERKLRGEARSTFGSGEAAISIQGIVIPDWYQLSSEGPGVPGEPLMRTHSMRMTDSPEQGWAHPMTESGRSNASVPSLYSPWSLRLRESRCVWAPCDDNGCEHLGNEDEAFDAKHSKGNMTLSLMALANAKASKTDSIDWRLICKEGAKECSDVPAVVRPTLVESHNTGPRCTEQRKGGADPPEGVDKAPFGEIYSNTMPTVVYPSDTIHQGRGGHHYPSAPKTTRTEEDTGTNQREMSPPHRADKQNDAHRLRPLHGKRRKVCTQAERHNRQTHKRGARNLVAQDPRTESNTQSVRTTAQTPDEACVVRSWG

SEQ ID NO: 1002356 - protein, 434 aa, Homo sapiens
AQASGPRGRAAVLRTRGARAAAPFRPRGGPVLLPRGSFPEHCGGGYRAPAYVAAAVQPVVAGLVVPVRADPNMMDMFTCKKTWASIVYWTWPDVFHWLCAFVIRHTQKQEIQSSQARAPAIDEVSGKTRIVRGLGDTSGDAKMGACDDVIASVIARTRRRIQLDTTIPGRRVPMPESVRVPIHESKEDIRPDIEKGRNVRASAPAVWFTTLDKVDTCRLDSLLLKFAKGDGEFRTGKGCTFPIGSWTLNIYRTRVHGRTTDSDTNAWPNASRAFPLGYMTAHIGAAVKRLETHLSTGRKILSSIPPGNEASHGTTELSVALQNPSLRRAPNLYEPLATDNTRNRVATEHALYTKPARRLTPRLNFPGSSTRVTFPTTDTRDIRGGHYDTPRSLCHTRKSDHGRHNFAPLFHTSLVAQAVYTHQVNAFVYIRPRG

SEQ ID NO: 1002357 - protein, 147 aa, Homo sapiens
RSWNLRLSVALTVPNPEPCAQPALWEAPPQLRALVVVGQRTAAQATDYHADVGRVLRDFRNGAVYVEPTYPGPVIALVMTLDSVRDSGSLPWQKLLGQYQLGHRYIALLGTVVTVRVQPTRGLRCPASPEIQGRRHYRSDTQFLAAL

SEQ ID NO: 1002358 - protein, 212 aa, Homo sapiens
MASWILATSTVDALRRLPYRYGCIGLVVTFRPLERPGVAKKLGDGPLDRTMMQRLITHTRKGGTQEVDGTHPKCEEGNHRIGNTSFIGERLYGSLCPDGTVGWADMNVTTQLQEQECNGRMHGLQGIEGGMFPREVRMERQSDISEAMGHTNGGAQTRLEPAEKARTYNGMTTFQGETRTLQIPRNNDKGRYTVEKYTERDRSSNKGDTHIE

SEQ ID NO: 1002359 - protein, 277 aa, Homo sapiens
MAPVKRRNVIPHDIGDPDDEPWLRVNAYLIHDTADWKDLNLKFVLQVYRDYYLTGDQNFLKDMWPVCLAVMESDIGKFGQGTMMGSLLTTSGALSQDTRLYRWDGVDHRAPSGLTGGRVCGLAACGFVTGPECAALCGAQDHPGITFSFYPQSGAKQAYETASGQWPAITYDTQLSALSLVSVYVVDQCAWNSGYLKACGHRSKETLRCFPTQHVVRALQTIFELNVQAFAGGAMGAVNGMQPMVSLINPVCSLMKSGWVVVYGLAVTMIQEVMHSF

SEQ ID NO: 1002360 - protein, 116 aa, Homo sapiens
MTTGSTSQVRQNTEQDSRGLPSSRQIKLELYASYVYLSMSLLLCPADDVALKELCQEYFLQPNLMRQREHAETQWMTAAETYRGGRNLPSKDLKKPGLVMTGAERGCTMQWAVCAL

SEQ ID NO: 1002361 - protein, 251 aa, Homo sapiens
MLTLFLLLWERIAPNLALFDLGEMEKDCFIDAIPYVSTRRRKLPGTQVSNSPRTLVPARASHGALRVCVKDNRTQYVMVYPVGPSVSHPEGWFLVSAFTHTPVLITLIVVFISRVSPELIPSFGVEGPAVGFLYETSPTDRVETSCASEVFMRIAAVIEDGWLRSASSLRNLQSTSWMEQSGRTTPDHEPRTTMEGPKSEPAFAGYTSKSTLTTRVAVAVDTADTSFVDEHRVSDLCGHLETSVMPITLVS

SEQ ID NO: 1002362 - protein, 228 aa, Homo sapiens
MLMNPWLIDDATSSRNTEHIRKLTQSLQKRNSEDRPWEKSAITKRQHAMVQLVPKTGFHLSTLLIHQSNKQSMKGYNICGTSLRRLKSRCTEDAYARRGRTSSWVEQSDFSDGTECGFRSRRYSQEHGASLSGRQDPSEVELTMMNEHGREPFDERASSRGACPGDLGTGSAIVVGRWLNIGLQTKYAQEPYILREEVLILEWPIEAAEGYGKTKKRLVDSLNSGEYK

SEQ ID NO: 1002363 - protein, 158 aa, Homo sapiens
DRGRVALTVSPKEIPVVERRSRGSQVTGTHFAVCHRKIEGCKPMQRYYSLFTLGEAHHLVLQDMHSFIASPTSSDASLASRLSSTHGRQQAARYLSEWCEQAMPAQAAYGFDVFEPCRANFSKNPGRGTYASTLTQRRSSLCGANFVSFHDHSAVGTA

SEQ ID NO: 1002364 - protein, 159 aa, Homo sapiens
MPRVKTYTHSLVQVPHTSRVRTVPTPHPHTQAIEHVANDTQHVLRASLPYSLPAYLHAASLVPASFLSCALIRLICKAVQAHRTRTVHSHSQTLAPQSSFPTVSTNFAQFVPTERLRIVLRTFANDQYLPSALPDGHARSSPSRHVLANSAFNWLTSVN

SEQ ID NO: 1002365 - protein, 123 aa, Homo sapiens
APLWISRLYVASHNEAIDPGARAQLIDTNRESVTRNNVQSGQAYNCLLERLLHDINPEHSVVDPEIHDRTIAIVDPRCVSAICDRPDDVAHDHSILEEFEVQSSSGRKFHAVEELARNPVDGK

SEQ ID NO: 1002366 - protein, 212 aa, Homo sapiens
GKDGVRKEGYRLYCHLFQLHRRRSEVKAKAKAAREIQPERKCTSTMAYVVLHHDTVKTLINERTDHTEPEVVHMVRASGSGLYEPLGFEIYQSVLFLLSLQSDTSRDACLHSCSAHGPIIQMATSHAAALSLMLTLVYLSFTLGVVLLGAYHSVLGIISVEPTGSSSVCTRTGVMLPHAFGPLSTTKFSSVAPICSRMPSRHQLSSKGIIFS

SEQ ID NO: 1002367 - protein, 261 aa, Homo sapiens
MTSINQWLEWEDDRAAASFVYAALYYYSRSNGNEGGTMYLDSSSGGALTHHIDHSLESTELNFPGLGREQNTTSRHMYKSGSPIRINYARINDLTSLRELEETLTQIGSRTLEVHHGKAIDRQRHDTKHLAELAEQTKVIQRQLRDHYHHNKADTRPRTPTKRGNARLDNPNIGRPVEAKRKGQHRARTPHNSLQGQGHASGANIESIGHTHGPERDKPSGPTYYHTDTREPTKQYESPPHTQDTDTNRVMRPKGTKSTPS

SEQ ID NO: 1002368 - protein, 246 aa, Homo sapiens
EHAPPRPGGREETMERQVLLSEPEEAAALYRGLSRQPALSAACLGPGGHHLQYWLATYLDGAHVSGPMRDHGTHGRTFRYLPPITVVFHRRGTHVVFSRTCSATSVETQGENSLTQTRLHSGHHWKLCLRKACMCTEALAERRTQFLEVMGARTRKLNELQPVSAGDNMGLIMRMTAEAACPGRTSETHYVVCGREEAPQGTSHILNRQKPEDTSRASDDEIARLKKPDTSHQGGISKEQTKTGEH

SEQ ID NO: 1002369 - protein, 260 aa, Homo sapiens
GRAFKALIAAQYSGGSVSACSPTTHFHFGQTNRTLNFSANFLPGKVPAFERVMMAFCVFESNAIAYYVSIIEDAAGKYSRGSSPGGCSGVSLADSDIVAPSHVPGLYPTLGIMHHNKQATENATVRNVRRILAAAACLLEDECTFLVGERSDIGLTSPVRLPPCLGLYKQVLEPFYPPMPYHNTNRWFLTCITQPTLSGHVSRRTGTCVAKDGPDRLRTHSLPQTRTLEGNTTDTDRVTGPRPRSPQDAPDRRANTAVLL

SEQ ID NO: 1002370 - protein, 137 aa, Homo sapiens
VNPRTVEDDLVPVDRYHAGHSASPFQYWTPQVLEEKNWNSICNSKVTITLDENDVSKTFTDITRSSYSQLLIPNEVERAMKIDHLSIEKLLMDSVHARAHQKLQELTAILRGFNANENSSIETALPSYLCTHLGALW

SEQ ID NO: 1002371 - protein, 212 aa, Homo sapiens
ESSGFPASTCACDCEPCAALFTHPCAWPAHSHALLSPLHLHPRDCPKAPCLPLQRRACHLTAACRLSLCRRHDRPASTSQCAPELPPVTQMACINAAIINLELYASYAFLSMSYYFDRAWLCAFERTSATYLSSPTLHEEREHADHLMKLQNQRGGRIFLQDITTPDCDDWESGLNAMELLHYIWQHNVNQSLLELRKLPTCTPPDPPLRCP

SEQ ID NO: 1002372 - protein, 252 aa, Homo sapiens
GALGLQSGMLYPQESPSRECKELDGLWSFRADFSDKRRPGLRGADEYRRALWESVPHSWTCRVPSSFNDYQPVTGVCGIFVVLGVVLNEEVILAGSDGPIDLRTMSGAAGLAVAHSYAIVWVNWGRQRYSMRGGYPPLRGRQFMQNLVQCWWPRATPGSGITYRHQTKTINTATACLAEDHPKYHDRDISKYPKGYFSPRTHNLDVIQATLDCRRSVLLYTRANNYIDDITVSTSVEQDSGLVNYQISVKGQ

SEQ ID NO: 1002373 - protein, 278 aa, Homo sapiens
MLASRTLLWTRCAGGMNNAGTPLIESQYLDFLDIDLSSSDNIIASWKGGLNLASQSRFETSGSSFPDIDSAELTIQARQALVTPCPIYQYSERHASFLVTLHQTLKLARHPRVRNTGGTDTPLGTVFAHRRSLVTGVHSTTDTVPVNSAINPESTPLKASTLQVENMPHTRWRHYISQGYLRNAEQAHAHRSRRPGSRTRTQDTGPTEEEANWCETNYGKQAMNRTQAVESKRGRTKPRRRTTEKRDSTQGQNHKDNTTAHAGRTQKHSTTRRRQVGE

SEQ ID NO: 1002374 - protein, 93 aa, Homo sapiens
SRKNRRGFKGEFSAPSLTLGGFLELWCCWGTRNPLLVLGVPPCRVSRVNLFIRGAGRLSVVGVFPLCLSGLSKVRKGQNAGGAPWARVCGGTL

SEQ ID NO: 1002375 - protein, 183 aa, Homo sapiens
MKALMVWGLSSFLLRVQWHRSYATGVQLAQNVCQQRFGNGWSTGRINAYQTGMCSWPQIGQTLMYNNDDAYINATNVWKTCTSFVTLMGISSSINSALLGRNDAPTAQGATFNAWSSVSLQCFASQDIHRWMLVCYVHKRGCPLDPTNGIPAAIEVAIGKHSRLVINTRRLSLSKYIVSNRLS

SEQ ID NO: 1002376 - protein, 206 aa, Homo sapiens
MAKRHQDTSRIVGKYGTRYGASLRKMVKKIETQPARQCTLALSVAFFRDERDASVASSGTVVSCMKTVVWRCLDVHISTFRVITVKLRTSEEQKEVDETSSTLLYSVEILCGPNYTMVLIICTHKHTNTTNTNTTTTPPHTHHTLLPSTLGEESGEEEEPARDIRKDKPPPRDPLSVGDKPEAEEAAPIHRHMHEGERTTPRQGER

SEQ ID NO: 1002377 - protein, 296 aa, Homo sapiens
AVPACGDAAVRRWCPGAALAPADFRVPVKTPALRAFPVPPEACSACYPEALTAGNDVRATKCWTVLRIPVILFWEATGETASCGVLRNAPPCVLPRSLAFSSVGVASDIAPAPWLHRRLSGGGLRTAVLVRCIPIDSGCAGNFTEVALAAETASNGHLELFDRLYRLPRVTVDMFTCRHITGWTPQGYESRIADRTRVARTAPLGGPSGAGTDGSLCTRHAGWPTQAGLDSYLPSYHTRGYGRYCRIGRSAFYLVTEIVECVPLWAQTNAPPIYVRNVPETPIHPRFIRATSAHIW

SEQ ID NO: 1002378 - protein, 137 aa, Homo sapiens
IEFTEGEDKITLRGPYRGCQCGPGTDRTAWSKTLINRDGLCGDSNIDHKFHQAPHLGRAVPQPSTDIKDTRYNGRPAAPMTIPAPDENRSNNGLPPSQTANRTGRRVQPKRHTGAPRTAHAPNRPSYQPSGKDLTPR

SEQ ID NO: 1002379 - protein, 218 aa, Homo sapiens
MSWRAISMNSHVQDRAMFLAVCEMARGLLNVRKDTSQLMRRKARSRECHSVGTQTRALRHPRDAQARLSSIIRGGDISWGLFDCINQIVMVTHANSKTQRGRVVCVGLKVKGVCTMALHLHSRLALGYTDMVHPYGFEHALTYVSLQRLPMKTYLRVPSRGATRKQEGTLSPCLCTYGAIITWLSSYREADQESSYPSAGVTPSLGRKFPLGLVFTEP

SEQ ID NO: 1002380 - protein, 118 aa, Homo sapiens
MGMRDFKFTRYTMSRICVRRQRVQGGIAMPPRSHDTDRCSITNILRPSDVRALACRVTRDLYIFNFLSHFRICPSVRLHSSHVLVMTHRNSVEALGRIAGNRFEKLRPGDGIPSEFRP

SEQ ID NO: 1002381 - protein, 155 aa, Homo sapiens
MAQGCWPFLPFFPWPGPPGLSLVATGCLNKVDTSRNRRPKGPPFMEARHTDDTRGLVAGRLGQDNGQRLGQAVGTHTEPGKGAGDQKRRGTPGGTPGPAGRTRARDGGNDTVPARLAIPFSAGQGRQATRGSLTWNAGGRLGLAFFQDGQREMRG

SEQ ID NO: 1002382 - protein, 343 aa, Homo sapiens
MERREVTIGLHVLPYSLHSMSLTCIVWRNLLELPGPLWRRATAFEGKSRLGRDAAKAYELIAKKGEDFTNGTARYERRGLICVLRFVPRGINCAKRLGPRRGFAGAWHRERSQGTIILGPVLDLVSVGPGFGGATGAGALYQAGSLRHLGNGPFVPGRDIGEPSFRPLGEGLTRNVKPGPSLVWAFRFGEPQLALFPRKNRRVYESFRKRCLQILSLGGEEIVCCTNDASGLHLRERFRRLVKVYFKAQLGPSGDVERVRKSPNPPRHKGGKPIVLSQGPGWPWPPRRKKHDKYTSQCEKQAEPGKVLPLDGNKAMTTCESLGGPERAWPTCDTTAKSVCGGT

SEQ ID NO: 1002383 - protein, 317 aa, Homo sapiens
MPNHRGFVRAPNLPSGKRGSPRLRRDQVGRGLWCRSGTRRLRVTLVVIPERLKRDILRFGAADAAWYDMHAKGKARFLALGIGLRKKVHKRRRPEGKLMVQIVWKVVRARLTQSLVAYGIVLLSPKVVPYTPQACTLSCPRVVSIPKASKAMDSPMARRERKTCGHLNGTVTIERTGNAYEGDPRALEKGDQDPLATGERKANLGGSDGIGDNGASESPVDTRTPWCVDLGLKPNSQRKGLLYDPPGAATRLSTQMALRTERRLELKRLGTPNLGDSIGHGVSYPPLVVKERGLKPVWGKPTAVPDSEGIMDTPCED

SEQ ID NO: 1002384 - protein, 241 aa, Homo sapiens
PGEVLEGAGRGSGPHGHAPSAGSGPGFGFTGSLCLSGRLVQVGGLGLPVCRSGLRRGCVAPLAASTVQWFALSASLMCLRSISYRVLKHFAAGRSRCALLLSAQASCMDLLLRHFIARKGSVSTVAWGTVVSMRACLTDPCLAALWLTWGPALHASAQDCAAVWPCSGSSPSTREAEEPLGDGGLSLRSRGLLGRIAARLASCSESTSIVYHRITRSVASWLTHFSANPWTSPRRYCQLHT

SEQ ID NO: 1002385 - protein, 175 aa, Homo sapiens
AGVADPAGGASDNGGPGTTSSTTYFRSGAHRRYSGVALRATLVCASTRNEFKPGDELKMHPSCVAKFCHPVVIQWGQCETIKAHDLGTPTWPGMPLSCAHQAYRRYVRVSCTMETTHGIGGNGTNSRKATLSTVEQTVCLALELDMDVCPCAPADHDRGHISRFNPIGVEVRGQT

SEQ ID NO: 1002386 - protein, 107 aa, Homo sapiens
CERGPYWRLFWYSRRSLQEKLSQKSGALDVLQVKEEDVHCKYPCEKREPNLRVGTEVIDVPRGASTSDEQWKKSSGIIIINQHLEGRTLGEASRWQLVQLVAIEKPV

SEQ ID NO: 1002387 - protein, 279 aa, Homo sapiens
MVLLQRNRVKGIKGIAAGWSLLLPISSGFHGRLEPGRDHPTQVPEELEKGSFVGNISKDVGSGAPGAGGAAEIRIVSRGRTQLFSLNPRKWQLGHRGQDRPGGALRSERAVRGESNILVEDRMKLIGIEHKKYVIQSENGRKIPSMKDLDVNINENVLREMRIPLPEAIDPDVGVNSLQSYQLSPISTSPKSSEPCQWRQVLGAGTGSTPLNREEEAIQPPWSSTGFRRGEPLRSWHCPCHVSNWLTDGKLNNARVFTFGRNTASEWSYENLLWVHPVC

SEQ ID NO: 1002388 - protein, 135 aa, Homo sapiens
MAVTIGCTIVLLRPCGSSNVEVLSVPKLRVLPTSNKRKKKRRTTCAGPPNVQGGAEHTREQKREKCATTHVVANNSDLLPVEAPEAIFREELHTVVDRTVTGPAFSPHNISAKLPLYNTSPELAARVCNNPGTLN

SEQ ID NO: 1002389 - protein, 70 aa, Homo sapiens
VCRQNTGVVEKLPLKAKMGKEQTHINIVVIWTRRFGQVHHYWPSASITCGGIDNKQPLKTFDEGRLTEHG

SEQ ID NO: 1002390 - protein, 116 aa, Homo sapiens
RAPWYSNCRANPQRDTLTCSRCDCHPLLVLGRAAIRLLLRDARQVPEITRLDNMLRRLAVHSEAALKRIVVLTRASLHADSRETLYAMDTSARLSEGAHGRYCNCSEIYVFSSFED

SEQ ID NO: 1002391 - protein, 270 aa, Homo sapiens
TGFRVLKGAGAGGSSSKGGSESLRSTFGGGPLCRAKGMVRGPYRRGGTLERRKESPSGLAATASKFGGGAFPVAQSPEKFSTTRRGPWGPGKSLHGPLWGPPCGRRGFPQVGRETPRDAGCGCPPWDSRATAPWAGALGETPGGTRTGNNLQGRFTPEGPSVGLRISELCGLFVPRGCALVKVVSPHSFRLVGPFFPSYVPVVAPPGVHTDVITGVSAALHCGPKQSGHAEKMFRGNHVANGEPRWISNKMYLGEEVFARYLLAIAPKKT

SEQ ID NO: 1002392 - protein, 291 aa, Homo sapiens
MAFRPESWNPTDIEGKKQLMTGELSRWTSSSVACTSEYETTLEGLALLIDGMWLLDNDRSLELQNCRNAETSGFALNLCSQREPRALGNQTIGADSLETAGPPLGGKEGAIPIVCELMWDDNGQTSSNLGPKDMKKPKGRRIQSTRVHRLQNERNVTTVDRQRARKRNAVDQAHEAKKTEGRRATRPTECPRKNNSGISDTRKGERLLSSTESQSDGKTGSIRFKALKSWGPSQSSSKLVPNGSNRLRTGQGRHAWIQWGTFLALVTGTTHMEWRHRRGLGNTTARVYMGT

SEQ ID NO: 1002393 - protein, 140 aa, Homo sapiens
NLAFCLTWMSPTEPDPGEDALHVVVVELLKATLIDSHEDAIFDAHWRTQRHRELREVGVMLMRNPMYPGRLQGALEARYEVTPNAQSECAETWVRAFQVLNFIRGHGAHYADAYAYVGKRTCMVRTPQMRTEQPLFIDLE

SEQ ID NO: 1002394 - protein, 118 aa, Homo sapiens
GRGDASGTNAGMAAQRRAPGPVQTCIGVVMVVLEKRASCHVIGLGESEKKYVATLGVEVHPLVFHDQAEDLYTFNVCGHRSGQEKFGGTDEMAIISKTSVPINNCFDVTSRVTYKNVP

SEQ ID NO: 1002395 - protein, 125 aa, Homo sapiens
PKQPQRVHRGNFRPQLYPRRVPGPWVLGIAPPSLAWVPPLPIVPGKPLYRGAARLSVWTLPTVLVPGSHIRCKGRSVGPHAPRVFGPTYTGLWGEKNRLWRLEITATQGKETRRSQGDFSWRRLV

SEQ ID NO: 1002396 - protein, 241 aa, Homo sapiens
GSEQQKPASSDAVLPATMSITGLVQVSENHFAVDEVLGIPDAQATHVIMDMELGTLVDKIEATRGYGYGYGYGQDSTSKYGYGYGQFTLLRKCLDIYYKNARHIVPRVAPCRLPFYPEINQRLDMVPHLETEHDAQGGVYGSGGRRGMTAYEYLDSRAVLSERELYRSGYDYHASLRPEDGNAPMRDNTMNYREQFSQCVVDRSSLRSQGTGHGPGMPGAAGTRPQAMGAMWEDPMGARGP

SEQ ID NO: 1002397 - protein, 254 aa, Homo sapiens
APVPPSLGSKDAIQCLWLVTQCHIQITVLASIVTMNCPQGNCGQQWTVDSRSRVSVVARLTASEASLALLDLVDSYHCLIRAGPGLCDITTSAMFTLLVRSDEALEGPCASAPRESRLLFTASGLLRCFLWLFNRAATIHIAEAVTHKSNTRERVRIGSRKTSRTMKPDIIAEQGKMKANAYYSTTYTLSGQRIQFQGPKEESFRRSRLAPMKGSVGIEPRHLIPRSRMSSGKRPTIAKTPGMQKHQVKAVRDS

SEQ ID NO: 1002398 - protein, 403 aa, Homo sapiens
MPRLPQPGLTPPARDRVAGALLRSASCEWERGRAWSLDGLPPAASGSERGLRPRTVWARGYRRQQTGVPMCGQNNNAPVTGGGPPPEPLCRQPGPDGTWRGPCGEGPMQALIRWTPALTARIEAPPDNIRRMQTSKTGHTNSRYPFEMAHQTGRLAKKYSGLSKSRKNCTSCPRGTGDPYTTHWSGGAGIKRTTTPSFGSGNRRKPGLIGIDWAGTPDQLRTPSNLHNDSQKKETLGSYIEQRPSRHMARDHDAQQGRHPRQTGRSEVDGERPWGREIHGHNSSWDGEEPNTPHGARKGSHVPTRARDTCPERESRDTHAETRGQTNTRGTLRTHREHNYREASRWNTEDQERKKKHTSHRTNKQCTTRPRTQNTKKPNASHKRQPEKRRNEGQRTTERRERQ

SEQ ID NO: 1002399 - protein, 404 aa, Homo sapiens
MLVEEMDWLLPTDIQAESIPLILWRSVMYLWLQKQAPWQNWCFEYSSYPDSLHETSERPIRTANNGKTTIKTGASVLNKWQMNPYDRGSAICNWAPRMVLCSLNTQANANGTWHGLESYYQDFMTQENETYLGHAMPVTSNPRDKKTEDSQDENLTPPASAHSSRRTRKRYRAPNTTRDQKGPPERRHHGAHTQTPQDKQQHTSLATTGTKQRQRKLTNPTATETTPTGHNEYTTRRDKLRITRGDEMEPNSIGDTKHTHCAQPRTRSAAPLGRTGHVHDATPSEHEEYERTRQRTTRQVPLCARRRLMKGKTSRRVRSKQKTLRSTVRERKRTREGPTHRKKRLRVEKRRCRQNDRLEVTENNTAGTEQQDEEKEQKAHREPKKQRRKRTTTQHQRHEHENKK

SEQ ID NO: 1002400 - protein, 344 aa, Homo sapiens
SSACGAPWSPEGLVTSADGDSPGAPSWAPITHTPSWPYEVGPAARVTPHRPAHLWCLHSSLHHVLVSGGLAVPDLPVVRPPHSGPLHDLLQRGLGDVPGAPKQWHSCQRMVRPGPSLRHGPTAFQPWTLECRQGYLDGGPWVLAVGTHGADEGTLAPVPQEAHLMHALDQRGLPEGCQGPSSLDTMQTLEPSEVLAVIAHWLTPDQEASQASTHVGNRLERTLGSVIRDIAPNSTTCLVGSWGTRRDPTDQGCPLIQSQYRCRIERRNQQTRDRDPERLRKIEGHLKPRHISDGRSSTGQRWNSKTEGCHVSIDPMEGGTHSAAKRLIALLNGVNLGTRRNIHR

SEQ ID NO: 1002401 - protein, 227 aa, Homo sapiens
MQVNYASQARMSYRGQSSAIGCIMRCKSVSNSHKVEYVRATGFMNQFILSLRCIATPRVYAITASNGYGTGVKKASVKGHYYREKDARYANRGRVRAITVAFLPLPVRGLDFIPFDNSSPFKNHGRHECPEQQLRLNARQGQHHLTLAENSDDGKKWRLPGKDVNARSAHTNLPKLTTRDELSRQGGIFKGGYITTNIPRGPHNRVNAILPAGETLAHLYRPLWRSE

SEQ ID NO: 1002402 - protein, 107 aa, Homo sapiens
WGSLTSTWAVGKNKRLTKGGKKGRQRTKRGLDSNFLKKDWVIDGRNAPWLWSHIIRDTYWEKTALSRRTQGTPKSGTICESGLLQKGSRGVCESVTDSCAVILRHKQ

SEQ ID NO: 1002403 - protein, 104 aa, Homo sapiens
AAHPGTSSDGSCASTSAVPAAHAGVAVAARLRLPALRGLCGCGPAPPAAGQLCTAAGICCGPVLCKRCVRAAGDNAAMVPPRSASDRDEGVGGSKVEAAGRVPP

SEQ ID NO: 1002404 - protein, 287 aa, Homo sapiens
AEKMQDLGVISSISLSWFLTLFLSVMPFESAAGHRLMCFFYEGMKVILQVALDVLDANMEQPAGLEREGRGMSMLGHDTWIIVVNKPRVSLLLYPNLRALLSRSDDRHLAEVDISELLEKCPHAVRFSEPEGRKTLYMMRFQQRLKVIQSLEDTAKRSVVRAIPVDIGFSIEALEDLYMVFKASTWTRPATGGAACTIGRTVWEHRHDLPGASNEIDASKFRELFASLNPWTCGLTIALLLGKGAMYSGYLDENKDSVIQLQGSRDRIDGMTKGPEEKDKVIKSRHT

SEQ ID NO: 1002405 - protein, 275 aa, Homo sapiens
MSILKIHAREIFESRGNPHSLGIDLFHRQRGALSELLCPVVLHTGIYEALELRDNDEDSRSMGNGMSSEGLLRRPVELNFCAVPVAIDREFLDRLLRIRRTMEEQMIEMDGTRRIMSRVPSSEKVAPSVKAVIHIVRSCVNLRGLASNKGEDPIFIDCLIRLYRWDLVILLDEFVAAQLHGYTQIGHWERVARVPSIGLCHSRFLWARSHLTVPIESLHTCPSWRYGTSHEDTARCDSPWADVPTIETWMEIGRRNGEHHGKAMRPIEGRLKDGQ

SEQ ID NO: 1002406 - protein, 396 aa, Homo sapiens
GCRFAADDLGPSGRRLFRAALSLETGTVTESHRTCMVQCPRCQTCLAVADRVLGRVASEDVHGLEPMNPCGLCAMVACRIARRTRDEGTTCRVGPDVEDISEGIKERSYLATVRRRCSSLCTRPFGEIAWFYSKLGRSDNLCRKADNIHRGATLDDYLKLVVVTGLCRRKGVEDIAELKQRDMATRGYDPEQIRKREHRKGAGQPGLSGNGKHVKRKSSNDTSASVTGLPQAAKRQANSGQHCSRGALDPDTDTRESGSGTQPEVTERRGHGVAEEPTADQYPEGDTLMRHRRTTCMGRPHSASDRCDFEVSASEAAGRQRASKQRDPTLGDAQQEQLAYRHVRQEPSEREPRRRGQDGSPDSAAGEANMAHGKERRHGGEPQERAPGGEGERPVR

SEQ ID NO: 1002407 - protein, 450 aa, Homo sapiens
AIEMDQCWTGESHYLPGAALHRVQTCVPELTVDQCVTLAALADGIKMLPAGTARCQPELSICLPAMWCAASLTVAVMPMPMTSLDCCLVEKLASVNIVKEAGEVSSRHSSLDELTPARKARSLDPTAGPWAHMELRAPGTTLTRNARRLVTSEWGTSHQKGDRDGWTPDGTQQYRREAKTRAGTWQNRNTHETHAHENDRTVGTQGNHQEGNRTDNQPAQWTAPQHEGDEKEDEENKRQAEAAERRKRAYVCSHKRHGTRTHANPTDEGRRQCHGRAPAEPRTRKAIVTRHPGTGRTETPSPKDSQRSDSADDTHKWPENAREQNKNPWAEPHTTGGRTAHRRTAQDQKGAQEEDNDKTTAGEQSPPELRLKPQRIEEGRQRAQSDTPKERRARTRRKRRRRGTRNTDENRGGTAKEANKERTRDTRDEKKTGSGRTGGTDTGEGRSQAE

SEQ ID NO: 1002408 - protein, 263 aa, Homo sapiens
MCPTHVQQGAFHYGVAITPTKLDVYKATHATESRVAVSVGPRTHNPLRGCLNCLRSLSYMFDSYRMLGRSQKLLRLMRDIQVNLGYLCHGMYSSSPAQSKDAAALLTGTKYGDWPSPSACCPAMSMMATVMHASAGPSLRPSSTAADTEASEQRGALHHQIQYGLLKILSKTLAALTHFTPDVCQILLDQSLDLAEYNFLFALSFTDSHLGLRSGPLLRDPSGTVNVALNMLGELDKKKGSPSPSAVGLSTPGRRDQDVQSPP

SEQ ID NO: 1002409 - protein, 110 aa, Homo sapiens
MYVIGHVDSGKSTTTGPSDLYSAVVIDYKNHGTEFEKEAAEMGLRAAFKYAWVLDETVDSLRRERGISIEYLLGGEFETSYSDYVTYRFDAPGHERLYCKNMHVQGTSQA

SEQ ID NO: 1002410 - protein, 74 aa, Homo sapiens
GVCPFTSDQEYFLFSHVTYSTFPETGTPPLCVSRGSDDYACAMTASASRGIDTKVSRRCLAWNTAVVASLYEDV

SEQ ID NO: 1002411 - protein, 306 aa, Homo sapiens
MARSHCYVYLATLVLSATGKELPEDSIQANRCMNPRWQNQGSQVVDCCSLLRIACSMVRSNSDETAQCINSRVGTTPDGKRQLRRTQWLRHSTELAVTTEVRAKEMTEHLGPPSSDHRMQWRKWQEQKNRGHPTRRGNDRQRQRQNKREWRTDPNAKRGQTEDCDDGTTQITARQTREARDNSPLRHTGRGDAAKNKTPPTKTENTFRRNQRPKERGEKPTKRKATQPNNRNRAPKEPVRKETTEQNKSRTERQSNHSGQRARDETNTEEDYGGRPRAKAMGTEKRARKQREAEHLEDETTQTRHA

SEQ ID NO: 1002412 - protein, 221 aa, Homo sapiens
MDHGVGRTLVSCLAMNYYSGIQAVVPICLYMYSSEECDLLAVGSYRSGKGMYETHAAPTRTEPSGVERAYFAVDDSVYHTRNNFKLFAKLLRVHLELGVVTCNCKGTLKGGPKGCALPKYEQVAGELNPGPMPRLGGTSATPLVCTRPPSRLKCAAAFPLKRAFTLDLRTANRFSYKHPRNISFTVVKRGNGWTASVYVITVVVAQCQSISHDRTGANQCP

SEQ ID NO: 1002413 - protein, 335 aa, Homo sapiens
SERRLANVRTSTPTTDRAYSSFERRQRVPRHDAGGHGSRSQKEFAHKSPPTQRYVGPSTFHSTGSGRTISMLIFQVISAISAVSRLSQRHTDTREISKDFVLVIDIRLNVDFPLQDSLDHTTGCTCWDDWFTISVGPLQTGRQTKTQRMRLLDSHDTHGRTHRVTRPASRGLDRTSTRRDTRENGTPATRDRHRTNQGAHPPMRARPDCRGKHWRADRADRRDHARMGKSARSTPTTSTSKATADRREAPTDVQADRASTKKGGQTDKATTINKAKRHSPTLRQRTRVDSQRLQSGSMAHRDRARKEADKDTEGRKRDGAQDTATQQHTRTEDGE

SEQ ID NO: 1002414 - protein, 349 aa, Homo sapiens
MTSGFCTSPLVCLGEGTECQSHTAQNSLTCMISESSKRYSTTAGILEEHVGHGILSRKSLHVARQFARSQTFQSYRILQDLAWCLFIPLHKWCGYNCHGDELAVGSSRQVDSKRQMGQTDSPDGSHMGWGSCHSPLEASGCEGTKRLRYMSSSDSLNNRAIEGEARPFDALEEGNLIFGFGKRGYPNREEEGQGIGSSFVVPPNPKVPPKSKVLNSQVNLFLTLPISLSQGLKTTGLKPLQHAIGTHGMASVQKNGPLILWGQLGTEPYMQGPMMKVGHTFRRLGVQEKRKSNPNNFERDITFVQSAADNRTERKRYCDMGRHPPPEITVGPEDDKKATRRHLTGGELQ

SEQ ID NO: 1002415 - protein, 197 aa, Homo sapiens
MKGDAVLLLDRDWGCCLQCSWASSLVPGGLCRKWMLDALSCASPRLCEQGERSHGSVSMVCTIGGTRCCRYCACWSRGLHAAGWRNLCTKAGVRFGHGYPAWPVVPGTRTRARHRMTCRDFRTLRDCMARVRSCRGHVASYCLVTCKNAQLFRLTKVRRTYDAVPSKIEWIEETLKGPRSRRPSFRNKSKKCTRSQV

SEQ ID NO: 1002416 - protein, 224 aa, Homo sapiens
GPPCEFRVAMLYFSLFWCELGLCMRCGQLVRMAIAVLSTGNACPDSSLRERKHAGSELAMDEPCQWLVILEDCWRCLLLEAENVTLQVLVAVDAQLASEMNFVHAELRMEALGVLSEATMYSEVIRGNESANGGEARRIGCDEGCEVMLVLQEALDAEGKTRMFENVWDAAGNIVERKIVLVPYDDLKYRGCTESARTRGVRIQYCRDVMSWRNHLVEAGHIQL

SEQ ID NO: 1002417 - protein, 174 aa, Homo sapiens
MKRYRSCRDVNANGKRTWGHRQFESTTGESRTSSPWARDGQQPVTRRGATEPRRPPNSDKVAKAPNKTSQLLTPAVTRPPRGHSPYSTRWLADPPNQHNNPTCSSRRYTIAEPMLRPSCNGRKRLYHALERTEANFDSVSAHHVTYLHLYSTRNLPDEFRINVNIYGVRSKRAE

SEQ ID NO: 1002418 - protein, 102 aa, Homo sapiens
SSLTFLKGSQNPVTNLWAQGGFPLKSYDDLKNVITLKRATRNKQKDQEVAPQKHFSLSPSRERFSRSAVCYTRFTPSLCIIHHYRHFKTVAYSVHTPQTRIR

SEQ ID NO: 1002419 - protein, 109 aa, Homo sapiens
GTGQAPKPPRPIVLDACGEARGELTSALSAGYLRRGEATKVCTRRWHWTCACTGAYMKTAVKRTNVCRVVIIYVDLVLSWDGLVGDPTRIYIRGSKEDASVSQPERDGS

SEQ ID NO: 1002420 - protein, 273 aa, Homo sapiens
PCIIVTMPPVVAGSTLPTGMGVCVLGDFISWSGMKGEGICEAYLGAGDVAVSYQASVAGPVVVRESISSSCFSLYDVLELDEAMRRRLRVEFMDAGLMRGYHVPSPVALTRYPVIQHQDMSTQAQCIPGASAWVLSCGRLAGGMLRDGASVIEWHTHCKPQAQACKQWIVHVACPCRTACYFTVTVVNWAGKESSLGDGLLGVQGLGEAAGGWNVVERWGRLELVDNDFAGGNRWVGRGRRLSNNEDARSDWEAWIPEKAIGLSTVGFGNGPP

SEQ ID NO: 1002421 - protein, 356 aa, Homo sapiens
MEATAPGRCLALRRCILLLTLALLRDQCPEDHLPPVARADTTAGKPPADYVPWGAVFSGSCVLSKKYGPVYTIYLGPMDGLWWSWLAQERCAGGPGTVRLRSSAGLGNRSDAGRDFLMAMAVFYLQLGELVEGSLSEVYRCLPHAATMAHWGKRRQGEELIQAEAPGDLDWRPFQGAPDRTTHFDSPQRDCMGTRQNIQTLALEFPPYSGHSEFIPYGGLRAVPRASSVRGKIGRKRLTCRTSRLPKGRRYTNRKAGMIIAWLSLRDPFTMGPPTKARFLTTKGSERCDLAFHAASPSNGRKAAHTWQTLESISGPPGKVNHVDLPFRWDDGWETRQGDRVRQGTHTLLSMEWQPV

SEQ ID NO: 1002422 - protein, 175 aa, Homo sapiens
RRAASAAFQENVGRQGTFPHGIDILTTADYFAVGNRSNCFLVISVFIAGFPEYTQPMIDHLVTMKISHWDGVILTSLAARALHNLAQQAPDVQRHSNVFPRLLSTDTELQHLHTEAWRRLSPAQKSLTPCTTLATPNENRPVTDHLDEQAVQGLKQIHQQLYDRHAIQGVWEDSS

SEQ ID NO: 1002423 - protein, 212 aa, Homo sapiens
EPFEPWGTLTDCVVMRDPQHKRSRAWVVTYATVEEVDAAMNGKANKVDVRVWNQRELSPEKILQDQVPTQLCNRSSVWWHYQQTLKNITYEIISDNSLDTSQVIEITELTDAVATTRGFAFVTFDDHDSVDTIVIQNYHTVHGTTVKLRKALYKARDGYALHPAKEVKWSLATLVVVAGGGHRWEPTNHGAGTGNTPRTSDGPRGRPAPAQD

SEQ ID NO: 1002424 - protein, 344 aa, Homo sapiens
VKAPHVVLYVYTGGSHCDGKNCHTCFWAGRRPDPHCCPHLTHFIHIITGCGCCPGLCLPSSFLSSLTYTWLAGCPLFLIGSSSYPHARRHTARLATCHGSALDPFPGHNRTGPPRPPLVPPAQPPFPPPLLAGPLMALVTTDISPHSLPPCTTTTLAHTSLTPPRKPRDLAPTLAAPPPHLPPRFSAPTKSQTPSPTAKPPCEFTGTNERKNSTRPPCGTAHPYQNLSCVNPSTPTAFSHAPYKAPLRGLYAATSLGLTPMRHHFSAQACIPILRASTPRTHGYPTAPDPDTPSRGPYQSPQGPPPKHTPSKPPLNDTPLDAHGPEEHPQGVGAKRGNRQLGPP

SEQ ID NO: 1002425 - protein, 386 aa, Homo sapiens
MASSPKRDPAYLTSGPRPLCGAIAPGVFLLVAPHCLRSTLIHASRTARSPRGLDATIGGVLGATRLQSTHQRDDTTGTSPSNVAHNDRTKSLRAKDSFFRRRFIHRPLSMPLAPATTLPNQTPTGMRKTVALPKGDCVLSLQAPHVAPHVRSIELYPAVYPPVNSEEAYQRVTLGRRRPVLCTSTNGRESDETGGRSRGGRLGHRSLEHPQQIARTVQQKDTANGGPNDDTRNETRTDGSNAGRAPETSRHSSKPPCTLAASITHATPAGAKATFGKTENAHNTTHYERSTQKGMRMGERLTQGDEHQPTSTSIADEQAITTEPTKRDIAQLDLEQPQHHVRHPTDGPRRNTQEPIATRTDTHNAHTIACNSGTTDKQSTHYKDTT

SEQ ID NO: 1002426 - protein, 236 aa, Homo sapiens
DDLGSQPHEDREPVDPTTKGRVASFSIPGSSSRYSLGPSLAVGHEVSERVQSSEMGTSVLIMLPILRFLQLLCENQTGTCINDIGRRKNKTRYKWVWETLQLLDMMCGRTTGGLGLSWGSTSMKDNVGLVIQELGDPQLRYWPGNPMTMRKPEYAYVTHRDPSGHKTIISRTDPSNDSRAHCASTDMDLGAEDQGQLGSKLLLALIGEPEMTVHNAERILISLRPQELMEVIKKAY

SEQ ID NO: 1002427 - protein, 158 aa, Homo sapiens
PAKGARVLPRKLRHAIGVRPSLHPATSTASGRRQPVHSPAPVGSVSEARLSVNSGLILSRQIEVTVTEDKINCPHLNAAGVKVLKPFWPGLFATGPGQRHSIWDASSAECTGPVDLLQAAGAASRQEVLAPCQLLLTPADGERHTWKTTEDDSNPRDV

SEQ ID NO: 1002428 - protein, 322 aa, Homo sapiens
SCVLTGLDRWCVPSPNCPPLCLAYLVDTQSLCELQLMESEQFEMRSTTIVILGFAWNLGASVWHESSYSRMSLIETSRYQIICKRNTLSGMLDYSRQQIGLFVYCSYVDRGDEVLTYVGQSMGVSSDYARHRMRQHHCMLASADSKGLAHGGCTYWLMWYLPVPANSMIDVADDQRDGGPVVRLEDLKLLLIQSQYSSEMIHEAAYQGEHSRPPAFLTHRKRSKDQPRGACISYLRNYYTPDRMVLAGRGRGARAIWWTVPEVPTGGPAGLEGAQRPWHIGQILWPQSTGGIANAMKRELSHLQPGPNPIPGLKHHHMRHLK

SEQ ID NO: 1002429 - protein, 229 aa, Homo sapiens
LLQCCELEAGELGMAVPAAAMVALVRWARAAPVSMAPWCSVEQRARRRYCAWDARSLFRGHSKTTRVPGAQRQGAHRVAMEVATGVALASGSFLTMTDKRLLAGEGPVGQRTTIYRGHGDTCGSSLCWHSNVIPDAIPCTVVWRLITHSQSGTVRIYKSIATVNTKGEQHSISAGCPRWADHWLIRQLRMTVVTVIVDAKQHTCSDEAEEQVQRFEVRRNLPGTMTISM

SEQ ID NO: 1002430 - protein, 79 aa, Homo sapiens
WMLPNFYGPAKEITRAIKTFATVRQMPNVLRKRKGRKGSLDSQHVKKKCGFRRPKNIGSQRLEKRFGVGNSRKGEIERY

SEQ ID NO: 1002431 - protein, 90 aa, Homo sapiens
APDVAFLCRSRWKKRSPRLVIDNGSEHVQKRGFAGDELLPQSLCCPSIVRAPQRLEVVMCGHGPEGLLTWVDEATEQGVAHPDPLKVALH

SEQ ID NO: 1002432 - protein, 229 aa, Homo sapiens
RIRPARSHSVEQQLSAKNSTLKQLEEKLKGQADYEEVKKELNILKSMEFAPSEGAGTQDAAKPLEVLLLEKNRSLQSENAALRISKQDETLKPQRVRSCKSVSLRLGTARAERAIARGAGLSIISPSSGRAEGAAEHRWQKIQSPSKRHCLSTDLSTSQGALPEGRDHASIISSRGTSVPNQTEARTLPDTSGLKELTAARDKSALEDKSCEYLRAGQDDRVGTVHREA

SEQ ID NO: 1002433 - protein, 83 aa, Homo sapiens
MAPGGERLEALTFTDNARVSSLWHPSRLIERDRGIRTYHRGNEDEREEDPGDRKHRVGWTRVSLGGHNTHQEGGPNLGRLPKL

SEQ ID NO: 1002434 - protein, 217 aa, Homo sapiens
MVPSKKSITSPHACIRIEANPSDRESGPNRGLSCAFEPMTGGLERSRSNIIQLSVFVSRDEAIAYMPLRIGVSPGGTIGMTLTDDEILAGPEFHKRSAEIPEAQIHEGFQELLRTLNQADRHCSMLSTRHMACAIETEGLKLVDKFLEDGGNLVRTENALRVGRSGGQREMAERPESRYCVGDGVHPAQGERSAPQELDQAGLRTGRMAGARGGWER

SEQ ID NO: 1002435 - protein, 243 aa, Homo sapiens
CKLVPGVHPGGLTELWSTEHRILLKSLSHKPVTDEHRTLHRMMTEDALNSDPTRHRSTTDTRTSPERRLSSDTSRGRLVCVRACPIPPMRASLSYAPEMIQTWDHLREGYTLAYEDHLDPEKSMTRCHRSSWGSQDLTHANTFDPALDIGLGPEDWHRRDSSTKRAQLDNGRRTRQQTNTRGLGRWPDREVVGSEVLSIMIRPRQRGASREAPRETQYGGQTRNWTLGQVWSQATHMGASLRR

SEQ ID NO: 1002436 - protein, 363 aa, Homo sapiens
ALSLSQRQVTRGGVGVESGDVAEHLVMACTRVRMSLPAMLGALGIGLGELVATCLALFCPSVRPLVRSQQPGSGPGMSLHVALLAGPAEGARDAQAVVTACTAWRLTGSHAVWIDDGPGSMFNTSLAPDTSYNKVPGLPEKRKDFIGSWHGDRTLETHEGANEKPPERHQDSIASSKHYLGIVAVNFTCRPHCFRLQIAIASTCITGPINEADGRPQMGTSNGCIGGGALREDRTRGGGYERLKKKGGPKVRYREDDVAKHRIMHTPADGSQYNFGVVPLSALPVVLLRGPWGNTVELLKRYARSELERELPVRSVERVKGSLTRSIYIPNPETWPRHDTGRKTSGGSNVSHLRHGAMQRPMV

SEQ ID NO: 1002437 - protein, 376 aa, Homo sapiens
GSAARSPAVPEHAVAMRPLRPRAGCCRSWLLLVVLRGPVDRRPRPRPWLRVDGGRARVWPLVRLLEEATRSFCPLLVTPYQDLTWSVAFQVGDASTAWTVHAYCWVRPVPIDLLGVPGPVFPGSLTLRLCWSPYRSSLRKGPFSHYVSVGAHEGLQIRSGHTLCAPGGSPWETLLFAVGGGRHASHSPSVAKARLEVAVLAWPSAAPRVSVLGPFRGGTECRGGVLVFGISAMGPSGVVPASLSSRRSDYRYEDKALRSNLVQPNCSPEGLENRFRRDRFTKVESAADTESIVNIIGARSGRIPACTANSQQRCIPPGSLNLTEMSFSFRREGLLVCRPEPQCPPAPPCGAFRQRTAPVDSHIHLPYSRPEPDGIC

SEQ ID NO: 1002438 - protein, 374 aa, Homo sapiens
AQTPRGAVDWSVCPLSCSSLARWVCLTVPGDTCLLGPCPGGYSGFSAAAPCVLLDWEEVGCVPSLSRPHLEPQVAPADPVCSCEMSCGRSCAWVRPVPLALLPGERVLNGYCASTCTGGLKWQRLGQYILAWLDALASAVPDECAVGLLGLWWNLGCDADGWSRGKNRCHERAELSQRAQGGDEARQDPRTAENINARAEGGHWHGDETSHLKTGPEARGWQQRPPGGVARGVRKEGDAMGWTGGTQGEEASPGPGERPEGAEPRERYAAQKGLQGARPGRDSGNATSPAAISTQREPTGEREGAQHVGRGQGPQGGSSGAASQGDSSEQHEAEEANVGAPRSEGLNWALPESQAKQARKQTRSPSAQKVAAPT

SEQ ID NO: 1002439 - protein, 247 aa, Homo sapiens
PHRLLPPAAAAASSAARCQPRRRLGAVPRLRAMGAGGLSMGAAWRRRMGGRQPRAARKLRAVSGGRGRSAGSTPLTAPQTAVPSAQGRRGAFCGRCCSREAGCSRAAAALCLAEGNLLGKVKPQAGLLPAHGMWNLQRTNRGLQASSTTPSQPNSGGVQDTEMGPCRRHSGPQVLQQTPDLRSTAGGSKQSTLPELVTIEAFYRKAGSARSSQGAAAEGSLLVLCIRIGEVPWQGSSRLAMEAPTLA

SEQ ID NO: 1002440 - protein, 136 aa, Homo sapiens
MNRNRHESRKENKRGRQQENSVQGKYRTKDTYNTKQRDPQNNKSQEEHKEEKHEKGWTKTKGEEKKTDKKENERNKRGKKNNIERTQPDQKTQRDREGHQSKEKTQQKEQRRNAMEAGNTHKRETEKRKRGKNTKR

SEQ ID NO: 1002441 - protein, 165 aa, Homo sapiens
ISSMRHSTQKADDGRSFPASYRNPMCGVVGIKGRQGRGPPGTGQLGETSNQGLDGLSERCAQYKKDGADFGKWRCVLEDWGTQPSQTHRHHGKCQCSWTRCASICQQNGIVPSRGALRIRPDGDHDLKLLSSTVTEKVLVCCLGGSDMTITIYLEGTLLKSNMVT

SEQ ID NO: 1002442 - protein, 277 aa, Homo sapiens
YKDAMEQCQNYNARLCAERSVACLSCDSQTGVAQSNCYIWTGKADTCGSMDWPPGQLYSYPALAAGCENTLAMPIPLRIHDFSFPSIKPDTDQTLKTDGAESLSDGSTLEALLAALTPCRTRGAPDPRVDDSTRLGEFPVTNSRARPRILEPDDFLELTSTDERPLNERLLPNAVGRTRGDHPKGPTRRVGAEARNGTAVMSFQSLGSDSGCIRARMPCCTTRDGKHRYTQRNPTQGPPSPPDLHRPNYHTIAYDRHGAAAPNPTDNTPTHHTPPPM

SEQ ID NO: 1002443 - protein, 215 aa, Homo sapiens
AFFLALTSKPNYSTETSSWTASEKLEYSLRDTILPDHQSKVHHRPVPSLRTPYTIHSTTVNASRPLIQSRVNVGHQWLLRPYAVQPNYGGAKCCQSPIILSPIYSYEASASTAISLTLTIDYYSRLECPHSYNNYITKTVLHLMRLSRTIRLKNRCNSRTSKPNHFHRYSTGGYTTVNALKSVAAKATDFNALSFLSNLIPPIKSLQHRARILPY

SEQ ID NO: 1002444 - protein, 108 aa, Homo sapiens
MRCAWLKADDQSAHQHAAVHRSRARFGGFMRQRALASQCAASTGGLLIYYERGRRSTHACPVAFAPLFLGPTIQSSIRAIVPWCSTGSIAFEASNRAFAFSGSMKVPP

SEQ ID NO: 1002445 - protein, 175 aa, Homo sapiens
MGLHGESGETNGGFPISIGTTPLGRALDPGALSPLDGHGGGLGPPAPMGPPPSVGQEIPGPFRWGFAKSGGGEVRGPDGRNFSPLKTENWLLAGERKGWLVPIHWHPLLRHPVRVGLGLTIVWKYFRKSLGKGHRGNGAHNTRKRARSLESFPRINSFPTRNEHFLPRTTQRTRE

SEQ ID NO: 1002446 - protein, 108 aa, Homo sapiens
MRRTTETMGKNTEKEHINTLELNATNKTFMTGNTVHRSFNTIPLTRNEREKGPLTTGSQGSKLQPIAVGKRQRTRGPTQKGDRTHEEIDRRKEQDTEANKDKDEHRKQ

SEQ ID NO: 1002447 - protein, 97 aa, Homo sapiens
QHTPVSPPLRQLVPRNAQCLQRTAGVAVAARLRLPPCAGLWACCGCCPRLLASSALACVALAGCPVVCFLQAGCRCWAGIGDNCGPCVAPEICLRKD

SEQ ID NO: 1002448 - protein, 176 aa, Homo sapiens
MCLIDFCAGVSKLYKVGLGLGYLELSQYQSTKSLLMEHKLVSQGWSVIARNAAAAESAVDTRCVYILDCWSDVFIWLVRKSPRLVRAAALKLGQELCGMLHRARHATVSRRLEGTEAQVFKGKFKNWDDVWTVDKTCNADAVLPEPGSLREEVKRDAEKNDQMKADSMRFSCRGSS

SEQ ID NO: 1002449 - protein, 110 aa, Homo sapiens
ANVTRVQDAIGIVAVLSGYQVLLDSLRIPSFRPYFGLSYPMYASRLLVDKFRRYIVMNENDDFMIILVLSDCLRYREVRGIARIMLSEDLMGTTTFKSDKVIACVVTKLA

SEQ ID NO: 1002450 - protein, 83 aa, Homo sapiens
QEGRTRAEERRGVVVDERRQCRRTEGYGLAVRCRRRPWRSLVSQTALSGEGLSREALAPELTSSEPGGSCCYVRSSMASQQSL

SEQ ID NO: 1002451 - protein, 430 aa, Homo sapiens
MRMRTVRGTRESRPRIQTCINESAVNRPPRSSFPATLAEFLLTMSVHAIEAEWLSPRYSRTARTMSKKSRDATVDYRNMITDMSTVDRAEAPQGAIYDLVPAVTERELVDGVDDTVAISGGIQWPLPENEMCGSINGTYASVGIACRRSERKDAEVGGPRATNASSTSRWSIWALNTTRSRGLREPSMLQAAKGNKRSTRAGNLISWALYRPIATRVAVQSHLVARGNPKGGSDRHGTKHENGRDEVAENAHVIWEDVCQPNTEHRFAYTDVEKKDERKVGFTHTHNHREGNAQNGDLRSCVPTVGRYTLPGMRKDGGEQAKNKRGIKHPPLAFSRTPWGKETIHAENHVFNQRKEVGTFGTTKKRMGPRQGECWGGIDARQENNGHQEGKDTHLWQSYGAIRGDTPQIGGNESPNQPLGGDTSGKGAFP

SEQ ID NO: 1002452 - protein, 216 aa, Homo sapiens
DLLGSGLRDVCRVLLGAPRRPAVPSEEAPTAIAGLSEGSWALLCYGGSLWSSSLSDDVVTDCHYGRCDTRIIHVLSDHSLVGSTWLFIIGGKVGVRVRTNPGRVRVMDLGQRYDHHSVLFGIMVTEDCMIDGFRGICITDAKDGEMRDMSRRKNSEKVVLRTVRTEKHKPLAIGLALQTQGDIHRKLLRRKRRQQAHAKYGIVEDTCKRERTRTRH

SEQ ID NO: 1002453 - protein, 278 aa, Homo sapiens
MPILVLLGLRPTFGCDPRLLVERAVRAAGSQDKSRQAGDLAEQELRPGSRVVCWWLDQIPGKHVRVNRSRYERWLVVRGPKCKKLFFVWTLASKEQGLTKKRTTSPEEVTDFSRNPVRVDASSIENTSKVPDPKDVLAPHRYTNAKKLRRKEQHMGEAGQAGRADPGGAQGTRPGILNPYRDNKGPRPGTQEQRRADLLRPSWDSDNPLDRPEVGQDEINLEQTKKKECSGSKHCKQDSPGAAVEDGASGATYNPSDEDQQTCTQRPRGGEQRRKRGT

SEQ ID NO: 1002454 - protein, 432 aa, Homo sapiens
LHSRPRQVRAVLMADHHSVEHMCRLDIRFLTIPSQPLDTVGIYHDTRLGPGLRTNLDGSTDLKGSMIKDRASVMWSYDVELASVMRTSSIYHSGWNASTSKWSRTGPRGDTGGSAVSGAHMSRTYPARAYCGMGGTFLRTMRIDREPVEGFPETSGRRRNTKCEPRQRDNIGQEKLLRGPPSKQISGNAHKGSYPSRSQPVGGELERTPNPSSGILARLSHRQENPIHLVAWLCSDTHTQEEKATSFVQPGDGDREKRAGGATDQSTSITDELRKFELRDLPNRVRSVADSALLNESTQQQRAWPTPTLVSRGTFGTLGARPVRRNTQNSRLLRDSTDHAQTNIENTSKAERDDTEQEILSYPTDGRSVSTSMLERNARHDTQWNIEKISAIERHTKSQTRSAKRTISGEERTYSREDKRIEPDNARYGVNR

SEQ ID NO: 1002455 - protein, 37 aa, Homo sapiens
MILNRQWSQERDITERGDGQKDQDEKQWTSMTRGKYT

SEQ ID NO: 1002456 - protein, 114 aa, Homo sapiens
MAGGLMHACFIVLCPGSCASSAEEIVFHDLNLTVLHGISHCHHLSGPAHARMAVSAMTLRGRATMCDLAQHGIHTGSRMMSTAGTMRHAIHEACGHRKPTMCENGTDSERRLQT

SEQ ID NO: 1002457 - protein, 107 aa, Homo sapiens
LTRRRNRAELSSLEHTRLPYGLGLWSLRVAAPPGCVAFYDSWVEACGSNGRGNFWAEELRHYYSKQSTAELVVKVIERSKCYMHTCRTATSFTEMSSAKVILLENAI

SEQ ID NO: 1002458 - protein, 192 aa, Homo sapiens
MGAPRKQMRPRSTYVAPLGSTPGIGQQRGLTIQECPPGAMWKSSWGRSTDPQSGVWEGGIPIQGNGFANLVKKIPRNMEAVHIRDLDRLHPTRGRARYKVSSTTQRGNVAHFVCRGKHHRDLARRWTTIRGEILLASMSHSKAPIEHSAPLKTTKRGWGNNHSLEGLKRQEWAWPTFCPQSMGENSERSKLP

SEQ ID NO: 1002459 - protein, 409 aa, Homo sapiens
VRCPSVNAVTCLLALRGRMGPLDYNTELDADGSDCRATRMLAITDWNPDLRGTVTISDTLECVLAAGLPYKVIDFIRARHSSRVALDVTGLGKPDAGRTVAGMLSGTNAWYAMGGANPLDGREPMPANVRIPLRERSFLWLTNELEHLSCEVGPRTLEFGERKRRYRVACSDANKKGRTLRFGMARRRRNASILVDRVINRYAVTHCWTHHRWAPFLVEYAHGTTIPTRSFVRNLGTLTIGHPWAMQKGKPDRKDPDTDRKIGSTRRRFNKRKGERERQLNRENAEARDGTRREWGKRIDDYQQLKHQKERTDQDEQDYENTVYAKVRTGNVRAALGVIRNRENRYGINVNGETYKTGSTKKAHRAARGRTERNISQGIGKTADTEKAKKENQNIYRGHSHNFHEGRAQ

SEQ ID NO: 1002460 - protein, 171 aa, Homo sapiens
MVLCAPVLLLVAPPGCLLASAALPASACLSLPLPALLGERGAWTRPLAVWPWAERLLDTCGCRGADAPALPPGMDQCVTVERRCLEERCCTSSQGYGQLCERGLEELIDYTELVSMHEILQSHGQDAELSGTLSLVLTQCCKQNKGYCSHNWPPTTKDIHSSVSRVGKAIE

SEQ ID NO: 1002461 - protein, 316 aa, Homo sapiens
AASTGREVGGSKALKATECAGRSVSRTSPTPPPSLPWPPTAKFRLRFSPLQSLRRRLGTAAPPSLRRRPLPLGSAPCRVRLGRAPRQAPAMSDACRSIMAFTQRARWRAVCDGYCKHRRNTCELPGPAFPVVHCTDMRPTCTQNESVLQAKAGGRLSTDGTFRELYKILESHQFSPHNTPTAATVADRRITVAGEKTARTNPWSPWATYRAAPKISTAEPTSATGSDDQDTWPSREHVRDGGPAAAPASTTPHLPLHPSRPPCRHPRYSLAPEAPPGHITPPPPTVQPTCITNEHRPAPTHNRDHTQATGHTSQPT

SEQ ID NO: 1002462 - protein, 351 aa, Homo sapiens
MRNPKSSGSSRNPTTIDPQLSAKGPCRQTMLLDNMLSHDPAATSTSSPRKPYIVSHFDWQLALTDEQTSLSPALPELTQDVIPQLVLQLESWTTYTDWQPKVDVLTVGLSPRSKLRFLLFAVHLHAVVGSTRVQYRALSGMLATTWQQQQVCTSPVEFGHSSIRTPMSPGSGTPRCHTRPFKVPCSAGHKAALGPKSFRDAVAYPIDLCKRYPWHEERSIRNETWPPKHAGSNVTFSNFDFLSICSIPWGPKRPRPHWDGIRDLYQGSCLVVDEHMVTFLRAYLTTASLPRHYNRGPTGWAKRVPYQGCRIDLAGKGPFLPQETQNPRFPPTKGEPNAEGARKLNLGPPYV

SEQ ID NO: 1002463 - protein, 350 aa, Homo sapiens
RDVSQRVLRSTDMGSLGLSCLVKRMSAEASLGKVKHAVLVRHDSVRILVALFTVTSMAITEAWTSDVDSLCAEVVQAVDPKDESEGEEVVGTAVTSCKKTPPSGGMLGTCAATLEDALDGLQDRSDELSIACSTVMWMHMQGRPFPIQRLGDTHSVRHEGSLHNDTCKNMVTVLRHGERKRAVDERDFMQALTECELPKSIPLSIAAALQDAALASLWRPGMNVPHLDGVSEGELGGILCAEKSWTVAQRRGVEHARVPVNQAVQGRMRWIERHQSGDHMGQGLPKGEHQTYGHTKKAAPEERTEGCAQVAWSGAHGSPAPCKAILCWHGAWARKGLTIHPKLRHDQNST

SEQ ID NO: 1002464 - protein, 176 aa, Homo sapiens
PGAVRSASRCGSGGRGSAGGGRADESAETEFRHVGQAQFEIFEDILNVGSAAMKVTIKCWNGVATWLWVANDENWWHPARMAFRRMLACCKVPRQTDLPCLVWGQWFPAAFHMHCIALSGCTHSEVQQQLPLVVPTGNGKFKGVMAQILVSSLGGGSPDDSFLMLWRRWLLGDSAT

SEQ ID NO: 1002465 - protein, 129 aa, Homo sapiens
AFQGSGCVIAHLREKMLLVSWRTLVAGEPRSDTPDICRAWCTDGLGGPPQQLGPGPTGHDPPPSATWQSPPWNEIQCVNSGLREVLCTVWLLVGVLSMWSDHTTDCGCPWIYVKCRMQGGPSKKYKGIL

SEQ ID NO: 1002466 - protein, 383 aa, Homo sapiens
MDMHGEGVNIHEEIAGGYRGGATAPGGNPCATTEPRIITVICPRNTVTNGRLGSFVQARSYGHHALAHEFGRRDNDHARQDTHQSGKMGSVNHPPSRRSSIHYLNTGENPLVDTEVRKQPFRTKMLHDTAAQDHYTPQGVDNKHANLTVALYYNNHLGGTITVRVASKPKYLRQTVEKAHHELSPPPLPQGEEMTEEHRKVVPPRVIKTPRCEHGYTTKTSMKLGPPLENRERPRRKETHTKSGKDEEHQPSTRVRAYQDKEHRKPPQKYSGATKSNGRAHRDISTDGQRMPPHKQRIDTTGRGTNRTDIKEEEIAEIPSETTNGDPEQESHTKGTTTHKQHPAEGDNHKAGDRPPRKNIEKDPERTTYTPQRERATQREYKE

SEQ ID NO: 1002467 - protein, 267 aa, Homo sapiens
MSLVHISWDCLCPRNAQMAPQKGTPMCLYKAQLLHQIHSNGPRCETSSSPPVTLLGLIDSLYTRASGTCVRDTHRCHSGGIPRANRCGPSSAARVCPVSQGKGPKDRPRLLHWVGALARVVRGLGRDTPHLGPGQPRTMRSQSPHQTGPTTPQSAIGETHPQNKGTDPSDHAAGHPPDPPGHPPHSKGPAPGRITEEHQPTPSAPTANTPTQHTKQTPRGTHAPSAPPHTQQTYNTPSTQPGPCPHPAIVTPNQQHKTRAPIPSSRN

SEQ ID NO: 1002468 - protein, 244 aa, Homo sapiens
MRPSEPESADEETAGAAVVLCGLGVLCVRAVFATLPAFGGCDAPIVGQHALAAEPDRQVAGVFLLVPRDEFVPGSETFVVIGNGEHIAGADIAGMETLFPGHPFGGQKCVGTWDEGDLVDRHPRLGLRQHARPLPSAVAAEPGAEVVRRGVLRLAGDALVLPDGRPARNLGGSVPGQRDSAGESFADLATASLHAGSLGYGCHVFIMNAGVPPIKLAGAGPASRGMRHDLPMRHIADFVPSPRL

SEQ ID NO: 1002469 - protein, 42 aa, Homo sapiens
MKVEESKGLGLVSFERHEDAQKAVDEYERKLELNVQNNTLCL

SEQ ID NO: 1002470 - protein, 160 aa, Homo sapiens
MAYEIFLAHDKIWFDYRFIDMTTARMGDSTQRDDTVPCGMCALARAKGMNRRPAMIRPVEHWRAGPEKNSPGRSSGLVSPLRSLGGPPADIASGDHGEHRSSGLPCLESGEPEFCVAWYIDAVRRTISNAGGPGERAGRRARLGTGPRYPTDRSYVSSHA

SEQ ID NO: 1002471 - protein, 238 aa, Homo sapiens
MARASYTRYATCEVILGARNSLDSNVHKEIVVAERTIKIGLIAREGLGKAMGSRLVSEGERKGPIARENALSVASGLLAVRRAQVSRLTLVIGENSEGTSEGGERAIRRGILGPPDRTLHWAQIGAEPWVGDTMLWWTQVGSTFCFGTDLRAPRHTRRTPWLPLVNLPWRRILFLDPIGDYLWKGTGDMAMRSGETFDPRFPGGGLGARSVHGPTGDSASVKGVPPSLVALGMSWPVT

SEQ ID NO: 1002472 - protein, 123 aa, Homo sapiens
MPKMELHSYVVAVAIVLSTIHVTFLYDVEHGGYSAIRYLAWCDDFGDLAKYICDLSLYAPVTLADFIYPTMITTWIIIESVTCCVLLNLMCLSGCLRCKLCKRGSLRNRRWCEEPQMLAMARS

SEQ ID NO: 1002473 - protein, 204 aa, Homo sapiens
QHFAIYSRGSRGGRKFRPLSDAWVGRSEDRAAPSLEDMELLSPPLRDRMTMSGPRGISLSSLCRHSGRLAMTDPCCRLPGPALSSKTLDPDSLYARGVALLETLKSTRYFPGGRVTSQDAPEASAVQDGGNDAALPQAGTHSGRAAGLTVGLQECAMRKTTNADRRKAATMRERRRLSKVNEAFETLKRCTSSNPNQRLPKVEI

SEQ ID NO: 1002474 - protein, 35 aa, Homo sapiens
MPLALAPSARGSGALRGPPFPRGASQAGLRRASLP

SEQ ID NO: 1002475 - protein, 365 aa, Homo sapiens
SLPRERTRKRLCLAFYLFYPPFPLTFRILSLYILAPTSNQKTNFTWRGGKPGKGTETRNTQQEREDKSRNTERREETKKGTEKRKRKKGKEERTKRERKDKREEGKKKEEEGGERDGGERGREEQGKRERGGGEDRRAGEGGRRRRAGGGGKGGGGGRGGEEGEERGGGGGGKKGEGGEGGEREGRRRGGGRERARGRGGGRGRGRRRTGRGRGGERRKRAGAEAKGQRTEQRKERPRRRRGEGEGGETEEGGGKGTKKRGKGRTEKRGEKGGRKGGGEGGGARDEETGRREGGERGEATERGEKRERTEEKRKKRREKREEREKEKEREEEKGTRKRREKRERKKEKKRREKRTKRRKEKKKRK

SEQ ID NO: 1002476 - protein, 344 aa, Homo sapiens
RASLLVTRAWLELGWDPDARAAAAAGAGPPAGALGGSEPRLAPGPTRKDGVGDADATPVVDCSCGFPVQEELRLELDDELYDTERPVQKRARSGPQPRLAPRMTCCPCSREPSCFQIVQLHVATCLPSWCPMSSWSPRSGGRAYRGPALPYRAREYTCNVYPSREALAVLEPYARLPPDKQCGSATEVLAGTHGPLSPFSLVTHGDYGKPGAEAASVSLEPEAAVLFQQMATRLAALSPAPVWSCVISSCVALSSLTGDRKKLGAWRSLEDSCCDWGQIDSCGDKHGVDQPSCDLRYSRQGASYSGKAPRLGAEIAPLHAGGISFRTELSVYRKGGGTLLGLAC

SEQ ID NO: 1002477 - protein, 315 aa, Homo sapiens
MFGQIERINEGARSGKVRRREKLRLMETVVKTCGKKCIEGFDEYGNGVQRQGAQETYWKGLRGGPLVSNFLILDLNWPTHEYCFAHQGPDEYTPSSTGLRTCGSADTEKKRNRHIGLRGTQEGKSDSDGEPPRKMQTRPRRDTCHRQGAAHGKAPQVHSEYRHNGVAKWREDPVRARGRPTVTLRKGPGYIRGPNGVCPTNSDSDPQTTPRFHRTRTRSQLPPKMGGEQIWKREGGESFGAHEVAIAELDNTRGKIGGQASTGPGGHGARETRYAHSRPQTPGSAGDRSSNTAAGSMRGDTKKLQETRETEGEAP

SEQ ID NO: 1002478 - protein, 163 aa, Homo sapiens
MANTDRQHRGGEHKNSAPVVYNHRNKQKDNAPQVVVSSRRGNNRTTINHLSGRQRQVGAQHDVSTNSYTKGGLMKEGPQLMLQPEQNGMKIHAHDARGSATQQSGGGWEQLVDRDNNGGPIGRHKHQPRAPTKEAAHLGAYKKQRITPQRKHRRSVDTVGVVP

SEQ ID NO: 1002479 - protein, 206 aa, Homo sapiens
MVDYVMPLWRDFSNGPMGTRAAVVRAPGIRGGQKGGGVTRNKSVQGEARRKRRECLGEEGTSPPGVDQERGFDLETPTGRVGHPCARRHAVLEPRKRQEWASPSGLVVKPREGAQIEEGGGAQGSQHGFHLRNTCEGDTTLANFPLSGEPTDLVHARLPIKETQWPDLIYPHKTRSPREEVFGGRENHLPIVVGANTVRRDVAAPK

SEQ ID NO: 1002480 - protein, 140 aa, Homo sapiens
MCIINDISLQDDMASEGEVCQSTCLTGQGGMPANAFREKLSVPIVERLTNLHDECTVQHTIGKKLMTVRYRQCMRFEDQYTMHHQAENASCKVLSEAPVIKHVVPRGGTPGRHLALRTETVENEQRLVDCGHAPWQPVMN

SEQ ID NO: 1002481 - protein, 168 aa, Homo sapiens
PAFPASGRGSASVPRFFLFFPPFPFLFMCRTVILSPIPRRGPVTPSGGRMQPGAGARRRRSTTEAEESAKRERESETGGEEAEEEQGRGRRQGGERGGGGGGGGGGGGRRGAGGGRGGGAGSGGEGRDEGGGGEGVGQAGGGGGGAGGGGSGGSGGGGGGGGGGRDGG

SEQ ID NO: 1002482 - protein, 120 aa, Homo sapiens
MGKGVKGGDEKREESGYRGSPSSMLGRRAGRNSRAQSTLRLLSLKEKSQSQNVWVLPRGDCERVVSKEGGAKNSEELSTLGRAKLWLSRGAINCVGEDSLARHSPAGIFPNKRREISPLV

SEQ ID NO: 1002483 - protein, 115 aa, Homo sapiens
AGFAMAANSPRFLAATQGLLGDYHGNHCAGAVTGTCMLQRPVMNFAELGSARGSLQMAAKFHRIITDFMIQGGDPTGTGRGGASIYGKQFEDELHPDLKFTVGWNSSAMASEPVF

SEQ ID NO: 1002484 - protein, 144 aa, Homo sapiens
MAGECSSTPELSVLFRRWPLMCPAWPGWWSYCPGRPAVALLVSVCACLLADVLSAGPAAAVWLSHALLCMMCCPCGWPVCPRLPEMRLLSCVCLASGCASPCVPLAVLWNPCCCVLWSARAGGSVPWDSGLGDQEVPVACARTR

SEQ ID NO: 1002485 - protein, 76 aa, Homo sapiens
GQQSHGGRPDVLPQRFKRDCHSTVHCLVTIECLYDFNKILENRYDPWERPLQKLVHEKILDDVAAFGNLDWKVAKE

SEQ ID NO: 1002486 - protein, 59 aa, Homo sapiens
AESEMCNPMRAREHDSDAGGAELYVTHSSTPGRSRSVPGSVLMSASPGSMSMDGDSAGV

SEQ ID NO: 1002487 - protein, 322 aa, Homo sapiens
ASFSLRPPEHQCALSCPQWSLTPPAAGPFGGRNDKGRLTSEDVYDFYRTTHMHMKPSANTVPFRALNHNTNKQSPPQLFYPRPQTNLNTTLYNNTQSINNNTPQHKFTNIIHQSQSPIPSYYHQEQSTHTQTQHSIDISSTMHPLHDTSSEYQSLTHKRNTQDIHTSLDDQENHKKHHTMHIHNQASQNVYNPNPLIIPHSLSLIYEFTTCHNPHITTHHQLLLVILIYEMRDLRINGGKRCEDDFRDKEERRCGRMSEHDRGDALTSRRTVLASKQTHRAQVSERQAQTRRSRGTGACQRRSIHMRMRVRVGVAARNSAGP

SEQ ID NO: 1002488 - protein, 230 aa, Homo sapiens
MACSPVQRGLLGGYIPESLLRKRSSRGKPDSKSWTTWDPSHSATGAAELDLILPSRHYGKSHSKIPGQGPMRRLERDEAGGRDEDNNLELVQEILSGTWQQLADAEQAQTAETCAHILQEPHFQIPPGDARLCGLTRPMRHQHHRPGLDPYVQQQTCTLPNAVTHWLVHSRMTARRHNLEVVTVHAVRRAAMLGRYERHPCNGSTFQVHARPADMVGTSIRRITGTMWPD

SEQ ID NO: 1002489 - protein, 33 aa, Homo sapiens
MPRQGHVRIKVVLFREEGATLAAESKGLGPLAQ

SEQ ID NO: 1002490 - protein, 105 aa, Homo sapiens
ERISSTRGQWWLLHASAHTMLTPPLLLLLPLLSALGLLCSAIDDHLKYIDSPQGMFALHEVSRNKTCYLQEGAWSVCERVMHGTCPMNGILIGVSSHAVILSSEM

SEQ ID NO: 1002491 - protein, 173 aa, Homo sapiens
MAMDLTRDKMCSMVKNTGRQGWNAHVDVKTYRWLLAFVCPREVLTNKNATIRYRKTSYAQHQQVRQIRKTDDCHIMTREVQTNDLTHEVVTETRFQTASRKDTRPGLPIYISLSMMSSLSNHVTMLKKAQVDSGKLMAAFMVNGQEFCKSHWGRRQVPQLNDLIASAHHQFQE

SEQ ID NO: 1002492 - protein, 89 aa, Homo sapiens
MREIVHIQAGQCGNQIGAKFWVRRITDNMYSNPPTGPTTGNSDLQLDRISVYYNEATGGKYVPRAILVDLEPGDPIGETFPWVFPGLSK

SEQ ID NO: 1002493 - protein, 191 aa, Homo sapiens
MAANQNHPLDVDLKAWFPELAFCSLCIDLGSLVRMAIRALSTATHAILRLGKQPRGWTGHESLSAHVTPEMWRVAAERHNGRRYMSVDSQLYCALHRTSLRERTCSRQACGVPYCPPGPLQVSSLGLSDPSCGAPPPVAGVALTERAAASPGGPCAPPYGRVWYDADGCLLLSPAHVRVPAAIAVPSTVPV

SEQ ID NO: 1002494 - protein, 32 aa, Homo sapiens
MQAAHCQTRFNDGILYGSTVAKAGFANSLPSF

SEQ ID NO: 1002495 - protein, 88 aa, Homo sapiens
AYFSCFPAAAPPIQNFGNGGGKKNFRVGQPFWPRPVACAGNQIGAKFREVISDEHGIDPTGTYHVWTCDLAAWNCINVRSNRPPCVGS

SEQ ID NO: 1002496 - protein, 218 aa, Homo sapiens
MQSKAPTNIVSKIDDMTAAPMDVRQWVDTDDTSSEQYTVVPPETYVTVAGHLRSFQNKKSLVAFKIMPLGETMNEFTTHILECDQCDTMVLSKANSQPSARVDATYQSTPRTLSCKHAEPLCVRDIRFMPANWPHCGPKPRCCNFDLTACPRPARVELFSDLKNQLKHMSVSSIKQAVDILSNERAHLFYLWMMTILNPQMQNNWHLNWVPEIFYSWT

SEQ ID NO: 1002497 - protein, 253 aa, Homo sapiens
GVVAVYVTGRQGQPAHRLNRCVCAVACPFLTLASAVSSLAFSDFPAPLLPSFLGPRPSSPPAQMDVPVPRKNACFPALALHACLLISGTGFLPSRLMSPETGAGSCPCWWERPMCLPDPAGNCRCFRPPREARQGWMLPLCGPTSPLVNTSTPWGGASFGAPWHAGLCAFSGHRHTALVKPPFRTPVRELRPTPPDRAPIRLCEGLVPGEPRNLGSPQGSPRDLPKEFAAGPGARRFDIGPVPEVFPPGGIRV

SEQ ID NO: 1002498 - protein, 235 aa, Homo sapiens
IVTNCDDMERDLAPQPSTTSCGVGPGRSTQMLLTEVPPEPQEANREMMTQIMFETFITPAVYVAIHVVLSLYASVAATTWHCHGSLETGVIHTGARIYRERYRSSRHCHPASVTWLARGPDRDTSGRSSPERGYTCSPPRPTGKSCGRTSRRSCATLAPGLLRQEMGTARILLRSLEEEPTRLPDAPLVIPYVVNERFRCPEAAVPTLPSWSMESLRNPRRPPSTPSWKCDVRHP

SEQ ID NO: 1002499 - protein, 86 aa, Homo sapiens
SSLGCVTRVGLLLEKCRGYRQIVTHYILSARIMVWCRLVTRHYGFLVYAHMGEPRETILLSYTLRWPGHRATIHIEGLLECECHAR

SEQ ID NO: 1002500 - protein, 228 aa, Homo sapiens
DSCEVEPEEPGWRRTSTSPAVKSKQGKKEAEGRADAPVHPVELADGAQPLSSLAEVLMVEVENVVHEDFQVTEEVKALTAEIVKTIRDIIALNPLLQGSSVLAEELQRLAQRVVWTTHIYLSDMGAALTGAEVPLSLQDVLGMRPIFLSGCTRPFSLLKKEFELSKLQQLPGAGGAGEDQCQTHRTIPCCRDQLQDHQRRSLALEKGRQGIAIRGRSSCGAPDGSSLL

SEQ ID NO: 1002501 - protein, 154 aa, Homo sapiens
MIVPIYSDYDADTGDSDSEPLKPAGSETLHPWSVLVHLLGHLAPVVGSILSVEKPCSQRKQQVSISSPWDSSYSLTLHTGEATDYHIGNQYQREPPMIDGLNIAPAREENTQRSCTPRDTSDAQKAKGLRAVTQTRKDFHDGATFLANNTISSA

SEQ ID NO: 1002502 - protein, 136 aa, Homo sapiens
QNELGARGPGAASTIRTIFNGLCDIIMLDVISKSYLQECAYLDRIWYDAADKTLPNGVVVMKQPKVRYLNGTRNTCRADPIPVCLSDAGQGRRESLSYLTEQYIVARTGKTYTETVSTKKSPVYTIRCEHYVLRGT

SEQ ID NO: 1002503 - protein, 339 aa, Homo sapiens
GVEVARPFRRGELALNDLGPLVPQACLQRRGMYAAGGTCWSPSRARPARLVYHHEGDLCPLGLRDPKPFPKLNAAVVFDVYQPRCLPTNGSVVAQGDLGLLASNREADTGWNLALNCGPLLRRRRANRVIANPPKADRKSETCPVPQEEEEDGAGTDTSPCKAHTPWRNACERALARTQRPGHGTVGTGPSPNNEWWPPCDCAITAHQSYIPRNTCVSYDTLPTSARLAYIGATVEQQRTHSTRGIINSTRTLWSKPRAGTPQYSQLGLHWQRWIVNLYQGDEIREDRQRPSTNPESYSAPTRARPQYNQNTSGRPEREMTTLYGIHVRPSRTSTLSWR

SEQ ID NO: 1002504 - protein, 335 aa, Homo sapiens
GARGARAAVGFPRARHVDLWLLGSLVLGLDLRMGLGPGLLTAAAVWCAVSLGGRSSPPRVPRGRKCILLYTPSPVAGHVAGGVFLELAVLLTGVAPGSLSPRDCVTRQLALVARMLSFFMCRFIGVAFVRVPSLDVGTAVTPSVQHYTLTRLCNAGDSYLPHGMSVDRPPGGPREGLLGVVSPEVDATPSPFGREPRFGRWALPYGEETTFQGDGSVGYPVDSACYLGAHVCGCKLPLELTRTESVVGPCRLSRFKKGVLFAPRPKRGNAARLPLTGAARSVLLAYWVPRCQSVGVLHLEFCAIGERPGESFHYRSDKPFRPLGLRWEPFGGPLR

SEQ ID NO: 1002505 - protein, 75 aa, Homo sapiens
VINNTRGVLITWGKQCKLSLTLLMLSSELGYESSQGAGGMVIRKSPKYALLSLGGTIGDIEVTAVLWRRLHNFQF

SEQ ID NO: 1002506 - protein, 107 aa, Homo sapiens
MLCLGCVDSTNSSWDPGCMTCGISVGNNAISDHLFLLTKDLHHTGMTGEYKYTPVDQSLVLCIANSGSMSLRIMRYKYESEVRYENAWEGTEVYSELLGHSKITDPK

SEQ ID NO: 1002507 - protein, 366 aa, Homo sapiens
MTLKMLQNWGGMMEKYYGMASSALRKSPMMPENAENEGDAFITIYSRVFFTDMVIAIRVINNWLIRSCIFKRPSYVKARGENASCYLPPTMMHVCKPTDVLLTKIAMEAAIQGAYICVTISLPVGLGSDHRTPTEHAFSLCAIDTFGKCMWTQTIRTLKTHGSGYPVYPDYYGKVDHCNDVVECDDKGTQSRYSCRITELTPHMAGQTARIKTTAPTNKATEYKKSTDGIATAQRPRTHNMVKSRNQQMTDNTGQNTPKKGHRPRSQKQKEQINRRRHKRHTTTRPARHARNPQNKHGETRRHHEDTDPRADPYRPNAPAPHETNDTKQGTQQRDAKTDDRPGTPRQQEKMRTGEKHKAQNKRHRT

SEQ ID NO: 1002508 - protein, 281 aa, Homo sapiens
FVSWMLVRKECENCRLPAGLPADPLAGRAARDSGMGTLLISNVREEYPDRIMKTFIVVPSPKVVRHGWWSPTIAKLSIHHGLVGEHGCRPTDIARIEALYDICLPRPSKLATPIYGDLNQLVIGHHERSHPSPLCFPGQRRTLSLRKLAGLTMVPFSLSLHFFHARLRTPSTGRGSQRVPGPCSVPELTQQMYDAYRYYDGRLRPRATARYLYGGHRCSGAVLSSEGRWTSRMLVYPEQEAARKLRWKWIPNYVTMWSGVDIPSPGLQMYSTFHRGTVRAI

SEQ ID NO: 1002509 - protein, 380 aa, Homo sapiens
GVQRRVWLRLLVNLKEAEAKRKTFLRHGDDAGGIALEWHDVLDAWAMTAAAVEEQLWNSWEISNGATCEHLSVNIWGDGISEMTPYDLTRQGMVAMEPRMSRSDCLREVLGPHSAQPGDRLEEDEFPGELPKRNGSIGLATSGRFCAKDFCLYQDVYKNVHHRGMKQRVYLEIDSYTISGMTVPLIEPGQAQCLAACTGRGVPAWLLPSNGSPRGDPRETTVTDPLPGAPVAGWAAMMPAGALDIEDQGEESPFDNRNTLRKSKTPKKAWLRHLGVVRDKCLGKKEHPRRNTGDPAETHKGDHQIWGFQRQQIKLTETLGSSQYSGSGPGSRITNPKLFNLKVKLPPRGTLGPGPPWCAPRKGIAPMETQEQLTQLNWTG

SEQ ID NO: 1002510 - protein, 225 aa, Homo sapiens
YRGSIHDFPGFDTQQDARGSVQLTMNGLLVSDKEAILDIIDLDVDNSARGRRSARVYKSLYGKDLIADFKYELDGQVGTVDMWSLNEGQLAYSDAKEIKDAISGIGTDEKCLSRDLGFPDQLSRCTSWWQHTKMPTSGNLEADINGDTSGHFQKMLVVLLQGTREEDDVVSEELDNRMSRDLYEDRGTEMGEQMKPSTEYIWEIAAISISGWSDDEYLKNHREDR

SEQ ID NO: 1002511 - protein, 305 aa, Homo sapiens
GACVDVPAGAGHVLSLMPDACCLSLRLICHPGLVQLAAAESLLPVLVLLALAVCHVLAATAHVMLENICAEHGVLLNGPGKCGWCEICKVLISNEMACRCSSSRHIMPVLERACGSASSCDYHSLLLMLAAHWAPACSREFLCHDGLELEAAAVAFLWMGVAEYEVTPDDNAEGMWAAANAEFSEPHWVLTSSLRSPGQLVTNCNPAGWSRVPAKTFSRNSPGLSHEYLMRGPFADYLDSIYFNRLLAVEVAWKGSQGPKTPSGNTEFLGKGGFGEVCALPGAGTGKMYACKKLEDKADQEAEKG

SEQ ID NO: 1002512 - protein, 363 aa, Homo sapiens
MELMVTCGCRVHVSVEDIGRRREVQFAHRRPYLKVWDYASSRKFLCKMDLQRLPDLERPQRAPKLEVRMHVAQGPTIGYHSTSADIMNGLSETRRKDREASRRLRAMVVSGGTSEQLFRPDKKEIEGGKTRGGLSIILRFKRADVRKLGVASHEPLTIGGKSGPWSDFKELHVWGPTGSNDRRKGSVRTNRGGCPGGTFTQSLHAWTSLYPHLYFLCVKRPPSPWVVLIGTQPLGIVPLCRAPLGVAFDIMGLDSQNGSTHMAIHVNGSLRERHPHDVLHQPDVIRWAIVQLVHTSRGEIWTGSLEDNKRREGQEARGGCHRDLDCFVPNGPGPLVYCHCLVVWHCANPGGYKGRRVGNWTTP

SEQ ID NO: 1002513 - protein, 340 aa, Homo sapiens
MAECFGVPGRTRAPLVADHRLFLATFARARSAPNYRNIYVPDVNQAYIEDVTDDSRESESESERDECMSLHKRGHARTAERTSDYDNTWAHISPHVILITHMLRDSATDSSICLSPFQCSTLYRMSELPSGPHTCWCARQRRGYETSKRQKKEKLMADAKAGPEILGHRQRTDPAQTHRRTPRTKVPACRKLANPRNNEDAPHATRGDQTTKNQKRRHHWGEAKTQPPQLAQWKRGKPARITEKESYPGKRTRSLPNYKKKKTNQNKIHKTKETIGHKSMTVQGKHTKSALRTWRGGHPWTKKDTAETQEQEETEKGSNTRKRTRNKDTQAKNEHKQRET

SEQ ID NO: 1002514 - protein, 306 aa, Homo sapiens
VRRRCGAAGLLGVLLSVPGPPVLYLEASEEVELEPCLAPSLEQQEQELTVALWQPVRLCCGRAERGGHWYKEGSRLAPAGRVTGLEGPLEIASFLPEDAGRYLCLAMRLMIVLEILTLITGDSLNLQEDDEDPKSHRDLSNRHSYPQQAPYWTHPQRMEKKLHAVPAGEHRQGSAVQVKGKPQGHHSVGLGCQGLSWGEPIGGIRLRHQHWSLVMEERGGLGPGHTPAGRRTLWAASVIVAVMCLSGPPTANPAGGLRAHHSGWAARLSCWAGCKDASPLQGGAHRITAEGRSQTVPFKFLDEDKV

SEQ ID NO: 1002515 - protein, 441 aa, Homo sapiens
ARLFPVLWTKMGNTLGLCTKWVTLPLPVSPLPRVNPCPTLCELRLMRAPVSAKTQQCQVPDMACLLGEYQGRRLHSHSDPSEILTCFGESVIMVCSLPARVLIVIWLGAGESEARFITWRASAKTCVAHLMQQHVLVNSYLVLEHLGVRQYRLCKSYGGQSPSACGARPTVFSHVTANLLHLVSRVTCRLPGCISSELFCDAREKLEWSRVYEMAGSSHRYRCVVTSCGAPTHTKLWGRIRRLRCRADLPPVYAHGWSRYEFPPARTEMCARALVPLCPESRVPCGRIEEPSADASPSEDTHPSRSLTRERQRAERPTGATRPGRPTANAARHAATTETAASSQAPPRQPDDAARGHDGARQRESRQGCATPGAPARESAERTDARGTAGRGRAAPSTTRCHQQGGATADRAGAGAEEEETAPRTRGDGDEGREGGRGAGG

SEQ ID NO: 1002516 - protein, 506 aa, Homo sapiens
WKQWRGGVLSWRSPTASWVERELTYPPAGSCCDDYVAQSIGRQVECARSCRLVGVLLRLCGRAARCLRHGLKQQWEQLDSQRSVGPDDGTCPTSMRRVPQVRSIACRMCGIQAGAAQGENDVRRDVRLAISRPKIHYGSYGLSCPFRVDHMKPEEVIPYRRTPHGRLVESTPRAQGKYRGRPLVTHSVNPIRQRFRQQLRYKANPFAHPYVRVVPLQRLYPGVTQGSPWKGRVVVNRGPLLCDDRIYHEPKLAGGCGAHSVGACLLAAEISRPLEPIDNPQWGVQGTFLRWGPNLLVPKGYCQARSWTNGRVNNGVVAGHTRYGTGADLAPGKSKPYGTGKEIGTGADTQGITKGLGPHGNGRDLGGERGSRYSKEVRNATRPGGQWNQCATRRENSYDNKAHACRTTPPELYIPVGQPVQLVEGPDRVRHVPRNSKITPVGGRFDRGIRPTGNWSATGCIKNLGHKSMSRDRHRTDSRGISEVCASVTTCHSHRSSQRPVFRKRA

SEQ ID NO: 1002517 - protein, 401 aa, Homo sapiens
MLKTSAWTENRYDVNRDETHSSDGFDTAIGRPNGGNLGYGHRKKWMAYTWKKMVTENPRIIAGGYHGWKFPYLASSSFPCQVKSQGTDIEDNHTIVANVDRERKQNDKEENRNTGSGMLDGCFLSFTNPGQYDETNQTHKLNVLVGWHGSSCGNHASESLIVIVVSQWDCVDSSNGNRANTTVWNLYKPIRVIAQIRYAKHSFPFTIAVLTDTAQAGIQSSDYTRVCKIPLKTHDVGSHPNKDTRTHRLGQQKRQTETRTPTPTSSRHVHTSRVSEAPHPILWRQLRANHFTLAFLERSQPWPKRTPFMITQCLTEKWPGWKHEVVYSPGTKRFPMLFPPGHRNTKRRTSQGQEPSALKRKRLKHRTHGDTVDNNGKQAGTGGENRRLGNDRTAQEGDAKQ

SEQ ID NO: 1002518 - protein, 351 aa, Homo sapiens
DKAPGLIMQTGTSAKAYTNVSGMERAVDGCCACDAGCYYDPCRHHTDGTRNHMNDSSLTAHDVARVPVLDDLLCLNLGRYGVDYLTSHSCSTVDKSIGSIALCTDCSLPLERTYRCTQLNLRIALSFSFNRAFFQRETRPDTVCTRVLIVHAIARSFPLNIYYPYETNPTLIVGLGPPPKIIKSGLGDRYVVIAKGTRGGPPLRKAPLNHRWRPRNRPGKTEGAHRVENSEQAFVSLQRKGLFRAPQLEKGQIGERTAMAVGRKSEPPERTVGRTTRVRTPEAKPKTVDLLAGGKGKPGPLRSPALVEKGLYGDRSIRPPAMSTVRHREGHHGSRTPGAGRTDKERGGAPY

SEQ ID NO: 1002519 - protein, 179 aa, Homo sapiens
ASRLNAVLRYLETQPRPPKADPSEKRVQRAQQPDARQGGPRYPNKRLPPSILGKRSSESAATAVDGPGKPLDRPGNMWTKGRTPPARAGMCQPASRRCCLDPVGVAPLAAEVNACGGLQTWTRRPRDDLCSYSGAPVGGPGEESGIGCSSFRLEDLKQCVPQPGSIAEPHRPMRPEGQA

SEQ ID NO: 1002520 - protein, 90 aa, Homo sapiens
ELAFQQQLLQMQQLQQQHLLNLHRRGAWISLQPNQGLGAPPDPSQAAVCPTDLHQLVERGEGAPGQTAEDSVKQERAGTSLATGRTPEYT

SEQ ID NO: 1002521 - protein, 204 aa, Homo sapiens
MGKVSVLNVAVLENPSPFHSPFRFEISFECSEALADDLEWKIIYVGSAESEEFDQILDSVLVGPGAKQGDTCLSFRADAPKPSLIPETDAVGVTVVLITCTYHWTGVHPSGATTVKQRSTFKPLRLAGENPPNASQDFIPSSKAETILGRRKPTGVNPDFQYQTGDNKHGQGWKAEKTRSPPWAAASNQLHSYQGLGGSLGWNP

SEQ ID NO: 1002522 - protein, 268 aa, Homo sapiens
MHSDCRPVGHPRGPKELFGHNKSRVLGNVWWTCCTRRNFGHNRWKTLGGYENTTFGAQMKKATPVWRKEQGAQHKRFVRPQLFGAGAAKQNTAPAERGTTNSTQPLFARGQTKAHDYSSASGRHHTQPTRTRARNTKTAAPPPPLCWVEDSVVTKTTETLDLDPPTSYIIRGGGRGRPPPRTPNHLIGGAKKSEAENKPQIKARRRRGGNNKHARWISQNNWGGKDEMEKIGKEEHKATNYRNSGSTTNKHTRRGADKKRQQKTRGRE

SEQ ID NO: 1002523 - protein, 85 aa, Homo sapiens
DGDTTILSSLHLFILSSGTSYEAEEKARSASDQSGLSVTWSSVPKENLPRTEYSDSVWSSSYGLGGMVEEWRVREVHEIKCGPVS

SEQ ID NO: 1002524 - protein, 286 aa, Homo sapiens
LAFPASGLAGRGASRKMVARCGVWLPSSGQVSALLDRPGVSLWLEAHYPHGVPEHRARTESGSRYASTPVMGNIAPRRVVSAVGGGAQETSAQVDSGFQVTSEEQTSAGPAGNTTHVKCTHAFVSTHVQRGIKTMRCGNGQWRNEDNVGLSKGKDPCVMGPTCVKGDHLLADLESSTIKQNTPDQVEEPAAGGCSPCKEATGRSMEDVNCIVPTGPFKFRMNRCHRRGRARGTPSFKEGGTDDRRLATERDSRRGGPVTRGNTGVETRGRTVETQSAPRGALGPWP

SEQ ID NO: 1002525 - protein, 68 aa, Homo sapiens
LDIRKNPLIDHSMMKAVIIKRPPEWKECQIDEYQGIRSPSVNGTIQNCKADKENYNSRKWSQIGISYY

SEQ ID NO: 1002526 - protein, 312 aa, Homo sapiens
LFLSSLCLPRCIKVSVVTRKLLAMPIDVGFPPGSLNYSYLKVCGRKWYRLSRRMGLNVEGHIDYTDPQRMLNRRSLGARRVMQQRANVLMRSSRAFRTVCSSWAIQHGQLPAWAWTTRLNIKTVCTYWEDFHSCTVTALTDWPWNGAKDMWDKLEKRIQETSTSKAAYSNSAAAATGRRGPCSRRSRCSWCLSRQDYSDLDFLLSVGPAPPERQPNSLHAPEIERKIHKFYGDVVILCDAENTHIGNSGKSMIHTRTVPTETRSKIGQMLQTGRQASTGKNRDHPEYKSRTYHNTKFRKRGKTSTIVKHIHH

SEQ ID NO: 1002527 - protein, 159 aa, Homo sapiens
GGRRVGCAHGDKERDRGGRVGPGGSNGRTPLRLLAQGVYELVPACKVLREYSVTGLSGEHGERLTAYCSASQYEGAARIPWLLDELPNTGASYRVTNVWPVSCSVGGVFARRRHPGPSSRGLEGVNVSLVRKLYIPYAVTWSSQSNPRQADQIKGAAIQ

SEQ ID NO: 1002528 - protein, 225 aa, Homo sapiens
VSLYVTSQGEVLVADCGNYRIQVFTRKGFSEGNPPSDPRWHWIDFVAEASLGQIYPTSLLSQMAMNCQGLIGVTDSYDNSLKVYTYGWSTAGGAVTGASRESTPWGITVLALVLAEFVVNQMWKVASFGVPQLIEDQGWSDTAAVCRCCAGPKVCHPVMLRAASYFTQGLRPQSWRTRTEVSSRPGGWSFAHGLCMARDGHVWVARSVNVCSENEGFPAEIVGMC

SEQ ID NO: 1002529 - protein, 284 aa, Homo sapiens
AAGACSVLCRVKTLNPNGLSVALMRSAAAVRVNIMLHALCGLHVTVLSDQPGVPTGHHEDARFWRCDDIKLTNDVQCACFTNMQHSSTQAAFLNMQKVATAQDDITGDVYCLLMVLIIWRACLETRRISYISCKCLSSSGIIHLHSGFDMLHSDHRPFSFLGTEGQHVTHDDDSDQRRQHFNYDLSRQEPLSFRTNTVSCLKRLHALSFIPDALVRWYLPILSGPIYKQVQRIDTLNLNTPFQCLAESPGQLSHASFNFWRTSLPDASHSSSALISGTPRAPTG

SEQ ID NO: 1002530 - protein, 329 aa, Homo sapiens
HNLCCIRGGLRGRRPHHRPCRHRHSAASALGALLLHRPLHHHLHVLAPSVLEKKHIRRISHLWCPGQQAMRRTGATCWPGSDTGRAWAGGQTLSTKRPYLHPYWQHYAPCVRHNIVRRNAVSEHSGSSPPISEPQRPSHYTPTACDAPPDQPFKYAFFQIRLQNSQRRSHRKPPTANTLFIRTQYDLTPRRDTLTLELPEPGLMHEAQQRHKHLEHKKQPFETCTGTPGSVTYNIITVMSSYNQTKFTWRHPTCLKGDHSGAHHLPPYPAHMRTPRTPQHITPQNFGHTHQHRSTSHSGSLGHHGNATGLRTYPTGDHPQQGTNSAFPA

SEQ ID NO: 1002531 - protein, 316 aa, Homo sapiens
LGLRWCRGHRWTEKTLGQADGFSCGRTWGPSVTPEISPGTRSRLEDSKELQPVVSHQETICRGPVWSLCRQFQRRLTLRAVNLNLRRRDLLETPGKPQSQVSKRTPGMQTRLSIRVLWVPCARESRSPGKDGTKWRGGDQVKARKAERAGAQDRARRDTPKSRGQEDREEDKPGHDQGRQDTRARRRERTTPHGEERKTMKQTTQKNTGRGAQQGTANTRVTEERKGTENRDRNQARRRHAKKRIQTRRTRTRHKPKERRTRRERNKGGTREEGGRTKEGIRQKRRGTQRKRRKEGKKRKGKKKRGDRKEKKERDR

SEQ ID NO: 1002532 - protein, 211 aa, Homo sapiens
MHWQDVTLIWIQTHVIHITTVRSGEMEKETREGDPNIHSSTDDTATVKLDRHYNPLNGPVARHELRPLNMKDIPLSKGQRHLGGELKLLEPDRHSYFTHSCDWAKQAVAHFIHIRSNPLASTPRDPEEGNIPETDMNGRAINEYRTPKDRIVSSFGGENPAKTAKRHGNKDHRVNCLVTRGTRCTQHQESQKTENVAHTQENKEHKRKKAE

SEQ ID NO: 1002533 - protein, 439 aa, Homo sapiens
QRRRCSVSSLPSPARGAPRKAPRLVSLEHGRLREREWLVSWQELRGREGSMAAANKGNKPTESGDIRFAASQRCRQDPTAQRPLLMRSLHDSGGHGHARRDDRRLTGTRYGFLKILHKDEITFNHDPQMHRLSKDVQRGTMSPRPLQPSRRPHSQWMHLSPCTVNRWSQLLRYTREAQTRADTSKKEHTDSPDERWHTGNTRRKRPMNGSARPQTDPRGAETPTGDTGPQYCQRHGRLKRWMQETARKPGDTYTEPTRRPQRRTGDNRTYRKLKRPPVQGPPRDTWALTGKTPLQEQNINRTPNILGCRTTTTGRYSWKATASTQSQCNPHINNARGNRHINETEMKRETTRKDNATQQHQTRTTDREEARTQHHNNHDNQTDRHNRQQETAKTRRREKRNHTEQEREPRHTRDVRHAKQSKRDKNTKNQEKHDKERDE

SEQ ID NO: 1002534 - protein, 332 aa, Homo sapiens
GGGGKMLLFGVHRNRLGIVAQNQVRSESSDEEAAIGALNTSEGENGFDQERQMKSIARSSKRNIIPKSSTEGSFILPNAKDACQMRSPKDRSKDKGATKESEMRRIAAGTESPKRGASAASSASSSTRSRSRLGRSSSGSSTQTRVAQSSGSMLFLSIQADSVKLQELPGAPALASSSGSPSPSRGRHDKRRRSRLQNRKSPKNRLRTERKEDGSAISLRPDAKVHIRGELSAEMDEEDHHTMEDNLPTMGEHIQRGTWSNASWNNGNGKTRESGHKRDKPIREQPEKYQNERPEKGGRTTLEMNDQKKMGQENTEHNEDDATGPRDSTAGA

SEQ ID NO: 1002535 - protein, 200 aa, Homo sapiens
AGAVAVNRISAAGESVGGSSAVAAATQSGLGYARGSPRPPTTRLYSGGGGTGGPLSGAGAPPGMTGTIFQKAMGNPCEFFVDIMCLVAHAPDLPEVGSWRSCRMQSSRGLAFVGARTGGRWGAGWTTASALAAWLLQLLTAPVSEQPCGGAPSLTSAEARNSQALVSGGDPSWDEEDPLGSRLTPLLTGVPGPQGGHAGT

SEQ ID NO: 1002536 - protein, 74 aa, Homo sapiens
MATGFDSLWGPRGTHNYRKETVTPVIELIRSEGALNAVRKEHTCKIMHGRSKWRFPRLDRNDIVNEHRLSGNAK

SEQ ID NO: 1002537 - protein, 220 aa, Homo sapiens
RRGGMEALLLVLRCCCWAAYVLVYYNLVKCPAVRPCMCATLLGHDGVVTWWVLECWVSAELAVAQLERSAWAWLVCSVAQSGSDSALVPAPVGPQAAKQLASENERRAAGDMAAAVGSSSGLVHSACPPDPSELRGDGGRAHSTILPQEEVGHTLTVSSFNWALGTFWAHRYWPFWVGRRTFGQRCLFLQHSCSPTWLGTFPTFQQIDQVSRFLDGPRPG

SEQ ID NO: 1002538 - protein, 171 aa, Homo sapiens
MKGQQDDNTHKRKYRNMQGNDHGDHNTPETQHNPEKIQKGKPHGKHQETRGTKQGNREIEHNTWEPQGNTPQKHRTMTTKRKGESNAYQPCQQHDNTVKRSGTNRTTSHSEVAPKTGQDRIQPRGNKKKDTKRKTKSVEGTEGCVETQRTQSQENRTSQEAWDTRKHRKKA

SEQ ID NO: 1002539 - protein, 505 aa, Homo sapiens
KDSYVGDEERQNKRGIRDPESTPVDHGIGTKLGTISGEDLDHAAPFYNELCRSGPGWEHHKVAEHERKRTLVKPTKANREEDDISSYVSRPYGTSHWDMIAVARIQGAVLVPSKHLLVDANPTVATLLVQWDIPVEGKGVSIATKSGVWHTSYSKEDIAANIPRTDGQNRVDSLVRTHDGMNVPQGRTSMKRRTSTVRVKMKSDQRRSRMDLPWVTTTTKQGHDAGDKSGAANQSNGIDTADDITVRPMGPFQKPREGLRQTDPDIPHTFLFVPGEGKERLKEGPGYAELGTHDGSIQLHIWGAHSEQQRYTQGMVLTERGRHGYNHNGTFFNLLPFVGLHWEHSFSPEDIHQRKKRSAVITSFPKSIAQGGMRQWGNKCAGKKDTIGNRSKPTEIDLVHEGTGGKHRAKMDKLPGVDHYGPRKQRENGKQNRKETQHRAALCRPPKRPNVKRHPQESIYGSTRQEDGKDNQQGGGTPGGEFQIPRGTYTMDTHTFHNRDTDRKS

SEQ ID NO: 1002540 - protein, 231 aa, Homo sapiens
ERIHPMFTSRISEKTWMNERLQDSLGKFGPALSVKVMTDEHVENPKDRICEALKGTEDAQKAVAMNEPDKELNGKQIYVGRAQNTTVERQTELTRKFEQMTQDRITRYQGVNLYVKTSVMMVWMTERSPEQEIILQERMQDNKMQTGQLQWQEDENDTPKGENENRTMKTYRNTERQANKQDQKTEKEKRESKKKEHKNKPKKKEKHQKTSKEKKKKKKQREKNTHKNHKE

SEQ ID NO: 1002541 - protein, 262 aa, Homo sapiens
MLLDWFTAVDLKEIPVSVLLLEHPCLVAAVVSSVLAKSEDLSFMLGPSSILDLRHVNRKRLRSPVIKLVFPVSSRCAGPIVIFSLAGETSSLVCGLSSASQLPGARPGFVHCDVEPRGESCLSGGDWAVCVQNSIMGSRLQGVLGCSCVRPQRFDSVSCERSELRTFVALSEAPGWHALVGAGESPCGWSAVDSSLSPGVDTLFVDLLLCVARFSRVQVLPTWQSCGETVAPGSDACRGSTRIGPLAWGSLVLKHCSPGTED

SEQ ID NO: 1002542 - protein, 233 aa, Homo sapiens
ENTKWRMTPVQRGGPWGPWWPWDGEPAVASAECFGSVHPGAWGRVPWTVGLGAWGLLELCVRQGLMDNVMWIATVTNVGPAGQRDIEGIKVPVMEIYTTSSHDPFTVTSGDHLHFFLGGAVSQRHWRVMRQNYSQVQQSRTRAGTGANQRLQGHYCHAYRGDIQFVTTSEYLGLYKVAPNGQCGLTRASGWGRRSFREPNGSSIRSPDARKQELTWREPTIRSKPHTTCSPLT

SEQ ID NO: 1002543 - protein, 210 aa, Homo sapiens
MLAMCWSLKPELSVITCLGLPKCMGITVHEPSHRDPRMLDLYNFVCRGSSMGFRCQARLWVQILSGSLVVETSFWYRNLPYPDAQYSIICNTWEHKITCFSGGLFIVDQVSNIDRCWISMREQDTKKQQVCGTRDSHMRKTMYQENSKLLRGIITRIEPHIEIKDKYLGRNVDRNRDKQLISSYHSERADMDKGQDVSLAQACRGFKTDI

SEQ ID NO: 1002544 - protein, 319 aa, Homo sapiens
LAKGSGCVIASLQRKKMFSSVAHLARANPIRTSPDLQLVHEWLSRDLRHVMLPRGPRAQPRLLLGTWTACRRVTSTVVMFGSAKYCALCGLGGVLSCGLNTSSAVDSPGSLRGNCLYAVLEPPKKYKGHIEAGFSVTLEEDGVRGSGVKRWASDVFRMGVLQCRDSATLWLSSGKSFKALGNQQVCSGGGRNTNTLGADHLILRDGVLTMVLNACWAFGPGSYVKLRRGSEYAKPRRGHAENLWRDASPKRVYRTQGPKQQFYKGGCSSLNDTREPYSHDEVRPGSGNGTGATPVQTSGGPKPRDAPVKSEELGATLQQ

SEQ ID NO: 1002545 - protein, 158 aa, Homo sapiens
LDKKRDKDYRRKEILPFEKMKEQRLREHLVRLKGARAMEFDRRREIAETTTRRRRDEPHYELHFVNGNDTGTPLTRRRRRRTRPTTHLTHGTNTTTTTTRHGHANAWTRDTHSYVNHGTSYRNADTGLLETRRGTQTRQQQHASYMTQEKRNSLKEPT

SEQ ID NO: 1002546 - protein, 298 aa, Homo sapiens
MADVGEIIEGCRLPVLRGNQDNEDEWPLGEILWREGHQWPERYFYDPISIDLQQTSGCMGDSMSVLVAKRMIQFPKKEAKIPTKTRTAMGPCPGLSREREVTGLWRRLEMGRPCAIPVQDHSPHSTCPRRRDGHTRWQSLNSRSPPASMALRDTDHPTSSGNSEGWRAGLTSRKASRLTKQKEEDTRDYESIENAQKMRAPTRIRGKRGDDTTTTGTRRRWTKIRQIRSPGHTTEFEVNVRPGKHAYVNWETSPWEEEHAKAAIALGPGPGVLLDSRTDQTERHKSDTRQRALKCRQV

SEQ ID NO: 1002547 - protein, 113 aa, Homo sapiens
GCGAGIPELGNAAAAVAWPTCWCPGGSEPRCAALVPTLERWGEMLSHRLWLLLLGSLSSEEAGWTLDGQLRYLSCPVQETSSKWAPSPDLHHRAMLPPDATHLLASKDQSQAC

SEQ ID NO: 1002548 - protein, 69 aa, Homo sapiens
AQHSGRKGQLPSKCLLVHEILCKLSCAGDHLLTTPRELHMGLSQPILICDAERDAVNIERAIMDQIGCG

SEQ ID NO: 1002549 - protein, 418 aa, Homo sapiens
QNTKCADDCRCSGGARGALVALEMWEPAGGFLRRFLADGILGPSVAACGQGPGAVARRDAQLVVQMACWISELDCPVHQVWACLCQCDMTIKSLEEIYLIHPLHIRGTLRRISLSIPYRVEGPSSYKGTDGYLERTILRDVATIRQGLPVDPGPRRPPQWVSHGHLGYRIIQEEHLNQVGPNRIRRYFGGLRYRLAYAKRARVGAQSLTQYTLCEVAHYNYSYETQYRLLRKSMVRPSCRAKKDSVTLSDVEMETEFRGDTTAPKRVGSTQYGPKGLGSEGDAAFWTWDISLGGRRAKQSHFHFTRLLYEPQEGDHSMGSNLRVAFAEQLRYSNGPFQRKQAYRRPLGTWGPRDSSGQEEVWITQHFNANMGVPIGECGANRRSGGKRFEPKRAKPLFGSSPITIKEPFHKRLPLEHP

SEQ ID NO: 1002550 - protein, 144 aa, Homo sapiens
GVHRWLSLAASGCLCVPCVSERWSNEAWARGVAETPLTWDPAAFCMPVSTVTSPGLRAVRAAQCPGPVRVELVPDGPVAVDAYCSCTCDRKHGESLRGPPTPMQRKPRMVRSNGKCAIPTCLYLLMVLYTSLTRFQLRNRRPMS

SEQ ID NO: 1002551 - protein, 104 aa, Homo sapiens
MAVARYNGAKGKNSDSSAESGKSRTVSKEMVHCCKVNDLKDKYKNMELNLFNDVPITQMKEAGDGTTTATVLARSIAKEGFEKISKGAKSSGNQERCECELLML

SEQ ID NO: 1002552 - protein, 114 aa, Homo sapiens
MWPCERKAYDHVYGITTNIRVSEMACTEPDLVPGLDCHNPCALLGTKKGVGQRQAGAASVPLNPGRILGLENPLYNRSPIIPPGAFLTCRTRLVEAKTLKEAGESSLTYVRASF

SEQ ID NO: 1002553 - protein, 216 aa, Homo sapiens
MVGKLAAFHVVLRGTLGQNDCLCIWFCGTMCKEVEALGSSVTKEDVYKYALMRRLPDKHWIVAAIHTAMSAEIGEALKEDSGTRPSCDAYGDGDMKPENSHKPGATHQKKPSPAGHSESRAHRRKALLGLTHQARDDIVEAQYLHANRAHKEPNEHAGQNQTPLTPPKEMAGPGNKTTQRIRTHNTGKTTAPSGPRQDHWEALKGDYAKQPEDTEQ

SEQ ID NO: 1002554 - protein, 423 aa, Homo sapiens
MGLRSGGLGASEQESLSVPGLKRKGSTSKELFVLKMYKRQGLHYYLTRLTVQWCDHSSLHPESTQAQYHHFRDLKSSTRVRWATYKRQRSTHYCHEQIKFIYTFNKGRTDLEISTYCMTRDMDYNKSWDSKDRRSDTMGLQKPSTQGSRQNQSAPRGDDSSRKRVTRGTAKEERHTRTTAIPHHTHNNKQGGPGENQTTTTHERVHSPINRENPTVGKKPGEKRRRQRAQEDKTKQVYTKTHTVRDHNKRHSDIPSTDTRENKGETQTRKSNKRHEPREDRKGALATGRKVIHHQGQKRTNEGDKGHNTISEWSSRPVARTQRHTEGATRAASNTMNEEETTTQDEATQVAQQTERQRATQLKEVRTQEQPRTDVGAPRAEIAHNTQHGHKRETRNYRNNHHAGERHKPEREEEAHENKDDEN

SEQ ID NO: 1002555 - protein, 302 aa, Homo sapiens
GITNGVWKAVRGSRKTNIKTSSGGFSPKINLTGSSFKWFTQNTKRKNVRGLVFSERANRDPGRAGGKKSYIHTQEGGGASRRGVGAHRVDRLCPSWQRASGLWVRPREHSRAREVLVERDHTRGGGENRRDTQLSGATQSGEKPGGDIQKVGGLRGSLTKDESCACEKGVGIEAGPCAAHNQSGRGGPWSGPPPKALCGTPGVGYTGWGQPTEGENKSTRCGPIARTSAAGGETSQREGNRGAKALRGEGENSIHQSEVTPPKVRAETKLEDPPGQHSLHRSREPPTPNHNAPYEVGSTPES

SEQ ID NO: 1002556 - protein, 297 aa, Homo sapiens
GLCTTGATSQCSLMSVNPGMARWIKELFVPERAVCVLHGGDCKHGFFSLTAVEGHQRWAPYRIYYDRAPAHKQPKAQQWCSYNDFSFVTADQIERAVPMRKWLSTWASSTWAPHIVLIFEAHKDFNKPSCKTVTDKSCLRRTALVLAHQQSHFLDSCACYTGIYFQRQQMKGLYQAGRPMQAILVCGLTQAVVLGQSDQDRPCNDFGLAPCIQRCKTRRWQRATHHAPSSYASTILGYKQTSGRIGTESRVSIWTSWRTTNWVIEREKKAMRNFPWNQKTFKSGIIGDRYENLNMYE

SEQ ID NO: 1002557 - protein, 120 aa, Homo sapiens
MPKFHVPELLPNGPYAGLEHRGSSSRREKKANSLFDPVACWTVYTPFSSMDNNGQQWNMGVLCRVDIRAPPSYNRGHQKGRNQRGGVGNGKRSNYPGKPTRTGKAEHARLCEPQRRYMLQ

SEQ ID NO: 1002558 - protein, 228 aa, Homo sapiens
MLTERRNSRLYTTTQRPQRCTAPTGYYEPFACRHKNVFTERSARKRACHDLPYTTLTIDLSPYALSVVQRTRVIAHYEAPRSANTTSRHWVQALKRICDLSYSSVYDAALLDLRQEYVKYRHDSVGEQQNIRDYATESVATAEQKGQKKSHMTVSLDIIRNYTSITNKWIHGTSRRLIDNEQRASSDYLLAIHDSIGPEYDGSSSSKQEDPNTKHPLSTVDPTGEIRQ

SEQ ID NO: 1002559 - protein, 363 aa, Homo sapiens
IVSWDGRWADIFLSLLRAPFSSMAKSPSRWAYISPSRWLCTLGRVCLRNGSPVCCNQLRTETASNSRMRHRLPGLLKCSPGRGARRPTGSPNSDLPVNECLPSFSLEPPAMQDRGTKTVCSRQCPPCKKTPFVSARASPTGKRPRRSQRREIFYVAGKECRSPIHLFGEEGPSCEEVDKSPIYLLMCCTLALLAFVGNWLPQHPLCTLSATFVFTSFHCRSTRAATIRGLRQPLRKELPRRRGQLYGKPPIHETSGYPSKKENRVVKTIRDYIFAIDVPLALHTARLEPTLLVGGFREGLPQEWLNRRHRWGVIILVDLLTTRGSVSRFAQICAKNCPIGRVGSPNFLRSPLGQNHLVFSTIW

SEQ ID NO: 1002560 - protein, 105 aa, Homo sapiens
GVCESLFQDAEAQIGAGPEWVPRASPACLCRSYLPACVCPCVLGLMCCRCRTVACRCPEPHGSRAHVCPPRCPFQVSCNAQEVKAFDHPVCLTSKAIVLLWTELA

SEQ ID NO: 1002561 - protein, 197 aa, Homo sapiens
MKSGSTSCRVGRASFAEGGFRGLWGTRAGARSREFRSYREFRGDDGREVGQWEQTSLLSPRSHCQRDTERGFTSMRNSPSGPADGLKTGSETHESDLAPSTRGSHSHGGNTHPGPSRSRRIRSRQLQQAQAESLPWGGRGFTPRRVPSRRGREEGGPVTQGRAGRRPYKTQRTEACTRTTNSTYDQQRTGGLTGERG

SEQ ID NO: 1002562 - protein, 239 aa, Homo sapiens
MFTLLDRYDPPVCGRALQIDATLTTLTLSCLLRRYSRIHALLQALYFRSHLPTWADLSMTLLRTRNLRKVPRCYVAHNIAFGKSWPLTVPAAYSPHTRTPFAFRTSISPIRPPSTHHVCKLGLIVARSMVTHTVTNPFTSSLPSAPRTAHPHLLYCTGPPFLIARTATALCALNVLLPGPTGHGRSSPLEPNLLHLGTPSLTLAAPFPTITRARSELDGAVVPYRRYATYMTISRATSD

SEQ ID NO: 1002563 - protein, 244 aa, Homo sapiens
TKWLDDCRVQLWVVPWGALVALGWGTAVASAEVSGSGILGPGAAVPVDCGPGWPEACGALRSARPRISEWMPVTKLGRLCQWTGMIKSLEEIYLFSLPITGIRDHLISSWGPLSRDECFEGLCHVPECMSLLPGQGAPVFTGILLLIVGLQVASVVSRVLRLLQGWLVNRHSVWAIILAKLSIVPRAAEGYLGEQDRASPTLSLQGDRPLRALCWYASSLHPGALAFVSWHLCLRRLLMMAGID

SEQ ID NO: 1002564 - protein, 71 aa, Homo sapiens
KSRFDSLSLLYRYRDGRWVVVGVMGKRNANDVCLRAAGTRVRCQCSAWAVGTKLVLSAVATCMLRSWWLPR

SEQ ID NO: 1002565 - protein, 215 aa, Homo sapiens
PNARIELQEWEHVTCIECHRHCAERRRVRASNGYVAAGTCLMQAERGHSDRGRILIMDVIDGGARAWPALEQEQVQSPLTEKEQKGPVTAHVHSAIGRPGVCAIGHEEFILMRACCAQLQLKGMALSSTTQASTYDQADHAINGNVTVLGKPTVGELRHLRCLRIPRTESKTHEALDVAVMPTTPVKVVQTLAPFYLHVSIYGPKPGSIYLAATS

SEQ ID NO: 1002566 - protein, 251 aa, Homo sapiens
TGQVCRGEGLAAVTYRAQASSSTVQVFGRKKTAESCGALKTLQWSHQGEQERPLEMIEPRTLQYKLLEQFCFSDKDAICWCRHPDVRVKGEKVTVAQIYAIRQIHLQSPGWPITRNMWMRLPRTEIKDILIQYDRTPCWIAEPSYAAKSKKVMEAPGCTDASLPEHPTDKTHRDSELTWYTIHQEHTHGAYRQRIPNRRQPKQPRKNNKRNPHGTSDTRRTKRTRYHNKWPHKGHQKKATPEPPHHPHEPQ

SEQ ID NO: 1002567 - protein, 135 aa, Homo sapiens
DGVMSHRNVLRLPDMGPSASCPRKRSSRYRGKVNSFTHKDDLCPSRCVHLYRLFPGIQGWHDSDIVLGSRTRPVDPKVNKEGGVLECCDHCRDTNQMVDAGAFVGHTCETSLVERPSEDRVRSTWSLCVVANNQR

SEQ ID NO: 1002568 - protein, 253 aa, Homo sapiens
SGFRQMGPTLAAAARRALPDGDTQLQLMLRWRIMTGPYFRYRTYLVLAGAEPFPRGRVAQAVRLPVCACVRGRSLASSACMFLTLRLTFFPLEAVREDAFNVPAVGRPDLFYMSPRHSSDFRDDVILTLAWIAGELLDCSCAAGLLACLTSQWSVPIDHVRPEGRGRGPCPEMAELRLKAGFPRITRTETFPLGRILNLIARSRYSIYNYGLAKRGQQEFPADAGMRRMAIASELGNIDRCQVDELGRKNYTT

SEQ ID NO: 1002569 - protein, 485 aa, Homo sapiens
MRPPRGRQYASPYRPHGRRQIAAFAISAAAEAGRRGRETSEPASTSTSPCPTPSPRQASSSLLEQTVSVEDTRVRDRLASARIDHCDSIIDSRVEEHTGLTIAAQEGVHWRTGDLLLVTRKLGEKRQLRGEAAFYGLWIVTSTAIRESDRGNNSHRAITSCIVETFPGNWVCEDAFTGLDLDVGRVLLHTMTFDKRGFVPPYDPMDVGRGQIDSDECCHTRNLSQLDLNRRFPLGIVPERLRRQKFGRFCYKLWGCIAIPVKSRLNKRKSPDAYWGRTCRDSEFERPQWVTSVAVPIGHPSQRPVDTPSMTHAHEGHSIPSPVEQHNEPYSRTRIGGTRRPWFPGGLCVGTNESEQRTTDTPFNEQAFGTRTRLPRRDHSRSQYKRLEKRDVGTIPGTYLRWQLRAHPHTEHKRRPRERQCNWEHKRVKAGGERLKEMPDSHTKIQHKSGHNVKGGARNNDTLGTIPPREETWKTRTEQTAGHHE

SEQ ID NO: 1002570 - protein, 279 aa, Homo sapiens
PRAPHGRRVSSSRAVGQSLCLSLGVLDGGGHTLYPGAVVLPEPGAEGLGHPPDQVSENHKRLPYPLVQIKSDKQQLGSVIYSIQDPAVDEEPRGVFSIDKFTGEGLPQLAWWNGKRMDGHGLKGLACGPGEDPPVGGPQDLEIVVVDQNDKAASFLQEASTGRVLEVQSPGTYVTREEATDADRPRDGQTQRCGFSNPAAGQPRALQQSRSSQENPQKCKVGLDRGGGRGVQSDPEVADMSGDGSQPLLSIITLMTSMTLPRGHQEESSGGLKPQGVNV

SEQ ID NO: 1002571 - protein, 107 aa, Homo sapiens
LAAISRGKSDSERALQAKQLCLLIASVPSVLYEKRQYSMCGADTVKPPAHPRASSAGPSSWHQGACMLKCGNLPIFQTMDMVSFHEKRKLDLLDSLSLNPFKGTCRQ

SEQ ID NO: 1002572 - protein, 283 aa, Homo sapiens
MRESKMTIYQRSPSQIETNGIIRDSGTADKESSSIYQENEAAPDTRRRPRLTNTYQDPLTGKTVEWTQPTRSHIGSGTNTHCTQNNRREHRSKSLSSEQLTHHLTMAERHKGSNKTWNKYMKYITDYVTHTTDQQPLNRHNLTNNQYETKSLRKQRHKAIDRPKHENHIQSNTWNPGEQNAEQLADKSMAHNPKLQIRMDTYNTQDKHSNIDTPETGKKPMDQHDKQEQNQRTNSSKHNNNHNRNKLPIQNNKHIAYKQHKAQGQPVRTPLGKNIKNHKQHRK

SEQ ID NO: 1002573 - protein, 159 aa, Homo sapiens
MTRLIGGRTIDLRYIALLFFMMKLGCWQDMMPPGPWITASTCESHKSILNETSLLGDFYQNSVFHPLKQLIAGKEPYVLATLTYVLEVCQLSTILRDRQYHCSLADMPSRTYRTKPGMNLVGPPRRSTRAVLWVLTIRAFLEWRARNLVFSSEYSRLRR

SEQ ID NO: 1002574 - protein, 284 aa, Homo sapiens
RLCIPSLVRRGSGGSRTPGWCTVDARDPPVENPASHTPNANRSAHTEPTNLMVDSMQGGTLPHGRHDGWDVGMPIGMTNLIECCIENTEASIQVRARTLYHHGRPVQLESLLCCPNILCPHHKIGNISVPMRAMNATPILCMPLLATCHGHAAVPVDAQGVARLYSASGRSVIVAAYDDRLCVYVAVANGVGTPPRRHKREQDPHIEDTEESDGKCAQITSQAREIDTNCRGHITSNGSEDDQETTTMHEHTMGIEITRQASQQVTNTVLVTTSEENPKWMGTN

SEQ ID NO: 1002575 - protein, 246 aa, Homo sapiens
MGSWRRGRVADWLAALGAVEGAVEGAVEGPRLSRGAAPFHSPCLALVPTGLGRNVCTALLPRGQRAGRAGEVLHSSTPRHLHQDKVRAERRKAATLITRTDFAGRVDRDGLDNQDRDEDEGGNNRTNKTRENSEQKTETTASKKATNETTANNKQTSAGRRRTRDLETAGREGGGARVGSHSNTEGSTQGHHHQATKHNSTAQTNTKQTTERQPPTTHHKETQTERTHRDEEARHTTEPAAAPAPR

SEQ ID NO: 1002576 - protein, 278 aa, Homo sapiens
PALVAGAHGRGSGQCIVGLDREVVSGVQSDPARWRTCLETASQPLPQPSSPVDDINDNAPTSSAGMSTFMEAIEAVSWVDVGRLEVEDKGPAMAPQTGVARFTILEGDPDGQFTHTARDPKNNEGVLVHCEGPGHMRAVQHITEHPTRSRVARTCRAPLDKAGIAHKRAEDWRTRAKGSDSSIDAKDKQTKAPPGYQRKKTTNFRNQELSTTRRNTPKRNIIGIGQTILLEPGNPMKHKKPTMAEEHQANITRDHNEHRKKLACKDGHQANWPAIKNQ

SEQ ID NO: 1002577 - protein, 177 aa, Homo sapiens
GKHSHVKIGRYHSDTLQVAAGLRSLTFGVTVMKCYPEIKEKEEMREDHSGRYGLTGKQQVSPKSGTCQTGQKCRVCLAWLAMAEPHTVLFLDESHSNHLDIETIRGPGRMPSMKFEGGIDCWTAHDFRLIHAGCTGILGSVTKQTIHQVAWRHPGLRGAPHSPSCDADEAEMRASRI

SEQ ID NO: 1002578 - protein, 146 aa, Homo sapiens
MRGGEKGRRGPSVTSIPEKMCWENPAPQGNNRGENMGHGGLGSPLGGKSNMGRVWARNRRKRENPREREGGARTQRRAPKPGEHTHKRARTAGGPPPGSKEGEARESRGETPRNRQTDNKERYTTRATAQNSQSALRRKPGIDTRT

SEQ ID NO: 1002579 - protein, 227 aa, Homo sapiens
MCKPLGPQWPRGDYTPRRPTHGNGRGRENPVHKTAQNTREQTILARNTRGMQRWNSGGKTDRQPREIHEENANNRDTRQPHHVRTHRGHRTNGANNKFRRPSPLQGRQHKQGEPRERRPNTQQSSNTRKCVSPNQTRGATIQSQQIGTINYPAPEGHKTAPKTPEDTQGGPPRRRHKQPPETKGTHGTADPTTNNPGKHTGGERRAEPQAAKHPKNTHKAPSPPTPQ

SEQ ID NO: 1002580 - protein, 169 aa, Homo sapiens
MTCLVLPTGPEAPNCACTHLPCTPVMLPQCFPTAMCHWLLAPGNIMSGGGEPQGWQRMDTTDGWHTRMNWKPRNDLNRDLKPSEQTRRHDNTGRAPGAEGTRQTLLQLVGTSHDTQRVYTTTIMLGKASRASRSHEPTRGPTSPRATAGPCPPGRFSPCARPSQGKRVC

SEQ ID NO: 1002581 - protein, 352 aa, Homo sapiens
MLDTQTNTACSSQLVECDLGLMWCQPDRRPGLSAPEVPQRPSCVMEDDVRDLPLRPTGIRLHSAQARPCLPPESEKGWEQENMKPQEQVTLGVHMNRDQCRGSMGVYRTSRPKVKKREVQRWSGLREMCVDTVVTVCVLLLKETHLVAEKKRKMKERKMVWRVCCVGGGGKRGGKRRGQVVKQGSSLLGTPKFHLRVPNRVVKQLRAVHCRLNKAKWSPMKLLPMKSPRGVKHRGFLEQDPQGGKTTAPPQARDGMALGQRPQERHDKPSPLCRKPPKLGTCLGGHQPRNTRYGGPGNRQEETQEGRRTIQERATRPPGRDTQHRGNAKPRKDRHPQEGTEAPATAMGKGPR

SEQ ID NO: 1002582 - protein, 308 aa, Homo sapiens
GVNAAGRGSGSVSAAGAGARGCVTLQPVQPWLWPWPVGMPLVVPALTGALVAKACSVRLALSWMPSLPASTTDDCGGTSRPETDQRAKCWRQLVCLRCQNRMENMRPGSFSFIAFSGYRGVVLFPWQARLYDRDVASAAPEKAENPAGHGFQMEVKGKTHTYYQVLIDARDLPTYISEIQTEAVTFLANHDDSRAFYAIPGLDYMSAMKTSSPTAPIDQGFPSNMNFFERFLLYDQTKSTFLYVASGERYRGLANDEESPLGLELSDCSSGKQIEERYVVTVIPFLIGIEGTPEFHCVLVALLNPEGD

SEQ ID NO: 1002583 - protein, 209 aa, Homo sapiens
GNFKIPQKRFIIQVSLESRGAYRVGFLGSRARAPGPPNFWDSQRQRVSYQQGPVIRDEDVLDLLLGSLFHYYFWVIRPPGLGKWDWTDSIKSGATWTTTLYTGHGLSTPANRLLARKAKLGLQEVLVTGDGWRRVPIILQGARPVTLLMEDLVARVFAHVAAQKLCRLSAFYGCSEELWHRIGKGTSWDGALGSQSCGTEKQTFTRRRG

SEQ ID NO: 1002584 - protein, 133 aa, Homo sapiens
NPSLAFNALKNQFKPPPPFNRGAVTKGKERTEPSLWRTTSVPVPPAIFLARDWDLWFSISVSPLLAWGWSCDGCETPSCGGALWAHCESPPFGREKSQRGGSVDKRPSVFADPWSIFVGNRVCVCVSHEKSLP

SEQ ID NO: 1002585 - protein, 317 aa, Homo sapiens
QRPALVTMEEIGIVCVEKAQDEIPDTVRCPGPRPACPSWALSHEDLEDLVQPAYIEAAARAWSSVEVQEADTIRDEQREPAKRNFSECPGGGEAISKRLSRLVIVTICVGGVWIRNTAIVGSTMRTSNYECAHHVEHALRSGYDCIEGAQSRHSDRTLLRMTTMAIVNCDGSSDVNAPESADQLAIMDAVSSEPEDRMWVYADIGGMDIQKQEVREAVELPITHNERLQSRSESIPPEASSCMAHLDCGKTNVGQGGGTITQQMTVQSGVGGSGGRTESILGDGPPTVVRECVPPWHKENDTGNQTTTTRRKPRQPE

SEQ ID NO: 1002586 - protein, 180 aa, Homo sapiens
MSTIKYAVRTHSRKYTTGEKYKVEEETSRTEDEHCTNNRDTEEATTHRERTEQGGETQSTTETVETRHKCATVARRQQGTSTATKAEKQTVQTHGATERYITPGQEMTQSIREQKLVSTGKGHLSSAATMRSRAVTNRAKDVGTIVEDDPTTDGRLHTSHTHSSKQTQHVDQHESERLKA

SEQ ID NO: 1002587 - protein, 340 aa, Homo sapiens
MGAGLSGCLGGPTVPTPGVGPRARVSLLPLFRALRDYRSHVASSREREAEVCPKQIATVDAPRESIPTYLSFKAHRFPEEGKVVLVNAIRPLVKKSLPSKLGTFPTATTGLFPPLSRCPSLICCQTYSRTGPIRVRTDVRVFTCRLGSSRGYVRTVPPGFPLLPPGVYPFISQSRSPLVPRCLCPVAGALKATKPFSRKSVRESAYTYCIVACFNTAAIGAIGFWAIPQKLRAREAACLCSLWRRKRAPISFGDRLEMWPLPLFDLAFKLILEPSRSQANTYKDRVPFPSYGGRKVGATFLERRDTVCPLLAFGAHRQGKEATSLKVSKERKRLLSLQSP

SEQ ID NO: 1002588 - protein, 177 aa, Homo sapiens
AALCEYDMVRDSAVRCLLEGPTSADFAVGQSGAWLAVPGRKNHEFMMILCEEPNSPVWARKAIDPALDACDGEEDCSAQQTSDDKEEPLYIELSAGSERAVLRDSELPNDEIPVAESQSKAVWNIGLRAVPIADSRKIEDGSLILREALNLPTLPKLQCTLRKENVQYTIPGSLDEP

SEQ ID NO: 1002589 - protein, 195 aa, Homo sapiens
MANSDPCRLRERKLLHTQRWGAPEGLWALGGPPARFARAPAGEAPDLPAKCVLERARCVGATTDPFLATRRPRDSMGALGPIGSPERCGRARLRHSGGALWASQLWPRGTRGTHRDNAHGYGMQGDPRDNADVAGNLYCDQCNNGSTVCCATHHLHVPEGTQLVLATGIQRRNSAKSNSQGGDPPFVCCTKCPTI

SEQ ID NO: 1002590 - protein, 363 aa, Homo sapiens
MRAKGVLIRSRNGTWCRMTIYFILKEIVTFDGHMGIASGFMHIGIELGKRLRTRIADGTYTYLGPEPGMEFRKALADCVGQAEHMIGFLYSSWALAVHGTHYGRVRVGSLLVATCSGRIPAIRDGHLGFAMPYGGGVPARFGIPCADYRAFVHLVCVFRRGRPAFERGYRFPFDAIGTPSGAGYPHWIPIPKLVPDVSFLIAIGDPNRQGLGPHSQGQGPDWTFPSHRGFRVAQGEKTIQGGIAAELPAHFCGTPRNGGFNPERRALEMKLVHFHQGKKHSTLGDSSEFAQPHKLLAGGQLAHADAGILDIRHKHQNYRLGAAQLYDVQCRPHDGRAWLRHMQPWRLLCAGTNGFVLYPPHAS

SEQ ID NO: 1002591 - protein, 401 aa, Homo sapiens
MVALRMIADSTWPLLLAVDVHLSLSGDVDSCDIDLSQKGLGWKSQFGGSHSPGYSIIHRSDPLDEYSRRSMIDALTDRSVVISNLSQDIYPCDMAQWSIGKVSQCGFHYGYLVDWASMGLCPKGLGFALEPLLALPDYPPDRRNPLEAPLPKVVLLQQLTVRATSGGPSSTHLLLHSHWPTIQEMHTLAKDVRRIAKEEGANSNPFASVCGKVGGQPPDGFQRFWGGCPHSPKVLLRAEGKGQGLSLPPGEDAAMGVPYHTTLVPGLPKLALGCTGDWWSEMVAAFGPCEPLGLLSGLRFGTTELPRPVAFGIPTSGCFSPFDHGISSLRDSRDDGLVCRIWSSNTRKDSRFVCPPGFRPTAVPVGLCPALWTRERTFGSFSTPGDVAVWRDVVPVWGGGP

SEQ ID NO: 1002592 - protein, 142 aa, Homo sapiens
GRNGGCGGSSGVVIRGAACGSGVSARVFYSEALRDGHYIVGREQIKKYTGMRTQVVLNVPETRVTCCMNSGLRVASEDSGLSTCTVGLWIDAGKLDTTHEKNNGSSTLSGSIWLSMGTKEEHPSVDLEALQIEIYGCSSQCL

SEQ ID NO: 1002593 - protein, 115 aa, Homo sapiens
MWRGDATCGVRLPGVLCALVGALPSLSPQNRLEQFRGSSESLFPPQVWERCEKETGAKRLALGLQTEFCFRGEVRSTPSCGGAHKRNVNGQKGRKAVGYLENHTTSRGHINLGGK

SEQ ID NO: 1002594 - protein, 234 aa, Homo sapiens
MPEPHDRRNDWRWTGSAGAPLGPVNGLNPAHTCCLCSWPRTWPCLKPCSFDVTFDVGDEYEIIETIGNGAYGVVSSGRRRLHTGRQVWHQEDTLMLSIVVEQCRSGASAELKIHQALINEGENTIIEHLRRISERPTWAHEGAKSKITSKKWVPGTLMGTRRTRDTKIIRILSQGPLSTESTVALLSCTNLLAAALTLHATSGSGHPTVNLKALQNTYGLNETWCSSRLGALGV

SEQ ID NO: 1002595 - protein, 101 aa, Homo sapiens
STVKGELAEYGLGFCFTCAGDDSCFDETLKTHHDIQSMFRNDRLACKFASLAINRLTAVSGGIGRIIWPKCEFETIPTFGMLVHLKRDTTTSLSSSVALQV

SEQ ID NO: 1002596 - protein, 47 aa, Homo sapiens
MRESCLVITRDCCSPSEQIILGLLHVIPGNLTPSMQTGSVIHEGRHQ

SEQ ID NO: 1002597 - protein, 115 aa, Homo sapiens
LLRVPSRFASPSMLRVAGSSGGTSARISLMTSGRRTSSIASSEIVPPIPSGALTRTFARPTPTPRASPCAFTAAISASVVDQSKRTPVISSPRSLKARAANCRTFPRLTLACFGS

SEQ ID NO: 1002598 - protein, 355 aa, Homo sapiens
MSTSNSSHPIRAYLRFSCMRASLRTVLLRCNDCIPRTSSNCRVTILSGRYAERQTSKPTGPLQPYSGASITLMWSPHAASLARVDVAICYTESLHGLNAISFVAPQCTNMAAVSGSAPCNRDDFAVDRIVTIHVQLVTYCELASVRGKYKKLDRLLTPGRGLLSLALHFIASASISDEQVGTQLLVSFPSSNTSSNCLLRGFPFVHPVTKVKPNSNPPPIPSSSNIITGSVLGLQAKTTRGSRPGNPLTWRASVTLRVSPEGDSEIGVMWEQFLPNVPRAKPTRIGGGEEMPGQWNGRATLALTEGYPLGGGPLVGPFSILCGVLFNFFLCGASVASLYIRFSAMLGGCSPFDGY

SEQ ID NO: 1002599 - protein, 270 aa, Homo sapiens
MVEGIRCCPYRICAYYLDYARTLTKGSRAEKADSHCNFQFCVAAGQVTVSRTFATLVAVRMRLSFTDDSPSLPRFEHAPLFVLPKKVGVRRDSLEPAIGRFGPKSSKIPPFPRYRPIRFPRSGFRGSGYICGSPICCGAPILVRLGPVPQDRTANFGTHANVSAVWGVGALRTEGGITYAMTLLLRMFRTDYADRTIAIRRKMWLHLLIEKLRFRIFHACLSCYDTFCPVPSMKLPPISWGGPTPCEPENTTRGFLSPFLRECAGIDTTD

SEQ ID NO: 1002600 - protein, 271 aa, Homo sapiens
MKPHRGGHAFVCGPYYTLLQLVSTHLLWCGVLNSRVQNAHRGLSSATVVVVLCACVLSLSPSLVLFATTQEDSSLLLCPPLLCAPRVVFSPSKPERPTTHRVWEKSARVFHCCGSGPHTLWCYAPRCVGGTHTISHTQQTLVRTVWSPPTLWGLLCEASGVGHNCGGTHMFWRPLLLLWEETPQPCCPHPPARVSQTSCGPSSLAAPPLVFFFVPPCCAREGGLPPFFSPTPHPLGAGGRLAASLQTRRSRPLLGGGANSLRGSQPVKQER

SEQ ID NO: 1002601 - protein, 140 aa, Homo sapiens
YPENWRAFKALIAAQYSGAQVRVLSTPFIGNTHLISQFCGRSSFEVDGSGVESTPCYYVSTEELGNTPEAEPVVQWVSLLIRLVPQQYLGVPLGICTNKRHECKEKEGIWGCGCYEERILWANDDMVTQVSAPVVVYKQV

SEQ ID NO: 1002602 - protein, 453 aa, Homo sapiens
EEEIQRFQTTFTLEDADLTSLPSLTSGVLFLQGAGLTWQSVDVGALLCQACFRHRVTAPCYSGDSCVADWSHMRFCFLFLMSAYPASGLLEPLCLPCFRVLPATLIIAGARRFLSICLWHLVVYSDSLWFAESLQAHRGHPNLVRRHACLWLQHGDYCTIAKDNNHLHHVYHICQLLSKASQLHCVCTCMSSGSLSWEEISACFSKDGPNPLRSERSDRLVLSQVPSRGPQWELAPNPALSFGIRNRFGDMAGWRLVCNFQGPCLEWGLPKAEGPPRKACTLWSPRGLSLVGPLPHRLGTFRCPPKALAIPCASLPKGGLADKVQRGITPRETRKKNRVGSTKSPLGKGGCGLFPRDRSLWAPQTFDPDRSLSPNGPLGWAPSGPRDKGSPKEEVPFRRWALSKGQQGKDQSFRACDFHFSQRVAFSLQGNPFGHGTNRGLRPKPIRFRNTPM

SEQ ID NO: 1002603 - protein, 118 aa, Homo sapiens
MVVCKKACKGQRKTLRNWDRNTNQNKFTQWKALGTFPRCHGFRPEGRRIAQITNLAGGVPLSHNAKLVKRWSGGFLHRVENSGGTPGVGLCTTLGNTFPIPTGGSPNGNRSAGFGGGN

SEQ ID NO: 1002604 - protein, 209 aa, Homo sapiens
MACKTANRRGATTLGACPTEDVHTTGLCRYLSVVALGDNVCTQGTEVVFPDRGLVVDVASLGHFHFIPGKRYERVTHVEEDAAKRGAKTHRGHVTPVEHEVIPPPTEERKYRRKTHDCLPIVGEESPPQRWGWHTSKKAPELSMMKYQDVENTTKSHRRRVQALSETSMSKDSGENAEPHDPTTRRKETDEWTRAQLTCGTGEQRRAHG

SEQ ID NO: 1002605 - protein, 74 aa, Homo sapiens
VYCTEVPRDAVRAVSLCLLPIWEALDAMGSVVNNGSLRVWEGRNPKVRAPGMWLSVGLHSEEEMRASTLVRRMM

SEQ ID NO: 1002606 - protein, 61 aa, Homo sapiens
MKKNKDEKEENTEKKKKEKRKQKRKEKEKKGTEKKKKRKREETRKEKKNRRREERKEKSTL

SEQ ID NO: 1002607 - protein, 206 aa, Homo sapiens
CAPPLTHSLPSFYSPSDSRAPARSELTPGSLPRTPAAHMEGGSKGKRSRHRGAETEYPAQKPVQWVRGAQKTNRHKKQNKKKQNKNKTKERHKKQKKKKQKKRPTKQKRKEKRESKKKHKKKEKKKQKTTEKKKKEKKQKEKQKKKKKQKRKQKAKAQEETQKKTKDSKKKKRKMTEERETKTKQQKRKKKKTEKKTKKRRKNRRR

SEQ ID NO: 1002608 - protein, 391 aa, Homo sapiens
MFCSPGQARQSTPWPWVMVVGLSGCSGLLQPRLELGAACCPAEASSPALLGVICHTDLRKNLTVDEGTMKVEVLLALTDNYMYLVIDDETKEAALWIRCSPDGRGRGEKSTGVKPEHSASPPTTLGPCCGDMRNLVKLESRTEGVPGVTTVIGALTSARSRQLVPHWQVASRERSSAWRTRDTKFRTHICHYVEQAREARRTPITEINTVNNLGGWLDSGERIYEREPADEECESFMTGGYMGRHAPGDEESTRWTKKGSSIQQTDTGSRNGQEWKTGKQGRTARRRQAEQRPQKADSTRIGPRPKRGQSKPGKEERPAHKKPNTVRRRRTNNTKKRKKETTDGDKRKQRSGEAAKEEKDRRKTAGEKKRPRQNRKRRQDTHRTESRQPGN

SEQ ID NO: 1002609 - protein, 492 aa, Homo sapiens
GLWEMLMQLSWLDLPERDVSVEPEPPCLPAASASPPRTVSPGPGARHACPMSLSLVLSMCLPRVAAAASERGGTGTMLSCCCLCEDVLCLDPVAGAALRCCGVRGKPACPGRHHCNEQESHVHFNIPHKAHITNILYHTYQHIHLHTSSYQKHATNHHNTLAEHQIAHCKSKYVHSHNNTPTRITQHQHYHHSTQLNYTRTHPASTIPLIASSRTLPPTYPPHSVPSTPSRTSHTKPNTTIITTHPHLPTNHGLLPEKHHHNIAQQPPSARTAPPTPHHTHTDKAYTRNTTAINRTSRSSTQPSSTHSPSKPLYKHSRTHPSRQTIVSHHNPVIYTDGGEGDRAERDTPSRKLSDASPHALARQRRAAALAHRGRDAQGSTRRAAVRNALGPLALTRAFIPVHSPNPVRPPHQLPCTHHTPSTPLSRSHYTLNTPYPPHHSSTPSSSGVNYHYTHIQLTTPTHYQTYSHTSTLYHLTTSPASAPHTPTISHN

SEQ ID NO: 1002610 - protein, 120 aa, Homo sapiens
MSHFGAHASDNACPTTQTWANANTGAWTVPSEMPCRTPDPEIVGDVRLQSGRQGHVHVSVAPGRLIAYRETSAARRCDWRPWGSCLNNKYSRGLSWQEIPMGEQRWMRVTTIRALRAMAR

SEQ ID NO: 1002611 - protein, 257 aa, Homo sapiens
GGTTQSYDTPDAGASFSRHFAANFLDVFGEEVRRVLVAVADDSWALAVSAEAMEPELADTSALKAVLPYGHSRSSEDVSTHACTKAPRSQRASRCRNMSLCRGGPRVLQTVCAPVLRLCPEPRRGMLAPCTVRAPATMWTAVPERCPRNAGLQGGAGGHFNARGRCASWCATTRPRCSGGSAQWQTLPPLLCAGAVADGTLPLEVLRAPKASGPKVRIPTWSALLEVRNHHAPWKLQRRITHFVLTGREWERIHLGE

SEQ ID NO: 1002612 - protein, 299 aa, Homo sapiens
GGSGYSAARGVTMALALARRSLGFPHGVPSIVAERADFREGTDQRLSGGLARVSALNMRPVPVGRPPGSVTVRRLEAGGSARERRRRAPGGSVAAETARLPVSREPLMGRQSHTRWPSGLRSKKGLLVSPQRKTQQTKVSTARPEVQGESTVKNGRRLASCFRNAVRDVRHVLQNIAGVSRTCAARLCRNSWGQNSFSSLLPDADLENDPYAFHSSGMVQQFQDELISVFQIQALNAFFNFWIPDIHYFQHQFFWIGHEKSGHLEIRAHSRTTDIMNSTMISSKELPRTQGRHCSGIAS

SEQ ID NO: 1002613 - protein, 138 aa, Homo sapiens
GCTPFHFVKFVFIPLYVCRGGRGRVTGWSEGLLPWNRERRTVIAAWLLCGTVLGILWSEADTSGVTWVPSGVPCTPPSLCMCVLSPTVIENRAREHHRTTAARCSRVKPREWRADMVRVPHAVNRPHNEQRRVRASKG

SEQ ID NO: 1002614 - protein, 205 aa, Homo sapiens
MENTWESGHNYNPLEGAAHKEHTPPGRTGYEHNNGEEHTGADNTAQRDTGTRRAVEQEGAAQKRNVEQPNDERNANRQAVHNNHEVGRHRRNTTKARPHNPNRHSQQNEKLRKRNNTENGENHIKKMQQEEVEEERTKRRSNETEDTRETDTDRGERTTRTEAGTDQQTNRRTDTIDKTYRTHSGRKQHNNRREGVQPLKNGYGR

SEQ ID NO: 1002615 - protein, 121 aa, Homo sapiens
MIGVTTTEMDNEQHSITNGLPPQGTLEGHHEATPTATDTPSRRDTKGNLEQPAPEYTLSATRSATTHNQRSTKREHQPGSQHAQPGTTYSVRRSPSTSVPPGKQDEHSGGTKIQGNPTPGT

SEQ ID NO: 1002616 - protein, 148 aa, Homo sapiens
MALLILDIAKQIGADRIHKNRVGNIYNTQFPENKGAVGHTAPPPGKVALGGTHWGGRTAEIRPLYREHKGAFKAFRSQRCHSATVTQRRPPFCAHRPTVTELLACGRRGDTPRFVSQHSGQRLTEGALSVGAIRGYDSVASLPNDLIV

SEQ ID NO: 1002617 - protein, 132 aa, Homo sapiens
MLLGRLCAVGTSTAYHHVKTRGTPPLVARDTVGDSQRRTTNSAAHCDQHIARRPTEEKSEQKAGEKKHTKGGATDTKTATRVSTRHHTPRGHTSHNNVHCGRTKQASTTPPPTQKHTRFDAQACRYQLSEQT

SEQ ID NO: 1002618 - protein, 40 aa, Homo sapiens
MEGTQGDHPVVSKRGTQRCEEGENRAQGGQEKGGNKREAG

SEQ ID NO: 1002619 - protein, 393 aa, Homo sapiens
MTLRVVRVSGGFVLLLCAGCVDVLLWLCNCGHPGTPVSRYLGRMASEPRTADEQGQASVPLLTLSMAPQTLPMLFSGDPGAKRPFSHFSLWVPDLEGLRPSRRVVFKATAGEQHRTWPLNDIFLLRVTPSWNYLQTRVPCYGLPCSETLVPRLSNLGKAVMVVSSRRERLVGLARKRPPSPGLQVAKKALAPENLENFVAYQHLAQGQAWDKPLGTDGAVALVGPNCADINPYSITPGGVKKSKEKPTVYGNQQDVLVRQLIKGTLGSLAGVAQSRRNIAMGAIAHIFIFPLHNKCCLRYTHRIGHCLLFSQDTCVNTADSTLNAPCAPIQKTGLGAPKKLSHQGFHTPFRTVGGTEVSLCPLCDSNCLVANGKPLRNAAIGRSIYGGREYHG

SEQ ID NO: 1002620 - protein, 71 aa, Homo sapiens
NDDRTVKECAKETRSVCSGPSCREEAGGSDENVVNSPCYEEIGLLRTFGIVTVIIQSSGRDLSRFVTIGTR

SEQ ID NO: 1002621 - protein, 204 aa, Homo sapiens
MRFPKENNIAQTGHKLTTDIAADFTLCEKIYNFFDDTHTNRYEVNELCYAMDFTAAATGLMALPHVQNSTMDHTMHYATTLVGLDTGLVLSAYPNWQHPYLLRFTRFLIRLVTRFFLHVAHHDDCGTNLFALNGPLLPPCTTFARSGYPLTNSIPTTKATLAPVHALPTHKRYVTIDPPCKQHGYSCNTTCIMISLHYSTELII

SEQ ID NO: 1002622 - protein, 715 aa, Homo sapiens
MATSPATYYLAICRQTTVTQRASIIPGFTPRSSNAICPHSTRAATDVYSGLTAAIHHLPSAALTTRIALLLSPVVASTYPPPPRPALPFPHRPPSPFSYCSSSAPYLTLQPTLTLGRYTHPYRSVPTYTAIQTTGTIHTITLKLHLQSPLRNLSTSHLYLAYHLSINQSPTAHPTPTSVSALFCTAVNVASMFGSYVAAPTLGAPRPPTPYAFFRSPPYVYIAPRSPFGASPFSIPSPSPANSQYLPVYPVVTHSACQLLPPLLYVREHMLPPYSTYAPPITHLSPTDILHLTHTTTNHNMLQHLYSLTRFAYPPHLLILYTYPLNTPPSPTHSHHFCALNLPPLIPPTSTHLHTPTTPPLHPTHPLIITPSRLLPASITHILSTITTITTPPHLHQQHPYYHPHKPTLHTLHPPTPLASSTPSSPPPHPIILPPPPYSSPHTQSPHSSQPLTTLRPICTHTYRHHHIPPRSHYTPLPPHLLPLLPSHIHTLVHPLYTPPRSSLPTFTSPIPHSLPPSNKLLHYSSITHHLTVYIILNIALDLNLLPLPTTITSYSFVSTYYVICCLQLHSVTYARLLSSIRRVSSQCLLTPLDYTLPIPLSLPLLYDYFFSLLYAPHFFNLYALVSLRSASAASLSAVPLPHRRLSSPPLLALVYFSHSSLLVVSPPSIQPTIRYALTISSSSSPPSSSTLTTSTTLTHFHHTYHSYPPTLSPI

SEQ ID NO: 1002623 - protein, 279 aa, Homo sapiens
ALVLRALATVGVASWPWGLGRASDLLQGLRPCVCWLSCARRTWSVPSMWHPAVVRLKNVCPDCAMHFANLRRCNPAACAQGDHCRTAPVMQDWSAHRCLVMRCMAPDPSVLSKPMCSAGRFLPDDVDGRWSILRSLNNDIGMSQRSFEWRSECASWHPRQAGRCVSLYLYTLGTTQPAQSAGYCDVTMHLRGTPLGSVCGLVPYVPAGPWVTGGTLKVRSCVRWKPGPGETVRPQEPSAVVEGPQCWSCGLGLSIAKQGHPRFAGGAVPLVTVVGSRDL

SEQ ID NO: 1002624 - protein, 372 aa, Homo sapiens
MAPVQRRATTKLPLGLNNIYVPVRAELKLVRELNDNRDARAQDGSLAMGTRDKVVRQEESGQVCCEPDPRKACARSPAKGNLMVAMCPRVSLLARGPRGRPVEHGIGAVGFEKAYEKWRLQRVDREGGPLMKPDQDSTADTLRADVYSSTSGPIGVPDARTLAMGTTAVRYASAERLVAPWTQVKEDFHFRASPIIELRKSGDDDRSRAASTASNSQRKDGLQRCQQSGHHSSTTWVTVEATVPRYWSARTQLLITQIPVTRQSRRAPRPHPGELVSLQEQRATYIAARHFGSFTRGIGPLSHWSRALTKRTLLRSYSVEEYPRPKVYSPTVYPLSEPTMVHLRKKESTADPARAENYKQNNKIDGRLGKAA

SEQ ID NO: 1002625 - protein, 268 aa, Homo sapiens
HREYDSDYVMRPTTPRSMYAGHPCRAVPSTSSEHSTGIVIEYQGDGVNQAVPILGRLLPRPQAILRLDLGLDGDLMQTITCTIFTVARVHASNSTVANGNVIDATIDREKAVLRYRSLSYSNMTLGPTDRSSLSTRGAPSLLSLSDGSGYQSAIWCQLSGFHVSVKCSCYQAIPVPGYGRLDLQSTDNSRFNFQTLKVDSGHSDNMNLVYDQQRVLSKTAHYHGSPGIRRLGNCRKSDDHRACAPQHQCKIQDHRTHQSAKVLGGGSV

SEQ ID NO: 1002626 - protein, 291 aa, Homo sapiens
RATFPALRAGGEGQRRNGVLASSGPYLTHQSKGVAGFISGRYCHLESWCVHDQTTYRYFACYDESPVGEEHNEVKKDMAEEAPMLLKEADERILGNVSQSTRAYIFPRDFSLGARSLVRRYDSRTRLPELVREDDVASIREKANCKSLDWIVYAQMHEEPRSGEKTCGEGEHGWGHTHDALCNARLRTRRETPPTRGWLRSIVAMPFSATLSHGYKGNAENVCPAPSLDADVNSSPARTPGPPGHEGGDRQVVQHRWKNAGSTCYVLLRMDLWQHAWNINILGSTTEPLTA

SEQ ID NO: 1002627 - protein, 132 aa, Homo sapiens
GPNEVVEVAKRGGDRWPFWWLLCLPQSAKALRPSQDFQHARGRRDGAGSSSESNRDEERLRQRPETIEHQQGPVLSNCKREKTATRGGSRMKVQTLPDIQTEGHWPYAGEESTRPTWPGEQQEAGGPCPARA

SEQ ID NO: 1002628 - protein, 116 aa, Homo sapiens
MGKTRAPHEWWGNHPTVSNTSPAEALEGGCGEGTKRERAPSYDHEGTLYIYLLALTALSALALSPTYTRWHPDSGRLTRGGDTAGGANKQRRGGSPEKKNGRRAPPPYISRTQRHV

SEQ ID NO: 1002629 - protein, 209 aa, Homo sapiens
MSHVDLGHLKGDKLARVVGNDPGHERSMPLPRSLGAARMSGLSGQAEAHLRFQGVHCLLRLTLAHESDRENRASPEARAEPNFARVRSMTNRSSPSPASLSLALTTYTRLDDEYDGRKTCTQDACCFSQRGIARGQPLGVFVVALGGSFAYPSFCLFRICLGHPCTLNIRSPRLGVAGGPHEECCPPGSFVYLGDPWVPVVVLYPIPRV

SEQ ID NO: 1002630 - protein, 151 aa, Homo sapiens
MWSTDTLGMAPASAVRNLLACPPGIIPHPGEASATELTRRSMELHSPCDEGAEGCCDATAKRQTTCGVRGHLAPSGPVARVGSHPGTFLSHASSTHIGGIFLYPSIEVPSALTIFRRASMAQRPLSYDLGLTGRSDKCRGLGFAGLQFGGV

SEQ ID NO: 1002631 - protein, 168 aa, Homo sapiens
MPRYTHSTIHIMDIVTTPMTNSIVIIARHDHVVTHDHHHDQTELVTRDRTHTTQQYPAQEPSPRDNIQRGGNSRETKRVNRQGEEHKDKKQKADKEPKMGQDKGQETTKKDRRRTNAQKQEGKKNRPTRQTTNRQNQENEEKQQSRQTQPEKMRGKGKDGKDKKGEKR

SEQ ID NO: 1002632 - protein, 112 aa, Homo sapiens
MGGDYHKEASWDTEKTRLRTLRGSDPKMVVRTNQPRPPRAYTHWGCYKEGPRGAPVGVGGLPATSGHNNTASPPRWEGSPLKVERRRQKRLFQKNNDCCGRLNNPLVVWLFS

SEQ ID NO: 1002633 - protein, 258 aa, Homo sapiens
MSSSEEKSTPYHACRRQEYGPTNRKFRPVPTDPRFNKMEEHAFLAKVVYRVEMVTTVLSLEIICCLNDDINGTALNRFESPRDYTPKRSSDYTVSRFSPEATSCTKFITAIGWDPEKLESTVCNVAICFHVLNIPQDSAARIASMRRMFKTLLRIRLLTAELERSTVPVESHVVRIGPHNMCQYQRRTMGPNSGCLIRACYPFGVFLRMKSQPLRHVKLCCRQNGTVVSEIRPRLTPDLEWVPNWLLKVWSRKLVNRA

SEQ ID NO: 1002634 - protein, 155 aa, Homo sapiens
MWRTAYCGTRRKHFRQEHTIIAFRVNPFFPRIFPTETGYRRLEAANIYSPLTQGLMETLREGSLSRGVELSQGALFFNIPQDILSMSRAHISTCAPGVCVREKPRGEKATFVRPLCARPACEGHPGRDLCGRVNARCSPCGCQRREVFIGAPVAP

SEQ ID NO: 1002635 - protein, 362 aa, Homo sapiens
MVHRSWAMLPTKLFRYCLYHLLKVQPVGSAGRLNDAGQFWYGTRRDVCALRIHNSDGSPGLLLTRIPGRGSRHWVAPNLSMEVASQGRSLLTTTQPNRIGTFIWMQGKGMTKKAGPLPCLSRPLWPVPLQTIAQEFVLGAKNALGGNAQVKGDAKPIIGAFRGPSPLRPPLALVWGGLGPGPMADLGALGTRGGLSNRLGFGESPGILLEAWGLAACPPGHFAGSAGTEKVQPNFSFQWTVGQEKGPFFTSSKLLDPLVASLAWGRQAKAAWWFSPQGPCIFGRNKPQAMTGPARSYAVFPRWFLEVGGVPQGILVCTRDSEEPWEGTGEDKSGHQELEAVCREVVAPSRWIALETGCADWA

SEQ ID NO: 1002636 - protein, 98 aa, Homo sapiens
AEASWCRHGASPRAVVIGIVKKQAEPKSRFCRGVPDATDSHFMNLVAGDRGRHCGMQVFLPVVLRAINGMSCSEVVQCSLLPAAQALARMARKCWWPK

SEQ ID NO: 1002637 - protein, 139 aa, Homo sapiens
ASMCRSSMRRPRIMPRFIEWWLVALHQASYATALVIEVGHPCVVEDAGKYLLLKTCVPDPTELRLAQDTGYIEQIPWWRQMVVLLGGKAQALLSSRGLPVHQAQPPLENPIPARGPMDGRNSTERIPEYDQIPEEYVIT

SEQ ID NO: 1002638 - protein, 120 aa, Homo sapiens
MPRGRMCRRASKLVLLKLGQLAEKWVQAKGEKSMSLAFSCQCKIWRGAGPEGVVVKAPFLLSGGLGDKLEYLQKYMKRSVVRMVRLPPGYQYTDSMPAWLDFGILLFSTDVFIFSHLRLT

SEQ ID NO: 1002639 - protein, 200 aa, Homo sapiens
SLTWLNGWGGENKAWGLKNSWSYSYKRGNGVKRLKTTLSSPILPFLVDEAGQGPAPCCWGLGREGSQSLEKVTVSSPCVLSRGLDRFHEVWGLQHCSVSQDATVSLRLSATDWSRELQRVDLGALHRHGASCVETLGRQRYGSIQLDLFVWEPPVDQPIAQGLVSHHLAGGEGQLVDQALVPDDLGQALQCPYIGSQTQV

SEQ ID NO: 1002640 - protein, 155 aa, Homo sapiens
MATCRSKSRLLTAVCCVRRAAAVLSDREPQHEELPWPGQPVAAMIGKLCWDVGENCPLLWPGDKLVPCGRMHWYNACGDGNTVHGMCGPCDIQTHVPMALRSSKCTHIVSTMRLKLADHQERDMRGQAQALLCVRSTDRTDYGHRRLCQELVVRS

SEQ ID NO: 1002641 - protein, 112 aa, Homo sapiens
GSTRVQLVSYFDTSELDLPVNECGHWTQAQTRYVPYGDSEFIKCNHVTLDETLPGPNIVCEDLSIEYTIVGVGGQNRREARNLHSRSRRLVRWLGDLLASSNSVDLLTAIVS

SEQ ID NO: 1002642 - protein, 118 aa, Homo sapiens
WRRLGGLSLATSPPRTWTAIGSDVWRIAKKGQVGGSLLAVVRTLQENLKKIMQAFQKGISGFCPAVLWVFTPVQGTSKQKSKDSVTKLKDADVAFGPFNLRNFTKDRVVEANLESVGA

SEQ ID NO: 1002643 - protein, 121 aa, Homo sapiens
MSESNFRYREESGRKSVKRSQGGIEPEAKIPNKSDQGDGLARCVLRPFFVRDRHKKTSRAPYVERRERQQEEFAKAMKHKLGVGRYIRVGGLSIWEGKGCAKERFVTKGFATRLIGLKYYG

SEQ ID NO: 1002644 - protein, 78 aa, Homo sapiens
DKSTNPFFTKRINCTLEKKGASSFPSKALMCPFSQRGEASRGKQERNPEGLQPEAWNLRTKRCDSGVSGKAFDLCQNI

SEQ ID NO: 1002645 - protein, 115 aa, Homo sapiens
WKNVSLLSPRLECNDLSLLQPPPPRFKRFSGLSLQKLGLRAHCHQFRGIILVFYSRQRGFRQCLARRGLDSSCNLSVIVPTFGLPKVLRIIDRSHRSPNPLLTFSKSSSPFSHLS

SEQ ID NO: 1002646 - protein, 427 aa, Homo sapiens
AHSLSGTRDLRTRFVRDMLALRPPKLAYAHVTDYDMHFSHYHRYEPKLSVPSTRGCPCVRSSSLGVGTPAVRAPDVLTYSPTLHKGTTLRVAAIIDVRLSSNLIYQVNVQERLGIKTTVHAFGDLWYVCLDTSLRINSVSKSMFAYGYVYTSTLCDPDAGGIVCGFSTHVDMLRLQYLTQGAIMGTENLPSDSKVKAGSGHPSKAWQGINQSAIVEGQYGGRRIPKLSETAVWGRFDWSTSCHIFPRRKLTFRVYENPKGYDLGPGRYAIIRSGEPFIRGGVCNNSHKTKAVMMRAWAELCDPPFVGFTIEAEYSDGNSSPVVLYLIGMENQDSFPLQDSLADCAIRCGDDGNKFFRSPAFRREVGRAPKCYTTPPEGGETPTPIDESSIRAELKGGSGCSSRIRKAPRLHRRGVTLMRPFENPERV

SEQ ID NO: 1002647 - protein, 112 aa, Homo sapiens
YAKDWSMVASDMMVSMNTFFSCHKEFHDKFHLYSFLRSPMRAKNWQLCIVSKSFITATSVDGSIYSANFAGGYALRLIPWDLPLLIQMLSCGTLSVYSDDLLLERRKCLAVE

SEQ ID NO: 1002648 - protein, 134 aa, Homo sapiens
AISSPCPLRESEIIDFFLGASLKDEDFMKISASCRSRPVPDQTTTEVQGHLLAIRRYYNGHVRSGRDLRCSKGGGPTSSDPCGAHQSMDQSSLIVPVSAEADWWENNDSSRVPTAVTLQKVDKSLRRQSSGCIG

SEQ ID NO: 1002649 - protein, 110 aa, Homo sapiens
ADDSVPPLICVPSPSDETQTVGLDGNEDHLGGLDTDHRFTSGRSLCALLHLRAEHRVLAMKKSCSLTRVDRLNCCAYWEADAQAKDGCTTSDPAQLRLHYECALCAMLYA

SEQ ID NO: 1002650 - protein, 89 aa, Homo sapiens
MKCRVHTGGYHNRESIAYGGTTSPVCKPRGSRNDNKRRTGVITGKAPWAQNRGSPPWGPGANVVGGGPSRGPPKKTRRHSGSKLGTKDE

SEQ ID NO: 1002651 - protein, 54 aa, Homo sapiens
ALPEAGVSSPPTAEHPVPEAAGSATVIAGLLKARWDQGAEAALAAYVAGKFRTI

SEQ ID NO: 1002652 - protein, 189 aa, Homo sapiens
HGSNLQTACCGTRLCNRETQSWKTWGKYTMVLSTREIFEATFIIVKRCVRDGICELCTIVSPRVRPGFFMLRIGEYPYGMSYCLDLAVTTHRSSHDSGLRTIAHTHLSWVERRDEMTDMTGEPDATQMTGTRTARRHGMMYQAQGNTSDQGTSNPTPLIGSYRQNTEKSSLYASYRDSTFTGAVEARGR

SEQ ID NO: 1002653 - protein, 108 aa, Homo sapiens
MNAVGQDTWSQLVGHRLGLDSSVAPPAFVNVLLTHKPVEITIVRGGSPLYVFGGTKLFSTWPARKGARRIEPGSSKKRHIPPKEPGARRRIAQHDTCSSMEWKPNSGM

SEQ ID NO: 1002654 - protein, 135 aa, Homo sapiens
TRQSWCRDGVSVSLPKCRGRHWTDEGEQGYGSSELAVRGELQCHDSTRASDFTVLVAAHLRAPHYIVANHVSRINVKDRHSLACSGCVLVDGRRPESSRPDGYLGYSLGPRTQRHKIHIGVGVQDESAVRACQSR

SEQ ID NO: 1002655 - protein, 140 aa, Homo sapiens
RFRKWVSSPPNRMLLCLKLSGVCYGTVGVLHEIPAWAKGWAVCRYGMASQCHYSNAIDDGVTRGFMGKGTRRRLVKKADRLWGVIARGTAAWHAAWSRRNRESDARKSMRGLQNPLIGHDPSKFPYDDPTYDKLSWKTLD

SEQ ID NO: 1002656 - protein, 109 aa, Homo sapiens
MSLPLVAVSIYVGLVVPLAPFSARHKTTVWKFGRTEHLDRKSHQEGLAPLVEREGKRALCERAFAPETSFYGSTSEQQPLLHYELSRKCSGTRLKSGVRHNKPAVASFV

SEQ ID NO: 1002657 - protein, 157 aa, Homo sapiens
MGSHRKAPHTTGLPSVPGDPVDTSAPSRSDDVYDSEIKEAYHVGRSFWHSLERDSLEGSICRVWVDTKERIDAVPTCSDVGCWIGRSSRCSYDLGVEGDALHAEVTRTNHVRNEEHSHFDTSLGTNPYLVGTVSSIAVQRGHPERSHCPGQSKRYRT

SEQ ID NO: 1002658 - protein, 199 aa, Homo sapiens
MRGDHCGIKRAPPQEGAGKTFCRAQPPGNAAPHSSLTWPHRRRPTRRKEPLPDQRHHKTRVDLHSEGPNNHTPHHGGSPRARHHQQKAGAPQPTLPCGSCHDPENNQSCAHSSTNNNIHSIRFVAIIYLLSFCHNTQHCAVISPHQHTLRIILILNTHQHILLDQHPATSPILFECLIGPHHHHYKIIYQLNVDFVYLP

SEQ ID NO: 1002659 - protein, 270 aa, Homo sapiens
RCLSPSAREMALRPEGASPAVPGTLRSPGLSASVGRKQLGPLIFAGWPNGISYSSLDYTGTWSSSISSTSDSFPSGAVASFWPLGLRVKIGHMRAGKNHMPLMVFHKSPGSRLTMQYSRVLQESNVLYQSTMLSNEVKQFLQSKDLEDSQWMIARIVARMPVGRITAFLHDLHATVGPENGGPGQTAHQSAVVTEKQQMLEQHLQDVRKRVQDLEQKHESGRESPGMTFDFNYQNPQESGDIARSELENNHVSDQAEDAQVEQMLLALDL

SEQ ID NO: 1002660 - protein, 150 aa, Homo sapiens
KKTRGPRGGGTPPGGGQASLSLLFLCVIILFLSGVAPQEGGGGGGGSSHYCSPADGGRGVLSLTIMRFCCSSERERGVFLHKIIQRRISLYNFRAAREKKRRESERVPPKRERREECVSNEWGVMVLTTHARGMHTSEYKQGEELSFRAR

SEQ ID NO: 1002661 - protein, 157 aa, Homo sapiens
MPSKGPLQSVQVFGRRRQRQLLAHRANSGMVSSKVNGRPLEMIDPCMLQYKLRGSSVCFSARSDFAGVHIRCFRVMGGVSRGPDLCYPSGPSPRARGWPYYQKICGYEAFHTKEIKDILVQYDRTLVVRCPSSLRVQPSLEALVPALVSRNPTDSPS

SEQ ID NO: 1002662 - protein, 495 aa, Homo sapiens
GQVCSPGGQIPTRCPHHAVTRNPQDSSSGPTLYLWNLPCAVQGPQSMEAPWRVRTDGASRVNVCHESVGKALVLLHSKGDVVSCADLDGALAPGFILTACVSFLVPVMGPQGGPLPTMPLWSQALTSRGEAEYQVRRTKANDFAKILQTPGESGERSVALAKGEGDHTWVTCTRLIGGPPFEHTELGMIVMLGTCVHSVGAIRPNRPMRMSRIECLGAPNPDNPHEVGEKGSESAWGIMGGASLAHDAEQMCPHAKCVEPRVSSCFGLVLISVRGKARFIPMRHLKTVRVTRHEGMFHHIPLGVWTVSERNPRRRCHRSKGGASMRAHSAPRAVPEFEHVLTCLRSVGARLTSGYPSLCLLATVLASLGFCVTLGPSQSTFTQVPAICPRVWQNQVYQGPFHHLPLIPPIGAREDTPSRGAVIGRIEPHPLVVVPQEKYTQGGNVKQNTKIGPKKRPRGVFHMARQKDKEDNRHRGRVGRNRVCKTPQQSSSQDR

SEQ ID NO: 1002663 - protein, 41 aa, Homo sapiens
MENPQSNSNTIFPGGFTIPTPSFAPKGPSQGRRDPQKHKAQ

SEQ ID NO: 1002664 - protein, 261 aa, Homo sapiens
MNPDDHNMPLAGQEQMALRLHERRKSHAVRDIERVCIPWSRSRRASMLVDAGLAMGAMESKRSSVILICRRWHSGKGIFATSANGTHDARVQNGQRQNLQGCLESLVRPGRVMSSDSVTTAARGKVGPAPRGLKTGGSAPAGKNQIFRLRTGASQRVASRGCCGEETRGGTPGRTPHKGGTAPPGREAGCWAKKGPGPPGEPKNWKGKKGPPAKLFPPNQKGVVAPRGDYSLGTQAQLLGLSKAPGPPSPGPSLVTQGGTP

SEQ ID NO: 1002665 - protein, 251 aa, Homo sapiens
PGVGERGPPRNPKGPPWAPRTLRSDSDKLTFSGHGGDLEFGGDLEARVGSSRFRLWTSRTPRCRRSARLSLGALGVIRSECPRTRPAFSGVALGAQGPRPGFLGLPGIAQALRVKMRVTPGMDVSPWRWRAVGVKQCAPVTEGGATVSPRVPCMVLVVDELDMAGDPGTCMEAHRAPVGRTWERAGASMHVARRALDRTVALRPGGAPLSCVGNGCHGARMGHEVALLRCPVWDLIAGDSWSCRVCAGVSR

SEQ ID NO: 1002666 - protein, 113 aa, Homo sapiens
MAYEKDTGEGIPQGVNRLHRQKRPVRNGGTETQRITDRWGETFRWEHLVCTSREQELPCTSERMGAPPQGDVSHSKWGGQFSIGTGRRLGLQVRTPPTSIGGGQFRTNKGIGT

SEQ ID NO: 1002667 - protein, 103 aa, Homo sapiens
MDTQHVQTSCRARAWDPSGDWSISLRAENKNAKIVERSGILSSETTVSCQNGTGICGGLCHMMRYSDRQGRLLADLNLHLRPTLSFANLRDPPRHLRPTADLQ

SEQ ID NO: 1002668 - protein, 382 aa, Homo sapiens
GPADKYADPVSAQHAKLSLGRVQTTSTNACCTLRIRLFLRLTLGPQRHSTTSDKETCDYHTAQDHVAFRGAHAELARVVAYGPLDREAVQVQHCVLISSRHSRLVDQVNVWIFRLRNALLTQISIRSRRHETALSPVVPANLFRIDDWLLVVHPHFGNNEPIGDEAVIVAGIDGGKRRGVLEIPSRSPPWGPLAPRDGCTGGTIYLASVSRMAPSQESSKRPKKDRMSHSPTNDVPFFLIPYGLERVLSGVDPVSIGRRADRNLLIPITKPEDTVRLKLPKIGWNLWNQRPASLMPKEANHIETGATESLATEGTGPIRCKSNAILREATRDTVACVGPDARGQGTETRGRLDTKEPNEATSSALAHGVKRRAGASKNLSQN

SEQ ID NO: 1002669 - protein, 78 aa, Homo sapiens
MGRKQPVIALVPTTRQKACSRCGGGIAGNSGSAVPRGPLGTPNPVMFRDYSNVGGTQEAGASIHLKDPSPETHHGACM

SEQ ID NO: 1002670 - protein, 96 aa, Homo sapiens
TLRIGRATDTLPASIPHVIARRHKQLMGSPYTRTVGSYREVTKINQKVLNKDKNGLITWCDHSKYGLKQMSNGTRRIPVSPEQARILQSARCDLQF

SEQ ID NO: 1002671 - protein, 137 aa, Homo sapiens
MNPVLADDRQFIIKAVVSIRLSRVHAGKTTSMGGQLQLGERVTIVLGAIYSFGKRSLVLIRATEEVSAGSLCVKTDPPVRSYLVPCACEHHRITHCRPITAARVTSPLTIAFVYSVRFRAPFFDTGESAYIKVDYNA

SEQ ID NO: 1002672 - protein, 170 aa, Homo sapiens
EPKEPAPETADGPYLVIVEQPKQRGFRFDMAVKAPPMEDCRCSSEKGRKTIPLIKICNYEGPAKDLTVDLGNNEQVDPNLVLMPHSLGGQAMLGAWGSCAGFLWGPKGTWLPNLTNLGVLAMLTKEEHDGDYDTKTSEAAVRSRPQDLTEAETGELEQEAKELKKVMDLR

SEQ ID NO: 1002673 - protein, 74 aa, Homo sapiens
SRELQSAQVVALNTVPRGNKTVKANYVTMSGCRERGTAVDVDDAALLKLCDEPVNCVTCETLGCWCVVCVPDVV

SEQ ID NO: 1002674 - protein, 446 aa, Homo sapiens
MGGIQNEKETMQSLIRPPGLLAGLSEEAWRPRNRRSWRAKLRGRLHWYQEGTPDGHYVGFGSHSLFQSSTSVWYLAVRLITHSGENYVWASKCTAVVSCHVLTICPLIVVLTSDIVMTVRQAIVDGDLGSLMPAWILCDEAESTPMGSSRALGVNIELSNREVISNRTLRGVGGNEEESEGVVKRGGKRCSVALQTKENRAEQEGKVEQGPYRARKNCPKLVGLDPVRRDQDCHRKISSDPSAQTEIHLSTEQYPVSPKIIEQKAWALRNDNPVGTVMPYGPMCHLVFFKAEGILGRDGGQPTKSGYNDDQSGVRCIAGVLENSLWRQKDRNRLQTMEGFERRRVTRIRKGYPLRKGSHEDPVHHSQFDEHNFFEQGDPKTFGEGKPWTFETGATLGERPRASNSTRFQQDILERHTDVQTTGKFPFSFAQPFWNVQQKDLWGNKE

SEQ ID NO: 1002675 - protein, 336 aa, Homo sapiens
MHFLQVCICPTIASNSNTQQAQGQLCSNVALFYQLAQGINQRQVAEAIEITYIPSSHSQHYISWTTRNRKLCTVMVIDRPWKSINAQKGKVLIGIDTHVRRHQGTESDQTYIGKYTRHAMYDMAHNGSKEPMQIQDRISRRARDRNIVIDATEDNKTRTSKQNKADVERTCDTGRSKTRTDMNAPSTRRHKHNTGNKTTHVDTPNAEPHKTNNATKTKQTNTTQQTTQENRKKKNKEHTTAAQAENTTERRRGRAEEKAEKTNQQDKERRDEHNKRQPDTRQPTARQIDEHNRRDTPRRRTATHLEAGSRKQREAQPEAGTKRAHNEQKKQSNHWQ

SEQ ID NO: 1002676 - protein, 320 aa, Homo sapiens
ADAEASSPAPDRRRCCLCSCSRGLLPTRLASGNRTRVSSGVPDPAYSRNHEPLTCARCGKIVYPTEQGERVVDKFWHNSMHSIARPARCTLQHDKNYKGYEKKPYMQLQTTPKQSFTMVADTPGKPFDSSKQSELQSQVRYKEEYEKNKGKGFSVWQTRPELQRITKTQEQISNITYHEEYEKNRKWAHRRRAKGNGARKTDRRITKSRPAANRQGHNEHTQHDSTQSHRHRRPRKNQEQGPRQKGRRGTKYLLGTKTKEALQGTKDTYHHQPAKTPQREQEGKKGRPEHGSQWTYTRDKTKNTQKTQPDKDQRDNNDHT

SEQ ID NO: 1002677 - protein, 137 aa, Homo sapiens
MSACGGPRHGASGCNAGDRLSSIMKRVAVHPMVVPGTRQSMNQPFKLLDGGFEQKGCLRQTVCQRALPKDLVMCPFKQGMDAKKQRGWRPIGAIPTERRPHLGRTLVITVSLSTVGAKTQANGETFKTNWVIGPTIE

SEQ ID NO: 1002678 - protein, 134 aa, Homo sapiens
MCTPASLCVTLGPGFSTRATTSWEKGADKCEWHKLLKGPLWGGHTNIQQHWVWWNTAGVLENGWGHMGAKHFEHFFGGQPTSPHGSPTQGQDKAIDTSPPVAGTGLPIFTAISVGGRMGPHKDKGHMGVKSLVA

SEQ ID NO: 1002679 - protein, 170 aa, Homo sapiens
AGVMTKDADPRLRPRWKVILTYLVGAAILWLLCSHRKENRKEPTNQQSKTNRKRLETGSKTYCIQRNYKRKRNKQKGNRMTIRHKKRKKTKTRTHRSKNTKKETKNKEKGNKGKTEQPENKEIQRKHKEDKIKNRTKRHKEKTDTHNNKKQRNTGSKKTEKRKAKRSKET

SEQ ID NO: 1002680 - protein, 103 aa, Homo sapiens
MNNGSGSKRLCPSGERAESQLELYWTWDLLALVVTIEAGYRMGPRRQRTKAPALNPCRGTIEECDGTGVGRVIALPLIANSEDATKRGLLQLEQLDLCEEESL

SEQ ID NO: 1002681 - protein, 357 aa, Homo sapiens
MSAMRLGSLETSSMNMVMTLHGFDLSVRCLMSRSRPQDGTKDWTINECVGQEKHSMGLELELIDTLTDSGTRLVQVETSSLSEEHFSSMRPWRAPLVHTSLSNGGHYTHCPLTHFMRLVVYSLLRRFRGIVIGPSHYIVNAGRPLSPPERPDLKLARRVPICTHESDYRHDAAGMGGKAIVHTANGVASGCGDFCGGGSLATGRWRAKAVAGSKVKVEDNDVGTSGGLRKVLRNSIGLWPPGGRYNAANQRLFPVVALTKGKEFGAMGVGWDTVETFIVVDRPKGLGQWPVHRVSLNGLEIPGSVDSAKEWPSAKHTQGTSSCGGRNLLGDKTKTDRMEHAKSVGRILDAAGARKGT

SEQ ID NO: 1002682 - protein, 58 aa, Homo sapiens
PGSVIAPCRHHPRAQNQRGAHALPRALLIIGRHPMMAQLCCPLALSSQPNAPVIPLHP

SEQ ID NO: 1002683 - protein, 309 aa, Homo sapiens
VASRATSLRHHGGTVKVGVNGLGRMWCAMVTSLLVTLCKVAICWPLNDPLLIDLETTWLEHVSQSMIPHAWSNAMGYRVKAVEREACHQHGNPISDLSRSEIPPKVTWGDAGSMRYDRWEIHLDVVSADTVEERLGSITLLQGRVMPKHGSTQYCEPRAALSDPPVYRVTWGGRKPMEVTVMEQTTRLQRHYDTRRELPRSPGRTPRTMCTMRTLPPSGDEGIEPSGAEPLRVNTVCANGNLQLDTQQVTNCTSFHSWAKDTKEHGTSAWEIGAQRLHLVRKQMSVDGEYELWDTTAAVQDTIPKQKTT

SEQ ID NO: 1002684 - protein, 164 aa, Homo sapiens
GRAAVGAAELHGGTRRRGTMKKKKEGVLLFPSIKDHSLECPDVAPLNAWQQWHRVWRPSLVSGPGPPVERRFNRARAADVGVIASSFDDGNLALILFVMLLRGHSGHSACACSGCWRHRSMSSCGGACIVRLLARMLRMNHNKGFESKTGLTLERGCGAGRIPD

SEQ ID NO: 1002685 - protein, 175 aa, Homo sapiens
LSRRLKHFPRGAAVATTCRDITQADPVPEPVSRGARGGVRSWCPWQGREPLPQLPEMPEPSLGESHRGTCTYSAKPQSEDQAVSCCPPYILPELPLRVLIVSKQTSWEPCPLTSGTLGSLRQLEVEQQRAPVPALGDVCGLSSLRELKCPEEASLSTLPEELGELPTESGWISPL

SEQ ID NO: 1002686 - protein, 104 aa, Homo sapiens
EPDEGGAEQAGDRQPELGLGEIALLHLQHGEAMVMEENSSIDVFDRHDRQVERWSLGEGPGRSELRPSTGVGGRTGPRSMRQSAHHGMIREVRAIVLPFRVMLS

SEQ ID NO: 1002687 - protein, 284 aa, Homo sapiens
GASGPEFGGWVWTPTQTRRPPCPRGGRDQKRIVDLPRPVAQSSCVSLGPQRLGLQTSGVSAYQLPIRAVLRGRGEASTWVWQSASLGSNGAARLVWALDARGILTYTGLDSMTRSGFPASWLSAGYGLHVPGPEVLRSTPTGTRAPRLRSPFARRLLDSPWEEPVTAQSEDQIKPGRTHGGKSRSEVPGSSFIVEGPAMVFARNSRESREGSRGLQGRDGGCGGAWSRFFAPRRGTYLPPEPTGPLLPVRGTAGVVERRACARLTTPRVVGGLRLGGVSRHEGT

SEQ ID NO: 1002688 - protein, 233 aa, Homo sapiens
MVPRHVPPQMLNIPQTSLQAKPCGLHRMPSARVAARGSMGPTRDSLSEPAPLTLDTSGKNLTEQYSYSILVLSAMGKSHSRLYERSSPINPAQSGSPNHVDSAYFPGSSTSSSSDDEEGSGGCDKAYQAGTRLAGDDRLVNATQRPQARGDPGDQCKGRRLCPLPLQRTPTSRGLWEARWALSSQSRASCRCPPWNHMDISMSSPCPPDRTCGAERWSEHRHKKGLMYPYIFH

SEQ ID NO: 1002689 - protein, 110 aa, Homo sapiens
GLEHRVLILDGSYDKVRVPRPLPSYKGSTWQSVRRGNPVLGGGTDVCGQGLPSSEVSLSSSGALAGGWLLGPGGLNSLGGHGGAMMCPPPCWLVRQHCGWSITPGRNEPS

SEQ ID NO: 1002690 - protein, 407 aa, Homo sapiens
GVAETVWWSEAGRAGSRLVPSPSPGASVTPGPQTVQGMGKGPWWTTSRDLVPSLLQYLVSGGSVLGQQCTTLFTLKLIGVVRATANDPRYKSTSKEVSLLLPTGKERGRSGVHRARTGGAAMSGMSWHSDPLVAQSVAVSSGLVDAVGPTVVPDVPVASPVNGCNLEACGNCRSCEVGAHGVFKGAGATDMVHVVIGLAAEGESVRRARSLADIVDVVRRYFPLIASENDEPNAWKIDSVPARVDSRSFRALRTPCGPPFLRGVTHAQLGPLCPTVGSIGAKFNCAHKQVGVRVAQYGESRKRTPFILRKGHERCPILSNLGDLHGFNQCAAFAQKGVSRPWFPSKQIAQRATPMLCVFGGNTHERALTGVFITTGLGGQFYTAQSVSSHGLRDRPERSLEEWARSQ

SEQ ID NO: 1002691 - protein, 318 aa, Homo sapiens
TLARSESQWSYQEASWGPGESRELLAVAASVWSVAFSSLVTCVGLDVMRGWEVRLRCLRACVAQPLRRASRVCPSTVCLRRLRRLYHDMAQLPRQKALSLVNAVSRWGVFLVTCLLDLLPDYLAAIYEALAGLQRERLQFPSCKEFDPGHGLLPGPGDGRRSHWLTRKQLRAVTSGRKATGICWEHVNGGARYALVDDWGQGIPRGWVVAAEIISSQLLTCLVYCVFSLGLSDSGVRGAGGRAAARPGFGPLDAVAWLLLVHKGIPGCQPCHLRLVAEPPLGAQGGGLVVGILFSCMTLWASGWVQVWQSRQGLLTVG

SEQ ID NO: 1002692 - protein, 111 aa, Homo sapiens
MWGWLAICKCAGFSVCFSCTPLWLLKTFILLQNHAGLAKGWGRWEDRPQRGSQENAPANKTCLVGQLPRDGATAASASWSAAPPVLRGDLAPFLTSVLRALFPASSSPLLA

SEQ ID NO: 1002693 - protein, 166 aa, Homo sapiens
MSSEGSVIDQVTVKTPESFLSKWKEGKQRDRSYSNLRLLSLWLCGHLPSFLVPPRKPSSPSKASPASVPPNSVRRPSSYHHLRPPKPPRASTRTPEATFTLRFGPSPRVTLFPSISPVFPGPPLAALGILLTVEVYKTKPFGRTQFPGSVTILCPETEPSNDSLKA

SEQ ID NO: 1002694 - protein, 66 aa, Homo sapiens
MKGTEPQFLPLLQLTVAPEEQRRELEDTKDHPYGGGKGELSTSVTTAPGKMSSGNGELATPPPTTL

SEQ ID NO: 1002695 - protein, 103 aa, Homo sapiens
WGGGEKGRRKPWAGNPKKGVGPLFPPPRGISIFRNCRNLQEKQPFIPGAGCSPPAFITARPPLPSLGVLPRRRENTLPHLWCAHAKTAIYHHYVATGEKYVAS

SEQ ID NO: 1002696 - protein, 108 aa, Homo sapiens
ANSSWYRRRTVEPEREPAVKLRLGVERRIVGRAIDCCLSQQHAEDVVISEDQLIFSEEEDTSSARSDGEEAEETKSRLDVQRAVRNDTKSLAGQNAWQAGHTEGSEIS

SEQ ID NO: 1002697 - protein, 176 aa, Homo sapiens
LCGVVFAQHLIMALWEVPFLSLTAFYPRPWSPGGTSGTGGAGLLWALSYLCLTQAGSPLSRPCCPCWDIPCALAAGQLIAMWRHISLECPRTPGEGETERHGERTYRRNDAVHKRTRGPWQSRMLKGIHDLSDNYVPCRGEIAWYDGAVTEGLVVVGLINVNHPMGILVGSYHLAP

SEQ ID NO: 1002698 - protein, 125 aa, Homo sapiens
GANPASGTHRSRLSGPQADSPARPGARCDSRGCGPGSIGLILMWMIAVVRMPDFPGIWLQVGGGGRDSLLDSGRDLTSVSRPHRKDAASRRGDPMSHGCALWVQHWEHCGACLTGSLKGPGPLKS

SEQ ID NO: 1002699 - protein, 166 aa, Homo sapiens
MQCCETRRACDGLDNVISVNNGVLYLYIMDPYKVSYGVEDPEYALSILSLATNETYRDTPASSENSLVAPKVIPRQARRSLNASIVDAYQTKLLTAWVIRCLRYAASRISIGVTPGIEEESMQMHVARHERRKAGQSARSLKGPRKVGINVGRSEETGQTPGLSKR

SEQ ID NO: 1002700 - protein, 108 aa, Homo sapiens
MTTTHGSRENPTLSPTTDDVYNKTRIFPHLYEAQTTCSTRTCAYRHIATTLVTIYPPTGGLLHTCHHFFANYAPRIPPQKNSFSLQRLLLTPIHTPHVVAQLLSPQES

SEQ ID NO: 1002701 - protein, 213 aa, Homo sapiens
QSSGKNLFYLPHGLSIDKDGNYWVTDVALHQVFKLDPNNKEGPVLILGRSMQPGSDQNHFCQPTDVAVDPGTGAIYVSDGYCNSRIVQFSPSGKFITQWGEESSGSSPLPGQFTVPHSLALVPLLGQLCVADRENGRIQCFKTDTKEFVREIKHSSFGRNVFAISYIPGLLFAVNGKPHFGDQEPVQGFVMNFSNGEIIDIFKPVRKHFDMPS

SEQ ID NO: 1002702 - protein, 81 aa, Homo sapiens
MFDGTVDNRRGLRWPANLETGCDRDRSNPKRGLGAQGVDLGLEAGAPGDPGEPEPWDVIAMHPDTGPEKGKKLGTKPEKKE

SEQ ID NO: 1002703 - protein, 176 aa, Homo sapiens
ATMYHRSISMREHRTAWFNISFDIIRSLPTISTADLKSRQDICPASLLKQRFRAARIRVGATCRCEHVCSLPWLDRVRGGRVSLLSAHEEARGDQCDRGGKLINAVELKKPQVKVCRSCPVVQSSQHLFLDLAKLEKRLEELVGEDIAMAVTWTPNAQVYHPCLASGWLKPRCVTQ

SEQ ID NO: 1002704 - protein, 345 aa, Homo sapiens
QAAGKMGDFQTERGLPKAADHLSKQRRGSWLGKKLGKEKLPRYYKNIRSGAYKTPKEAYWRAPTLTRKWPLPLGNGVSIQKGEILSGKWVDQDRKWQRGPLVNPPKTILALTIRQCTSRASKRGHTRNMCREHRESPREIQGSVQKSGDTRAHRWDRGAGPRETKKVRHSSVCLKGSHKGACARDTKKEVSQKVSVKSVRQLGTDIHQKRYKEELNIDTHCTQKKTTRSQPENNKTTKNTKKTRTRGINYKGGLKKNDVEQQEEKGRNKQRKKRPPAHTNQQTRTTTQEKHTQQKHAKAKQRHNARGKPNKHDQTEAKKDEARTGENTRKKERKQQETNTETRRN

SEQ ID NO: 1002705 - protein, 129 aa, Homo sapiens
ALHVDWHLRELKLNASSLLCCSIRLPTQQSGLMAPGSPHRQDEVIRAGPEPHLKSEKMFQYTAGLKGFRLPGGPLTLAVVAEGYVASCYKNSQYHLVIHPPVSYNDTAPRILFWAQNFSVAVQGPRGED

SEQ ID NO: 1002706 - protein, 267 aa, Homo sapiens
MGLCSWICDQQTPARSGPPGGGADGTSLTRSRPRTGPNVLLGSAVETPDIPSDEKDFSLPRNISAGIHWASHAGAITHGQCGLRVTPKVTETLFIGRVYHENPAAEVRARSCETCLPPEHNRDWHSTRPPSPNTSRLTPSLEEPNFLVRNCRAAPTCMRHMCVRLRVMFPSSRTPNHWNLMLPESGESMLTTPRRQAWIGPVARIPMMRLSRLPCLASAPTCCSPNNCAHTTETRYAYTLHATLCATHISTRPPSLASQRQERITAP

SEQ ID NO: 1002707 - protein, 282 aa, Homo sapiens
MVTGGRESGNQCDRLLARRPTVDRPRAHVPPEARAPMNAPEDSGWAIHRHGLAYSIGLGTDVSHADMRALTVIFCRDGSTRYAHVPAFLQTSWPWSYVTGRYCIMDILELAESRRAKQVASHSSARWQARSPKRKVGVPPACPNTSPWFRPRQHRRAQSQEYTEGLLQKKCSGYSIRRANAIHPEEESPALTFPSAPRSTPGLPHLEGTWNRNWAYLELSPPWEERDWLVGFRIPGEKPSLPFTFRLQMIEGGPERAKHLGKAETGLAGKELPPDNWTVSSN

SEQ ID NO: 1002708 - protein, 274 aa, Homo sapiens
RSAVTLPRNGRDQVGAADPVERPHLLGLVQGASLALRACNPTALIPLQPVPGVPCCSVPPASPTDACAASPEACTCCAPAGERGERRNANAGGSPAPVRRRPEASPVQKKEKKDKERENREGRRVPSALGSAGLKKRQSAARLPTLTRLSGSTDLLSSGPNPRPGHPLHSKSWHRPASPLPKARTKGDTLPPKANHPPEVTIESPKAGGDSGRDSAGRAKARDPEDDAEVSPGGTRDPDTELQEGAELNGGTVQTGPGGITGHQPTWASPGQRH

SEQ ID NO: 1002709 - protein, 66 aa, Homo sapiens
TTIARKQMGGAWCPTNSCYQLAVDPRGPVGYEALSVDDALRVPSNSTVLVYMADQLRGKPWFHWKV

SEQ ID NO: 1002710 - protein, 128 aa, Homo sapiens
MRSDTGRIVGRRGTQADEHKRHTRGEEVVVTHHPPMLQQHVGRAYIEFNTIIVARKKGPHQRLLDMFVGENNHRHPICSVPRETNEKTTRLEGTGNWPQQVSSCRERLAGAYTPYPDEITHRQETEIT

SEQ ID NO: 1002711 - protein, 327 aa, Homo sapiens
MECLVEVCTRSSLLFVHRSKARRQPTGEPSDEQMTLVQVTGNFYWESGGLMTQNLSYRGHFKRTPKEMDTARRGCEGGNCSEPHTFLLQMTMDRRRKESNTGVRSRMFSLATSQKAVWSGRRRDSALVVPSCVWHGQDPMLQCSWGAVAGPQGSVLASQSGSLGWSPSRAKGDPDSRYRGGPAIASRRAIPSAGGNRAAVYDASSEGGSLVNPGRSAVWNPGGPNSSVPENATYSNHAGDPGMWTRETSGPGQGAQVPTVVVGSRPLPLTIFMTFEAWGGRNLTLALSRCQNEPSASPVAKKLSGDLVIAQMSTLAVHQEVSPGYYS

SEQ ID NO: 1002712 - protein, 398 aa, Homo sapiens
MTKITLNESRGKTSVNPEPDHQKTVSEARQQSTCANMRTIQVRRLGAHDKRELGGGKEDLSGTAARLRKERGQQELLCQAHDLNSQHVYSSDAKARQRLVETAGAKRADPAGEETKDERVDEGNRKLQRPANGARKALGQSLDDDGSLPWPGSCPEGLQDWVRALLSKSGKGHRPSGLHTGEHLERRNVPPKRPRKRDREAIRGRSAQHGGEEETGFEDFGLHSPYGWNSGNGLALTAGTTSSKRTVPLSLRHKGRKGAGDLEVQTENRHVEGASLPAGITALATIRGINSQDDYGAYIAQQVQATKQGGSGTADDPGVGNDKRHLPMRGLTAARQRSDHVVAKSTARGHDQPTTNVEQTEQLHLSNDTPNRYWQHTSGCAGGPRHTRQQCGSNTQWS

SEQ ID NO: 1002713 - protein, 265 aa, Homo sapiens
MTGVALGVAPRCEFPRGGPREVQKFVPVRGLKSRTLDTRVGPQYKFKPIHRPKKCGGTTKNEPWGLSEQGQEHGGAPFVCVHRGDFSHQQGRKRAPVGNCDFPGPGVTKVCDASHTPGPLTSKTKKGLETPHSTGPQEGAKQGSPGGSSERNPSSTSGEKTPKGAQDTPRLATKTPNVSPNTTHGAVEQRPKLPGGGADNTPHRTRDPNLAHTTETATEQDPTPTADTPNTNQQGTTLQGTHHPHTNNHLAPSNRTTQYRDSPRN

SEQ ID NO: 1002714 - protein, 127 aa, Homo sapiens
MNYLNPFVAYVVPGVVGAWRHQLAQFLALVAHLVWERLARPIGNVCARFDLGYAACGAYVGVRALAPLPYFNALPPRGFLSILTSPRRQSLGTRVARGGCDQLESCLARCLLPGRPLGSVRDLFFTL

SEQ ID NO: 1002715 - protein, 301 aa, Homo sapiens
MAKFAQGVARCHPRGLKVVTVTCEYQSPIMDTRSLRATGCRKTNPSCPSWVAQGNGGRYPAKRHPGRGLVHLCKGTRWWGFAELLCLPPDSPRAPGGQIGDSFGHERIGPTGFGGGPPSLGEHFKTPRSEVVAHLMVPPKMTNKVPLEPLVAQDPGQGAPGITGTVAKHPFKDPHLLEKKVAPQEENTSEPRNTLKWARENNNKSFPHGDDEQIRCPDKRGPPHCLEEHTTHKNPRHETRKPRALSHGRQKREKPPRLTQRKPRETGATNKRQAPRPPRTAEPQIFYLKHPSRNRDRTRHN

SEQ ID NO: 1002716 - protein, 38 aa, Homo sapiens
MLKLSVRTQRDLSETTAVAKGVYAAEILDPKEGGPGEG

SEQ ID NO: 1002717 - protein, 304 aa, Homo sapiens
MESLSLSTFSRLRGFSTHGTRSWLSFDEDRTKFKFQTTFTLEELTAVPFVNGVLFCNGPGRSEPLLSPGTTVNYSPLNHQRAGQAGHGGPVQLVGKQGAGKDPALPGDCPMPLAEDMQQLLNVQTMPVADWWPLYLCPHSLQEHWLLRHVFTPPGPCLRCSLVLVVARGHDRLRNPATCDCSDCLSCLSAVPYLVYWGNLLGASSLCSPCRKRLASSPGKLSSPLALHPPGTHLALWKAPHSAYGPSLGPHSLVPVSTCASLSPMGAIGEPWPLLAAPYGRVALRNHSPHTARGFISHETPDHL

SEQ ID NO: 1002718 - protein, 346 aa, Homo sapiens
AGSDPRGAGGQTGLQRSHPRRTDTMPFDFRRLDIVQEGAQGTYTQPSVQPGPFISICLLPLHRSSSSSRSSPEFITTRSCERAPMSIDPRSRTSGGKIDVRSEHLFTQSALRVGWADIQDDSMGRHLKLGRPSTTPMKIPRDQWGRLPLRGAASSITKVPGNVPTCPHHSATSPATEPRHDSMFQSTSSAFGEQAYRSRTSTGAFQCCSGDASTDSASKPLCFQDYLLKIVPTGFMTDHEWATQRYSVTRYTGGHHGTYVAYSHTGAAHPCKLGRVNDLSPITEHEHQQQKRTAALHASPPPEWGHYCGDPSPRRRPGPPAFSRLTPAHDQVCEVCGHPPWPRTRP

SEQ ID NO: 1002719 - protein, 297 aa, Homo sapiens
AGDKCAGGRGVFLLLAVNVVLLSTTDADAMLILCARGGNELQLRLVLCHVRRLFLLVHPWCPEDEARAERLAELVALEAREHGDVLQWAFIDTFLNLTLKHLHLLDWLAATLSAARFLLSGDDDVYVHTANVVRFLQAAVNPVPALFSVPGHGGLRCPSCDQVEQVLRACLQLFPGFRFTLVYCSCAAGFPPVRHQLARALRAVSPGHTPLFPIDDAYMGMCLEARLALRPAVHDGHSVPYGRAACWPHRRSSFDPCMYRELLAGAPVTRPYEMLVHVERRLPGPGLSCNRGHGVTS

SEQ ID NO: 1002720 - protein, 394 aa, Homo sapiens
GKVEQKRGSQIYAKSSLWMMLQKSLRGNQRRKGVIQNGRERWKKRRMRMRMRMKMTDERQLLGEFETGTGRGSCFRQTETGSVRHVTPLAWQRAHWNHIIQETDESSWTQTGPDRRDVTSRDRRQCLASHSPLSNKLITKTGGKQQSPELVKKHKNTHEGRPQKASPITPTYRGGSWGTRVRVRVTKLRLARVLPQDLNCPSDDDTGQQPTAEHNTRRWLGARTLLDDGDGPPAAVAETFAHHKSFRPHGGLTGTWKPRGPLWREPDDGHLKTPSTEDPQPLQQGQPGSLRTRPVKDQAAGQHKRQSNTTDAQHCTATYYKVVVAGKQGSRHETCYTPKNQNTQSNPSHSTQTNYTRAAHTQTTTEEHGGNKKENRKSVRATEARSNETKPHRR

SEQ ID NO: 1002721 - protein, 230 aa, Homo sapiens
GSERCVEIVRPGQEVLCMVLGSQAPASPQRLRDKSSECCRGRPWVLLLHSLERDVHRVRMLCQQADSPIHDPEEYSLRVTWALIEGRDDRFVLDRILVCELRVARSYGRVLLRRNSDATIHRSSNSYIGNETVVSTVRPSFCECRQDGLCEGGLWRSLRCHDTLTVDVDLSRAQDRWVPTTWRWTDSLRENGRMAAGNGRRIHCADERHAHCLMAHGPLKPQGVTCVWLA

SEQ ID NO: 1002722 - protein, 198 aa, Homo sapiens
MRSYPRVLKPGGLSRVTPGASCGAYVLALHLWGMCPSEKSAVYLEHIPLTPSGYQAVNNTVGNRSSIQNLSGILSEAARRKILHSPHPCCTFSMAFGPWAVPFTFTYAHVPALIRGAKGVFPGIEPGKWTVTELGNDPAHLVMSFRILLDGQWALGDLNLGCPMADSLAKLTEVCLAVLREARYPKRLRPQKEAKAMG

SEQ ID NO: 1002723 - protein, 150 aa, Homo sapiens
MVGRWVQKDSYVGAEAESQRGILSLKYPIEHGIVTNWDDMEKIWHHTFYKELRVASRGDTTVTADRGPPLNPKDKRREDEPDHVLRHFNIPRHVRCYPGCAYPCTPLDVPRGIVMDIRDGVTQTVPIYEGYALPPCHPEIWTWLCGTLTD

SEQ ID NO: 1002724 - protein, 213 aa, Homo sapiens
LYVVNRTGAEANWCSSAPLLRTSVDQAPGQASQCPGSHQHCLIILIPLNVCSSTALVLERTATPLSPGTAGLARQVPPDGTEWPNPGLRNNSTREVHNGGSILRASVELLDEMKSSLEKLHQGITVSDPPFDTQPGPRTAFPEDPGTQLFPTWTDGHTEASAAPLARCERQGIFPPALRRRTKGLCRRGDTDRDALRTRSWPALEAPTNLFAG

SEQ ID NO: 1002725 - protein, 101 aa, Homo sapiens
RAFNYKPHGFYILAYNAETAVIDRSDLSSSPTDELTSLTSHNYRPWALSSAQLRRPAVSSAAASMQALGALVPIRSSHQRVGCTDTGEMSQRRLHAHPPPP

SEQ ID NO: 1002726 - protein, 55 aa, Homo sapiens
MTIPCAITSQRMIPPKMLTIIASTFLSEVMKLKCFCYLMDCTTTTNIKEVGWSVT

SEQ ID NO: 1002727 - protein, 152 aa, Homo sapiens
MGALRTCGYWICRECWLWPLGPGRYWLDLGAEVIKVERPGNGDDTRAWGPPFLKDAYGENTTEAAYYLSANRNKESVTIDFTRPEDQKLVRDLAAKSDITDENFKVGGYEQANGLNYESLKEINPEEDLLYYYRVRSDWALCDKGELRIHDP

SEQ ID NO: 1002728 - protein, 88 aa, Homo sapiens
EPALFIKRFRQFQHDVADEPVTHHHIADSVHDVAGFHISDKRKHLSREQGIGFLRQRIALARLGADIEQPDARFVDSEHIFGVQIAHH

SEQ ID NO: 1002729 - protein, 69 aa, Homo sapiens
SQISLRFYSPPEKPTCTERVNKSSGIFRRAIFSSINILKIKAVERFLAAIAAHRIKCRLQEKLVTDTWN

SEQ ID NO: 1002730 - protein, 63 aa, Homo sapiens
PCASNQPHSYLIAIIANCLKRLMMIIPIRLKCTYALGLNWSNSILGGFNISGYKTYSYDGDND

SEQ ID NO: 1002731 - protein, 90 aa, Homo sapiens
CTQPASQFQCFGVGHTYILVIQRFVVMRSQICVDLRTCAIDHHQTDAEAVQQPDIINDTGEILMLNGFTAEHDDKRFSPVGIDIGNRMAE

SEQ ID NO: 1002732 - protein, 97 aa, Homo sapiens
HSDEPVLFAASTVSGLLITQQVALDVKICPDDRLNPCAMSRSENFTRPQRLVKSVIASAGIPNAAAFFTNGAVLARPSIIEYSLCTRRCTKRGSDIF

SEQ ID NO: 1002733 - protein, 143 aa, Homo sapiens
MYPNGLSTGDSHVTIMGDYSSSLVGSAYTLQGARTLRIGVGIAVGSPPPAGSKEVVLRLRSVSSIVMPAAQALGSSIRQHSRHCCAFRHGSAQRGALGIGFMAGGFILLIVVHANEMAPKIAGRHLLRCKAHSWLGLRSTPVG

SEQ ID NO: 1002734 - protein, 70 aa, Homo sapiens
SRGSRRVVGMGRRTLRGRRGQSKRGIPTLKYPIEHGIVTNWDDMEKIWHQEHTKSHAKSHTMSHTKSHTK

SEQ ID NO: 1002735 - protein, 34 aa, Homo sapiens
SLEDRKSLIATVLPRRNAQSVSCATEMQASQQLA

SEQ ID NO: 1002736 - protein, 74 aa, Homo sapiens
PALQIFKAGYRDICYATQKRQSAVRDLSKLVDLILVVGAANSSNSNRLREIGTEAGVASYLIADGGSFNPDVWS

SEQ ID NO: 1002737 - protein, 71 aa, Homo sapiens
LSVYEKMLVYRGPSGLINCWWGVTAQPVPAPASTIADASMSKREGGKSQKLVLFMRGNAISGAPIIRGNSQ

SEQ ID NO: 1002738 - protein, 90 aa, Homo sapiens
NNNVTILTSQTLRKKKPSELSCAVIILLQIALPSLRILYITDEVNDPSLTIKSIGHQWYWTYEYTDYGGLIFNSYILPPLFLEPGDLRTY

SEQ ID NO: 1002739 - protein, 40 aa, Homo sapiens
AVPLTSSGLKILSIKGSSGVELQDFTPDLKTRLRTLYADA

SEQ ID NO: 1002740 - protein, 66 aa, Homo sapiens
GHTIEETPFYTNTYTDNGHPEVSIHILPGYGILSHSVTYYSGKKEPYGYIGMVCAMISIGYLGFIV

SEQ ID NO: 1002741 - protein, 173 aa, Homo sapiens
RFHCGYAGSVKGGNDYVVWDYAHQHGIPDETCNNYQARRTRSVTMFNQCRTCNEFKECHAIRNYTLWRVGDNGSLSGREKMMAEIYANGPISCGIMATERLANYTGGIYAEYQDTTYINHVVSVAGWGISDGTEYWIVRNSWGEPWGERGWLRIVTSTYKDGKGARYNLAIEE

SEQ ID NO: 1002742 - protein, 135 aa, Homo sapiens
IENNTPIRRDWTPRGITQINPHRSPTPKHIQYYSPQESQSPELTISLIENNRNQIIQALLITILLGLYYTLLQASEYFESPYTISEGICGSTYIVTTGFHGLHVILGSTFLTICFIRQLIFHFTSKHHFGFEAAA

SEQ ID NO: 1002743 - protein, 83 aa, Homo sapiens
MLASTMVGVIGVNGGTGMSSSTAARTIRAMDMEQRMTLCNMSIEAGARLGMVAPDEVTFDYVLQDAVRTEGFRRRGGKVKAAG

SEQ ID NO: 1002744 - protein, 180 aa, Homo sapiens
SRDPQSSTYVYQMVCAVNTGDEMGMLYKCQVSRALIPALEDYISETSTTLCQTLFQACSVGADLNGQAVYAACQTILKRLEPYKKKKSSGSWEDWVTAAYMDTVSLSATGFYRTPNLGYSFETNSGNPLHYFSYGVACSEVEIDWLTGDQKNLRTDIVMDVGSSLNPAIDIGQVEGAFVQ

SEQ ID NO: 1002745 - protein, 97 aa, Homo sapiens
MAIQSYCRTSEVEYNVYVSCSTMSSDEFANTMPVRPPTVKRKMNPRAQSTAADHFIIASVECGESAKYFDAGGDSDDYGSGGEICSCVYVYSYCKYM

SEQ ID NO: 1002746 - protein, 81 aa, Homo sapiens
PGTPYDCVIIAVRSVMAEMKPDLVLSGVNRGQNVAEDVTYSGTIAAAMEGTLLGIPSIAVSQAYMAGDRTKIIWDCALQHA

SEQ ID NO: 1002747 - protein, 70 aa, Homo sapiens
EILSFGKNTSRRKSNESLAENVKSGKPYLGTSAGSNIAGLNMKTTNDMPIVYPPSFDCMSLVPFNINPHY

SEQ ID NO: 1002748 - protein, 94 aa, Homo sapiens
SSLKPRLVDIEQISSTHAKVILEPLERGFGHTLGNALRRILLSSMPGCAVTEVEIDGVLHEYSSKEGVQEDILEVLLNLKGLAVKVQNKDDVIL

SEQ ID NO: 1002749 - protein, 235 aa, Homo sapiens
PCALDVSAQSLWFDQDIFTQRESSPGYENAKLDHLFQDEVATAQHLREEQQRQQHQMEHERQRLVASMEEARRRQHEADEGVRRKQEELQQLEQQQRQQEELLAEENQRLREQLQLLEEHHRAALAHSEEVTASQVAATKTLPNGRDALDGPAAQAEPDHSFDGLRRKVSAQRLQEAGILSAEELQRLAHGHTTVDELARREDVRHYLQGRSSIARLLLKATNEKLSVYALQRQL

SEQ ID NO: 1002750 - protein, 41 aa, Homo sapiens
MRGNAISGAPIIRGTSQLPKPPIMMGITMKKIITNECVRRS

SEQ ID NO: 1002751 - protein, 66 aa, Homo sapiens
YRKAIQEQLYQEQLYQESVYSRQPALRGGRYTGVISSSQETKIYRGNPSCLRIMASAFIGYVLPEA

SEQ ID NO: 1002752 - protein, 133 aa, Homo sapiens
NILFCILDSTPALLAIQQLPVGAISLSTPDMTYHQTPWYSRRLPRHVLLGPLQGGLQLGQLGVGILDGQLSTLLGICNGGLQGSPLAFEALNLSLQPADVPVHLRDLSLCAPQVIPVLPSQALQVLILNLVHA

SEQ ID NO: 1002753 - protein, 87 aa, Homo sapiens
GRLGRVVVDTVTDTLDAGLVQRPDHLFELAHGVLDRVAGLGSEVANGVVAPVVARAELHQPMVVHERMHRHQLDGRHAEPLQMIDHV

SEQ ID NO: 1002754 - protein, 98 aa, Homo sapiens
RYSSHTSANCPSAERASELYPSCSSVDDTPAQMTTQQPFKQFSTTPVSALSVSSIALDDLSYTPTHEHHKNIALLNAQSKPHPTTRPPPSSSSANQPN

SEQ ID NO: 1002755 - protein, 38 aa, Homo sapiens
YSLTFRRWYRSVAAQQAQYKDQVAFFHGCFVNYNHPQL

SEQ ID NO: 1002756 - protein, 53 aa, Homo sapiens
MAFLMLTERKILGYIQLRKGPNVVGPYGLLQPFADAIKLFTKEPLKPATSTIT

SEQ ID NO: 1002757 - protein, 144 aa, Homo sapiens
LVMKVMAPEDIERTAKVYREDGLVYGGSRMGVVTLLREGRLVQTVPAPASTIADASRSRSAGGKSQQAYVVSCGDKPYRGHRIHSGATQSVANSLRFMHGSFTMQEAFFTNAWAVHAYTLSDVVVHPAQHCLVGGILSQSHCQA

SEQ ID NO: 1002758 - protein, 131 aa, Homo sapiens
IELVPLTDYSMSLCHCRRDLKITEGSTVSVNYVSGSSGDRIEKMFLSKRSLKAGSRVLIVDDFLKGGGTVNGMISLLREFDSELAGVAVFADNAQEEREKQFDYKSLLKVTNIDVKNQTIDVEVGNIFDED

SEQ ID NO: 1002759 - protein, 74 aa, Homo sapiens
MFIIIQSGCGEINEDLMELLIMTNTCKIVLSSRVTAVIPCFPYARQDKKDMSRAPISAKLVANMLSVAGADHII

SEQ ID NO: 1002760 - protein, 80 aa, Homo sapiens
KISPAVICVLAGSLPLVANLFDGKGGIVDLVCYVQDAYGWEGDEDKMIAGRVYFRSVSYCPERLRCSYLVRCVVSVKTMA

SEQ ID NO: 1002761 - protein, 50 aa, Homo sapiens
MIPSRARIGGGVLARGCNNEGKDEVKGKESCEGGTGRRVTSSDSLQHGLS

SEQ ID NO: 1002762 - protein, 95 aa, Homo sapiens
HFWPAVSDPTPGPEDAVIRVEASGICRSDWHGWMGDWTWLGLSPQLPITPGHEFGGEIVALGREVRDFQIGDKVTVPFHYACGHCEHCHAGVPNR

SEQ ID NO: 1002763 - protein, 75 aa, Homo sapiens
LSHRQLGFHLGHPTVHIRCEEIVNANVNTYFKKIGYNPYTVSFVPFSGLNGDYMLEPIANMPLFKAWKVTRKDCD

SEQ ID NO: 1002764 - protein, 83 aa, Homo sapiens
DNPLADHLEYPRRTWDSAGPPYSQKRYEEIVYRSQQLYFKKIGYNPYTVSYVPFSGLNGDHMLEPSANIPWFKGWKVTRKDCD

SEQ ID NO: 1002765 - protein, 80 aa, Homo sapiens
MQSISSSSVDSTGIDILSVVTFHPCNQDMSSLGSSMLSPFPSDIGTNATVSLVVSDFLTVSADFLYNFLISLLAVGWPSE

SEQ ID NO: 1002766 - protein, 58 aa, Homo sapiens
LEYPHTATPTWIHKLARWCRRCKCQFRTVVFFSAMTSRRITRTAIPHSRPGEIFGPHV

SEQ ID NO: 1002767 - protein, 62 aa, Homo sapiens
MTAVTFLNSLKISSPKRATSARLCGSICADVESGFIRAKNTVPIKESRCVNYRNPAAACVRR

SEQ ID NO: 1002768 - protein, 65 aa, Homo sapiens
TWRLGHQFHHNNYHYETPYHNPLPNAPLRLIRPSHSIPTSPSLPVLAAAFIILLTDRNLNTTFFD

SEQ ID NO: 1002769 - protein, 104 aa, Homo sapiens
FSCCYWPGKRRCSTPLAIWCMVRAVRLTAGRCANPVATINVLMYAIGAFFLSHLLYTIYFASQMTLSFFWPLPLVLLVLGALLLAIIWTRLEEYRWPICTFIGM

SEQ ID NO: 1002770 - protein, 72 aa, Homo sapiens
HERDLSGFGNMLFMALIGIVLASLVNFWLKSEALMWAVTYIGVIVFVGLTAYDTQKLKNMGEQIDTRDTSNL

SEQ ID NO: 1002771 - protein, 71 aa, Homo sapiens
KFQQHQPLLVSLESLGRHTIQMLHDVLDAFARMDIDEAVRIYREDKKVDQEYEGIVRQLMTYMMEDSRTIP

SEQ ID NO: 1002772 - protein, 117 aa, Homo sapiens
MLPVNRAEGFGSALSQRPCHWWPCTGRTSSALISQCTPKVDFPQDQLTALTGRIQEAGTEVVKAKAGAGSATLSMAYAGARFVFSLVDAMNGKEGVVECSFVKSQETECTYFSTPLL

SEQ ID NO: 1002773 - protein, 150 aa, Homo sapiens
GALMAHATQVSLQLLYFPFIEKLGTFHDHALIIIFLICFLVLYALFLTLTTKLTNTNISDAQEIETVCTILPAIILVLIALPSLHILYITDEVNLIPPLPSNQLATNGTEPTSSTDYGGLIFNSYILPPLFLKPGDLRLLDVDNQDHHQY

SEQ ID NO: 1002774 - protein, 61 aa, Homo sapiens
VSQTDPLLADFLLFMRGNAISGGRLIRGTSQLPKPPIIMGITMKKIITNAWAVTNNVVDLV

SEQ ID NO: 1002775 - protein, 62 aa, Homo sapiens
MTIVDVSYTRITCRVVGCLVHALANTMPVRPPTVKRKMNPRAQSPAADHSIIATVQCGESAK

SEQ ID NO: 1002776 - protein, 141 aa, Homo sapiens
IRCSIRSGDICKLRKGNISCNLKSLRVSSLLNFGSIEINSLNDAASTPTSAVSAISITTTYNRNGNGALYSPTNKPGDERVEDDGKKQRQYQLHNDICRCVNAREDHYQRGQLEQNVHARFIGLRGFHWGFLVTFCIKCSG

SEQ ID NO: 1002777 - protein, 146 aa, Homo sapiens
LRGSRVAVSSCQRPCISDSILSLRTLVHSRDIEYTIGIMSKRLQSEEHLGLQEVCCEFNLPAGCYLVMDARLHKLNKHTRLVVRIGSEGLCLLGRNGGITLDEDSHDSTSSFNTKGKRSDIQEQQILNILRLVSRQDGCLDSCTIS

SEQ ID NO: 1002778 - protein, 97 aa, Homo sapiens
MSRGSPSSPTIRIKVVALRFPIVMVPVLSKSNTSISPAVSTALPDFVITFALSALSIPAIPIAESKPPIVVGIKQTNSEIKAAIVIGVLANQQMVLG

SEQ ID NO: 1002779 - protein, 106 aa, Homo sapiens
RSESHPVLLHEFKTFTWFLRFDLQNNVTVLTATTRLLNEFTFDFFACFADCFAVRNLWLTNSCFHVEFALHTVNNNFQVQLTHTADDRLTGFFVSFYAERRIFLRQ

SEQ ID NO: 1002780 - protein, 157 aa, Homo sapiens
DHTKEKGGKKEVSVTMARTKQTARRVAEGKAQRKQLATKAARKSAPSTGGVKKPHRYRPVTVALREIETLSEVTELLIRKLPFQRLVREIAQDFKTDLRFQSAAIGALQEASEAYLVGLFEDTNLCAIHAKQCNNYAKRHPASTPHTWRTCLRIHYD

SEQ ID NO: 1002781 - protein, 124 aa, Homo sapiens
PDSSETTLPTALAALVEAGMMFLESPGVITPQFPGGAIHSLLGGSDGMDCGHESFHDTKVVMDDLARGAKQLVVQEALLMILRLLSYFSWFTPMTNMGASAEGAEMMTLLAPPCKWSKCNQGIL

SEQ ID NO: 1002782 - protein, 151 aa, Homo sapiens
MTACAWLTLLGWPKVQMGIESLQAFLRAAFALGVWVYTFLERILIPTGLHHFIYGQFIFGPAAVEGGIQMYWAQHLQEFSLSAEPLKSLFPEGGFALHGNSEIFGAVGISLAMYFTAAPENRVQVAGLLIPATLTAMLVITEPLETFLGIL

SEQ ID NO: 1002783 - protein, 102 aa, Homo sapiens
EQISRVTTLDIVRAITSVAELKGLDPARVNIPVIGGHAVKTIIPLISQCTPKVDFPQDKLTALTGRIQEAGTEVVKAKAGAGSATLSMAYAGARFVFSPVHA

SEQ ID NO: 1002784 - protein, 99 aa, Homo sapiens
MYKSFINDYPVVSIEAHIEQDDWGRYGISTQTSAGIQVVEDDLTVTTPQRIAKASEEKSCHCLLLTVNQIGSVTESLQACKLAQANGWGVLVSHRTGAT

SEQ ID NO: 1002785 - protein, 112 aa, Homo sapiens
VNYLCMNLVESVLLIMTYLSWFTLWRCSRLHCHAFDFIYTGQSIRDIYVQVNSMVMNGPKLPAPFGKVKEKKLYIDDSSALPPTEVRARARRIAKQHDGKLGLHHGRLLTAD

SEQ ID NO: 1002786 - protein, 128 aa, Homo sapiens
RVIPAMLLQRWIDLDHNVYVQVFMATEQSQTPWIRPCYRPGRLDRIIEFPLPDRRPKRLIFSTITSKMNLSEEVDLEDYVARPDRLQELIFTPSVRTVQCRLSVKTATLILATDFQKAYHTAILQEQH

SEQ ID NO: 1002787 - protein, 109 aa, Homo sapiens
MNYGYAGYYLLSKNFSLAMPSLIDEGYTRGQLGLAMSEIAIASGLSNVPHGTGVRTLQPALLPALRTPGVRRGDVPFRFRTLGYVQRAHACHFASHPRLGPGNGLDAKW

SEQ ID NO: 1002788 - protein, 150 aa, Homo sapiens
NLECFRRIRKPSMNGGNRNETPQWPNSCRVPRWARQHWGCMRLEPCDSLRLASLVHHIHCLVHTDRLWQWPQLLIKRYRAFGAALRATSPYNTLCDLPRIMFRTSRKETSTVSSPATAILAHKLPVAVVGAEGKGALPYMCQALLLMRTM

SEQ ID NO: 1002789 - protein, 108 aa, Homo sapiens
EGLCSGSISGWREIFLAVSALSVIAFIWRLIYVPQDITHHKPLSLLQHLLLKKQPRLLLVYAMTAVGYGGTFIAYTFLAPSPQEISRFQLGTVRLVLLYLRYLGYPLE

SEQ ID NO: 1002790 - protein, 66 aa, Homo sapiens
MTATSTPPSSSPPEEETPLYTNSYSDITVRLEDNILILPGFGIISHIVTYYSGKKEPFGYIGMVRA

SEQ ID NO: 1002791 - protein, 80 aa, Homo sapiens
MPLLSGTMIGAGTIAFLLRSRYLTNSSTPPEECISSRFSTAWRMSDSTMWTPELRKASSRSRCSSVAKSYSTFLKVSVEA

SEQ ID NO: 1002792 - protein, 102 aa, Homo sapiens
FSTYRRQAPVTLGIDIAQTQFLLLAELDARDGVGHLAGDELDAAQRRLMVEQNAAGRMQAEAFAVVDRDPVSIQLGNAVRAARIERRALVLPFGLDQTEHLA

SEQ ID NO: 1002793 - protein, 198 aa, Homo sapiens
GGADGAGKRSRCAWVVVGIDRLREHEPLVGIHGAREFLNGAVELEMNCRLERRRPGFRQVTESREIAPMFRVADLRAEGRELVKGFSSGRLAHPCQCRDGLTICRQQVGDEVVHSLFGCWREVPSGIKFAEASAHGRFNEGDAALPSSLERRGAVEDTTVKVEVLIEKAELREEARERYGVPALPRLPLVKAFVDEHS

SEQ ID NO: 1002794 - protein, 47 aa, Homo sapiens
KAFGPHFEAPIMLANSARNRSASIRIPYVSNPKGKRIEARFPDPMMN

SEQ ID NO: 1002795 - protein, 157 aa, Homo sapiens
RSLIWPGWFRIITVSSEASCSIGGSLAVTRRLHENILDRHILDIEAHIVPRKSFTQSFMVHFDRFYFRCNVDWSKGNHHTGSENTSLHSANRNSTNTTNFVDILERQAQGLVSWTSWWKDAVQSLKQRGSTGIAILTGDFPSLEPRHVSTWIQHVVT

SEQ ID NO: 1002796 - protein, 150 aa, Homo sapiens
CVSIPRSTRVLTEAPDPKTNARRETQIMYETYQHPNAMYVAIQAVLSLYASARTTGIVMDSGDGSPTTVPIYTRGMPSLYAILRLDLVGRDPDLTNLMKIPHRARLQFNLTNGLKREIVRDITEKLCNGRPLDFRARDGPRLVTSSLPGE

SEQ ID NO: 1002797 - protein, 190 aa, Homo sapiens
VITLVLRDSLALEMYKGPSLALLERKESEELEVNPDPLACRGPPGDRCGPGSRGFPGADCVAGPKGPAGERGSPGPAGPKGSPGEAGRPGEAGLPGAKGLTGSPGSPGPDGKTGPPGPAGQDGRPGPPGPPGARGQAGVMGFPGPKGAAGEPGEAGERGVPGPPGAVGPAGKDGEAGAQGPPGPAGPAGE

SEQ ID NO: 1002798 - protein, 110 aa, Homo sapiens
MSGREKMTSICETFNTPARYSGHPGRAVPSTPLGAPLASSWTSERRGHPKRMPIYEGYALPTQTILRLELAGRDLTDYLMKILTETRLQASPPRTRREIVRDIKEKLCYV

SEQ ID NO: 1002799 - protein, 172 aa, Homo sapiens
MIYITVSADGHEYVVKRTTITITNDKGKEALSSGLDWDNSISIELLVPKGVYLRETRVTHTQVIYGFYLELISFLGRLSKEDIERMVQEAEKYKAEDEKQRDKVSSKNSLESYAFNMKATVEDEKLQGKINDEDKQKILDKCNEIINWLDKNQVCVYIFFYFLPHSMEGKGM

SEQ ID NO: 1002800 - protein, 99 aa, Homo sapiens
SRGPPESSIRWAHFRYRNRKLDRFLMCLSLGYPDPAAERALLAGDDRRQLLARLHPVMQVTELLEAQQELKQIHVSASLLDYVQALAQATRKRRCIRRR

SEQ ID NO: 1002801 - protein, 134 aa, Homo sapiens
MILSFSCCQSLTSSPECAVRSPVGVFQRPFTFRHPINLTTDSQHRIDKAIQFYLAFRLGRFNHQCTRDRERHGRRMETVVDQTFGDIHFADAGLFFQRTNVENTFMRHAVIATGIQHRVSVFQTGLVCSSGVQV

SEQ ID NO: 1002802 - protein, 196 aa, Homo sapiens
FVNHAVAHAWATPGLLPEAAAPGTWGALSSRSRHWSCSIVSCLHLHRLLSVETRSFQNHLLVLLVAVAHSVLEPPALVPNVQCEMCTHSGPRDLEAAVCPQHLGNEPVLCVKEGVVLKPLTLGAQEGPAAVLGMGWSLFKTEADSVFERVQRPGAVAHACNSSTLGGQGGQIMRSGVRDQPGQYGETASLLKNNKN

SEQ ID NO: 1002803 - protein, 77 aa, Homo sapiens
PEEDTEWSTGAVTCCHCYCQLLLPGCVCTSRACHVYLPGASVDLPTTTSSRQTTQNTTDNPGTTTGTSVDHIDKKYN

SEQ ID NO: 1002804 - protein, 215 aa, Homo sapiens
VEEKRTAMATVAAKSILHAAVRACGCAGKRRVTEDERATALRSCQCLDMPVAARYENWRELGDERPLLWPGESWFLVEKHWYKHVEMCILCREGTMDSSTFPGCINNATLFQDEINWSLKEGLVERRGLCAAPKQLLGNYLVSWYWSRSMARHPLNARSLELPNIAEGRSVPSRTCCFVRHNDLGNLTTVQFSQYRFYWLVLATARGPGYMVEPR

SEQ ID NO: 1002805 - protein, 183 aa, Homo sapiens
MNGSERKGHMQCQCAHQCGKGLEVEVDHAHVREMWSLQQQAEWVTRVNIVKPAQPRAHSSMNFHLIYLISDDTKSPVMYAAGLEMHVRVTVSITLQMTPMEFTAILDASGLPTYAGDCRAMQPRTAQANSKMYYYVEMGSTLLLGVDWFMNILLIKLIRAAYNFNISDWGPVLSHQALKYQWH

SEQ ID NO: 1002806 - protein, 157 aa, Homo sapiens
SDRVRSESSESRSAKSDHLPTPLLPIFNTTCVANKSDNSSSRRVISRDFSTLSRGFPVVLDSAAVFATSFSASRTDMRFGDNLIRQLNLGCAIGRQQGTGMAHVNIAAVSMVCTGFARFNKRSRLDTALRELADGICRLFMSERKICDQTMYALRLF

SEQ ID NO: 1002807 - protein, 143 aa, Homo sapiens
MRLSSKRNLKMDATHEAAIGKLSFVHVIVDTYSHLLNATCKTDQRAWSCTMGIVWSFCVIMGFLENLKERQHKQKNKNTENKQHNTNTRTKQQTRNTTTTTQPNKTQKKTTEKKQTERGAGGRTAADKKNSPASRGEAPSKID

SEQ ID NO: 1002808 - protein, 157 aa, Homo sapiens
YALNPVVALPCNQPAFGFDSEGKAKGGFTRDGRADTLAAQAATPFLAAHEMANKDAADVVSKVQQGSYANEFKAAFGSTIFSNTDNAFDRILYALQQYQKEDADFHPYDSKYDRFLAGQAVLSDAELRGLALFNNPVKGDCAACHTSSKGANGLAPL

SEQ ID NO: 1002809 - protein, 153 aa, Homo sapiens
MAASKSCVRQQVGQQPLYLSSWECVCGAVRLRTSRARALGRASRDGQLGFCAVWWHPLLLGQRVPYTCGVRQQRRREARGRGDASGLKRNSERTDPGGQGQCGPGQRDPMKVPVLTMDMNLSCITSHKQPRLQGDINIKQRSEHNMNKPIQWL

SEQ ID NO: 1002810 - protein, 286 aa, Homo sapiens
HTSPTRSGEGRGHRRGDLGSGATAGQPRAPAPDARLHVRAAIRARTRMLDMTRGTAPSLACSPVRAPPSSMSARGRTPDIATLPPISQTAPEGPVAADEGVSASGGSTGDEPRQERRRHDARSRAMTSADDQRSAGRLQKGYRHATSADHMHGAASARRAADDSKAQDRMLTARQMTRHSIGSEAAEQAPPAQLCRTSNAGPATKARRSAKTAEAKLMAACMSEQRASGPFVGRKAEPPQRTHASNKERKHHTNYESNQDTGARTEAHNKPGQQADSRLRAAEAAD

SEQ ID NO: 1002811 - protein, 102 aa, Homo sapiens
MWHENDGRQETLELRGHIGNREVRGLGKATWELGNLKEEKGSGKTIQGTTDVRPQRALENKQGGLSSGKTQGWRRDKPRGHGEHAGTHGRGGGTLGAPKETH

SEQ ID NO: 1002812 - protein, 318 aa, Homo sapiens
ARLPPPPAPRLPAPLPPRLLVALSAPQPAPPPRKGPGRSSCPGSSSATLLKAKHKPGGTPNLQQKKSQARPGPRSTRCPASQYRKLALTPQTGILTLRRCCTNPNPLRRCAPTLPHTRPPRTSDPAARLPRAQPPPTHPGPGSSLPTNLPTCHGPHPHSKRYSAIPAEGPNPPRPPPDPCLAARPPPDAPTPHRPRPPPRPTPTRPDPPPPPRPPPAPHPRPLRHPLPRRGHPLTDRTHPPRPPPTAPPPPPPPTTTPATHGTQPGPNAQPKRPPPPPPPPTTPHRRPPNLTQARPGNAPPPPPPYPAQAHKAPPHPP

SEQ ID NO: 1002813 - protein, 51 aa, Homo sapiens
EAPAAAVAAESGSLRAVCVLVHAGAQCEPEDQRSPFGAGREGPMQVGKHEL

SEQ ID NO: 1002814 - protein, 71 aa, Homo sapiens
GHRCRPVFSHGALVSSLCHSLFRRQRAPGGPPCTLSTRHAYYSSALAVSLWLQKPVCLCGSYSLCSSRAVT

SEQ ID NO: 1002815 - protein, 182 aa, Homo sapiens
MTIQGSGELWARANTYNGRATTSRCTTEPRDRLSRSFPLLSSSLRLLVPLALQKPGAGPELYALARRELANYATTPHPTGQRTLSASPTPLRYPAPLPDTEPAPPKSWHSSKQRRHPHTPLQPTPPRRKRRHTPRTPPPTRPPHPAPPPSRRHQPAPRPHTTCTHPPDAGTTHHLPPDALPT

SEQ ID NO: 1002816 - protein, 342 aa, Homo sapiens
MERVPWGPGVRWARGCGFPSGTTWQTCALRGSLVARLGPRWGWCPGLLTGLLSVGGSWAGAASTIHAPENLVSNLAYTNTPCPGSWSCHNPVPSAREEPPGMDGTLAAGTPPPTASELARPGSAWEAEAVFGCVASFPGLAAAPVPSRSRGIRPLPRAPSLRFARPGEWSGLPTPCLWTGRTPYPTDRCLNLGDTNASGSALRRGICMTKPLRRVRAPRGCHEKRLPCVNGDTVTDTIPPPPSSTETLSKPHSNRHHPLPKHTAPRSQNHLHPLPLSCFNHPVPYADQKTTHFLHQLQNDQTSIHRILRPMTCTPLHIQCFPPSNPTHVTTHRTYPLHTTQL

SEQ ID NO: 1002817 - protein, 35 aa, Homo sapiens
MRAAPFLFLLLTAKTILFHLVYTVTLGKGINVVPY

SEQ ID NO: 1002818 - protein, 39 aa, Homo sapiens
MANDTTRTTQRTDSTAHNHPGRPPQDTNATPPRPENNKR

SEQ ID NO: 1002819 - protein, 131 aa, Homo sapiens
MPSCPPQTEKAQYRRTTTANRTHSRHTAHTLTGDPTADDNVLLNNQVAIGSTKFVERILPSRRREKNPPSLRVQCHHLANITSRASTIATHTLPAPLPLSPSIRQQQEAEFEGAAAGMCDLNLAQALPIKN

SEQ ID NO: 1002820 - protein, 533 aa, Homo sapiens
VERMDEEFTRVRMQTDTSLTEEYVEHYERIEAQDVCQSSSDVQASNWRRRALPEEVMPHSTIGCRIHEQPYVPSKIYNGPQGATRLNTEPEGIINSHEQEPEQTNDGAKRLGQSLDRTKTEDKDTLYAPRTRKDTGYPQPMHSPMHLCPAIPKQTKDTCNTGKHEITKGPAETTTIAPNDAQLCQEKKQIAKTMTTGTGHKPWKKYQFTNERQPNGSQDVGDNHKLTHTQHRQNHRNTKGGKTRQNTNGHTMARGNKFPKDTQRLRTQKNQKGRHNHSETNQQAHEHRRGKGQAHEKGENPKTTNGHARQQKRDEKNSDDNNQKKNHHKLTKTTMRRNSEKPLGRKPQSTHDQDGRTQTRGTEHSRATTETQHRQKNSPAIQNESTRTHKPRRKAEKAHSTDKQPPDTQATPTSATATTQQREPNRTHLKRTTTTPIPHRSHTTEKTQQSRHHNDMTANTVDRHHKGHEPKNKASRLPRRHRHTTHNTAAHPRLNPQRQEHAHPQQRHTQRTHTEPRTRQYQETPRPNKQSKT

SEQ ID NO: 1002821 - protein, 259 aa, Homo sapiens
MRLASYVNHTNTNPYNQWYGAMEIIEKARIRKVHTATHKPVPKHGLRIRGIIAMFITSGSQVLRRNYSLSACVSQHAADPSHLTLAQIEVGTLGAAYLGNRSRRKIALEIAISVRHIPVFTLDDRKVFEIEPVTTHPEVLRLEKIKRDPPELEFARERGYDLTTLHSVASFSLFIAVLTKSLRVTMASSEDRPSFSNSDFVPGIRQGPKRSLQDDFVIFVTRYSVPLPTVIFSLRSTCYYGPSITGSRVNLNRSFQSPS

SEQ ID NO: 1002822 - protein, 251 aa, Homo sapiens
GAADGRSAPAPARTPDRTRGCTFSKSHNALKLATTASDECPEPETPTSNHNTGPRMLTPRNMYADAATPRRTPETAPNDVDRPSSRTGVHNPRDTRHINEPTRLQVAAPTQDVLPNARQRLVKRTPIIERTAHRTRIQSPSRASTQAPDTSKPRTTVEARSEKRTMGTPPNQIQLHSSHYGRACSQPGATRAQSKHETKALDHPHAHEESDQSHQSGKTPRPDHPLRKHPQPTRTAKAPRQPHQRQTVTTT

SEQ ID NO: 1002823 - protein, 31 aa, Homo sapiens
MSTGRAELSGDGHGVTMDAFDVHEFDQVPAP

SEQ ID NO: 1002824 - protein, 662 aa, Homo sapiens
QDTLTVTNPAQALPSHPCPAGSTPSSSPLAAGTDFGALSTPGWLPAHFHACPALLRCARYRALRRYARLRHCAAPPRHARLSPNAHTLHPANPLRPPPSRTYFSKNTACPYPLSKPIPCHQAPLHPTPHIYNPGLNNNSPERKTNHPFSPFSPRRGNPTANNPLAPPVALHTTNLARPGPKRRNLGPNHTSQPNESQTPSSTFSPTTTALATPRPADLLITPPPLTHNPFVNPVPTLASTRKHKHTFHTTLLPNPHQNPLPLNLYYQRPYNTTERPDPFMVAPTKAGVATQTFGKRPPWQSASATPFTSHKQTLPPLPPHPSPLFGHLTPAGQTGSGAMTVGPYYSWTPRQTAHILGARTPNKHLCYPSRRTILPKYWLARDTNTPQTAQNQTRRGRISILPLNNILPPPWQTCGHFWDYQPAQRGAPPARPYTILCGSPTSPHLLHARSPPPYVISRSYQNASGLNRTPATPTYRRPTTTPSVLGSLPRTSFIRLSPPMVLPRPPILSMVAASPTLFPKVVRSSTTHDKLGNVTPRTRLSFHHPTTPLDYNNASQKSTLLLFTLDTHSTRRSNLQSSLYYLPHIKRIESCQLPPINPPSYAPIGNILHPNTHHNTRYTLLPLIITLPLPTLKQQSSIPIDHPTTPNQPIIPMPLDTTIPSH

SEQ ID NO: 1002825 - protein, 441 aa, Homo sapiens
MWKTTLWFLYICHKRRRSTQKTHNKQKHNRRLCVARVRGINHAVVRVSSPPPPQLSCVRERVHNACVTHICAVCATPPPREEDVFYPPACDRRQQPCRVVQPCAELMQRDEPSYNHAASMCGDHTTTTVDVRTTPRCCWCHQHHNHTTTHNNTTPQVAASRALLLYLFIEMMMSIFCSVCVDDVGVCITSIFLFFMLSVVLSPVVSGSPAVAVSCPPHHGGARAPPLLFMLLSSSTARSSSLLSLLARPLALSARPPSAPARADLRSSVLALRHSRLVLLRSLLWLVVATYSRSASLHLPSPGRRTHSLRPPWSAHARRALPFSAPYPSRAGWRSSSVASRSLLSSIVAAHPPPPSVSPSSPAWSLSSSPPTSLAAGAASPSLQLPLLPDASPLPPPRSAPPAPAPALLPPASPPPPPPPHLRSPCSSAACRLLPPPPPPP

SEQ ID NO: 1002826 - protein, 93 aa, Homo sapiens
MGKPALTAHDTQTRKQQANTQPADRYATPQRPPLAADRARPRDRDRRQPRAYHTTPQTHQPKAHYTNRPTGRVTTDTTPRPPTTTPRRHTTPA

SEQ ID NO: 1002827 - protein, 142 aa, Homo sapiens
MTEKALLGTPCFLSAGHPRFPTSRAAQGTPSLQTPQVPRDPCAQGTAVPCDTTGTLRPVRSGDTRPCGHPRFPGVPCASGGHPSLQTLRGLPWNIVRFTGPRSPAGGAAVRGVPGGQRDPVSAARALAALAGLADRRGLSRV

SEQ ID NO: 1002828 - protein, 129 aa, Homo sapiens
MYQISTQHTKRHHPCDRLIHNRSVHKNNNQLPFSGLLIRQAHIQHITPYNSRIATSYTQRQQRTFLPNRYHRPNRDCHQQSTLESSRDDSHNIQRNTNILQWSAHKESITLNRRTTLTSRHSHHGKHVT

SEQ ID NO: 1002829 - protein, 402 aa, Homo sapiens
AGHCCPGDCSGAGSRWPGPSPGVTVGFESRDPVPYGRVVRSWDPAWSAVLRREDLWVAVLRGSQPGTPPPLVTVGETECLSWACAWPPLSPVPLQAHTWTMKVASPHTGLGWPCSSAYYFGDDNLRPRPPAELRVLLTRGPNAGVRVTDAWPIHYARSWAHNHGLLTDPRLRALLAKRRGWDIPRCCNHIRADSTGTGNEKPRRRPGQLGMDSIARVHVCRTLRSQLDRPHGERLHQPLTEQQRRSLGGMEVPIPLLHEHHYQQIPATSKIPIPTETWTTLLPPLPPAFTYRHPSHTRTPSTLSTAHARNTAMRPTSQPPSITAIQATHIPRPNLQQRPSPHAAAQARGKKLSKATRKRGLIGRGPPWERQNGWTRCHHCNTSQTTARRYEGGRRLHNKHAA

SEQ ID NO: 1002830 - protein, 121 aa, Homo sapiens
GRPTTHSMEWQEGTKACSMRPWEDPSAGRARLPPPFPTSHLGNWEQTHPTPFFLKRGLNPRAPAARARVEEGAPAVPSPGPTACVHHECDSHEHASTGTGVLAAENAAPEQPALLRLCAAW

SEQ ID NO: 1002831 - protein, 223 aa, Homo sapiens
YSDCLRNWQTTHVMLDIRLCNTNQYVISVTKEKSKYKFQHAILVNFKVYPVAVQLFQNGGMGDFKLQHTKTINYEISCLTLAFFQPRQFNNCYFYSTKMCKITGFISSHFHCLAIQSFQCSSIFSAQFQTQHNTPFQKNTNFRKQEHFLFTLQVAKRLGTSMFYRQDSVLATFKLLICVCAVCSVVVCVCRELAVEPQLTQTNYHRHSLAYRDTREEEEKNID

SEQ ID NO: 1002832 - protein, 134 aa, Homo sapiens
GAFGNDNQLQIISIPGEHRRGESACTSSCSDRQRELKELHRKGGPIRLTLPSKSTELTVGSFAELRLLRKPGKPQFGTSPIVIQVACADAPHHNCLRVMAAEPCGPRHVMEDAGLRLLSGTASTDARMVLEPCG

SEQ ID NO: 1002833 - protein, 516 aa, Homo sapiens
MCLPSVTVEFGMLEVGLEQSVLPREERKQERQVTKDKRKEKEEAREKKEKTKRSSEPSARRASGEERETGGAASEGGGRQQTRGPEGRTRGEGREGRTGGGRGRGGEGRDEGAERREHEKQPHGEHGREQRRRQERETEEATRPRDRQKEHREHDERAGQAAKGTKATERGSRETRGERRTETDEQGETETGPERDTREEEDERRENRQARRRDRQPRDERQQGSRSRGEMDRREKKEETREYGEQHGAREQRKTQQGRQASEAEAREKENRASEKRGDRAEMETSDRSSADEHEEPQARGSREEVTREGARAAHDEQKREAEHEKETAIESSRRRAEMRGYESERDRDDESQGQGEAKGRGRERRDEVRNEDSSEWAETRERRREERDRDEDEERERRDERSTGAREQDRTAEQGGGASKRTGEAAKKRGAEEKRRSRDGRGRATQTHQTSNERKERESEARHEERDSRSRRRSEQTKRREERGSRPRTRRREETETRRKQGPQEDEARDEGKEE

SEQ ID NO: 1002834 - protein, 333 aa, Homo sapiens
MPNSDNCMVYRKFPVPSYKKPTQVYSSKGEVAQAVTPQDPNTRGRRKGSGVNGCLTVSVNVTKSYKKLHHLAHIKTSTSTQELTGGLADCPATVAMDDPYDEGPTQQNITRHEDNDKRRTHTRDNYCRHTTPTTTTAPNAAGNTHPPRLSDQPGRRKRKADTTHSRGAATTRPQGTNNRHRRTLRNQTKPTRTRRQAKHPQQATTARPSTTNHTPPHKTAEGEAGAVTTREGKRSHTNSSRQRAGSRPKGSDTRTQRATTAATLQNDPGRPTQQEVRLDRPHAQQAKLRERSSNNETRETQTKQRQTRKGRSRRAANAEDSTVTPGRNRGGDT

SEQ ID NO: 1002835 - protein, 407 aa, Homo sapiens
NAEEPWLSAGAEHPGQNKPTDAKTESGHTGQTSRQKTVLAAGLRCPPPSPRHLRPVRMSPDFRAMDVEPRAKGRPSWSPLSTRYVWGTSCVLRYNRDKPVASPWSQREHQYPTRAIPAEDAQKFTPQNKGVVSVRFEEKMRTGTLLSTIAYPSDQGTHWNSRTIVDNSQTEKPRTRHASYTRTTKEKTIMLSDTADHERVTDLGASSTAQEPRTLDRAVKRRRQDPAQWLKEHLKVMPPHHCEQKSNGGNSAVPRRHSTAVRKRVWDPRTRGPPRPTSATRGDARDDTAEDNRHTAGRSLEAPAGTETEKSDTGNRQAATRGYRCTAQRKGGPQRNQNKRGRRQREPDGENGANTARRDAPQPATRETDKQPDASNWNDPTTAHADDDAEAQQTDAHRDDANSQNPR

SEQ ID NO: 1002836 - protein, 146 aa, Homo sapiens
QRVGVYLLCWEQPPDFFKPEVYTILNVSSIRIAEVSCCLCIHRLEHVDRLPGNWANCSHQRPLAKHSADSMCTLHAVGEIELLSGTRGSCSIAGIACPSVGVLQTKKGYGGDAGGALSSEGLDRLCASEGRYLPRGESRRMSGPVR

SEQ ID NO: 1002837 - protein, 300 aa, Homo sapiens
SVYSALYPAVMQSSLRHAPGCVPPEPHPRKPDVLRPSLTSIAAVPADHLQLCGATIIRRGARRTAITHQGHSREKKSTPEQTSQSLAYAHTTDTPQDRTTKNTETERDHNNRKHPKDEAPDQPRTGPHSTPSETTEHTDPPTETNQQKARTNEKQRKTARPHRHQARHRSAKNTGTEKTRTRPHTMNTEHSGRAKRQGKTTDRANQRERYNQQHNKMQTHRAKRGKHKKSDAHKNHTRKKRKEQTSKNSKQTNKKKHRETKKPKNHHTKKTNPGKKSKPKRKTDNTKTTQTAQKQKTHNK

SEQ ID NO: 1002838 - protein, 229 aa, Homo sapiens
DEEARGGTRPRAPKSDLSGAIVRHGPGGVMVSTHPIIQCFDVRCISVSRCSHMHQDMSEALACHDRLPRYMLAAWFEGPCENGAGPGLLVRRVSCAGSMVAEDLVKPGRFIGNQGLKQGRWRELGLHGMGWGLRISLAKERAPATYFVEPAIDLIWRTRLIGGIVGVQRTSRFHVEQGQGINTLSREPLNAPRIHFSPEEVAPPFRSERIYSTPVPRMMVMATFGLGCL

SEQ ID NO: 1002839 - protein, 85 aa, Homo sapiens
SGANLRDSPSYPDSSPEGPSEALRSAGVSERRTEVTHGRYTEHAKGDEDNSKETKTTREKAANNTGERNDKKIKQRSKKIEEEGR

SEQ ID NO: 1002840 - protein, 264 aa, Homo sapiens
EDNAGGTGLYWVPAGLRVCCSQRSERPEKEEQPVQNPRRKGTKAGANLDMAKTLQCKMKECLRIKESIDNEEQPPHEGKPASSLYSGRQEVRKRGKHRKHGHSRVEEPLTGYKKSQSSSGQQAKGARHTVQQQARAHSPQHARAGSNSTEGNSPAEQGRRARGCTGSSQTSAPREPTRVHGRSQTSEQQTGCRDNSAQLTDDYPQAKPQKKQHQQGAGSVAQANIRKPYHDMNFSNEDMIREWDNMARVEGSQGKTSKKKLGGV

SEQ ID NO: 1002841 - protein, 103 aa, Homo sapiens
MWASLSPIFAFPQKYRFKFPFPEGSLVGEGAAIRASVPSGPPWNTSAGLGDIFHTRFPCEPRLCPQHILSLGGSYSRFITDNSTETSVHFTLVDATLENIPNI

SEQ ID NO: 1002842 - protein, 149 aa, Homo sapiens
MTFFARGRGTLRVWGPINGRLGLERGVHSTGSTGKEKTHYRRRVGFPLLGASGGFEPMEVGLWVEKFRLIGGGDERANHSSSSWAELQGGDRRLGNIRGYMRGTSLNGAVKGNAFGVHIWKLAPWGLSAENGKMVWTADVFDSNTGGRG

SEQ ID NO: 1002843 - protein, 119 aa, Homo sapiens
MTKIQRNQETLHNIDCTNTDLPETTSHNLNARKLTGESPTAAYMKELSHKVASKTPIRKQTKTERTQEHPDPHIATTEKGERSRNIQRKPTEPTSNRALSDTQYNEQPRKEQDGEQHET

SEQ ID NO: 1002844 - protein, 111 aa, Homo sapiens
GLKCPLPVPASAGLQHLSCVLAEDGRDVMTGEGYSACVANDDVRHECGGQENKKRDKNQKKERERHNRIENIIEEGAVATRITLFASLCGAQSFFSANEESLLSSWRERGR

SEQ ID NO: 1002845 - protein, 127 aa, Homo sapiens
MDLRLLSVNSAPPDPPTPERGTEHLPAPQIYGGVTKPTYDPVSEDQDPLPATFKRLGLRKPGCHRGLWLAKPYGRVPGTKAARARGAEVHAHRLGEEHWYRAYGPARPSFGQLAMDDLSLQDETPLK

SEQ ID NO: 1002846 - protein, 30 aa, Homo sapiens
MGLSSTTASTEGGESWGSDIGVHLNKPCCL

SEQ ID NO: 1002847 - protein, 407 aa, Homo sapiens
MDAGAGRPWLRGARSRASRLLSVLEASPHPGFLLGSALTPARLTGLTTPHGTHRKPRETQGRESEQHNTNTTKTHRQEQRQTRHTHTQNDYQNTTTTNDTRPPFRTRQRENGAREETSTRNATADAEPSEDKQRRPGEPRTRRHATSASERSTRADAPQPSGKRPRDGERGRQHQEHTDGAPEHDDSEHPGQRRTTTRAHTHRRGAAQEDPRVHPDSQKETTRPQPATTSNDERPGARRGKAQEEAPHPAPRRRGGEAGGGGGRGGSGARESGEAGRERAEEEQGSEDRGGPDTGETRGRRGRDRTASGGRTGKCAPGGRQQRRGQRAGRRTRDKTAKTTNKKYHPPHNNTIPNDKALQLHQPPEPNPTITDQHILQHNTTPRPNTTPPQPHPQHYPHYPPNPSTPP

SEQ ID NO: 1002848 - protein, 281 aa, Homo sapiens
MTCKPDYGCPLEGCTRGSLRRALHFLRDNLLEERATQLGGASDAWLAAQMLRQRDKAAQVAAWVDGGQCVSTSIHGLNSCVPLDALWATIVGADIALVRGSEEQGVPGCRNCSWRVDPIGRRETVVHEMLVHPAFNGNPRAWGNRPFPKGTPPCNSKKNDIWDPKREKEDSLGKTRKRGNEGHRHQMGRGHVITGATGKFYVGHRHNQGTHTTRMGKQRGNRVVTSQDETPSEIAREGIVATKEETAGHTNRNKGSTQIGKEGETIHGEVDHRNVKITTQV

SEQ ID NO: 1002849 - protein, 403 aa, Homo sapiens
DCGAWLALGHLAWGGSGGPRPWCTPCRDTAECPASRTLAFQRPESVPLSVSHGPKQPYSAGMACSYPEDATAIWADRKAATSSREKTKNEIRSKNAGTAGPDLLGPQSGTAEDTGPASRKTVRTPRKAKGIPRTGDVEGAPSASNNKVGRPKATRGLGDARLARHNHGQDLGAFQCTRERTKPPTLREMTEGETTAKGITASTAKFRKANSDTPEKGKRPAYGPPEDTERRHATQQSCLTIHNMCHGGHGTVRKGGTLLAIMRQNWPSHTLGPDCNAAPPEQGGDTSFHRQALVLALHIFHGAHKKGARAQKYTVGIKQKIVGQCHQTPNGKQTATKRKFTNPAAAHIHLRQNGGTTTYRTRSHTVLTSRCTGKRGPHHHGRQLDSICREPDSLRPASANIGN

SEQ ID NO: 1002850 - protein, 85 aa, Homo sapiens
MFFTKDGASVVENYRVPYYKLWKASRIPIIESDWYSERRADLRILSAANPKRHINKSLHTPHTVRHLVALVPLPTPQPHQKNTTS

SEQ ID NO: 1002851 - protein, 317 aa, Homo sapiens
GARWRTSPWTNSVSEARGGERKDGLMPDTGVGGVQISSWDPDKAFSGQSTRTATFQQRFDARREDWTLRCPGQTGSQGCPGEAFAERCPISNQRESAGCQRDVEHLARQERPRCPQKTQPGELMPGRKISSEEECHHACLHKPTHRDRRHPSSESSHKTIQNLNMNLDEDDCWYSISRILLQQMKVEQTQAAYSSNMAGAKKDTKAEHNDAKGTQPHSQAKGGYSKECITKRIHESYHMSVLKADTEKAIGTQTHGTTGENMRRNNGKKTHHKKGSMTSIGRKPARDVKSQKEKGTKEEVKKYNRGTQQSNKRQTDQ

SEQ ID NO: 1002852 - protein, 221 aa, Homo sapiens
MPPNPMNSTQPSTAGMKCVSPLPSALQRSLRLPISHRPACLSYLMHPHLSSSRHRKRRRTSSKSEAVSIGVEATGSKAKWAEGAWGGRTHTQQHTTALQQASQKATDSKFQYGNYCKYYGYRKSIPVRMGSTSDVEAWVVSEARDVLDHGLTKVRPILDPLKHFGHCKKMRGPRYTGQWVRDLGTHQNTHGHPIPLHAPASKRNPENDSLFRKEQCDNPKT

SEQ ID NO: 1002853 - protein, 118 aa, Homo sapiens
MLSALSVLENERGRVRVSQETMSSEKRCRANGPGRAVPILRQNTFGFWFCFVHLCLDATFVPPLFSFLYPYSCFVFRTQPVPALYIDGDVADTRNYTLAVMAAVSVRTRVHYECDDIP

SEQ ID NO: 1002854 - protein, 409 aa, Homo sapiens
MSGQRSAICTLHPGADRLVPPSLHAMPNALACFACPCPTMPLDRSSFCSLLVWMTALLLSTCDAFCLLGMCSTAVDFFLVAPITMLQCACSALCAHQCAPCSVLLCLIAFSTATIPSHSFHLTPKLCASPFHHSSIHPSHSIATCTPCAHPSCSSHMPCPCSHVVPPCVIVVRQVPQLGVLAHFGWFLTNPRGSIPKSWPPQVKPYTFVGQRYSGLGHLLVPFQQGSPFPHLPFINVRKLPLQVFPPNRWRHAVWAHGGNTFAHGVGQLFHAFGQLPPFGPMWTLYTIATVWELCGPVSSTNDAPPMSQSRSQLALFFRPPKGPAVWLTGHPQRFNIVWQFQHQWCQWRIPLELENAVRGHTPLVGTHPFPGQRPFGKAPTEPPRFTSGNNCWLFPTDTGIDHINATST

SEQ ID NO: 1002855 - protein, 232 aa, Homo sapiens
PWLWVGRGGGGAEPRQDLEPGPWLCRRLNAANGRSRMEPGEELEEEGFSSVAVRMASSVEHLAAEAMAVDMDPWLVFDARTTACHMMLDAWSWPMYLIHPEVTRYGGPSVHPSSEPVGLDCMCMGRATCPKLSGTCMGLHACLGSSADQWAGHHTGYPVASSPSTTTLLSGKWLYASGTGASSWTTAWGLGICLAPSVEVPAFRLAKVGPRCQGGVGAMSICVTRTIPAVGC

SEQ ID NO: 1002856 - protein, 239 aa, Homo sapiens
MCGTRAILWRALGGWWRSAKEAGWRPGLASRSLSELVRRARPGEPALASMLCVIYHLDNPVGPDVQLAAVQETSLCPGPDPKPGSNCSPAQSVLSEVPSVPTNGMAKNGSEADIDEGLYSRQLYVSAMRQLKRLHDIHVSWYQCLRWPWAVALAKQHHPLVAVKAVTLHDQWALPRWADLSSQFYLREEEHRVKNLGRGKYRPRLAELSTAMCLSLAYTGPLVRGLLTATPVVVSPKTP

SEQ ID NO: 1002857 - protein, 103 aa, Homo sapiens
PRVRRSQDFQEIEPVPCALGNKFPKDSIRDRYLRLPGFPALSQVPDMCQAWGLSQTVLLRSFHGEGSHPTACCESPSLEKGSRPVRRNGLEFELEWILSHGCS

SEQ ID NO: 1002858 - protein, 647 aa, Homo sapiens
MTSPEEPTFDANGGSASTDLMLDNLSRLQNITNADSKRSYLALSVSQVVAHTAADEDELRLVKAYWNTATRPQHTKRLENLGTPKPLAWRKARAPRSKALESFPMEAKPKYSFDKTEPQKSLATPPYNNLMAMPSTTPRPFTFLWGTSEARRPIYQHTATWQTKRWPTSKEPHLPRPRFNRQRQKSLRSNSWGNTRHGVTFCAATHPATTFPGQPRVFGKDYLGQHNVSQRMAQPYVYNPPGQNAGPIMWFDGQNNGTYTHNTRGGTTNRRMATPIDGWRHYKTAPSLPWRTARKTHRVIWQHNLPPLDSIDQQKFNKWEKVVADSKTFIQVDNHHRLSRPNNIDTLWRIVNTPVWAVTPELSKRMQHLWYCGQHTRDRQLTRNIKRSKRAPTRRLERSTSNYKRPRVTRRHMRNHSGGVPLNGSFGPRLSPEKVQTARQRETHARTTAYPDHNGRVTTRRANTREYLAGSSYTTGLMRRGTKNRQRTQYDQKGPTTSEQQLGAELTTRTSGQQQTTTPTAERLVLDVTAQALIGAQDNNTRVGTTPHKTDRLLVTRRTAEPRGTWPTINTNRADNHTARYTHQQTPGPPGTGPADTEVADMAGRQLTINPADDMRSTPPAATEGASAAINRCENNGGRSIGREEHT

SEQ ID NO: 1002859 - protein, 396 aa, Homo sapiens
RTRGRTRWWRQPPSRARMSLPNEQTKLQHPSSKANLLADSWRRKMTCILHHMPVAYSQGHSYDNYCNDIGELPVLQQQPEQTAIHTIQERTRDSTKATRSSVTVSKPRRHGRTRSPSAACRGPSIHSQAPDPDPCGQWSRSTSRIDKSRQLPHSTANTRSRLAVAEAEDPRNNAHHSLLVHDLLHSLNNLDTPGNHREKAATHKPKIQPRPDHRMNRQRTHLAHETTPKTTLSRRQFVRGQTLGTPYQTFHLQIIRRPGNTKHPMGNYANLARTQQVSTLGTRPIEISAHTAHIYTRVPTRLSEGNVHTGPDIAERPRRRHPLTNIPGAYLDPPSVHPPTAHLCNFARGISAPAEHTRPLDMHTNPKSNKTINRVSYENAIPTMKNYRGRATIVNQ

SEQ ID NO: 1002860 - protein, 270 aa, Homo sapiens
VNDWQEDWVVSYARQRIQPQMDMVAKESGDRALPSMLWSALQLTDPMSCFRDLEIILSLYSTGDLMGWKHSRGFLLGRLIFDPASFYGHSVNMSWQYAGMSGGFEPAPFTPATTVKVPKDPGFDEAPSGCISSFTYLNHWNLLDRGYRGSSLNIMRNLVKVSVALLWKGGLRGYSTVLFWANSCFFTNARTKHYDLMAAAYIQGLAKVYKLSTQETASRSYPNVVHYMWGFVRENGTITYIARTEQKGCMTIVLTLTLTCLLKRGYLSWT

SEQ ID NO: 1002861 - protein, 302 aa, Homo sapiens
PRVAHASPTRRYFTAHRGRRGPVSCEGPGKHEGRQEEAMKGQEESPSNHDTEQGDDDEPASNQHEHGPDDKQKQKHTQATTLEQQDTEQKTNETNKETEERQYQGHSNELDENNRKNKPKDTDMTQAQATNKRRDDTETEKKTTKTHTKELQTKLKNKHSKNSEQKNTNNHLTRKKKADTHKEKRQEKQTQQIKNNKDEKKNNTKLNNNQKTRQTRTKKKKKRHKRKETATRQQARQQQNKTDTTTKKKAHRHRAKQNTTPTNRTSTMPTHSENTADKRDQTEPTHTPNNTETRQRKRRRKE

SEQ ID NO: 1002862 - protein, 96 aa, Homo sapiens
CDHGSGAEVLIVLSMLLLAGKKPYGAISHGVVEVDPMLTLEEQQLRELQRRYENPIYRFLEEDPDPDRLPLQRDQTSPLSGGAEARIPSRRGAGMS

SEQ ID NO: 1002863 - protein, 368 aa, Homo sapiens
WGKNTFIKKKITNQNIEQQNGGFKNNGKIKIETRGCGGRECPGGGTCEQGPRMTRPPREITGHRVEVQARGAAKELGERKKSSRAASGISASECPGIPRPLLSIPRGGIRARVTEPPVKNRLSGEANTHEISPPEDVAEPEDRGRERERRTHPADMRGRDRVLAPHRGPTLCPEFTRRDYGGRRNTMWCSPRRIKHHQRWGVYPQPGVETEERRPRDTTREVWDSIAETVRRAVDYTRRRGARIYLPPHIFNQSRTSNITTPTEGTKAAKALTREKVQPQHTAAEHTPRQSRFNPTGDKESNPKATTPAEQPQEAHHINDNHHKRESHHQRQSISPQEEEASPHAADRRRRTHKSGRNITNRDGSKTA

SEQ ID NO: 1002864 - protein, 123 aa, Homo sapiens
MSWKYSVHIPCVIRNLPGIRILSYSMRKRPGQDHEQQQGDWNNTGSITTNRHLTTRGNHKLQQTTTGTDTTGSKEPLKTRTNTQHLAKPLSKESSLATTNTQRRGRNRRSSTTTETQSTAITN

SEQ ID NO: 1002865 - protein, 189 aa, Homo sapiens
MHEGISIQNAARQLGTNAHGKEHAWDLYYNEAEPPPQCACPSQDLKPAHKSESHDKHKPGNKRCKHTRSADGHRRQERAQDMVLHRTKMRTSPTAPHYTRQKRRMLVTPRDKTKKNARHRGHHNTPCALQLANYAQDQTASIRPTVTADASGPPTHGHRDIPHQQTEINANQPNRGTATDTTLAHNKTT

SEQ ID NO: 1002866 - protein, 242 aa, Homo sapiens
MGSHAGEGRPWGARIVRTHGAPGKYHLQAVPRVYACAHTTPREPDAISARQRAVLDTEGRENHTVGGNDRAHYHHDEFIRRSALPRHYIMARIGEAPSSCKSRCYHNHHQYYGVRRGANWRQTIYQGQSVGVRTRTRRLERPVGAAPLDKREHTTFLGTALALEPLKVSHWAGRSNFNDDTLSAGYCGPDHNPGKRSTHTTPKHSSSPLRTQFKNDAIAAPPHTSLRLPRNPTRDNNANSNN

SEQ ID NO: 1002867 - protein, 106 aa, Homo sapiens
MSILVISLSTHKHTRRNPIYVPNTKRPSYPKKASTRRYTLVAKSNISDSPMGVILNLIVVSGPKIPKIINTTTKNQQHTTTQVTQLSVIKTMSTNTHGAPPRSKPV

SEQ ID NO: 1002868 - protein, 223 aa, Homo sapiens
HVEPNKERREAVKLKITKYLLDWAEEIFNCHLQRLLSSGASPSAGFSSLRLRPIRTLDSAVEHAEGLPGVVRCVIDERAAGPVTQSNQEGPYVVKSLPQVTTLGDAGKRADHHPTRKSPYHERSLLQVRFVERGGTIPVHFPWQPLRRTSVAKGKGSIHTLGSRQPWARPPRGRKHSPGKQFNLGAYKTFLGLFHNPPGEERNRNGAYKTFQNATQHYKTHSN

SEQ ID NO: 1002869 - protein, 270 aa, Homo sapiens
RRAMQKAGRLGSTVFVANLDYKVGWKKLKEVFSMAGVVVRADILEDKDGKSRGIGTVTFEQSIEAVQAISMFNGQLLFDRPMHVKMDERALPKGDFFPPERPQQLPHGLGGIGMGLGPGGQPIDANHLNYNGIGMGNIGPAGMRNGHGLGLWNKLKWDGMEGPFGGGYGKHGIDMDLGMNMGRIKGNPQVMHCKRGEIIEKQGEQVEVRRKATPGIEKDWGPGHLTDLKGVDRQLDAPEERGPRGHGHGIDVKHQEDSSAMRTRATRNRQ

SEQ ID NO: 1002870 - protein, 272 aa, Homo sapiens
MPVQQCGGPWGALCGPGMGNLWWLPAGGFGQWHLWAGVCVRVTGPGAMRSRSIAVGNGLRIMELDALYTNVGPPCVKDMTDQVPGGDLLVFSTVPINGIHDDSLTFVPGGPHLNGIEGISARLMAMCRQARTPVTGTQANNQGYQGAIHVWLLGGPTNGAHPFGSLAVVTPWHSNGKWGAQPGPIPMLVWAITFRVAKGTPSNSDPARLLRKTGATLGRNTRGLRGKATRRSVCSAFANGVDQWAQALAAILIGHGVSRHVSIYGIGRPKVG

SEQ ID NO: 1002871 - protein, 143 aa, Homo sapiens
MPLVDFFMRDLTSEALAGGHGGTSSHRMLNRELTTTVRNEQVRKPGLSVHFQQNSWTTQNEVEIHITPPNDRHEKITQGNAPEDPKNTSQKANNPGPTMDNRHSNNARNGRQHQTRGTDKTRRRAQRHSRHTKPGNPPTPRED

SEQ ID NO: 1002872 - protein, 130 aa, Homo sapiens
GRSPGEEFDAADSRGGRPGLRLFATIVDLTSGQSSPGPGSEARGIHGGPSRIVPKGSSGSEKVPRLLSSPVIGLLEKLLYQLLLAVGRMYPPSTTKSGAHAQSQLPVKKLPSARHANLSASIPVTSSDSD

SEQ ID NO: 1002873 - protein, 80 aa, Homo sapiens
MRGQNRLVLNLVTPNRAIPRVLRQRDFLHRASRVHPEGTLVELTWACCLADCPRLRFCFFYLLVFLLVCTRGDLFFTVHH

SEQ ID NO: 1002874 - protein, 68 aa, Homo sapiens
YVYPEQCDRPRGIEHTRCNRMYRINLNFKVQIEQLKQQNYQQASSFPPHEELLKVISEMRERNKWSLE

SEQ ID NO: 1002875 - protein, 70 aa, Homo sapiens
MSVRPRVDIVDQALAHASGAGQIGCGDASTSSFACLATCRLAATTQLGGPLVSPRPWRDPSLVAVAHMVS

SEQ ID NO: 1002876 - protein, 248 aa, Homo sapiens
MSTSVATRRTHASTSSRSRAVALFCFFGKNGVSHWSETAVVNDRQCLVYTTHYGTRSTTKAEIRVHNAGPSNGHTLRASAHNRTHHHTRVPQKKPRHKPHRRRHNQNTTPLTTPNRRPPTQQHNAQQHSGAHNNTLTRVKHPNRRDHTPHITQSEETITTSAEQQKQHYTQTQATPTPNQCDDRLKENTNQPTDQKQDGKPNTSTEDRTRNTPQQQHNENTLKTQQTLTANAPNTTTEEAQKQRKNTE

SEQ ID NO: 1002877 - protein, 311 aa, Homo sapiens
MGYVDQASSGITGSSRVKGAKAVGHPDAAAGPRAVRRSVGRRELGAVAVNGSHGTDVVVCGCSLAEDAVLCLCHAHACVHAVPTDSHVPLCYLLPGGFPPVSHNPLIQCAYTSWCVGVPTQWVNPTCPGQLELPVPPVTLTMCQPLHKYASHGNALMAGNPVQDVHFAATSMLTSLRAMAPMSPALHGSRGSLACVLARYCTTLGVGALRFAGVCHGRGRCTVCGGRTRLGTTHAYCPLARLSLSHRLLDKHTSVYTQTVIMERDSIIIAHVSRDAIGTIPKPLLSGGDPFLGLKEEPHRGYSRIDPHLLH

SEQ ID NO: 1002878 - protein, 151 aa, Homo sapiens
MVFKVPNQCLLRTDPVPEEGEDVAATISATETLSEEEQEELRRELAKVEEEIQTLSQVLAAKEKHLAEIKRKLGINSLQELKQNIAKGWQDVTATSAYKKTSESLSQAGQEGLQGALFVCWLSHHTKQLEDCKELPKLYKSFERTGRKLKV

SEQ ID NO: 1002879 - protein, 107 aa, Homo sapiens
VHDVNMSTTRSFQEAEAAVSVQIMSRALQPPPPGFKQFYLSLLSSWDDRHAPPGPANLFIRVSETEFHAAAQAGVQWCNLGSLQPLPSGFQAILLPQPPEIAGTTPS

SEQ ID NO: 1002880 - protein, 427 aa, Homo sapiens
MLGLGICRPTLSAEELLGPVELTCAPADFRGREKPCAAGPSQCPRWPVRRSRSPTGVNESSTKAGLVLGFRSFWSPDETPLCGSTKLPRGAQFPASFGPSSETHSGARVVGEPRTWGPCDRAHMIRVRTSDVAAQELNGLPCGFCPGAGRLGEFDAPRESEPETRDGARASGQEEPLRRGPHVRSFIPHGGDAKGSLSGPKGAHLEQGPSEGQDNPVVALERGTLELLLLVRRMKKPRLWGQVCALHAAPVATPLEPLPFLAQARFLVTCPLAHINPCHMCFANAAGNLWLPPFVEPQSVSRWVHAPNLHTFGPHSTLPRFATSPPGTPYISRFACRFKAHLGKGVDYTHTELVPGKHLSFDKEHWYWRGPPVRKCAVSLSGPFPDPGGTPHREVKGWERNTPSKSRRTSLLDNVFRRLRRRKLRAQ

SEQ ID NO: 1002881 - protein, 68 aa, Homo sapiens
LVRPGVMGYVDQRCLGSAWVALGWGTCGGFLLECFCAVAFVVPGLRACVTGAVVPDVPGVSLRVMAMA

SEQ ID NO: 1002882 - protein, 262 aa, Homo sapiens
AGTGLRMYLDIVDPQLSGPRPWLTHLPAILPVADGLFRRRPWGLEQIRRTPSPEGLFDKPPPEDPPAALRAQCRLSACGARTCLVRQLLGVECAAVVVPAPGQPPCQACICAPPAAQKEGAITLARRRWLYSHTVIPAPSSILSYYRKRDRPFIHSPVHGNHFTRIIPTFLPEHLPLKDGPMRQANMGVRARTVHLQLCATRDNVRQPQRDFVAYYGALQTHMQHAIRTISLVSFIELRVVFVYQDRNCIVDVVVCGPIQDN

SEQ ID NO: 1002883 - protein, 107 aa, Homo sapiens
MSTHAVGAGGCDNSLLVRALDRFHLALSGSRGPAGLLPGSETLPRRLVERVARERLVHHLQGLRAAFLGLPDRRPSGRCETPRCSGKEGPGLAELLANVASSILSHH

SEQ ID NO: 1002884 - protein, 101 aa, Homo sapiens
GSVTSASVTWGCLWGLPLKQSGMLLGSRESSLPGSNPCRVGELLTQVGAQVTVIDSRDGLGCCPGPGEQNETSGFSLEVIHGKMWYMVVMSIFLNEQCPIH

SEQ ID NO: 1002885 - protein, 101 aa, Homo sapiens
RECDQAADTYEYWLQDFRGKPPADYHGPSDLMSSHKCKKVTFLMIGNGGYIVCLMHISFFLFYWRQSLCPVARLAVRWCNLSSLQSPPPGFKRFILPQPPE

SEQ ID NO: 1002886 - protein, 209 aa, Homo sapiens
MAYVTAPRVGRDEVGEEEMVEGNDYEECGAYGGYGTLTSFDIHILRAFGSLGPGLRILSNEPWELENPVLAQTLVEDIADWIRKHLPMMTVPPCAANCMPCCLPPPTCAALGLLPAAAPYLPSVKVVASHLGGHGREVSRRRIPKPTNLRLPEAHGAHAHETNTFFFRRTSADRYVTSKHGLPPRLRKTLRHRYPDQASPGPGRLLPEG

SEQ ID NO: 1002887 - protein, 161 aa, Homo sapiens
SRAEFGTRKAKKEAPAPPKAEAKAKGLKAKKGVLKGVPRPKKKKIRTSPTFRGAKTLGLRGQPKYSWKSAPRRNKLGHYAFIKFPLTTESALKKIEDNNPLVFIGDVKAHKHQIKQAGKKLYDIDVAKGNTLIRPDGEKKGYVRLGPDYQALDVANKIGII

SEQ ID NO: 1002888 - protein, 35 aa, Homo sapiens
HEELRMHDNRIRKVPKGVFSGLRNMNCMKMGGNPL

SEQ ID NO: 1002889 - protein, 45 aa, Homo sapiens
TRLLYSSSYSYYYSSYSYSSSSYSYTFFRATLAGPCAPSNFPLDL

SEQ ID NO: 1002890 - protein, 35 aa, Homo sapiens
ARGATERAENSVPPNRPARASSFRSRRATPSMATD

SEQ ID NO: 1002891 - protein, 121 aa, Homo sapiens
WRQSLALSPGLECSGSTLAHCNLRLLGLSYSLASASRVAGTTGTCHHAWLIFVFLVEMGFHPVGQAGLELLISGDPPASASQSAGIYRHEPPHPAQMCLLFSKQIGRNTKTNCIKGGYGES

SEQ ID NO: 1002892 - protein, 111 aa, Homo sapiens
RLQKNNGGGLSVRHLDEAAVTAAILRASQCQAKDYKKKKDAGKSAKKDKDPVNKSRGNAKKNNWSIGKVRDTLNSLILDDKATYDKLCEEVPNYKLITPAVVSERLKIQGS

SEQ ID NO: 1002893 - protein, 62 aa, Homo sapiens
KGRDDRIEKREEIREDRNSRDGHDERLSKKRYRNEGSSSPRQSPKRRREHSADSDAYNSGDD

SEQ ID NO: 1002894 - protein, 55 aa, Homo sapiens
TKDRKEKKEGAEEAENGRDAPANGKAEKEENGEQEADNEGDEEEEEGGEEEEEEE

SEQ ID NO: 1002895 - protein, 68 aa, Homo sapiens
ARGESMTDGFQFEYGGQGSDPVDVAIQLTFLRLMSTEAFQNITYHCKNSVAYMDHQTGNLKKALLLQG

SEQ ID NO: 1002896 - protein, 45 aa, Homo sapiens
ARAARGGLPGLKGHNGLQGLAGLAGHHGDQGATGYVGSAGPMGPA

SEQ ID NO: 1002897 - protein, 54 aa, Homo sapiens
DRFCAGVWFCAGVWSCAVVWSCAGVWFLCYADDVLYNLTHWREYSVGPFSTRTN

SEQ ID NO: 1002898 - protein, 48 aa, Homo sapiens
MELCVLVETILSVTCINSVLAGHGKELGDQAKAAVEENPFISESTVSG

SEQ ID NO: 1002899 - protein, 40 aa, Homo sapiens
VSLLVCSCAGLSGFGASSVVVQGAKNTRQTRTHEQEHMHQ

SEQ ID NO: 1002900 - protein, 38 aa, Homo sapiens
DLEDLFLCWNDKQGFTMKQVFDHGVSLLLSKGHPVTEQ

SEQ ID NO: 1002901 - protein, 38 aa, Homo sapiens
LCGRPQHLLDSEDKALSPGSNIASGEEVAIKLECVKTK

SEQ ID NO: 1002902 - protein, 49 aa, Homo sapiens
IFLCRVVCALWSVLACVLVLRVFCAACGSMCFGGLVLGVVLCFGVVLCW

SEQ ID NO: 1002903 - protein, 63 aa, Homo sapiens
CVWFTFVNTQSAKINRIEAKEQEALVLGTERTVSDTESKLGSFELLLAVGVAELHQVARAAVP

SEQ ID NO: 1002904 - protein, 103 aa, Homo sapiens
PPGGPYGQGAKIPFPKFFFSNQEKTRNVHHELPLKKIFSKESPWAKKGKGPFFREKNFMGVFTDPAQPKKFPYKNSPELTPGLFKKRPKGSFVLQIKGDNHPQ

SEQ ID NO: 1002905 - protein, 96 aa, Homo sapiens
VVLVLVVEQWHGILSGWELLGRVGTHWLFLLAFCSLRKVGGSVLMDVQFDDYSLVCLVLQDAVRGDEDSICCLMCLMRMDATSVSGFKSMIVTEDF

SEQ ID NO: 1002906 - protein, 216 aa, Homo sapiens
LSRERSQSQQSGPCVCLTSSLWCVLWCSCRGDLYTNVTIFKKLQKPCRHAQRLTLHSCNVNPATSTSHTAHHATCSFLGFEHASTMPSQRHITACTHPALGARPVCNTSITFSQSQGNNMQQHLHPHFQDNSSFRVCRNFKPLRHFHRQQSSNSIHMHTFTNHTVYATRQHQPKANCDGFPGPGSHRPIIAHLDAVYHQQSSKLEELEWRMEYDTI

SEQ ID NO: 1002907 - protein, 152 aa, Homo sapiens
QKKLTPEQFYVTREKGRDPPFSGIYLNNKEAGMYHWVCWDSPFFSFEKKYCFGTGWLSFSEAHGRSGFDESHTGILRGLDTSLGSARTEVVCKQCEVHLGQVFPEGPGPNGQRFCINRVALKFKPRKHCPFSRVRFPCHPFRGTLNFHNSLE

SEQ ID NO: 1002908 - protein, 318 aa, Homo sapiens
GRVGRPTRSARGNPEQTDPVTPSIPPEDSEIITKHGITVERAHQSPISTLAICREQAGAERNASATQTYQLSRWTPIIKDIMEDTIEDKLEQPKHYPYISTLFLCLLQHHRRQAPAMGTGIRTRPQAKYRSGTPTSSIFHPWRVWRPAMSMRLSLTRVEPRPNGNLGGCLDRESKEHSLSQQKMWMEHHVERNFELKTRIEGNITQVKKNTDRTQSKNEGTTQKWTNKEASSDGEVATTDQTRPPTIDEEGPHIRETNRTGPDDPHKPPMATHHKVNTKDNHLQTAHAMRKRPTNTGNTKGDIAEHHTPGDRTEKQRT

SEQ ID NO: 1002909 - protein, 105 aa, Homo sapiens
AGVSPRLTLLAVRKAQCFPVNPSPAKRRGALIGWGGASSSKVMKRASSPVPLPACLGSQGCAPASPWGPRKHESCPEWKFKPAQCPPCSHSHFFSGQRNKGFPPS

SEQ ID NO: 1002910 - protein, 70 aa, Homo sapiens
KNDPHLCVFIETHSLNEQVKPIKELGDHVTNLRKMGAPEFGLGENFFDKPPLGASDNEIKPGVNFPKPVG

SEQ ID NO: 1002911 - protein, 119 aa, Homo sapiens
MRRWTEYSQLGAEGDFVSTQKLVRNRKGFWKHRKGGDEALPARVAIPSDELATVTPKVCTLYGPQGQRNSHDPLGGRPLTWRGIGKTSLRNDAGQGGIDTDIAAQQRWDTGFGPRAHKR

SEQ ID NO: 1002912 - protein, 40 aa, Homo sapiens
FTLGLRGLLPEAAQTNQGIRTRQAALERGRTPEQVYYSNL

SEQ ID NO: 1002913 - protein, 213 aa, Homo sapiens
LPLPTVLRSPCPSGIIAINDEGLFTVDSHMQSQFAQIMTCETGRGSALAEYITTDIIAYRHCDTGKRVRSRLVAYGPHIKAHTRKMRTAHYEVMPDTGNCLNGISTRHGKNRTSQQKRDQRQITKTRKNARTKRKHNKQMSNNETHNRKEAVTPKNIPKQDTQTRTDTTPRRATTQNPTGERNKHKPRTEQSTERNKQNEQHKTTKTTRTQQR

SEQ ID NO: 1002914 - protein, 242 aa, Homo sapiens
MAIFRSFLLSPLKLTCGAGPWGVPQGDEKRVEGYTFNTTLNLYHKMWRLHTDGDNFRPSLGHSQGRLDTSGRDNANFSESVCPAVYTNLISAKRHPRGKQPVCGEETRVESTYILACEPSKEHSRIISPRPRKGLSTVITLPLERQISCGRNHKITHLSPQYMRWDNTGSHAPLHRTTAHHLKRETRLYISATHTPWVVTTLHTHTVSEPQSPPHTRGGLTLHTATPHHRQRNPIRAPTARH

SEQ ID NO: 1002915 - protein, 166 aa, Homo sapiens
FLLWGLPLPTHKHQSQALPMTEGAGWPPFPPSRLSQGWSCLSSSWNAGPLSLLSPSSLMRLSASPRPLPPGGGGCEGGPAGLDCLLGAARRDGRSHIERPGPPSDEREIQGTTAKSPGKENQGPRNARQGTQRSHTADRHPKRQQRPTTQAKNRIENGHKQAHTHT

SEQ ID NO: 1002916 - protein, 30 aa, Homo sapiens
VSRFACSFRSHLSSTHSVPSIVSTSVCHKY

SEQ ID NO: 1002917 - protein, 169 aa, Homo sapiens
GLLTPTPLSWVGACLPLSAFSSWCTLLRAPVAFGLGGRAHLFQWTPVRCPLAPSDCVWVPGWWWGWWMKGRAAVVQREETPHHGEPKTVVVPYPSEPPLVTPPACTLAHFHPSNSLTHLRPGPCLALYPYPPFSQRCRLNAAVGIPATHGRASAIESELAETKQPPENH

SEQ ID NO: 1002918 - protein, 121 aa, Homo sapiens
MQIWANLHHHLPGDPGYIPSHHCRLRLLLWCLWLELNAVYPPSRGGLDWSLMAPPSFPSAGIGVTGTIIVIDMLMENISTKGLDCDIDIQKDHPDGAGAALRACCTTDAQYKFIYVAFANH

SEQ ID NO: 1002919 - protein, 206 aa, Homo sapiens
PRVVLCWEKAADASLALLEIRCTIRTQGHPIELETLEQKDNRGNLASSASAQATAEESGKCGGHHLFADHIERILAPSPMFVQLFTNRSLNPSLLPNGHCVTDSGVVYSVGMQWLKTQGNKQMLCTCLGNGVSCQETAVNPRLTVAIQMESHVSYHSPNNGRTFYTPAPQKGDRDGHLWCSTTSNYEQDQKYSSSTRTKRQHKNQA

SEQ ID NO: 1002920 - protein, 34 aa, Homo sapiens
SKKLAFIGNYFTPRVSFKNSMLWDNLLIHWPNTK

SEQ ID NO: 1002921 - protein, 86 aa, Homo sapiens
KKKKPPGVDPPQVSSSLSPEGTLTVEAPMPKLATQSKEIPIPVPFKLGAQFGGPKIAKSNENPPKYNLSPDAPPSCPHGMCLPPPL

SEQ ID NO: 1002922 - protein, 41 aa, Homo sapiens
WVCSLMGLECVMLDLDYVVADTSKDNDSSQKINSFFGSTDH

SEQ ID NO: 1002923 - protein, 46 aa, Homo sapiens
WLSQHIFIKPLKLRGGGHEAGPTGKANFFHKVLGLKALFWATNENL

SEQ ID NO: 1002924 - protein, 231 aa, Homo sapiens
VGDKGPAFWTSCRDLPCLQWRKMKGLRKRRGCGLPGPCSATREDGEFEIQAEDDARALEAGTWNDPLGYRSPTHRNATLGCGRLDTREYWCVPRTKEEEEVLEASSPIGPGVYPGCSNGIMNEAGTEFANTPNRRVIDAFPSDSYGIGKGTEVAIGRRIGAQCRGTALRYLPSQLYRAGSKTPSVAHDRGRRAPSFLLRPTAESVGRSRPVKVHYSDATVDVHLGLQRTCP

SEQ ID NO: 1002925 - protein, 178 aa, Homo sapiens
MSSQVVGIEPLYIKAEPAALTVQRVPRRQRPEPPVCPGPLVQLPTRCLPGHRGKQEAWGGGWAWRAVAVGSWCSAPLPKRLCLVCGDVASGYHYGVAILGGLKSLLQEDHPGDASKYSCPASNECDDHQAEHAGLPGLAASASACEWALLKEGVRLDRSGVGRQKYKRRPKVDPLPFP

SEQ ID NO: 1002926 - protein, 50 aa, Homo sapiens
LRHLSLTSELSVCVLHVILGLNGSVRDLGLLRDVLTLARCFLGEGGASPF

SEQ ID NO: 1002927 - protein, 134 aa, Homo sapiens
MAPHSSSLLYSILLITWLKHSNHHRTTSPCIRTVTASTIRPISYLSMQVTTRSHHLVLSNHLLIHVASFYTSSTSLSTNSKVTTLLELLLCLSTNAPLWVHKIIESSVIPTPYGKEHPKPENTAPLQNAMAGNG

SEQ ID NO: 1002928 - protein, 89 aa, Homo sapiens
VRNSIINMLLSTVLMWRQRVFIICVLTESWSLICLCWSGCNYLMFRGSCKKVASAIVPARLLMCKTAVIQYSEGSALGRVQETTDPFST

SEQ ID NO: 1002929 - protein, 159 aa, Homo sapiens
DIAFVLACGLCWMEVFNLFFFMLLRASVPLSGGAMHPLGLPGWSHSQVMAFSTTSGSVAPALSPCSLRANLTFCHAQTPESGPLTFGILVPFNVITAALPVQAQLHLITLQAPLPFHCQGQLLLVPFNVLLGSGHLCLELHLFFLQRLNLKVSGDHLLR

SEQ ID NO: 1002930 - protein, 99 aa, Homo sapiens
VVWIERDARWLLLYDLRSMSLYGVAYEKTDIEVQYTVRGRAILNSNGTIQSTASSDRTKQAEKGGIVAGLLSLLVSVFLLWFLLPLDVKIPGSSAFGTQ

SEQ ID NO: 1002931 - protein, 46 aa, Homo sapiens
EEEGGEEEEEEEYCDSEEEDGDEDEEAESATGKRAAEDDDDDYVYT

SEQ ID NO: 1002932 - protein, 99 aa, Homo sapiens
GSRVLVWCIYGVQHLVAVEEDAESEDEEEEDVKLLSISGSGLPLEVGRKVPPKKMKNLLLDEDGLTMMNEEDDDEDDWMDDDFDDEEAEEKAPVKKSIR

SEQ ID NO: 1002933 - protein, 91 aa, Homo sapiens
IEEEKNAFAEPWRYMSVYDDSPEMYETISQEFLTPGKLEIKSVELLKLHMEEEKRRSEEERKHKLEMEKHECEHLRQEMGEEEEHNDTFGL

SEQ ID NO: 1002934 - protein, 33 aa, Homo sapiens
GFRVIFAGEKMETDSNKPKNQNSFHTPVNWPQT

SEQ ID NO: 1002935 - protein, 208 aa, Homo sapiens
MPFSNSHNALKLRFPAEEQFPELSAHNNHMWQGADPQKLYAELRAKEHAERLHAGRRHPDTAWTTRATRTVMTVGCCGGATKESYEVFTGSLTTPSSEGPARRATKAQAIEHQAPDHQNPDNHSRADATNLRNPKPTLLEAYDGDADTGPASHPDGHSMHIPPSNVHTRRGQAPQAKLGRTAHRSGKPPDPDLEQATPAEARKQTQAQ

SEQ ID NO: 1002936 - protein, 383 aa, Homo sapiens
DGNKGLGCMRYEVGVLVPPLEKWDLVRVKEKGLRGTCPLPEKQRRGRDKKTRGSVTCPVPGKADEGVRDKERRGWGICPFPRKAGLAPKGEGPRQASLCGLTPLKRGRIIREVSLQVIKHQGKAAFPVRDRCRSLWAPRHKNVLLLMLSTRNLHQAIRNFKQPRRDHCTLWCQRIEQARTEHCARYVHGKRSDAQTTLTQLIAPLTRDLENLGRRPVHSAPSRWALLDGPLTAGPAGLPLHSAPQLSPEDAADLTLLTGEGSPWNPKLNGAPQSSMRADPAPARRTQATRGAYAARAPWRTSNDTPAHDKARRHGLPEHTTAHAAPGPNRAGAAPRRNTRHAHTRTKNLQRTSAVRPHCDAERRDAHRRAQRARTQRDHEEQR

SEQ ID NO: 1002937 - protein, 36 aa, Homo sapiens
MIDDFTDHRSATIIAVFIFSDDLGLHPRYELNRICL

SEQ ID NO: 1002938 - protein, 46 aa, Homo sapiens
VLGKSRGMQIQERWENTKQGRGKHSSLGLWNLKRDCQELVSWVSIL

SEQ ID NO: 1002939 - protein, 195 aa, Homo sapiens
MFVYCTSLGSALTSSVPMRGLGLSGPSRPIFGALHVFDACYSPLCLHPSIHMSPTAFTHGALKSVYPRKNHPLVAHTNTRCDTLDHDPLLLGSSHSTILVSHSAPRRTLDTVTILGLIDIARSARPCNTSSPTRRALRHPHSLPTHTTPSHAPPTSGAQPTIQLRFKLSSSPKTNNISYSGSALSRLRHMLWSRA

SEQ ID NO: 1002940 - protein, 129 aa, Homo sapiens
MEDLFLSGVLRFGLHLEARGSSAVVHPNSGIPPRVDIGLRQGLHRGSPSDPSRAHQGVTPSHKPCPSALPHAAGVWTHPTPAALRPPHPRAPVGPKTYGGNPLPWLEQTRGPSTLILWPTGLRILKTSW

SEQ ID NO: 1002941 - protein, 326 aa, Homo sapiens
KVAREAIPPQKLTMQDSSGSEAQISKTKYKNERTGIELGDIQSSIESITTPNTRHSNIATSKSFMALRQSILSFQAKTGPRHYFLPTNTQHSLPSFSSCILLQVHQSTLPCSTVRQFLVTHCNQVQLSTQQSDSGRGHPVFQVGLGSFISHNITNHSAQNHKNTTSGSHPTLSSRSIAPFSAHPFHTFPPLAQQSQLHTSFWHLISHRCRRHAASSWPKGTHFSLSFFRSEQMVSSHTLQVINIQKPQNTAHHHHTCSSLSFDNLPLTRGTETTLPYRYTLLNHGSHGPRQHHLTPALPPHSGLPIQPQQAPVASIATSFNTTFTP

SEQ ID NO: 1002942 - protein, 109 aa, Homo sapiens
MNLPEGSEQQKRRPEFLEKKGALNDMGGDVYIYKRNEESEGESAVYIKNKLRSWWRVDKTRSYTLEEGRYFVCGRGTGDNHFIVAWEGEEQKIICWEHKKLLSYYRERL

SEQ ID NO: 1002943 - protein, 43 aa, Homo sapiens
MGTIQWLERKGTFDPAEGRGLERRVRMYNGASAGEETMASDLN

SEQ ID NO: 1002944 - protein, 257 aa, Homo sapiens
TRGHGGMRDNTSDHQRESGELGEQGNKLQFRYPFQRSQEHPACRQVSRVAGYAASKRGDHADEQDGDSRFSDVILATMSATKSEMCGLKKFGTDRLIMCESMGTQHCVTAMLRGRSAQRKYSDQLIKHVCIYLFSVVSATVLQHEERRCQYLTREAKLILALQDEVSAMAAGNEGPQSPFHHILPKCKLARDLKEAYDSLCTSGVVRLHIKQLAVEVSFCRDPQEIHYACSSLIAPEGIERSLKASGPTMPAVLSDE

SEQ ID NO: 1002945 - protein, 81 aa, Homo sapiens
GRVGRANCDRYLLVWDVRWTTYKRIGLYRGPSHRLMVPVHITLVSAFHDVGYSTFNHPADGGWTVIYDLGREGSNREEVRT

SEQ ID NO: 1002946 - protein, 112 aa, Homo sapiens
MESALPPRLECSGAIPAHWKLRLPGSCHSPASASRVAGTTGARHHTRVIFWIFSKNRVSLCQPRWARSPDLGIHPSGPPKVLGLQAWATVPGLTGLIFLKKGTWIKVCKLKE

SEQ ID NO: 1002947 - protein, 64 aa, Homo sapiens
GCYAYDLFKFKFTSSDPGKHRNIKQIHAETNLSPHVKNTAGIRALPAAKVFRIRYSRFPLHGAD

SEQ ID NO: 1002948 - protein, 279 aa, Homo sapiens
RLCRWEREASRPVGCWAPAALVLPAAARRRQSAGGAGGMESLLENPVRAVSTSMELTGIVQEPCRASSIPDESVIDELERRWTDAEPLENRSLWEQTASLLQSPASDRVLVPPPSYGPDAWPVRGHTGFLAAADQGARGNLSEGPGDRAQAARRPDSRAPDRCTPRSSNATGQGSWKHATQGGGHLDKPKGASRSIRNGSAPKKASWGEHKKGGPVARDPTGERDGGTRPEGLDAAWFAREAPITLQGLTAIPPFRSLRAKGEVLSASEHLEVTGRTRE

SEQ ID NO: 1002949 - protein, 50 aa, Homo sapiens
MVLSAADGGALSLAEASRQVSRDPQSCTPTDSRFRELRKRYEGPANQCLR

SEQ ID NO: 1002950 - protein, 294 aa, Homo sapiens
MSVLAVGSRPDWWKMCKCGARYKVCWPVMAMRLTPCLWTVGGHAEPLGDTKLVICCEGNAWVPIEAGLRLHAPGMLGIFSPGLESSEALLDRHGGVIPARMRLKCHGCGGSSYAISANWCFQAPRNDHLSSDSVLPIWAVSLDIDGAMRMFRTSECLVSIDPGIASFGLDLCALWVLKRHCQTAWRGLVDHGPVTAAVSILNKRETPRCVKIPWVPCTCRDSVRTNGMQIISTRRVPDGTIYVSTRRAMILLVECSVTAIGIARVDGKKRGSLAVVRQWLEGLLDRSEESSFII

SEQ ID NO: 1002951 - protein, 42 aa, Homo sapiens
LQDLCCVSKCTSRQSTRLRLHSAQDSALLYYRASRMGYARCP

SEQ ID NO: 1002952 - protein, 175 aa, Homo sapiens
KGYGGHEPSCHWINMAALVTSPRTHHDSPPVSPIPQIPSLPYVQTLPSCDEDELISCAENHGGWCLTQPALLPQGAFRDTSFWHCSTNSLHSWLVISGGVGAKARGKAISSYERENHTETTKGTFVPATTEHKLSIQVVLIPNAMQIMSVPTKQDGTTVGDERGRPGLECSGATH

SEQ ID NO: 1002953 - protein, 41 aa, Homo sapiens
NGQAAATCPVRVEALGLLQEALDKDSGYPETLVNLIVLSQH

SEQ ID NO: 1002954 - protein, 109 aa, Homo sapiens
MALDYVDNRKPSPDAKPNRPNNYISTSDMTFQEDSIIGINIKQPQPNELASSLVLFFNQINNNLICCSPKTIGLRTPNNPASVMTELTVTPIACDHRMASERQLIQVNH

SEQ ID NO: 1002955 - protein, 54 aa, Homo sapiens
MAHLTPEEKTAVMALRGKENEDAIGGEALGRLLVVYPWTQKVSEYYEDLSSPDA

SEQ ID NO: 1002956 - protein, 195 aa, Homo sapiens
MRQREPRSKRDREQRGQARKDNESNNAERADTEGGCGEKKRGGKNAEEQTRRESKRGEKKEGETEAGKKGRKTRAEESRGQKQEETLTEQNREEAQTQREEKRGRSEEKGGEEREEEGKEEKGRGGGRRKRKAEQRREMARECQTARQKSAVRGEEKDKERRRRGTKKEKEEERDSREGQESKKTDKGGEEEGQR

SEQ ID NO: 1002957 - protein, 219 aa, Homo sapiens
MLARRQRLQMTLVSAPGTGQPGGFPKPGRSARGEGEKGREGGGGRAKRESQRLLVLLSCGWRPGQTHAPALAACGRRNEAHPGPRGTGRGRPVCVKELNGLKTAQCGKVQGCRLRLLQKRASKQFSLNMDVWKAARGPETVGKQRDLQGQGTHSGLTGTGSRVTRIAENAKVPQMDGPNRGPTTKEGGARKKSNGWKRRGRQLEENPKDNRNARENDQI

SEQ ID NO: 1002958 - protein, 315 aa, Homo sapiens
SALVLVKDPGMANVAQAGSNPGAPASASQNSGDGEHLEPPHSAAFYIKSRDGVLSRVHPGVELQGPPSGLTCSLEPPRLSAILPTSSLSSSRDYRVCINAQTRPHLHHCISRQHGGTWADDPPKREETPRGAPNNAPHRANHQTPQGAPTVNLHRALKMIPKDKGGLQTGGVRPTQTPGIVETDTIVGKHKGGISHSGWPPGAGPRKNPRAPHRKNASQREGQAPKGCGDHTPWSPRRGHTQSHQRAPSVGAGPTPEEKETAPERIKRGKETAQRDGAAAVENPHNSKRKWPKQRGAPGEEDKDTTLADTHKHGE

SEQ ID NO: 1002959 - protein, 102 aa, Homo sapiens
ETESRSVTQAGVQWCNLSSLEPPLPEFSNSPASASQVAGTAGRHHHVRLIFGWLLEMGVHHVGQAGLKLLTSNDPPALASQSAGITGVSHHARPAFLSKGDF

SEQ ID NO: 1002960 - protein, 289 aa, Homo sapiens
PRVRMSCVPRPLLTLAQSPPRVSAAAAGHEPCTRRRPPEEATKLRSAADQPQPMACMTWPSVFRAPMLVALCPWLQALQHLADVLEGDSSEDTQLFTLCCNRGTDSANCRGGSERTPSTDPFAQRTINLAGPTGPDADRGMVHWSIILQRLKGGPLSLSPVWPEAAQKSALRWGASEEVDHRIQTRCQPDETITRDFPTMDNIDPCSITHRQIRHQHRNVYTPWDGMYAGRHWTSHKAEIKVVIRNTACMEGIHGKWDNSQCTHDRRYDSTARDPNVINKEGRSDDMYI

SEQ ID NO: 1002961 - protein, 259 aa, Homo sapiens
PEPSVLSEVTKPPPCLENSSPPSRIPEPESPAKPNVPTASTAPPADSRDRRRSYQMPVRDEESESQRKARSRLMRQSRRSTQGVTLTDLKEAEKAAGKAPESEKPAQSLDPSRRPRVPGVENSDSPAQRAEAPDGQGPGPQAAREHRKVGQDSWTGAAEGDRQRKPGETRTQRVPDTPEKGRAPSSRAGQAVASGDLRPRMLRPDIGRARRTAEDRCMQELRKGDRSGFAEALTEDHAADGAAPGGAGRDSKGRPLGDK

SEQ ID NO: 1002962 - protein, 184 aa, Homo sapiens
MVTPAYRAFYSVLPVVSKRTLGICRTRNRSALRVLEPHCMAACAWDHTRGLGYCPLELGDSCTQMTFLGRHHLNSTCSELNACVDGRAGGFVGLPVSLRPMCGSVSLSRREARAPRELPGCDAGRPFVSVELCLLICTCDKAPPFLALRYFYPLFTAFEVHCWTHVRLVYDWQVALKEMGCDCE

SEQ ID NO: 1002963 - protein, 156 aa, Homo sapiens
MCVNKGPTKCVSWGHIRGTSFNGGHANTYWRAPNTINSDEASPRRETTPSPVRTIVGPLTTRRRMMPLLLQTSNTQARVLHTLCCAAVLLPHECCSSPNDRRKSRKKKHPQLVALLGDEIYSSIKNTLLKAHKGWQQYYHTYTTRRRLRARGTLPI

SEQ ID NO: 1002964 - protein, 214 aa, Homo sapiens
APGAADGRSAPARVPGVLDRKARMPVHPTATTQLKLRIPGPRNGVLAVRLDRHTINHHGQQVADPRSSGTLVAVSSKYPRRVGLTPAWTTSSQHYGPCDPTLSEPNTLLTGPARNHARGPRPLARAPQTRMERITVTPHNDTFATTGGIPFILKNHPPNLTMPCLRHPHDDTTRSPAAITDNRPPEECWRYGKAKPTQNPRDPTYAQLPQLGND

SEQ ID NO: 1002965 - protein, 75 aa, Homo sapiens
DKKNKDKKKKKGEKEEQEKEKKKGPSKVTVKAMLEALAKLKEEEERQKIEEEERIKRLEELEAKRKEEERLEQEK

SEQ ID NO: 1002966 - protein, 148 aa, Homo sapiens
MAMLRIQPEAQAKVDVFREDLCTKTENLLGELFPQRRFLSWMHLYKKEPCFSMKPSLSNCEWPRLVHLAVPVTYVNGRNEETQDAERRACMDERNDKGMKHERQGRGLNEQKGPSRVGPTLNLSTDNTSRWIRYCSRLERAEDQRTVT

SEQ ID NO: 1002967 - protein, 267 aa, Homo sapiens
MRYSISHRVDALRSVVGRDRFTAAYPYTVLGDTLIQTVGVVITGKVRLRSRNSKAFGVGVTYRSLRPHSEQLGQDRARILVAVHSNNNLSEHEYMTSDRPMQRQQRSKDARDCPPMLLTEPCDCRDMKSFHNAKWSHRMFTFLLELTRKPKIEVLGTTSSKISVPRQVRMHAHCVSRVIGWLRRRCSAMGIESGIKRHIGNVIRPQWIAIDCRPMSPLHKQQARTWQDVCLHPQDNDLPKNTNTDRTLCKLRKADAPSKGQNRRNPQ

SEQ ID NO: 1002968 - protein, 97 aa, Homo sapiens
RLRWQIVSAGGGVNVKQESNYEYDGFQLDARRVSIGNFEKQRLAFHTVRYDFKPASIDTSSEGYLEVGEGEQVTITLPNIEGSTPPVTVFKGSKKPY

SEQ ID NO: 1002969 - protein, 149 aa, Homo sapiens
KILLHKSSINREGTRLRSRMADCISIGHVKVQMAASIGRDSSQVHPLAVLLLTDGDVHIRDDGRRAHHRQLSDSDLLRLEGDSRTVRLAEQELRRALGRMVERNLRSELAALAPQRYYGGARCKLLLRYVCMSMLQRTTCGSFDVRKTS

SEQ ID NO: 1002970 - protein, 94 aa, Homo sapiens
MGGGVGQAGLKLLASSARPGLASQSNGIIGMSHGPIELLSLSFVVDADGLWLNKNLDFEEPVTFEDVTLGFTPEEWGLLDLKQKSLCRGVLQEE

SEQ ID NO: 1002971 - protein, 68 aa, Homo sapiens
QQGGITLFMIETVQISNQAGVTPLRHQKKWLPYGYIGNSIIGFTISLLVFFRARTAFGFDTFAWDMTN

SEQ ID NO: 1002972 - protein, 78 aa, Homo sapiens
HASVKLEVGCGNGLGVIGDERDIEDIMKPVNSTSEKDTAEREKRYLQKRLMFSGYGLFFWDEEKNVLELVRGVGCAAS

SEQ ID NO: 1002973 - protein, 815 aa, Homo sapiens
DAWALKSSLVTGRASNTERIYWNGWSPAGTDKTYHQTSGYTRQPSGTGILQSSELTQDACDSDHHKHSAGPQMNLSQLLGTRLTWLSAALTSTAFLQAVTLHRARLTLTGHDYLARADSVLATQRQKRDHDLCPKNKHSLSTTPEATSTTVTCRVQRINKLATKRQRKTLYTIIVGAFHTALTAHNIWTRGQFLRPRLVVHTPDISTAQIPVIQRITNNQRYNLSREPLLRPPSLGHTFRRAYYQLGDDNLCNQHSSRHYSRPHTATLNPSGGHLTNTSIPIRRLTRTHRAGTLIIGPTHQIIDRTELMRHPPTHMCATIVPPKPTTVITPDISFSYYYTAHNKARGHTLASTHTTVRRAFTLNGAHNQSDKSLRHNETSLQIRHTIQTMHSNSSWAVPDFPHNRAAYQIAALYDRERQPHVINRPNKDYYWSAQLLSHRNAAFYNADPVYKTPQVSYLPPANRDSVEHSILNSPVGGNTPLQSIPPQFTNPTTGQTKLLGPKLHKEEIMESNIGHAPPTSSDKTHLEGEHKRETTPKEAHRTTNANSGLIPPQPMSADNNQHAPPKPVRQPAQNPTVEHAHHARNHNSRAYGQPHHLTQQHELGFNQKEESQPQEGEKRIPKPPRNDALSGKQPEQHAHQLVTGKIRSYSITTLCCRRTQSPTRRQQGQKKASTTPNNQVGASHQEWYTTQHRGGKETEVGYDTNHSQVISPMIFTADAASQHKQPRTRRTALMMSKHHHFRHTTQKTITNSPIEQQHRYLGTTRQQQPITNSPWSIMDDPPTSFILTELEPHTRLGAASQIDPHTQFIHHMIV

SEQ ID NO: 1002974 - protein, 236 aa, Homo sapiens
HSVAHASAATISSVSAGPLALRAAPPASPGSPGNGRHRNTGARWTASPWRSKLRCQQGRTGRLPYSHNLYLAWSPRDGGSGEIPSTRHFHFPRSHHPQHHACLASSRPLYRYSAFYFPAIQELRAIELVEHGDRTLLMRFRPFHTIGATQQAHNGALACYLLQHTVEISTLPRSVRVAPLARACKTRGAWATSDGKGPCRAAGLKRASLVQGHDCTQLQNSTWTPTHAVALFNPGV

SEQ ID NO: 1002975 - protein, 214 aa, Homo sapiens
MCVLCQTADRHVGCPTNERTRVFPPPKWRHQYSQDIGTRALVWGKPPRGKRTPSPLRSINPPPCGPLLFLREKMPPSGFKHTLSPLLKPRGELFTHRPKRQRREFSVFNTRSFSTHPRGLAGGAAPSVGDGGAGRAMVVSPLWCRPVGMSFFFSPRDIAGTHHPALARVAHNTVLGRGPAFTRRAGRSEGGLAGFPPITWGVPHSLAVAPDTGL

SEQ ID NO: 1002976 - protein, 67 aa, Homo sapiens
PEHTGVLLLTDAKSTFSKTGLKAGPQRQQDTTVPFFGAKRRVPGKFKGFSGEAKGPNNIVNGRQRQE

SEQ ID NO: 1002977 - protein, 235 aa, Homo sapiens
SRSAPPQSQLQLRGTEPCTRRRPREEADKLRSAAEHNARPWVACSMDQPVPCPVTGQPWIHEAQASMQHLGRCSRKETAQKDLQHIFAMRISGPTAPTAGRCSAAPSTIPLPPPRTLLDTRTSPHGLCMGLIRGVQRGHISMSRVPSGGHEGAVGSRGQCGVQRVDTEGPLSRGIPARGQLARGGYPQERYGTKPNGPSPWAGYTPKPRSTHKDIHGYIASQMTKRSNDTGALDR

SEQ ID NO: 1002978 - protein, 57 aa, Homo sapiens
RFTPRHMLLAVANDEQLTQLLKGVTIASGGVTPNMHPKLLTNKRCSKGKLEAIITPP

SEQ ID NO: 1002979 - protein, 342 aa, Homo sapiens
RDFVGQEYRPLSRHTNISLIYGPSIQEDSQLTVLDIDWSTVEDINVLWDGSYSFFRGQTQANGDRVAPVVCPGPMAPRYQMPVDIIRSFAHKKDVNMALRSLSVTFEQVPMDRKTSPGSRSLQLAKRSNKKGTQQPHSKAHSTADGDVDECDLYATGPVSLEHSCIRTRTHGNLYSETNTTIEDRTRPRDQGRIDNGQYQAKSQSWTIEAHFLAQRGIDCECQAAFHKHCGGPWKTVRAVIPVHVADGSVHDLCGILAFERSTSENNGATAMEFNYDAADRKPAAGLSVFTEAAKVNATRFHGQIYSVKVVATRDKLAGNTDTMRQTGDNLTRTASPAAVNM

SEQ ID NO: 1002980 - protein, 233 aa, Homo sapiens
MSSCMPPGILQWGRQTTNGEKKVLLPGHSFYQFKLAKYHYATHTRLDPAFPSLSYNFWQFQSVSRLPLVSKESSALGLKLPTHTTSARHAQAWTGRQPLTHAWAPGQRGPWHALNVSTACRSEVNLTPGPPRATAPTPPDPPQPNNRLATPKAKTTRSQPVPSPTCRALPPRHCDTLRTRPTHVPKGRAHPPHDAHGELPTTAHTPRPRPATSLPGVTHARPTRTHGPPQHGP

SEQ ID NO: 1002981 - protein, 47 aa, Homo sapiens
MSGRRKGRKCSMNGGANRHLNVLCDNIHGITKPDIHRWALLGGLKRI

SEQ ID NO: 1002982 - protein, 110 aa, Homo sapiens
KKLIPALMDDFEELRMSVEEVPADVVEITRQLELELGPSGEMKLLETHDETGTNRELLLMDEQRKYFLEMEYNPGGDAINIVEMTTKDLEYSINLVDKAAAGFERVYSKF

SEQ ID NO: 1002983 - protein, 421 aa, Homo sapiens
RGLSQWRYCKFHPEASDGILVSAAGTTVNCWDAAKQQPLTELAAHGDLVQRAVWSRDGDPGGHGVQWTSSMRIFDTQNKAAGPLRARRPMRPPQGEPAGHGWATWDAPCVYWIQPDDVSDEVKLLWTRRYITPDALSTPSPWTPSLEDVLVPLHGPLTLGSWSMDRKGREASCTMLRRESTHAAERLAQDDPDVIPGQAVHAHGSMHPTHAHRHSATYAASMNTRPETPPRVTNEACSATHKTHPSTHTTATQSRPPGKGTRARTTTERETLALPRDHPRPAGMPSPMTNRNHPQIDKRHEHQEAHNTHTTVTHNNGTENDGRRHELEGRRQPNQDDGHTTTSNRTTEVETQYQEAPERQRQPTDTRPRQAEHGSTPQRNRRRDPNARGRTGHTHAEAHNQPPTHTAHAHPHHAARRQQRA

SEQ ID NO: 1002984 - protein, 109 aa, Homo sapiens
MFARNLRDDPVRYPLRVSGQRALFPSNVYLYLYTLWGDLYSWAKGVRRLRTIDVAFPVLMNIVLHVFMGVELLRVGFSRQARAASDISQEDEEVVTVYLIEGIQLKNNV

SEQ ID NO: 1002985 - protein, 491 aa, Homo sapiens
GAAAGAASGSAAEPEGAARLPQDTRTPEKRQWHQKSTMEKIRNVLKRGRDTANIRSGTPCAYRRRRRPQKKGLERRMQGTHQETRAADVHEDEGKSRRPSPNRHHRAGYRHQTHPQNEARPTQQNASGDRTTTITNRPQQANTTYGEKQDDTGDNSTIAQREKLSRDHKRTRDTTTEAPEAPQKWTHTGTQQGAPNGNFTERTQPSHTRDEHETHDHPEEEDTHEHIQHTLTNVATHARQRGHHPNTGPRPYTQKRKATNRDTANRHYTTSDTRAHHTTEDKTTPPRTTNPTAHARRHQQTETSHRLGTTHKQRARTNPEPIKAAKKEHSEHQRRGEHTTHHNGQQPETKPIAVTHDNDSKPHHRKRRQKHGHKDRQQTAGSTENTKISDSTARGKNHTTERGQRAEEGLTREPAAEEDEEDTDPAETEREQASTSGGRGANGRRHAREGTQRSGREQRRARRRAGGDAHDSTDKQQRRGQREGHATQASA

SEQ ID NO: 1002986 - protein, 58 aa, Homo sapiens
EADHSGYAGELGFRANSGSGTRLDGKKKGVQPIRSAIKPGDIKRGIPNYEFKLGKITF

SEQ ID NO: 1002987 - protein, 146 aa, Homo sapiens
MEDGSDDMDTSVEDMVVVHVITRFVRTLLLIMEHGVKPHSKHLTEYFAFLYEVCKKWVKKRANFAFIAMLYLQWYMFTWEQKDLKNPQVEVSSEEEGDRRRGRKKISSLWQKKNYRPAALENDDSFSCSYGLNSLDSDKAFDIITD

SEQ ID NO: 1002988 - protein, 70 aa, Homo sapiens
YVGVFFLLPGPECNGAISADRNLCLPGSCNSPASAFAGMHHYALLILYFQQKLGFSILVRLVLNSQPQEI

SEQ ID NO: 1002989 - protein, 209 aa, Homo sapiens
MPVRDPAPSPGTRPPRTTTSGCSVRVQLWAGGPAVVRGRQCRGLRLPRCQVASRPAVGPVAGGPVYPLVLQPLGCLATAVTLGVAAEARCGPKCTRSPPTLGMTVLEALASTDERVKQPKRACQQALGHRLTGWPWPLGTWGSRRTHKAPGGDPGRRKELAQRLKHRIGAKPRRAFVSALKAGSLANTAPPGAKWPGPTTQRPVKWTAG

SEQ ID NO: 1002990 - protein, 326 aa, Homo sapiens
THAVRNERILNSCTDLMKVSGLCPGVGLHLEWPPVIAVLVSAVLSWLLVTDIHCLQKADRGDAAVVMGAWLAACGTVAQGSLDPTGLVPTLWPLRTSHTHVPHGSASWDCALMARSDVGTMGRLEGPLSHLLVSLELAMYLPLFSPSDHYVWAAHCSSDIYAKNSALDRKASSSDLPRLCGLRSHTAWWSAADQGCVPSHGASSRRSSIGPCFTTEIADQHWPHWWLAFQSVNGQAKHKPPRWDRLQGTVLATGQLRGLPMLVASHQVRPGPQYEAHENAHGLSSWTWSPHSSMTEARAHLSSRMHVLGSWPTQLEADPTGLAERG

SEQ ID NO: 1002991 - protein, 277 aa, Homo sapiens
MSHRKFSVSQIWWSLGLPVLGSAAAGIVEKVKSFPKDDPSKTVHLTGFLGYKGVHESHRAVKSDHGLEYPVVNNEGGGGEAVTIVETTTMVVVGTLCGYRGITPRRPPGTFHSTCLLPAATIKLHRIAQQGWFPYSSQSRRSRSYTKKGPFYAKTLTLQTVTWARRVHGTGPKQRQRYRRKCEAMHARPMYTDRIELAPKAAIPRWLQLCPNSTLLVIAVAVTLTIIVRPESAAPVLAERLPFVHASPRACTRRQGQPWMRPRKQKTFGELGRRPAG

SEQ ID NO: 1002992 - protein, 50 aa, Homo sapiens
LSRLSGPETTTEEMPSLLTSTVQVDSDNLIPQIRHKEYPEEMPHSPLGSM

SEQ ID NO: 1002993 - protein, 284 aa, Homo sapiens
HASAAAAPMAAVASGSSGPKAGAADKSAVVAAADTSLRWQMTHHPPSCRNNERYHTVSPSTRCLLPGPALHLPHTHSYLAADGGSWRWQHDMGARVSLTRPHAVHADRCLHCIGQSGMTWLDGHARWTKATLPQTHKSRVLWPDLLQHRHRAGPRQLADEGQPDAAASYGPRPTEIPEARGAASIVPAAEEKGGIAWPCTDNGRAVAGDRRHLNGASPEFTPNMGRYTQIKHKAVFNFMNPPSRMEVPVARETRPEPGRGPGLRYHQCTGNKNAHRTIQNHGTK

SEQ ID NO: 1002994 - protein, 137 aa, Homo sapiens
MCCDVGRCDVWEIVTALLWTHTLPEDSARVSCTIVAFQAGPYTACCIFITSDTGCTTSSVWSHERTGHAWLCMNEPHTAPVTIQMAHSETQTGTQPMLQESRSSETKTLSSLIGDTSSMAAKEPRRTRGPCCYGGKR

SEQ ID NO: 1002995 - protein, 61 aa, Homo sapiens
MCLGHFSSFTGKPGGKDCFNFSGFLFVSDDQGVKGSAASNFKLHVGLIFLDLDRFGIPSGG

SEQ ID NO: 1002996 - protein, 353 aa, Homo sapiens
VLTVTAASTAPNCIRLHSHVRTDAWWTRIGRRDGGSISRVGERIVLQKSGGKGRERARDVQSPGGPPEGNLVDPVYASRVIGQSAKAVTSRPRGPPEGTSNKILRWPVSRTGGSVSSYGMKESSRLRYIRRNVSGKDDAMNCRRVFGRHELALRIHHVIPSRAGSATTTKLARKRAKIRDENTGASLEDLELAQDRGELDLYIDGRAHLKMGWARYLGAVATNVVAGGKWCLGNRLEAERGILAEIPFRSQKYLDSPTVVETSSLYGGSKGGSKGAVGVARIPGTPEGHLEPLLNPSQDVGPLFPRKFGPKDPPEWHSERRKERKLDYNGSNDYQAPSKCGVCGIGPWDRERP

SEQ ID NO: 1002997 - protein, 39 aa, Homo sapiens
EEGSDDDETENGPKSKKRRPPKAEKKKAPKPERLPPSMK

SEQ ID NO: 1002998 - protein, 248 aa, Homo sapiens
MCVSVTVRRRVPGCEPRGGVYPNDSVTHVRARVCVCARRGESPAPLLPFPISIPLSSPGQSASPSASSPSIIEETAASLQSHQHPAPFRSAAQRPLGADERGSQGAVGAPGGNGLMTLAQARQEPGRRGPRGERFAETDGAGGLSQSFAHRQSRIRSVWLMLIMIISVTSGQAPLIMARGGVRGTGVPRQMLALCYYLSGTPLQVPQAKGKIKSCAELNGHVDGDQDEDPGEEAPEAYRDDQWVDNNT

SEQ ID NO: 1002999 - protein, 44 aa, Homo sapiens
MEANGLGPYGFPELNNDTFVLAAWGEETDYSPVWCMRQASRYLP

SEQ ID NO: 1003000 - protein, 370 aa, Homo sapiens
VWPSWSPRPSAVSVGGDVRRELTFCRTTGLRGDGNRGEYERLHVPTLHGVTPGVLLQGRRGAGPDSPCVCTSLGSVPLEPCAHEDPGGWATTSSRSTPGAPTFACTSPSIAQKILDATALRAIPRDVRPPLQTAYPCGPHKGLVIQASQEEQKEGHGAPGPPGGHLQGSHGPQVQAVKAWNEAYIPQTQGPKATKRIVVSTRGDSILTSGRAHSKDGAGGGSEAGWAFQKTFDEAHGSGRDPVGHSIHITKLRDMHVPHCGHQWNETVEMSQPQGQGGTGKGTLVGTYPSSGGPQGGRSKATPWGSRQSTDGEERHREKEAPYGGAQYEPSEAMAREDRDRTRGKAPNKTDDPGGSMTHRNTNNTEPGHD

SEQ ID NO: 1003001 - protein, 322 aa, Homo sapiens
NNNMMAKTLEECRVTLEGLKMENGSLKSHLQGEKQKATEASAVEQTAEQLRQFQQHVDTVARSSRKIYWQLSCKGAQHEAIHSKAKRCNIKPCFQVCWPRWQKDYSYLKADHVITKAEPAVSRTSLQAASKHRHPEQCMQRIERHERNQYLTLARSVWQQHRAVKLHNNQLISELNSSVTQAGGTGSQDLERQLKTLTKQMKEEHEEWQAAQADLQTAEVVANDIKCEAQQELRQPVNDVKPGVGASDGARNGPGMQNGDCGGNDCQGHKGKGWEPKETAGHRTTLAASPQQKDHVKDRKEAGTDGPGAHKKAEQKTRRHEE

SEQ ID NO: 1003002 - protein, 246 aa, Homo sapiens
MSSPACAVAYSVHFRSSRTDPFSSNTSWRWRPWSLTPASEGTLGKTKPRHFLEPIPHSTPTRTATPFLAPTATTHPPSPHTSNSPHTHPPPALPHPHDPWDSTVLRAWGPKLPGPLACGIHPRAPTTPHQGPANAGHPGKDTPRRPNIGGDVSPRCATRGIPRRRHTATFPANPKHPKALALMAAPPITAPQPRTGPATHQHPPAAGIPMPVHPLQPPRGLPPATTDTPHNLLQARPQPTSPGHHG

SEQ ID NO: 1003003 - protein, 101 aa, Homo sapiens
GFLSSSLTIQFHKKIPFPLKTPIWFSPSSREFPPRGSPLLDLPWVWSPIAFISVPVYTLASCSQFAAQSPPPFPCVGPTRGSLGKVLPQVCLHSPCQVLLL

SEQ ID NO: 1003004 - protein, 286 aa, Homo sapiens
AAAARRGPRGGAGLRLPRPRCPAPPCLGSRPLLPSSTAAENNGQPLLCGQRGGPGGWQQLAVWGTGTLGWLRVPGEAMLSGVGLAPGVGGWRGAPGGVPLSNAGLPYCRAAANGDVEARWCPGNAFLRGTFFDCQLGTDLPRLNRIPKNCQLNLGLPKPWKPGGFGLSGRAFQEPASAINFSGPQSSLLSCPKRDIFNSSRELSVAPRLNLPALSGPNFAKQKVAHQGATPGALSRVAKRPSRGVKGDKGNAKRWEPLAKEVYARAFFNTARLARNGDTFVKTRAV

SEQ ID NO: 1003005 - protein, 233 aa, Homo sapiens
SDEATGPRSSSPASETWGAVVGNSPDRLSSTLSTANYTQFYVARKTPNFYSHKDRYHDFKFHAEPSKAEDKEDECAPSCNFHFPSGDLMKAMTAHDGPTAMGEQGHASRHAEPAELQIPRHPSLAQKERTVAAIRPSRVTRGPVQNAHAAGQPGNPKRPPSVILVPFLHEKKQSPLEWPSLAIQGNKARGPPLSLPIALGDTFTNRSGAGPQATWLPPNAREPLGAFKGHTRT

SEQ ID NO: 1003006 - protein, 40 aa, Homo sapiens
IDTPEYYVTGVASVDLPLQAIMKGLILKTWHRLLEAQNRH

SEQ ID NO: 1003007 - protein, 305 aa, Homo sapiens
MADDAGAAGGAWGALDGPGMGNRGGFLRRISAVSIRGTGVADVDVWTEWTDVTEELAGGGKAEDKEWMPVTTSLGRLVKDMKIKSLEEIYLFYPAHYGNQEIIDYIPGGDLISRIEGFEDYAQCKKTDPMPGTDATKVQRQLCCISRDYTIGHGSGHEGVKSSYHRTGRATMTIRRGPIHTLGQRSSNTVPTIAGRQATLRRKTKIQAKPHYKYDHICTRDAQEPCFDGNPCMALGNDAYKYRCKPSGDTWAFDTTRNHNVALKGKDIGTTGEGLRNTNNIENKHPRTRRGIESVDQPPMKGETN

SEQ ID NO: 1003008 - protein, 504 aa, Homo sapiens
DSAEWNKAPIPTGLLVAELQVLTHDTASLTKQLCARTDCNAQSALPIFLCVLMCPLLELKCPLSLPLVHRCHKLKPEWQLHVIQCNICLSLGSLPTPWPSSNHPKPRPNHQACNTHNAGPGLRAHTPHTRAALIHCLVAHPCEPPWLYPTRHYSTLGHQAHTHTAHLRRIIFSPNPLAHNATLAFPLRPRTGIFYDPPARFSHSVGAKMHMSAGWQPTFRHFPGPLTSLFSTTPARYHTEFPRNTAASWHDTYGNVSMDRVPNWINPHFPNQWLQTMSSTRRSPLLITTWTVESKSPPRCRAVQRSRTRLLFVTDPTVTPFSRYSLSPTASLRRLGLRVTYSRFAYITGPNTLYTGHTRMRITPILPTRSSSFFITPILSQPPEHSPLSAPSALNQTAIWSAQLRVCNAHLPHLSSHIIPRLAAHNGSAPHALRYHLASLQPSLICVSPLTLTSVSDLHISPVLAATNPYYFSVNNPALGCTPPTPSSYFPTFVSSSRMRPSRN

SEQ ID NO: 1003009 - protein, 332 aa, Homo sapiens
EFHSVARLECNGSLLQPPPPGSSDSPASASQVAGITGTRTTPGYFYLVEMESHHVGQAGLELLTSGDPPTLASQRCWDYRHEPPGRPQDFILSLLALKQNKKGFNYSHFPDESHERCLLVEYQGLGLCFLVDTHTWSPSNGPFLKLPENTNMARESYDSTGNGTPSASSRIAPRRQWRRPLGHVCTCRLLPKHGYSLTRVAHTPMADRPTHRPQPPHHTPTPPPHTPPRNARTKQRPGRRKERPDQPGPPRTGDGETPKPGAPNAFAIDASASGTRGPSYERTTEARRSIGRISRPLRRTTTRTCRSPLHQGRHHESKLTKPRRHARAYALP

SEQ ID NO: 1003010 - protein, 134 aa, Homo sapiens
RNSERLLDQLDPGAWLLSGDLTATRKSKQERQPLRMQRPGGPSANVSKVRNPSCQRFASEPREDETSWSSEAPALALPVTPQKEWLHMDTVELEKLQLDPVTCLHCLGVQHDTRTWMHGSVHVFRENYWTLTWT

SEQ ID NO: 1003011 - protein, 43 aa, Homo sapiens
VVVAAVLLLASRCLVCQRSPWVPGCFRRGTVLTVGLGCQWERR

SEQ ID NO: 1003012 - protein, 59 aa, Homo sapiens
PLLLSKAFCLLGLSCSWWSVLEHLCSCQFHVCPLETSFNVINSHSSSLSSGSFQHVWAV

SEQ ID NO: 1003013 - protein, 34 aa, Homo sapiens
YTHLSLTCRVTHLASSRKHGGGFGYPRSTFVLLV

SEQ ID NO: 1003014 - protein, 78 aa, Homo sapiens
VWAGKSVHLIYGSRKAVSQRPKQACLENIALYLTHMLKIFGAVDEDSSLGFPVGGPGTKPQVSRPHVMPYLQVSSRLP

SEQ ID NO: 1003015 - protein, 63 aa, Homo sapiens
MRAGMIEKLVKEGAPGALVDPRSVQQIHQLRGPNANSIKQMLLHVVSEPRTRGYEALSTSENF

SEQ ID NO: 1003016 - protein, 49 aa, Homo sapiens
GASVISKNSSTSERKKFPSSSSSSSSPPPPRPPVLSRPNGPPMYEVPEH

SEQ ID NO: 1003017 - protein, 33 aa, Homo sapiens
AGSYGCAGNYSGSLLALSGGICDLNLKIPEINS

SEQ ID NO: 1003018 - protein, 45 aa, Homo sapiens
SEDPRDTGEDAGIWEQWKRVPTLGWDQPLVAVNSASRIPAPRVPA

SEQ ID NO: 1003019 - protein, 44 aa, Homo sapiens
MRKFKALISIARRSVMMIIAIGSIYRAGVIITSGRRPMIRIRNH

SEQ ID NO: 1003020 - protein, 51 aa, Homo sapiens
MRSRCSGLLSLVRARLVLLVLAVLCDLVLRQPVTRLYTVPVCPGSPGPRHT

SEQ ID NO: 1003021 - protein, 56 aa, Homo sapiens
MDQRMKISRPKLTGTQPGISPKEQGSSMGLSQGLTGDFDRIGATGTSSLRQQGYRS

SEQ ID NO: 1003022 - protein, 41 aa, Homo sapiens
MLVVSDDLVMDSAPGSWQVILNLTCDLPTLAPKWWDYGVKH

SEQ ID NO: 1003023 - protein, 87 aa, Homo sapiens
RRRTSLSASPLGGRGIVMSQELFHLPSGEKFHSSPSSSSSSTSSSASCALLAQDPAMETGLSMYSDDFGSFMRPNSEPLAFPARPWL

SEQ ID NO: 1003024 - protein, 42 aa, Homo sapiens
PATENPRNQQQCYVGHVTAPLACVPRGSSIVPTGARTHNCVL

SEQ ID NO: 1003025 - protein, 73 aa, Homo sapiens
MAHCRRRIMHLGYTYTGVYVAGNVNNRTSRTIASMRKFKALISIARRSVMMIIAIGSKYRARVIITSGRRPMA

SEQ ID NO: 1003026 - protein, 38 aa, Homo sapiens
MGIELKGRYDAALTDLTLRGSSALPGFPFLEDLNFILK

SEQ ID NO: 1003027 - protein, 99 aa, Homo sapiens
DPKPPPFPRMLPRTGFLPTWAIIEESHKHNSLIIPHIIAHITLLHLYFSPTPNLLHLNHTTPHIYNVHLNRQFEHTKANPFLPTLITLHTLLLPISPFI

SEQ ID NO: 1003028 - protein, 76 aa, Homo sapiens
ALSEHSHAGLYSLGRGLSSVRDLLTVCFVSVAVWVTYLGFVGFSSYRLLLLYWGGSSTTSPSRPSPLEPWPSYTPV

SEQ ID NO: 1003029 - protein, 36 aa, Homo sapiens
MYALLLRLLCVTRGGFWGLLYDVALPGLHAWTWPVV

SEQ ID NO: 1003030 - protein, 79 aa, Homo sapiens
LPRRLYRHDLDASSLSYDGGGLHPSPSSRWWARWVAFFGSLAHLSHSSPLLGFNPGSRLPGRRPGHSQSSHTPPGIVAG

SEQ ID NO: 1003031 - protein, 72 aa, Homo sapiens
GCHGFQFFIDSQDSWIDCKHVVFGKRSRSGIAGGADIVESTKTDRRDEPLKDVILGDCGQIEVEKPFGIGKE

SEQ ID NO: 1003032 - protein, 66 aa, Homo sapiens
RPALVKYLFKSSVMAQWLTPAIPALWEAEAGGSRGQEMETILGNTAETLSLLKIQKKLAGHGGGRL

SEQ ID NO: 1003033 - protein, 66 aa, Homo sapiens
MTRWAGDGCPTSRCVGCSEAWGQTPAVSGSGPWGCNQWLAGLGHLLTGQYGDVRKNYGRGIHAEAG

SEQ ID NO: 1003034 - protein, 141 aa, Homo sapiens
SRFSSGGGLRAPALRGRLSVSSSRSPLGEPMGWGAAMAVASAAAAAAFGSGLGGGYGGGLGAGLGGGFGGGFAGGDGLLVGSERVTMQNLKDRLASYLDKVRALGREANADLEVKIRDWYQRQSGLVEINDRDPMPPGTEL

SEQ ID NO: 1003035 - protein, 32 aa, Homo sapiens
MAKSIRSECLTDNVLTARSLGTYGIICMDSAG

SEQ ID NO: 1003036 - protein, 39 aa, Homo sapiens
HGSVHTLSLPESTLLQAVDATLRSLMAFFVQLHSMTLNG

SEQ ID NO: 1003037 - protein, 87 aa, Homo sapiens
VCRGGWAVGTTRVRHVHLQVSMHSCAFGGRRVPCLHLGQGGTRPVLRLEHEAEGGARKQLLTPGDVEAALSLSEKHRFYAGGQQGLN

SEQ ID NO: 1003038 - protein, 59 aa, Homo sapiens
HGVEEYWAWLDMAGWLGMLRVVGDVGRIGVQPPEEGSSAGLMRGLLCSMGAKHGLCRGS

SEQ ID NO: 1003039 - protein, 63 aa, Homo sapiens
WRHGSVAKQVGSGRWAGLLGAPLQGHGLDGLFLSTAPRNEMGQGAGSVTGVQARTETGRPAHA

SEQ ID NO: 1003040 - protein, 53 aa, Homo sapiens
SCGMRLYTYRDGGVYGAVTYREGGVYGSELPAMKEGYMELNTYHEERGILVLY

SEQ ID NO: 1003041 - protein, 108 aa, Homo sapiens
WFRCRMYWVTLAHIVFLAPPHPEWIAPSVTQLLSGPLRPSESFLRYLQRFHNDHTACHLICNHNRRLFVLCPLYDPVCATTPVRLPPSCVRSSDLSHYTVCATTTSVS

SEQ ID NO: 1003042 - protein, 37 aa, Homo sapiens
SREIIQAACVNGSLLFIAAWYSVVYALAPMKDTWRCF

SEQ ID NO: 1003043 - protein, 45 aa, Homo sapiens
GSLVGRSVGGVVDSVVVPRAQVHELVALAPAAPDSHRCWLHTAVQ

SEQ ID NO: 1003044 - protein, 49 aa, Homo sapiens
MNHPKRNEAGGTCTRRAADPAGNTKQRIDEFEALNSQCRTMGRGALIVG

SEQ ID NO: 1003045 - protein, 73 aa, Homo sapiens
AVTEGVEGEECRLNGEGVGQVNVSVVQSTISSGYGGAAVSAVASGLVWRKQLPMACGPWHLDGGFTFHALRVA

SEQ ID NO: 1003046 - protein, 52 aa, Homo sapiens
GGIGSGGGSSSSVKFVSTTILLPEELQELRTCCKVTAFQAAATHAHGRLPTS

SEQ ID NO: 1003047 - protein, 67 aa, Homo sapiens
CDERVEDSGGEGVGPVNISVVTSSVSSGYGSGNGYGGGLGGGLGWRPRVEVLPGGSWELLLQLLGSQ

SEQ ID NO: 1003048 - protein, 46 aa, Homo sapiens
TAYAADCGYACFTFCGQGAAQEAVKLCDSYHIRPGTHLGVCISVAN

SEQ ID NO: 1003049 - protein, 90 aa, Homo sapiens
AAELSGHGWCTSVRQQSQQVQLWQSKSFRISVISSIRSPSVLCMVHPFVLQVQLAFSHCWVVIQSVVACSIFGGGASLEGAHQTCISSDG

SEQ ID NO: 1003050 - protein, 59 aa, Homo sapiens
VVRLNFAGGYVHLPFQACCTSVLAGVLCDTQHQALSIFNHYRCSSVPSSSTAAMCTCSS

SEQ ID NO: 1003051 - protein, 61 aa, Homo sapiens
MTDPAHPDHVRLGVSRFLSRSLLSYSILAPLGAQPTRMHRAGARCLLRGMTGARSVLLGAS

SEQ ID NO: 1003052 - protein, 37 aa, Homo sapiens
MRSLVLWKVVSQSSSKHILSQRHGLGHLDYAADNDVK

SEQ ID NO: 1003053 - protein, 36 aa, Homo sapiens
PQRSPSTQKGIDAFCRHRGCLSTALCHWTAPFLGAS

SEQ ID NO: 1003054 - protein, 70 aa, Homo sapiens
GEYAQPWKQDSDARHTLWQGEVTDKSLALRKGEVLKAKQMLPHPANPEPSSLCSMGIEALARHLSRSRVP

SEQ ID NO: 1003055 - protein, 34 aa, Homo sapiens
VWFLSHAVPSIPSSCASNREHQHFARKDCPITDR

SEQ ID NO: 1003056 - protein, 66 aa, Homo sapiens
SVISDLQIIHGVMLTSFGQSYLPELSRPRTFSSQPLQIKLMTHNGLFRPIPYVTAASGDNFTASKQ

SEQ ID NO: 1003057 - protein, 48 aa, Homo sapiens
SGSKSKTPKKTRRQRQHIRALLMTDVQERKGRAAPEEVATPIASLAHR

SEQ ID NO: 1003058 - protein, 79 aa, Homo sapiens
AGKVTGLYVTCGAGWDRQRRSRPKQSLCDGQWHSVAVTITQHILYLDWDTDSSYTCWTDPLPICQDSRANTPLAGLQPI

SEQ ID NO: 1003059 - protein, 51 aa, Homo sapiens
MDILYSKYRAATDVYALMFLADVVEFIIIISGLWAFGKHSAGRDITSSLSD

SEQ ID NO: 1003060 - protein, 101 aa, Homo sapiens
TGESGSETKYEALQVTAGRHGDEHGKTKQEIAEINLHDPKELRSEIEHVKKQCANLQAAMADAEQRGEMALKDANEQAGSGWRMPCREGKQDLAWLVKEYQ

SEQ ID NO: 1003061 - protein, 42 aa, Homo sapiens
EVPMKPGTKGRPGSDGPKGEKGDPGLEGPRGLAGEVGEERSQ

SEQ ID NO: 1003062 - protein, 112 aa, Homo sapiens
MVGVPVSGRLPVLVLDKRVPVMPVIACGGEDTVQILTSHHAIASINKSWRTEASVVHSYCSRAMASNHSPPTLNGAPVTATEIQQGSGLLHIICTHNSAIASALVVFEKSAS

SEQ ID NO: 1003063 - protein, 82 aa, Homo sapiens
MAVSESQLKTMVCKSKYRDLTVREIVKVMTLYKDSNLFGIRYVLNDGSSRALMNLTGTIPVPYRGNRYNIPLCLWLGDRYPY

SEQ ID NO: 1003064 - protein, 61 aa, Homo sapiens
TRRSGADWCPGKMAKGLLVLWVLLAQLASLEIRVKVVPPGLPVYSLDLPCVPSWGYRRLRS

SEQ ID NO: 1003065 - protein, 100 aa, Homo sapiens
MGLGVLWLGKGSALVVELTLPSPQVQPNSVHICAVVVEYETKAGRITTGVGTTWLRAKEPVGENVRPALVPMSVRKSQFRLPFKASTPVLMVGPGTGVGP

SEQ ID NO: 1003066 - protein, 70 aa, Homo sapiens
LTSPAHLVWGIGVCYSRGHFDRTKKGTSSKKVIYMPASVPEVKENSNQTSIIPVCEPGSAHAPSHMQLAF

SEQ ID NO: 1003067 - protein, 87 aa, Homo sapiens
PQRHKEETEGERTTNFLNLSNWDKKDRARLGERLQWLEGAVRVEHRVLHKPRTHVGLQHNSPLLFQTKHTSDLLLLQQQEIILGSRD

SEQ ID NO: 1003068 - protein, 39 aa, Homo sapiens
KGRVRGSERGSGLVGCPYNSSSVEYRQMSRVRYGRGRGS

SEQ ID NO: 1003069 - protein, 43 aa, Homo sapiens
SVLRIPKGSRVSNAADGDGVDEHSLVIDTLKEVDEARKCYRYG

SEQ ID NO: 1003070 - protein, 95 aa, Homo sapiens
LRVLGWETDLVITGEFTQILLKLSEKLLISLSLIQRHKGVDVGKSFPCDRCEFRGTCQVSVVQESQWNHAVNKGNVFIFQFSSCTGQGWFQSGSC

SEQ ID NO: 1003071 - protein, 93 aa, Homo sapiens
MEKKLKVMAALTESAPTSTSFGLVTAHWWFRKQKPTNHRKVQRAEKSRSPMTRYLRSVALLIWGEIRVDHQEEGLGLEGQHPDGTAIPECLDL

SEQ ID NO: 1003072 - protein, 34 aa, Homo sapiens
QAPFLKAAGPHCRCEYPRDEIHTLRFSLSMRSPR

SEQ ID NO: 1003073 - protein, 143 aa, Homo sapiens
VITGSLRQTLGELVTKYTGSVTLRPKDGGDEILAQGLDPGYAHFPCEMQLQQLSLGLLHALWFPLDADQMALLTVRRDAHGHLVLVLDSVDVGTALPNEVPVELVVDVDLHIVHPVNQILDHAFYLCLGHMDILGRAPQRVGL

SEQ ID NO: 1003074 - protein, 40 aa, Homo sapiens
WNPITIFQCSAHSQLKWGCMLALQQLCQSSGVFAPPWQTK

SEQ ID NO: 1003075 - protein, 51 aa, Homo sapiens
LLVSIEQEMGSLNLEANVTADVSLVPWKRDWPLCTSEMSGRWNVRSWQRHR

SEQ ID NO: 1003076 - protein, 63 aa, Homo sapiens
MREYSYGMASLQEQDAMLDSHSCLAYQIRMGLVSRREKHYMQDILKVESDFVTIFEKVVWLYK

SEQ ID NO: 1003077 - protein, 75 aa, Homo sapiens
GDLAGSLRQTLGERRKFMSQGEQGLLLDLPHRLLQRGEWDHHVYKGFLGLLPMLWTLMNCASRNQISGMEDPHAP

SEQ ID NO: 1003078 - protein, 104 aa, Homo sapiens
QDLKTDTRGGARGWGWADLRQSWALSISEEVVKKRDFLFHFLNFLCMLVEDMLAHKLRTLEFLATERTQPLYPGPGSGGVGGGRFSSFRARGVLAAPVFVGPLP

SEQ ID NO: 1003079 - protein, 54 aa, Homo sapiens
AGVYVSGSQELILLLIFGLFFRRQWRLGAAVVSLLSEFMSKLRPCSVLLPACLF

SEQ ID NO: 1003080 - protein, 139 aa, Homo sapiens
MNEQAFQCPERGGATWWEHLTFDVERDEEPQGWELPFDAGTSHCAQMYPNDKFTQNPMRGVGLSPEHICLLPTSLHLPSSPGANEQEQVPPTVLCLPVPGLESVVKPHGVRPCRYGTNPSFRHGNAGCSGPHLSPYPDS

SEQ ID NO: 1003081 - protein, 78 aa, Homo sapiens
SGRDGIMSQGTRCCLTFHTDFSNEEKGTIMVYNGLPGLLPRLWTCDDCASREQSKGSEDPTAPCARHLGVTIYGWDGY

SEQ ID NO: 1003082 - protein, 37 aa, Homo sapiens
CRGSLKGVRVAEVRIPESGRSRLQRAVISPLYSSLGD

SEQ ID NO: 1003083 - protein, 172 aa, Homo sapiens
KTDTWGKSDTLDKTDTRGKDNTGINSRGVSSPINRQPQRPVPCSLGPQRQPGWPSHLPLPHRVAEHLWSPRGQVGAILQGGISALTAGHGAGSLSSAGRGGSSAMQPRAGSFYNMPVDRELAPPSPGPCQGQTGNTREPEGQLEGRYRGQETKRAGAGVNGRQVKSPVACGA

SEQ ID NO: 1003084 - protein, 94 aa, Homo sapiens
MDGTEKLLDKSWEEIRAHTKAVRMGMRGRLTRVEDRSSDHLPGCERLEKYQISEGLREMPWLGEHETWNSFACWKNGVSARSTRPGGRPGAVIT

SEQ ID NO: 1003085 - protein, 51 aa, Homo sapiens
QRTPEDKEAGHWLNITRELIKARGRDWDPRMKPSGAEKLCAQDAAIKIIKI

SEQ ID NO: 1003086 - protein, 64 aa, Homo sapiens
SHTRSDWRYDRYALKQSQYNLSGIQPLLQDIEELGDRSRRTYENNRVILEIDNARLLVDDFRLK

SEQ ID NO: 1003087 - protein, 42 aa, Homo sapiens
DGNAGAVGRQPEAYIVYGNPSLKPSPLNALSAMPPTPECLVL

SEQ ID NO: 1003088 - protein, 64 aa, Homo sapiens
RLFQRHSTAGSGLAWHRPGVSSFAPDRTGGSGQQAAGPEGDGEPTDTPKAYSISTMPLGAGQQG

SEQ ID NO: 1003089 - protein, 72 aa, Homo sapiens
MTTTLMADFVGRNYPKVWTTDDRSMCIIQGLRHEEEHQEMVLTLSPTRHNKQLCQGPTHVPSDMTSPIHYPV

SEQ ID NO: 1003090 - protein, 70 aa, Homo sapiens
MGFGTGSAISTFSLHKGASRQGSGECMNSCTMCSRTSFPRIGSGVFPGHLCRSLVLLAHHPDHVISLVPL

SEQ ID NO: 1003091 - protein, 48 aa, Homo sapiens
MCLSLYPIPVYLCGVGSNRLHTYTLLQTNTSDGGGADSLTWIPRGIAW

SEQ ID NO: 1003092 - protein, 64 aa, Homo sapiens
LVDADGVSDLGILHRSYSKVKSHVTIRRTVLEEIGNRVTTRAAQVDKKAQKTKVPVQTLSSDRG

SEQ ID NO: 1003093 - protein, 31 aa, Homo sapiens
MPRREETGSSQNLRNRNAGSWRSGLVARQFR

SEQ ID NO: 1003094 - protein, 60 aa, Homo sapiens
AAIAYHLCVGSTGTDRSAKPVPAHSPAMSVCSSSGRWCDRSQTAYAICVWRIDVTYELAR

SEQ ID NO: 1003095 - protein, 72 aa, Homo sapiens
YKGHGTNGRTQASLQTPEGGQHWEGPTHMNFPMDQPLSTRAWETAESHGSPSRHMETQGALGSLVPFSPGFL

SEQ ID NO: 1003096 - protein, 39 aa, Homo sapiens
MTGHLPQRPAAAKMYCLELQGVTLTLNYPQGRTTKEWSV

SEQ ID NO: 1003097 - protein, 38 aa, Homo sapiens
LRRTTLDTVVEENTQCGGGGKIRATDPDEGLNAQIMYQ

SEQ ID NO: 1003098 - protein, 69 aa, Homo sapiens
MCDVIRGSRCVMQVSTNSFRCRSRESVNKRMVVVLHVSVSICAGCVHVCSVQVMCSVRVWVSAYVCMHV

SEQ ID NO: 1003099 - protein, 64 aa, Homo sapiens
MRVTISMVQGRGYLQKLGLNSTCDDSILVKTVCGVLLQEARTAVRRRHGLRLRTRSARTEDWTV

SEQ ID NO: 1003100 - protein, 47 aa, Homo sapiens
IPCQTVLSMASTQHGHSSRGQGVPSPPPSPAPSPCPAPTRARVTAAR

SEQ ID NO: 1003101 - protein, 90 aa, Homo sapiens
MQCSNAVAEMAPPERLCAGISVCVVTNGVGGGLGGRMPSVSWELGLDGGNLQRSRVWYTPQAKRPELNAPLIACLWHCLWGLLTSKCQGC

SEQ ID NO: 1003102 - protein, 103 aa, Homo sapiens
RYLEYRYECSDSDSMYIVNIQVAGTLIGDIMGGELTCETSVHQLLSLLLFYKGLGRDPSLTVAAERIGPSRSSAGENTSKLLNESIPSLRTTDRGGRDSPKHI

SEQ ID NO: 1003103 - protein, 59 aa, Homo sapiens
MGGPRYGSCSRPGLALGRREGSDQCEGVVASSGSPTPECIWDWDLTVDPFPHESPIPDW

SEQ ID NO: 1003104 - protein, 34 aa, Homo sapiens
SVLKKVHEEEIVSCRLSYRNSRIQVEMDMSKPEP

SEQ ID NO: 1003105 - protein, 65 aa, Homo sapiens
LRGSSRRHKEVREDLRLLRMTWKEIEQKYDVEKEILITVLSAGQRRQCCNQGHGKITGSQDGGGG

SEQ ID NO: 1003106 - protein, 37 aa, Homo sapiens
GGEDLSVIKGAPRPERGWAASVLGAKDLSWVDTTLHR

SEQ ID NO: 1003107 - protein, 51 aa, Homo sapiens
QCARFLQSLQTTPLGADPTLEAGYVPHRLGWWRCSQRSRIGETQQRCKRQP

SEQ ID NO: 1003108 - protein, 73 aa, Homo sapiens
CSDELPRCVLPRSRPLQWSSQVMGGMGAPAASLHRSWPPAQLPGALAGLGWSGLVMPLPCGAWARVSSLTRGT

SEQ ID NO: 1003109 - protein, 36 aa, Homo sapiens
FLCVEVSELHLVTKTPPRDLPPFRGVQALSSDEPPM

SEQ ID NO: 1003110 - protein, 66 aa, Homo sapiens
EGVVVVKVLVVVVEVMVEVMVMVEVLVVMMVVVKVMVVMVEGVVDVPVLVVVVAVLVAVLVVVMVM

SEQ ID NO: 1003111 - protein, 65 aa, Homo sapiens
ALEAQGGRGTSKGVRVKQRPACEVAWAGRGDLPGGSVSTLGGLLGLSWGWRSLMFCGAEGPGSVG

SEQ ID NO: 1003112 - protein, 178 aa, Homo sapiens
EGPGLDFFKPISHPYGRRSSIAGRRMARDSSHSITLQATANPNTGLVEDLDRTGRLSLTTQQSNSQQLLYITCKAWQKLEHIQTKFSSDITHIGMMSQVEEKTQIILKASSHLLARYSSHYPHTKESRIFIPVTSAKSGSFGVTAVYGGRFQILMSVVPYQETKTKFHPSGGSHTTHG

SEQ ID NO: 1003113 - protein, 60 aa, Homo sapiens
CHRGGRLYVVTVGFSRTWAKGSNSSQAAQNLATSTSAAVIGPRSKVIHGPGRTAGTATLV

SEQ ID NO: 1003114 - protein, 39 aa, Homo sapiens
VGRQLGKGRNGSQVKTPSTKALVASGSSPELSPLSLSVT

SEQ ID NO: 1003115 - protein, 46 aa, Homo sapiens
ATPGQSTRRPPDSSPGSLLSYSILAPWGPKPTRHAQEHGAEVSPGE

SEQ ID NO: 1003116 - protein, 47 aa, Homo sapiens
TFTNDDWGSTLTFAFLPVTYDTTVLSAMSTSRHHKPHTTHGYATYVS

SEQ ID NO: 1003117 - protein, 52 aa, Homo sapiens
RYEKMAEPNVKDAEEWFFTNDYEELNRRGATNSELVQMRQELRSRSSGAPLQ

SEQ ID NO: 1003118 - protein, 70 aa, Homo sapiens
APEAQGGGSRGLHFQQFPSFSGSGFFPSGDLGLLIWDKHRQRGAGVVGGFLDAAARGLDLALQLLLLGAS

SEQ ID NO: 1003119 - protein, 53 aa, Homo sapiens
KKQNKTKNRSLGNRIRKLSSSSSSSSSSSSSFFFTNFFSFSFSFSFSFSFSSW

SEQ ID NO: 1003120 - protein, 54 aa, Homo sapiens
RGPPEDRRIYKGRDGSPFKLWTTKCKGTLSTSKKFYIFLKLNPYSPKGLYHAFS

SEQ ID NO: 1003121 - protein, 55 aa, Homo sapiens
VCEKDGSKKVGTLWEKRGLVEGISPEGQDMGAFVAEQKGGVYPGRGVGSPLAERA

SEQ ID NO: 1003122 - protein, 45 aa, Homo sapiens
LEDPPEDKEAEANEDEECGYTFLCRLKACRGASYWEARSISIDFS

SEQ ID NO: 1003123 - protein, 38 aa, Homo sapiens
ARVHKGDNWKKSLEDVNSEPMEEPKQDRPTKTGMIQDT

SEQ ID NO: 1003124 - protein, 141 aa, Homo sapiens
EGLLCGWLLWCAAVHPGEWGTGCAVVVSGKLRGPRAQSMTYVDGLMIHSGDPVNSYVDTAVRHVLLRQGVLGIQVKIMLPWDPNGKIGPQKPLPDHVRIVEPKDEILTTTHISRTAGWEGQTRLPCPRQSPQNNRVSLDAV

SEQ ID NO: 1003125 - protein, 47 aa, Homo sapiens
MLMMKKRQIIDISMDIPFSFIINKENETELNIVNLQIRKTLASEITA

SEQ ID NO: 1003126 - protein, 80 aa, Homo sapiens
CPMWPLRRRSCLSAASRGPAPPASPWPLSGPAPLMPPGGLPKPRFCLSVASAGLATAQPSASRRPAQAQPLPHSGLSTHS

SEQ ID NO: 1003127 - protein, 90 aa, Homo sapiens
MGCVPDFELLSDPEDEHLYATLMQLLRESLARRGWALDALRGLVIASQLVSQVGKELLGLAYSEPCWLRGALLDVCRGAGQELPKRWPSW

SEQ ID NO: 1003128 - protein, 79 aa, Homo sapiens
YQPHDIVRLAHDVGRQDMASSDVHRCIDRVEVRALRSQSSIFHTDLNKPYMYGPRLVHRGIMSRWNRKRPSRNWYGGDI

SEQ ID NO: 1003129 - protein, 108 aa, Homo sapiens
MKSQIAAVCRACLQALEYLHSNQVIHRDIKSDNILEEMDGSVKLTDFGFCAQITPEQSKRSTIDRNPNWMAPEVVTRKAYGPKVDICSLSIMAIEMIEGEPPYLNENP

SEQ ID NO: 1003130 - protein, 38 aa, Homo sapiens
DCSTLSWFFFMTEQLLLEQPRSLSPRCSREILGVSIDL

SEQ ID NO: 1003131 - protein, 48 aa, Homo sapiens
MGSARYSCHRSLQTALLSKAHHLRLELYTLCVMRMLLSTWCSSAGGRD

SEQ ID NO: 1003132 - protein, 128 aa, Homo sapiens
LLSPLDALPPPPPAEAPPAAPSQPTQLVITQRTVSRVARNATEAGRVLKEEWQVLLHKDGCPPSMRAAGQLLTVWQPEDRDRQPPSCHDHTWVSLNVAPEGPLNTVLRTAEKITPKTNYPQMPVTTPG

SEQ ID NO: 1003133 - protein, 38 aa, Homo sapiens
ENEDQQTLEDLRAKAAEARGPWQQVELRNLAQSKLYLV

SEQ ID NO: 1003134 - protein, 181 aa, Homo sapiens
MLVLSAGRRRAWRYFKEQFLDSETGCDFALVRIQTRVMILANSYSVPGKLYGDEEKDKGLQTSQDARFYALSASFEPFSNKGQTLVVQFTVKHEQNIDCGGGYVKLFPNSLDQTDMHGDSEYNIMFGPDICGPGTKKVHVIFNYKGKNVLINKDIRCKDDEFTHLYTLIVRPDNTYEVKID

SEQ ID NO: 1003135 - protein, 107 aa, Homo sapiens
AASLCFPGRLSVCVCWAPSGRSQHRPRKDSAKGPGQAPGSPAPGHAFLSTPRTPWFLLPSSGLAEEFRFPGPWVLMCGGRLWLNTCAMPSCQCDFGCRGVHHEPCNG

SEQ ID NO: 1003136 - protein, 43 aa, Homo sapiens
TQWKQRFYNIKNETNRLGAVAHACNPEHFGEARGGRSSMVPTL

SEQ ID NO: 1003137 - protein, 92 aa, Homo sapiens
PAAVCCKCAGVGWRSTQTPFAWVSLSEAAEQQRLLPVPSSGSFVPLAAVALLSTCQMPNRALLYEVSFGPYWEVSPGQDTRRSGAHLRGSTP

SEQ ID NO: 1003138 - protein, 56 aa, Homo sapiens
TGSLIEEGEVIKRFAAQLNAVQKAEWLFLVSPQGEISLSDKPGHWPKPKGEGTDND

SEQ ID NO: 1003139 - protein, 74 aa, Homo sapiens
GRVSDEDPKYAGFASPAGIMCSQLMSSFLRLTNCSAMTHSPHATVSFPAGCRNEKVQGEMTLNNAEVYTTHARA

SEQ ID NO: 1003140 - protein, 109 aa, Homo sapiens
GNKAIARSKILEKNLDECITRITNTEKCLKELWELKAKARELREECRSLRSRCDQLEERVSAMEDDMKREGKLREKRLQRNKQSHPQLQLQPIPHQLPAESIPPPPCCL

SEQ ID NO: 1003141 - protein, 57 aa, Homo sapiens
MTDINIDSFLCLVFFFGARVYISLPRLECNGHNLQFTDNLHLPWFKQYSCISLPCSW

SEQ ID NO: 1003142 - protein, 76 aa, Homo sapiens
RGRRRVRQDIVGRAEGTRLEYKEEQDYKKSVPGYRIYVRIPNVAPSATGAKPVYHLATYILTTTYTRLGIVHHRIP

SEQ ID NO: 1003143 - protein, 69 aa, Homo sapiens
RYSNRLHDADDTAGLQAWLQPVGGVLHVGHVNAQAAILTQQNHRRPLLHIAGRVPNSNHVFFFLLKQDE

SEQ ID NO: 1003144 - protein, 71 aa, Homo sapiens
VEYMAPPTSQDRGRLTGTESPGLPQWYGQWLRNIKQILFFQGARKRCYFPMSIILTITETQVWGRPGGLAP

SEQ ID NO: 1003145 - protein, 72 aa, Homo sapiens
VLAGSKRHKGGPLRGIGSRKPGTAPRRVARSPLHGSSGLWLGAGGQTRIRALSVPVVAQVQRKLSVLSSGTV

SEQ ID NO: 1003146 - protein, 37 aa, Homo sapiens
CYHPYIIATSPSLTSTSTYAYFTPTPVPMNSEVPINS

SEQ ID NO: 1003147 - protein, 40 aa, Homo sapiens
ADALRHKEETQAGIAAAVPDPGLMGSVEEQLAQLRCEMEQ

SEQ ID NO: 1003148 - protein, 75 aa, Homo sapiens
SATLVNTTPTHYTVTHTDMTLTHMHPQTQGLTPRRDGRCAYLDTHVFIRTIIATITLLNLYFYLRLFYTNPGADE

SEQ ID NO: 1003149 - protein, 52 aa, Homo sapiens
MALRYHRHSLIIGTRYHRHSLIHRHIAIIGTIIATITLLNLYFYLRLGVDEE

SEQ ID NO: 1003150 - protein, 37 aa, Homo sapiens
MSLLLTAQADIVGLTLPESDNRWSERRTVTVKSAMQA

SEQ ID NO: 1003151 - protein, 108 aa, Homo sapiens
DDRRTWLGVASPLLAPDDLGNGDAPNLLSLLTAAEKGSVGLIEKKAVTYLFADEADDQPGLGYTERTGCMGSDVWTVTGCTGFSDLPQGGDLPVSDPVAPDDQRLVTV

SEQ ID NO: 1003152 - protein, 105 aa, Homo sapiens
VLRSLKTDSPTSDPDCYTDVDSVTLGRQQQTGFQEPVLDEARTEEQASKQQFVVKIGKESRSQCDLVKDATADRNGRANDFGGDTLRKHGLPGQDATRNLVMTRY

SEQ ID NO: 1003153 - protein, 49 aa, Homo sapiens
FRLADVHGLLVELTGNESSDALLVVTGGHLGQVGVVVTLHLQVQDPALG

SEQ ID NO: 1003154 - protein, 48 aa, Homo sapiens
MYTWIRAMVSLTILSFGYSLPSLSLLVIKLYSAKVWDGCGDMSYGPSN

SEQ ID NO: 1003155 - protein, 51 aa, Homo sapiens
AHLTQRVTARRMKLVRFLMKLSHETVTIELKNGTQVHGTITVCGLSRMTYT

SEQ ID NO: 1003156 - protein, 68 aa, Homo sapiens
ALQIPAHLTQTDVDGLRLGLEVHASPPLRSGSETSQVSVPGPHLVKRLQAVCLEPPSNSMGAKCNSET

SEQ ID NO: 1003157 - protein, 130 aa, Homo sapiens
RPQRHAAGQIQEMIGSVEEQLGQLAARWSTQNQEYQIVLDVKTRLEQEIATYRRLMKGEDAHFSSSQFSSGSKSSRDVDLLQPPNPEPRSWMCTMARLVSTQDQVLRNQELRLPSPATGLGGPPVWTQIP

SEQ ID NO: 1003158 - protein, 73 aa, Homo sapiens
VRVALRRTPGHLTTTGRVTYRTLWLYTYGDGGPRTVGPHWGWTWSASSHTLSTLLSARTNTVPLTDTDLTPGD

SEQ ID NO: 1003159 - protein, 33 aa, Homo sapiens
MGVDRDRGYTMVTNGYLKNIPCKHVNFALTSRF

SEQ ID NO: 1003160 - protein, 50 aa, Homo sapiens
LRERHTSSRNTLPPKTVCYSRHDGLWTWTRPLDVATASGRGSGVTTVARV

SEQ ID NO: 1003161 - protein, 32 aa, Homo sapiens
MTHQQHGPTRLDGPDDVRYHDLNGVTLPTPNV

SEQ ID NO: 1003162 - protein, 50 aa, Homo sapiens
YQLRGLYVAIQAVLSLYASGAHHVAYVMDSERPGSPYTCAHSTTGYAPPH

SEQ ID NO: 1003163 - protein, 30 aa, Homo sapiens
MAHPSWAVSAGQKPSRTWDHGKPAGNRSPP

SEQ ID NO: 1003164 - protein, 135 aa, Homo sapiens
QRHKEDWGGSVCVGLDRDWRSDLAEHSTDVILKWLSANPAKQSIFPGPRWRGMVSDTEEFWDEPRTSGGVLYRTDLDENLEFTPVPSVGKEKVKMEKLKKLWATGEDQGRNSGRSKGLRAWGSALVQLKDAGLVQ

SEQ ID NO: 1003165 - protein, 165 aa, Homo sapiens
MVYRGSLAESSQIKILEKQLEETKAVLNAAVPDPGLIGVWRSSGQLAVRWKKKSQEYQILLDVKTRLEQEIATYRRLLEGEDAHLSSQFSSGSQSSRDVTSSSRQIRTKVMDVHEGKVVSSKEQVLRTKKLRLPARVRHRRPPCGHRSHWKIPSPAQALHSWTLL

SEQ ID NO: 1003166 - protein, 71 aa, Homo sapiens
IWKKILSSGVFYFSGPKEGSRLDLLVRTQKQGDDSSEMGGHSFVLTAAKGFASGACGGLLGGTRRLDTSYV

SEQ ID NO: 1003167 - protein, 50 aa, Homo sapiens
EDSFLYGRGATPLEISLDLYQTVYARNIFNEAAEYLSKWNQVVEIYLFIL

SEQ ID NO: 1003168 - protein, 68 aa, Homo sapiens
QRHMEVEATSELRWKKTERHEEATLPKITAEQRTVTKIKRFKKTFLEGVHISVYRVRNLSTPAKTFQT

SEQ ID NO: 1003169 - protein, 38 aa, Homo sapiens
MRTLSDQTSRSAPLRPVRGRAPADMVTLDNLGAIARPP

SEQ ID NO: 1003170 - protein, 153 aa, Homo sapiens
ELEEDKEDVIYVRIEGIEGQESGDRGSGPGIIHQLTEELGPLWIKSPTVKMKERVQITLEPFPPRCIGIQRRGQVQSSTACGVDAAWEGAGSMREMRVLMCSKVTIFLIGPGIVGLIVGTVAFSQQNPGAHGGPIPILKAWVIQPGLSFLGAS

SEQ ID NO: 1003171 - protein, 35 aa, Homo sapiens
ALFSALVIIGTKYNIKYALTSRANGAMNREVPTNS

SEQ ID NO: 1003172 - protein, 49 aa, Homo sapiens
NWEEERGASSPLQQAAVVAISCSSGVFTSSRILYSWVLLLHLAVELGQL

SEQ ID NO: 1003173 - protein, 95 aa, Homo sapiens
TFDVKTLIKCDVGRCLQDAMLRSETVVLPALSKPRRSILTSWSGALFNLRNIESKPILPPSPSSSSSSCCLPRYQGQLLLVPPPTFLARTAEELS

SEQ ID NO: 1003174 - protein, 82 aa, Homo sapiens
WQTGGRGCRLDHGRTEKRERTYPRKTYEDSERRVSRKYTRFPVRTFCLPIAEGELSDRTDWGRLLGQHVVCSGVRGPEAVGV

SEQ ID NO: 1003175 - protein, 41 aa, Homo sapiens
MLMMRAILLLPGGRCQYLYNQADEVENQILYRDVQGIRQEQ

SEQ ID NO: 1003176 - protein, 35 aa, Homo sapiens
ACDVIASRGAEWSRRLMRTVQRVTGRPRSSMRSEQ

SEQ ID NO: 1003177 - protein, 49 aa, Homo sapiens
TLTPTVTHLAPGFAAYPSLPNGTHGCRFLRTLTPTCTLLAPHFSCTAHP

SEQ ID NO: 1003178 - protein, 78 aa, Homo sapiens
LEDLRRGTREENKISKRELEVGYREMESKEETPGTEWDKVAQLCEFSPKSRMQMKDVSGLGSVSHVPEADATVPVVAC

SEQ ID NO: 1003179 - protein, 87 aa, Homo sapiens
FPQPFNLELDIQQGPISGDCGYITQGSHFQHPAYRESLLECNTSYQLRILEGSTLLTFLIPIISSCSKSSSIITASTTILAKKAFCW

SEQ ID NO: 1003180 - protein, 65 aa, Homo sapiens
RGTRRAEGGSGVIFWAPSFSASVQLVLDLLVQFACNSCLIPVSFFLMASLVPLASLVPLASLVPL

SEQ ID NO: 1003181 - protein, 158 aa, Homo sapiens
MHKGRVLCSPMRTLLTILTVGSLAARAAEDPSDLLQHVKFQSSNLEKNLDVGQLGRRATPDTVYSIEYKRYGERDWVAKKGCQRITRKSCNLTVETGNLTELYYARVTAVSAGGRSATKMLTGSALLQHTTLKPPDVTCISKVRSIQMMVHPTPTPIR

SEQ ID NO: 1003182 - protein, 90 aa, Homo sapiens
SEDKRLGPRAQRQRTRRQRHKRQRLQWTEIMPCIQLGNRSRFHLKRNDNTKPDLVWWLTPCNARTWEGHRWDDHLRPAWATWPDPISNKK

SEQ ID NO: 1003183 - protein, 44 aa, Homo sapiens
RGSQSRASTPRFFWYAFHYCMTFKINERRHLETQMTDANLRAQF

SEQ ID NO: 1003184 - protein, 118 aa, Homo sapiens
MRVVSDLAHKVWAAMIAFPVALIPAGIPMSLTWPPVSGAYVDFQIKIESIHSYPQHGGFQKKYEAELHQPSPFLLQPESPAFDLTQAEKLQPCQPTALAESAHTGDTRQWLVAKLSPQ

SEQ ID NO: 1003185 - protein, 71 aa, Homo sapiens
MTDPSEAQGGRSTPHWKHGLGFGSLVYWGQPRAGLPIMVAPPNQGKKEECGTGGPKPEGQGGGQFPFPGVY

SEQ ID NO: 1003186 - protein, 68 aa, Homo sapiens
MIHHNSSDEVQSQRRVLPQIEFKSQGCPSITPNGVSQWEEPCRALFMVLISTAIGSTDTTEKQEVGAA

SEQ ID NO: 1003187 - protein, 82 aa, Homo sapiens
MEDTSHAKDTYGADYQKALLYRDVVVRGLKPDTAVSVQKWCSPCFQLPGLDNQLGIPVPVAIPDEGDVSITPNLILVAEARS

SEQ ID NO: 1003188 - protein, 84 aa, Homo sapiens
MGLVFQARVRILGSGTLSRWMYMAGSVLGSAVATRAGARRRPGPHPSSAKSWGETASTGEEQDSNTREASLVALSLVALGVPSS

SEQ ID NO: 1003189 - protein, 84 aa, Homo sapiens
SAGTTHTLRDGRQQQDYGLIDVRAQNDLFSHISAMTWVLLNLNCDEAITRVNYDERELGGRFRLTLQTRPLGPSRLINSGTDSL

SEQ ID NO: 1003190 - protein, 48 aa, Homo sapiens
RLLRRIPRRAAVQGAGVNESLIATLQHSLQLSLPGKSGSSPSQVALPF

SEQ ID NO: 1003191 - protein, 69 aa, Homo sapiens
SSSGAQVTMLVLILRASIYRNSITYSWSKAWEKFITRSIGNTNGMTHWVMHYIPPVELSIEMLLCSHYR

SEQ ID NO: 1003192 - protein, 52 aa, Homo sapiens
QRDKEEVLFVTWLRRRRKVANEFSAEKSLGMRVEGCTGVMHGRRVLGGRALG

SEQ ID NO: 1003193 - protein, 71 aa, Homo sapiens
SDVLDVLADVITTRVMKSGFRCGRHGMKGLVPVGYTSLAPCRPGDPFPCAMLSTSPCPPGELDMCQLTHHS

SEQ ID NO: 1003194 - protein, 71 aa, Homo sapiens
VIGMKDKIQIRSCQPDDWDEDCPARIPDEEATKPEGGLDDEPEVRNLIQTQRKLRIGMTDWLANGRLLRLA

SEQ ID NO: 1003195 - protein, 57 aa, Homo sapiens
PVDGGLQTRFTTVGYFYKKNLFGNEVSLCFPGWSPTPALKTIFPPGLPEVLRIIRRE

SEQ ID NO: 1003196 - protein, 89 aa, Homo sapiens
ALTCTHSHTHTYLLAHRSSLERQKDCIDPDSDSTPAIGAVAKVLFGQGPVKILKGLSREVRVDRELLSLKGWIVTGASSEWPLRMSVRI

SEQ ID NO: 1003197 - protein, 37 aa, Homo sapiens
MLIQSATHEVDSVNLEKTAADTDSTETTCSDDRYGLT

SEQ ID NO: 1003198 - protein, 38 aa, Homo sapiens
VAWLYFTRQVLIEAVLQVIVRFLTVMMKHGYIGSEITA

SEQ ID NO: 1003199 - protein, 47 aa, Homo sapiens [sequence omitted]

SEQ ID NO: 1003200 - protein, 34 aa, Homo sapiens
MTGGEHDNIATDGYHARVASQKREDVCMGLGGKY

SEQ ID NO: 1003201 - protein, 49 aa, Homo sapiens
MRVTERYPFITRSDLLTERGRITSMNITHYSSSHDSEKLWLQPRFFQGT

SEQ ID NO: 1003202 - protein, 138 aa, Homo sapiens
YIGERGIMGRRYNMRNTDFGTGFEYCLDDEEELDVKSWLEAVYEHRRNATIFSHKTGVVFYLDFQEFQFQFNNEYVINRLNPDLEKLKKDGTEKVLRKLDRPVERSRFKVSKEISESTEVPKKVNEVEVLIGRAMGLL

SEQ ID NO: 1003203 - protein, 38 aa, Homo sapiens
MDPTQEEIPDLPEQEFRRLVLHQEKAQRTVKPNVRKSN

SEQ ID NO: 1003204 - protein, 46 aa, Homo sapiens
GWLYTLAILQRSQWRNEEKGGEITIPSVTVSLTKYIMVYCVIVHAY

SEQ ID NO: 1003205 - protein, 48 aa, Homo sapiens
MALGVSPAIGRNLNDENFILKHTGSWQSMYLANAGSNTNSSHVFHLAL

SEQ ID NO: 1003206 - protein, 122 aa, Homo sapiens
SRDPWRGTLKDPVHFLYHSETVTDPVHFDDTRDPKQYPVILRLHHETHPKTPSYFFNQHTETTSTVLQFNSLITIIETTHRVLPSFTSLITTSENPQQQYSQLHFFDYHHRDPLKQYSVGVA

SEQ ID NO: 1003207 - protein, 102 aa, Homo sapiens
SCRALCSSPPLAQPIYLHLQQTLMTATQYAQYPRKDVRSMVEPMRWQDNGLHFLPQKTTIALMPLKGRRLALRTYTCGRYSAEVEQRALERNHGYRRSHTVL

SEQ ID NO: 1003208 - protein, 50 aa, Homo sapiens
MYNTYRTGGFTTVGQDGLHLYDLVIRPNTDSQNAGITGVSHQVWRVKLRP

SEQ ID NO: 1003209 - protein, 77 aa, Homo sapiens
DPSQQPPSYGGSHPCQGRGGHLPAAAALDEGRTTTCKGYTPTDASPRRPRRLHGPDPGFRTCELVTITKLESEITDR

SEQ ID NO: 1003210 - protein, 89 aa, Homo sapiens
GYQLILEQYVPESVPKTSLENSSCSWMETKLKALGMTASQDRAVVNTDTQGNEDVSREGSEGPRENGNTKRKAKERGARANAEKPSNSM

SEQ ID NO: 1003211 - protein, 82 aa, Homo sapiens
LSGLTGAICACHLSFMKMGVTVLSTHELTSLLEKGAGAVARTEASDASVSRTRLTARTMREWEAPVALWMHELPCDGAYCAC

SEQ ID NO: 1003212 - protein, 40 aa, Homo sapiens
AGPPKSGGWPKAGEGAVESQALERVGSSSWTSNEYEDSRR

SEQ ID NO: 1003213 - protein, 113 aa, Homo sapiens
SSIADTAVLLEHWDTRVEVIRAIKFHHQVCGCLPKKSVMGEGTGPKLADPESVIQFNSHQGVEVCHKRCPSLIARQKQAEVMLCFMWRQSLLIPEGSSKVETQLLVYQHYCLH

SEQ ID NO: 1003214 - protein, 92 aa, Homo sapiens
AFYYVGHAVITPSYRRNSDALGRGCVIGHCAEKISETADISVTAGDAREEEAEVFHGGRGCVDHAGGKNPPSSSCAQEIQNSNPLQAYLSNT

SEQ ID NO: 1003215 - protein, 86 aa, Homo sapiens
FRIQRWTYYGPVVPEATRSLCLYDAKKVVLWEDVEWPETEKPTEFPGVAVEGMSSELGDVQEAHRNPGHQVLIFNVLVVVKETCSK

SEQ ID NO: 1003216 - protein, 39 aa, Homo sapiens
MASQPHSGYDRGDCNTLRIDSCTSVLYKQHFLSDERKLG

SEQ ID NO: 1003217 - protein, 82 aa, Homo sapiens
LAGADNRDGDIRVTSRDAHEEEAAVFPAVEVVVDHVVANPPSVLCSKIPTSAPYSLLELIPNQIRLQTLMPANLITVLTVVS

SEQ ID NO: 1003218 - protein, 67 aa, Homo sapiens
QISDVPSRPMLVSSLSGIPIACEHETRTILGLLGLGQCRVLVISITDRFHVEEFVLGDDAFLIQDHT

SEQ ID NO: 1003219 - protein, 38 aa, Homo sapiens
MWSPHQKSGEMVHVTASWRLVDWPGLRTARTIMMSSRI

SEQ ID NO: 1003220 - protein, 77 aa, Homo sapiens
LSLTSILDHRLEYSGVNSGHCSLHLPGSSNTPASDSRDSSDYRLPHTVDCDEMPVEAPVLRAYGCYKLTTAAVKMTL

SEQ ID NO: 1003221 - protein, 59 aa, Homo sapiens
DHTRELYLVHALMKQARNSSQDSFSLKFRLVQQGLQLTFLRPRTVSSIYIKITAVMTRD

SEQ ID NO: 1003222 - protein, 35 aa, Homo sapiens
RDMDYRYSCSPERFITYTTGRISLHVGCIMCAPHF

SEQ ID NO: 1003223 - protein, 41 aa, Homo sapiens
MSSSLTSYSLQSTRLVPFPIARDFSRFVRFRIRATGSHSVI

SEQ ID NO: 1003224 - protein, 104 aa, Homo sapiens
LYCSSTSQCLLPEGSSLLLISCPRDQWRGQGKGESSPPLGGHPSRNCPVHQLHQYVEGFLLHGLLPAHVIRLLLKPHVQAQQDLQLLLELLEKMGLCYWLNKPK

SEQ ID NO: 1003225 - protein, 37 aa, Homo sapiens
MRSSYPGVIMVSLDVENFNADKEDCHTSGPATLGVEP

SEQ ID NO: 1003226 - protein, 130 aa, Homo sapiens
MWYTNVDGGVVLCGTTGDRYLYLGQAVEDETLLVNDGNVLVAVGPKGVVVVIEVTVYMEVIEEVMGGVELTGVLKDPVEMSEVGVSVVVLGDVAVELVNVVCPVPVVATVDEGVSIFVHVVNDMVVVGHG

SEQ ID NO: 1003227 - protein, 95 aa, Homo sapiens
MLGAVLVCFHATDKDITEIGKTKRFNWTYSSTWLGRPQNHGGRQKALLTWQRQEKNEEEAKVETLINPSGLVRHNHYHKNSTGKTGPPGTAPRIQ

SEQ ID NO: 1003228 - protein, 99 aa, Homo sapiens
VGARVLLDVIARRPCRYAQSTEGTQFLGSAETREAGEALRGVAQHVDKVDVELREDGSVEVWELSPIILIMIVGELLRSWAEAVSVWARQGSTFLSELL

SEQ ID NO: 1003229 - protein, 55 aa, Homo sapiens
RYFVFYSLAKPKRMYLSRLFCPGSFAQVRERSDHEIYHLSTLLSVSPGLKAKVKR

SEQ ID NO: 1003230 - protein, 48 aa, Homo sapiens
YGPPGVLGVLPECVTRSPRYARVFTQVCCVLPVCAGFSCVYLSPSWDV

SEQ ID NO: 1003231 - protein, 51 aa, Homo sapiens
MMTMAVLSNRKGGNVGKRERSQIAAVSVKKEVDIGDSILFCTKKNCSPRDT

SEQ ID NO: 1003232 - protein, 73 aa, Homo sapiens
ADEMLRRSAGYRTSGVITAYYNGVHCKIFSLENETNENHAQYFLRLELQLRADLKVHNLALFRRTSARVPGSG

SEQ ID NO: 1003233 - protein, 35 aa, Homo sapiens
SPIWMPLDAYDFNMKKLHSHSKNWISGIKVILEQS

SEQ ID NO: 1003234 - protein, 140 aa, Homo sapiens
HHLDAPYAGQGCSQEVAVLGRSRYCGSSPSSLRLTIPPRNPDTVVRKRETAGDHKATGCDFGPSILQVATSRSNEGVVSPVSVLLVTGVLVLVVVMSQRVTSWWSYCWMLISWPSSITPGFRPLMVVDLLVAWYGSFLPT

SEQ ID NO: 1003235 - protein, 139 aa, Homo sapiens
APGCRRGGPVSVPLRARPKSELSCRDNQDGTCSVSYLPVLPGDYSILVKYNEQHVPGSPFTARVFTRDDSSAYVPPKGRLLLSDIPINISETGSQPARTATVVPPSGREEPCLLMRVRFGHVRIAFVPQETGELLVHVK

SEQ ID NO: 1003236 - protein, 124 aa, Homo sapiens
RPSHSRFASRIGKAGVFRTGNANLAIKGGHAGNNPFIHENLDALGAQVRSAQAARMKKFHSDRMDAALGDPWVHMGIDLADDSLTGLNAAQYHRLITFSLEIAAFAFEYYSRIRQLPFKEALNF

SEQ ID NO: 1003237 - protein, 124 aa, Homo sapiens
RIPHLMPLDAVSLTGMRRYLSSCFPAESHPLSGSRRNAFRWSWIFALTSSSCVTGLHLKGDGLVHVRVFTKICISTSENGGSRCRVALFLDLVIRPGAPIFQSRFPAEDQSLLVRMDAFLILDL

SEQ ID NO: 1003238 - protein, 164 aa, Homo sapiens
PAIGQSARVFDAQLARARETACVAQHMASLWSERFAGDMSTQKRLTDHFARLLERPFVGPLNEERVAQAREALRGESLADVVYRVLREQARDLEPLRLAEGNVFAGIAPSVPGFYTKRYLQYFETQAPRLVDTIARDNWVLGEGADLGHQDLSRLMAQLQQRFF

SEQ ID NO: 1003239 - protein, 51 aa, Homo sapiens
MRGKWRLPVLAMTLPICGNRCEFINSSMSFVQVLGPYSTGVKKVTNVNNLQ

SEQ ID NO: 1003240 - protein, 50 aa, Homo sapiens
MAFSRIQAIDVTVLIVKGSIPEVLGQLKCYLSWGYCDFFPMPYVNFTTRI

SEQ ID NO: 1003241 - protein, 72 aa, Homo sapiens
MSVHKTRACSWQIAPFSVQHEASRVLHGLLLIVGPDLLFLLLGGLLGRQQGLVVGAAFGGEVDLGERVLHQQ

SEQ ID NO: 1003242 - protein, 77 aa, Homo sapiens
YFQQDTYGATTRKALLYLCGGDDVKPDHGAERPERVLTRLPANRSRKTSWRITVPGAIPVRVTLALPPNLILVAEAG

SEQ ID NO: 1003243 - protein, 59 aa, Homo sapiens
GVWGDEGSPTRAERQKGGVTRLPGEQVWKTSWRLTVPVAIPVRVTLAFTPNLIVVAEAG

SEQ ID NO: 1003244 - protein, 59 aa, Homo sapiens
VGSPDELKGTVSSPESSTKGGWVIYGILLYGKFPDTAHFGALTQLRSMPGIPLFPPFSS

SEQ ID NO: 1003245 - protein, 33 aa, Homo sapiens
KALLYADVVEMTGSPTRPERPERVLTIFQANSV

SEQ ID NO: 1003246 - protein, 83 aa, Homo sapiens
GGRGQSSVPGHDRVVISHDSVDKVPGVKAKATQVIMNSLITKQTQESIQHFERQAGLRDAGYTPHKGLTTEETKYLRVAEAGS

SEQ ID NO: 1003247 - protein, 60 aa, Homo sapiens
ASPGNSSVLGKDTTQSKPVSSPLPTKPWEGQAEGDRGECKGGDEEENDEPPKVVVAEARS

SEQ ID NO: 1003248 - protein, 101 aa, Homo sapiens
PHLMPLDASHIHSLSLSSHDIAQALVKNPPPPTVDQARRTAQSFPDKSPPRQASVGILQLPTAAQARTDTTLFPALLFAPGPGLEGGTYGLQSEFFIATTR

SEQ ID NO: 1003249 - protein, 84 aa, Homo sapiens
LKPAHRTLHQQPAMMWSFGIVMCRGAELCGDKPYRERMSNQRGYELSIEVWVPGCPPPDVTALAPSCLSLMQELLGSLTGARRA

SEQ ID NO: 1003250 - protein, 46 aa, Homo sapiens
MDEDADSENDYQGVIFKSDKLFYDLGKYASCRPTLRCMCHASRGFM

SEQ ID NO: 1003251 - protein, 47 aa, Homo sapiens
MPSQGESSEAMELSDLLCATMLELFFYSSYFKTKAGCGKHVPIAPSY

SEQ ID NO: 1003252 - protein, 43 aa, Homo sapiens
MDLVDMSHVTHSTEPLFKNVSPWETSTSSYSSYFVLRPLVPIF

SEQ ID NO: 1003253 - protein, 34 aa, Homo sapiens
CGRSGPLTLWHVLSDAAGEDVRADGTPPGAPGRP

SEQ ID NO: 1003254 - protein, 121 aa, Homo sapiens
LRDIPKAYCLIDIIGVHHNPHVWRILRCMPTPFNSTHPIHSNKVCVYTTFRFDPENSKGEVNSGLYSFIRQGPGTANGQAFAMEEMKVVLALIATAPLSYTGWNAVALYQLTAGLTTGVKP

SEQ ID NO: 1003255 - protein, 43 aa, Homo sapiens
NDWCAFCGLDTTSTELSVVKSVYKDTEQKYIIMVHKYYMSQKH

SEQ ID NO: 1003256 - protein, 59 aa, Homo sapiens
GVVGDAVETVTSDALASLEELGGTTIKGDPNGSQFYEILTDPSDDTKGFFDPITIHPHP

SEQ ID NO: 1003257 - protein, 100 aa, Homo sapiens
VNFGHTASTPDDCSKCIIPEVQCLETKMRRTLERNFEDSSSTCHKCDKLMAWPCILSIHPPIIDHLSILELGYLRVAKSMLRNVSLQGRALSPHFHCFTK

SEQ ID NO: 1003258 - protein, 55 aa, Homo sapiens
TVYSSAIVTLKENERFFGRRCSKAWRLENPKATHTLLPDTSWGTQADNPTCSSIT

SEQ ID NO: 1003259 - protein, 34 aa, Homo sapiens
LNGRLGILESLEAHRLSLWRRAVGTAPPSGRLFQ

SEQ ID NO: 1003260 - protein, 35 aa, Homo sapiens
RHFSWDVCLTTVSYTGLWFTGTLPLWGLLYDVDLH

SEQ ID NO: 1003261 - protein, 44 aa, Homo sapiens
ERDDLRMEPSAGQHILRSQKPVMVKSKRTAHQELLSPLAPKSMF

SEQ ID NO: 1003262 - protein, 109 aa, Homo sapiens
MSIYAAAHAGELAVGMSVSWAREMLQALVLFKVYITGEATLTGLEWMDGFPGEETEYMRSQGQGTLSVDKSSSTAYIELTRLTSEDSAVYFCARGDYYRRYFDLWGQGT

SEQ ID NO: 1003263 - protein, 47 aa, Homo sapiens
TVVLLAVAALRCVAAIPPRHRLSSSPLDALVAKGRHQRPGGIAATTA

SEQ ID NO: 1003264 - protein, 187 aa, Homo sapiens
WGAVWDCSGNELGKQQVGVGLVLGEYQGRDEVVDGLALLQLVFHLDEELHSVHQHLHQLHLSEAQGDSVGDVEHPGDRSRGHTVCASLLKSQPRKRLREVLMLAQVGQLDMHTCPQAGAPVACAGEDVGQVRVPDELLVLRLEQSYNLGEAGAQAGEDVLHVDAVLHGDDLQVDSSLTTSGRCLDMC

SEQ ID NO: 1003265 - protein, 62 aa, Homo sapiens
VGLTLLPKCVRTPDGRFDGHGHDPAQRPQNYLFGGELKADKDDRIEVDNDENEHQMISEEAD

SEQ ID NO: 1003266 - protein, 35 aa, Homo sapiens
MTLIDRVCSLRCCYVLVGFRGSSLGSPCGLGAYSG

SEQ ID NO: 1003267 - protein, 76 aa, Homo sapiens
GYAYRWAVQAAHMHLGYNIRKYVAGNVNTGPLEAIASMRKFKALISIARRSVMMIIAIGSIYRAGVIITSGRRPMA

SEQ ID NO: 1003268 - protein, 74 aa, Homo sapiens
MADLKWLSHPRPLFGCEADLGHRIRHLPPLEQLASLTDSPVRVERKQPRPRSTVVSPCRRCWGGTMMAWGVIWL

SEQ ID NO: 1003269 - protein, 39 aa, Homo sapiens
MRKFKALISIARRSVMMLMAMGSIYRARVIITSGRCPMA

SEQ ID NO: 1003270 - protein, 39 aa, Homo sapiens
MPQIKALISIARRSVMMIIAIGSIYEGGVIITSGRGPMA

SEQ ID NO: 1003271 - protein, 39 aa, Homo sapiens
HVCAQHKLPAGLLRTQKHQHYQRSARAGAGVELMQKWNF

SEQ ID NO: 1003272 - protein, 54 aa, Homo sapiens
VHLRYPWSPKPWSPTLEHQTLEPPIPGDPSLGALKVGLALILGPLSSLLSSDFW

SEQ ID NO: 1003273 - protein, 55 aa, Homo sapiens
KTTTVTETLVGFLMYRKQESTVPELKEVSLLICVWTNFFKTPLLTMELILPCNVI

SEQ ID NO: 1003274 - protein, 88 aa, Homo sapiens
SFRSFNSSTTQQYLHLLSTTSDLVEEATSYDSSRGSMATTHFPESSTTSGRSEESTASHSSPDTNGITPLPAHCTTPGSNVLLKLLET

SEQ ID NO: 1003275 - protein, 34 aa, Homo sapiens
FVVACIHHCGACSLYKFRREVSTVLTSKYRSAGA

SEQ ID NO: 1003276 - protein, 78 aa, Homo sapiens
EQMAYYELRAEHSVDIDVAMLAYAEQRVLRYGYLGKAKLKELSLWVGTIDGCLTNGHIYVLRTTQKDIILLLTVEDCY

SEQ ID NO: 1003277 - protein, 34 aa, Homo sapiens
KSSEQIETVLYPTEKEEVAKSQDRRDRQTPSPGL

SEQ ID NO: 1003278 - protein, 34 aa, Homo sapiens
MMPFPVPLPVFRKPVCDEETLKKKGSQGPFRCSQ

SEQ ID NO: 1003279 - protein, 30 aa, Homo sapiens
MRISVINSNLVPRDIASVYARPVRVKPVYS

SEQ ID NO: 1003280 - protein, 106 aa, Homo sapiens
RLWGSSSSSASASRVAKMTGMCHDTQLIFYFCREVSLCCPRWSQTPGLKQSFQLSHTGITAASHYTWVNQLLPMNVSLLNFYEYPQLKIQRSHILCNSIHYPFRVD

SEQ ID NO: 1003281 - protein, 85 aa, Homo sapiens
DAQRKRVLFSSHFLQMAFKSFRNTQFIRRFMVSLNMPHSVKSDVRRPSWWLELSFMIYLRSPVKDTFSVYLPIMILFAIETSKTR

SEQ ID NO: 1003282 - protein, 64 aa, Homo sapiens
ARQVQNEPFAGGEDGTTLSHAGQSLQPGPPGCVRRRRTPPHGPAAPGLGGPGSLLTDAGHVPQC

SEQ ID NO: 1003283 - protein, 33 aa, Homo sapiens
RWMPLLQHHGYSGTQHPKPPACHVMHLSSQRLD

SEQ ID NO: 1003284 - protein, 67 aa, Homo sapiens
PVELGHRIPLVSFGRTCSVFADFSDLDASVGEALLAVTAPTLRLMSSQASAVCIFGLGLSLELPRCL

SEQ ID NO: 1003285 - protein, 63 aa, Homo sapiens
MHALCLHSRCSQQLVNQPQTHSCQFQPHPFHYPHQGTSLFSSHFNHLISNTLPNARVLHVHIK

SEQ ID NO: 1003286 - protein, 62 aa, Homo sapiens
AAAVRSVAVRSSMTNLTNMMKPVFTNNTKISRAPQLLRRLSQANCLNMGGGGDCSELSSDPQ

SEQ ID NO: 1003287 - protein, 41 aa, Homo sapiens
DFEDEADVNGVDWYRGEDNRTLVAGSSESLRYGSETEHPPG

SEQ ID NO: 1003288 - protein, 36 aa, Homo sapiens
MLTRLLLVDWSSSSTTGRMCCWGVVGLGAIDTFSNS

SEQ ID NO: 1003289 - protein, 47 aa, Homo sapiens
DSSWYPMLRKPGSSASDADVRDGAVDPAVLVAAVQPDATSGAYRITT

SEQ ID NO: 1003290 - protein, 39 aa, Homo sapiens
ATDNFQYPTVTLFLRSPSTEAQDLKCQFYVGKDTGINYI

SEQ ID NO: 1003291 - protein, 36 aa, Homo sapiens
RYRQNRAEPPPIDAMALLLYTSAGCTRELTEEGEIV

SEQ ID NO: 1003292 - protein, 73 aa, Homo sapiens
VGPSFRSITSITHSRLLIEIFLDSFPHEFRKALRCSVYFHTYSVNHLLGGAGDNTLLQVVGLLLKVFTSLVIS

SEQ ID NO: 1003293 - protein, 74 aa, Homo sapiens
MIELLIGAAVAAGVGRYIIKGYSATGVLMVGGLLLLGISALMGKTLLPSGAASTGGRATDIIEYVKILLMSRGG

SEQ ID NO: 1003294 - protein, 35 aa, Homo sapiens
LWLYSLSSLFQAARTHLSLKLKLIQCRLRRIHVTI

SEQ ID NO: 1003295 - protein, 45 aa, Homo sapiens
MLPITCLESSSQTTALEELVGLKGAGARAKPKAWSPRLVAKAGAC

SEQ ID NO: 1003296 - protein, 32 aa, Homo sapiens
VCRRVFTMRSWLPVQVPSRSEHVLTSKYRKLE

SEQ ID NO: 1003297 - protein, 60 aa, Homo sapiens
VDKSCRQVSTCCPPNIVKLEPGRRVSPMGPCSLYKFRRHVNTVLTSKYVKLEPGRPLDDP

SEQ ID NO: 1003298 - protein, 53 aa, Homo sapiens
MASSMICNGCRVTEDLVTIITLVTSPYTMDCLMVNKCRLCTTGFPWCREHVEF

SEQ ID NO: 1003299 - protein, 94 aa, Homo sapiens
LLSVSPQLTPFDPHNPSFLAHIATAPTKKFRTLSLSTSDSTFVGSGTSSWSPDVEKGHGISPPKNNTMIPPASVCSSSCVQVYLLCPDKMLWES

SEQ ID NO: 1003300 - protein, 104 aa, Homo sapiens
RYVSTILDDAKHLFQAMLQKATVDADDVREESSAALIRLLTLLPQAIFYSLLQGKEIKPPLPLIKPYSGPRLPTDRYCLTAPKYRLQSLQKKASTSAGRITDPR

SEQ ID NO: 1003301 - protein, 124 aa, Homo sapiens
NKFPPNGQSHSPSSKYLHALELIDSLYYRKSICFSSFSSNQYSIGMTKLDVIRHSGQDFMIYALKLLSTPPLGMHLRTVGVVAVGEDPEAALTGVGFLKNTSMQIPHNMSLLRCTANESSMSLS

SEQ ID NO: 1003302 - protein, 78 aa, Homo sapiens
ASDSVTVAIEPKASISNTTAHIFFSTLQLGVWHASRDPATWKAAVQKHPLQPGNLQASVQLMHCIHCTPSLRPTRGIL

SEQ ID NO: 1003303 - protein, 39 aa, Homo sapiens
HLNDPILNKNGARRWTALSSAFSSLGDPGTGAPLRVELR

SEQ ID NO: 1003304 - protein, 62 aa, Homo sapiens
RCITDVSLVCTWTCLALDVCASLSGPPQCDGLALAHHDLGALSPGSHGADFSGVPVPYIQPG

SEQ ID NO: 1003305 - protein, 48 aa, Homo sapiens
ARVPHESRSVLVCTWGRRHYWDMWTFNNRGLLYDVDPAGLTAGDLAVV

SEQ ID NO: 1003306 - protein, 39 aa, Homo sapiens
HVNRTRKSVQEACEVKKGKDPNAPKEAHVCITICVFNAS

SEQ ID NO: 1003307 - protein, 51 aa, Homo sapiens
VTSADLLAEKSCWDMKIEDYFPEFGRYTTPEDATPETRKDPRVNRAKYFIR

SEQ ID NO: 1003308 - protein, 56 aa, Homo sapiens
DLEDPPFSGELFLLLLLLAFSFFTVGFLALPGMLSCCLEPAAWDFTSVSESLELLL

SEQ ID NO: 1003309 - protein, 82 aa, Homo sapiens
LDVTGSMLTDIMEVSTGAHCVDGTVYREACTDGGEYTSTRLQLNRYLEVSMVLMCRRNLSRAACIAVVNTRRAGGMHALVGN

SEQ ID NO: 1003310 - protein, 35 aa, Homo sapiens
ARRRVITTAVLAPCTSSVDTVSTCADLQDIVKLEP

SEQ ID NO: 1003311 - protein, 52 aa, Homo sapiens
MSRSSLTRYSGVFQAAPNSRPAPPTLEEECRLLGAQAGLPGSFFPRDSGVWC

SEQ ID NO: 1003312 - protein, 63 aa, Homo sapiens
RAVTFSHCERSTRTQAKPSTLCLETSYTPVIPATQEAEAGEWLELGGGVCSEPVSHHCGSSLG

SEQ ID NO: 1003313 - protein, 36 aa, Homo sapiens
RTHPGLLLLGLPGRLTGGLLYDVDAARPERLGPGLS

SEQ ID NO: 1003314 - protein, 50 aa, Homo sapiens
CGSIAGWPGEQLHGWHCVEGLPAPSLVFGLVRQLVDLCIQPSSLSQSTSV

SEQ ID NO: 1003315 - protein, 39 aa, Homo sapiens
QRSASGCPPHSRFSTCRQVCGSGSPITSAIGLQMGRNII

SEQ ID NO: 1003316 - protein, 50 aa, Homo sapiens
MSRSRVSLVPRLQSMCITAHASLTFTSASQVAETTGMHRHGWLFFNCLFL

SEQ ID NO: 1003317 - protein, 33 aa, Homo sapiens
MEDPDMTQACMLARRRVYTTAVIASLYKFRRDV

SEQ ID NO: 1003318 - protein, 34 aa, Homo sapiens
YKQSQHIDGGSEALPPPMSACQIAMVLAPPQHLI

SEQ ID NO: 1003319 - protein, 59 aa, Homo sapiens
PRVSLVYQSVHFDPKISFISGLRPGVQGAGFVQLLWLSLPKFHCVSFFPSQEVILITFR

SEQ ID NO: 1003320 - protein, 35 aa, Homo sapiens
MTHGRPRLTSQRTFFCTTFYYDCTYPFNLTVTLHC

SEQ ID NO: 1003321 - protein, 51 aa, Homo sapiens
VNLSTLGGKAGITEVGVETRLMEQNGKPRNNATHRYDHLIFFLFLERERDS

SEQ ID NO: 1003322 - protein, 74 aa, Homo sapiens
TTRVRGGSLESDEAPALLIFWRSALVLTVSTELCTGRHAPIVGEYTVDHGSSLYTDIMEVSTGAHRVDRNLSKG

SEQ ID NO: 1003323 - protein, 47 aa, Homo sapiens
MTGIPHAGGNGARLGFIQLEDTLLCWLAGPVVLAEGSAVLCHPIKVQ

SEQ ID NO: 1003324 - protein, 63 aa, Homo sapiens
WDTIFVKTRDWYGASPSTVEPSDTIGNVTAKIHAKEGITYLISTRLIYCVGNTLEGMDAPLCD

SEQ ID NO: 1003325 - protein, 61 aa, Homo sapiens
GYYSRCTHDTYRHRFTDHNLTDDKTYTTTDTTQYDMTTDVTTTRTTTKTETTRTNGHTYYT

SEQ ID NO: 1003326 - protein, 41 aa, Homo sapiens
LRVRSLLSLFCSDICHLYSITQCPLGPGVMARTQRLYDEDG

SEQ ID NO: 1003327 - protein, 40 aa, Homo sapiens
MQSSWQSGQGCPPCIWRGRQLLCAVMELGRGNMRRHPVFP

SEQ ID NO: 1003328 - protein, 89 aa, Homo sapiens
GGSVGTDRKQRLTEVTRQVEQAGLGSKSVPVLGCEAAKGTGGRLGTYLSLEPRTVLGFVLGPCRLCSKPKVSFIAHFLDLARLFFYSFF

SEQ ID NO: 1003329 - protein, 60 aa, Homo sapiens
TPQFISNHQWSVDRYFQKESVLGPLALRAHPGVTGQPPGSKGSHQVLPMEGLAATSHCNP

SEQ ID NO: 1003330 - protein, 52 aa, Homo sapiens
CYQEEGRLAHCPQCLQTLASCSVLARVPFRLSRGAFLPRIIIVPSLCLFGDP

SEQ ID NO: 1003331 - protein, 65 aa, Homo sapiens
KADLGGWGLMAYLPPYASGKRVPEARWYSTLVLREKCMCRVLSSLTVTGDFLQGLVPTCVSKNTL

SEQ ID NO: 1003332 - protein, 76 aa, Homo sapiens
MGVACFWANNRAKYSLMAGVAVNVIVTTTVKGSQHCAFQVILDHKICDNAGEEIYTLILIIFTEHGVAPSIKITEH

SEQ ID NO: 1003333 - protein, 71 aa, Homo sapiens
MNIAGWGHGDLCVLMWARLSTDPTPLLSRCCQIRTACYALYDAIYETKFPPGSPVVGEPVFFLTTSPFLTV

SEQ ID NO: 1003334 - protein, 37 aa, Homo sapiens
GPICAYINGQIQSLRRPLQSSWEGSDKCTSNKYGAQG

SEQ ID NO: 1003335 - protein, 41 aa, Homo sapiens
VRRATVRSPLDAPAPPPFPVFPAVSLRGLLYDVDPAGMTRL

SEQ ID NO: 1003336 - protein, 57 aa, Homo sapiens
APAITIFGGQHGAHCVDGTCTREACTESGEYTYDQCSSLTDILEVSTDAHCVDWNYV

SEQ ID NO: 1003337 - protein, 44 aa, Homo sapiens
YRFWFRKAFVLQFYNEPGAMAHACNPSALRGRSKRMLGPRMSKL

SEQ ID NO: 1003338 - protein, 142 aa, Homo sapiens
MLPSVSVCFHAADKDIPKTGKKKRFTGLTVPHGWSQNHGGRRKALLTWRREEKMIKQQKRKPLINPSDLVRLIHYHKDSMVETPMTQIISHQVPPTTHGNHRNTIQNEIRVGTQSQISRLVSDSAQAILLSQSKKCCDYKHK

SEQ ID NO: 1003339 - protein, 45 aa, Homo sapiens
VRATRPDSAAQTTPRMEVLKAKSKTARRPIRLKVTEEYNLPLHLD

SEQ ID NO: 1003340 - protein, 34 aa, Homo sapiens
MRGPCRRSWPYLMDYRCPWNQVDGAVYSQYFLGL

SEQ ID NO: 1003341 - protein, 100 aa, Homo sapiens
QKAGRWQMCVGESRGMRWWEGERQEDSGITPEGCDHRRLGKIEVKKPFAIAREWGQGHLSLSDGLWQACSPQGSELHWPGCWHLVRTTRLTFHRAMDSLS

SEQ ID NO: 1003342 - protein, 77 aa, Homo sapiens
LGDLEDLLGLTRVAMWTARVVFAEATSRLSGPDAAHFPSSKLTRQSMHLRYQHKSVESLSGLRPRLASETILQLNPS

SEQ ID NO: 1003343 - protein, 35 aa, Homo sapiens
SVIFDYRLRAPEISHQQPTESPPNNRLIKLILKTN

SEQ ID NO: 1003344 - protein, 72 aa, Homo sapiens
PVLHHEVKKLVDEKHVVGSLEGMEVVRKVESTRKTAGINPLKDVIIGDWGKIEVEKPFGICKEEGTGTSFFE

SEQ ID NO: 1003345 - protein, 37 aa, Homo sapiens
RDLESDFGEDAIDGVRGAIIKHKIENVAEVTPPLDIV

SEQ ID NO: 1003346 - protein, 39 aa, Homo sapiens
MRKLKLLISIARRSVMMIIAMGSIYRAGVIITSGRRPMA

SEQ ID NO: 1003347 - protein, 37 aa, Homo sapiens
SDTKYFELCNVAVEMYAYRWRSWQAANMHPRPINIRE

SEQ ID NO: 1003348 - protein, 40 aa, Homo sapiens
ADCCGSAFFPPAATLSEPPVEEEVRLLFVSARFSVISSDG

SEQ ID NO: 1003349 - protein, 95 aa, Homo sapiens
LRRGSPEASTLSTTPVDSNSPVVTSTEISSSATSAEGTSMPTSTYSEGSTPLRSMPVSTKPLASSEASTLSTTPVDTSIPVTTSTETSSSPTTAK

SEQ ID NO: 1003350 - protein, 35 aa, Homo sapiens
NGALLEEAQYTAAVFPATLFLLIKTQSEEQVLLAY

SEQ ID NO: 1003351 - protein, 89 aa, Homo sapiens
WFLQNGGRCHQVDGAGVILRGVHHQSDVWSYGVTCVGADDFWVQTYDGIPAREIPDLLEKGERAQPILTIDFYMIMVKCWMIDSARNPE

SEQ ID NO: 1003352 - protein, 37 aa, Homo sapiens
SPEVEQHRHIPNQLFINLTDLLYLDLCNEPTLVPELE

SEQ ID NO: 1003353 - protein, 51 aa, Homo sapiens
RTVAGGSRSGQLTTSLRASYPKYGSVADSLTTLSKCRGVHLGELVRNWYGG

SEQ ID NO: 1003354 - protein, 100 aa, Homo sapiens
VSLEEEIVSHCTQLLRQYRGGAVGRLVICKTGGIPVFQQGMKNKILIFGLFEETGLAAFLSYWPGGWVEKENYYEAPVLHAVEHQGTQSGRKPRRQGAEL

SEQ ID NO: 1003355 - protein, 143 aa, Homo sapiens
RVVLATETVLRRHCERKACADDEQDGPRPVELQWSPRSSNRLSRGIVQNVNVIISTYGEGESGPMGNIMIDPVLGTVGFGSGLHGWAFTLKQFAEMYVAKFAAKGEGQLGPAERAKKVEDMMKKLWGDRYFDPANGKFCKAPT

SEQ ID NO: 1003356 - protein, 67 aa, Homo sapiens
EIRVVLADIGCCSATGRLVQLMHALADVSLLSAVLQLSLMAWFCRSSSSCASCSSSSARVSDRARAS

SEQ ID NO: 1003357 - protein, 95 aa, Homo sapiens
ALVIHIFLCIPPVGEQMLLQFRWGLLDLSAEEGTFSFTPMFGNDACTRPSEIVRHSDEECWFTHRLSSDGDHGATLLDGLMVSTSELPDSWTQFG

SEQ ID NO: 1003358 - protein, 129 aa, Homo sapiens
VPVARLESLMNSTLTDELGKLKGKSERSSEDPTDDSRLPSGRKRRREKDQLRTQVVRLQAEKADLWGIVSELQLKLTSSGSSEDSLVEIRMAEGEAEGSVKEIKHSPGPQRETVSMGRALSEIIGADLQ

SEQ ID NO: 1003359 - protein, 62 aa, Homo sapiens
HPECHLAEALPAAVSLDDLARATWAHSPACLTLHILGLKRTAQIRLFLPVYFGHFIIIKALS

SEQ ID NO: 1003360 - protein, 91 aa, Homo sapiens
RSLPLLSSLLLSSSFTSLTTGWSGPRSAALAAFSRSCAFSFRPSLIFTLTDRDSDSEPSSSPSSSSSFSSPSLSSSFSIFCRTLVKTDGSG

SEQ ID NO: 1003361 - protein, 39 aa, Homo sapiens
EPVFPFCPLTAGPFRATRVPCFTTDSLTYWTDSLLDPFY

SEQ ID NO: 1003362 - protein, 37 aa, Homo sapiens
LTDDIRSSICPHPRTCWQLSPSDLQWFTGAEERADRL

SEQ ID NO: 1003363 - protein, 50 aa, Homo sapiens
QHNTLTTNATTHYNYQRRLHTPLPTTTLLHCTTTNTYYYYSTRTTSYTLT

SEQ ID NO: 1003364 - protein, 48 aa, Homo sapiens
MGSGGGAICILAYKYSGVYVAGNVNNLCTSRTIASMGKFKGGDIDSGA

SEQ ID NO: 1003365 - protein, 60 aa, Homo sapiens
MQNEDESRWVIPMPSASIRDHVQCCECVTQPTTMTTTTTEPTPRAITTTTTVTPARSPSP

SEQ ID NO: 1003366 - protein, 35 aa, Homo sapiens
MASTGIGERYRTLVVVLRSFLRIVVSRELSTQRRY

SEQ ID NO: 1003367 - protein, 59 aa, Homo sapiens
RAGELGRILSVPESQKGACRLPGCCLQWAGCCACRRFSGLSAELRNQLDVAKVSQPGRA

SEQ ID NO: 1003368 - protein, 186 aa, Homo sapiens
YNRWWRRVYGRVQEGRGRKMATSGANGLVRHGSCSNPRKFSEKIGLRSSVQAEETAAFEEVMMDIGSTLVTGPKNCDVGITSELIMGGSLAQLLTQIWLLALAEVPRAPLHSTFGIHLREHSCTNGLGVNGGAVRILEAMVSPVRAIQPATLTGLPIVLPTYLLPQSLAGEGRWAGAIPLQRKGQW

SEQ ID NO: 1003369 - protein, 98 aa, Homo sapiens
MKTNLKFILMDCMEGRVAIHRVANLLLCMYAKEHVGFGMLKAKAQALVQSLAGSPSTQVAAIFNGHWWHSWGQHTEHCTICQGRGLLTSNFFRNGGQA

SEQ ID NO: 1003370 - protein, 33 aa, Homo sapiens
IPPRGPVSALSGVFRVPAGLLLFLWWVTCPHCA

SEQ ID NO: 1003371 - protein, 59 aa, Homo sapiens
ARLSPFLRRRSPRAAGPTAGPVRPGRARCPFDRPLALCCTVSVYDGLPAPTFTPLTCRP

SEQ ID NO: 1003372 - protein, 38 aa, Homo sapiens
ELCCRTHVWSPTSQLMAFVPPPMFLGASSSSVCRQSLG

SEQ ID NO: 1003373 - protein, 69 aa, Homo sapiens
WRRDSHHSHDSEDFWTPRYQLKTLWAVTHETRQHRESDQAPASTMGLHCMHGKGSPLPQTSRPPTCRSP

SEQ ID NO: 1003374 - protein, 42 aa, Homo sapiens
LGDSSGAYSAPQLDQMVFDRTSRARGVRKPKLFYAEHPFILP

SEQ ID NO: 1003375 - protein, 96 aa, Homo sapiens
YLHHRSARVTARAGSQRAFAPLLTPARHPKCSVLLLTPSAWLSSAAGLATTGSSELLPLALSTAVCQVCAALGWNKHSQACLFCLSSIFVDLVCIR

SEQ ID NO: 1003376 - protein, 48 aa, Homo sapiens
LFAHSAERRLSLVEVRTGSRTSKSRKDRSGQQDCLSLRKLTACGVGAF

SEQ ID NO: 1003377 - protein, 43 aa, Homo sapiens
CGVYDLSAPQLILYIKVSEDCNNAGRKKRLSTSILLVHYHFDL

SEQ ID NO: 1003378 - protein, 33 aa, Homo sapiens
FAPTAHQHHDTFHNTLQPLTILLYYINNSSYIF

SEQ ID NO: 1003379 - protein, 47 aa, Homo sapiens
RGSVRCEKEQQNQEYKIVLSVKTRLEQEIATYLPLVEGEDANLSFSQ

SEQ ID NO: 1003380 - protein, 42 aa, Homo sapiens
FTLDVEIATYRIAVEGEECRLNGEGLDKFNISVVQSTVSMCY

SEQ ID NO: 1003381 - protein, 38 aa, Homo sapiens
CLEDPRCETRASRRTELLIVFLLEEVVVYLMVGTCRPP

SEQ ID NO: 1003382 - protein, 71 aa, Homo sapiens
YDDSVWFFDHDYLDKHVWTCLMNVTCQAKEYWLGTTQALNYTRMTLTSNDAQGQRYLSYIPVLGHHLNVNA

SEQ ID NO: 1003383 - protein, 67 aa, Homo sapiens
DLEDPSTRKNGDTRQVRTMWKRQDGKVISSREQVHRPPAEDSATPAATQEGRQPAHLPHSLRPLQPQ

SEQ ID NO: 1003384 - protein, 63 aa, Homo sapiens
SQILSEPRSSAMGRSVSEWYPGEEAATPWQCLGLRRLVPAAESTGGASALLEAEFHHQVHHDL

SEQ ID NO: 1003385 - protein, 86 aa, Homo sapiens
MNFLQKSPGAQTGTVTMTPNASISGYTSCAILRVLANECGNRTKQSRYHLEICDEILQPVLSMFSSLFCKLSSFVLQEDSLKYILY

SEQ ID NO: 1003386 - protein, 81 aa, Homo sapiens
MLYMSAGVAYRWAVEAAHMHLGYKYLEYTYADSNNRYLWNIARCEIKALISIARRSVMMIIAIGSIYRAGVIITSGRRPMA

SEQ ID NO: 1003387 - protein, 37 aa, Homo sapiens
MTGGKSFNPGWKEITGDLQRDSSVERFSCSVVGLSTD

SEQ ID NO: 1003388 - protein, 47 aa, Homo sapiens
MTRSQAHLLLFWDAHHPHGLHALLEHVLVLRPGHVSTQGGLESWKAA

SEQ ID NO: 1003389 - protein, 35 aa, Homo sapiens
YSRSFDFMSGILNLKGPKVKGDVDISLPKLEGDLK

SEQ ID NO: 1003390 - protein, 56 aa, Homo sapiens
LRIPVTRRPEGGAVQLRVAKVTGGCGLQGSLRSESSGNHAVFTVLTSTSREETQEF

SEQ ID NO: 1003391 - protein, 68 aa, Homo sapiens
VKHSSSQSGVLTPAVFKIWTSGQVVGANSSSPFTSNVLQPIGMLRLQGHMYTYTHKPPRLRPRADVGV

SEQ ID NO: 1003392 - protein, 203 aa, Homo sapiens
STGLTCSEESTTVTSSQVHWNSTLPTRSELSSCWRTYNVTISSGSTETTALPGSNTTAGLSEISTNFYSSPRITGKKNLHLPARQAQGSVKKSTTSHSRPGSTHTNSIPWQYHHARRQSGIYSFPQQPRLHRHNTVPWQYHSIIPWSQNLLPSTAAQAPLKQHSYLTSPQPPASLKHLRPSTAALDRHTQHCPLPALQPVRGY

SEQ ID NO: 1003393 - protein, 85 aa, Homo sapiens
IPCISEDRGKERRSLRYRVILSGGLTPVSQGPERNSGVGSDQQVGYAGIIEGEPEPAFRRKLEVLWTGCSGLRWGGRLRSRNCPH

SEQ ID NO: 1003394 - protein, 86 aa, Homo sapiens
SLHVVRTQREEDYDLLEALSPDYDVILMCFSIDSPDSLEKIPEKWTQKSSISWSKRCPSSLVGEEEGIFWNDYAHKGGELSPMIEC

SEQ ID NO: 1003395 - protein, 35 aa, Homo sapiens
MACSEDSHEFKWVSFGSCSGPWRRYFWVYEVLARV

SEQ ID NO: 1003396 - protein, 209 aa, Homo sapiens
LPPIRRARPDPGLHPTPTSSHPTSLRLTGLHFVVKKGFRPGAVLTPVIQHFERLRRADHLSQEFETSLANMVKPPSPSWVSPPSSVPTMSCAGDLLAALIVLAVLEAILLLVLIFLRHGIRMAIALLKEASKPVGQHDVYHVHTHVVPFVLLLICIATWAMTALTWLIRGNPSMSLGIHISSPAGESAITPHAPQGHLVNPRASVVCVP

SEQ ID NO: 1003397 - protein, 61 aa, Homo sapiens
LRGSRLFWTLTGYCAWAMRLAGALPSTGLPQAPGHPNFPLILLHRTLRYHTWSLAFGALCL

SEQ ID NO: 1003398 - protein, 64 aa, Homo sapiens
YSRDPGSSGPYWVLALGNASRWSFASFYLGFHKPRTSLTSPLNSGSIRTLRYHTGSLAFGALVL

SEQ ID NO: 1003399 - protein, 42 aa, Homo sapiens
NVGRTDMGTHKSVTVDKRAHVSDACIILSNRSVRDNKQYYQR

SEQ ID NO: 1003400 - protein, 87 aa, Homo sapiens
MSLRERHQEVDFLVLVHRCSAVRCSELFDPLAEVGHPLDDGHAGSHRVVVQLRGKIPFTSSLISVRKSVGLLLLSFAHLDDICKEPT

SEQ ID NO: 1003401 - protein, 59 aa, Homo sapiens
GHVIECIAGEWEVGNGMYKEEEMERKVDEGYGLGVQRLEGSGVLRDLPEFFRINEVDLA

SEQ ID NO: 1003402 - protein, 69 aa, Homo sapiens
DDLEDPIARRTSSPVEVSQPTTAAELNSNNTLFCQFHNLGPVVRNQQQSTAAQVQLEQHSSLPALPGTH

SEQ ID NO: 1003403 - protein, 39 aa, Homo sapiens
MHFPESDTTSGRGEESTTSHSSTTHTISSASSTTSARNP

SEQ ID NO: 1003404 - protein, 35 aa, Homo sapiens
RPAATALEHLIRSTDRLRFPYYIVQHAEVSLGDCC

SEQ ID NO: 1003405 - protein, 66 aa, Homo sapiens
DSKRSRVVLAEQTRRTIRNSVTLPHPGMVFSMGEELPMHTMFLLNIVEDGLALDTTEQLADLWKET

SEQ ID NO: 1003406 - protein, 60 aa, Homo sapiens
MGTPQAGPCVWFASRGRCSAGTEGCVGLQTGALQARARHEAAVEHAGIVVVLRGHQCVAL

SEQ ID NO: 1003407 - protein, 36 aa, Homo sapiens
AGTDYAHRRVCSFSVLGSSSGFGGLSLGSPCRQERN

SEQ ID NO: 1003408 - protein, 42 aa, Homo sapiens
LYSTYLTPYVPGDRLTQHFYCTFTFFYWTTFYHTWGGLLYDV

SEQ ID NO: 1003409 - protein, 70 aa, Homo sapiens
HLGKGPVIMPLITPTVSLLTPKPLQQLEVPLISRETCNCLYNINAKPEEPHYMSKRTWWVLGYVEGGKDA

SEQ ID NO: 1003410 - protein, 51 aa, Homo sapiens
MSKVNYSIYPNYYRSPYYYTVKLQHHNLTVIAQTETYYPDYNRVLHTRSSA

SEQ ID NO: 1003411 - protein, 38 aa, Homo sapiens
SSVFFSIATGYLKAWCSDVVLVPYYSPELSVDLHVLLK

SEQ ID NO: 1003412 - protein, 79 aa, Homo sapiens
MPRTLAGATESDPSQKKKKFIWESREDPIIPKTILSKKTKAGGFRLPDFKLSYRATAAKIAGYGNSQNKGGPSKVDRRA

SEQ ID NO: 1003413 - protein, 44 aa, Homo sapiens
DLVAHDCITALPTHGALYAWELRARDDVLQVRVDGQVTFNGTYE

SEQ ID NO: 1003414 - protein, 63 aa, Homo sapiens
MAVIDSDLFTQRALMQVYKEINIVFMPANTTFIWQSMNQRMPPTFKSYHLRNTFHKAIAAIET

SEQ ID NO: 1003415 - protein, 43 aa, Homo sapiens
MQSRELDSLIRDQVACVSLFLPAPGSYEVDQIIWCVVKWLSKG

SEQ ID NO: 1003416 - protein, 92 aa, Homo sapiens
GCSVKLQCGLKWSKHPYDVTGCSWSKSNQDPLLYLVSQSILQDSYECEIRNPVSARRSEPVNLNLLPKLTRPYINIKKLNPSREYRDVFAFI

SEQ ID NO: 1003417 - protein, 161 aa, Homo sapiens
NRCGEGPDIEAPAPRVREGPPRALPPSRSSRAGMARLSGYVVGRLCAAGGLLLGTPGGIPGGDRTGRDGILRRGCEEVTVGMHALVVQAVDGIGGAEKEAAAPTGTGIRGGPGVGPLTAGGRPGGCMLDTGRRCGVGLWLLALWSQVSSTGGGTGVDTVLV

SEQ ID NO: 1003418 - protein, 159 aa, Homo sapiens
TVYAQEVMCSIKPTDNQRPRALARAGVVVIAENERENDGEWGARSPGVAPTSWGKAGCVLGTLHNRPSAGPAFRGHCLMYGEAPWIVEADLASATLWRGLPSKAWGSSVGGPGAGGEIVPSLPFLVPFWYCWQKQLEGPAGGTGLMRVVTTRRKETERL

SEQ ID NO: 1003419 - protein, 48 aa, Homo sapiens
GLSQKRHHAGFAAGSALKRAKKRESDICLKKLRMTQQLEEYAVAMVLL

SEQ ID NO: 1003420 - protein, 37 aa, Homo sapiens
AHGGHNGITRLFQVVFDVLLTVKLSPTPYFVSAGIVH

SEQ ID NO: 1003421 - protein, 55 aa, Homo sapiens
VRSYHKCSPQTPFLNSSLKLPIASLKSAMIKGCRETPYPSILTDATMEKLALAKF

SEQ ID NO: 1003422 - protein, 58 aa, Homo sapiens
MAVRCMSIPLKAMMSHTMIRLTTTVPGATGAQELLSGPASLMMRLRPEWAGSNFPWGR

SEQ ID NO: 1003423 - protein, 40 aa, Homo sapiens
TRIYRGDVSLHSSPTLPTTLYQSCDLSVGGPSLLTWGRAE

SEQ ID NO: 1003424 - protein, 53 aa, Homo sapiens
MPIPASWPGRTVVHSERFCPVPLGPSGFRRLSLEKPDFVVLLFTLSDGGIKKA

SEQ ID NO: 1003425 - protein, 32 aa, Homo sapiens
RTSYIDEAEAADYLWPGVRDQSRQHGETLSLQ

SEQ ID NO: 1003426 - protein, 64 aa, Homo sapiens
MDRDGVTPHHCLTKGTWPRAWEARSMGGPEHREGSPVSSTVVGLGPSYRTTDPSVEQAYTGYEE

SEQ ID NO: 1003427 - protein, 48 aa, Homo sapiens
MGFTAGASIAGLWDPVTQLEAWVLLRRVKDPALAPPPGDAESLGAGRG

SEQ ID NO: 1003428 - protein, 67 aa, Homo sapiens
RQYFDEANEICPYFEIAAGDTLSADIRDLLVNEVVITPLNRYMIQYKSMVDVQQCQMISIYVGKSHL

SEQ ID NO: 1003429 - protein, 77 aa, Homo sapiens
LETHTLVPARLEISTLSGSNTKTQDSVRDLHLLQQAQINNHNTLTCQLDKPEEEVKESTSSRRQACVLLTQTVSPWA

SEQ ID NO: 1003430 - protein, 79 aa, Homo sapiens
QNYAGVRARNVGPSELSAPGIDMILKVIVIGCCAGLQRHRLGFLGAVLGLGGHGAGLEQEVFVAISASSLDDLFAFLGS

SEQ ID NO: 1003431 - protein, 62 aa, Homo sapiens
HCTLPLNSASTLLKVAACHTSTPGERSTPLTNILVEHHADWPHSEASTLSTTPVDTSRPVTT

SEQ ID NO: 1003432 - protein, 32 aa, Homo sapiens
ELTSSKKYWDYRKKDYFGPGTVAHTIIPALWE

SEQ ID NO: 1003433 - protein, 64 aa, Homo sapiens
AFREWPTSIKTSEPSLRSPSPELPYPIISKYDECKLLNDPINTVLSISTLIQAINCFHLYHCNV

SEQ ID NO: 1003434 - protein, 73 aa, Homo sapiens
VGTGKTVSKLLFVMHRCVELRARSGRLARRSKRKLRNRTCISVIDRWRVSCIQFMEYFNMGIARRHPGEQSTG

SEQ ID NO: 1003435 - protein, 80 aa, Homo sapiens
MELVPATGYLRSLHAVHVSRAYDEATGTSILRIWTDKRDLEMWAQLEADPARPARLPLFHRSKRLHAIRHRSRPATRAAA

SEQ ID NO: 1003436 - protein, 51 aa, Homo sapiens
VVWYSAPTHTPVITQTVLTVLIYGLTPVLDTAFMGATWETGDQFDCPTLLT

SEQ ID NO: 1003437 - protein, 39 aa, Homo sapiens
LDDSRVGARTVDVTCTLFLRRTTTDGLNGHGTTATTAPT

SEQ ID NO: 1003438 - protein, 59 aa, Homo sapiens
TAGLLYDGLPVRSGLVGRYLALVGCYCALVGALALCGRYWPWWALLCLGWALLALSGLH

SEQ ID NO: 1003439 - protein, 48 aa, Homo sapiens
LLSWWALLALVGVWPWMGAMALVGALALVGAMALVGSTGLRWALLALG

SEQ ID NO: 1003440 - protein, 53 aa, Homo sapiens
MDPQTTLADRLQSWEGVLQLPWHSSPLLAEAVITAGNWSCIVQAPMCNANRDN

SEQ ID NO: 1003441 - protein, 45 aa, Homo sapiens
DERIGYEVETVPVCSQATAAQYPGMRAMWSFCVVRSDEGEIMVEM

SEQ ID NO: 1003442 - protein, 39 aa, Homo sapiens
VGILFSPLCTVLTPLDTVGVLGPALAFVLLVLAVSCVPF

SEQ ID NO: 1003443 - protein, 56 aa, Homo sapiens
SVVRFPQSNPHFPIQHFSHGVQAASCHSNQFKHSQWLLLTPFQWPEPVGSCSTVFR

SEQ ID NO: 1003444 - protein, 49 aa, Homo sapiens
SSQQGHGRVVRHRVAAATQAPAPACGITHPVHRHRASICQHLRAKHRQS

SEQ ID NO: 1003445 - protein, 70 aa, Homo sapiens
VLEVSISSTTHRYRSAPSTTSALVEEPTSYYSSPGSMAATHFPESSTTSGRSEESTASPGSKVLWKLLKV

SEQ ID NO: 1003446 - protein, 60 aa, Homo sapiens
QIESSRYPEFRSLTSRHLFHHFFGLVCRPRRSCFAGVIAWGFLDTGLVLVDILLMGWFDD

SEQ ID NO: 1003447 - protein, 41 aa, Homo sapiens
MRWLLVCAVLSLKLRGILPYVADTGIPMLCASCADSELVFT

SEQ ID NO: 1003448 - protein, 35 aa, Homo sapiens
MAHPNPRKRQRRSHAHNRPRTYILITILLWKLLKL

SEQ ID NO: 1003449 - protein, 41 aa, Homo sapiens
MIWGSRLQVRPVPIAVPHSVAFTNAHPCTTQWRHLLQTFDS

SEQ ID NO: 1003450 - protein, 52 aa, Homo sapiens
PEASNDSLWGGEQHHQPTRFDVGLVYGQQWNMEAAGVSSRHTYTAIETSKTR

SEQ ID NO: 1003451 - protein, 49 aa, Homo sapiens
FSASFNQPHAAVGQGVHLNTPSFTPVSHSTGFNRVHAVGGILSSRTCQA

SEQ ID NO: 1003452 - protein, 85 aa, Homo sapiens
MHRIHQARSAEQQQFGIATWQHLQVSIHAMHHSPSPHMQGRGHHLHFQRTCGHHSQGTFNPPVNTHCSRFHHKRILNMRPNGTAQ

SEQ ID NO: 1003453 - protein, 33 aa, Homo sapiens
QVGLVGMSPDRSTPLSLLYACTLPSSFAQEAFS

SEQ ID NO: 1003454 - protein, 94 aa, Homo sapiens
MISGVQGPSYNCNTDRRQPKDLRLSVWTKRLQPVSDHEVIRPQTADLLCEYNQKVLALIPMSRGNARAWTGQDGRVARSWAPANDVLGAKAWTS

SEQ ID NO: 1003455 - protein, 58 aa, Homo sapiens
VTTHSKSRKTPRADRICVPKIYVDGSPDTTVDQPLKICQRQGGGKGLPVCVTTNRRWG

SEQ ID NO: 1003456 - protein, 92 aa, Homo sapiens
MGDGVVDSPRRTEVVERAGRTIVPVASWLLWDAVDSSLRPEVVDAVSDTCVVAVDARAAVVRWYGSSTRADCGARTLTDIVCVVLLLKPSKT

SEQ ID NO: 1003457 - protein, 38 aa, Homo sapiens
LMQWRFPNQAASQPGLLPPMGCVIQIHWVTNFLFNTSG

SEQ ID NO: 1003458 - protein, 66 aa, Homo sapiens
MLKTNERHILKGDLRVYESHLRESCYETPIGRGPKVESQIIPQRALAQKPMEGDESPPNPVLFQGQ

SEQ ID NO: 1003459 - protein, 42 aa, Homo sapiens
SSPSGVIIHRMQATQRSKPATPGHITSLISHTPQSALSPYTP

SEQ ID NO: 1003460 - protein, 37 aa, Homo sapiens
RIETTEGIVGTQLEGSRSEVPKVTRARWFTPGIPRTL

SEQ ID NO: 1003461 - protein, 63 aa, Homo sapiens
SPIKPAVTVKLEREELAEASCGGCRQPPQDEEEDFGKEAEEEAKAEPPITSGFSVPFSRLAGA

SEQ ID NO: 1003462 - protein, 122 aa, Homo sapiens
PALFQQHRHAGTIQAVGNTTPIATNIQHTPVAMHSTQHQAPFHNQHHTLSIIFLHSNTTTVSSRPLNHQHTMASAPQPCISSSTAGKPAHSIQSHQAITPAAQHTGSISNFSTCTQQSSSFH

SEQ ID NO: 1003463 - protein, 48 aa, Homo sapiens
MLPAGGRLKSLANCGRHQHAKTGGAVDRLTDTSRYTVLPQASASMSSG

SEQ ID NO: 1003464 - protein, 88 aa, Homo sapiens
GPLWGGHNPSMVPAAAWSGFSFGRPGLGHISSSCSICNAAGISLGVPPITSCQTHSKHISLCAHEVHARAQRLSQHMACSWHHFSQTQ

SEQ ID NO: 1003465 - protein, 75 aa, Homo sapiens
NPGPFVWVGKDSQEEEKTEALLLLNRYIETDPPMGSADAPHRVKQGSKPPSFVGWFLSWDDDYWSVDPLDAAMAD

SEQ ID NO: 1003466 - protein, 40 aa, Homo sapiens
NPGLLCHCLLSSSLLFFFNLFRISVEVQIRHDLPKVVPLG

SEQ ID NO: 1003467 - protein, 46 aa, Homo sapiens
MVPFHQHSNRSSAVIIRAGRFSHSTLNTQVPWAHPVASNTHMQHTT

SEQ ID NO: 1003468 - protein, 31 aa, Homo sapiens
FHRTTLPHSDFTTYHTHDHFTSRTTTTHLRT

SEQ ID NO: 1003469 - protein, 49 aa, Homo sapiens
HPYGKSVERGGETGEPKASPADYQMKPLVYQVNVSTPLVIAHDKRSFPI

SEQ ID NO: 1003470 - protein, 59 aa, Homo sapiens
MGGGCKAASLGAGAEGYNQIEPGGPGKLRGSMRDLSGPLQPKLEDPFLVRDCMEISKTR

SEQ ID NO: 1003471 - protein, 41 aa, Homo sapiens
AYICSRCITLRCAPVKFRRHVSTCVTSKYVKLELVELENPP

SEQ ID NO: 1003472 - protein, 78 aa, Homo sapiens
LLSTIRSNSHHCLASLCGEEVVVVVPLENYPHCPRTKAVPGLTRRPFGTRANSTPSKHGHSRAPLRIHVQLQLGLQSV

SEQ ID NO: 1003473 - protein, 132 aa, Homo sapiens
IPNPARLCVLNGIIHPSLILLSGRKLIHPSLICVWKEVIRPSLICVLQDVTRPFLICVLQEASTLSLICVWKEVIHPSLICVRKEVIHPFLICVLQEVIRPVLICVLKEVIRPSLICVLQEVIQPCLICFLR

SEQ ID NO: 1003474 - protein, 41 aa, Homo sapiens
CRYPEELFIGLHDIGHGSFGAVYFATSAHTNEVVAIKKMSY

SEQ ID NO: 1003475 - protein, 59 aa, Homo sapiens
HLVGHGTNLIGIISPGSSGTIVSLLLRWLGQEAEVRNQRWEDQCGPRRSTEGRGNPTGP

SEQ ID NO: 1003476 - protein, 31 aa, Homo sapiens
MITEPKGHWMLFLAGNQDKRKEVLKSLNEEA

SEQ ID NO: 1003477 - protein, 41 aa, Homo sapiens
MTVHRHSNHLDKDGLITSAPELAWFFILTLALAEKTTIMQS

SEQ ID NO: 1003478 - protein, 67 aa, Homo sapiens
TRRAPLQDHIPIHSHVYSAGIVVVAPNWALGFQLSAHSDEPFIHINHITFILLETKSFSGSGWRAAA

SEQ ID NO: 1003479 - protein, 45 aa, Homo sapiens
IEICSLSEHRSPPVDSTVTLETYKLNPEETADVDILTLNLIYNLD

SEQ ID NO: 1003480 - protein, 76 aa, Homo sapiens
MDWLAGQEFQGTFITVSLATEDLHSYTAVDVEVGGAAVAAIAVVAAFKGRRDDPKRGGWGWPYSVLRKYDLGRNGH

SEQ ID NO: 1003481 - protein, 113 aa, Homo sapiens
YQGHKNAHGRICSSGVGSGWSLSTVIWMVAGTYPLPSLPIWTGSVVRRASLILGLLGLELLELRKTPGLRHPQLTRHGTVLGTAWLAVLSLWRAILAPADLGTGDAPNLCVAE

SEQ ID NO: 1003482 - protein, 93 aa, Homo sapiens
VPRGSIEVTVLKKALDEETRSHEAQVQEMRQKHCTWLVELSSQEHAWSMFNDGPMAEPYDNELMHDCFVRNDELHDSVPVGACVVSGAMCQCS

SEQ ID NO: 1003483 - protein, 168 aa, Homo sapiens
MGALYTREQFPRLNMDFPVSHSSLQYKTVSTSTLNKYHPAFCGRSTGFLTAATDLTSTFTVSSSSAMSTSVTPSAPSIQNKEISTLVSTTTTTSPTERMTLTSTENTPTSYILTTCPVTYSFSPSTSASSDWTTDTESISSAPAITSTLHTTAESTLAPTTTNSFTTS

SEQ ID NO: 1003484 - protein, 40 aa, Homo sapiens
KNQNGGNPAVYYVESTLTVAALEPNIYIHKARHRANAPAE

SEQ ID NO: 1003485 - protein, 86 aa, Homo sapiens
ISHVIRMRNSIAIGTGTHASDLLRMCVWRGFAWVAVIIVRIVLIIYFLEALLQVTDSSRPEFDASSFGHPNRGCSDFSNPQDLLLG

SEQ ID NO: 1003486 - protein, 79 aa, Homo sapiens
RSMWSCTEVSFSHFALLLGRRLCRMPCQPGFLAYSFYAPRCLQLSIGMSLAVPASLGPLIPWTGCHVHAVRLAFLPMAS

SEQ ID NO: 1003487 - protein, 56 aa, Homo sapiens
EDGDVGHGQSMQCRKNLVGDRSSTSCVRVDGEAVGNDTCEEKAEVDVRAGEGYGEV

SEQ ID NO: 1003488 - protein, 45 aa, Homo sapiens
MILEQEGCQGGDPELDLGEKGGVEKIGKLERKFSCESKQYPQWQW

SEQ ID NO: 1003489 - protein, 40 aa, Homo sapiens
PSSASGPIYAEDGDREINQPIIYSIFRGNVNGTFIIHPDS

SEQ ID NO: 1003490 - protein, 69 aa, Homo sapiens
LEHTNSEGQNLGPQAIPQDGSITHQISSAVILQISGPGFVNRFTAIKQYDRVAPARPNMLLQHARMKLS

SEQ ID NO: 1003491 - protein, 50 aa, Homo sapiens
LVTSGTPPRTRMSPALPCEIVASGVPLQQSACRLPLPCEKVTSRVPPPHS

SEQ ID NO: 1003492 - protein, 45 aa, Homo sapiens
YPRLCLRYWLCAMPAVVEHLLQRVGGEMSPYAGPSRKAACWAVEG

SEQ ID NO: 1003493 - protein, 45 aa, Homo sapiens
CVYWTYCTVSGVSDEGGSGGGGGGKVREEACPIGGSHMSYLATTS

SEQ ID NO: 1003494 - protein, 95 aa, Homo sapiens
TEDLHVSTRDSSPSPPSYKAGKGLPIVGSVIQVSFLESYGEATAAEQHITNMMELEKVKCSCQVVVARKVREVAEPPHPVLWPERHACINSVMLG

SEQ ID NO: 1003495 - protein, 78 aa, Homo sapiens
RCGGSIVSAPAPQCRSPEGLGLKENQLEDNLYLAVLRASEGTHDERDRGQKPYFAILLNVVGGGAPEARHLLLSRSLV

SEQ ID NO: 1003496 - protein, 44 aa, Homo sapiens
MGSSRVTCSRVLPSLKCKDIDAVQSDPDGFMGSLAVTKNDGHYR

SEQ ID NO: 1003497 - protein, 50 aa, Homo sapiens
GSRQRQLAISSEIRGGAGIGAEAAHSWPVAARKKLEGELEELKGSVCASA

SEQ ID NO: 1003498 - protein, 72 aa, Homo sapiens
MLPRASLCPWTSPKAVLSPDFLQRTLYSAPSLPGLAGNLLSPASRSRPRRHLLSPASRHEDSCRHEDEADIE

SEQ ID NO: 1003499 - protein, 123 aa, Homo sapiens
AWHSSRGDKSETPSQTNKQPNKLKTNRSLTLGNGSRGMAWCGFLQPTIMTATNYFRDYTVYLPVFSSPYYTYHVYYRDYVLYSLRYTTTLPAQQQTTPSAYWGLSSYGDDDTRTGSTPGRDAQ

SEQ ID NO: 1003500 - protein, 101 aa, Homo sapiens
CMLSEELKTPCGGGEEALWILVLGRSAYSTTNSTSVEGAFWTPTGSSREATASGNIPMCSTWKVRAGSDKIGEVSITWVWGRSSSFEIQPLLPKENDIDLI

SEQ ID NO: 1003501 - protein, 98 aa, Homo sapiens
SLQLMTFEEEQAGQGSVYLESHQEPLINLQVGTKHELITFYVNSGVARSSICFPPSNIACSSEELLVSGVKGEGFKAKILESTEVKYQDRLTHIQFLL

SEQ ID NO: 1003502 - protein, 46 aa, Homo sapiens
ARYADTSTVAEYDHNPILRPGVLNPSDLSSPPLPLITVVNTPLLTY

SEQ ID NO: 1003503 - protein, 33 aa, Homo sapiens
DYRHDHRRWRDDPVVISKHAGQSLTDSLFYYCF

SEQ ID NO: 1003504 - protein, 123 aa, Homo sapiens
AHYRQAVVEGIVHPSSQGALVSLDTTLTPGQLHKLLAFREESTTFQSWPSSSDTTPSPPGTTAAPVEVSTTYHSRPSSTPTTHYFCQYHNLWAVVRTSTTVHSSPGATENSTTSLTRYCNLQF

SEQ ID NO: 1003505 - protein, 61 aa, Homo sapiens
DASEDPDEVMETCSHLPGNHGLGPRPREGAFDAMDGTRRRVPPSVHDGCLSLLAVQDGLCA

SEQ ID NO: 1003506 - protein, 39 aa, Homo sapiens
VIESATKERSKLQSYTNSSGGQVLWLMPVIPALWEVKAG

SEQ ID NO: 1003507 - protein, 35 aa, Homo sapiens
MLMGPFTTTNRERGQVHRFTRAMLIHASTTVNREH

SEQ ID NO: 1003508 - protein, 39 aa, Homo sapiens
GSELHSIGRSAARRTLLHADAVRLLPERVRISPDRSTST

SEQ ID NO: 1003509 - protein, 57 aa, Homo sapiens
MPSPSVSRSSCRCRRIQSRTRCRSSAFRPSTLGSRSFCTSATVNGSTASVRRFMNVG

SEQ ID NO: 1003510 - protein, 109 aa, Homo sapiens
MPLGGGASFTYVFSLISLGIDDLENKSKDSLVDLIGICKSYEDATKITVRSNNREVAKRNIYLMDTSGKVVTATLWGEDADKFDGSRQPVLAIKGARVSDFGGRSLSVL

SEQ ID NO: 1003511 - protein, 40 aa, Homo sapiens
PNDASSKSTGITGISHCAQPCSIISNNKQLEKLNTAYTFF

SEQ ID NO: 1003512 - protein, 69 aa, Homo sapiens
ALVSSSRSRMSPAYSCEMVGPWFLSSTRCRLTLHVKWWRPRFLSSIRMSPDSSCEMVKSGGPLQDSHFA

SEQ ID NO: 1003513 - protein, 55 aa, Homo sapiens
FQTRIRCSSCNVGQVLLSTRMSLPLHVKCGVGYLSSTRMSPALHVKWWRLVNPPA

SEQ ID NO: 1003514 - protein, 122 aa, Homo sapiens
PETYLPFMRMHTDSPLVKAFLPRTIPPSPLQLVLKQRRLWYPIGHLPMPRDIYGMPHWLLVSRGQKPRMLINILQCTGQASTTPAETSQCQAEKTCSKGEAPSPSSFPAPTVLARISIIAFR

SEQ ID NO: 1003515 - protein, 45 aa, Homo sapiens
MVGSGVPLQDSHFDCVFHVKWWRPGVLSRTRLSPGLSCENGGTPG

SEQ ID NO: 1003516 - protein, 92 aa, Homo sapiens
DLDHPYHVHVSSRSSQTVSTSRLPLGRTRADSELKENYSVLQISGAPEKQIVFPGPIWTVYRRVSAQGGGRLRNKPKNIEGAGRPFPKWDVD

SEQ ID NO: 1003517 - protein, 35 aa, Homo sapiens
FFEISSETEAITSECFKFENQLFLLDAVVQCCNPS

SEQ ID NO: 1003518 - protein, 45 aa, Homo sapiens
PLSRLSWASPAQLDLPQVLVDVSLLRVAAGADVLVGHEALLPITD

SEQ ID NO: 1003519 - protein, 57 aa, Homo sapiens
SRLIEKSDDQAQLVGEMLRIFHALKEALIIIGDISTSTVSTPVPPPVDDTWLQSASR

SEQ ID NO: 1003520 - protein, 43 aa, Homo sapiens
EPSTRAEAAKESRGAHASEDYKVRIDEYEDSKPIQGPQKKPFE

SEQ ID NO: 1003521 - protein, 34 aa, Homo sapiens
ADSQTGHVVLVPQDSQRLNISNQLVLSEAASAPM

SEQ ID NO: 1003522 - protein, 105 aa, Homo sapiens
STSPAHKNFHTPEPQQPGLPREPRPPGACYKCQKSDHQAKECLQPRIPPKPCSICAGPHWKLDCSTHLAATPRAPGTLAQGSLTDSFSAERLKTDACRSPRKPRR

SEQ ID NO: 1003523 - protein, 60 aa, Homo sapiens
VDIQNSGGTSTEAVHLLQLLKYQHANLNSWRKKHSINKYACQTHASGQFEASTLSTSPVD

SEQ ID NO: 1003524 - protein, 49 aa, Homo sapiens
ILSDQVGQVLTCSLKTGLTCKNDDQTGRCNTVLQRTIVRCAFASERTTC

SEQ ID NO: 1003525 - protein, 66 aa, Homo sapiens
VLPVRIYHEDLASQALRRSTRCKVDSYWIVVVRQGTTILPASFPAKINLLLGQEGIAFLCLGYFAL

SEQ ID NO: 1003526 - protein, 37 aa, Homo sapiens
VHCSGPLVRCVVVLHTALHVASPRPATGRNYVGSTLC

SEQ ID NO: 1003527 - protein, 69 aa, Homo sapiens
SLITVQGSASAVSPETLVARIWAAIWASTGGAPRSLTTLKLQVTSDNPENFPCNPQGAGQSKSSLHIRL

SEQ ID NO: 1003528 - protein, 41 aa, Homo sapiens
IHYIEEAGDMRVLERNPVYATISHVKMQCDMLSAEEERLTP

SEQ ID NO: 1003529 - protein, 48 aa, Homo sapiens
TYQPAASETCCREGGCWLGVRTVLSGTSCGSHLDLTCPPASVLGISLA

SEQ ID NO: 1003530 - protein, 44 aa, Homo sapiens
SPHGTMLTALNHCKFLGEGYRIAEVQKNYFGLLHVNIQRKRFYS

SEQ ID NO: 1003531 - protein, 65 aa, Homo sapiens
VTAVISPASRSPAYLCTLQSGAHRSFILSVTRQATSGKPAPAWTRIYKHVVLITAEASFAATTRW

SEQ ID NO: 1003532 - protein, 54 aa, Homo sapiens
EITTFQQSGHWNTLLTCRSAPLASLESHTLTPQSKLNRNNNFTRQSHNAKHQLR

SEQ ID NO: 1003533 - protein, 87 aa, Homo sapiens
LSGCLTLSCNSIHRILLIILLKGCDIFRGLCTVAFLRPLFRFAVNNGLLGVHQVVLVFQASPGLRNGCPVALHALGSLYLAQVSIRH

SEQ ID NO: 1003534 - protein, 45 aa, Homo sapiens
LPLHMEDGAGGLLSQEFDTSQPNTQGSAGLDVTAGNHSQMSRYGG

SEQ ID NO: 1003535 - protein, 72 aa, Homo sapiens
RAALRVPRFAFRRLCFAHMPLPVLRSMQSTCVYVVFMYVSSLSPPDFCFELPSFCYLYFLKTCYSDRYFCYF

SEQ ID NO: 1003536 - protein, 58 aa, Homo sapiens
MVAGDYPCPFLRIPWLSSPSLSTDCCDRSKLSTLPSRALILLAPLEKIFSAASYRISL

SEQ ID NO: 1003537 - protein, 68 aa, Homo sapiens
MYLEDQTLHVLSVILFRKSDLPWFTFCLEKAQLNSSQKESATIVTLNRYWKKIFHSKLTNGLDLLVLF

SEQ ID NO: 1003538 - protein, 82 aa, Homo sapiens
AAAARPWLLAFVLGGNDWRCMPLTRTRRGDNALPVTTDNRLNASFPVILALFGRKGALPLLFHEVAAERNDCNLTSRSIGFC

SEQ ID NO: 1003539 - protein, 57 aa, Homo sapiens
GSAMNVKVSYRDHGLSPPPPGATASTLKVLTSTATDTHSHQLQSHSLLQSRDCNRPS

SEQ ID NO: 1003540 - protein, 71 aa, Homo sapiens
PPETHCSCVGSRAEIGVRGPFHGPTGPIVSGPWLFGLWALMGPGAGCVTGLGIPGACSENMAVPWRETPPN

SEQ ID NO: 1003541 - protein, 61 aa, Homo sapiens
MASFAGFSAPLCFVALWVSSCSYAPPCGLQPWLQVPGDLMTGVFKSTLSLRAGVTLGKLFN

SEQ ID NO: 1003542 - protein, 52 aa, Homo sapiens
GRRLWRSVMGQTCVGREPVVGSCGVVGGCGVVGGMQGTHTALLVVESFSSLF

SEQ ID NO: 1003543 - protein, 54 aa, Homo sapiens
MLWQGGKVWLLMTLHLRSAQERRKALRLQGSVTKLTSPHSGLSFHEFRNSSSLD

SEQ ID NO: 1003544 - protein, 91 aa, Homo sapiens
PSLLLVLLVLLVLPGGQGIAGSVVWSACLVREEREASLGLPGPYLVNLGKQGSLLRRVGGHGCPPWVPIGPPPWIWAWDPPLVEFLDVEGG

SEQ ID NO: 1003545 - protein, 76 aa, Homo sapiens
CLVGEEREASLGLPVPSGEPCELGPSGARRERAPPCPMCPPGLAGSPGESRREVARGAEGSPGRDGSPGAEGDRGE

SEQ ID NO: 1003546 - protein, 52 aa, Homo sapiens
APWCLRLASFDTLRWPAGAGVFSTKSLMAESWVEPCWTSIMWLRGSYFDWNI

SEQ ID NO: 1003547 - protein, 66 aa, Homo sapiens
SCNVRQDLSASHVAASSMWMVASGSLQHSHVTSLFHVTCWRLRFLSSTRMSPAFSCEMVASEIHPQ

SEQ ID NO: 1003548 - protein, 74 aa, Homo sapiens
VLRRPPGPPPTLPLTDGRRPCDAPETEPRTAATFPLERRHGDHCDDADGRTPMDRHLLSHWNDGSGDNCDVLTG

SEQ ID NO: 1003549 - protein, 50 aa, Homo sapiens
HAALHVNVRRGSPQHRMSLLFHVDVHQVLLSTRMCLPLHVKWWRQGFLLR

SEQ ID NO: 1003550 - protein, 34 aa, Homo sapiens
QVMWVRFSSASHVAALHVNGGSRFPSALACPALH

SEQ ID NO: 1003551 - protein, 44 aa, Homo sapiens
GVLSLSELLVSYTHPLFQSLDTLSSGVGTDALGLRCSSGRVAEA

SEQ ID NO: 1003552 - protein, 41 aa, Homo sapiens
TELPLHVNLGIGSLSTRMSPALHVKWWRQWNPPPHWEPPPD

SEQ ID NO: 1003553 - protein, 32 aa, Homo sapiens
MVGVSVPLRALACRLPLPCEMVASTGSSSALA

SEQ ID NO: 1003554 - protein, 38 aa, Homo sapiens
MVASGSPQHSHVAALHVNGGVRVLSSTRMSPALPCEMV

SEQ ID NO: 1003555 - protein, 108 aa, Homo sapiens
MAIESNFRMIQYFNKAYVDDKVCLEVAGLVKETKVHSFLFLENKSNYRYLEHPVLICSFIIVFYVDTFEHSPAFILSLQERLGEGGHLFFGAGNRKYHGSTSSKENIG

SEQ ID NO: 1003556 - protein, 99 aa, Homo sapiens
VVESGNPASCFSSSRTRTYCAGVLQQTLVFLADLASPRDDTCQLERRLHLYVVSRHGLGVLTTGQRGPENSFMVFFCRVSPSALDSQGSPRPSYSLLHS

SEQ ID NO: 1003557 - protein, 76 aa, Homo sapiens
HKPHTLVNNLQPSTASPVRTENTLLPDDRITSGLVEASTPIHSSTGSLHTTLTPCQLHKRWLQAEIYYLPELAKFK

SEQ ID NO: 1003558 - protein, 55 aa, Homo sapiens
LPAAVPDASGTTTSSSHSKNSGRGESTHSRISPGSTEYNNVNGSNTTPGLREAYT

SEQ ID NO: 1003559 - protein, 33 aa, Homo sapiens
EASLVSLPEAKGEGVGTEEIPDIILALLTGVLP

SEQ ID NO: 1003560 - protein, 63 aa, Homo sapiens
GLVGLEKLVVEVLAGERSYSYTLDRRPVLLYRGWSSSSTERAASGGTHMELVREEGDTRLASC

SEQ ID NO: 1003561 - protein, 46 aa, Homo sapiens
MAAFGLFPALASALNSHPACTWLVEPSTWRPGHVSGPALASSPQIL

SEQ ID NO: 1003562 - protein, 33 aa, Homo sapiens
SSSQPRAYWRCSGLRCVTDRLASSMGNYKSRGS

SEQ ID NO: 1003563 - protein, 34 aa, Homo sapiens
VTQSSHLHEDRTARVRPAQFDLKRYETTRKKRHP

SEQ ID NO: 1003564 - protein, 72 aa, Homo sapiens
LTRPGVVVLPGNVVISVEPGVMHDVVDSPRRCGCVVCGYRVLRPFAFGLLWTIVDSSLWPEVVELAGKCVVG

SEQ ID NO: 1003565 - protein, 34 aa, Homo sapiens
MQIPSADSRRGTTITLNHEVISLLDLTDPAYHLE

SEQ ID NO: 1003566 - protein, 110 aa, Homo sapiens
MSLSPRPAPHDSSPRPCTTPAATLSPQLLRASPTLRTVALDSLPVSRRSFLASFEALLKCHQFPYLKCTPSGQAQWLTPVIPALWEAEAGGSRSQEIETILANMAKLHLH

SEQ ID NO: 1003567 - protein, 98 aa, Homo sapiens
MVDELQGPFSYDFSYWARSGEKITVTPSSKELLFYAPSNGKPVVQWRTAAQGKADRESTGKAGLVFEEGPDSNPEVGKEFEICHSGEQGSAQICESGY

SEQ ID NO: 1003568 - protein, 61 aa, Homo sapiens
EDIAELTCLTRSLGACTTSMERYYSGLIYTYSGLFCVVLTVRGHLVPLLALVLFHNLFRVD

SEQ ID NO: 1003569 - protein, 88 aa, Homo sapiens
SQCEGLIAHPQLLSLQAQHGRYGPYQTWVSSYCRSLMVLFFDSMNILQLAGTPASGLQGPWSEASSDPRRTAPPSSPQRCSEPCRLRF

SEQ ID NO: 1003570 - protein, 78 aa, Homo sapiens
TVGRECAPRGDERPPSMFPSSSPDPSSQMCCRAELLLARLSAYLPMTLKCSYVLFPYDKHRDTCTPREIEVCLPAALS

SEQ ID NO: 1003571 - protein, 56 aa, Homo sapiens
YVLPGRASSPIPKRCPYMAQPVCYGALPDLRSCSYLQVLDWCCSSNSLNIPPALRD

SEQ ID NO: 1003572 - protein, 52 aa, Homo sapiens
HLDNINTIDAPGLGGGVCHIERTGVMMGENVAAYHHGFRLAHGATVKHGDAQ

SEQ ID NO: 1003573 - protein, 34 aa, Homo sapiens
THRSYLTEDKYVNINGASVSRMTFPILVPCCQMV

SEQ ID NO: 1003574 - protein, 68 aa, Homo sapiens
LADLMQERTVASAYGINGCALTAVPGRCRCVGQCSHCFHMHCILKWLHAQQVQQQCPMCRQGMASSTE

SEQ ID NO: 1003575 - protein, 46 aa, Homo sapiens
PVNFSKFQSASMHGQGKSGNIITAQQPSSNGSEFHQPSQHPSMEVF

SEQ ID NO: 1003576 - protein, 80 aa, Homo sapiens
GGRGRQIEEVNRSRSSGQHGEQPISTKTLHTNELGVVACALQSLANSGGCGRKHGLRPGGGRLQGTQDRADCDLQFDAES

SEQ ID NO: 1003577 - protein, 41 aa, Homo sapiens
MTTLEVIPLGLQQADVSKCGVTEKTLLVLRSKLTVVGDGVS

SEQ ID NO: 1003578 - protein, 186 aa, Homo sapiens
RIELGPRSVESLNSKDSASYRGSLLQWRLRVTMMPDQRSEEKAVRMHFHKLPSLLSYDDVNMRIAAGESWALLFEWARGIESDFFYEDMESLTQMLRAWATDGNKHRAKVDKRKQRSVFRDVLRAVEERDFPTETIKLGPERMYMDGWVKKHTYDTFKEATDIGRRSDQVNAFELVDRRSGRQLEL

SEQ ID NO: 1003579 - protein, 44 aa, Homo sapiens
WVRMAVCYEGYVAGWRVCNELILGLYVEAPIAGSIVLAIETSKT

SEQ ID NO: 1003580 - protein, 30 aa, Homo sapiens
MKETVDMLSHISYFCRCLSEQRSFHVPRLK

SEQ ID NO: 1003581 - protein, 91 aa, Homo sapiens
MIRIELVPIGFKVYVVERIRSQVHNDGSLISGGSKLITPCFYGCPPTFKTHRQSGRVSCEGSVNLITSNTIFMETVFFWKTFKSQFYWVIK

SEQ ID NO: 1003582 - protein, 43 aa, Homo sapiens
MHVPGCIMCTEMQEFLDFIAQEVKVSQKKLCLIANAIDYQADS

SEQ ID NO: 1003583 - protein, 94 aa, Homo sapiens
LTLEELMGACMCPGQPFSPHLQQDTESPPSPGRHPGHTRGTSRTHSHMHTQQDPHLEPAAQQPHIGPHNHGGDHGPVKPQVCLSQQWPGLTANP

SEQ ID NO: 1003584 - protein, 56 aa, Homo sapiens
MASGGNRLRWVGMRDSHSIPGPVAQKLDPSSPDFWIAGLGQVGPVSLSFTYLVSRM

SEQ ID NO: 1003585 - protein, 142 aa, Homo sapiens
RRTGRQIYAREISSLVDNKELRTGAGGQWVPDGAHSSLLPQSPTGLDGEQLVVLTTRPSQAHRRMSLSLALINRAKKVAVLVMGRMKRENHHTLVSRVCMSPRSWPISGVLPHSGQLVWYMDYDAFLGGGRLCPFAGFAPVL

SEQ ID NO: 1003586 - protein, 38 aa, Homo sapiens
MIRIEPGTASCKKFNSNLRSLQIDFHEDIWCFRIKTVP

SEQ ID NO: 1003587 - protein, 44 aa, Homo sapiens
RFSPHTCLNTAQEPTGQLGQPSSHHGVPCAASPQSPTLSLRSFW

SEQ ID NO: 1003588 - protein, 43 aa, Homo sapiens
MTHYNNSSIKKILRVFCLLRHGLALLHPLECRGATMTHCILDL

SEQ ID NO: 1003589 - protein, 47 aa, Homo sapiens
MLLGAMLLNGKVIIWVLTSSRMMLYTQESKLRRHSCWKNSMRMTSRD

SEQ ID NO: 1003590 - protein, 76 aa, Homo sapiens
VVLEVSIAKTGFLDVSGTQSLLDPLVQAASASLGNLLEIRISGPGPARGLLNKKACGGAWQRVFKGRPPEIAADAL

SEQ ID NO: 1003591 - protein, 101 aa, Homo sapiens
PEHGNWSAPSSAIKPDEVQCELGEARSSSASSRKGFRLVAMKFLRASEEHLKQHYIDLKDRPFFPGLVKYHELNGQPGAATWEGHHPYCIVAGKDLSQRIT

SEQ ID NO: 1003592 - protein, 69 aa, Homo sapiens
RIYLHHSASHVWCGLIAHCPPLTCFYRDCCWCTLLPYEMLLMWDALNQPNLTCGNQTQIYCVSIRVPSL

SEQ ID NO: 1003593 - protein, 30 aa, Homo sapiens
MATADKQYSDRRRAVASEIAEQDIDSVLVT

SEQ ID NO: 1003594 - protein, 60 aa, Homo sapiens
GDSKDPYSAPQHDNKYRMKTQRFKGEKEEVWVDLESPRNRFHFALSSLYKTKATQFKFEA

SEQ ID NO: 1003595 - protein, 47 aa, Homo sapiens
SNSGLNSVFNVAQLIDLRQIRSKVFQGLVYTYLSQIRVSSIIHFHLR

SEQ ID NO: 1003596 - protein, 85 aa, Homo sapiens
VTVHILVAQIPLISALCDSKSNCFRTGPLESPGGCPLSIPQMKSTPSKPFPSSWATLSVTTTASICQKPRTLPSPLPLSRVHQVP

SEQ ID NO: 1003597 - protein, 82 aa, Homo sapiens
ILCWLSALRVVTTVTQAHSKHQYGNTDFCIQTQFKRPFNTFSDYGVSVTFITGSTATKHFLDSSTNSVHSEESTVSHYAAQV

SEQ ID NO: 1003598 - protein, 96 aa, Homo sapiens
GPKEQEGEEEIRRREKKDKEEKERKEKAKKASRPKMLSHRPRRNRRKRRRQQSRRYDEHQHQAQGFRSRAVGIPMPLTSTELWPPGVGTKLLPSLA

SEQ ID NO: 1003599 - protein, 81 aa, Homo sapiens
GHTDCVQGTGADAVTPDIWAGQSAIALSAPGRRPMSIPRPDRVSSSEPRKSISWPSELSTCTFRQSDFISLTSTLKDSGIP

SEQ ID NO: 1003600 - protein, 50 aa, Homo sapiens
MGLDGKVEVSTGLKPRLGVKPGVGLKLGFGGRCLVVVPSSSPSFSGVDFP

SEQ ID NO: 1003601 - protein, 100 aa, Homo sapiens
CTVPDEVSDSGAPKDLSPSRETISPRQKTLVFLLGQVFLAVKSSPPFSLVDQLVLLITQYSEFATVSLMLLLLFTTSIFCILLWSKYTYLEKVFPLFSPK

SEQ ID NO: 1003602 - protein, 93 aa, Homo sapiens
SRGSHTGFEFHAIERILATVQEKVCERGCVPCRCPQAYCQALPMARLLVLPPVSERIPGCKLGLHDNHWVPACHSFNRAIHKKAKGTEAEEEY

SEQ ID NO: 1003603 - protein, 32 aa, Homo sapiens
VLTLTFPARAVNMDFTSKHAACYFQCSQTPPA

SEQ ID NO: 1003604 - protein, 48 aa, Homo sapiens
IYGCMHVPEEENCLTPEPTIREIINQQRKRLNHLVDSLQAAPPLTNRL

SEQ ID NO: 1003605 - protein, 34 aa, Homo sapiens
WVHALVSLEDVGWLTRSGRTSTSGTHGNSEVGCD

SEQ ID NO: 1003606 - protein, 111 aa, Homo sapiens
MLEYNVVGCVEVLYVMFGVAHGSEVMVYVAVFLFLLVLEIGSCYVCQAGLKPLGSSNPPTSSQTAGITGMSHCTQPYVAFGHWGLRRSNPIPFPQGIILDVVLCGQNIPES

SEQ ID NO: 1003607 - protein, 65 aa, Homo sapiens
WRLIETVTRIPWRTGSKVVMIVRAGMVEIRRLVMEAKVASVEENPVVGGAGPASLQPTLVLPDNT

SEQ ID NO: 1003608 - protein, 68 aa, Homo sapiens
MGQTEVLLGARAVLLYLGCCIVGGDQGGKGNIDRGLGLSCLQGRPHTHTLILTVMLTIHGQMLTCMHP

SEQ ID NO: 1003609 - protein, 52 aa, Homo sapiens
SPWRMEAWARLLFNPRIIALQQSARADNLIPSARCAQQLEQILQGHPEISGS

SEQ ID NO: 1003610 - protein, 44 aa, Homo sapiens
NRILDNGDMLWYLPGTMLCLWSLVLLWRSCRFLTDAWHGGTASG

SEQ ID NO: 1003611 - protein, 47 aa, Homo sapiens
MSRDGNRRSKVTSPAHLTSGQKPGSHDTSDEEHYRFLRFLAERRKRL

SEQ ID NO: 1003612 - protein, 48 aa, Homo sapiens
MMVVTGKAALLEAAPLQQKLEVLLVCVWVVEVDSVVVPQVGQVHELVA

SEQ ID NO: 1003613 - protein, 42 aa, Homo sapiens
CGSSTLTALTTLSAQEQLVSLRAATSSAYLFKEDCHQKIDRP

SEQ ID NO: 1003614 - protein, 177 aa, Homo sapiens
WVELANPSNMFHIHSPHHCAVCIRLCERKYSLPGLSAPVLPQLLEQHCSVLVQYGVSVGVSCMAQDCPLRTPEDFVFPLLPNEELREKYRRYLFRDYVESHYQLQLCPGADWPMVIRVQEPRARRVQCNRCNEVFCFKCRQMYHAPTDCATIRKWLTKWCRRTLKQPTTFVLTLKTV

SEQ ID NO: 1003615 - protein, 61 aa, Homo sapiens
RADSLRGADTPVAMQDTSQTMSNQIIEENDDMSSRIDDLEKNIDGLMTQAEVEELESENKI

SEQ ID NO: 1003616 - protein, 33 aa, Homo sapiens
AWAVMLVTHSLGLSLGVAPPKQWPQAVASAPAA

SEQ ID NO: 1003617 - protein, 72 aa, Homo sapiens
LEDPLHWVRVEERNICLPGESWASKLPDLKDAEAVQKFFHLEGKYSLVKSYQASQKGEYGEKGGVDHLDQNC

SEQ ID NO: 1003618 - protein, 71 aa, Homo sapiens
DSGLGGKLGRSVDAEVVDPILWHVAPPPRSRLTLKASCKGSGAIILQIGCCQPQRPSGPEACLVPCISGDF

SEQ ID NO: 1003619 - protein, 81 aa, Homo sapiens
LWGLVRPHQIYLDVVPIIPMCRGRDPVGGNRIMGAGFSHTCSRDSEYISRKSDGFIKGSFPARALLPAAMEDIPFCSFFAF

SEQ ID NO: 1003620 - protein, 36 aa, Homo sapiens
MAQRTFLYKAKPLAVTQRVLSAYCPKRVGLPEKPVT

SEQ ID NO: 1003621 - protein, 66 aa, Homo sapiens
HDGEMTLMGWQEENLKQSKAAAAKEQVFGYDRSGESTGGKGLGARPSSQAKNIGNRMRDSLIDRLN

SEQ ID NO: 1003622 - protein, 79 aa, Homo sapiens
MAVRVDVYSATWVCNVLPGDKYPGRDVEQPVLSYQISVKLGAWVDAVFNYCGCMPLLYRVLVDDVSTSADLQNIVELGA

SEQ ID NO: 1003623 - protein, 74 aa, Homo sapiens
QYPSMHEWLQVDVYSATCAACLPGLSIRRDVSNRAELQISYKLEPGRRVFTTAVHASLYYFRRHVSTVLTSKYR

SEQ ID NO: 1003624 - protein, 31 aa, Homo sapiens
KSDKKFILCFSQHKAGDKTGERAGCGGGVED

SEQ ID NO: 1003625 - protein, 41 aa, Homo sapiens
MGPCAPKCLSLLGFHLGSSPVSGDDISLCVLWLPILQSVIP

SEQ ID NO: 1003626 - protein, 33 aa, Homo sapiens
SGPAQGRHAWRCAAQPAGGNRLKLAGGATPPLR

SEQ ID NO: 1003627 - protein, 50 aa, Homo sapiens
MISCRLRVSVQVLAARLESSYSGALCLTGYRSELQNFTVSVQLISSVWTR

SEQ ID NO: 1003628 - protein, 65 aa, Homo sapiens
HSGVVEYLHPLDSEKQKRGRHLQGLCGQSCKTNMPWLMWAFIPQVATIGLTCGGFMVALSPVACI

SEQ ID NO: 1003629 - protein, 73 aa, Homo sapiens
SVPAHASVVQKRAMQQVIDVSVAKVRLLSQMLDANNQMMVVRREMLIRQGDDRSSDEKRIADLVKRYEASWSA

SEQ ID NO: 1003630 - protein, 46 aa, Homo sapiens
VPDRLALWSEALLSRIGTCTFYGTANTNQMVMEVMGLHLPGASFVH

SEQ ID NO: 1003631 - protein, 62 aa, Homo sapiens
LARYPASSCGAEDWLTVGAMRLRIVVNDLPMHPLPRVAEFSVNQIVNCIAVTGYRQCGLQAR

SEQ ID NO: 1003632 - protein, 109 aa, Homo sapiens
MECGYLYNAGEVCVSADSHMAASGIWDIHLLCDELYTDATLQERAERSLKPEEENTLKSQKSLIYPLAFFQWGKIQGINARVHIFPRLYLKSNENHSVLSVTQKNTKRG

SEQ ID NO: 1003633 - protein, 48 aa, Homo sapiens
CTAMHHCNQKMWMASGNCGVIGACSQNIFLLYWRCQVWAGHPELNGKL

SEQ ID NO: 1003634 - protein, 47 aa, Homo sapiens
RSTLAEILLTTTAATRIVMIAIASIYGKACSVLNELCYILLNNPKRS

SEQ ID NO: 1003635 - protein, 77 aa, Homo sapiens
LAWAYWQEYENLDHRRLEAQGEEKRLWVLFRPVSVGVDTSLHSFPFTNIKQLVHKRVFSNPTLRTGHFSSYNFLSQI

SEQ ID NO: 1003636 - protein, 46 aa, Homo sapiens
SWYPAYLVAFKFQLFRNLALWQQALMVMVLSLAVDVIVFWAEFLVI

SEQ ID NO: 1003637 - protein, 33 aa, Homo sapiens
MILKVIVMGAGSRRGHRLGFLGAVLCLGGHGGV

SEQ ID NO: 1003638 - protein, 43 aa, Homo sapiens
SSSVPISRPCITQGMVVYAYHADCLNLYRTVRAYTHARAYTYA

SEQ ID NO: 1003639 - protein, 46 aa, Homo sapiens
SDLAELMVHACGEYDIISSGTKCERGLTLANTAGWMPHQKVSTSPL

SEQ ID NO: 1003640 - protein, 68 aa, Homo sapiens
IRGVNDPTEGLVLGKYWAQQGISETIHTNDTATFISCFTFNHDSLNQFRLYGKEDGQEATGVSLVFKK

SEQ ID NO: 1003641 - protein, 36 aa, Homo sapiens
MGDDVDPHAQESTANAQSSSTTPSQHSLSSSSSSSN

SEQ ID NO: 1003642 - protein, 121 aa, Homo sapiens
SVYIGYRGVLVSSLYQMVDDAGSKQSSVDVFVTRRTPLEGGVLRPLNRGEGLSVELRLLILQEVELKAVDSQLWIFLEGLEGVLAGIEGIHEHQRQSSAESLASREHLCSDDVEEGLAVTN

SEQ ID NO: 1003643 - protein, 138 aa, Homo sapiens
MHVDREVNNIRDRKQVWCFISIDHCWLCKKNYMTVVMDCSQLEEAAGPVRAATPRVVFLPQPTNIASVLGVWLASWQIFSSQYPRSGGSEAVHLHRQTAALLPCLVLGLWLLLALLVGGIMSPKDVHLLPPGTCEYLT

SEQ ID NO: 1003644 - protein, 49 aa, Homo sapiens
HEQVISDVKLKGECRRVDVDIDESETSHYLWVGLLGGVLRVEEERDVGK

SEQ ID NO: 1003645 - protein, 46 aa, Homo sapiens
ARSVPGSACLPRQPRHAPRERGGGQREPGDPANSAGGGSLAMRLTR

SEQ ID NO: 1003646 - protein, 117 aa, Homo sapiens
SLRCESLRESEHSQSREAHLGQACHRCSGFLALVPMPGEVVLRDRCSAVGEVPPAASTGESDSSLLGDSEGEPLSPRQCGLQLIPVLRDTAWGLAQLNCAPRLLQRQGQASFSLWNP

SEQ ID NO: 1003647 - protein, 74 aa, Homo sapiens
NRDRSGIGPEAPVLVWRLLPCETSLEFRRNSVDATRFSRMRRAVACLTRAATGFSVWKYTSCPIHNAIFRILVV

SEQ ID NO: 1003648 - protein, 76 aa, Homo sapiens
SCLGLRKDLMGAVKSRRLLAIQAMKEREIQEREMIVKLKRQAEEERILKHKAAVEGSFQEGIVKAKLVILQCPIFT

SEQ ID NO: 1003649 - protein, 152 aa, Homo sapiens
LGACMWVWWCVSQCWKGVESWTGGGSGLELVTVGVVAVVVRLWEGELFSEVEVGGGVDPVDAVVVAVVVGFVRIQVVPGVEEGVAVELVAGCTGAVAVVVTAKHTHVVVEAHVEPACLVFGLAGQPRLQAAGQHLPEPGPMRNLGGSSPAGT

SEQ ID NO: 1003650 - protein, 98 aa, Homo sapiens
VELKKNESREELEKQREPVDKSPPSHNFQLEERQQACTKTKRRVWVNNHPPQVRGSSECLQDQLKTLQRNYGRLQQDVLQFQKNQTNLERKFSYDLSQ

SEQ ID NO: 1003651 - protein, 38 aa, Homo sapiens
PGIPPMIAKYIVDDLSLVKNEKLNLELGQQEFTKCLHS

SEQ ID NO: 1003652 - protein, 53 aa, Homo sapiens
LEDVIPTALVTRGDIRICVRPLAHMACLDGQHPGVVHFQRSCGGDYRNTMPNF

SEQ ID NO: 1003653 - protein, 43 aa, Homo sapiens
PLELFGTIFGAKTGMRSAIPCLPFAITCIPSTGPGHFPTRSQA

SEQ ID NO: 1003654 - protein, 90 aa, Homo sapiens
PTPIYHTGTRTLGFLNLFLNYLRRVGLGDIGKKSVKYSLLLIFTSAPTDKFTDSAIAMNSKVNGEHNREGASAAGRRGDSNQGRLLTLDV

SEQ ID NO: 1003655 - protein, 50 aa, Homo sapiens
TGKNGEKCRTHALLTQEFHFLVPTREKHVMHCAQAGCVMTTDRTATVCNY

SEQ ID NO: 1003656 - protein, 37 aa, Homo sapiens
MICGGGEQWELAETVLRQGAGYQGRGTGASNFANSLA

SEQ ID NO: 1003657 - protein, 133 aa, Homo sapiens
LQIHSAPTAWIGLEEWEGRWRRHCAAVGSSLGQPVPVPDSVCMMMVTSGRRMTGTGCLHHGDNEEAPVSRKVGQNEGEEEGLGPERRWNRTLVSSPPRCGEAVEDLLLLEFGSDLLHVGPGRLVIVHAAWDVG

SEQ ID NO: 1003658 - protein, 43 aa, Homo sapiens
VIPGWECGGANLCSLHPLPPGFRRFSGFSLLRSWDNRGLQPCP

SEQ ID NO: 1003659 - protein, 69 aa, Homo sapiens
MAIMKSQETTDAGDVKKRNAFTLVGGSVDWFNHLWKTAVEIPQGIVELANTHSTAIPLTGLYTQEDYEL

SEQ ID NO: 1003660 - protein, 98 aa, Homo sapiens
MGDDVGVMDQHRGLVIRDTFRKWSDDGQMQRKRKLESKQILKTDYQGIHSNHSIGASTHRLGMRTKTPELAENWVQSLTVLFVPTCFFPLVNFWVHSE

SEQ ID NO: 1003661 - protein, 80 aa, Homo sapiens
MANKGDSLQKRGERQVPIVCPGPNMHNTTGLQTSHPLRTGHQWTLADTISFALHLTYERRQTSTEALFSTAEHRTPPAMA

SEQ ID NO: 1003662 - protein, 78 aa, Homo sapiens
WVLIPGYCLCEQTPHEQHGGWLHHALPRPWGSACKLGPNAGDVTTQGCCWNSQSQACASWPMQDQHPVDTGARNSVLH

SEQ ID NO: 1003663 - protein, 44 aa, Homo sapiens
MTCLGQFCGAEWWCLPGFVLLAGNNVEYVVAGPVTQPFAFWRVA

SEQ ID NO: 1003664 - protein, 67 aa, Homo sapiens
RGSMGAHPPAAGMAWCLQYVCHGGQVPSAGYTNTLDNVHGTRGPTQLTLVVFEGLWGLHSSHCGFTA

SEQ ID NO: 1003665 - protein, 92 aa, Homo sapiens
MLWVSSPNSRRLRRAGLHRLNEGLLLFDAGDIGAQINQRKWETAIEGGAGGRGYLGGPGAVELAPQNTVEKREGRTLAATGNGPPKNGIIDL

SEQ ID NO: 1003666 - protein, 44 aa, Homo sapiens
MVSSPSVNICGHQVLLSNVNSGARKARPCPPGVPFPKGHYWEIF

SEQ ID NO: 1003667 - protein, 105 aa, Homo sapiens
YVLLYVLGLVRMGGEASMPKLCSYPGPLLLPITLRELCLCVCVRVRAAGAGMLGCVSEPELPFQSVLEGGGQANDRKEGVDWLHPLCILLLVFFLLTQEWVGIPG

SEQ ID NO: 1003668 - protein, 63 aa, Homo sapiens
IPALREAYQFCAIDEHWTTRPKDMFDPMAGLRTSYYEALAKGQKIEMDKLEKGKKEETKIEFV

SEQ ID NO: 1003669 - protein, 33 aa, Homo sapiens
SSGIPPETIHELTNEEKDALSPSEFPGLGAVSD

SEQ ID NO: 1003670 - protein, 105 aa, Homo sapiens
MVRFKSFDLSRTREPSTLCCRSLVELVPVVWGIASLRVQQQGEHHQHPPQQRFTNSPDSKICFYDVETWAQVTVFDFKTWDTIDRERRRFPLMSQRLIKSPLFVG

SEQ ID NO: 1003671 - protein, 54 aa, Homo sapiens
RFYLVNTASQCAPREQKRRSCRVQKAGSSCLKVIAFCLQEKYLLHLSYFCVIKE

SEQ ID NO: 1003672 - protein, 36 aa, Homo sapiens
PHWVRVQSEGQQTARQQRLQRHGLFEEENGIRRTGR

SEQ ID NO: 1003673 - protein, 36 aa, Homo sapiens
VSRPCNRSLLHTNCCIEKNMFRSHGASTCGDGLQMR

SEQ ID NO: 1003674 - protein, 122 aa, Homo sapiens
MSTSSPHTVGDQCARNYSLCCRQFAHVENASLVKTRGLESLAWSGLSLRTPEDFVFHCFPMIELREKYRRYLFRDYVESHYQLQRVPGADCPMVIRVQEPRARRVQCNRCNEVFCLKCRQMY

SEQ ID NO: 1003675 - protein, 179 aa, Homo sapiens
VALEDPRVTFCSVDGKSTHIPYLGLKAYRLLQDPLCNPDCDGATWAASYNVEETLTILRYATVPKTIMNKPRVMRTQDASFENSRKRLLGSRPSWKKRSIGRRKRREKAEEKVVAVVGVGEEEEEEGEEGEEEGDDKDDYWREQQEKLEIEKRAIVEDHSLVAEEKMRLLKEKEKKMED

SEQ ID NO: 1003676 - protein, 111 aa, Homo sapiens
AGSCVTSALGAWPDRDLGGSHSMRYFYTSVSRAGGGEPRFISVGYVDDTQFVRFDSDAASPREEPLGPRGMKSRRGPEYWDRKHTGSTRAQGTRLDRRERCGNPCAGYIKT

SEQ ID NO: 1003677 - protein, 37 aa, Homo sapiens
MSEQFARYIDQQIQGGLIGGALEWKCWGSYTRGPGTP

SEQ ID NO: 1003678 - protein, 69 aa, Homo sapiens
HIYCQNIKEFTAQNLGKLFMDQALQEYNKLMKVEVSSKRSLHRTLVIHTRSNSMEEIYLLYEIAQSDFY

SEQ ID NO: 1003679 - protein, 71 aa, Homo sapiens
LLSMNKVNDDAKLKMSHKYVPDREGTTVISTASVLTGTMARVSSLCQSAAALSRLATTSLHILSNENPMVK

SEQ ID NO: 1003680 - protein, 54 aa, Homo sapiens
MQEPSRFDEGCEFGPSLFDATSASNSALFQGPELRFHKPPSSTPFHLRKGNSII

SEQ ID NO: 1003681 - protein, 56 aa, Homo sapiens
AARRSVVLVCWPRETKAPEVTQPSIGPNLLESLQVFTALVVQTIGKALAVFSIPLG

SEQ ID NO: 1003682 - protein, 54 aa, Homo sapiens
MAAEGLGAISCIPGTRHHSHIVVRTQDQEGPFTKDGGGHLRVAGLGAAVDLPPY

SEQ ID NO: 1003683 - protein, 147 aa, Homo sapiens
PIDYLMKILTRGGYSFTTTDEREIVRDNQEQLCYSAPDFEQEMATDESSSSLEKSYELADGQVITYGNERFRCPEALFQPSLVGMDSCGIHETSFNSIMKCDVDIRKDLYANTVLSGGNTMYSGLADRMQKEITAWGPETMKTQIIA

SEQ ID NO: 1003684 - protein, 116 aa, Homo sapiens
ERTEQRSLNRSCRPPSARHSQGQRGKQKQRLRKWRHVLEANVANQPRPTQSEQTLRPARTWMRRGARFLYIYLSDKHGSKASGTGSMVACVNKACTSYVTVWGNGSLLVLVTWVPV

SEQ ID NO: 1003685 - protein, 129 aa, Homo sapiens
TIDYSEDLTSAAQFTPRRAGIVRDTEEKVCYVALDFLRKRLARLLPKLSLLRRATSLLYGQVITIGHERFRWPEETLPDFLELGMESCGIHETTFKSIMKVLTWTLRKELYANTSAVWRHHHIPRAVNG

SEQ ID NO: 1003686 - protein, 45 aa, Homo sapiens
GPIDFGGRRPCPGSRRTTDSSVASLRNGDSRGHRLRGPGAFPGLL

SEQ ID NO: 1003687 - protein, 60 aa, Homo sapiens
PGIIDRTCFSRHLATLVTPVIMPRRACPAMYGQRALRHGPPSQVCPWGEEAAPGLSMGPG

SEQ ID NO: 1003688 - protein, 65 aa, Homo sapiens
ADIDQVLLQTLHISLPDDTLTDETLMSRPTKKGPHCQAHNDEDSTDQDLTGQGLTDKDSWTKSLL

SEQ ID NO: 1003689 - protein, 74 aa, Homo sapiens
ADIDLDVMKWLPYTQSNHENIRQIPTEGHLTKQSALILKTVTLQTVTVKRSLGRHVTSNVTWGPEWNRGTGRGH

SEQ ID NO: 1003690 - protein, 114 aa, Homo sapiens
MIPPLIDRSPGEETTVTWKSLENQHRHVPPTTLEDIVAKETETDIDREYFNDFKSFLLTQPELRPPHWWKTKEAICTSGCFLTPQTSSKHKYFTLHINSVYYSRSAENKTGRMS

SEQ ID NO: 1003691 - protein, 43 aa, Homo sapiens
SLAACTFCMRYLHCIAHALIAGPETQKGFLGGFGYYPSRSNLP

SEQ ID NO: 1003692 - protein, 121 aa, Homo sapiens
GSCRSGCCDANGRPRAQEMAEPWIFLHGSAISSALGVAVVARLLSPQEPTTLWAGQMQRHPSGKTVRKRGRNGQLCQYIVVERENDHGRNAHDGCALILAQPCLSSKSYSLPTWTLKGRAK

SEQ ID NO: 1003693 - protein, 69 aa, Homo sapiens
MFGSVSTVLTMLDGILYRKACTAVVRVHVDQAPSLRYLEVSTVLTCRRNYVQGGMHRSGEYTSTCRDSM

SEQ ID NO: 1003694 - protein, 43 aa, Homo sapiens
CVWFILSPCDTTGSDARLQYGLLILGAAVSVLLQEVYRLDYYK

SEQ ID NO: 1003695 - protein, 49 aa, Homo sapiens
GRSRRIPLSTVYWDKYQHKKHAGTVCTHSTRLVYAIIQSSSAKSLYIRF

SEQ ID NO: 1003696 - protein, 56 aa, Homo sapiens
SLNILSTVSGMMLDLTFCRISAQCSILCVSPARDPDALRLDDMGGVGRQMGRTMGA

SEQ ID NO: 1003697 - protein, 60 aa, Homo sapiens
MKSSPEERERMIQPVKEELRLEEAKLVLLKKLRPSQIQKEATAQKATGSVGSTVSTPPPL

SEQ ID NO: 1003698 - protein, 130 aa, Homo sapiens
VSEDSNSLEYSNSDVLLSVLYLLIDNRLTYFLCRDLDNPTVHGSHGQRQAQGHHGMQTNLLWMLPPLIPQMLGGFHEMLVLPSGLLSCILLRLFLCLAPGILTGFVLNLPNSRVLHLLIMSSVCLRLAEF

SEQ ID NO: 1003699 - protein, 40 aa, Homo sapiens
GCSLSTGRVGPLSNGDSPAVRVTERTPRDYWKKVPAACRV

SEQ ID NO: 1003700 - protein, 48 aa, Homo sapiens
EVEISPWSAVLELFLVQEGERLRKQTGASGQTVGKSKCHPLNGLNFST

SEQ ID NO: 1003701 - protein, 166 aa, Homo sapiens
MMWYRSPVLGRGPPACGRVCMLGKRSFDFGYEADLDVVRLCFIELEKEKGPVSWAHQECFQKPQRFVAGIWGEASDSWVCIVWSHTGCVIPGSSWVEPSTCIHTLSATIQTLSCLWGLNVEIFVSLESPQAKLLLAGASLGELHGLLFPPPALGIEVDIDVEHGGK

SEQ ID NO: 1003702 - protein, 110 aa, Homo sapiens
MHVERNTWIWTQAEVLASLPSHVLKNDHVRRFLSTSSPPQQLQSPSPGNPSLSKVGTVMGVSGRPVCGVAGIPSSQSGAQHHGQHPAGSAAPLPHCSHAGSAGSALAYRT

SEQ ID NO: 1003703 - protein, 105 aa, Homo sapiens
MFGHGGRWGVVGRAKQAMKPGVQAQAQRVIHLPQSVQALIKDFQGTPTFTYKAHIFFTDNWPEPLFSELGRSRLAKVVKTLKEIHLAFLPYEAQVFSLDAPHRNY

SEQ ID NO: 1003704 - protein, 48 aa, Homo sapiens
HDVDDGTRFLFFFPKNFLKVLNLDFFFPVLTIPKAILQPSPKAYMSTQ

SEQ ID NO: 1003705 - protein, 34 aa, Homo sapiens
LWCMHVDDSGIPECDFRDERASKKVQGEIDNIQN

SEQ ID NO: 1003706 - protein, 42 aa, Homo sapiens
MTPFLLTSPKILVMEPNPAATRKVQVPALVGSSSGCRTRFFI

SEQ ID NO: 1003707 - protein, 60 aa, Homo sapiens
AIWQRYRLDKAPYCISTVGQEEYKVKFDNQGKSLLSGNHIAYDYTLLLTSCMWRSRGGRP

SEQ ID NO: 1003708 - protein, 69 aa, Homo sapiens
ILMRRLSNRAYGTNGVLQKDLKLDMLFCSSEKVALDYTKAVVINKKTGKERCAPSRNLLGMEASRRFNC

SEQ ID NO: 1003709 - protein, 62 aa, Homo sapiens
MGELLTCTHILNVTGESGNGNYSVLHIPWADCLEVLWQERTSITCYGPTRHGKLELKLQLAW

SEQ ID NO: 1003710 - protein, 44 aa, Homo sapiens
MRMRCLSWNAYHISLPGKFFLLIQDSLYLLILNLKYQVEVRFQI

SEQ ID NO: 1003711 - protein, 55 aa, Homo sapiens
MLWGAFSLLFTQGSHETVIPKKTYFIDQGLIPPGTSQMVDFDTNGDSAIGTIGGL

SEQ ID NO: 1003712 - protein, 83 aa, Homo sapiens
DERDKVSNLSVVLLESYELTCDQSQIRETAPASRDLSHIRLKALIIGYARRSQPLRTGEEGCNAFSQSLGMKLLNAIETSKTR

SEQ ID NO: 1003713 - protein, 55 aa, Homo sapiens
IFGSLPTTHCYWNTFYTHLRGDSSTTSTRARHAHACGTWPPSFYHTVVDLGTGLP

SEQ ID NO: 1003714 - protein, 57 aa, Homo sapiens
SFENVNERENSKGAIDALQDDITSQLARKCKGFEGASGLSSLMAAGGFWCYVLWKLL

SEQ ID NO: 1003715 - protein, 71 aa, Homo sapiens
MRIKKRRVCAKLNESPSNARRVEVLEVGAVKAVFVVVRVLDIDRLTQGALEGPALHLGQIACESKKHPVPR

SEQ ID NO: 1003716 - protein, 92 aa, Homo sapiens
MGGAYCLRTATFLEDCNLSDRCYSFPVTFGSLSLRLFQLGDCYPGIWRKLGSIVTEGTVDNSEYCPFGDAIQLLEGGLLGMSLFLQLGYRAS

SEQ ID NO: 1003717 - protein, 42 aa, Homo sapiens
GSLERRFWHMNSLVVQVLLYNATSCDALVCTISTVLCRRPKA

SEQ ID NO: 1003718 - protein, 51 aa, Homo sapiens
LWDGADWSFRAVASLSCKTLSGELVTCVSDLSSDRGKRRDWLHRYTIQSPA

SEQ ID NO: 1003719 - protein, 94 aa, Homo sapiens
LLLGTAGQAAYSWMPCVNWHLSRTYRHRFPQRGGQLRLVAGLELTWPPPGCYWVGSSRSPPSEKERLSEQPRLSRDPQSVCAGSPLEGCLRTLG

SEQ ID NO: 1003720 - protein, 33 aa, Homo sapiens
ALGVVSSDHYLVILVACRGLHGVLSAFAAYQST

SEQ ID NO: 1003721 - protein, 37 aa, Homo sapiens
MVLIPLVLNFKLRAIDDLVPQGRKDEFGPQPRCSRGV

SEQ ID NO: 1003722 - protein, 34 aa, Homo sapiens
MSRDCCRLHGDLKGRGRAKLHNLIYFKSGGMEHA

SEQ ID NO: 1003723 - protein, 75 aa, Homo sapiens
LVLIPRDRHGCSVQCDRQGHGGMCAGRRRATFCFWVVRLPVTVSGRSPGFSSHWPGWHLARSYSLAGEGLRSGNL

SEQ ID NO: 1003724 - protein, 146 aa, Homo sapiens
MNALKLNVCRIVQEVNIRDDYRKCPSNCGQKIKIRRVLMNWPRRLVSIGIVWDSEHSDLTEAVVRNLATHLYLPGLFYRVTDENAKNSELNLVGMICYTSQHYCAFAFHTKSSKWVFFDDANVKEIGTRWKDVVSKCIRCHFQPLL

SEQ ID NO: 1003725 - protein, 109 aa, Homo sapiens
LGDLEDLRVHHVTHSHMCTYPLIHLGTHTHTLCIHPMHTPHTTHPLIYLVTHAPTHTPMHTYPHTPIHTYPWAHIHTHICTHPTHTFYPCTHPHAHTPARTHTRAHTPC

SEQ ID NO: 1003726 - protein, 41 aa, Homo sapiens
LIQRISLGLSGTSELSNDTVAPSSPISQPQVEAATCMHPGG

SEQ ID NO: 1003727 - protein, 61 aa, Homo sapiens
HSGCMHVYLCVVVFCLCVRVCHVVRTSVHLLYTCPRPSMFAHGGRWGVAGRPRQPLSLGVQ

SEQ ID NO: 1003728 - protein, 64 aa, Homo sapiens
LVYIEVNGTEAKQQVECGSDPEENSARSPDGKRKRKNGHCSLKTSMSGISKLLDKTSTFVVGQA

SEQ ID NO: 1003729 - protein, 81 aa, Homo sapiens
MSGRFGRVLSWQACSGMWTNMHGGSAGLKWLTEQSDGTAGNTVKLAPAGSFKFPFNGGLVSPRPLSTPGNLPLQPKALPKL

SEQ ID NO: 1003730 - protein, 50 aa, Homo sapiens
RCCWSSKICDHAVEVFVLQIWQGSVLGPFRACDMCETRDSRLNCGEKPKK

SEQ ID NO: 1003731 - protein, 67 aa, Homo sapiens
SRDPASAWYGQAQRLSTDKGGVAGYQARGTPGTGHHNPMLSKFAQKIGGSELLPPYAARAVYCCGDR

SEQ ID NO: 1003732 - protein, 70 aa, Homo sapiens
SLDDVMRCQAGHVRVKDAGDGENFSYDRFLHCLSVGQIGWYSLDFLAAEVYALGVNDEGEQLEEGHTSLV

SEQ ID NO: 1003733 - protein, 105 aa, Homo sapiens
MVQRSNSTGAARETAAVFEASETESKVGKQVTLEKQCRVEEASAVGPVHNSVPSNPVAAPGFFIHPSDVIPPIPKRTPLFMTPPFTPPNEAVSVVINAELAQLIP

SEQ ID NO: 1003734 - protein, 53 aa, Homo sapiens
EALVLGLVGNLGGAELGLPFRRAGASELALGAWSSEGQEVTEDSLGPGIRCRR

SEQ ID NO: 1003735 - protein, 109 aa, Homo sapiens
RRGNGGEAEETSYYHYFLETVSLCYTGLKCRAQSWTVTSICQVQSILLPQLPEQLRLQVCATRPANFRFFSRDRFRHVGQTGLELLTSSDLPAWVSQSAGITGVSHCTP

SEQ ID NO: 1003736 - protein, 111 aa, Homo sapiens
MKVNDSWWLGELLMFARLEWETRRFGGGDGDALSSRRVYEVKPFFSLEVEKESISSVLEESIFQEKVSADVGEEKESFVVFLVWESCAVRREGREKETVAFWLGGEDGLLL

SEQ ID NO: 1003737 - protein, 88 aa, Homo sapiens
TLTLFAVPFSIVLYLCGEVRASLTWDNPVIYCAHANGDAHSAGCACVMGVPGLRIEEQTPVVRYLPGGRSRKGTDLVGYQRWYWEQNG

SEQ ID NO: 1003738 - protein, 137 aa, Homo sapiens
EVSDPTAIPSFSIGSMNHSSCLSRQEAEFNKSMGELLTCTHILNVTGESGNGNYSVLHIPWADVWWYCGERNLHNLLRSNWTGTCALVQLAVPFTLAFHKIPENSHGHQNRRHLTNSFNPNIYIDTVSPQGGERAPQ

SEQ ID NO: 1003739 - protein, 73 aa, Homo sapiens
LYGVDYSGYSRMHCGSYTCDMQIVWSCYLNTGRFQYLERIPLTLPIALVARDIITNDSNTADSYWAALGAPDL

SEQ ID NO: 1003740 - protein, 105 aa, Homo sapiens
NHHDIYMCSTQSTRTLNKLSSIPRKATSYASKTPGLVQHGDMGSSPPEDINYPRGYTGVSFTYTEGAQKHQLAYKFQHETMAPQQLATQKPHPGTGLTLEKGPGK

SEQ ID NO: 1003741 - protein, 43 aa, Homo sapiens
IFAQARVQRLFTGAIKAYYSLKTPGAKQSSSLSLLSSWDYGPV

SEQ ID NO: 1003742 - protein, 39 aa, Homo sapiens
EYNVVLRTEQHIFESMHVRFDWAVCDSQETAMQRGPTGT

SEQ ID NO: 1003743 - protein, 73 aa, Homo sapiens
KQVRRSLQDIRSSEDDVGKPRAMKAGMLEKKWTRPFDLHALGSCRTDPHLCDFLETHFLDEEVKLIKKMGALE

SEQ ID NO: 1003744 - protein, 47 aa, Homo sapiens
GTLRSGERMAARWMLLLCLLRRVVGAGQAMEKVTGGNLLSMLLICCA

SEQ ID NO: 1003745 - protein, 41 aa, Homo sapiens
LRVIYIRRVMVTLLIQHFDWLRQKDCLSLGVKVAVSYDRAL

SEQ ID NO: 1003746 - protein, 40 aa, Homo sapiens
IRRMMAVMNKVLAVKDGWLWNFLKEENNKAGAVVTPVILT

SEQ ID NO: 1003747 - protein, 47 aa, Homo sapiens
MAGEARKLTITAEGEGEAGTYGHVGAGETERVEVGGLHAFKQPESHK

SEQ ID NO: 1003748 - protein, 71 aa, Homo sapiens
RINDPVMVSYNPEVGSEIKTANDMEKPVSSKKTELAGCVCTWLSSYSGGKVGESLEAGGSARGLRVEPMIH

SEQ ID NO: 1003749 - protein, 80 aa, Homo sapiens
MYCDLRCSQNEAAVDRNSKRVVVPSSAHQAVKHEGNRMGQNHEPTVIAENELLGAAAAIEACSQKARAAEARATPKEADE

SEQ ID NO: 1003750 - protein, 49 aa, Homo sapiens
ASWFRLFVSDVAAGLRSAQWCGCNALMDLEVVFPLMKSRRLVFGRREIN

SEQ ID NO: 1003751 - protein, 88 aa, Homo sapiens
MVLHLQEKYEWTKGLLKTHLTKLQQLKKDWTILFTTFPSQNSGLSSECYRVQIKVLYRRSFLSKAQSHSRHQNNLDCAQKNNKPQKLG

SEQ ID NO: 1003752 - protein, 41 aa, Homo sapiens
RSAMAGVIVTVATGNQYKPWWPFFMSLPKLQAHMGTCQDQS

SEQ ID NO: 1003753 - protein, 43 aa, Homo sapiens
RRSEWCIEGLTVAGPAQMKGFHQMSVKNLEENTSQHTPVSEQV

SEQ ID NO: 1003754 - protein, 42 aa, Homo sapiens
ADDGQKTSSVLDAVQHSSTYLTQHHSFSDHSWICVTHARLHK

SEQ ID NO: 1003755 - protein, 56 aa, Homo sapiens
YSCGFLATRQTLLAPGASLSPGVGRVGHSYGPHTQPETLEGTADNRTLQRLKRYLP

SEQ ID NO: 1003756 - protein, 105 aa, Homo sapiens
PGSPYVCSLLGSSSGKEQPLECDRAVGRIALGATYPSFDVQDQFEPGPPGKEETNERILLWSFLVKITFRGSTWAEDLSICSLVRSKHLTGELLLSGVLTHHQLP

SEQ ID NO: 1003757 - protein, 48 aa, Homo sapiens
QYSRLPQDRWSPYMPTLWSRPDEAVYKLHESGREVMEEGHYAQEPLVA

SEQ ID NO: 1003758 - protein, 96 aa, Homo sapiens
RLVLHVEGTQLVQEGVEHGLQGSLRRKSKRNRISREGPLGHRVLANSPLRMPLKPIFLLSLARLPGPNLRHLCLEYTFMALPVTGVSPKPTLGTLP

SEQ ID NO: 1003759 - protein, 43 aa, Homo sapiens
SIECLVILPHLEHTICILQAWHKHFLCETSFAATQGESSNFHF

SEQ ID NO: 1003760 - protein, 49 aa, Homo sapiens
IYRILCSPSAKMGSMACGEDLRLFWDSKNELKKKHRWTVHTTTSLHQEA

SEQ ID NO: 1003761 - protein, 74 aa, Homo sapiens
SPVTHTQEHVGQFSKYSTQGTGNKKLGRAGTARSSACNPSTLGGRSGQITWGQEFENSVGHTVKPCLWLKNTKS

SEQ ID NO: 1003762 - protein, 38 aa, Homo sapiens
LLIPRHVICLRNCIHQFRSHEVKFLHPSYPERSTSYRY

SEQ ID NO: 1003763 - protein, 59 aa, Homo sapiens
SNIPNSHCYRLGVTWGIGPGLYGSRRSHVAADQITYHRRPEYKNLAWEDGIHDCVAQYL

SEQ ID NO: 1003764 - protein, 97 aa, Homo sapiens
MVKLAEETDRIISLPIDQYRDLVLEESREVKQSSETPAALASGKPLHGTDDPLGERPTLDKYKEASRTRVTKASILPGAKQNMVNSSRGAKRKKVVV

SEQ ID NO: 1003765 - protein, 52 aa, Homo sapiens
MPCLLILINRRDHGSGSVCPDLSQKVLAVKRSFPRVILLESDLAVHAKRLGT

SEQ ID NO: 1003766 - protein, 39 aa, Homo sapiens
LLVPLYQRSLYMSTGETYRLVFLEDHSSSSFFFDINLHL

SEQ ID NO: 1003767 - protein, 35 aa, Homo sapiens
GLSCSGWQEGAGVLSTPEINLIICAALLKRKTTDQ

SEQ ID NO: 1003768 - protein, 122 aa, Homo sapiens
DSRGPPVVCIWNRISVRDAGVGHFYYELGVQHYRSVPALKHRNGGLITLEELHQQVLKRKGKFAQDVSQDDLIRAIKKLKALGTGFGIIPVSGTYLIQSVPAELNMDHTVVLHVAEKNGYVT

SEQ ID NO: 1003769 - protein, 47 aa, Homo sapiens
SRQVPVRGLAGLGATVICTSTWSLVQQNRMQLSGARGQRVDEYKTEL

SEQ ID NO: 1003770 - protein, 43 aa, Homo sapiens
RRRASGTLAADDDFDTTLLGHRDCRTDNTVTDTPTTPLLSRTT

SEQ ID NO: 1003771 - protein, 43 aa, Homo sapiens
MCAFNVLRSSGGAGTKKQFQKVLSAGHRPAPHNEIKLFSTENK

SEQ ID NO: 1003772 - protein, 49 aa, Homo sapiens
GVCSCCMRREFGAMSHTILLVQPTKRSNLPDTRYSLITKKALPGSEVTK

SEQ ID NO: 1003773 - protein, 61 aa, Homo sapiens
MDRNVVGEHCMQRRSMTERACGAHGRENAGVSSGTWVRIPRTDGPRSPEEGSSSLGYSGPK

SEQ ID NO: 1003774 - protein, 98 aa, Homo sapiens
SVYSGVILGITDNLTRDWVYILYGQKVALKYCKDFSHAKQLFAACYGVGTHDVLTERLRTGSCLHETVAFWTTSYPTDSLGTTGHGTDDDDPATPDRY

SEQ ID NO: 1003775 - protein, 125 aa, Homo sapiens
YYCVYALTWSRRAVELLKWGIGESAPQAFSLSWSTGSKQHFKPKVYNSFCSHCLRDMDRSRGLSRRRSEVQGWQRDQVEDRHFSSQSRATQFQAEAATVPLKASVPARPMNHFLLRGLPDLALVY

SEQ ID NO: 1003776 - protein, 50 aa, Homo sapiens
MKTSGAYGFHMWAMPEQYSTSTLWENSSKKLIFGVKHKFTITGTGIHLGI

SEQ ID NO: 1003777 - protein, 44 aa, Homo sapiens
MLQGEGRAALTLEGAVEQQVHEAVVGELGTHLRRAYEVSGGDAN

SEQ ID NO: 1003778 - protein, 33 aa, Homo sapiens
FEQDFFCGSEQGLYHIVKVRGLLLKKKKIFFQH

SEQ ID NO: 1003779 - protein, 53 aa, Homo sapiens
VSVHALQYLRFPEELAGGELGPAGGEMEVVRNLSGLEAGLRRRAGGTLASYPA

SEQ ID NO: 1003780 - protein, 51 aa, Homo sapiens
KVGSFVFMEMSDNYEKLRKHVALKAGSGKLGRDVLSSKPGKTLTIVNALLL

SEQ ID NO: 1003781 - protein, 54 aa, Homo sapiens
MVSLAVQCPGKAEGAPVYRHIRILECVLYGRLSECRGMPDSQCVLRSVWFIPIT

SEQ ID NO: 1003782 - protein, 39 aa, Homo sapiens
SVRAVDTAHRLLESDAQTTESLRVIPEMWPTRDSKHRYT

SEQ ID NO: 1003783 - protein, 40 aa, Homo sapiens
EASAKHVSACARCSCPEGAATVPLRCLLGAWPQRMGWAWA

SEQ ID NO: 1003784 - protein, 54 aa, Homo sapiens
ILSDLSTDAKNQGKIKYCERRYHGIKVLEMSCLFNHQAYTLQFSMLSNTVARGT

SEQ ID NO: 1003785 - protein, 76 aa, Homo sapiens
GHGSQEEAQQVPQDTRKGQLKHYSSQTVTGGRIPEAVWPPQHQKGTTEQGPVAEDVTKASAPGVSGDTGREAPFSQ

SEQ ID NO: 1003786 - protein, 43 aa, Homo sapiens
RGGPLCDFNPMSSNAVQRCVRLRSVLSVLKQTPLSRYVPASVC

SEQ ID NO: 1003787 - protein, 66 aa, Homo sapiens
VAAVGEQRTGFDHKQVTYGGYFRDQKDGYGKNEGYIAAVATASSSLQTATELSTLFPAWGIQALKS

SEQ ID NO: 1003788 - protein, 48 aa, Homo sapiens
GYPTGNVTRADSNEQAVFDVHSVLRVVLRVRHGTYMLPWCATPVLQQD

SEQ ID NO: 1003789 - protein, 35 aa, Homo sapiens
VLRRYVLRDGYFTLTVLGRSGEEEGCASIPLSPPP

SEQ ID NO: 1003790 - protein, 63 aa, Homo sapiens
VASVFHTTRWVPPLYRGAVRGCAPQRSALSASHGFMWYTVSLMPSGHLVSCPSPLGRNKCSAE

SEQ ID NO: 1003791 - protein, 61 aa, Homo sapiens
TVAHKASKTLRYVKEARAQKITIMYDATYMTISRINQSTETECRLMVTPGLEARAELRTHL

SEQ ID NO: 1003792 - protein, 53 aa, Homo sapiens
MLVNSLYADGSSPVNVPENPPSMALQAALQQVPQFLKAAEDYGVIKTDMFHTV

SEQ ID NO: 1003793 - protein, 105 aa, Homo sapiens
RGYVVRGCVRGAGLFLGRTRLSAVLRDAWGTPTRVTRPRWTLSTGFERVNGSCEDVDDVRDWRAPDNTESVPKTPRRVHVCVPRTGFLLDSPRSQLHTSQHRDLT

SEQ ID NO: 1003794 - protein, 89 aa, Homo sapiens
MYEPEDSQRGVTGQTNVGTESRVMSIRWTWKDGAGGCPQQKHLMCLLVHLLAWGKEVLSEGLRSVVFCVERKARCGVGNAGRVLSETSF

SEQ ID NO: 1003795 - protein, 34 aa, Homo sapiens
SWVLIPPAHESLYYADNQTQPVCQTPALVPPPAQ

SEQ ID NO: 1003796 - protein, 86 aa, Homo sapiens
DSRNRYSRAVLEVGSLTTIMPTCGILGNLRDDSGVERSRVPLNRARTTRAKKYIPSTFGSAMRKSIASARSRIDAIFVAAPTRSKM

SEQ ID NO: 1003797 - protein, 60 aa, Homo sapiens
MEAKGTISVLRLLTGVIAHVSVDCQAGDVKSLNDVAVPFLAVLNVVEDVVECLGWHITAL

SEQ ID NO: 1003798 - protein, 72 aa, Homo sapiens
LEDPWVLIPRHLPLEQTPPPSQHSRLAPIHALSEAMAVRADEGRMQETSQHRDVAGTLKAKLRLKAHARQHP

SEQ ID NO: 1003799 - protein, 37 aa, Homo sapiens
HISFPGRFLSTHSEGSPSLAEEHSGALRTPGSVMTNP

SEQ ID NO: 1003800 - protein, 52 aa, Homo sapiens
MSLVHDVGLLRGSCECGQVTDSHGLCYAGFYDGNRECVHVHRFTRAMLIHAS

SEQ ID NO: 1003801 - protein, 54 aa, Homo sapiens
LQDLIARLVSPLCRGREDIQAGGTVLLSVVVLLHALLSMGWKLYFFWRHRLAEL

SEQ ID NO: 1003802 - protein, 33 aa, Homo sapiens
SRGSGTRLGEGRYGWGVHDCSCARALGNSERVS

SEQ ID NO: 1003803 - protein, 44 aa, Homo sapiens
DLGACMWSETRGLDSGLRYLASLPYSRVAQLTMSRRFLSTSISP

SEQ ID NO: 1003804 - protein, 58 aa, Homo sapiens
DREVCCTVSGLDTTAIKDAGGQCLIVTTDIPTVPQLVVAAQPEGWAKRMLNGLHPMVS

SEQ ID NO: 1003805 - protein, 39 aa, Homo sapiens
MQPVAEVEEAVVQGEQDVGDQAWHFGQQPARDFLGGHLD

SEQ ID NO: 1003806 - protein, 97 aa, Homo sapiens
CGVRGSEYADSHEGIIEVRRGWQEVPSRKNNLFDFFLGQQVVGVTHFFLRSGQHEGEGEHSTCGRSSCRSCISWASLAEKKANNAPLQAQHPGARVD

SEQ ID NO: 1003807 - protein, 49 aa, Homo sapiens
MRVRWWVGVVRSRASRLYTPSEDIESLLLFSHALCATPLWVPSLAFDFL

SEQ ID NO: 1003808 - protein, 76 aa, Homo sapiens
MHVDIEHENNNRFEEYESVWTEADTGHHSPANVAFRGSWPSSMLQRATEQPGPVTAALGLRDWAMTPLRAMANATN

SEQ ID NO: 1003809 - protein, 49 aa, Homo sapiens
ALVALIYKARMFCQYSLSKWFQEFDSQVIVIHKLIVCHLHVTNSYSQTE

SEQ ID NO: 1003810 - protein, 34 aa, Homo sapiens
MTPFAYAFGTPRGDFLFHRWYYFLVFKLEHILAI

SEQ ID NO: 1003811 - protein, 38 aa, Homo sapiens
TLAEMPDGCSSPAAERLFRPHIHWELPVTLCTSGHLMP

SEQ ID NO: 1003812 - protein, 80 aa, Homo sapiens
TRVLLVCLEHREMRSGLLSCSDTPATPLRKSVEPGVYSFTTVGEDPGAGSGTCTSEKMCEHAGSCTLPISAHIRGKNYCA

SEQ ID NO: 1003813 - protein, 67 aa, Homo sapiens
FCGQVPAFEGDDGFCVFESNAIGYYVSNEELRGKYSRRQQPKVVHVGEALLSSEYSGPRQVPGLFPK

SEQ ID NO: 1003814 - protein, 69 aa, Homo sapiens
GCSSPTQISTEDINKRYHYQLTLAAEGYLEEADPQEAHSLEKALQGGGSGRVKPNSEELGFGETGKNLH

SEQ ID NO: 1003815 - protein, 66 aa, Homo sapiens
MLGSPQLVSFGPQPHLGLANTCSVLENPGLGGLVYLCLPHTPTARPAQVAQAESQVLLVGVLLESR

SEQ ID NO: 1003816 - protein, 37 aa, Homo sapiens
MCAALGLTILASISNWIDRQQQMIERCGEDHRGTSGL

SEQ ID NO: 1003817 - protein, 58 aa, Homo sapiens
MYSKDPLSLWTAEPVGAMLLVTGCTQIWVLIGKHLHSKGFLVYAGCLMKDQGHDGVTE

SEQ ID NO: 1003818 - protein, 47 aa, Homo sapiens
GCSSPNDEVITEVQEFYKDHYKNAENQGLSPKGTLKGFNYAFELACG

SEQ ID NO: 1003819 - protein, 58 aa, Homo sapiens
VLAGTVNITHNGNPLSPLLGAQVRQNVKNRLLVKQPGCQYFNTFSPQTSNFCTNPCAN

SEQ ID NO: 1003820 - protein, 36 aa, Homo sapiens
WDGVLYAELWYCSGRTVPDGLVTVCATSTRRTPCCL

SEQ ID NO: 1003821 - protein, 64 aa, Homo sapiens
DELIAVGSLRGNHPEARGAIHTVRGSRSRVARRYILELVKNGKRLPQGFTSQDSQEDKAPTHQS

SEQ ID NO: 1003822 - protein, 56 aa, Homo sapiens
SIQEAPSAFFLFCSEYSPLNQGEHPGLSIGDDTQKWRYYRKKKSFGILTKITAYGK

SEQ ID NO: 1003823 - protein, 40 aa, Homo sapiens
PAVSRTVTTRYFTETPAGRWTTLSRDPTLDWAFSLNVQLL

SEQ ID NO: 1003824 - protein, 54 aa, Homo sapiens
SHQKMVFCRTDVRICGMYRARFTFSFVVDFNFHIQFFLLQNQSHTNFTHVTAHN

SEQ ID NO: 1003825 - protein, 60 aa, Homo sapiens
MHTLGRTSPLLGEVDRLKPSSLNSSKPFSIQLCSIAGKELCSFGGGEALRFLEFSAFVLC

SEQ ID NO: 1003826 - protein, 41 aa, Homo sapiens
NSRGSPWVLHVHTARCGDMDQTPAYPSFTAPSTQTVPECMD

SEQ ID NO: 1003827 - protein, 88 aa, Homo sapiens
MGAALAQVAQLLEYCLWSDSREKRKTCCEADWAEDRHCWSSVSEESPLVLDISSFRSTLSRAKVRTARASFSCLAVGSSTSVPSESRA

SEQ ID NO: 1003828 - protein, 76 aa, Homo sapiens
MYIHITEGREDKQRRAPVGMLITFMQLPLDLNTHDTLNEIIIWEIHNTLLSSIQSSKAVCKSPQFDAAGDVVVEGD

SEQ ID NO: 1003829 - protein, 51 aa, Homo sapiens
MHLVMESSASGNEVTDWRTALDGPADSGSSISPGGEVALFIVVVIVAIALR

SEQ ID NO: 1003830 - protein, 99 aa, Homo sapiens
LHVHVQICPQYLSYRSCSRASDLLSLRVTGWPPVPPLRLDSVWSVNWKELEGLHRREGSALLVPVCLLVLAFVVCACPASWWGRGLSVTVCREFSNTQV

SEQ ID NO: 1003831 - protein, 39 aa, Homo sapiens
LLMYLQVAYVNSYVGQCTLSLKAGTSSKFFKPARPSPLF

SEQ ID NO: 1003832 - protein, 111 aa, Homo sapiens
MLVLSGSFLAACWSLCRMKASGDPTLPVDSDEERVLVLSLLLLVTSLPCLFHAQCVLNELKEKYPAPAKHHAEHILRGDLFLPSPSGKFPGGQEHLGICLVAPFGPLTKAS

SEQ ID NO: 1003833 - protein, 79 aa, Homo sapiens
LYRALHSSMASSSSIRRTMAPRSMSPYAVRLSTWWQELVAPQYLATAANLLRHYPTEEAEQALDLLSEMEENEPYRRNM

SEQ ID NO: 1003834 - protein, 90 aa, Homo sapiens
LEDLINEGAAVACSQPVPRSFCQVRSEARSLVLHQDEAHSLSVQFQGAHPSKPARCRASPSLQVAQDPFLAKRLKLSSQRSLWARHEQQS

SEQ ID NO: 1003835 - protein, 42 aa, Homo sapiens
LEDPPGCMHVPWYHACAGSYFLLLTSPEAQDPGGDGRSRERS

SEQ ID NO: 1003836 - protein, 44 aa, Homo sapiens
TPSLVPPPWEADGSDCLSPGIQWLHGSYDHTCRQPLHSNLGKAL

SEQ ID NO: 1003837 - protein, 34 aa, Homo sapiens
MCLCTKAAIRSLYRTMLSGFLEHAAEITSGTELE

SEQ ID NO: 1003838 - protein, 90 aa, Homo sapiens
GEAALFPGNTAGFTTWDWLQWCSCCDLLRRGEHDPGCECCAWGPWGVCVNVTCGGGIRAPGFGGCWMTSGVGSPCLLTPDLRRLREGREQ

SEQ ID NO: 1003839 - protein, 38 aa, Homo sapiens
RDEIWPGTENEKKLKSSCPRVEADLEWQSQEYQETASP

SEQ ID NO: 1003840 - protein, 95 aa, Homo sapiens
SCLRENSARTAFRMYRFNCWHRSRSRSTMSCKGLFSRLSLFCALSNFSFQTRFTQLSPVQTAWSSSARARLFTLKRPRTGELDEDTRSCQQCGHI

SEQ ID NO: 1003841 - protein, 44 aa, Homo sapiens
DAYWSRDGSEQRKADVQEGRGRVKAEHGHAFHVVLTVALARHHV

SEQ ID NO: 1003842 - protein, 44 aa, Homo sapiens
CFGTADTEGRDVPHLLVDLIWRWRISTRALWMDLGKARLKNWVL

SEQ ID NO: 1003843 - protein, 46 aa, Homo sapiens
RISPSSGAPDTSGVMVGIGQKDSYVGDEAQSNAWHTDPECTPIDAW

SEQ ID NO: 1003844 - protein, 59 aa, Homo sapiens
GPHSRVDPSWRLRNSLNRASFLKWQTLSPQGPKLYLEDTAPWASAVPFLRVLGVRPQHI

SEQ ID NO: 1003845 - protein, 50 aa, Homo sapiens
TDDRPCLSSACSSLISSSSFLHSSHPEVCPDKPWQKGRPSITKCGSHTDG

SEQ ID NO: 1003846 - protein, 74 aa, Homo sapiens
MAEESEMALRSVIRLGVSRPSEVDACRRALTLSQESVVHAEGSSYSPHVGSSATEEFSLVPGPGSATSVNLEGM

SEQ ID NO: 1003847 - protein, 40 aa, Homo sapiens
QDVMPVAGSTAETHLLFNDAHFLMASLVHMNPRTQQGAAE

SEQ ID NO: 1003848 - protein, 53 aa, Homo sapiens
ALTLATQVTKPHVLKVELKDMYTAIKQIPRGTAQLSIHRSNIRQQASTTPDAD

SEQ ID NO: 1003849 - protein, 34 aa, Homo sapiens
LGRDAVAYVCLQPVSSTRMLMYHYEDWLIVLGSM

SEQ ID NO: 1003850 - protein, 63 aa, Homo sapiens
MRTRPYNCNTHPCKLNGIRSHAIANTHKACETIHVSLPAFNHTPSQTPHTCLNTSCNPLQAFE

SEQ ID NO: 1003851 - protein, 78 aa, Homo sapiens
GSYCFGTADDILRPDSVSGTGSGEDLKRGPRPRNSVHCCQLLLEDLLPGSCHFLRLFDCCEGGTFCSLLCHGRRPKAQ

SEQ ID NO: 1003852 - protein, 43 aa, Homo sapiens
YGIESSDRALRCVHKGQCTAACNHSFSRQQEEYIMPSQALKQT

SEQ ID NO: 1003853 - protein, 53 aa, Homo sapiens
AFALGRRYCFHYYFIEALHTAAGVMKDHWDNLEFLLAGSGGCTYSGIDAVPQH

SEQ ID NO: 1003854 - protein, 77 aa, Homo sapiens
SYVLWDGDGPLTRISVVACVGVVIVQVPINALRCSQNSIMVRNAVGPASDNSRRIYAGHQQCSTKAHLLSSVIRPKH

SEQ ID NO: 1003855 - protein, 131 aa, Homo sapiens
MTVDGLSFLGTSLSGQRAAFTVHWWWGMDLELLVSAPQSSRTHLPPWVAGASAALAFWLQPQWRLQLPGGHCAAMTVGSSGSTHSVPFMASAAWMSSVTEPATRFECPVNCCFSSGLGFCRVSSTWSSSSR

SEQ ID NO: 1003856 - protein, 133 aa, Homo sapiens
SGYCNQHSRVDLRSSSQARTIGKGSSGEVYKGIDNHTKEVVAIKIIDLEEAEDEIEDIQQEITVLSQCESPYITRYFGSVPKEHQAMDHHEYLGGGSALDLLKPGPLKETYMATILREILKGLDYLHSRRVPS

SEQ ID NO: 1003857 - protein, 40 aa, Homo sapiens
RYLSQTTVYHQMLVSMWNKNSPSLYENQNTTIHMGFTYWG

SEQ ID NO: 1003858 - protein, 47 aa, Homo sapiens
MMRVRRTGGEMRLSVEWGKDISEFKKYEWIVLVGLGGFAGQAKIQYQ

SEQ ID NO: 1003859 - protein, 49 aa, Homo sapiens
TSDHLMQQITPAIILCNSRRPSDHLMQQQTPSDHLTATDNTDTVIILTA

SEQ ID NO: 1003860 - protein, 58 aa, Homo sapiens
LDDGIRVDREQNETVIVMRFVVESVSGKCRGNAFSVFSMSSVLGHMSRGAATPPAIAL

SEQ ID NO: 1003861 - protein, 46 aa, Homo sapiens
WAPESKLCSRRSEASSAAVALQAHGLIPDNGFPGQFFPSGGPLRAQ

SEQ ID NO: 1003862 - protein, 70 aa, Homo sapiens
CHPGENAGGQSGFTTTSASGVQAVLLSRASEKRGLQGGDHQARLIFGILTRDGVSPLVGQAGFQLSVTLR

SEQ ID NO: 1003863 - protein, 53 aa, Homo sapiens
DLEDPEKTTEGEAGGVPHTESLLLILAYLASCPFVISLLCEMALGRLAEEIAG

SEQ ID NO: 1003864 - protein, 121 aa, Homo sapiens
CGDLEDPRYVCRRASNVLTLQFAWRLLCSMSAVSMNRVTSHGWLQAVFRDMSCFNFIFVAKASWMTPDESDDTCFSFQVLFNFPNRLQQALQAFLDTLRLGNCFLQQRRSLSQAIGEALEV

SEQ ID NO: 1003865 - protein, 102 aa, Homo sapiens
TDSQITAAPLLYSILSITAPTLFCDEIPQITGHAPLLRVTGFPQLTTDDISRLPVTDVYSGSTGQVSPLAVTRLSSVSTGDTTPLPVTSPSSASTGHVTPLP

SEQ ID NO: 1003866 - protein, 81 aa, Homo sapiens
NCDYTKFVECTRNPKWGDLLASGWGSIEPENFSFPDDLQCVDLNILPNDECEKAHVQKVTDFMLFVGHLEGGEDPWVGIPG

SEQ ID NO: 1003867 - protein, 46 aa, Homo sapiens
MLELDQRNCEASSEVATLHLDGTVKAGTATDSHGQAHALNASAQWP

SEQ ID NO: 1003868 - protein, 86 aa, Homo sapiens
MTSSELTNWNKNIFMVRLFSINPVWVLWAVRKFSNPSHCPLFHHHGCSAIMHTFIKLHDGRPVHGTCDDLWQSRSYLGIGSSSHIQ

SEQ ID NO: 1003869 - protein, 58 aa, Homo sapiens
LVLEVSIAPTFSPQNNETHLVSTFPHPVLKTEIHVRAFWLSESSLPRQQGAIETSKTR

SEQ ID NO: 1003870 - protein, 71 aa, Homo sapiens
RDWGCPIIDDTKKLSFIRVFYKKSVGDSLILKKEEEKHKTCNHQWLGEHGNSHQIRQYKPVKSVCVENTER

SEQ ID NO: 1003871 - protein, 31 aa, Homo sapiens
MISLTLFSSHTICTFIFLEMHRKAYKKLKGI

SEQ ID NO: 1003872 - protein, 65 aa, Homo sapiens
QGRPEALGLIIAIAHAGLPAGPGRRFPPSRLGPPRPPLLPALLLPLSLGLSLPLLPASPSLASPF

SEQ ID NO: 1003873 - protein, 35 aa, Homo sapiens
YTIELLYPEQHQLALIHATVTAIKLMAVAGIGSRI

SEQ ID NO: 1003874 - protein, 57 aa, Homo sapiens
SFRELLSRHPAGLPAVTGRRFAAVVPGLTKARRLRDLEGQGAVRFPPEGSKIGRGLA

SEQ ID NO: 1003875 - protein, 45 aa, Homo sapiens
MIESSRYPAVACTCKAICGKPQEDAQGAGINETLFMALITLDAQE

SEQ ID NO: 1003876 - protein, 45 aa, Homo sapiens
SESSRYPRPFPTGVLHVVERRYSLGVKRADYDRDFATVLAVAAVE

SEQ ID NO: 1003877 - protein, 46 aa, Homo sapiens
RAVQRFALLRVGGGGVGGGGDAAEQVGLVKDTVPCARQVVTGCVDV

SEQ ID NO: 1003878 - protein, 138 aa, Homo sapiens
AVTQRGERKAGLSQKTMVFQEIGGPFQNKAKGSQTSRMEAVSPNSITYTTGGMAFGENPFFQGAILALFTLPGSKSNMASRKVRLMQLGHHCDAAGAKGGVHFSQIHLSPTWVLSQGWYWGRQVSDLVENPGSRDKSN

SEQ ID NO: 1003879 - protein, 43 aa, Homo sapiens
MSDEPMNHRHEYLYNGLRWNGKKHYQMQTYGGSDAWTFRVEGL

SEQ ID NO: 1003880 - protein, 45 aa, Homo sapiens
LEDAGGLLLTAVDWNWNCLEGEESPLDIIVVWVVDLVLVTPSQST

SEQ ID NO: 1003881 - protein, 80 aa, Homo sapiens
DLEDPSVLWDGGNFKDLDNELLANPVEQLAVSQAVTVFRPLMSRLEPQQQLLIYDPCTLQGLVLESRRHYMPSLDSHHLC

SEQ ID NO: 1003882 - protein, 62 aa, Homo sapiens
LLCFGTAVAEPEVLYRLNSGLMPKLGLSKHELTGIFHTVSYIEVHTFQRYHAFWRRSLKSLA

SEQ ID NO: 1003883 - protein, 32 aa, Homo sapiens
MRIRALRLVSHKGTSGTCGHANEQLAESQRRV

SEQ ID NO: 1003884 - protein, 40 aa, Homo sapiens
MLSVISSGLSYLTLLISDRVALSSHGEQVVTDSDAVQAQG

SEQ ID NO: 1003885 - protein, 37 aa, Homo sapiens
MGRGIAIHSTYGWHLTPLLQELTKDHWDTLEFFLCGI

SEQ ID NO: 1003886 - protein, 35 aa, Homo sapiens
TGSMMRKYYREVLGYRRRPPIKRGRRLRRRALLLG

SEQ ID NO: 1003887 - protein, 50 aa, Homo sapiens
SLDEERTGIGMYWDEERFCHLASPQLSLEVEQQSQSSELNSLLSKPQLPY

SEQ ID NO: 1003888 - protein, 38 aa, Homo sapiens
WRTGIGGQAEHACMMCMMKMVRPGEDVGCKGVCRSSVW

SEQ ID NO: 1003889 - protein, 34 aa, Homo sapiens
PAVITSWKVYFEGHWVVMGSLVLVPVNMALVRGV

SEQ ID NO: 1003890 - protein, 57 aa, Homo sapiens
TGSYEERHWDAERYGMRNVTVDEERHWDEERHWDEERHYEREQAALTWNHSTPLHCS

SEQ ID NO: 1003891 - protein, 33 aa, Homo sapiens
SLIGTYWDEELYWDEERTGMRKYWDEERTGQAV

SEQ ID NO: 1003892 - protein, 52 aa, Homo sapiens
LETAEQPHLDVSYVLLNAIACGAVCRDPGGHDTWRWAAAGDMLTNQPGRRLI

SEQ ID NO: 1003893 - protein, 45 aa, Homo sapiens
HVVITRLFFCSGEDSAYETPTSVSGKKSTGSPSQETQAPYIAKRV

SEQ ID NO: 1003894 - protein, 98 aa, Homo sapiens
CSDHAFRRCLTFTGVTSESRGQLVRAKAGSPSLYLSQTSSAPSCDKGSPHTDMRAAVQSKCSHNNIHTATHAGVDNTHSLNALLNVTRLPPAIPAVST

SEQ ID NO: 1003895 - protein, 37 aa, Homo sapiens
MIDALELLIGVERAAEALVYISCQLNQGRSTEHEHFI

SEQ ID NO: 1003896 - protein, 91 aa, Homo sapiens
QPSRKYCFVVLKGRPCNIVDDVYFEHLASTGTPRSTLVGIDIFTGKTSEAICPSPPNMDVPNIKRNDFQLDWHPGWVPITAPGQRDRYLED

SEQ ID NO: 1003897 - protein, 53 aa, Homo sapiens
NGRVVVGHDAGRDSQEPQHCAVHGGEDPALDILDALAAVVLPAPKDVHAADPG

SEQ ID NO: 1003898 - protein, 31 aa, Homo sapiens
MCEKMESRVHNKYMRIEETLTIQREKYNAEI

SEQ ID NO: 1003899 - protein, 37 aa, Homo sapiens
MSLLPCLLAALVHKSYRFGIHLIVPFTDTPLTQKGHR

SEQ ID NO: 1003900 - protein, 35 aa, Homo sapiens
DIALQYIRVGSEQSCDSYQTQASLWVCPNAEAGLS

SEQ ID NO: 1003901 - protein, 52 aa, Homo sapiens
STFWLLHLHDWVTMFSPGSRLAYLKEQKESHRTGNMDQTAARVHTRCALQTL

SEQ ID NO: 1003902 - protein, 46 aa, Homo sapiens
TLDDAYDGVLEIFLDCILEIEFCSCPLRRKCRGGIWAHGNPPPLGF

SEQ ID NO: 1003903 - protein, 40 aa, Homo sapiens
DLEDPGDACLSDQSAGPPPAGERADGWFDLINARIPPGGG

SEQ ID NO: 1003904 - protein, 108 aa, Homo sapiens
MVSVVVIKELKLVVLCEVVLVLAITKVNLGVLCKVVLVVEIAKVNLGGLVEVVLEVAIEEEKPGVLCEGISVVVLEEVKLGELCEVVSVVTIKEVKPGVLCEVDLVLV

SEQ ID NO: 1003905 - protein, 135 aa, Homo sapiens
MVALQSHQSTDYILNGSPSPNRTLEPFHFEESYFTFTVMESRPRCSHDWSNILWSLLAYPFGFDITGGNYDQSLSMWTRELEPIIVCQNLLIAETESTNYNLTVEATDRTTTILHQVFLQVNRPNDPRPQFSTIK

SEQ ID NO: 1003906 - protein, 173 aa, Homo sapiens
SPGQIDMNGAIITWDLPSLGQGPNPNSRFAQIRTTLTSYEETQFNFCFFPYKSREQPVSATGPFLGKQRTEMGSTRRGIFMHFLGTIPFAEKLGVAFIASEPPTALSQWAAWPPSRCFPSLLRAAWRHRPEQHSHILVSRCTCLALTTVWTQVGSTLPPRLFLCIFSICVTSG

SEQ ID NO: 1003907 - protein, 115 aa, Homo sapiens
YGGSNYTGLVSTNKLIEGEDHLLPRRRHFICRCVKPSTTINMLKHDTTVLQLYPLLKTPRVQENNKSQVDQIQYEKMSVELENTVFRGQRGLACPFYYYVHYYYVKITSLGFYVS

SEQ ID NO: 1003908 - protein, 47 aa, Homo sapiens
WPIILKISYKRSNFYIKILAVISDEQFESTIGFRAPKPPVIARDCLA

SEQ ID NO: 1003909 - protein, 47 aa, Homo sapiens
WYILAVGFHVDDDFLSGSNSRSFGDFNRLQNHLKATGNPGSPRLLAK

SEQ ID NO: 1003910 - protein, 92 aa, Homo sapiens
HAGVSQESTAFSGSQPPPKQGYLPHSQPQTSVRNQLPTTPGHSEESATVHSSPDAMATTVLPAGSTPSVLVGDSTPSPISSGSMETKAVVGS

SEQ ID NO: 1003911 - protein, 45 aa, Homo sapiens
ELLQSDFTWMLIFSRSNSRSFGDGLHEISICKPLVTQAPRDCLAK

SEQ ID NO: 1003912 - protein, 54 aa, Homo sapiens
YELSLCCKQNTSFAKSQTGACMSIASMAYSTWYKRPSGENIVVLGSYLRDCLAK

SEQ ID NO: 1003913 - protein, 68 aa, Homo sapiens
KLLLHYPPGALWQYSSDGGLGGMRLEEVLLGVLCEVILVVVVTKFVVGTVAVTVVRKEEEVGRREVTV

SEQ ID NO: 1003914 - protein, 123 aa, Homo sapiens
SLYTQIIADSQLTAHSTDDIPMFDDSPPHTTTPVDYEDEEAAVVQYNDPYADGDPAWAPQNYIEKVVAIYDYTKDKDDELSFMEGAIIYVIKKNDDGWYEGVCNRVTGLFPGNYVESIMHYTD

SEQ ID NO: 1003915 - protein, 66 aa, Homo sapiens
SDSYEKKILLSQSECMRSSNASQMRSVYVLGIGAPVMHVQSVMIVTGACLCPLISVAALLYVHALA

SEQ ID NO: 1003916 - protein, 110 aa, Homo sapiens
LAELLRRCLAETQYSFEKHIRSILNVVLQSSIFEKLLRRTYALLLENGFSFLSMSSQVFREQYILKQDLDKEEISGGSNYYDEPKKKQVEDLSYCREERTSLRDMAERIA

SEQ ID NO: 1003917 - protein, 55 aa, Homo sapiens
FQWSWSYFLLMAGVRCVGRVIPSSLHLWVTSWAANIARIWGRIISVCLKLHPTSH

SEQ ID NO: 1003918 - protein, 46 aa, Homo sapiens
MVDPIFAFTISLRWSSRARTALALDTLAGDMTNSYVLTFNPGSIDL

SEQ ID NO: 1003919 - protein, 118 aa, Homo sapiens
WCPSMVILEAVGVSAFSLLFLLFYTFFIFFFLFFLLLLLFRVCYYFYMNCVSFYLFCLLITGHIVPNHPIKTAQNLLLLLVQQEVMSLPLLVLLAWVALPLTMTDIGFNKQPDFPYGC

SEQ ID NO: 1003920 - protein, 157 aa, Homo sapiens
VNPGNSSHPPISASQVAGKTGTSHQTGLILKIFGSDGGLLVFPRLISTSEAQSIPPPRSPKCVGITGLDDGAGLGLLEKESSGSRKFSGMSLWVGQSLSLDDKFGSGVESGHRDRVGGNYRDTGGPRMYRGDPRGEYSNKEIRVLMQAQVGPESPSS

SEQ ID NO: 1003921 - protein, 67 aa, Homo sapiens
GRYYANSAPHQPPSTAYLTKINSFLGNGSKIRKINFLKFHYDLFIYMTAKHIKKSEGGAKVLAFMVI

SEQ ID NO: 1003922 - protein, 147 aa, Homo sapiens
DGAHIFFLALGVCNVPKKAKNNSPNGSHVLKDFARGNSVLMMWKKLNLSHLNDIQWISNITIIARAEHSMCQPGLRGPRGKRPRNTSGGEGRLPRGRSHGHEACQSPRALRWHQDTTRTNLAIFVSLRFQIEVDLALGRGISVPRRN

SEQ ID NO: 1003923 - protein, 45 aa, Homo sapiens
TGTVHEHLPCAMRRIQQEALITPDVGTFCLDFPASRTVRNTFLFS

SEQ ID NO: 1003924 - protein, 57 aa, Homo sapiens
LDLQVITTLRLSPAAGAGGGAQRVHHQLLPKDTLYYDSFAPLTGKPADELKAWGGVV

SEQ ID NO: 1003925 - protein, 119 aa, Homo sapiens
AGTVVEWYVVDVKRRGIHSTMVDVIDDVMRRGAINITAHGRGSPQDLLKGPGESSGYGSVPHLSSKVDNLIKGDIPTVFKVFRYLSVSGGSLEGLDDQGRGRGHHLNRGLSGPEGSVPW

SEQ ID NO: 1003926 - protein, 84 aa, Homo sapiens
SSRYRLIRVHGQLSHRIALPQVPGYEGAGVIVDPQRGRSTGRRALAVAGDGSWQTFVTLPEDRVVWVPDDIDDNDAAQIYINPL

SEQ ID NO: 1003927 - protein, 74 aa, Homo sapiens
GFHTEGQEKPVQDLWRGLGYGDGLHLRGSDETFQCWVWDVNDDFPEELPKQKDLMKECKHFGKESVPNTMMFRR

SEQ ID NO: 1003928 - protein, 109 aa, Homo sapiens
MDMALWERPPWAPASPSEIGIGTQQCPDRFRASPCQTQGNASHRWAMPTESIFLQGLVNRAVKSLGLVLPGGSVLSTRRNVLKGPSRIPGAEFPQGPGVKKVIPLLFAP

SEQ ID NO: 1003929 - protein, 107 aa, Homo sapiens
YNSHQGVSITGAHHSLLRKQPGNQIIQARFITISGGLYLPLLQASEYFESPFTISEGIWAQHFWVATGFQGLQVIRGSIFLTIGFIGQLIFPFTSKHHLGFEAAAGY

SEQ ID NO: 1003930 - protein, 74 aa, Homo sapiens
CPHSGKSVYGASLILEEQSYSAADRLYNVGKELYRAGVLMEGESILASYGSARGSWSACRRLTSGGVCTQREEQ

SEQ ID NO: 1003931 - protein, 57 aa, Homo sapiens
MPELNTVSEVVRFAILLENGFLLEYLCGHPHGEMALTPKAASAQAAPGRLGFSFVRP

SEQ ID NO: 1003932 - protein, 82 aa, Homo sapiens
MNASSIVYIITVFWVTTGIYGLTSKTKTGYLKIMLRDFKLFLYDQFYTDSASCLKVLHSPKSKPSFRGVEIACALNHNNKQL

SEQ ID NO: 1003933 - protein, 59 aa, Homo sapiens
MPQFSLSLGHIHLALLEASTEGSSMLILSYETSGVSLKTHALAGRSGLMPVIPALRLVP

SEQ ID NO: 1003934 - protein, 53 aa, Homo sapiens
RVGCEWGISACLSGAAEWGAEWSISADGAGASADRAGCLGPDGVSVLCADWST

SEQ ID NO: 1003935 - protein, 50 aa, Homo sapiens
ITGLQALFLQLPRARVMSDAWDTGRRVGELLRDGKELDSPCYVIPVSNGE

SEQ ID NO: 1003936 - protein, 70 aa, Homo sapiens
CVQLTSWSPACVILWLVTSLGAADRPGDTYNSESNSSSDALSKVLIWWLSATLGCRNDEIHSHSTGGDTR

SEQ ID NO: 1003937 - protein, 104 aa, Homo sapiens
HIRIELVYPRGCSVVMLGRVVPPASWTPGPAVPASAGFDFELPAPDTSREGSLIGVPLSYRADDANVVRDRDLEVDTTLKSLSQQIENIRSPEGSRKNPNRITR

SEQ ID NO: 1003938 - protein, 142 aa, Homo sapiens
MFSASLLRYQHRGHLTQLSQLDFCDCQHQDHFTEYSHALTSLTHDHRDQLTQYPRLKYFSRHHQDNLTQYWQPHFFDATTETTSHNTPGFNSSIATTEITITQYSQLHFFNHHHGDNLTEFSQLHFFDHHHWVHIPQYCQLH

SEQ ID NO: 1003939 - protein, 55 aa, Homo sapiens
DPDDVVHVAKEEPGAGACAWTSIYAGRVLFYGGAYLYKIFGTSTTMTCTTCGHKR

SEQ ID NO: 1003940 - protein, 51 aa, Homo sapiens
FLSVIAECLPPAQSNYRNKYCMSMITSRNNLATFSAAHGIYGHKSCSSDIP

SEQ ID NO: 1003941 - protein, 88 aa, Homo sapiens
MEQRWTPKAETLVQQASQCLSKLVQIASRTKRNFILDQCNVYNSGQRRKLWLFKTFSRKVAGGGPIMTEDCDEERCSLSEGKQQAHDA

SEQ ID NO: 1003942 - protein, 98 aa, Homo sapiens
SFTLFKNVVRPHRSLLWKNLGENDYWVHNEMKGEIKMFFETNENKDTRYQNLWDTFKAVCRGKFIALNAYKRKQERSKIDTLTSQLKELEKQEQTHSK

SEQ ID NO: 1003943 - protein, 61 aa, Homo sapiens
MNYDNPNVQSVNKWMSQTVVYAIQQNTLKPKKGTRHWYMPPCGVSLENMLLSWKKPDYSKA

SEQ ID NO: 1003944 - protein, 46 aa, Homo sapiens
AEPFETLVDVAATDCKMDSVMKWSEKCHGLMESGLHLCGALEARDF

SEQ ID NO: 1003945 - protein, 103 aa, Homo sapiens
MTGGGIYYFSLVSVGRPVHEAVDRSLDFYERSSMTFWLLVRDTPGENVEPRHTAIGRLVLNVVPADLRPPWFLPCTFSDGYVCIQAQYHGAVPTGHILPSPLV

SEQ ID NO: 1003946 - protein, 51 aa, Homo sapiens
SAVRLCLRRWPAQPEPLGNTGTEHASEAWEESQVRTSIELAADTLCEPGCV

SEQ ID NO: 1003947 - protein, 107 aa, Homo sapiens
QKRSEWIAKIPNFGVTTLVNHPQVSARLGEEDEEARHYWTRVEVTELEDIKSGYIIDFYLDENPYLENKVLSKEFHRSESGDPSSKSSEINGKSGDVTKRSSQTQNK

SEQ ID NO: 1003948 - protein, 80 aa, Homo sapiens
FVLNEKPTLSFRHETTLAPPILTGLSYSYQKQYVWCQPDMVLAEILYFISWRKQPRSSTSRYSSVATEEEQSAHVGGTEL

SEQ ID NO: 1003949 - protein, 72 aa, Homo sapiens
PVIDNAQTPDLGLLYRCLPSCRLLLLDLSLTRIAITFITISQHQISTLHHHLNPGQGIVKLYFLYFFFPLIL

SEQ ID NO: 1003950 - protein, 132 aa, Homo sapiens
MSDDAMYVSMFGQSVLVVLVPIVCDLDPWQANWCRAMPLGAWPVSQPRLAYGDRGGGMETELSDVYLRAYSQAMIERRVSAQRGLNLDWIWRHDTPVKSCCVLAFSADSAGSGDRPPVPLKSLVPLHSSSFG

SEQ ID NO: 1003951 - protein, 53 aa, Homo sapiens
MLNWVRVPHDEIIMAVSTDTRVQTPPGGSSSVSANTVSMSAKLAKRRAIILPQ

SEQ ID NO: 1003952 - protein, 50 aa, Homo sapiens
SSHRWIPPIFPRVTRETLVSRYAVPAGSWDTDAAASPEVTSAPLWVGTDA

SEQ ID NO: 1003953 - protein, 37 aa, Homo sapiens
IEDPSHWVRVPEVHAFDQTSTTAKAQYRSLARNHPGG

SEQ ID NO: 1003954 - protein, 58 aa, Homo sapiens
SSSAQVSLTIFKRYNSCGNKYIHTVCATITTIHLQNFLIQPKLKLYPLNKNFTIPPPS

SEQ ID NO: 1003955 - protein, 110 aa, Homo sapiens
SSCFLKSPMRSKRALLSYHASKIHRQSPNMKNPLNNLRIMLKLNPYAKTMRRNTILRQVSIHKLRVDYGSCCIIGTTSHFRLEGGGCRREACGRLEEDVTLLLVSSKQEL

SEQ ID NO: 1003956 - protein, 108 aa, Homo sapiens
GGRVLRSPLFLLLEKAQNDSRGWPSESITQEDPFSSSYLQGRHPTEQYLRIMLKLNPFAETMRRNTEFFAMARNSQSSACGIGSCCIIGSTSQIQTENGGVSQCKKPV

SEQ ID NO: 1003957 - protein, 82 aa, Homo sapiens
STGSPQFLLLEIMDVHPCNTKAEYLSRIEGGSECDIQLIWAILIWYSETVEQDDTIKGEQTRRKYSRRELAAVRPWFQEAGD

SEQ ID NO: 1003958 - protein, 75 aa, Homo sapiens
DTPSSCFVEINSMILDTPEVGDAAREPQFLVDRDVSIFLPCTVYLDPQLREIIARIWFQKARNGGYRRSIFVLCC

SEQ ID NO: 1003959 - protein, 66 aa, Homo sapiens
LRENLLRPSGYVSPSSPYPFKWYDRNVSSCSYPCQVIHGLKRYQEQNHYAGPGELDSTISRSRNWV

SEQ ID NO: 1003960 - protein, 114 aa, Homo sapiens
MHDPPSSCFLKITTSWSSGCKMCVSAPVHITDQHLVPVEEDAISSEDDEAGGCDTLKLYLSKRVCPLQAGIMVPQIIVELACLLKMITIIISRIMITDDRVESYTVDSICTLKY

SEQ ID NO: 1003961 - protein, 99 aa, Homo sapiens
AIALHPINKSETPSQERQKEEIKKERQTETRKKGKKEKKEKTAERKKERQKESKTERKKERKQRKEKEAIDKESGSSTAEEGDFSKVCLRCDHCGYYTN

SEQ ID NO: 1003962 - protein, 138 aa, Homo sapiens
LYAAGDSMTDPPCSCFLKWEKRCAAYLSEAESNLTHTSITRLSEQKLLLHVVSQNCDGLHLRSVLTRTAISISTVNMFIEVCTSCVPYSEKYVRVFDVTDRTALHRHQYRPDLSQVWDPAVALHCATWGEGDVGAVSE

SEQ ID NO: 1003963 - protein, 69 aa, Homo sapiens
NTAHSSIAISLSWSFYCHKPGALMHKLKTNLYLFKTSVLQGFSINIFSDYDQQAYWCSIGTFQRSTELA

SEQ ID NO: 1003964 - protein, 30 aa, Homo sapiens
MLYAVILGSPTLYSVLVAPSISSKQELGVI

SEQ ID NO: 1003965 - protein, 48 aa, Homo sapiens
MLNGRVETAGNAENPSLLKVQRLGSRGGAHLWSQLLGRLRRENRLNPW

SEQ ID NO: 1003966 - protein, 35 aa, Homo sapiens
MAEALLAGLAWFDPVGGFRSVKLDTLSLGKAMLSS

SEQ ID NO: 1003967 - protein, 138 aa, Homo sapiens
RWSSAAYQPQFLGCLGRSEHCVRRWPSIDAKKFAETQSYRGHTTCQRRVHGEEKQKPQAERKEAKRAVAPAPEEEMADCEQALAAEPKAKDPFAHLKSTFVWDEFTRKYSNEDTALCGTGNISGSTLIRTAGPCGTQS

SEQ ID NO: 1003968 - protein, 94 aa, Homo sapiens
AGDGKCWGVQWTASFLRNVTWSSLRWKTSLARCDNEFDTVVEEGSLPQVSQQDDDPLFHQFQRGDWGCSEGRLASCITQRTMHGSQPLALKTRY

SEQ ID NO: 1003969 - protein, 128 aa, Homo sapiens
MTETGSGKLHIIRDLVIVLAECTHTLLEGTACHTPALTGEPNAYEATNLDSTVLSQTLYATVTQWQVDVSTHRREVKTQSDHLSGPPVCMVRREQKHREAARQQDHCCTGGLETSAEQRSNSCRIPES

SEQ ID NO: 1003970 - protein, 84 aa, Homo sapiens
SLRVCASEVLVDSAEEGSSLRGEWRQKREQRLRKFRELHLMRNEARKLHHQEVVAEDKRLKLPCNFGRQTKLVLDVGTYNGTTD

SEQ ID NO: 1003971 - protein, 130 aa, Homo sapiens
PLRIIAANVVAICCLTSRPSPPSGNLRDHARGREPQSQDRRLLGGCCPRVPRMQPQHPAPSVQSPPAVLKTVVWRPTWEAPPGDLAPQVTPLGLTCSLALSNCCVWTSPESSAPRVLLQNTASFGVPAWQ

SEQ ID NO: 1003972 - protein, 182 aa, Homo sapiens
YSRHPSVVLPQILYRPIETSAGCFGASHVLLSIHVLSLNSVLYSILRKLAGTMGEWLGDQMQTGFGGKARDRVEQDYVASANARGTAMTGYERLTSVSSSVHYDQRDNGNCTWLTAIFRIKDAEIRDKLWGRCREIPVLSGGTSSGLLVVVGVLSVGIVLPVNFSGALLETNAYSFGRNTIA

SEQ ID NO: 1003973 - protein, 45 aa, Homo sapiens
MVIFTASHEDTFQRTPVTSSLTSASIDFLNSRNHRMDKPGRGTEL

SEQ ID NO: 1003974 - protein, 113 aa, Homo sapiens
MSHRPFSYGQCFRFSGVNIRSRFCSKSSNILSMVVVSLNHQNRGWHGEKASFDEPLLMEMVNCFQVFQRNDLLLFPGISSLTSGNKSQDWSEGKVSNQQTRPCSSKIQSNHSE

SEQ ID NO: 1003975 - protein, 178 aa, Homo sapiens
MVLLQDIRVSVTEDECGGAQKLIEGRLCVMRGCLRDALILLGAGCLPQGQPAPIVGRVLLLLPPDAWARMLFCLDFVPSQGSGVSLLAGPRLCQATGVFSLQHVVGAEEFSQVYLRGVPVPVLDQLLKLFHQHIRRLLEVHLGRSLVPQLIGDVHHHLDPLVYQVVNVSKVSDMAYEL

SEQ ID NO: 1003976 - protein, 98 aa, Homo sapiens
KNRPFSVVQAGAQGHNHSSWGPQILGFKRSSHLSLCEERELRVCPTTPGVNNGILGMGVRQVAGAGLELSPSDRPAGASRKGGDNRREQQCRVRLYFF

SEQ ID NO: 1003977 - protein, 64 aa, Homo sapiens
MVLSLVTRWWSGRVQAWCAFFGWSDFGLLWFISGPGPPQKRMLLHSFSKVPVMEASAQHFGVPS

SEQ ID NO: 1003978 - protein, 154 aa, Homo sapiens
MVLSSSCLSRGQLRLKGSKGHLVAGHGPQHPPHPGVPVAPGSAVPAAAARSRPGLRNGAQLTARGSGTLPAGAAGGSGHGAALSGSAPPPALPPTAPGAPPADASPPEGVPAKVTMGHLIWHLIPVLLGLPASTVRGGQFLRQPQHLRLQVRTI

SEQ ID NO: 1003979 - protein, 82 aa, Homo sapiens
SIAYLFYFYKASITLVRCNAVDHVYLTVLPLSHQRTTDNEGRACLTHLSIYLAGRARQELACRCRQPWGGRQWGGTTFDIYD

SEQ ID NO: 1003980 - protein, 80 aa, Homo sapiens
RGNLTRLFTFHFICLHYAVLAGLHLLFLHETGSNNPLGITSHSDKITVPPSQILYLPLHLALHYCSPSSTPPPILAQTRK

SEQ ID NO: 1003981 - protein, 45 aa, Homo sapiens
SFGYVLRKEQCSTHERVTEGHRGDRGQRLRRLINIQLGPMEAQAL

SEQ ID NO: 1003982 - protein, 53 aa, Homo sapiens
CSSRSTYRCSYQPHGGRHTVHVTYAGCAHPSQPYTVTVEQACNPECLAGRVGR

SEQ ID NO: 1003983 - protein, 175 aa, Homo sapiens
SQSESALIFATMPPTRGLYPSSRPLRGLRMLLADQGQSWKGEVVTVETWQEGSLTASCLYGQLPKYQDGDLTLYQSNTILRHLGRTLGLYGKDQQEAALVDMVNDGVKDLRCKYVSLIYTNYEAGKDDYVKALPRATEAFGDPAVPRTREGKTFIVGDQISFADYKLLDLRTGLW

SEQ ID NO: 1003984 - protein, 84 aa, Homo sapiens
GVAEGVSEDPYAGRKSRRAHWSGYLNQVVCLDDTTVKFEIWDTAGQGAISQAEPPMYLQGVPKAANRGLRTLLSQELCAEQETL

SEQ ID NO: 1003985 - protein, 85 aa, Homo sapiens
MGSALAGFMGGSSWKAGDPEMVGRIPLGGVLVTGEFRHSIRNFLVIDDPGTSRGGAEERAAGGRAVVPGRELARRRRAPPGEWRE

SEQ ID NO: 1003986 - protein, 152 aa, Homo sapiens
AFEVTVSTLSVVVQSDPDVHLFCSKQVVLEPFSTPPSLSTPEFRAIEVLSLALTIRTICSGQFKPSALNGTEITQDNPSSGKKPGSPQAKSLQPAVAEKQGHQWKDSDPVMAGIGEEIAHFQKELEELKARTSKACFQVGTSEEMKMLRTES

SEQ ID NO: 1003987 - protein, 42 aa, Homo sapiens
SHFTLSKCEVMAEEHLSSPTEGKLPYLMMTHLPHDRSQAHHL

SEQ ID NO: 1003988 - protein, 50 aa, Homo sapiens
WRDFCLVLNALITLGAQEKKKTIVTDGFPGFNRGSSLKKFPHPGSASRKK

SEQ ID NO: 1003989 - protein, 37 aa, Homo sapiens
LIRVCAAADHNYQSYILRALGQLMLLCGWNAGRWWPT

SEQ ID NO: 1003990 - protein, 133 aa, Homo sapiens
QEQLVVAAATERREPPKADGSPGRTVDLFSTWGRCNPSPQTRARLRWSPLMIEWGTDATVVVANLQTDTGNIADTPPRKRECRVSSVISSTSRVVDAAIVEHLLDDPPQGDEGEMLSMFSSVASLAPTIVSQS

SEQ ID NO: 1003991 - protein, 65 aa, Homo sapiens
MRSQLLSDELIRHRVHVALDYIEVIGDVEWSSRTGACDRPRYLDVTKAAGPPPGGPERGWNRVGF

SEQ ID NO: 1003992 - protein, 68 aa, Homo sapiens
KDLSDCASMVRVSYDYGLISSSYWLNMFVVYDIVIEMLGGSVHVKAKRGRDEGCKGIVKKASLRLRTE

SEQ ID NO: 1003993 - protein, 40 aa, Homo sapiens
EDLMVIFRVVHLSGLCIFPGCASSGLCILPGVCILPGFCI

SEQ ID NO: 1003994 - protein, 100 aa, Homo sapiens
FLLLRTQQNDAACPGLSAESVRDAATDDDLGCLNVQVFLPGNLWTSDCVPLSTRYQVSQSAEEGSTLQCRPTCALILAPGGASSLRNASWVWEGGTVDLR

SEQ ID NO: 1003995 - protein, 145 aa, Homo sapiens
SIMCDQSDEQLSQEHENREKKPCLTHFRPLILRGNSPIYLNFVNYGQFIADLQQTRLKNTVLPSGLLFVAHKYDPTTPWINARKMADKFSAPLLTINGDGHTLALAGTNLCVDEAVVRHLLFPGKSDDLTCQGSGTGDTNLISHK

SEQ ID NO: 1003996 - protein, 64 aa, Homo sapiens
MAYGGTQTTAWPLVRSSTPGELYLTDPVDSDEERPCPAPRRTVSHMRGIHQAVNVRRSNLALHP

SEQ ID NO: 1003997 - protein, 134 aa, Homo sapiens
ASYDDWRRKVLYLPRPSFSYAKSIVQVDGKIGLFRGTESPVLMSNASLYCDSRNYEEGFPPDQIEQVSKKDDMKTSLKESSEVDRSYEMMMQCVSRMWAQPLSCHLNALHGPVSGTGGQVQWCAELHWEDFQRG

SEQ ID NO: 1003998 - protein, 39 aa, Homo sapiens
LLVESCSCLLISLICPYPLILYCLSTGLSLSALILFSLY

SEQ ID NO: 1003999 - protein, 38 aa, Homo sapiens
MLLCHCGTAETEGYCVSCASAEFFQLWVPDARNSVNPL

SEQ ID NO: 1004000 - protein, 95 aa, Homo sapiens
LFLLSLGNPAPMKSLAGKGEECQINSEEELEKELAPEPEETWVVEMLCGLKMKLKQQRVSPILPEHHKDFNSQLGRRIPQRAPPILFFLKRGNFQ

SEQ ID NO: 1004001 - protein, 46 aa, Homo sapiens
KLARRGDTNRWCQLFRIQWGGSLETRKSRLQGAMFTPLHSGLGDRV

SEQ ID NO: 1004002 - protein, 147 aa, Homo sapiens
LGNGIMLLRVMAKVEFCRRVSVTPGIAEMATPMADIDLFDFMSVRVSVSARVVRISGSADGLGPLQMCVPVTRTSRSGSSRSTMVLMSSQRSAESVEQVLRIHRLRSVTTWSFRLRPRVQLPLRLHNELLQAAPIGFVDVFIIGVQF

SEQ ID NO: 1004003 - protein, 66 aa, Homo sapiens
DGPQLYERPLKFIPPVKRKRYPWTNISRFPHCLPGPHPTHQRSVYIDCFSISTSMKLEFSRNPYYK

SEQ ID NO: 1004004 - protein, 96 aa, Homo sapiens
GPSAGQCTEKIPDMLRLNTQHVRCYQAVLYLYRLWLYTGIVMDSGDGVTITVPIYEGYALPHCILRLDLAGGDLTDYLMKILTERCVTASLPIGPA

SEQ ID NO: 1004005 - protein, 68 aa, Homo sapiens
MACGDHVVLQQGAFQVDVVVTQSLVDSSQHLLGHILAGLQVMVPIREDLRLHDGHNAVLLADTAIGPA

SEQ ID NO: 1004006 - protein, 58 aa, Homo sapiens
HYRTKLAQTALYRDIKLGWAQKEQQVYTAPGTKLQIFEPELAIEHCDTLNVSLALSQG

SEQ ID NO: 1004007 - protein, 58 aa, Homo sapiens
LTDGSQIEELPITSRWVVVPQTLSDDALYTRIWDLHCKGLFMTWSNSGQQQYDIYDED

SEQ ID NO: 1004008 - protein, 64 aa, Homo sapiens
TLECLELNAWLSSGRGSSAGAGLTVFGVLQAKQVQEALLVQGVTRQELACGLILDPWSCRHIGS

SEQ ID NO: 1004009 - protein, 99 aa, Homo sapiens
PGCEQTAHTSKPMRRKQWFDVGVIKGTNVLVTHYFPGTDYCVPEDDDLGTVPDYNQLKKAELGAEATPNKFRVAGINAWWRGAPPGKSQPLRRACLVSQ

SEQ ID NO: 1004010 - protein, 68 aa, Homo sapiens
TATHSVWCFHFDGTHLVFVQDTLAVELVLVVIATKQNGIIRNFSFTSRVSDVSSNSFWGYTSTAIGAA

SEQ ID NO: 1004011 - protein, 65 aa, Homo sapiens
VHLSEWYAVFVRPDCRHHLEVELSDTIENVTAKIQDKEGIPPDQQRLICRRNSWKMVVPLYVTYN

SEQ ID NO: 1004012 - protein, 72 aa, Homo sapiens
LAADSGWGGTARADVMSRWFSSLIIIMMSIPVAERVLKPKTMTLEASLAHSHTGRYRSLEISSVWNSRTCRT

SEQ ID NO: 1004013 - protein, 37 aa, Homo sapiens
LDGNSEISGPRGQMKKCKAGGRHPGGTLETDPPASRA

SEQ ID NO: 1004014 - protein, 47 aa, Homo sapiens
MRNPKVLSESVGMHWVRADSPRSPSSPVCGFRLRHAHPKLSVSRLPG

SEQ ID NO: 1004015 - protein, 116 aa, Homo sapiens
GGQWNLKTSQTTCCQVVVGMVCALCGNPGTQACVGSGVPFRMKHFYFPFLPWGSQAVLLVRWAGGTPQSSHCVAGGRNLQYDRAPLLEESSHRRYGAPSFLVTWLGPLGQDPSSFM

SEQ ID NO: 1004016 - protein, 75 aa, Homo sapiens
ALEDLSGCASEKELQAERRQVILNRGGNKYKSMEVCERDDQGTVENANSNAYRDQAGNINEVKHISYKKINDNDS

SEQ ID NO: 1004017 - protein, 92 aa, Homo sapiens
PTHPGVHHRNKFACMGGISGSDGRFSGWVTEGISSIAVTAWAGWDLGFAFATSCCSTGSLRVDLLVLVYRTTYAEQGSTHCPWDIELLALLA

SEQ ID NO: 1004018 - protein, 52 aa, Homo sapiens
MLVIVTVLVLLFKSLLLGGCRVLQLVKFLWLFLFLLLHIISELTSLTDPLNE

SEQ ID NO: 1004019 - protein, 41 aa, Homo sapiens
MSILLICRMQVMCAQKTVWVRSWDVSTLMMSEVVRDAKIML

SEQ ID NO: 1004020 - protein, 41 aa, Homo sapiens
LPMEYTASSLVRIYYLPQRPGSTETTLFTLTHHSSGSLKIY

SEQ ID NO: 1004021 - protein, 34 aa, Homo sapiens
RSPLIILLTSCICSRSSSSSQSVAILLVFFLLLK

SEQ ID NO: 1004022 - protein, 69 aa, Homo sapiens
IRGSTLANAPLGLLPTAGEAEVTPGRYRCIGGTGGVVWCIEDIRMTASLWSTLNSFCIPHSYGSYNHSL

SEQ ID NO: 1004023 - protein, 37 aa, Homo sapiens
PGCILPVCIFRVVHLPGCASFRVVHPSGFGHPSGLCI

SEQ ID NO: 1004024 - protein, 54 aa, Homo sapiens
LSSDDDEVTVTEDRSMPSLKQPCKCGAFWAWLVAKALANVNIGSLTCNVGHGIS

SEQ ID NO: 1004025 - protein, 55 aa, Homo sapiens
HKAGCALGVVSLPGSCVSLLAGPRLGPGNWMSFPFRHVRGAEEFSQVFLRAGSVY

SEQ ID NO: 1004026 - protein, 70 aa, Homo sapiens
LTCRSEEVVTAIVPALAVCVLKVIVSFGSLGVGLRNLCVQSSQPLNEEGSEKRLLGENSVPPSPSREQTS

SEQ ID NO: 1004027 - protein, 41 aa, Homo sapiens
ITLLFLFVLLFIILRTLRHRYQILLLFRIGGLLLVFFLLLK

SEQ ID NO: 1004028 - protein, 177 aa, Homo sapiens
NAGVLEGSCVIVCLGSRILTRHDKCETINVRVYTMRMQSWEFAIQPYTTGKQLFDQVVKTIVLREVWYFGLHYVPHHRISYLAEAGSEGVCPGGQEENPLQFKFRAKFYPEDVAEELIQDITQKLFFSKVTEGILSDEIYCPPETAVLLGSYAVQGKFGDYNKEVHTVWDLSSERLI

SEQ ID NO: 1004029 - protein, 50 aa, Homo sapiens
TGDWNEAEQIACMEARPTSAKHRLDNWIPSLAESQLQTRQHIKKLEEVSV

SEQ ID NO: 1004030 - protein, 45 aa, Homo sapiens
RSERRNKETCAKSYLVLPQRPHALPVLERSRVCSLGISYLSVGVA

SEQ ID NO: 1004031 - protein, 63 aa, Homo sapiens
MHGDATSERCAKVPPLVTGITFLSGGRGGGGVINLNAINKCPHAEALGPDPSPTAAALHGPLP

SEQ ID NO: 1004032 - protein, 53 aa, Homo sapiens
VPSRNSHHYSITEISAYSNLRVLAVLFIILNHMGMVYITSIWTSGLSHQTPLF

SEQ ID NO: 1004033 - protein, 59 aa, Homo sapiens
LITCIVDTGEFSCTHVCVDTGESSRHTHSAVDTGESFSPHTSAVTLENPSTHTHVAPWT

SEQ ID NO: 1004034 - protein, 66 aa, Homo sapiens
NRNTESIARSLYGPGWYRIITCSREPSCFHEVDHFMQSPDNVAKHKHTLTDTYLNIRQPTSYPRKK

SEQ ID NO: 1004035 - protein, 104 aa, Homo sapiens
MSVSMPMEISTLGTTILVSTTAVTRFPESSTPSISSVYTSMSMTTSEGRSSPTTLEGTTTMPMSTTSERSTSLTTVLIRPISEMSPSEARTLSTPPGDTSTPLL

SEQ ID NO: 1004036 - protein, 118 aa, Homo sapiens
LLPPGYAQQRNALHDVGCQDKVLDADHLVYVELRVNKGHARQFTGPQEPASCRGRRSRAGGRLLIMAVIEVVPEPGQPLSTVTSSLSFTSRRRSAPVTALCHCNGHLMSAIDQNGSGY

SEQ ID NO: 1004037 - protein, 153 aa, Homo sapiens
CASAAEVCSGCTLLIPDIVPPASTWVFPTLAIMHHNKQATENAKAEVRRILGLLDAYLKTRTFLVGERVTLADITVVCTLLWLYKQVLEPSFRQNFPNTNRWFLTCINQPQFRAVLGEVTLCEKLAQFAAQQFAEHHPKTDNHGTRRVTGRDA

SEQ ID NO: 1004038 - protein, 81 aa, Homo sapiens
LQERQSGGTYRFHDMQNQQAVIQTTARKSSFLSPCTIYRQEREGSAPKGLGSSGAVALQCSAPAAVLMGWATVEHLVAFPQ

SEQ ID NO: 1004039 - protein, 33 aa, Homo sapiens
SQSSNRAHASAIAQASVGIWSLQALHILSIHRS

SEQ ID NO: 1004040 - protein, 36 aa, Homo sapiens
MHVVFGSSNTVQAKVIPELNAQACPMVQGRLQVQQR

SEQ ID NO: 1004041 - protein, 50 aa, Homo sapiens
IPPVSSPRLLFILATSSLAVYSTPLISDEHQTNYALHQQGCTTPGKVTES

SEQ ID NO: 1004042 - protein, 49 aa, Homo sapiens
CYGCASPSVCMTLADLPGDPSTTAACPDRWWLEHRKAQVAERMASLPLD

SEQ ID NO: 1004043 - protein, 84 aa, Homo sapiens
FPFSRRDSRVWGQRRRARSDVRVEVAELGTGGVPGQYHCSVTDLKLGSAEEYTRVCVRQAKRDGCRNGAVGGPGSGLALSALTD

SEQ ID NO: 1004044 - protein, 41 aa, Homo sapiens
CVLQKHCVAYRSCGFTYTYDEYEVVRDARLMPGEVKSAQAA

SEQ ID NO: 1004045 - protein, 70 aa, Homo sapiens
TKLLQNISRMRHDRAMETLKILYKYEQNKANALLILGDAPRSKVTTFEHQYVMCIKTLWQDPGIQECYDR

SEQ ID NO: 1004046 - protein, 55 aa, Homo sapiens
MVSSLSSTRPRGLFHRFNEPLSLVWGPASTIQQQCGLSNPSLKLFSLLHLRGGRY

SEQ ID NO: 1004047 - protein, 38 aa, Homo sapiens
PEFSPSPGISNEASDCLYSFCNILKCTCLPLPLSLQQP

SEQ ID NO: 1004048 - protein, 54 aa, Homo sapiens
RGVCASLCEVGELDEKRGYFDSGPCSFLAVPAWESDYQYQSAVRQWRLLLCIRL

SEQ ID NO: 1004049 - protein, 57 aa, Homo sapiens
MTYGPLPLLRAFQRLRSTPMRLSYSFSDHNCTFISHKAALTKVEAGSIHPLCHNGTW

SEQ ID NO: 1004050 - protein, 54 aa, Homo sapiens
YRSNSSVMADWTESSSSAKDSRGYIFFQNLQLWTYTKPSTETGSTVLPDHNGPC

SEQ ID NO: 1004051 - protein, 73 aa, Homo sapiens
RGSLQVEVAEKVQKSSAPRKMQKAEEKEVPEDSLEECSITCSNSHGPYDSNQPHKKTKITFEADVSVVGTGAR

SEQ ID NO: 1004052 - protein, 63 aa, Homo sapiens
RDSVGFGVGVVVVVVLRVSVIVVCVPVGVGVGVPVVVVVLGVVGWRLCAGACWGWCHPWHVNH

SEQ ID NO: 1004053 - protein, 76 aa, Homo sapiens
QTLTLPPSWLPWATPFLVTLEFQVSREAPLYRPTQLGYDYVQTSLVGALGKLSGSPRQPSRFPSGQPLVSSGQALA

SEQ ID NO: 1004054 - protein, 103 aa, Homo sapiens
LEDVILHPQLSSEKYACFHVPRSGPPARYGKKSSLIQRAMPVFTDIRYAGKWRRWDTVQSVGELEAVVVPSGQVDDTVIELIPFPGDQLVLAGVTRRGLWVAD

SEQ ID NO: 1004055 - protein, 98 aa, Homo sapiens
PEAARLQVTIGRFQYGYPEATDQRQESLLPEELEDQMPRWVAEESNRGSTTINKEASHHKGRLVAVVGVAKGVRDSGAPIQLIPFQQSRSLPESTQKQ

SEQ ID NO: 1004056 - protein, 68 aa, Homo sapiens
GSLILHPQHTNYGADWVMRVTSPGLPGNEAATPHFLLLLQRKAGVLGCFSALTSGETPKALSERAVGG

SEQ ID NO: 1004057 - protein, 131 aa, Homo sapiens
YGVTGNPVAVLNYLIIAIRDATHSGGFANEMPEAREVTKGRSEEILHLSPSQDSCLKLFKLVRDTSEPLGTVAGRGLRVATLLFHLSSILLHITVTNTAPINTTAKTARPATMTTMGIVDWEDRSQLKVRG

SEQ ID NO: 1004058 - protein, 64 aa, Homo sapiens
HTDSLSHNSETIRAVNSVTVRRHHSPRITSDQYGLNSAKGYMTCDELTQRQLLKENAWWVELDR

SEQ ID NO: 1004059 - protein, 68 aa, Homo sapiens
AVQVISPSMTIRFETPCMSILLTCLLQCPLSLSTFPNLRISFCPQGVLFHCQSAKVSRSVQTFDTGSV

SEQ ID NO: 1004060 - protein, 66 aa, Homo sapiens
TSTDSADAYDPWHGLIDITNLPLYNVTHLMLASLNWNYSSDENIVLKPVSDFRTGIENLESDLDLV

SEQ ID NO: 1004061 - protein, 126 aa, Homo sapiens
VPDTCKPRGTPHSRKSRHHYGLHGLTAGPRQLLTSRSDLSLCTDPPHGFSQSLTPIHRWLKIPGDAVHWLQWTLLHLALEAAVVEKKSLRVFLEETLCSTGGPWVQLYIEVAKSGPIQPLCHEGSK

SEQ ID NO: 1004062 - protein, 46 aa, Homo sapiens
EILITCIVGTHHLNQDDAVVRQRIEGEHSGIATYVEGLEGSNMIWV

SEQ ID NO: 1004063 - protein, 122 aa, Homo sapiens
MYCLRHITLVGTEFENGRVEKESEEWGVHDKLELKVNSLASAVPVTELGETEDDAEKMHVDMGDCCCKGYEQEKTPYRNTLTNGCVNQWTIWTSPPRPRSVGWARRQWPGLDRDYPNGPWIG

SEQ ID NO: 1004064 - protein, 99 aa, Homo sapiens
TCIVYSAERQLLGSEDPDSRNGAAIVGSKQDDTGEGILPQLVQSLAPSRDEIAAHEGLSEFFQGKRYSEYHRDQPSLSKCSQKYWKCHRECVLIGVHAL

SEQ ID NO: 1004065 - protein, 39 aa, Homo sapiens
AWQKTLRGDEARASVDPAPEVAIEHGIVTNCDDMGSEPG

SEQ ID NO: 1004066 - protein, 41 aa, Homo sapiens
TTAFEAASACGVLCRIPVSYVKLVAEYFDSITHCDVLETLL

SEQ ID NO: 1004067 - protein, 75 aa, Homo sapiens
ILHHSCSRCISALPKLLFSGSAARCHRCRVTHLYFCNYPVLLIGILAAVPTMVVPLSPNPGPAQRHLGWPKPPEH

SEQ ID NO: 1004068 - protein, 115 aa, Homo sapiens
VPLCKFITCSGGGHKQALLYIDKHLLTLSFQKQHVFKDTEQLGHLILTNSILFLLFFEMESCSIDQAGVQWHDLGPPQTPAPGLKKLSWLRLQSSWDYRRVPPWHVDPQWHVAGY

SEQ ID NO: 1004069 - protein, 36 aa, Homo sapiens
VLEDPITCIVRKVQLHPHEGCMLWAHRLLFFTNLDE

SEQ ID NO: 1004070 - protein, 58 aa, Homo sapiens
MVAYRPCQQADIYKGTCAGITLVIEGMTSFLRRLGGRVLVPNTLSLEGSVCVVWFPTT

SEQ ID NO: 1004071 - protein, 45 aa, Homo sapiens
YDGLPRAIVGLTYGGGLHGTDVRGTASWQLSYPTDTLRLTTRLYN

SEQ ID NO: 1004072 - protein, 68 aa, Homo sapiens
RQAAGECRECTQDVRQQHKEQGNSRRQPGEGRKAHRVVCSRTKACWCFLQCREPVPTAGTGLEKEPPQ

SEQ ID NO: 1004073 - protein, 101 aa, Homo sapiens
VTQPLTQDNTITSADSRHNRAQSKHSSSSQGLNHPSVLTSTAKIHSYQLYSHPLLHPVDHVDRPSTDHHPMYTMSTIHTFSNSRRHPKLHSADHHSHNGTW

SEQ ID NO: 1004074 - protein, 139 aa, Homo sapiens
LLFSSSLAAACGGLGGGSSDTRAAGRLRAVVSVVVIDAVTLGGLCDLVSVVVMAEVKLGSLWAVLSEVVLGSTVKLGSNVVAGVSSGGHEQKCSWEILREMIYGGGDRRSDAGSKCVRWSSVVVIEKMTLVVLCELVSV

SEQ ID NO: 1004075 - protein, 40 aa, Homo sapiens
SITGELSHSQNLQNNFIGIIPLPTNTCRRALSIVTADSEL

SEQ ID NO: 1004076 - protein, 43 aa, Homo sapiens
MEKHSYVDTNTIPPSTLVTTLPTPNARYDYSETTYSNSPTGPV

SEQ ID NO: 1004077 - protein, 105 aa, Homo sapiens
DHRAMSGQWTVCDVIQSKCLSKETATTDLLTILPAHTVGDVQCDMEVSCPDWLYLAACLQYGGLGAAALFTQCCVHVRTTLHCCRRGDLRCDTARIFTVCNSGPQ

SEQ ID NO: 1004078 - protein, 39 aa, Homo sapiens
EIKRKTAGCVQSGSTGDFREKKLYANMFERLAERGEQGQ

SEQ ID NO: 1004079 - protein, 138 aa, Homo sapiens
MGRTWRELKVSNMIWVIFSLLALGFRGGSVEQGGVLFRCYTQIVEGVVADVLHVIPVGDDAVFNGVFESEDPSLGLSLIPQIAVFLGHSHHHTLVARAGHNGGEDSPGGIISCEACLEQARAIVTHERGGLLFTQWHV

SEQ ID NO: 1004080 - protein, 41 aa, Homo sapiens
MWYLILALAIWVRVSNDSQAIFGSEDVGSSSYVAVDILIAV

SEQ ID NO: 1004081 - protein, 99 aa, Homo sapiens
YAGQWQWGHVDRVGLVPSCHGEKSSSASSSAWRAEKPNARGLASGTEVESSGHQAKQCSSGKHPHACWHRWGFRRQNCLGLWGCTEGAGKSMDDAMGPA

SEQ ID NO: 1004082 - protein, 50 aa, Homo sapiens
MDERKLSQIEKKYDEELEELVVEWIIVQCGLMWAADRGRLGFQVWLKNGV

SEQ ID NO: 1004083 - protein, 57 aa, Homo sapiens
SITDASTQEDRMCHAHESPSLRTAAVRLRCSRFRSRSCLAPFPGALLSPCRESVVFA

SEQ ID NO: 1004084 - protein, 45 aa, Homo sapiens
KVGVGESGCVEVVIAHKGDVVVGGAGIVSFELAQLWKVEILPDVL

SEQ ID NO: 1004085 - protein, 35 aa, Homo sapiens
MGESSCLAGMWRMRCSETFPAMESEAAPPSPFLTL

SEQ ID NO: 1004086 - protein, 54 aa, Homo sapiens
SIKAPGKSSHSPVSAISVRGCPLQQWCKMSGSSLHGGQQASVVQQGSQLNSVNP

SEQ ID NO: 1004087 - protein, 66 aa, Homo sapiens
DPHSCIQPSSNTCKLPQHQASKHISQHIIKPSTHNGLRCGWQQLGHLSSQFCQSMVHQLFPCSATW

SEQ ID NO: 1004088 - protein, 32 aa, Homo sapiens
MVYWDGISLGTWGNSDTEMVIWIGPLTGNVAI

SEQ ID NO: 1004089 - protein, 39 aa, Homo sapiens
NNTERCSSTSAGVQEESTTFQSWSSSSDTTPSPPGSGAA

SEQ ID NO: 1004090 - protein, 109 aa, Homo sapiens
MLPNLLLSSPSLPAAGVPAQQFDVMVMPNSLWQHLSTMSARELVGGPGLVAGANYGHVYAVFETVSAGATARLPPFLLFTDLVEAHSYHQVSPVNMHDTEVTRIIPGLY

SEQ ID NO: 1004091 - protein, 46 aa, Homo sapiens
LVIPTLMTDSLDLKLYSFSKPSLVKQTVKSHTETDVETQQRAGTLT

SEQ ID NO: 1004092 - protein, 48 aa, Homo sapiens
SQHHWHTDPTQHAINTTTIVIPTPTPPAHISLSMRPISTTTMVTPTTN

SEQ ID NO: 1004093 - protein, 36 aa, Homo sapiens
NPCWLPWLRSLDYSSMDVPCPKRIIHPAVRTFPARP

SEQ ID NO: 1004094 - protein, 33 aa, Homo sapiens
MTQCVYKKLSSFFCFSLRSVSEGCRMITPNDEV

SEQ ID NO: 1004095 - protein, 65 aa, Homo sapiens
MSVQVTSLLLEDFSNSPDPSKGPLFFVLIKALTMLRDCITSYQGCLRFLTTPVVSPPFGQVFHLF

SEQ ID NO: 1004096 - protein, 61 aa, Homo sapiens
CCFSPRSGRHDRDVRDDGDGHGLLGWVARLMMAPAQAPAVPVARFTVYAVGLGLPKVLKKQ

SEQ ID NO: 1004097 - protein, 127 aa, Homo sapiens
MELVRIEGFHKYRAIPLPYDYILASEYLLEQSNSTHSSLIAWTTYGLDYDRKKVSKADILARINRTGDGNYKSEAELGVPQVPYSKNSQAEVLNSQFIHYESCYQDAKDDDVHPFQYSILLKYKSIA

SEQ ID NO: 1004098 - protein, 41 aa, Homo sapiens
MYSASKPGQGEEREEEEEEQISESESEDEENEIIYNPKNLP

SEQ ID NO: 1004099 - protein, 64 aa, Homo sapiens
MSLRSHLEVDSKALACGRHIDLDDDGSSSCEPSYAVFRNMAQAGCRHGGTSHGGQAVHIVGGRN

SEQ ID NO: 1004100 - protein, 51 aa, Homo sapiens
YRVLENTLTESEACYSSSLPRCMCMITKLLMAQLAEIWADLERQNQEYQCA

SEQ ID NO: 1004101 - protein, 115 aa, Homo sapiens
GRPAVLSSALLVIYYHTQLSINLAMAVPFCMSGAGIDGCRSTIKNALAHFLPQGTPTPLIPLLVILETISLLILPIALGVRLNGNITEGHLIMDLIGSANLAISTIKLPSTLIIF

SEQ ID NO: 1004102 - protein, 97 aa, Homo sapiens
NRVCPCIRVLLGLIVSDSALLLTIHGIIGLDYLHNFSDILPKCCTNSPYESMQHKLVARICVILISMQCVCDEMIRVNSTLGWYQYQIRVYVRLIPL

SEQ ID NO: 1004103 - protein, 72 aa, Homo sapiens
YGIFSNRRLFAYTENLILGRPSGELAAASTSAVAASSCTFVMEMASFLQSQDLTSASFQLFFCSFLTSIRIC

SEQ ID NO: 1004104 - protein, 127 aa, Homo sapiens
WTGCCHHSSCHPCLMGEHISWTLTCLGHPVENYRFQGRCPSWLGGSDRQSYSGVEEAAWRGSPHLHGMPPSWGWLAQLTHGGTTSVLPLPNSRAHVPLCLAHKHAHRVSICLMFQGPSHVMEGTWAG

SEQ ID NO: 1004105 - protein, 66 aa, Homo sapiens
DPELCPVTPSILRPTGSAARHGLFRRCWALVPVISVSRSTIFRERHGVRVRLATGDSRGVWQRHGR

SEQ ID NO: 1004106 - protein, 33 aa, Homo sapiens
SSWTSASCGLSGGLPSFRDFQRYHPSDIHLLAI

SEQ ID NO: 1004107 - protein, 120 aa, Homo sapiens
RIAHFSTNYLVPGLCTGSPATGARTVSSADRVYTGAGGSGSRISVYRSTSFTGRHGVRAPGHRDSRGSGRNGRHQNETETMQSLNDRLASYLDRVRSLETENRRLESKIREHLENKGPQV

SEQ ID NO: 1004108 - protein, 48 aa, Homo sapiens
LARIARHEALRGGACQNRLGIPSEPCGSKAAALFGPVDSEQLSRTVTA

SEQ ID NO: 1004109 - protein, 74 aa, Homo sapiens
RDFSITYLNVLTFMKNACQDHSTFKNYSRKGYIGTWGAPKLCASGIFWFLSMPRMIFSSYGLLANLANSFISIS

SEQ ID NO: 1004110 - protein, 38 aa, Homo sapiens
MPIFSQGSHKSDPECEAPRKDLMKHLIGIEAKNVVVNT

SEQ ID NO: 1004111 - protein, 49 aa, Homo sapiens
MIAGLNRRWRLLLRAWLRLQEWRGHRGCDRRFHGPSDRAGGWGLHRIHM

SEQ ID NO: 1004112 - protein, 121 aa, Homo sapiens
MLLGCVESRQRFCLSRARSVRGSVDYSGTVPGLLTVLERSVDCIIFAYISDPNLYQQQPALEWCVAVYAICFILADIAVLLNLGECTNVLPIPFPSFLSGLALLSVLLYANALVLWALYQF

SEQ ID NO: 1004113 - protein, 55 aa, Homo sapiens
YRGWDDDYGRPYGPVCDYGPDSRPTTTVASWYLWLLCTGGLYYSDYTLSGDWTHF

SEQ ID NO: 1004114 - protein, 40 aa, Homo sapiens
MCASPGHCDVGTTALFVECKPAKAYGIIYAETHNHGRIHH

SEQ ID NO: 1004115 - protein, 120 aa, Homo sapiens
RKEVTPRTALLTRTEPPVRPADYLATASTPLVDLTGEILAPRRDHISRSSLASNPTSSYKCTDTRPMWGQSLLPPVSTSNHHVVGCGYPFPRNCGEEIQNGAGASRTRNIFLNGNRERSL

SEQ ID NO: 1004116 - protein, 33 aa, Homo sapiens
SQTREDRVCSQPVQGCGGLLIHTHHLLHVLKAV

SEQ ID NO: 1004117 - protein, 55 aa, Homo sapiens
LVYSSIQEEKEGVWSSSLECLQVGGHLYSDSLLRIDSFSWRADMARRMCSFRCSP

SEQ ID NO: 1004118 - protein, 58 aa, Homo sapiens
TELYCHSIRIQVVCTLTQTGGLGSAIVQLAIISMVGYRVRQPARLVIQAVVLRDQPHS

SEQ ID NO: 1004119 - protein, 101 aa, Homo sapiens
LIQVTLLQTLSCVRCHDCFFKTRLTIWKLLVSVSAPYPYSPLWSRTRVIANLYCRRRHFKAETDHSIQVKHKETWHNVRFNSSLHAVAPFRCQDIGHEASL

SEQ ID NO: 1004120 - protein, 125 aa, Homo sapiens
IPGCHQDRVEQIGGIAQELNELAIMTHPVSTPVDKKICDQWDKLGALTQKRREALERTEELLETIEQLYLEYAKRDRTFKKWMEGAIGGTAENLHCAQHKKEIQGLSTGHEQFKGTLPDSQQESL

SEQ ID NO: 1004121 - protein, 62 aa, Homo sapiens
PRLDFSCPLSCVCILHFIIKSLYGLVDSGLHLLHVIIDDLREKLWPCGGSSRRRSACILMVS

SEQ ID NO: 1004122 - protein, 43 aa, Homo sapiens
VLRKLVLFVLKLIASRHQRGKMLCTLLVTQRAAKPLWQCDPCC

SEQ ID NO: 1004123 - protein, 142 aa, Homo sapiens
MSDFENSRNMEPMTYMVMPLRSLRRHPYGEEKKSWLAPLRCTTETKEAKKAIKVIQGGSRVAYIDFLLQSLHRGRRGPGRSPGSLDWCRRLLPDTIGMIFRIMSILGPSAPGVPTPCSKTCLGFSYCPQRRCVPSSVTSKPG

SEQ ID NO: 1004124 - protein, 38 aa, Homo sapiens
IQLQGGLLRDIALHINPRMGYGAVVRNSLLNGSWGSDG

SEQ ID NO: 1004125 - protein, 97 aa, Homo sapiens
HSPSSTPGTDWILTKLSTTATTTESTGSTDAADSPHPGSTWILTEPSTTANVKVANGYTDTDSYNRATDGSLQSSRPARTTKHTVIQDPRDIPSSSP

SEQ ID NO: 1004126 - protein, 51 aa, Homo sapiens
DEGEGMKGRRSSKWSSEASKVIRTHRQRKHKRVPKRVGYNSSPWLRSAGYL

SEQ ID NO: 1004127 - protein, 121 aa, Homo sapiens
YGIQSSKQIRQKGVRGRRSVKQNAESQKGSEAGSHCFHSSFQPLPVSSKASLSNFLRTKEIETFSSNRLVWSNTPVWFGSACAPSRLVGPLCYRDNHRRAAIKRLCSILKIFYRSSCLVFR

SEQ ID NO: 1004128 - protein, 35 aa, Homo sapiens
VRLTARILGEQKIHPEKNTFGKIVAVKEFESHLDL

SEQ ID NO: 1004129 - protein, 44 aa, Homo sapiens
TVTLKKQAGTASLLGTPRYICNTVDEALPSSYAIPMPFLTSSGP

SEQ ID NO: 1004130 - protein, 53 aa, Homo sapiens
VCLLKFPCMLRRVCTAIYTPEGQETPSCTPLILFPKHLRSELGEDSMNEHGKS

SEQ ID NO: 1004131 - protein, 45 aa, Homo sapiens
PGTSRLQRAMIMPLHCSLGKKARPVLKKNNVFGRMIAETKQIIGN

SEQ ID NO: 1004132 - protein, 114 aa, Homo sapiens
SAISVLYRHKTVLYIPFLFGYFHSTSFMRSIWAAALAVANSFLSLYDISIDRTYSNSFFLSIVDGHRAISNSGYGKNHSYEHGLVFCTRLSGACLHASPAGVPCPGLWAGRTAT

SEQ ID NO: 1004133 - protein, 44 aa, Homo sapiens
MIPAPLCGKRSELEMDHSRRSQVCNDVSCGHVWIFRKNINKLKT

SEQ ID NO: 1004134 - protein, 34 aa, Homo sapiens
VTVRLGCVSVYQRERLLQVTTAFSYYKRKYLKPK

SEQ ID NO: 1004135 - protein, 74 aa, Homo sapiens
MYPGWSRTPELKQSSHLASQSAGIIGMSHRTERQPSFLTSFILPTTSVNYYTRPLPHWRSLAAAQRTLQHHSSA

SEQ ID NO: 1004136 - protein, 88 aa, Homo sapiens
MWRDVVAVVVSRSGGVHWSVVLEEGVAENQWPQLYVVVVSTVGVWVGPRRCSEGVAVETSGSWAVRGLCLTPHLASRCAARLPLSPGR

SEQ ID NO: 1004137 - protein, 87 aa, Homo sapiens
MTSEVKTMVKQLKAVRKPPTESNKQMDENEQGDEQHVSYVISQHEAKIKSLTEYLPNVEQKKRQKEDSVDALREELVQLRAQEQVHE

SEQ ID NO: 1004138 - protein, 120 aa, Homo sapiens
MLLVSCTVAFLPCVWIILTKEKNNINENNYKLEEVNDNLNSRPPQPTFSPLAKFHNLPEQRHCPGGRWMVTSFPWMQEVAQKQDGHERDTYGPRGSSTCLGPQRDLNVTTASVRGSTGTS

SEQ ID NO: 1004139 - protein, 40 aa, Homo sapiens
TCAASGIGFTATVIYELLENGQRNLQMTAAARCPRMVLLA

SEQ ID NO: 1004140 - protein, 105 aa, Homo sapiens
MSSFTTFLLIREAYKEWKIISSFTPTSTDSREENRPLVEVPLDKPGSSQGRSLMVNPEMYKLLNGELKQLYTAITRARVNLWIFDENREKRAPAFKYTLEETFEI

SEQ ID NO: 1004141 - protein, 40 aa, Homo sapiens
MCAAKRSEREMDHSEGVRCCNDVSCGHGGFSRKNINKLKT

SEQ ID NO: 1004142 - protein, 45 aa, Homo sapiens
MPESRTNTELIRRIAPPTSNGHAAAPTESKKSYQGCQIVYPARGT

SEQ ID NO: 1004143 - protein, 96 aa, Homo sapiens
VILAAVPYLRLQSTSSAPPLLVSVLSGVVELGTLVHYCPIDVFTERCFMMLFLYLSPCVKQWLSISTSLLVSGEEAPVSSWYVCGPPSAGASCNLL

SEQ ID NO: 1004144 - protein, 54 aa, Homo sapiens
TGYSAALHRIRTYSFSSEKLDRLKPSPLNSSKSSSVQLCSIAGEELRSRGGEAA

SEQ ID NO: 1004145 - protein, 107 aa, Homo sapiens
MLPLRNRTLIPRHPWSPWYARRLPSKVDRADVRMGRRRHGGRAIGPRLSRVTKAAGARPPGRGRRGADRVGFDLINARIPPAKGVSARRHVLALELPQLSKEERNTG

SEQ ID NO: 1004146 - protein, 33 aa, Homo sapiens
LARSPPIDASLLGSVQVHLKFDYFIGWLEEGGF

SEQ ID NO: 1004147 - protein, 62 aa, Homo sapiens
DSRYALEYTKVCPVFSIKAFDYEKVYSLQWTNEHEFMQQTGRSYTVQISFVKGCGQCYTAPV

SEQ ID NO: 1004148 - protein, 67 aa, Homo sapiens
STTAGVTRIYSLRSSSLTVFEELRAAGSVMRLASYYRFEILEAFRRAVGAAAGITLEEVSGSGGLGS

SEQ ID NO: 1004149 - protein, 38 aa, Homo sapiens
HHHYGDQPQHPPDTDPNPTPITSTTTVTPTPTPTGSAL

SEQ ID NO: 1004150 - protein, 36 aa, Homo sapiens
MRRSIWVPKLSRNYLKEGYMEKRGPKTERKVLPGQR

SEQ ID NO: 1004151 - protein, 71 aa, Homo sapiens
ILHHSPHWRNGFKSNLENHFLMWYTLNTTLQPTQSSLGCEAVPGALSLLETMSQTAQNSCGSARALLGLPQ

SEQ ID NO: 1004152 - protein, 49 aa, Homo sapiens
DSLTSTLSVHPQSYYNIETPGRSVLTAGRFHPTVYYNLETPSERKEMHL

SEQ ID NO: 1004153 - protein, 64 aa, Homo sapiens
SDEHAVVRNTQIDNYLGAEERSLARKMPFVRGQSFSVWILCEAQCLKEDGLGWVQPPQNGGDKR

SEQ ID NO: 1004154 - protein, 83 aa, Homo sapiens
DLEDPNSAAHQGQLFAQCTQWVPLKNYYDAWCRQLLHAGSTLECASLQAYAGPRVPSKNIVPRGGGTTAMGPCLVDVPISRGS

SEQ ID NO: 1004155 - protein, 90 aa, Homo sapiens
MGVHCDCSPVGTMYTLMPERSPGRCGGHPVFGRQSGWSTGVELQQVLPAYSPSRLADPGPWDALPPTLESSGIYPLARAGMAVAVSPDSR

SEQ ID NO: 1004156 - protein, 35 aa, Homo sapiens
LSATTYPLYRNTLGSVVTTNKNGRLLIWYLTNLTL

SEQ ID NO: 1004157 - protein, 67 aa, Homo sapiens
YLADLFCTTAGEVVFVVQVVTGDGGDGVGGDDVDDNGDGVVMVVVVSYGGGDGREVMVMVALVNRGD

SEQ ID NO: 1004158 - protein, 53 aa, Homo sapiens
ILHHSHNHHHYGDPNPTPIATTTTVTPSPTPTGTQTPNDDTHTAPTTTVSAKA

SEQ ID NO: 1004159 - protein, 43 aa, Homo sapiens
PRISTSHSRPGSTHTTAFPEQHHHARPQSDSTTIPQTAQSSTG

SEQ ID NO: 1004160 - protein, 69 aa, Homo sapiens
TKTAKRAARFPSQQHPSRHIGLAGNWLWADTIPLEKNVNLDICLAEWLVMAKEGSSPAAVAWRQLSGTY

SEQ ID NO: 1004161 - protein, 66 aa, Homo sapiens
ASGTVDDEYDCIMSIAVYEYGPYNELAVKMSMGGIDEYRLAVDEYRLALMSIGGVDEYRLALMSLA

SEQ ID NO: 1004162 - protein, 105 aa, Homo sapiens
SESCTCLDSLPLYLIYNVSWNHNGSLFMLSMQGQKACCIIDPTYEAPVVARAVIEVLMSGSLAPCGPIIPGRMARVYTTWLQPDYTSWQIEHALAQPMNSLVGTH

SEQ ID NO: 1004163 - protein, 34 aa, Homo sapiens
MAYTVECLRGDVDILMEFLLTCHHSTGVSSLGSS

SEQ ID NO: 1004164 - protein, 37 aa, Homo sapiens
SVIFQSILLQPQTSHHSPHNSRDKAKGQEVPHTLAGI

SEQ ID NO: 1004165 - protein, 63 aa, Homo sapiens
MFAYYGEDYLHPELRTCCSWYRGWTRADSDSPTQEVNNECLLTAEAPREAYRGRHIDVELAST

SEQ ID NO: 1004166 - protein, 46 aa, Homo sapiens
SQTLVGSPSSQSLGYHPFSINNLMSEQTPDTYQNKDVGSIGRLQRA

SEQ ID NO: 1004167 - protein, 32 aa, Homo sapiens
MLTGKERGGDHADWLKGYEKTPGDLLIAVRCA

SEQ ID NO: 1004168 - protein, 84 aa, Homo sapiens
IPPNGVTLTHSSRLAGGGLRNLTITAAGEANTSFFTWWREREESVPIEARKTLIKPADLMRTDSLSLEQHAGTADTVKSTWSLP

SEQ ID NO: 1004169 - protein, 46 aa, Homo sapiens
VALEDPGTIVLATRTLVRRVAGDQWHTLEVYGRALQIKKEKRAFRT

SEQ ID NO: 1004170 - protein, 106 aa, Homo sapiens
MVRGRPLPGVTVPIHLTLLLCSPPLTPFLSLNWQVISVPRRNPALKQELCSYAILGLALSEGVGLRCLMVAFLILFASVRLLGGSPGCRYCKSRPFLVLGGVKLYH

SEQ ID NO: 1004171 - protein, 30 aa, Homo sapiens
MQVKLRTAPRRAAGSQDGRALTGNKLLLNP

SEQ ID NO: 1004172 - protein, 38 aa, Homo sapiens
MCGKRVSGDGSQPKENGAAMMLAVATVDFSKNINKLKT

SEQ ID NO: 1004173 - protein, 64 aa, Homo sapiens
QHFFDHDHRDPSHSTPSLTSLITTTKSTSHSPSSFTSGDRHHEDHLTQYSQLHFIDHQPRDHLT

SEQ ID NO: 1004174 - protein, 68 aa, Homo sapiens
LCMTSLLLSLGTVKAVVSEVCSYRFADSWLFFAVLGSSISRQVPSGASIASLDLPCFIFQIVVWAISV

SEQ ID NO: 1004175 - protein, 64 aa, Homo sapiens
LCIGWRAAPLRLGLAPRGPRLTVVAVDADVPSPYLSATATHRVPTLDTSYLLVTTLFPSVPLVL

SEQ ID NO: 1004176 - protein, 137 aa, Homo sapiens
CCDLEDPILHHSAGGTVGSRGRQCPHLSLWLLQKKQVCDCADLCHRVCHCVWLECPIPDAPVVTNVTVKARVWNSTFIEDYRDLDRVGVNGWVNPNSSEPESPASTWRTRTTWFSVDIDSGAGGGAAGRNRAVDGAG

SEQ ID NO: 1004177 - protein, 103 aa, Homo sapiens
VLPGRSTVLFIVQIHILLIQAIPQAKLQMHLMILQMTGLRILATSGKTVLLQLVDTEVSQLAKPKTSGLHKQHQQTQTARKHSMASNTSFSPTSIRALPDSSR

SEQ ID NO: 1004178 - protein, 33 aa, Homo sapiens
MEGCVAVAVCQVDDIAEDIWGNGLKFSYVVPHY

SEQ ID NO: 1004179 - protein, 88 aa, Homo sapiens
PMLVIASGDSIQLLADRTDKHGTFFQGGRIKHDCQQWTCQTLIKPSDLMRPAHYHGNSLEETGPMIQLAPPGPNLDTWGLLQFKVRFG

SEQ ID NO: 1004180 - protein, 51 aa, Homo sapiens
STVQVHVEGSLNPRYKEGVVIRVLFQVCPRPPSQPLPQAVTWQFTVCTLQA

SEQ ID NO: 1004181 - protein, 39 aa, Homo sapiens
DAEKVSQMTDFDRFKDYEGKKMRNRIIQNEGKKVQKGGL

SEQ ID NO: 1004182 - protein, 45 aa, Homo sapiens
GTVCGMLRSLATPFPTSISSTSGSANTTEEDTLCTPPPHDLVPEP

SEQ ID NO: 1004183 - protein, 94 aa, Homo sapiens
LAAGIGGGHKEEAADSYFSVLNAFIDRKDRYYSIHQISGKLQNVEGPPGLSGEGGVVGFPFRSFLVSGDVGAGGCKPLNTELLTILSLVVTSTP

SEQ ID NO: 1004184 - protein, 30 aa, Homo sapiens
MLRSFQRIPAPLVLCSGDSDFTIEKNKGVN

SEQ ID NO: 1004185 - protein, 43 aa, Homo sapiens
QLARLCLENIDKNTGDAITAEGFTDIDLDTLVGVLERNTRRER

SEQ ID NO: 1004186 - protein, 38 aa, Homo sapiens
VRRWNENACYEQQQDGNARVSGRSFGERGARSLGLSGR

SEQ ID NO: 1004187 - protein, 48 aa, Homo sapiens
SSQPLQRGDDPAANALICVSNSVREYVQRHYPSVPEQTLQVIPTWRRC

SEQ ID NO: 1004188 - protein, 67 aa, Homo sapiens
SQAPANDIRTVSTVLTCRRNYVQEGMHRNGEYTSPGLHVNDNEEVSTVLTYRRNYVQRRYAPQWIEY

SEQ ID NO: 1004189 - protein, 40 aa, Homo sapiens
TLSQYVLSRYSRLATTVTTTVTCLPHFCTGFSSFDFTDLP

SEQ ID NO: 1004190 - protein, 105 aa, Homo sapiens
MQALVQDEAYKHRASGCHLQGQCGLAIPVALRTGRWRAWQDDGPRMAGATSLEHFNTQTDVAIVVPGSNKCLEPGALAGTGLLLHWHNLQNLILERGPQEEINDL

SEQ ID NO: 1004191 - protein, 86 aa, Homo sapiens
LNAAPQQPGDTETTSYLTHHNLRPRAAIYTHPQQHWLATHNTDPCQLHKLLAFRNESTTFQSWPSSRDTTPSPPGLRRCSLWVARI

SEQ ID NO: 1004192 - protein, 48 aa, Homo sapiens
GDWDLAEGFGPVGVGPWDVGPCGGTLLVLTLQQARVVGGDGGEGGVVP

SEQ ID NO: 1004193 - protein, 97 aa, Homo sapiens
MLIPQIYIPGPTSGLSLPLVETPTTHELPQRVQDRVHRDLGKEAELCRDVDRCMLRYRLVVEETQSYFQAHSLSPKAPMNSRWSSQCPRTGLSSFTL

SEQ ID NO: 1004194 - protein, 114 aa, Homo sapiens
CLEIRRVMVETDILQHKQASGSEDALSTGSANLRQGASRFHDPRLLFPQQQGDLGLGTPQKPFQGLESRTQQSLTPLSTIKAFATQSGSQDLKALNTSYQSQLIKPSHCTPAGY

SEQ ID NO: 1004195 - protein, 50 aa, Homo sapiens
MMNNLPPQNKAEGKIKIHNLYSLKTGDQQYAVHMQIVAGGKHGQSDRSRY

SEQ ID NO: 1004196 - protein, 38 aa, Homo sapiens
MKELYWKEQGLNLARQWNNCAFLESSATSKIYVHEIFY

SEQ ID NO: 1004197 - protein, 42 aa, Homo sapiens
MAAASSQELILSNDCGVLWVYPFCSLHGFSSLDELSDGTSHT

SEQ ID NO: 1004198 - protein, 37 aa, Homo sapiens
MDHLPGIVLSGQRAAYSALVVWNGIGSVKYLLLKVQG

SEQ ID NO: 1004199 - protein, 58 aa, Homo sapiens
SRVSPPHSTEDAATDTQVAGQRLCWFSLLFQIYSLQQKCRSLCNTGLSSHAHLMFYFH

SEQ ID NO: 1004200 - protein, 127 aa, Homo sapiens
MLSYSPGPISQSLSQNIFITQAAPDIKLKLQKLNSGPQTPQQDLINLAFKVYNNRKKLQFLASTVRQTTATSPAHKNFQMPEPQRPGVPPEPPPTGACYTCRKSGHWAKECPLPGIPPKPRPICVGP

SEQ ID NO: 1004201 - protein, 76 aa, Homo sapiens
STSTRIPSYTVLGSGANVDAFLYGEGTLELWSLRTSQREIPEYVYSEPVWVKVLYRVVIEDKLTRESQVRPRSALR

SEQ ID NO: 1004202 - protein, 54 aa, Homo sapiens
DLTARLGGGGLVMSCSDTGLPVAGCHSDSDGADLIVSEADSTIMSLKRYLPSPW

SEQ ID NO: 1004203 - protein, 77 aa, Homo sapiens
SAAGSTLTDSRHHCAGIIVIITEEYTNEQRNVKSAVSLAEQLCRCGLQRLHVRMHFVFLPDMIPVSSHVIVDQSIGC

SEQ ID NO: 1004204 - protein, 32 aa, Homo sapiens
MKRSSSLFYVGPVAVTQVYCIDIIIQVPGQVC

SEQ ID NO: 1004205 - protein, 42 aa, Homo sapiens
RLRSKTSEIMLWTVLKRETCSCLEEMEISSFLGLNRPCFFFE

SEQ ID NO: 1004206 - protein, 31 aa, Homo sapiens
DRIELVPMRRSCSLPGFVGMCNRANKRSLRE

SEQ ID NO: 1004207 - protein, 35 aa, Homo sapiens
FDNRICNINVHLGSGDIDVGLGQAHIQMWTLAFEA

SEQ ID NO: 1004208 - protein, 35 aa, Homo sapiens
PFCPPVGSVPCTRAPLYLSLLNCNSIYIHGQIHVW

SEQ ID NO: 1004209 - protein, 53 aa, Homo sapiens
TESRIPRLLVDDWLTPCMTSGRDWTNQRLNTQITQWSWSHYMEMEMPEPGPAG

SEQ ID NO: 1004210 - protein, 47 aa, Homo sapiens
MCVLTETEPGADRKQYAQRAELGHGGRAARLCRHVGVQASCLSGEIG

SEQ ID NO: 1004211 - protein, 56 aa, Homo sapiens
MSVDGRLTGSLSRSAVCYKSGHQHSHTRLVHAASRVLTPLNVENRLRSSLAQRPSN

SEQ ID NO: 1004212 - protein, 59 aa, Homo sapiens
VQRCSWVQRSACDNLRAIVDNCLCEDRRSHEYLRGVHSVPQTSEPVYQGSSNNCRTVCT

SEQ ID NO: 1004213 - protein, 91 aa, Homo sapiens
MLLLEGPISAGYPGPPIGGPFTVSPQLTWASQQRWQASISSPRQVVGIPVQFMHMPHSTHSHGMHKPQPLVSLQTRNSVNHVSIKRVSLVV

SEQ ID NO: 1004214 - protein, 92 aa, Homo sapiens
TVAAPGGYTAWCWWWRWWSTAYSLVLAARETLGGTCGGSCWPGSRAMSIQICRTNWCTCAFCSSSSSTMSSLILPDRGAEKAWRGAICAMSA

SEQ ID NO: 1004215 - protein, 102 aa, Homo sapiens
TVALHGSLSDFTGIVTTVLTAHKTAKYCGVTTKLCAQRKASACYPTVKPVHVNRPDHTLPVTISATVTTFLTKVTTQWLSKTHDQHGLAVCGSTVYNSLSTF

SEQ ID NO: 1004216 - protein, 54 aa, Homo sapiens
MVWDVSVVSSYCGKERLEDQISPGGCGTVSYDMPIHYSLDDKQDPPSKENKAQL

SEQ ID NO: 1004217 - protein, 58 aa, Homo sapiens
EWQPLAEGLMRRWLPAGRRLVADDHLSYLPSPVTGPVEYRCAAPVARGPRDDECCHGA

SEQ ID NO: 1004218 - protein, 69 aa, Homo sapiens
CLGIQALAQLDPPCGGRLNTKDAAIHLSRLPQDYPSQQNCEWIVYAPEANQKIVLKFNPHFEIEKHDCK

SEQ ID NO: 1004219 - protein, 103 aa, Homo sapiens
EEQSSSSPSTLCGVMHGKEVGSIFWKKGELYNGSRSRAVPGSTLSGGSCPESINTINGSTAAVFHAVSMIAFKLDEDLCAAPANGGNVSRPPVTLRLVIPASQ

SEQ ID NO: 1004220 - protein, 141 aa, Homo sapiens
RYLGRRNRQDTISMWLENVDTTMKVHIKNRDDLVLSVSPAVPLTTPSCLPRTQGSALRPFQEVAPVTRAAQAPAVLGQDETVPPNSILFPSNLAENHLETQFTSRLFPCGILGQSSTRPHFLNLQNGLQHSFMIAHAVPKH

SEQ ID NO: 1004221 - protein, 62 aa, Homo sapiens
VHRPPVPVSTSCVYGDMAAVAYLCLSVLQIQADSAVPAAQASTVLSDWQYAAHHVHHTVSRH

SEQ ID NO: 1004222 - protein, 101 aa, Homo sapiens
GRDHRDHRITTPSRDRERGGEKGERGDQETHKVRETGTGENPENWIRRRTAHVRSPPNPCAQQPQPKTSQHSKENPAAPGFLHQAQLILVFSPCWPSWSRT

SEQ ID NO: 1004223 - protein, 116 aa, Homo sapiens
GTASDTQCQWQQTLWDIEHDDADEEDDSLKPGCIREMRGEELKKETPSEDSHAVVMSLDEVLNLEWRWGVFAHLPSPCCQGWRLRAHDQCWSARCPTTNAPEAVYRRLEISVIHGS

SEQ ID NO: 1004224 - protein, 112 aa, Homo sapiens
PIAVSRSIHVFTVRGPSVYTMCYGDMAVSPPCVLVSPNPSGFSCTFRTGLNLLSDGKICSPCIHSNLIFARRIDIRIVSLDIPYVADVVVPLNITIKNTIAIGVNPQEGNVY

SEQ ID NO: 1004225 - protein, 47 aa, Homo sapiens
AAKGVERERDLVGPISLPECLLHNAPSRGAPDSPLRLTLCLVMSERK

SEQ ID NO: 1004226 - protein, 77 aa, Homo sapiens
SSQSLIHLIEAYPCWSAVCVVTMVSGAHLRYRLRQMWHVRSYPSIYHYFPEQVTLIVTHSNQALQQLYETLVAFDIR

SEQ ID NO: 1004227 - protein, 72 aa, Homo sapiens
RLYGSLLLWDGAVLWYGEAGGSRGQEIETILTNTVKPCLYKKYKKLAGNGGRCLWSQLLGRLRQENGVNPGG

SEQ ID NO: 1004228 - protein, 60 aa, Homo sapiens
TVWPSLQTVCFVIQAPSVTAVFQIIFPMDHRLFLVWLVLATAVQPVAQRLKFRLNLYELE

SEQ ID NO: 1004229 - protein, 165 aa, Homo sapiens
DSTGVFCFGTATVHIGHAGSSSDSPLSTLCPCLPEAGSGCRSPRALEMKAGPCSCREGGGQWAHGSVPLQTQHALRALGIFLCPGETLSASLHWNPIPDHPLGSIIGPQEESAQPSRHPEAPPSVGTEAEERSRRSSPQDSYGSDPGSPAGPSGSPLPTRRPKAQ

SEQ ID NO: 1004230 - protein, 96 aa, Homo sapiens
LAQCGSDSLLRLLKAAIKRLAGQHSFMEALVEESASHVHSGCWRNSASLLALSWRPLSHLKAACIPSYVVPSSFKPALLLFLMLHISLPFSCIRGI

SEQ ID NO: 1004231 - protein, 69 aa, Homo sapiens
VTTLDPRPAGDNFVVQACSLQCFTGWTQLEETQLVFLSSQGGFDKGMWPGMVAHACNLSTLRGCTGEIA

SEQ ID NO: 1004232 - protein, 33 aa, Homo sapiens
PPITPAPTHSHSTLTHRSLQRMRWGYDRSLSAR

SEQ ID NO: 1004233 - protein, 58 aa, Homo sapiens
IDKFQKSYYPASNIILISIPAMPRWHPHSPNIRPSFQDDRSHCKASVSADNSHFDYFH

SEQ ID NO: 1004234 - protein, 61 aa, Homo sapiens
FEDGGQDLIPQCLRATRPRPGSREVDDIGRLVLEVQEGVPRDREGTGVTNSPYQTTHTNPH

SEQ ID NO: 1004235 - protein, 41 aa, Homo sapiens
EQLSVRSFTDQAGRALLSGLALSAEFANAQGALRSSGEGTT

SEQ ID NO: 1004236 - protein, 103 aa, Homo sapiens
VFHSVATSLWMKPSAMVSSSRGYKEKIIQMEIFFTQPAGNAMIVATRIEGNGLETRTQLRPCLQSVPESFLDPSLTVRHRALHSERAPSVSTLAGTIPAVPKH

SEQ ID NO: 1004237 - protein, 43 aa, Homo sapiens
SGGARSAALECSSGATRSSLYKVWCQYLTTIVVPDWMTIAMLQ

SEQ ID NO: 1004238 - protein, 43 aa, Homo sapiens
KIISRSAQLVRQRLGAQLHHDDAVCQYSSPASAPTPLPFLHPA

SEQ ID NO: 1004239 - protein, 49 aa, Homo sapiens
YLVSLVIPGSAVEYVGPWKAAPQSWSRVGRNPQEVGQECLVWKSLPSLH

SEQ ID NO: 1004240 - protein, 83 aa, Homo sapiens
SVWVSKSGDDGDLGHELVSMSAFFWRSLRVAGLQAMHHAHVLFVFLVKTGFHHVSQAGLELLTFDPPNLFQCWDYRHEPLCPL

SEQ ID NO: 1004241 - protein, 71 aa, Homo sapiens
LRDSDNVLCESRPGTVPTEGAAVFPKWLHQIHSPAAMSESCIWAMSLYTFGIVSLHLSATPVGTEPHLTVG

SEQ ID NO: 1004242 - protein, 106 aa, Homo sapiens
RSHADHLESHCHVILVTINCTVVRVFSLDLQVGLDQDLAPVIHGSAFHSVSSSPATSAHASDDHNSALFPCAGYQGHSCSGSLLVRMILQTPPHIHPCYWGGPVGN

SEQ ID NO: 1004243 - protein, 79 aa, Homo sapiens
IRRVHGYEVNGGTIKGNCNHKDVSFPDGGLSGEISVLLVYPSPFSLINGLRPVHENQKNNPRRFGGMKIKDLAGSEQII

SEQ ID NO: 1004244 - protein, 61 aa, Homo sapiens
WLGRNAEINSALSITAGKGLRARIPGLGQLEVPQKVQFCFLQAFETPRHSRYPEVKVAAPV

SEQ ID NO: 1004245 - protein, 82 aa, Homo sapiens
RNVIGSVVADTSMRVYCHYRTFPLQWLVAVDAMMSWLMLRLTVVVIENVLVKVVTGFCVTGVEVEELLKATCVVVTQKGVRL

SEQ ID NO: 1004246 - protein, 44 aa, Homo sapiens
VRDNSLLMAHVSPESQICGALSGLLGLGLGAGQLITTFLFWLIL

SEQ ID NO: 1004247 - protein, 65 aa, Homo sapiens
SESLCVTVTDRLVATIYSQSMPHYSSAAMTSGCADSGAQKMLQDSQKQRSAHIPITPFPNFPARA

SEQ ID NO: 1004248 - protein, 68 aa, Homo sapiens
WTTSGSVAVTRVLPTVNSVSYQSLSCELCLERTRSCITEVELARVLLLSPETPRPTLMSQEHFDPNST

SEQ ID NO: 1004249 - protein, 86 aa, Homo sapiens
MGALIEPFYNNRAVSKSTEVSQMKKLDDGPIAGASGNQVHEGKYPIRRWPIAKLIRLVQMRTGDRLRLPSALRTGSNSKTRASGEG

SEQ ID NO: 1004250 - protein, 47 aa, Homo sapiens
CLALTCHPYMILIGFTLYVTKKIKLTHLPFLRTTANRDPPKTNAMDE

SEQ ID NO: 1004251 - protein, 122 aa, Homo sapiens
MSINAFLSSSPVLRICDSIECCPSPINGLVRAEAVGELFSVVVLISLLLFQPVSIASPFPILNIYILLNHCSLSIPIAEDITMYLLASIAVLFLSGIKSFVIVKNRMRVMGSASKRSCNKGA

SEQ ID NO: 1004252 - protein, 113 aa, Homo sapiens
GVPHDWSRVFLSLWVFFFSWGSLAVIDHAGLHTTTSKISPEPAYPGFKRFSCLSLLSIWDYRHVPPHLGDFRIFSEHGVSPCWSGWSQTPDLQIHPPGPPKVLGLQAERITGR

SEQ ID NO: 1004253 - protein, 78 aa, Homo sapiens
VRFRPVLRSRSLSTAGDRRVWARHYSAIHFERLGYSAGEVSTHSLTDCDLHGQPPAGYINQQPFWDLMNATTGGGILD

SEQ ID NO: 1004254 - protein, 47 aa, Homo sapiens
NKALKLLAREKIKLLAHNPILVRNVEIRFIGQSHLKSSFSSMNKSSN

SEQ ID NO: 1004255 - protein, 48 aa, Homo sapiens
PGTCVPQIYFSKSHMPPQVVCRPSLYLLVGPAACEALSPFRLVPARGP

SEQ ID NO: 1004256 - protein, 71 aa, Homo sapiens
RSLITYYSCSEAPLGNSDVGAPARSREGYRQATDEAPSRCPSAVKSISLPGLPGTPHMQYRNLYHREGVQE

SEQ ID NO: 1004257 - protein, 54 aa, Homo sapiens
CYVLFSYSFSYKHLNATSGSANTIEEDTLLHPSHPYDLVPDAPSVTEHNSHIVA

SEQ ID NO: 1004258 - protein, 40 aa, Homo sapiens
VTAAVAHHELPGPPVLAGPPSVSSRVPRSHIRHIHGPSAV

SEQ ID NO: 1004259 - protein, 108 aa, Homo sapiens
TGVFALGRRAEQLKLFEMLVSEARQPLLRHGPVREALLTLLDACGSPVPSKPSNWIEGFGATSSASCVFVVAQGAFIGSKFFAADHLLGALGAAPPVFFLYFYAVPNA

SEQ ID NO: 1004260 - protein, 31 aa, Homo sapiens
MRTRLINSTAEEVAMRKLMRTVTVVEDDENE

SEQ ID NO: 1004261 - protein, 65 aa, Homo sapiens
PSILHHVKAPAGRVPSVTCCGEKKGGSEAGTPLQQPWVIRPSRSDPSDFPWEPHFQYLENGLNAK

SEQ ID NO: 1004262 - protein, 42 aa, Homo sapiens
NSAPQPKQRSWLDQNKLLSCHHQLQPGLAELAGPWAPWLDSY

SEQ ID NO: 1004263 - protein, 32 aa, Homo sapiens
YLHHSSSRVWQSCHQCQHVGLLVSWYATACLS

SEQ ID NO: 1004264 - protein, 116 aa, Homo sapiens
TCNHQHLYTFTADSVQRTKDLYLGAFQPARWSLSFRPQTNTLVLIVAADSSPAAFFLMRLPLFAFSSSSSSLSEAKIFNAAKSSSSARIRPSRMRPWILQSIPELLHCFIAISIYL

SEQ ID NO: 1004265 - protein, 89 aa, Homo sapiens
MCRPRGPTVIAENELLGAAAIEAAAKKLDQLKPRAKPKEADSFNFEEQILEAAKSIAAATSALVKAASAGQRELVGQGKVGAIPAIALR

SEQ ID NO: 1004266 - protein, 104 aa, Homo sapiens
SLGSDAPLPFTGGCCMDLAASSICSSSSMTHLLLGLGPGFRCSSFLAAASMAAAAPKSSFSAMTVGSSGSTPSVPFMASAAWMSSVTEPATRFECPVNCCFSSG

SEQ ID NO: 1004267 - protein, 63 aa, Homo sapiens
WLLDCVYMYCDRRSNARTEQQLQDIKRVGWSVTELIRLLSHEGTECVDPEGPTVIAENELLLS

SEQ ID NO: 1004268 - protein, 108 aa, Homo sapiens
MDLAASSTALKVKIICLLGGPGLQLLQLFGCSLNGGCSSQELILSNDCGVLCVYPFCSLHGFSSLDELSDGTSHTLGMPCQLLLQFWAWLLQGQQYMVQQFQVAIALR

SEQ ID NO: 1004269 - protein, 39 aa, Homo sapiens
MLLTVDLILHKEMGLLQVGATVSAHVTLKVAVTVPPSQS

SEQ ID NO: 1004270 - protein, 173 aa, Homo sapiens
QFRWEEYTFHGRLLLLLARVTTTIPTLSWASCAPVGPQTSRTNLRRWCCWLTRKKNVVVFKSDGSVLLNELQVNLTHVTASFSVFRPSSYHIMVSMAIGVRLQVQLAPVMQLFVTLDQASQGQVQGLCGNFNGLEGDDFKTASGLVEATGAGFCQTPGRHSQAGMTRWTGWTI

SEQ ID NO: 1004271 - protein, 48 aa, Homo sapiens
SHVQVQGLCGNFNGLEVTLQDGQRAGGGTGAGVLSNHPVNGTVKQHDK

SEQ ID NO: 1004272 - protein, 107 aa, Homo sapiens
SHLYFCCAASVRSADAYLHVPGDDTAQIRGLQMSCTLAHQREVEVVEIVENDISAFTYEKNTMMEQRSEMLKQMQVSKNEQEREAQLIHDRNTASHTCGGSQEPSAG

SEQ ID NO: 1004273 - protein, 38 aa, Homo sapiens
MSHLLGPDMALGISTRACGWTWASLKTWVWRRLSKKSS

SEQ ID NO: 1004274 - protein, 138 aa, Homo sapiens
LTISSQHVACSLYMCEHVIACHLLSPDANTRQLSFVSEIRILMGLRSELEYLGLLALSKILKIHPKSVQSHKDLILQLDDKDESIRLRRLDLLYGMVSKKNLMEIVKKLMTHVDQAEGTTYRDELLTIIDICGQSNYQ

SEQ ID NO: 1004275 - protein, 47 aa, Homo sapiens
AFLQGFLGGGLGHQDTREHAPGYAIDTVQVHGQEKYLILFEVGPDCL

SEQ ID NO: 1004276 - protein, 65 aa, Homo sapiens
MVTSWGDAYGYEELDSEEERSELQLRGGQAACRAQAQGVSVGPPGVGRTQRGRGGGPFGAREDVF

SEQ ID NO: 1004277 - protein, 93 aa, Homo sapiens
GRRWHRVCASAPLLSLTQPRSSASASRCNHTLVIQQAPKPWSPIRPPQVTLTQTPIVALRQPHKRIMLTTPQQIQLNPLQPVPCVETRRRKGQ

SEQ ID NO: 1004278 - protein, 92 aa, Homo sapiens
MLGPGIVYVSVWVEKDGVTSSVGTVTTGTAPQPSGGKPLKSWRAQDQTSSDRPWTLGRVPPRNGAPKNPTELHLRLSTSDGADAPKPGVRLN

SEQ ID NO: 1004279 - protein, 76 aa, Homo sapiens
MTELVTCGYASGENQRARHNQKYCRQRTGVSLKHARHVPGWKPRSRHWMKASLTLTSCPWDHLLQPVDMSALSSKL

SEQ ID NO: 1004280 - protein, 99 aa, Homo sapiens
MNVILPGKYVHRQLCSIHKWSIASEPEISVNGEKTKLERLEALDANSRKQEAELKEKGQEMELEEWYARQDEQLQKTKANNRAAEEAFENDIDESPPKH

SEQ ID NO: 1004281 - protein, 201 aa, Homo sapiens
WDGGLYGKAWARAARVGKGSVSGRGALAIVIVERQVGHVAAEVTEDLVALVEKVILLTVWRIKPAFSRLLAYLRASLRSVKPFTLWYSQSTTSEPIKALGMVILSHMRSRTSNPDSGEAMAFTMAAMSLWMDKWKSSRRSVSGMELVMEELVEVMVLREGFMPYAGKVPVMAAVWETQAAGSMGLDVPLLGNVKQHVSLVQ

SEQ ID NO: 1004282 - protein, 75 aa, Homo sapiens
ILLWDGGVDQEIAKYGAQVRWRGYAAHSTSGITSLRPSLSRVCQADLPVMLETLSQSPQGRVMTIPVPAHAAQST

SEQ ID NO: 1004283 - protein, 62 aa, Homo sapiens
LVADNFEQHVTARTCIPGFPSIIRMSWIRVYGSVHRHGGSSGDKTADHAGTEVAQDVVMRSS

SEQ ID NO: 1004284 - protein, 35 aa, Homo sapiens
MKLCVCSTDFRALTVVYPQTYNSARPLDYTSGNSL

SEQ ID NO: 1004285 - protein, 43 aa, Homo sapiens
TKRVEASQEVQASLVQAAFNKRIVNSQPKETQRAAPQPGPPGY

SEQ ID NO: 1004286 - protein, 73 aa, Homo sapiens
GWGRPLISSKALLAGPSPGARDKQARLASLIRELIVPPKSPPLNTTTWGARIPHMNFGRTQTLTTPSALRKAT

SEQ ID NO: 1004287 - protein, 91 aa, Homo sapiens
LNLSALDSVMAYDSRGHDYTLLRDRVTYHRHSKNQFSLTVTSVTGETRRLLLCERGLDCSYPKLTDALDILGSRGQRVTCLFKPPPKGPIG

SEQ ID NO: 1004288 - protein, 38 aa, Homo sapiens
MVVIWLLWECRYSLRLRVVRLPRNSCRFIQLRLMREGV

SEQ ID NO: 1004289 - protein, 105 aa, Homo sapiens
TVVVVGRQEVSKLQYGAMSGVKLAAERWGPRMRKGCEAAVAVLVVVLTLLLLTLFMPEPNAGFEAESVDGLAEVMGATAEVALASASEERGQLWWDAVAGVSCLA

SEQ ID NO: 1004290 - protein, 35 aa, Homo sapiens
LLVEGEEVALRDKARSWEPAEIVSDHARCDKKKRN

SEQ ID NO: 1004291 - protein, 33 aa, Homo sapiens
RLEREEVVLSVYNIYWRIINSRARGHSCVNELE

SEQ ID NO: 1004292 - protein, 38 aa, Homo sapiens
GVRVVLCVCCGGSLCLTGLPVCRRCVGKLSPQPCCESQ

SEQ ID NO: 1004293 - protein, 71 aa, Homo sapiens
MRYVAVTFLGCLDQNPSDRPKNGKRTWTLELRALWENACWQAPCVGLGGYGAPYWNRSGRIENCTVPFLDR

SEQ ID NO: 1004294 - protein, 36 aa, Homo sapiens
VQGGCSELRTFELRPDMRRNQLCKIWGRGIPGRENS

SEQ ID NO: 1004295 - protein, 68 aa, Homo sapiens
MVTFPSSPGQEKTLEGPKLLVPMHAGKRASHSLSLATDPLLSAWRLPRQGLLCSRQAKGPIVPPSQST

SEQ ID NO: 1004296 - protein, 126 aa, Homo sapiens
MQIDRTAVYTKAIYRFHADSVCEASNRRRSVYLPTREYPSEQIIVTEKTNILLFELHQQWDKKNAVKKRDHEQVELEGESSDTPRKVGRKDSPDMHGGHLRLSTPQAPPARSAPRSPTRLPAVPKH

SEQ ID NO: 1004297 - protein, 42 aa, Homo sapiens
MILLLWDGGIYNFIGEFMKAAWIRRPDRSKPCHVPGMPAMES

SEQ ID NO: 1004298 - protein, 35 aa, Homo sapiens
GAQRLDRASETGLYRRGEAQLLMSEFESAKGDSEK

SEQ ID NO: 1004299 - protein, 39 aa, Homo sapiens
VVDVSSAGAVSISLIAYVLHGCAQVNSDSPAVLELGISR

SEQ ID NO: 1004300 - protein, 89 aa, Homo sapiens
RYYPLKFMTEAEQQQLIEDHFLFETLVTPEILLLGMARDWPDARGIWHNDNQTSLAGDNEEDHLRVISMQKGGNMKEVFTRFCTDLTQI

SEQ ID NO: 1004301 - protein, 97 aa, Homo sapiens
TLEIPDSALIPENLSRKSVQINPLFTQHWGSRSTVSQCSCTECVSASEELPRPSKEQDFSYLNIPFLPEPFFSKAEPKARDLGGATPTFNNAPNQGQ

SEQ ID NO: 1004302 - protein, 105 aa, Homo sapiens
CAGGGYSQVWRSWGRAAELQGGRSRSWKGDRGEALSLEGGRGEALSLEGGRGEGLSLEGGRGEGLSLEGGRGEGLSLEGGRGEGLSLGRGQRRGSEPGRSEKERL

SEQ ID NO: 1004303 - protein, 38 aa, Homo sapiens
MRSRGGHPIQYRRMDINDRKNIDLSQFTRGGYIMPGTY

SEQ ID NO: 1004304 - protein, 37 aa, Homo sapiens
MRSLFTRALIIWHPNCPCIHPCTSICGAHRIIQALSH

SEQ ID NO: 1004305 - protein, 36 aa, Homo sapiens
MLRSVSDCPRLAQHLLQQVRSLGAGPWKQLSEILPG

SEQ ID NO: 1004306 - protein, 69 aa, Homo sapiens
LWDGGPHYSFDGKTYTFRVDCYYVCNGDHNDSYAPLASMPPCSTDQQTCLKTVVLLADKKKNVVVFKVR

SEQ ID NO: 1004307 - protein, 72 aa, Homo sapiens
RALNNLHPQHVLPCLSYYECVNPVIAVLISLSSGMPNHSASIQLCVQKYTDIDRGFRSELEVPGAAGNDQDP

SEQ ID NO: 1004308 - protein, 59 aa, Homo sapiens
GQRQGWGHVLQAHLVSAFHSTNAVSVFSLLSTIRACTPGTLTLVPLATSRCLGGQVETK

SEQ ID NO: 1004309 - protein, 49 aa, Homo sapiens
RGSPVLWDGGSHISTSDGKTYTFHGGLLLCPRQGVTTTIPNALSEGELA

SEQ ID NO: 1004310 - protein, 54 aa, Homo sapiens
RVRLALEGEKRHHINKVHQGTQCLFIHHQGRRPHTGKPPLNTQLLKDPQSAILL

SEQ ID NO: 1004311 - protein, 131 aa, Homo sapiens
TLLDGDCTPAEAPVDMIVPEYVRDLWSQRSENTLSSYRCTPACDPGYQPTPGGACQDVNECETLQGVCGAARCENVEGSFLCVCPNSPEEFEPMSGCCVPARTSAGTYPCSQPQAPASPVLPARPPPAPLP

SEQ ID NO: 1004312 - protein, 98 aa, Homo sapiens
LLEKITYEIPEVGWIVLLGGFFGGDENEMKRMMSYSQTRMLPNVYFVLLEIYSFYALVEEAYFLAEYYYEEMAAFLGLAAFQVNTILIEIYGAVPKHR

SEQ ID NO: 1004313 - protein, 49 aa, Homo sapiens
QVVSMSRESQHIPTAEGASVIKHGYEEIRMELSPDTHTQAAWAWKKYLV

SEQ ID NO: 1004314 - protein, 62 aa, Homo sapiens
TTFFLICSRNHSSLPINGLSRGCLRPRGRRRATLRCPGARACALYAEGLRFRAWAPAPLPGQ

SEQ ID NO: 1004315 - protein, 106 aa, Homo sapiens
SLLPLYTSVLLETRRLTHQFRPMKTQRYPAVHKTGLSEKSTTFYSEPQITRHNTLTCPHDKAQASVKNPPPPTADQAQHTQQHSLAVPPCQASVRNLQLPTAAIAL

SEQ ID NO: 1004316 - protein, 81 aa, Homo sapiens
PYSNLTQHPAAIPDWGYVEDKQRDEDLPQERGRIYETNSTPIHIRSQLSPMDPTSPSYNSHGLQPSPNINQSKSRIEYKAI

SEQ ID NO: 1004317 - protein, 59 aa, Homo sapiens
GQIVLSLTCEVLAARLSSSAAVLSVGSFRSSQPVLGSLDFTIFFLALAPVILPLTGDSV

SEQ ID NO: 1004318 - protein, 77 aa, Homo sapiens
RCNSRYVYDSLLTPAMSCAGFLQGDVDSCQGDRGGPLDTSKNKIRRLIGDDKLRCWLSESLQTTSVRECDLIHGLDV

SEQ ID NO: 1004319 - protein, 97 aa, Homo sapiens
NTTDRLTSDAVNALVSCHHLHNIPFDLNRYNTAHIGSVIRMMMDELEANIHVPPPELQSDIIDITGLSANLYRAMAVLLKRVKELQAEQEDRCLKEF

SEQ ID NO: 1004320 - protein, 136 aa, Homo sapiens
MALRNPGTRIGQEPGMGSSAMSTVSGPTAHGRKAVYMYLAHVPLLIPHRLRDERTLQDAHRREVVICVTSAALPAGPGTPYTSIADRTQEKKLIRCDECNFGSTTQSHLTRHKRVHTGEKAYRYPLCRYRSNCCEN

SEQ ID NO: 1004321 - protein, 148 aa, Homo sapiens
MPAVDCRVEHQAGREVTYRCEQLPHGVPGMVLVTYINEVTTEIRVADSTRKPVLLDKNKSLQVALTSKQQSLETAMSFDDRKACCDVRNGFLMRKVAVFFSNTPTRASPQLREAVLKLSDAITLFLTRQEDRQLINAFADNNTAVGHA

SEQ ID NO: 1004322 - protein, 119 aa, Homo sapiens
MRNALPGGTLNSWLHAPILKGTLLSVCGGSVPLAEEQQLGHCPPRSLSFSWKWQQWAYPVQGQCWSLWDVGCYSKTRIRLIGFKELLAGNWNLLVTTTGAEYPTIPRLINTVSVPAVLL

SEQ ID NO: 1004323 - protein, 81 aa, Homo sapiens
MHAWGMHAGGMHAGMHAGMHAGMHAQHAFMRRMQAGMHRAHAGSPCMRRMHRIKGMQWRPCMHSQGMQWGACHCSAQHCHA

SEQ ID NO: 1004324 - protein, 90 aa, Homo sapiens
MVRSPPPAVCSVYGTSALSSERSQSPSRITSYPDHLFIFAVCILSDVLWLLQLHLLQVPSSPHTFMGRFSMTFIPLSLSSDAFSASSSFC

SEQ ID NO: 1004325 - protein, 39 aa, Homo sapiens
TLEERMTFCSADLLLVSLLYLTALITVLIYLHKHLFVSC

SEQ ID NO: 1004326 - protein, 83 aa, Homo sapiens
MPDKQGRCCLKVQVTIMHRLGSPGTRARAAGGDQHYLPTTLPTSATSLASDSTFDSGQGLLTVYSRLAEASQAELVMLFFPFA

SEQ ID NO: 1004327 - protein, 36 aa, Homo sapiens
ESSRLLLSSGVMQVRGLQQPKRMRGVSFGFQECHCG

SEQ ID NO: 1004328 - protein, 93 aa, Homo sapiens
ARLLHEMDGGVTVQVQITICWRWRANDCTAERSRSEQEAREKQAAPSLLKQKDKKLKEILLQVEDERKMGEQYKEQAEKGNASVKQLFEAAGG

SEQ ID NO: 1004329 - protein, 35 aa, Homo sapiens
MHVCRCVVVCYHMESSEICSTLCILENRKEFSFLR

SEQ ID NO: 1004330 - protein, 57 aa, Homo sapiens
QIFPGQSGEQWTLHAYASDFALWKAAPRRCSGPLPVGPWDGWAGTSECSAIASMVFW

SEQ ID NO: 1004331 - protein, 32 aa, Homo sapiens
MAYQCYTYTFLVQLNAVGTPVVSTLCLGLACD

SEQ ID NO: 1004332 - protein, 39 aa, Homo sapiens
HLPDKAGESRSADGRFKHGPLWANHSGACLKRKRISRVR

SEQ ID NO: 1004333 - protein, 77 aa, Homo sapiens
TTSTQTYSDMTIRPSPPPDESDMPEGRSEPPGMCEQSLTGKPTDPNWNAKKLKIPRPRPCSSLNFSISGVLRAATSF

SEQ ID NO: 1004334 - protein, 42 aa, Homo sapiens
YDFVSGLYDETGGPLMRYSTPPCPAGAGAPFISVGYVDDTQF

SEQ ID NO: 1004335 - protein, 55 aa, Homo sapiens
PLVLATFTGLLVFGGNMDAQTVQTQNWKSRWSELCYVPPSSMTFILLPSETKLAM

SEQ ID NO: 1004336 - protein, 37 aa, Homo sapiens
MANGCLVITEDEVALRRVPSISIRKYVIACFRVVENP

SEQ ID NO: 1004337 - protein, 44 aa, Homo sapiens
ATEDRSYTKRDDDAPGCCITHFCKVYERGEYFWEVRAVHGEGLS

SEQ ID NO: 1004338 - protein, 33 aa, Homo sapiens
MCGKSRRSKVLAMMLAVATVDFSKNITKLKTSC

SEQ ID NO: 1004339 - protein, 35 aa, Homo sapiens
HLCGKRSRRSTGAAMMLAVATVDFRKNINKLKTSC

SEQ ID NO: 1004340 - protein, 60 aa, Homo sapiens
DLHSHGCGLRKQNMLWQDNGIGEEDERHSGALSLLKNHIDNGYDVASARNDPVSNSTLHD

SEQ ID NO: 1004341 - protein, 53 aa, Homo sapiens
MPGSFVPTDTAITTSQDLQWLVQPTLISYMAQSQGQTLTCQPPDVDPYDMPVT

SEQ ID NO: 1004342 - protein, 61 aa, Homo sapiens
TRRELLKKVVDFSLRPAVVVLPGNAVVSDEPELMRDIVDSPPRADVAEPDEKSAALAAPVL

SEQ ID NO: 1004343 - protein, 61 aa, Homo sapiens
VGVGVGVTVVVVLMGVEVAVCVPLAVVLDVTVACVLMGVDVAVCVPVAVVLGVTVVCALMG

SEQ ID NO: 1004344 - protein, 95 aa, Homo sapiens
GQDLPERILPHLASFNPAFFLPPGWDCPPPPGEAEIDALYQAQYGTQHRVPGPPWTTWQGDPLTPEFIKPTMDLASPEAAPAAPTALPSFSTFMD

SEQ ID NO: 1004345 - protein, 121 aa, Homo sapiens
MTRDGWIGSANETRRGHYSEEPGASGADQCGFHSGGLRLQRGLGRAECPPLNTGPPRQRLDLRKPHCLNMSKNPGLPEGKDHSSGKQNGSGPAQSLANTGQQQRKASGPAQSLANAGQQQR

SEQ ID NO: 1004346 - protein, 94 aa, Homo sapiens
NASGRCRGPPGPKHLDDDEDLYESSIHTSERAWSLSMIFEGKLRRRKPDPRRASSPLWKDEGRWEHDKFREDEQAPKSRQELIALYGYDIRSAH

SEQ ID NO: 1004347 - protein, 108 aa, Homo sapiens
STRSPPGVSWLRAPGHLLTSSLSLRSLLQLVRPPLFLNDFYGGLLLRRFSHSFLYPTCRGLSLLYTRPVSFCPLLSAHPPGWLLSTPAASSAKRGPARVGAPLVRKLR

SEQ ID NO: 1004348 - protein, 92 aa, Homo sapiens
MSVDIITQPSGCKRVTHQSCELHAEMGLPDHNCNSFSVAPTRPPHPSLRAPKAPDATCCHGRHEFTYALMPHKGECWGRWGLPAALDTSLPF

SEQ ID NO: 1004349 - protein, 42 aa, Homo sapiens
MVAGGTVRYQRGQQKVLALAHCVSDWHSFHLLLLKRVERRLE

SEQ ID NO: 1004350 - protein, 63 aa, Homo sapiens
PTMVLSGQLSVVAWGTVVAFKCRCDGQWYSSSLVAEVRRHSQRCISRLELVGIITRGTSSIVS

SEQ ID NO: 1004351 - protein, 37 aa, Homo sapiens
MPLHRRPAREPRVMQRIAVQSADVPFADPPYQAGGHE

SEQ ID NO: 1004352 - protein, 63 aa, Homo sapiens
RGQRLERGEAGVPAEFSIWTREAGAGGLSIAVEGPSKAEITFDDHKNGSCGVSYIAPDSGPRG

SEQ ID NO: 1004353 - protein, 59 aa, Homo sapiens
SEDPRGLLLLDDIFATYPAAPGPRLAALFPGDVNRLRRMSVIEEGDCKRIMIASYVVIG

SEQ ID NO: 1004354 - protein, 83 aa, Homo sapiens
AQLLDLSLLGPALSSSTAFFSHRHLLSPSWSLSSCCVAVLSSGGRSSWRELQQHSLVFPLYVRKKVGTSQWSASSRKLFLGGI

SEQ ID NO: 1004355 - protein, 40 aa, Homo sapiens
PQLLDIFRIATPHSLGSVWTIRVWQRTTNGLYALTCVPAS

SEQ ID NO: 1004356 - protein, 62 aa, Homo sapiens
TVGTLDLGGAHKKPERLAQPPKDLEARTGAGPLARGERLRRVDESSTPGANNVQVNALVHSM

SEQ ID NO: 1004357 - protein, 56 aa, Homo sapiens
MLCTHSGYRDPISTGFPRFPVHSLSDDGVVYRNFIFLEMSIELCLTSQNRRSTRVP

SEQ ID NO: 1004358 - protein, 54 aa, Homo sapiens
SWDTAAFLCQVVLSISEPATASINPSPASNLLPPQILTSKYRFKGLWQIDLAPL

SEQ ID NO: 1004359 - protein, 80 aa, Homo sapiens
MVGLPGNAVACVEPRRLRQAKDSSLTPELVVLYTRQCCDGDLVLLMKTLNHSHRHCRRLHAINKLESQSHMTESTSSKAV

SEQ ID NO: 1004360 - protein, 66 aa, Homo sapiens
LVAVSFPGKFAAAAGTPKDTRRPSPRLVTGGHPEVLSLGFYPAEITLTWQRDGEDQTQDTDLVETR

SEQ ID NO: 1004361 - protein, 52 aa, Homo sapiens
SVVAHCGDTVGGPIEVVRLYDGTVGTVPHPLGWPCKVPDGQPRQTVPFSTAS

SEQ ID NO: 1004362 - protein, 37 aa, Homo sapiens
SRVQDLPMQATHEHDALRQANARDDVNYRHQIQELRV

SEQ ID NO: 1004363 - protein, 36 aa, Homo sapiens
MSNVLTIGSWKLDSREGDVHMTLVDFLLRFSMTPRN

SEQ ID NO: 1004364 - protein, 34 aa, Homo sapiens
LPRNLRDINTGYISSRVVPLFTHDVHFVGRKRDY

SEQ ID NO: 1004365 - protein, 69 aa, Homo sapiens
SAAPGEYLKLEGEVGSKFTSIRYTSETRCNITPISPPSLPIIPPNMGPVHVNPPLLSQLYLLTSVTTKI

SEQ ID NO: 1004366 - protein, 94 aa, Homo sapiens
YTQKRRDKLMKATTARGTDPLWSWTFRKQAVSSPSKKVSFGCPVHYNIQNNLLGLSEALTVLTFLTYTHEKMGAAMLCVSYPNLWPPHFEFRDT

SEQ ID NO: 1004367 - protein, 49 aa, Homo sapiens
GQLSPGPWDDAVSTARDHVRVCGAWAAVGSCSIPDLRPGMRGTASGMLL

SEQ ID NO: 1004368 - protein, 118 aa, Homo sapiens
METHIDEDEVRSWADLRIRKSQYSVITRKLVEVMTKYNEAQVALPRTQHRANPAAARNYWQQDTPMSELEAHVGEWPTRPSSLLASLTHSIPSKPSVKLEGRHKDMVRLKSSIKAAHD

SEQ ID NO: 1004369 - protein, 30 aa, Homo sapiens
MSSQLLWAGSQAGGSRRSGDRDLSWLNTVV

SEQ ID NO: 1004370 - protein, 38 aa, Homo sapiens
NKKLLTHIIFPKIQNNNTLDHTANTQEFTPINRRGALK

SEQ ID NO: 1004371 - protein, 57 aa, Homo sapiens
NEQQNNIPWCTTRGHVGWSQVQCVNVLLLSPAEEQVLSCGKDVRQMCWRQCHYACHM

SEQ ID NO: 1004372 - protein, 52 aa, Homo sapiens
CSALFCCTPVFVSQSAVLNVMSELRLGCQGYFKRRYCLLTVAPFLVQPETHA

SEQ ID NO: 1004373 - protein, 102 aa, Homo sapiens
KPMTGSWYVMAGLPLWQLAVDGESTGIGASQAGLPCTHDTPEPQLFSFTAHNTYLAELYGLERSIKCQIWNRCSVIVAVIVHPLLRIQEKEIELWLQGCGPP

SEQ ID NO: 1004374 - protein, 93 aa, Homo sapiens
MISRQLIYTKAQSACAETNPSAVYAEVRTEVQRSVLTAVPQVGIPGTKNGALKGRPSKQWQCKHPGQQHSSPKANRSHFSSCMHSQACMQVCS

SEQ ID NO: 1004375 - protein, 137 aa, Homo sapiens
YRTFDSPLLSNQISFTELKFPSGSCSKSEYKGHAKGAARTHLRGDLTLHRPGVQGPGSPRHLSLGVIEAVSRVAPGTGEGASPCPRQSSPTAEEELQIFICADELRPSGGIGEGEGGEGQSLTQQSAYCVPGMVLRA

SEQ ID NO: 1004376 - protein, 72 aa, Homo sapiens
LTCHNSRAWNSLGDQLPTTPGHSEESATVHSSPDAMATTVLPAGSTPSVLVGDSTPSPISSGSMETKAVVGS

SEQ ID NO: 1004377 - protein, 65 aa, Homo sapiens
KRGREVGYEKDGGEEENTETEGGTPMAPRLVIQHFERAEGRADHPRGQEFQEPALANIGDTAHLV

SEQ ID NO: 1004378 - protein, 40 aa, Homo sapiens
AQNTELVSGQEDYCSVVTWLLWDAVDSSLRPEVVEPSYAV

SEQ ID NO: 1004379 - protein, 65 aa, Homo sapiens
DDVGCAGSSLTPELVVVAGESVASGDLGLVEKVVDFSLWPEVVELAGKCVVGVEPELMGEVVDSP

SEQ ID NO: 1004380 - protein, 175 aa, Homo sapiens
LYPPLPAVREQGAGPDVSKEGDAVLMRGARLWFRRLRPSHQDPGYFRGKAVEIQEITLIGAEHLWIPAALRNHGGAPGAFFPTLVPLGLGAGSWEPWLVGVGQSSGTGKNGRPGVQLQTLQEQDIRLVRLLRTPGEFGSPMTNLGALFGSLQETSLGGKEEYVATHLEHHRDHRT

SEQ ID NO: 1004381 - protein, 121 aa, Homo sapiens
LLRPSLAGVLERERPMRLAGVLERERPRLAGVLERERTRLAGVLEETCHFSCLAIYYETCAELTIAAYDLRLAGVLDRDLPLRTDVLDRTYAWWEFWIVISAWQVFYERDLPRRAGVLERD

SEQ ID NO: 1004382 - protein, 126 aa, Homo sapiens
PRIMEMNQVDSRINTDEDYDFTLSLCNGLNMNASLVPDGSRLNLVRNCIELKFCHPELYGGEYCVDPSPKGWQIGCYHGILLITGHTGRNMHKCQSFECSTDILVDRFYMSVNKHVWFGESMDGAF

SEQ ID NO: 1004383 - protein, 39 aa, Homo sapiens
LGLQAEATAPNITLFFALTQKGDKAQETALSFKLLACTC

SEQ ID NO: 1004384 - protein, 49 aa, Homo sapiens
MFIIQCYKYADRVVCSSDTLISYAVMTVLSPIEKAISKANRVVKSSLVV

SEQ ID NO: 1004385 - protein, 134 aa, Homo sapiens
VPPEALLLLNTTELPSFLSYLPQSSGLQAPRILYLIWLVVPLLQQLPYPPGACDYLAWRRMVFRRMVFAYGFSFNMILKFFSGFFFRTLRWIFLRGARKGSLDLWAFQDSAKICINHLVHGKIVVTLEEKRLYA

SEQ ID NO: 1004386 - protein, 60 aa, Homo sapiens
MSFLLFPCSECRSVCHSSSDWACVSQLMASINTTQKSLPARLLGNLWYCWLISNFNWDKE

SEQ ID NO: 1004387 - protein, 50 aa, Homo sapiens
ISRLCDCVLIPHYGLQYCGIYHCICVCLQLERHRCCRTLVVCDRTPRGCS

SEQ ID NO: 1004388 - protein, 47 aa, Homo sapiens
TLIMAKVVELQVDVLLAVATGLLWTGVDSSLRPKVVELAEKWVVGVE

SEQ ID NO: 1004389 - protein, 46 aa, Homo sapiens
LWLRLCSRASFRRLWHVDHEVQEIETILLNTVIARLCYNFDKIRLG

SEQ ID NO: 1004390 - protein, 38 aa, Homo sapiens
MSRCTHVLLVHRRGNLEEYSRAAPPATAFMEPLKVEQP

SEQ ID NO: 1004391 - protein, 43 aa, Homo sapiens
MRRREVRRGGSRGAPVRVGGQEGPGSNYGNPGRTQEKVNKAAK

SEQ ID NO: 1004392 - protein, 70 aa, Homo sapiens
RSALRGSGFDETGLAPLHEVFPHLRVPGPCRVEPCFISVGYVDGTQFVRFDSDAGESEDGAPGAVDRAEG

SEQ ID NO: 1004393 - protein, 90 aa, Homo sapiens
AWRDILEGLCTELPVNKQLRRIQEKLFSKYGPLSELHYPIDSLTKNTKGYCIQSPSCSPEHAVTGLLGGGTGRSFPGQGCSNGCYQSTIP

SEQ ID NO: 1004394 - protein, 85 aa, Homo sapiens
NPADRGQEKPRDVSSVELLRNNHQGIKVEIDARNDSFTSLHGTWEIPVGEKTGMHLRRVRKKLLQVDGRRGKKMSRQGGKDGVGK

SEQ ID NO: 1004395 - protein, 87 aa, Homo sapiens
LVDGSRLTFISGLKAYRLSKIPLWRKTVDGGNVGPASYNVEETLTTLRYNRAINIKNKPRVNEDPKDALLREFQEEIARLKAQLEKR

SEQ ID NO: 1004396 - protein, 40 aa, Homo sapiens
HSRDPLLVCSGRLFTSAKISETAYLQYLMVQARLVHFQVT

SEQ ID NO: 1004397 - protein, 46 aa, Homo sapiens
RVLLLAPTGLDQHHHSTGAHGRTLSRLGKGDEAIWFLKCPTVRTEQ

SEQ ID NO: 1004398 - protein, 37 aa, Homo sapiens
TTRTMYFTYLEIIPYHVTKDGVYVLDKAAKVDATAEY

SEQ ID NO: 1004399 - protein, 48 aa, Homo sapiens
CVVGDVCEARCHQAQEGQLDGHMAGSELLAPYSNWNPSDMLSQNQTCV

SEQ ID NO: 1004400 - protein, 64 aa, Homo sapiens
IRNESVIAHVDHGKPEVDRYPGVVRRAYISLGPGGGDLLSLDTRKDEQERCITIQVNCHLPYFY

SEQ ID NO: 1004401 - protein, 47 aa, Homo sapiens
LLRSTLTDSPAWWYGRYRRTELRLCVKVTLGRGGCNLPPSLSTAEAG

SEQ ID NO: 1004402 - protein, 74 aa, Homo sapiens
RFPVLLCLSLVPFRVTLSLCVPDACDADHHPACTLPPTSRKTWPLRMNEGGGGAWGPPAMESSTTIIQAFGSRT

SEQ ID NO: 1004403 - protein, 63 aa, Homo sapiens
LLVLLCLSCLARGLMGERDPAHWQRQDKQRQDKQRQDKQRQDKQMLLTENGKKEILRYQRQDS

SEQ ID NO: 1004404 - protein, 108 aa, Homo sapiens
SIDGTQSYCGSTPSVCGDRRLTIVQAQWKHRFPRSTTKPGLSEKSTTFYSSPRSPDTTHLPARMTSSGVSEESTTSHSRPGSTHTTAFPGSTTMPGLSQESTASHSSP

SEQ ID NO: 1004405 - protein, 41 aa, Homo sapiens
MCSAMHGQKKEGYFRLESFLLEFSQLQKNFISRFRSIGFID

SEQ ID NO: 1004406 - protein, 107 aa, Homo sapiens
MSPTFHIWEKWNQQFDAWLGVCRKHEAPEVQGPHTAQDPHMAASLSSTPGVCRALPSHTLPLGKAAQAAVGNRNPGEGRKSGGTRQPSAWLGTFWQTVSPHCFPASN

SEQ ID NO: 1004407 - protein, 112 aa, Homo sapiens
FVIRNMSVIAHVTMDLSKFDRLPGVQGGLIASAGPAETRFTDTRKHEQERCITINVNAISLFYELSENDLNFIKQSNFCAGFLINLIDSPGHVDFSSEVTAALRVTDDALMV

SEQ ID NO: 1004408 - protein, 78 aa, Homo sapiens
MEGSYQDMHCKVLHTCGLLAVLQAGLPFLPSLAFPDTTERPGSFLWHQPRPLAQLASPPTSSWGIRASVEDNGARERS

SEQ ID NO: 1004409 - protein, 44 aa, Homo sapiens
PLLVMLCHKGPEYQDNNVFSACPASAACLCLSCLCCLSLLVLPL

SEQ ID NO: 1004410 - protein, 125 aa, Homo sapiens
FLIIFYTESIIYMRAVPRAHRSGFSESWKTAATGFPEPVFDEALTEEQASKQQFVVKIWKRVPEPLRFGEGSYEEGRSANDLVVKLGKRIPGRSECNMVMKVAGGLACQPHGGGEQALCVEDPTP

SEQ ID NO: 1004411 - protein, 103 aa, Homo sapiens
TILSSHSSQPCLFRGDCCSMLGAGEMQCYFPSVLLSICGYVTQSDSCPPHSRRGGGQVNRQLDRVSRVKISEGRKPEVCAQPAEVWVGVSDRNDVPGEEPATE

SEQ ID NO: 1004412 - protein, 59 aa, Homo sapiens
IPIRRQKGLIQKFKSFIQLLVLCLCTSACIALWRKTTPFAGMDKDSWERYSPKGSKGMG

SEQ ID NO: 1004413 - protein, 50 aa, Homo sapiens
PYRRQKGGEGRVKRHRKEKMKRKEAVLNRVQDILERQTICETKGRAVRDE

SEQ ID NO: 1004414 - protein, 80 aa, Homo sapiens
MPLYSNLGNKNKIPSQKKKKNPKTLKSLPWGDYNLQKLCHGNSGTALTSVPLIMAAYLSTPIGLDYLSQGPICMEAPLRS

SEQ ID NO: 1004415 - protein, 52 aa, Homo sapiens
DKTTEGTDSRCCTLRAVTLTVRVRSFILEVSETKNPPIPGHNRTLVSKEVII

SEQ ID NO: 1004416 - protein, 74 aa, Homo sapiens
NAIRRQKEEVRSILMTDITRTHYCKNGTKGKSPPGFNHLPSGSISNIGDYKFNMRLERGQGTKPYYIQKRVYAK

SEQ ID NO: 1004417 - protein, 41 aa, Homo sapiens
AVLRSTVVEDVVWPHQFSSSCLKEERTMLEDIWVTLYELDN

SEQ ID NO: 1004418 - protein, 38 aa, Homo sapiens
LELVQWLTPVLGNFPITFACYGALFCLSASIIYPTTYV

SEQ ID NO: 1004419 - protein, 105 aa, Homo sapiens
DTELNYGRAERDTALELATGAGIITRACRIHEHLKNRASDLMNFDDPAGLQQDHPVDKLTIQGLKDFTPDKAPCSSIIKHPNGTQENILLNHTFKRDAELRWYRG

SEQ ID NO: 1004420 - protein, 40 aa, Homo sapiens
YTELDYGEGLSREHAALEPRHLVGCAIITKSFARIHETNL

SEQ ID NO: 1004421 - protein, 39 aa, Homo sapiens
LERAELVQWSKLSWCTSPYTYAAMRPLLLSGSSFTHHYV

SEQ ID NO: 1004422 - protein, 44 aa, Homo sapiens
LQYMAPEIIDQCPRGYGKAADIWSLELHCHMRWPHGLPPPIHAA

SEQ ID NO: 1004423 - protein, 38 aa, Homo sapiens
MQTLNPCALKPGAKSKSIIVSSRHRGNRVLKFVRNVPW

SEQ ID NO: 1004424 - protein, 69 aa, Homo sapiens
CTLLSNHAQIPAGDQVLVMPIMTDETSSITLDYFQVSLRSSPAIRDSAVCPRYSPTTPTFQLESVRGTP

SEQ ID NO: 1004425 - protein, 41 aa, Homo sapiens
PSFWWALVRRLADDIGELGALERHGLSPHLSARSIDQSPVL

SEQ ID NO: 1004426 - protein, 35 aa, Homo sapiens
SSRGTLQNTPTILAGVRSRHPGLTYKLTDRYMLTL

SEQ ID NO: 1004427 - protein, 70 aa, Homo sapiens
MLRTELELPQVLTEPDYVAQKLLLKRHQSMDNSKAVLVVAMGLLSPHLTMGPHSQLIVLVSSSELLRHSL

SEQ ID NO: 1004428 - protein, 34 aa, Homo sapiens
MGDMCLREGRINATVEAPAHSWLQDLHIHSRQEE

SEQ ID NO: 1004429 - protein, 73 aa, Homo sapiens
RVESRDWHYRKSLAQHIIPSSSLQERASTGILCTVHAPALNPILSPVFQKKSLMARSIIIATGKVACTCLFST

SEQ ID NO: 1004430 - protein, 65 aa, Homo sapiens
CNQHLGSPGVGRRTPGVVSTKEDPTVLARHSSSFSTTELLLQPLLLSSKTPMTDSHHEPLENLAG

SEQ ID NO: 1004431 - protein, 35 aa, Homo sapiens
VRGSCMDRLWGSKGCGIVLIESSAVASTRRLHIVQ

SEQ ID NO: 1004432 - protein, 57 aa, Homo sapiens
MARVTREHAALETRNLVGRAIITKSFARIHETNLKKQGLLPPEPSLTLAGLQQRFTL

SEQ ID NO: 1004433 - protein, 33 aa, Homo sapiens
VSCIGAGTAGASYQRSGTEVQVRPYTGCCSPAP

SEQ ID NO: 1004434 - protein, 79 aa, Homo sapiens
RGVVLIELVLGSWKRSIPVGLRAVVGLAHDRTSGDLADPVQLCVALHGHPLQGGQVQHRTASDVVVVVPAPVEIVVLCL

SEQ ID NO: 1004435 - protein, 75 aa, Homo sapiens
AGPAEQLELPPWRYMHKRLPKPAPTTFWYKLALMLSRILGDTILGIYIPYSNDILTDSPANFLESRLFSHSQISQ

SEQ ID NO: 1004436 - protein, 77 aa, Homo sapiens
SCPPGRSDCCEDTFLSSEAATVRELMDRALELEARCWVEDVPPQRLDEHCHRELAIDIIQISSQAHGKAEIITLDLG

SEQ ID NO: 1004437 - protein, 113 aa, Homo sapiens
PKLNFLKEKERNLSSWQCENANRFCFLTGYADSQTSHLHCQHSGPHLHQSPGCKQVHGYSQTIPLENRPPCTQNKNSAISYTYGTESAWTMEWATNMTKNTNQVAVDQLGGGP

SEQ ID NO: 1004438 - protein, 62 aa, Homo sapiens
SDLEDDTQIMFETFNTPAMYFAMQAVLSLYASGLYHMAVVIGLRVTGFTKICDHSTRGVDSS

SEQ ID NO: 1004439 - protein, 63 aa, Homo sapiens
YRRWPNGTVRGQLLRWSNRRTKKKKKTGRAKRRMQYNRRLVNDCAQLLVKNEGPQLPVAPSGG

SEQ ID NO: 1004440 - protein, 56 aa, Homo sapiens
NPAGRPLRPPWTAILPHSQDDPRRPPSGAPVYTYQFFNAHSPTQQPWYKYTTGSHR

SEQ ID NO: 1004441 - protein, 69 aa, Homo sapiens
MRSSLDVDHDLKLLLVSVTEKVLAAVILEALSDHHIYLEGTLLEDNSRHPRPCCPQKFSHEEIAIGPAV

SEQ ID NO: 1004442 - protein, 54 aa, Homo sapiens
QGVFQVDVVFTQSLCRHAASTFSVTYCQQHSSHGPHQEDLRLNDGTMPSVADTA

SEQ ID NO: 1004443 - protein, 46 aa, Homo sapiens
MAASTFSGTYWRRFRSWSPSGRISGSMMGTRPFCVGDTAIGPKRGV

SEQ ID NO: 1004444 - protein, 52 aa, Homo sapiens
GTISVHEISTSQVTVIFVFQPSRIAGITGSRNHTRANFCIFSRGGVWPLGQR

SEQ ID NO: 1004445 - protein, 45 aa, Homo sapiens
KVLCTIEATPTGCMRKLLNRHSGPPTPYAPPGIQMKVKHVRENSV

SEQ ID NO: 1004446 - protein, 74 aa, Homo sapiens
MEHPQILHVTTSSVATTGVSEELDNGADASDKAAHVAHTDVEEFATLNSRYTRIICEVHHPSRSNDNTVVLQHV

SEQ ID NO: 1004447 - protein, 30 aa, Homo sapiens
MTMMNLMVVVLSSSYLHSHSRQDRPPRHGQ

SEQ ID NO: 1004448 - protein, 65 aa, Homo sapiens
KHAKIHSQNESSQLQTPDYAKVKQPGSLERWLCPNRSLIKHRYECMTVTGNWYSINSHYHKELTA

SEQ ID NO: 1004449 - protein, 37 aa, Homo sapiens
GPHEEERDPHCWGVCHTQSPTTLNLPSSMVLTSSMVL

SEQ ID NO: 1004450 - protein, 72 aa, Homo sapiens
MFGSALQEVMGIRESATPSAAALGADTGSLSECAERSTVDQTEGHLQWSLCDIEDGDIALNAAEWTTWTGAH

SEQ ID NO: 1004451 - protein, 58 aa, Homo sapiens
MTWNVEIANYRKLLEGEESRITISSIQTYSDLNFRENSPAATGVLRVPYQAQTVLIND

SEQ ID NO: 1004452 - protein, 104 aa, Homo sapiens
CAGAFGTCSVPEGALLRIWTRRRAKDNPDHPQLQHPKAWAQGILDHDLVYGFGDLTFGIESYDLHLCQCLPSRVTSSISSGRRTELTSGQRTPVANSEGASREG

SEQ ID NO: 1004453 - protein, 151 aa, Homo sapiens
CVILEDPAMVLSVAQQGSSCRRAVITFGAFLIGALSTVHSGTSTRTRVPQQAGARVGGCPGLLGEQQEQPQHREHQEHPLLDQQHGIALAPGARPAGKTEQPAAGSTGVNSPWGASPPFDPRNCRLALGAIPFPASLSRGPCLRSAPTGFG

SEQ ID NO: 1004454 - protein, 91 aa, Homo sapiens
SCKTARNCRDLKFCHPELNEWRILGLIHVCDAIWCSDYVIVLGRSVGETAKACQLGIKEIFRKYRIAVLNVKTNIHVLSKPNVLLLSTRIC

SEQ ID NO: 1004455 - protein, 163 aa, Homo sapiens
GVSGKMDSTVSPLAPVSRRLVMLVCPPPPDSWSPVLQRWFDSASAHALKRRSRWWRYYRADDAQCGRDRDLDVDTTLKSEQQIENIRSPEDSRKNPAGTCRDLKMCHSDWKSGEYWIDPNQGCKLDAIKVFCNMETGETCVYPTQPSVQKNWYISKNPKDKRH

SEQ ID NO: 1004456 - protein, 51 aa, Homo sapiens
TGQHVHKPTLKVEQMIYEVCLIHHYSSDLWPTNYHFFKHLNNFAENTSTGY

SEQ ID NO: 1004457 - protein, 44 aa, Homo sapiens
SGMAFVSHCQRVSGGADCRLEKLTKYDDIKKVVKQASGGPPQCG

SEQ ID NO: 1004458 - protein, 33 aa, Homo sapiens
VMQIENLKEELAYLTRRTMRQEMNALGGQVSGE

SEQ ID NO: 1004459 - protein, 79 aa, Homo sapiens
VVVLYDAHEYSCCCASLLEEIDVISRGILRAIRTASLRVLTSGIFETQFPVDQVNFHMFDVGWQRDERRKVDPVLQRWG

SEQ ID NO: 1004460 - protein, 33 aa, Homo sapiens
MAISCSSRVFTSSNDLVLRGSCSIFNSVAWAQL

SEQ ID NO: 1004461 - protein, 56 aa, Homo sapiens
LWQLHEERLCVSSRLFSRAFMLSWDCSSISRFCVCAGVRDLALAALNQLAVGGHLA

SEQ ID NO: 1004462 - protein, 59 aa, Homo sapiens
DIGLVRRDSQTVLQAVHRIWITTLPSYAETLRLPAPCCAVLRVSHAEEEERVPPEDDEY

SEQ ID NO: 1004463 - protein, 97 aa, Homo sapiens
TELRVHRYAFSKQEGITPDTATCTNAPQASCQFSSSVVMCAAQSEMQAGASLATGQTVNATQASFKAHFIIFTIATAQCNRPIAKQFLTQQTHPAPT

SEQ ID NO: 1004464 - protein, 77 aa, Homo sapiens
MSATQTYKHKHTAAHTCTNTAHKQHTHMHTHKHTCTHTNTSTTHKHMQKHTYKQKHPCTHMHKHIHTITHKHTQTYA

SEQ ID NO: 1004465 - protein, 64 aa, Homo sapiens
TQEELIKADVGAAGWRVLSRSLVVITPHTLGVTRYTSTLEDEDETAMMRPNVVWSTCTDSGSLK

SEQ ID NO: 1004466 - protein, 70 aa, Homo sapiens
PVLYTCVVICIYHIRHHASSSSMIASNSSEYSICCTVNSTAHFWLPKIVCLWVGMPSLSILPLEPIAMLD

SEQ ID NO: 1004467 - protein, 34 aa, Homo sapiens
GTVSIDTERYWPRAVEAVNIKAGNSLPASQAQGS

SEQ ID NO: 1004468 - protein, 53 aa, Homo sapiens
SYQRRHSNTHSSHRQFLPSGSPEPLLLQVLDSSQMLPVSSSTSKAAQEILLFL

SEQ ID NO: 1004469 - protein, 44 aa, Homo sapiens
MEKQIQVISQKRQYRALQEISSDVHYRQVICLALAIPTCWDYRR

SEQ ID NO: 1004470 - protein, 39 aa, Homo sapiens
LYAVQGEEERRKEEEEWEEEEEEKEEKEKEKEKEKEKEK

SEQ ID NO: 1004471 - protein, 64 aa, Homo sapiens
MTRQTRQCYLFIRPRHIEFLSKAFPETLTTDCSLTSSIACMCAGPYELVGIYVVLAESVADPAL

SEQ ID NO: 1004472 - protein, 33 aa, Homo sapiens
MSSCWSGWLGQREMIPGGAYVCAPSEGTVGARN

SEQ ID NO: 1004473 - protein, 58 aa, Homo sapiens
IESYQFWSPLPAVTILMPNLVRTPDRHSALQPRTPGLKRSSSLSSRVAGTTGTRQRAG

SEQ ID NO: 1004474 - protein, 38 aa, Homo sapiens
AEEGSDQHDVPDGADGTNMHSARVSTPWSVDGSEWSEH

SEQ ID NO: 1004475 - protein, 40 aa, Homo sapiens
YLRRTRGGDERPASQVGGEINVEMDAAPGVTLSRILKEDA

SEQ ID NO: 1004476 - protein, 36 aa, Homo sapiens
YEAGADRPAVYPSYSPSRLVATGGLNCTSYGAAGNS

SEQ ID NO: 1004477 - protein, 105 aa, Homo sapiens
SSRTGYKSADVKQRWTQAIAPTAACAGRGCPPDSVQERTVTTRQVRTNVEEVPGWQGHTPPASRSTTTPAEESAYPAGPTQGRQDGSPPILPHSLRPSPASSSSS

SEQ ID NO: 1004478 - protein, 117 aa, Homo sapiens
MGRWSRTHTQCQVGQGTQPPSRQGTHYLDRRDAGWDVTCQWTCSGQAVRYMHQEDHSGNFSYEAGPSVRARRIRLFSKACDVTWKMLTPVESFHNSLAGELECPVLPQSLRLPPWSH

SEQ ID NO: 1004479 - protein, 46 aa, Homo sapiens
SVAGLEIELLPAQHESILECNLAETENRYCVKSQIQGLIGSVEEQL

SEQ ID NO: 1004480 - protein, 51 aa, Homo sapiens
AEVERRHCGETGAAAYLPPVWRPGELSLRGGLVDLLWDEIDLAILDLFHNG

SEQ ID NO: 1004481 - protein, 32 aa, Homo sapiens
MTYGLVCTVPEYGGARRKPVENWVDHDPRLNI

SEQ ID NO: 1004482 - protein, 51 aa, Homo sapiens
MHYALLRRGATDSVQTDGDTVSGYIVKGQDASHLSREQVTMTPAEDSATPA

SEQ ID NO: 1004483 - protein, 66 aa, Homo sapiens
MPCRAAKMAVWPVAPVRGSGRASQSAPIALPCHPYLAGPAPVALFSIAPSRAHTLVLELVRGSLRS

SEQ ID NO: 1004484 - protein, 135 aa, Homo sapiens
SRRSRYEEELTQLEALVGRDRASYEAGSAVAERLLMHLEEMQHTISTDEEKSAAVVNAIGLYMRHLVVLDQRVETRSLGRNFFRKTVMGNRLVGRSLPRPKKGLRRILDCGRWNRGEPQVPDFRDLKAEVDAEKP

SEQ ID NO: 1004485 - protein, 81 aa, Homo sapiens
WRRVAESQRVVLVACSREEMIAILYLFHNGTHLTGGPGSFLYCVTHLVEDAAQVHACGSVHLHIDLTTHLGSQGVQSPPRL

SEQ ID NO: 1004486 - protein, 43 aa, Homo sapiens
MLSSLCRAVIWVGRTEDSIRDNEDGMEVDTYKVAGQMRMQMLI

SEQ ID NO: 1004487 - protein, 42 aa, Homo sapiens
MVSKTRKEHLPEGQDLKSSWKKGLKGHPVSGEQQYQGYRSFE

SEQ ID NO: 1004488 - protein, 42 aa, Homo sapiens
YGSWVGAQRIRRVNFEYLKREHSLSKPYQCVVHRQFLTVESR

SEQ ID NO: 1004489 - protein, 58 aa, Homo sapiens
PDLIPGSGYYPMRYSHCTSILPSYQLFLYTADYVMIRAVTLSRTTIRQTEAAIGQEEE

SEQ ID NO: 1004490 - protein, 94 aa, Homo sapiens
TRLPVRRPVSHVGRHDNHALDDWTAGDWLPTPHVLTLCLTHLTLCTLPHRGYCVCWPEAADGCTPLAHPHAPLWDVPTDGVDSPMTCHRDCWTD

SEQ ID NO: 1004491 - protein, 74 aa, Homo sapiens
MVSQRKDSSYTEPEVALDRMEASIQEAKVMSTSHLTRMGTGHFGLWSSRENERKRIFQRCHISTQLHTAQLSQE

SEQ ID NO: 1004492 - protein, 68 aa, Homo sapiens
RIRIPVLGIRGKICLLAGTVADGCNPSTLGGEARGSRGQEIETILAEHGETPSPVKYKKLAVRGGGRL

SEQ ID NO: 1004493 - protein, 145 aa, Homo sapiens
WPQGCKNKLEGLEDALEKAKQDLAWLLKEYQELMNVKLALEVEIATYGKLLEGEECRLNGEGVGQVNISVVQSTVSSGYGGASGCRQWLQAWVEEAATPMAVGLGVGGGFSSSSGRAIGGWLSSVGGGKFHHQVHHHLLLQQEEL

SEQ ID NO: 1004494 - protein, 167 aa, Homo sapiens
LWALALIIIRGMVQICKGEEFWLEPKKALENFQEPDIGLVARAFLQGSLAYGGWNFLNYVTEELVDPYKNLPRAIFISIPRVTLVYVLANVAYVTARSPQERLASNAVAVTLGEKLLGVMAGIMPISVARSTLGGVKGSLFTSSRRFFAGAREGTFPVLWAMIHVKR

SEQ ID NO: 1004495 - protein, 134 aa, Homo sapiens
PYFYDASPGIYEAWMWVGKRQLEFTRTVAGSARLRILRGSLVFPCVSVCVKKAAAHEITFLSSSYRSSTEGAPHAPKDVGPRTLGKKALPPSSLKIFLQTVDGARVHGCQGLLCARDWIIMRRRTVLTRGRTPR

SEQ ID NO: 1004496 - protein, 65 aa, Homo sapiens
SHELLAVVAAVHHHGVREALHNGTLSLAEACGGIPPWTVRQVLGILLLQCNVILRGNALICHHRC

SEQ ID NO: 1004497 - protein, 90 aa, Homo sapiens
SVPVRMFPGDSCRYQLNWKLSMAYSSDGYPCQAHLSMSNVLSLFVCLFCEFVCLETEFGSVAQAVVQWHDLSSLQTPPPGYKRFSCLSLL

SEQ ID NO: 1004498 - protein, 65 aa, Homo sapiens
MYCMCVYNNRKSPWQGGPVLAEFGCHLVRQLEDLRVVQVLGVIHRCGSRCCSVSGVVTAYKENEV

SEQ ID NO: 1004499 - protein, 62 aa, Homo sapiens
MDGWLVSNEPWFPVNSIWVQPLPDEAVKRGLKWFYLEAAVYSGKAGLKRQYVVPSWLRGVPS

SEQ ID NO: 1004500 - protein, 105 aa, Homo sapiens
MIRIELVYRFRHVPQCKITKFFCLVFVFVFVLEMESGSVTQAGVQWRDLGLLQPISQVQTILLPQPPEYWDYRGMLPCVANFYIFICLRRRFSVVAQDGVQWHNL

SEQ ID NO: 1004501 - protein, 51 aa, Homo sapiens
MYQEPSLYRVPEASPSSPPAPGNVVPGREVPGTPSEPATTTTGFPAGSEGY

SEQ ID NO: 1004502 - protein, 104 aa, Homo sapiens
SSVPVRMSQAECSGIPAPASLPPRFKRFSCLGLLSIWDYMTCIPCSANFCIFSRDGVHHIGQAGLELLTSGDPPALPSQSGGITVMSHRSCPEPAFLLIYSGGE

SEQ ID NO: 1004503 - protein, 110 aa, Homo sapiens
MFREELWIGFQVPSTPSGLGARCLHHLSKGYHHPSNLQSQKPVYHPGFLFYGPSSPPSTSTFKRIWSIFSVSTTIILGQLRHRDFNISLRTGSVVSTPGTSQVAGITDAR

SEQ ID NO: 1004504 - protein, 108 aa, Homo sapiens
MYVALGRYRVCGTILSSTVYLILPTLTDSSLSFKSQLEMILPQKAGPPERGKVLLMCVAYYSSFVAFNRYWFILYLLSDCSGLGTGLGLSISEMRAVVPGAHGTYQSK

SEQ ID NO: 1004505 - protein, 173 aa, Homo sapiens
SEQAGITTKLTYFIQFLPSLSQVFTPSPRGLSGRSQLLYHQAQIAGGLSLLHSGITYRLTNLTGVLPGLPQVLALSPQFSFSYSEYFSRFQRESVPGTHDTPPRSPISRTQVFTPQPSGTLRSLSAILQPSPDISGSQLPTPRSYRRNSQNLRAPSPISLTQVITPQAQGLSC

SEQ ID NO: 1004506 - protein, 34 aa, Homo sapiens
GKMAEFRRERAYQKQPDHLSKQEEGPAGRNWARR

SEQ ID NO: 1004507 - protein, 147 aa, Homo sapiens
GVVRIPGADECQVALEVEIATYRKLLEELRNADSVEKELDHVNFSVCHNAVFPRGYGRWHVANGVWPRLEVLAGGLGWRSCRELASGSYYSSSSGGVGLGGGLRVGGSGFSASSVRGLGVGFGSGGGSSSSVKFVSTISSSRKSFKS

SEQ ID NO: 1004508 - protein, 106 aa, Homo sapiens
LRIACPSSPSELCFPSFLGGSPHCSGSVHPILWDAGAPAVILADRCQDIPTPKKEPCSPVRMMGSSPSAGTCRPHAGSRNDRVSGSEGIFIRDLFLGLVSMGKPGI

SEQ ID NO: 1004509 - protein, 54 aa, Homo sapiens
RPFPEGKGVEDVGIESREEGRVSGYACDPSTLGGRDRRITLGLDFETSLAYMAK

SEQ ID NO: 1004510 - protein, 38 aa, Homo sapiens
VIKGEEISVVPNRGLDAQVPRHPGCPGWKPVPVMWGGA

SEQ ID NO: 1004511 - protein, 64 aa, Homo sapiens
CLVDEHTDTDKLPDAISTVNQQVIITAQCQPNYRHAHQGKVKKSKMELGKSYSACVPETSSLAS

SEQ ID NO: 1004512 - protein, 88 aa, Homo sapiens
ACTRVASSNAATFTLSLCPGGGEKVCECSPMTGRVSLLSCMTRGMNPESQESAPLTMVHQVMVAPSPLWRWHLGPLYTGYKEPEVQGS

SEQ ID NO: 1004513 - protein, 102 aa, Homo sapiens
YLLKTLHASHLTQRKNQNVSPLLTQTFLSNHFSSAYSVLATLISRALPQTCQAHHSHPLSALVPYVWNVFSIDCYMVSSLRQIMQISAHMPAPQRPSLIILY

SEQ ID NO: 1004514 - protein, 150 aa, Homo sapiens
GSQRILHPASRISLPLIPEGLEGQSTEKASLVLTWETRIRSSGGRENGDEKRTRDLTCSAQPHALTKTCAFSTLMTRKGHGKGGGIGGVGAVARRVGATAWRMRGDGVTATHGSGAGVIREGGRQTRRKRNTQGFPGFCGTFQNSRIKKV

SEQ ID NO: 1004515 - protein, 35 aa, Homo sapiens
MSASRPDNPQFNTFLPQLGAEPLIRRTNGRAIYCY

SEQ ID NO: 1004516 - protein, 43 aa, Homo sapiens
HTLSWIVWLATWGPDGRLLRGYDQSAYEGKDYICPERGTCALW

SEQ ID NO: 1004517 - protein, 67 aa, Homo sapiens
ETGSLDLADNRTSRYKAGNRNGFISPRHFKDSRSYPVAYKHHIGPSDRTKRYIGTCILTTELFHVPS

SEQ ID NO: 1004518 - protein, 183 aa, Homo sapiens
GDGNGDAAGRGPPKEHVTHHPVSDHEATLRCWALGLLTRAEITLTGQGDGEDQTQDTELVETRPAGDGTFQKWAAGGGAFGKPVSQPTIPIGGIVAGLAVLAVLAVLELVGAVVMCRRKSSGGKGGSCSQIPRRQGVPFPESPSPDVERGVSEPREDVGLQTWGRTGACSGGITSSPEEGKDY

SEQ ID NO: 1004519 - protein, 95 aa, Homo sapiens
TSQLGLGTCYEDAWTRSSLRKQTYPGSLCFSCQGAVGDLVLFPFCMKHKPQGRGSRMRRAKARDLYLNSSTGEAGELRKHLYIVSAALDSRLAHP

SEQ ID NO: 1004520 - protein, 180 aa, Homo sapiens
DGVSEAICSGQTHTGGTPVAARVGPQVSGEAKGLVDGQIGLDHKDGGAGHLGLLEHVAPFPVQNPVDATDHLLVDTGSPQGRWAPGGVGNIKIWCLGPEGTGPKILTDITKGDRYFDPAKGKYRQVSHQPRREEAAQHLLPVDPGPHLQGVGCDHDFHERGDGTPDRENWTSNVDSEDKD

SEQ ID NO: 1004521 - protein, 54 aa, Homo sapiens
ARRLGLGRRTVDDAVLRSMLDARFQLVTHIEHLGGIGNAIAADLAGAQGTFHIF

SEQ ID NO: 1004522 - protein, 150 aa, Homo sapiens
ETGVSGESATLQPNTLHHRGGGGWHRRRSWSPFGPRIPWALSDNSYPSILPSHPRGGAAGWSLVSTWLGRWRPPSEQHPLSWFLGSLGIVTNPEVHNKNWRSQYPGKAFHFHLKSKRWRGVAAHSRNPSTWGVRGRRMAGGQELETLSNI

SEQ ID NO: 1004523 - protein, 58 aa, Homo sapiens
AEHWGWLSSVGGGVPPSCTTPTPPPAGRATSTEVLRQSQYHSSQAPLWLQRPLLRLAV

SEQ ID NO: 1004524 - protein, 33 aa, Homo sapiens
ILLYLGLLRSGQERKGQKLPAVWPPSTHHRWQQ

SEQ ID NO: 1004525 - protein, 73 aa, Homo sapiens
MRERLLKVVKGGAWENYLCKIRATVSVEVHSREGVIQKVWRRLRQADHLSPGAGDLPGHSETRLQGYRLDRRR

SEQ ID NO: 1004526 - protein, 57 aa, Homo sapiens
NQVYKSISSHDNLDSSLVASKPSSWGSNYSIVTLHLHKYPYQNPTSSREGADWRSIS

SEQ ID NO: 1004527 - protein, 49 aa, Homo sapiens
FSRYPCTDGAEAGTATPAGCLLALTPGIILGLAVADSGITYTLHVHGIL

SEQ ID NO: 1004528 - protein, 48 aa, Homo sapiens
IVTDEHGLLLKLRAYGPSGFSWNLEKDCSRHAENDMTGSGNSEDLGWK

SEQ ID NO: 1004529 - protein, 74 aa, Homo sapiens
LLNPITVPVEQPYLGRVAQGGLWSRWGGPESRVYTASDSLCGRGTSLGISVPQLPSCTRRWGKIRSVFFLSSSF

SEQ ID NO: 1004530 - protein, 39 aa, Homo sapiens
DRADRLLTHFVTATRLTLRYVSWDFPWLGPRSWDNSRDP

SEQ ID NO: 1004531 - protein, 83 aa, Homo sapiens
RLPFFGDGFLDGGRFVLVLYDELKKVIKGRGGSNTHTPEGNQENHVESSSVRTINLREIPVVFFSSRILPVDGRERLSKKGGP

SEQ ID NO: 1004532 - protein, 74 aa, Homo sapiens
DSREILSAPFFVSLLSALVRRIPFLGEEKSMVSGLASGEMLAKSSGKSVAIGHLSRETTFKRSRLPTLCRVITP

SEQ ID NO: 1004533 - protein, 76 aa, Homo sapiens
MSQKERARDTYPLVDKLQYNERNFIEIASLAAWSPGDVPHSGTEDRERGDPISKHLIINSQDRMGNGQGSRSPPPR

SEQ ID NO: 1004534 - protein, 102 aa, Homo sapiens
YLDECDKMLEQLDMRRDVTEGVRMTPHEKQAMMFSAILSKEVRPVCRKLMQDPMETLADDETKLTLPWAAGQYYAETDFTPTKNRKPPVTSLPCSLSSNPGG

SEQ ID NO: 1004535 - protein, 89 aa, Homo sapiens
MDLSAIKIEFSKEQQDEFKEAFLLLDRTGDSKITLSQVGDVLRARGTNPTNAEVRKVLGNPSNEELNAKKLELEQFLAMMQAISNNKDQ

SEQ ID NO: 1004536 - protein, 118 aa, Homo sapiens
VSRGSGGLFLNSNSSKPACFFYECLFQSCLLSFGGQWSPAGRTESNRTAHVHCLPKAIPHYSTTSLLTDGKTVSGQARWLMCVIPALGEAEGGGSLESRSLRPVWATWRNFITTKEEK

SEQ ID NO: 1004537 - protein, 38 aa, Homo sapiens
CARKQVESGSEAGLVVAETLRACVDADREYARRTLAVP

SEQ ID NO: 1004538 - protein, 75 aa, Homo sapiens
ETKMAMSRMEEYIADLYSAEPGEEEPAWVQTDEAALNMWVRLVDWRSHSGLGRDPLFGEPPVSGSVHLFSLITFP

SEQ ID NO: 1004539 - protein, 60 aa, Homo sapiens
MDQAPPILQTEKAVAEPLVSHIAAACHLGVQLVALEDLVEEVDVPGRQLEGLNLAQLVRE

SEQ ID NO: 1004540 - protein, 43 aa, Homo sapiens
SYYSLRGMQARLYSTFTYINPAQRPMYTPIADTSGVPSIPCRS

SEQ ID NO: 1004541 - protein, 49 aa, Homo sapiens
LLLGRERAGPQVSVWLIRSAQSRSQQVLPCVLECSDTDQPRVEAPPWPL

SEQ ID NO: 1004542 - protein, 40 aa, Homo sapiens
GPASRLLWKEMRLSYKVSGHKCQDSGCPGAVGGPLGEEHT

SEQ ID NO: 1004543 - protein, 90 aa, Homo sapiens
PVERLAAFELLASGGQKLSEDENLALNECGLCPLPSYLLVDMAVLEDIKAAWAEASEPALCAGTSGDTLETLEEREGSGVHPFKADFVGG

SEQ ID NO: 1004544 - protein, 93 aa, Homo sapiens
WGSFRVWGNSGLLLNQGERGLQDQVGSRPKYSPGSAGIRCQGLSRGSRSTPDPRRDLAPLEFCFPWELGSGPGASIYPGVASVLSGSGGTMHS

SEQ ID NO: 1004545 - protein, 103 aa, Homo sapiens
PFMAEEMGDGQRKDDPGNDLGTIILRFAIQDISGEETSAREGLLLGCQRKTAPYKKVKVQNFHISGKDGLAFQGPVIHRAQNQKRDGRMTRLRQGRPVSPTVN

SEQ ID NO: 1004546 - protein, 84 aa, Homo sapiens
HSGKYSRTSSGSPRGQDPVSARCMTRSPPAIWTQRKGKLRASEDPDSRKGAAMVGSKKDDTGEGILPQLVQSREHSSDEMAVRS

SEQ ID NO: 1004547 - protein, 74 aa, Homo sapiens
NPQLGLASRMQEQAGQLEEALQKDKQDIARLLREYQELMNTKLALDVEICHYTASCCEGERMQTHVESYYSMQQ

SEQ ID NO: 1004548 - protein, 130 aa, Homo sapiens
VLMLFRENQVCDNLTLDAATPGTATAHPQPSATACTEARAHHTEPTTKADTPTAAGVVASTATSGKTSTEAAAKTSTEATAIATATAISRGNTACDNRDVDWSNSFSTESAFLALQQLAVSGDLHVQGQL

SEQ ID NO: 1004549 - protein, 40 aa, Homo sapiens
WALTSGPSIRPSRRGSGRGLGFEGPGGEPIREMEPKGYRS

SEQ ID NO: 1004550 - protein, 34 aa, Homo sapiens
GVLHPEGSHSTPTSTIQESTTLVYTNVLGPEQPA

SEQ ID NO: 1004551 - protein, 103 aa, Homo sapiens
MWGDLEDPFDWNGCTPLQVFEDLQVQPLLAGIQTVDHLLIREFPGTESYASQMASEKRGHVQVATLGSGEKRRSQACNPASPNSLLTQHGVTGAGSSGDGHAG

SEQ ID NO: 1004552 - protein, 58 aa, Homo sapiens
RSELLDTAQQIVYRNVMLENYKNRVSVGYQLTKPDVILRVGDRETEPGGGEMKFTNKT

SEQ ID NO: 1004553 - protein, 44 aa, Homo sapiens
RYPENSPSVPTAGVHKCSSSMWQPRGAGCGVVVGQPVDLENEVI

SEQ ID NO: 1004554 - protein, 56 aa, Homo sapiens
SVPFIRKVFIEVWVKIEDLAEQPVTLIGPGVEVQQLAVIAQALRAVQHPEVAQVLV

SEQ ID NO: 1004555 - protein, 43 aa, Homo sapiens
MLDMCLTATQDARMLTVPHSNELLLRAYWSARVPLANFPCRSQ

SEQ ID NO: 1004556 - protein, 120 aa, Homo sapiens
LGLHSGAGLKEGSSLFRELGLSSSERISFRSWVPRECRGVEMCMSEEYGPKQQGTREGQVKARAATVDYVGLKGITHVHIHVDVHVKQRGQIEVHVLVAKAEEPVANVGWYSRLLGVIRV

SEQ ID NO: 1004557 - protein, 35 aa, Homo sapiens
MQIFVKTLTGRASPSKWSRGDTIENVKAKIQDNGG

SEQ ID NO: 1004558 - protein, 102 aa, Homo sapiens
MRFNFLIEDKASIWNKSGSVTHNGEQVTYFTGYGGVDMPTVIQAPGGIIHLQKEHYIMIFIKLGKGRSTSSQLGINGFQEYCARVCIITELNHGFIAVGFII

SEQ ID NO: 1004559 - protein, 114 aa, Homo sapiens
MSSDRIYTGGDWQGKSYLRKARNTTTEPQTLSNVPVAFIFACWPLSLGQMFECAGDAAEPMMTSVGPCTSNSSIRSASLRAKVTGQSHTLEVVRVGQGLPHISPMKQVGCVCVC

SEQ ID NO: 1004560 - protein, 35 aa, Homo sapiens
VNLQRSRNHRTGDQEERQDYINRDESEAAALDDEW

SEQ ID NO: 1004561 - protein, 71 aa, Homo sapiens
SSARHGFHESSEKGGLAQMNDSVEQSLGGVRGSQSIRVCQGKAQRYGAEVRIGGLRAMPSKLMPKMSGDGP

SEQ ID NO: 1004562 - protein, 68 aa, Homo sapiens
CAAHGKNPTDDIFRDLAINFSPHMVRTHGETRGPGASFIMASRYSSVGYFNEASISCNSSLSMKPSRV

SEQ ID NO: 1004563 - protein, 83 aa, Homo sapiens
MVVLQWAGLDYSPEKDKKGLSNCLEEAISEGLRVAALWKAVTGSRFLALEALPGGGGGGRQIGRGSWLAPRQGLSLAPALGQG

SEQ ID NO: 1004564 - protein, 174 aa, Homo sapiens
WGSISGSEKSTYLKVGARNKGGPGEPAYVDEPVNMSTPATVPDPPEKVKWRDRTANSIFLTWDPPKNEGGSGIKGYIVERCPGGSDKGVAGGEPVAETKREVTGLEEGKGYAYGVKALNRRGASKPSRPTEEIGAVDTQEAPEIFLEVKLLAGLTVKAGTKMELPATVTGKTEP

SEQ ID NO: 1004565 - protein, 120 aa, Homo sapiens
VQGLRGIEPRASGHKNNSLNWIYNGQGSSRRAAVSGTFGLLRSFQMDLCMGGPGVRGPETTRGSGVYAGRETPAHPASLPRHLPGHWEDAGHDRLLGFQMTPEDYEKLGFPGARELAKMF

SEQ ID NO: 1004566 - protein, 101 aa, Homo sapiens
GDGVLTFIRGCTGCDVGAGRGAFLRGYDQDAYEGKDYFALNEDLSSGTAADTAAQITQRKWEAARVAEQDRAYLEGLCVESLCRYLEKGKETLQRADPQKR

SEQ ID NO: 1004567 - protein, 102 aa, Homo sapiens
MARGLWVVCLLCVRCAAACPSRLRVYLRPPLHALAFQVGSRVLRLRGRLPVALGDLSRRVRGGPGAHILVQGDDLIAVVGELVIPGEEAPVRPQVAGKPLEG

SEQ ID NO: 1004568 - protein, 92 aa, Homo sapiens
VWPRLECRGEIWVTATSRVGTFWTTSLMGRGLSWANDRGSRERLSGPAPAPRSEPLTLEAGGENLVDRHRESPFTQKRGAKGWHHTGYIAGA

SEQ ID NO: 1004569 - protein, 65 aa, Homo sapiens
SRGPLWRLGSHTLPDDLGCDLGPGRGASFLLVITMFAYEGKDYFCPELRICAPWTCRGHVLAHDH

SEQ ID NO: 1004570 - protein, 87 aa, Homo sapiens
GRYRGGRRQGGSGCITGGEQEQERGEGATLLNSQISLQLIYYYKDRTKLFMSDLAGDPNTSHQASPPTRGDYISIGELEDKYPNHIR

SEQ ID NO: 1004571 - protein, 38 aa, Homo sapiens
RSNYPEDYGWTGARGALLRGHDQFAYEGKDYICPELRT

SEQ ID NO: 1004572 - protein, 81 aa, Homo sapiens
GLPFWARTERKSTGGGRCTFLSSSDTVLGFTGRCRWARKSIGSAGISFRSSSDRVLVLTFFPRRSGKSSGSTSGGGIASSG

SEQ ID NO: 1004573 - protein, 43 aa, Homo sapiens
CGDGFLGWCMGESTREQGRGMVFLSLMQVPPTAVLFPYGLGVG

SEQ ID NO: 1004574 - protein, 34 aa, Homo sapiens
MDGINGRLGHSKRNDQARHGAHTLSSQHLWEAEA

SEQ ID NO: 1004575 - protein, 133 aa, Homo sapiens
GAPFRYRRRGGSRSRSRPRPNLQKGREGTKNENEIGSGIGIRGTEIETGMGTEGTGTVNDPAYLRVEEKTLNLGRRETLRGMTRMTMVIRSLRPSHYPVEELRAKKRAEEEAEAKPKFPPKAEGEAEALKRRQ

SEQ ID NO: 1004576 - protein, 57 aa, Homo sapiens
QHKETRWSEAESGVWPIRGVTRGPVMGRAISWCRSRMPPVMGAQMGISRPVKGAQRG

SEQ ID NO: 1004577 - protein, 77 aa, Homo sapiens
DLKDPLGLHSGKTGFMESREREMELRGLAVEEERRRREQVEGRLQSESAGRQQLVEKEVKMREKQFSHGTTPGPGYL

SEQ ID NO: 1004578 - protein, 49 aa, Homo sapiens
GEYGLKGVQKGRIHKLVTGNALHNSLISPAPLGLRRWFSGEGDLKTKRV

SEQ ID NO: 1004579 - protein, 41 aa, Homo sapiens
LDGSPYHLVLVIRYWPPKPWEYSLGESGFSVWPGREPKGYR

SEQ ID NO: 1004580 - protein, 112 aa, Homo sapiens
GAPFEGRGREQEVDDSANQQDHRVSGGSHGESTAGRAPQRHHHMRPGDDHGEEETQGQQDPLSNYIKFRDGVKLDMVGYGGLGMPLTKWGQEEALYQALEDGDPDLQVYPGW

SEQ ID NO: 1004581 - protein, 49 aa, Homo sapiens
VERQDEVDLSKGYTEFPGISSRGGLPSSGDIRVASWPSIISPSIPEGSP

SEQ ID NO: 1004582 - protein, 167 aa, Homo sapiens
LGLSQVFTKIWHPTSEREHQVQRGLFRGCGSRRGMRPSSSCFPAKINLGGSGGMPSCVWDLGLDILKGVTRLHFESEGLTSQGSSRKICIPPLRGSTRCRVATSWMWSSEGVRPSSSCFPAKIKLCWVRRDAFLVLDLGLDILKGVTRLHFESEGLTSQGLHEDLHP

SEQ ID NO: 1004583 - protein, 72 aa, Homo sapiens
GGPLEGARRRRVMLSFTRPSLVTFTEKGLPGNVRVGKLDVDDVVAWLCGAVVTRHVPSSRSSGLMSTREGSP

SEQ ID NO: 1004584 - protein, 34 aa, Homo sapiens
FFLSSVPQHHGSSNRPVSLPPGKGSPNEVTASSQ

SEQ ID NO: 1004585 - protein, 30 aa, Homo sapiens
MDGPMEIGSGSVTQAAVQWRYPSGLQTQTL

SEQ ID NO: 1004586 - protein, 83 aa, Homo sapiens
AYTTPLGAYLSEALTLRLTPSTDAHTVTTPHGPFSSAHSLTLPLGYGVGFPISRRRPLLTVRGNTERPIGTLHDVHHYVLTRY

SEQ ID NO: 1004587 - protein, 69 aa, Homo sapiens
MAFTWGGGDDDLDGLGRGGVLDFTLGGEALEQLCLEGVLDFNSGSGDDSKQLGLCGVTDGSLWGLVMDP

SEQ ID NO: 1004588 - protein, 47 aa, Homo sapiens
KTADAEDIVNTALALDEKAIMTYVSMLLPCLFSELQKLLKLAANLDL

SEQ ID NO: 1004589 - protein, 183 aa, Homo sapiens
YIGGKRHVLGYGPGRSLCVSLSWWDSIFLFPEYFSAPQVHGVFCLQRRPGFHPRGHLRITYQGVPGTSRVPGTVSGAGDTGAGPHLTPLKLGNIMIHNPHTQTICKRGGTPWYRSPASGIISIWPDWFHQGLPTHSPQTLPIGAQIDWGVRVCVCVCVCEGVCVFQRQGLALSPRGEYRGEII

SEQ ID NO: 1004590 - protein, 48 aa, Homo sapiens
SAGRCIRLMDASSTLASDRKVIQCSGGHCAALVERVAMAALLMRTLLS

SEQ ID NO: 1004591 - protein, 41 aa, Homo sapiens
VRMFQEWNQEFVATELDFSKEKEELIHSRLTTKGLGLRTGS

SEQ ID NO: 1004592 - protein, 46 aa, Homo sapiens
MVDVSCDLLTHRSAVDCHYITCAIYGFYSSAEHMKGSCIQALHAYL

SEQ ID NO: 1004593 - protein, 42 aa, Homo sapiens
MSRLVRMFARLACTQCSPAQGNLHLLGSSNTPASPSYTSQVT

SEQ ID NO: 1004594 - protein, 163 aa, Homo sapiens
PPRRTQHMKTQGKAQNECCKSKESFILHAALLLTGRSRLPRCVEKESERRRSGLASKIAAVRQTVLDPGEEAGAPVGTDAIQNVLMVSGPESKGDPGPGIAKISVLIPGQELDLYVIPAPPSNQRFIPDIHLGPHLGPGMFLGHIHMHCLESIIHSLQEMSLP

SEQ ID NO: 1004595 - protein, 73 aa, Homo sapiens
DPRAGTQQGFPHFCLLPECCMRKAKESPCTGERQDEEMTPGRRGFGLVAAGVLALGVSGASRDLGEPGLRACR

SEQ ID NO: 1004596 - protein, 114 aa, Homo sapiens
SHPAGSQRCLGSLGSKLPNQPPSYLLAVAWRINVHLGFHIFSWSGARLSSNGAPFPASCCCRFQIWILFSTRALAASSSPVVSCSSMARASLGPVPLAGVSIKLCRDTWPASAP

SEQ ID NO: 1004597 - protein, 74 aa, Homo sapiens
GTQHLTTRADDSAPPVFRPRRDTEEIFISFLRRPPLRFLALCRIKPHAPPLVRVPVDGTQHLVIIVYSGDYQGI

SEQ ID NO: 1004598 - protein, 43 aa, Homo sapiens
MLKDAKNKREGLEDARQKGKQDLAGLLKEYQELMNVKLLDVEI

SEQ ID NO: 1004599 - protein, 106 aa, Homo sapiens
MAKVEKLKPLEVELRRLEDLSESMVNDLAYMKKREEEMRDTNESTNTRVLYFSIFPRFGLMGLATGQVFYRRRFFKAKKMDGVRKEAYSPPTWYLSQQNIAGTCRA

SEQ ID NO: 1004600 - protein, 140 aa, Homo sapiens
SELGKMAPIQVGGASAAPHAGTGACVSLALLQKAPPQLPTSGKFYLRRVWVSTSSVFRSWVLAIPLPGQCDLRRVEAQGPAPQGGLRVRDGVVGHMCLGGVRALQRLLPVLQVVCGATPGTCPPGRLSAARPQGRLPSLL

SEQ ID NO: 1004601 - protein, 101 aa, Homo sapiens
MGPGTLEEGLGSFVFGNLPPAVNGPGVHNIGPFRAGRHHHSTRNRVKGVGHQPGDGRHTRGNHPAHKKVHVLGVRQHPLGSIIDSEVGSSIDNDALDRDVE

SEQ ID NO: 1004602 - protein, 56 aa, Homo sapiens
LAWAKLCVIVNGFLVWKEAHVSTMVEKDTDGGGSGERVPKSHIWLDVINPFGDPLM

SEQ ID NO: 1004603 - protein, 109 aa, Homo sapiens
LEQAGGMMVGGVWSVTGPHCRSGILGLALPGPPVLVLILILARRLQAFIFRFIQVGQGAALELGADSESFLVWTGFGEGSPLLHGGRVRARPGPWSGLLAPLLGGHAWT

SEQ ID NO: 1004604 - protein, 71 aa, Homo sapiens
MGLTLWELEYTLPFRPWDFRIPGGGVSGRQDLHQPFRHRGGSKALGLRIISSAFRILRLGDWDGARPPVSR

SEQ ID NO: 1004605 - protein, 47 aa, Homo sapiens
MLTIIFCINTLCCSHRWSLSPLHGDSGVGLDEGVSELLKGELGELQS

SEQ ID NO: 1004606 - protein, 37 aa, Homo sapiens
YAKGCGVMVVANFFPKHVCHLPLLISFHMTILNGSIL

SEQ ID NO: 1004607 - protein, 48 aa, Homo sapiens
ERITCGPTLPHGDGMEPLNQKVFYDAAGTSLKDVPDLLLASRRCPMDT

SEQ ID NO: 1004608 - protein, 72 aa, Homo sapiens
LELEEEVSEWNRGLELYPGSNSRTTRGLQTFLGGQAGHDGPSTGECSQLVLLPQKLIVLAAIVTPFAPGHSE

SEQ ID NO: 1004609 - protein, 34 aa, Homo sapiens
RRRAELEKYDGEARTRTRVGGWGRLRQEMPLLGS

SEQ ID NO: 1004610 - protein, 40 aa, Homo sapiens
GFGKRLQQVLQNVYCVCGGEPQPASCLSRLLGKLPELRTL

SEQ ID NO: 1004611 - protein, 70 aa, Homo sapiens
MNMRKRRRRTEEEEEEEEEEEEEKERTARARSEEQEADARKDERGRGDFAEEAFLRRCSPTYSYNSVHIS

SEQ ID NO: 1004612 - protein, 47 aa, Homo sapiens
SVPRVSFSDPLHPGLKLSRRSSQYNNCFWMVTSRSSSVSIAPEWPGR

SEQ ID NO: 1004613 - protein, 56 aa, Homo sapiens
CCIYSSEPVYRGSEGGFSTVKKEEEDESYTPVQAASATDSQPSLARELFRQALQTS

SEQ ID NO: 1004614 - protein, 31 aa, Homo sapiens
MLPRLVSNSYAQAIHPPRPPISAGVIGKSHY

SEQ ID NO: 1004615 - protein, 65 aa, Homo sapiens
CKLLGDYLGLCRNGALQELSKRLDHRNYLLESPHRFSVADLQQHVYHCDLCTPRGFICQIGRSLL

SEQ ID NO: 1004616 - protein, 68 aa, Homo sapiens
RGPPRCMPSRCARVAAGVPVSWRSLRGERTYLSRVWRLVFGIMVLDFSLSMNELQRRLGPRGLVVLGF

SEQ ID NO: 1004617 - protein, 36 aa, Homo sapiens
LLYEDPRHEAADGQYFLYLFIYFEMESPSSRPGWSA

SEQ ID NO: 1004618 - protein, 52 aa, Homo sapiens
RHAAAAGDGMILAHHNLHLLGSSKFSCLSLQSAGIIGVSHHARPVPVFCIIL

SEQ ID NO: 1004619 - protein, 97 aa, Homo sapiens
DVSHFSGIVSIHEHTASFSLQWDVSIHELTAECLTSVDVSIHGLTAKLLTSVGCIYPRTHGRVSHFSGMYLSTNSRPSFSLQWDVSFHELTAAASCR

SEQ ID NO: 1004620 - protein, 66 aa, Homo sapiens
YESYLVVVLTLRIEYMSGGPHCLQDMAYHCGCKSYGPNEMVSYDGFGLVLKASLIVLQMYSHSWNK

SEQ ID NO: 1004621 - protein, 60 aa, Homo sapiens
MTIFCALSDSQSINGVAENRGGAGACRRESARAKKREIQRTGIASCPGGLHFAVIICTNS

SEQ ID NO: 1004622 - protein, 59 aa, Homo sapiens
ERDYVYPTRHALIKPESYKTGRCFVQELVDVVLISTYYRITQILQQHNSLWYGTRREEG

SEQ ID NO: 1004623 - protein, 77 aa, Homo sapiens
LALCREIATYRKLLEGCGVQAEWLKGVGQATISVVQYTVIQWLYVVQLVSAAGYRPEVEDSSYILLARWSLCVWQDG

SEQ ID NO: 1004624 - protein, 47 aa, Homo sapiens
LYCEKEQSNRDNKHPAEHVKTRLEQEIATYRRLLGGRGCPPRLQYKK

SEQ ID NO: 1004625 - protein, 104 aa, Homo sapiens
ETEEDVLISCRGTHLGGTNILTSRWNSTSIQGNSDGIYIINLQRHWEKLLLAARAIVAIENPADVSVISSRNTGQRAVLKLLHVTGATLIAGRFTPGTFNNQIQ

SEQ ID NO: 1004626 - protein, 56 aa, Homo sapiens
GDWRKTMDGMSGMERPEEDCLMPPVSDLTIEASLLCCALSSCFMLLLLAALANLKS

SEQ ID NO: 1004627 - protein, 114 aa, Homo sapiens
AVGRSPGPGGPPSTGSMVDVDVASDSHRPAGDMNAMGTVGHRALLPGFQLAAPGVRSRRTLAVCGTPCLQNWGLRGAQLDTGGNILQKVGSMWLYQCQAPYGMGLREVPTLAQT

SEQ ID NO: 1004628 - protein, 37 aa, Homo sapiens
LSKLGNPGGPMKDGMFTTCLRNLIWRWGISTASVVDG

SEQ ID NO: 1004629 - protein, 187 aa, Homo sapiens
RSPTVSSAEETKPVLTAARGAQAGSGKPVRSWAGSPARGAGFRSASAINKGDHRDLALGFFSGERVGFKVRYTFPENKCSIFKNPNGSTVDYGSQNNSWRIRLDSLIFGLWAKWPFNGYLNPWCTDALELGTWGECGVAVNGSSWPWLITVSGAQQAPLASFRDGSRCRPGLSVDLPHVEEPGLKWT

SEQ ID NO: 1004630 - protein, 47 aa, Homo sapiens
PREPTPTPGLSYSLTTSLLYNLAAPLTLPYYNTPSVYSTSHDYGSRV

SEQ ID NO: 1004631 - protein, 162 aa, Homo sapiens
LEGSGRAQNSPSTFEGGAVVNSLHRIITNSAWDGGPKMDAGYGHSVELRNMWGETFHNAGQGGGAHPAIGRAPSLTCKENVQVSLEESLPPHRRGRRPSSRQGKQLTTGEKCSSRVPRGPQAKHDLGNQPFRILRKQTGYTDMHGIRHSPDGTHAQTDTHTG

SEQ ID NO: 1004632 - protein, 62 aa, Homo sapiens
MDSSIRCGDGRSRRPEPLQTLDEARDGVSRVKVSDHEIRAGEWSQDRVSPQVLRGIIAGPML

SEQ ID NO: 1004633 - protein, 129 aa, Homo sapiens
GRGGFRHPAGWSLRLQAGQRRVGAILQLLLKSPDLARQLLHLLHVLPVAGRHACLHSRDLRLPGHQLAFSLWASRAGGFGPFLVAISWELPQVGSVATAASSGSGGQQFFLLFQRQNRHRVTLRRGLGG

SEQ ID NO: 1004634 - protein, 97 aa, Homo sapiens
PEGLTLMWRNVNKEIASQDSPGRNGQEKAANLKKDLAEMQEWMTQAEEEYWERDFEYKSPERRLRRAVDRRLPTGNRRMCCSRTVTREDSQETTSSY

SEQ ID NO: 1004635 - protein, 63 aa, Homo sapiens
MEFRDNPVLSPITDAPPSHGNDRVYICGVRVFGIDASGVVSQSFCGHYSTAEGTIGVDFCHHL

SEQ ID NO: 1004636 - protein, 81 aa, Homo sapiens
LSTAGGGVMVLLVHQGSQRLRDWKRLGPSHTASEDQSSFIVGGDSKLRALSTTPHQPGCHQKCSPKGRRRGFFFGGMHIGN

SEQ ID NO: 1004637 - protein, 49 aa, Homo sapiens
LQSSRCRSGSGPRGPSTIHTSLVFLPTTLAGKQAFQQSQVSSSRARVSR

SEQ ID NO: 1004638 - protein, 47 aa, Homo sapiens
SYSWCSPLLCSLAEVPDELAAGGCSGWTLSWTQCCAIWLVLGPHFFL

SEQ ID NO: 1004639 - protein, 148 aa, Homo sapiens
LGWQAAVPHLPPRCQEPEIHVREGRHGRSLKGGAVVYAVELSSQDSSPRQGLLQGGIPKEPLVRREELAVQQCDAWAHGELCGIKNGDRSHQTTPMSVQNYYLHLQDAVPVNRARIKTPLEIQEDEAAEVEAAVNYDGATAVKARQES

SEQ ID NO: 1004640 - protein, 106 aa, Homo sapiens
RRDDDNSADSRLWGGLDHPVPPLPPWLGTGDLCVSSSALKQSQFLLYHRRTNPFLIILSDPAVESAMIHPPPYSSTLYPAVHQEPAALSTLGSRRGIQPLLTRDIS

SEQ ID NO: 1004641 - protein, 37 aa, Homo sapiens
VSGVILLMQLTSQVQADPSSSAPQVAGTAGTVPPTPS

SEQ ID NO: 1004642 - protein, 176 aa, Homo sapiens
QPWHSLGADSVPANTENEVEPVDARPLLPTEELTTRPGSGLTNIKREEISEVKMDAEFRHDSGYEVHHQKWGSLAEDVGPNKGAIMLRGGGVVIATVIVITWVMLKKKQYTSIHQGGGQVDAVVTPEERHLSKMQQKGYDKSKPTSSLSRCRNRPPKQPLKWDSKSIVSLPIGVHS

SEQ ID NO: 1004643 - protein, 36 aa, Homo sapiens
VWLAGKVWQAVFTWQSQQQQAVQQGSRQLGIFGQSM

SEQ ID NO: 1004644 - protein, 109 aa, Homo sapiens
ETKPGSGGPGGSAKAKSRFLETSGVQVMVRPQPPKYLGITGLCHHAQLIGYNLGISRRDGGPPCGARRSQTRGPQVIGGPQPPKGVSLGTGSPILYKGQSFWSSRDRPA

SEQ ID NO: 1004645 - protein, 44 aa, Homo sapiens
ARYTYMGSSYYSRGGEGQVRGGEGYQITAEGKPNNLSGTITGYR

SEQ ID NO: 1004646 - protein, 110 aa, Homo sapiens
MTLLQLSGSHITFELLTHLNLWGPCSFDHVAQAKAQCWPNAWSAGESVVCSVEAPQSRCGQCCGPCRSGKTQGCRSGGQGQSPLGWNEPILRSFRESWPNMQIDWGDFEV

SEQ ID NO: 1004647 - protein, 63 aa, Homo sapiens
VAVGRIDSAGLLALHWAGLPAQPGAAQVGGGVVDGEALLGGTGLTCGEKVDPVYGPPRELCGL

SEQ ID NO: 1004648 - protein, 48 aa, Homo sapiens
ARLLPYKDIGRCTELKFEGRGWQEKRATSMYRQNLGAHSMDTSDSDDK

SEQ ID NO: 1004649 - protein, 78 aa, Homo sapiens
NLSRTLARLSYWASCQQGTGSLFLGYGSNTFGRGCQPLQASHPQIIIFVLTGGLVFEASLQIPAEPGDGRALMWAAAF

SEQ ID NO: 1004650 - protein, 124 aa, Homo sapiens
AYLDEGHLTQSGQKDMVLYGSQIFLGSVPNRETCEYITSDIGKASELGLRISTSMMEKTCWSSGRPKSKHRLMPLPGRCGFSTLETKLVDMVYLSKQVSLFGQVVVTEWDWAEIPESATCGRSW

SEQ ID NO: 1004651 - protein, 44 aa, Homo sapiens
TAHLVIPAREEKPFQHPPQHITGQHGGGVGATPSARTCKIILPL

SEQ ID NO: 1004652 - protein, 52 aa, Homo sapiens
LTSGYSSVSSMVLLIKTSFKCKCQDNNNNNNSNNHHHPVHCASGPQRFSRWS

SEQ ID NO: 1004653 - protein, 38 aa, Homo sapiens
LSQDVVQMYLYIFKHWHSHTVEDEKSSETDSKNSGIGM

SEQ ID NO: 1004654 - protein, 104 aa, Homo sapiens
ALYRHFIQLLLSRTFHPAPPLQGHFIQLLLDRHISSSSSSTETFHPAPPLGTRFIQLLLYGHISSSSSSRDTFHPAPPRRGHFIQLLLYGDIPPSSSSTGRVPS

SEQ ID NO: 1004655 - protein, 44 aa, Homo sapiens
MYKKMSFSYRLTTSIRQSVDPGVNWNRSLIKETPFERLGRLYRG

SEQ ID NO: 1004656 - protein, 99 aa, Homo sapiens
SGASWGQGGASEATLLNMLNISPFSLGRVIQQGFDKGSIYNPEGLDITEETLHSRFREGVRKVARVCLQMGYPTVASVPHSIIKGYKRVLAWSVETDYT

SEQ ID NO: 1004657 - protein, 156 aa, Homo sapiens
IRRQRETWRAVYGECQDVLVNGCIQHKGLVFIFYFSILFPSQGVQDTQSHGISQVSENSSSGDSQRIQNCSRSSLWLSLSLSMHLVMVLRNLLNIRAVRSDSPLHTPTYFFLSKRGGADIGFTSATVPNMMVDMQSHSRVISHADCLTQISHLLRR

SEQ ID NO: 1004658 - protein, 94 aa, Homo sapiens
LSKRGKGRMPEASASGRLEPQAEQGEGARGRSTGVTHLSSGEPGLVPSSPAGADGGCLLSVPAGDKLKVISKATMELAYRCSRISVSGPKICHP

SEQ ID NO: 1004659 - protein, 63 aa, Homo sapiens
MVHKDERIESFTLRCSQPGDEARCHTGRKHEEHEHLLPSLKQDAKLPMTEQCGRHNLTDDGGT

SEQ ID NO: 1004660 - protein, 84 aa, Homo sapiens
GWGRLSQYGAETPYYIGVLSARLKSTDGVLILLVSLTLSNRQGREQNKYGLNSRDSIIKFCPPGPKDSGSPVLVSATDPGREPG

SEQ ID NO: 1004661 - protein, 80 aa, Homo sapiens
AGSLPHQSDGWSYRRGKYGHRERHQRVVHIKTWRTLHKGDHRQAKEKTASRPSPQSGTSSLHNTKKINICGGCYLVKGIW

SEQ ID NO: 1004662 - protein, 183 aa, Homo sapiens
WLHSGPNTSVVTGGIYLGSIMKGGAVAADGRIEPGDMWYMVSVPILGGGVDRGQGGVLPSVPCSFRGPFWVGGRLPDLPSGVPFSSSPAQLFIPVGVLSQVNEIKLENMSNDDAVRVRREMVHKPGYGWNGARGKGLGLTYTHPAFSRTPLFAGTITRDVAKCGDPSPGCCFTWARSKGMGDS

SEQ ID NO: 1004663 - protein, 150 aa, Homo sapiens
MEGRSGGKGDMEKAVGEKKARVCGKKKEERESIQSGTQIRIRAWLHTYRGEALKASVTSSVKGGGEGTGHLQPFSPSLAHKYGAPAVAPGSAPASSGAVIISPSYASSGEGGQAPRDLVYRPAARELLDAPEHFRVRQGGHNPLGNSSLS

SEQ ID NO: 1004664 - protein, 117 aa, Homo sapiens
MVLNFSIRDAVPGAILARRTSTIISAIQMEAKGIMGTAVPPGPTLINIFTRFSRWSNHPMVRVAISALTGVPSRQVNAISRTVTWNKTIRAIRVRYTVGSSEAWGAGTHMSGNTGSS

SEQ ID NO: 1004665 - protein, 89 aa, Homo sapiens
LEDPFGSIMCIMWKGQAGGSVAGAVHLRHDNRHIGLGCVLPAKRSMVFCVKASGSASWPTMQERGVPLSSSSSGCHAQLCWSQRKVVVP

SEQ ID NO: 1004666 - protein, 113 aa, Homo sapiens
MGSIRSSFLSLSYSISSGRCRWIRAWKARPSFQLMWKSAHGRSYRGLSFSGTREGALPGPRSLPGRCPGMANLGMRVQIIPRVILAWPATISSGRMETSLTPWRIKSSAWYTW

SEQ ID NO: 1004667 - protein, 87 aa, Homo sapiens
LVIRTLQFPFSGGHSQGKKETPGPLGKHTSPDAGLGPPSASLSKEQLEHRNSNLTGNPSTRGGQGGQVIGGQEYKTRVVKRAKAGLY

SEQ ID NO: 1004668 - protein, 33 aa, Homo sapiens
KSKLAFPSWGTLMCLKREMVLMYGAIWSSGTFF

SEQ ID NO: 1004669 - protein, 51 aa, Homo sapiens
LISLYHISRSLVSHIRDGPAIPSSSSSQTLGTVLTFFLPFTLKKPWFPKVL

SEQ ID NO: 1004670 - protein, 47 aa, Homo sapiens
MRGVAVPSSIFKTSRVTSSDLSDSDLGFGGQILLPLLQTLVVTRDPE

SEQ ID NO: 1004671 - protein, 129 aa, Homo sapiens
KDPWGSSSGTHYLHIGQGGGVAGCRERPGCTKGRGGRGYIKDGVTLLLTGGLRQGDHHSGGEGTGLQFGGEDHSILHLDRVNARVLRPQVWSRELIALPQPAQTGLGWVVEAIGDHLTILIQVNLALRI

SEQ ID NO: 1004672 - protein, 57 aa, Homo sapiens
GSPPWYTSRYEGRIHRPELMDLRSWTAGDTGGQITQRNVLECGPVGAVSSGRAYRGG

SEQ ID NO: 1004673 - protein, 58 aa, Homo sapiens
HEEAIRTHGVWSSVDFLSTSVGDDVVSTTTLSEEDLTGDPSRSRVDFLCQPASGNVHA

SEQ ID NO: 1004674 - protein, 41 aa, Homo sapiens
CGDWGLTPSRGLLGCELGPDGRLLRGYNQFAYDGATDYTRP

SEQ ID NO: 1004675 - protein, 38 aa, Homo sapiens
GGDGVWLVPRLGLELVGSSSPPTLAFESTGFIGVSPHT

SEQ ID NO: 1004676 - protein, 157 aa, Homo sapiens
VQDPGWVLVLEVDMVLECGAVSEFGFWGGAGGGLGSVVELCLECGFGDPGFLVCPLGGIQEVTVKPESLDSPQAENLSPAIQRVRTEEGEQIKTLNNKLGSFIDKVRVLQQNRVLDTKWTLLQEQGTKIVRQNLEPVFEQYINNLRRQLDSIGGERG

SEQ ID NO: 1004677 - protein, 49 aa, Homo sapiens
MDRGSGMCKAGLAGDDAPRAVFPRPGNPLIITTILSGLLSAAGGSKYRH

SEQ ID NO: 1004678 - protein, 116 aa, Homo sapiens
WSHHVGRLVSNSLTSGNPPASASQTTGDHRREPPCPAGWFGFWGQSHFYGPGLGVQRHDLGSLATSPSRVKRFSGLSLRGSWDYRHAPPRQSIFGILSRDRGLLHGGPGGSPPDFR

SEQ ID NO: 1004679 - protein, 124 aa, Homo sapiens
MWPRLVLNSGAQVLYRPGPLKVQRHELPRPAIIIIIWRQSLALSPRLECSGVIWAHGNLGIPASKGFSGLSLLSSRHYRRAPPCQANLVSEGETGFTRWARRVSNSRPQMIHQPRPPKGLRLQA

SEQ ID NO: 1004680 - protein, 100 aa, Homo sapiens
MSRSRQARPSKLVGREDVNKKQKNSQLRKRSRGANKIVASVKTLGPGKLRHLIQEGDVKKKTEPKPPVPVRSLLTRAGAARLIGDRTEVLQNPESLSGNG

SEQ ID NO: 1004681 - protein, 53 aa, Homo sapiens
LSGPWQALYLARLSPGLTPSQPGVTSVVHMVLQQLKAIMAASASVKSSQKAGS

SEQ ID NO: 1004682 - protein, 219 aa, Homo sapiens
SYLEDPLRSWDSLYWMAPSGVRVPRETHLPFVFKQMEQVAQFLRAAEDYGVIKTDMSQSVDLFEGKDLAAVQRTLMAWGSLAVTKIDGHQRGDPNGLMKKAQERRREFTESQLREGKHVVGLQMGSNRGASQAGMTGYGRPRQIISKSGEGSPEPGPPPVPWLQPSRLALLTHTRVVPSARAKLGGSVTEQRVTDLGSSSLCPQQANFLPDSFIALAPL

SEQ ID NO: 1004683 - protein, 182 aa, Homo sapiens
SKRGRGYKKLLLHRPEEGDGGHYNKWKPGSALVRAGPGLVVQSGTTALLVVTHRDMNEKELEAQEAGSAQLENHEREEEEEDGDGDRRERRVGAQMRSRRCGSSSEREGSEDEHFGQQSDREEGDWDEASDKSGCGEDESSEDEARAALDKEEILGSDADEEDADSDDEDRGPAQGGSDNDQ

SEQ ID NO: 1004684 - protein, 89 aa, Homo sapiens
CCVALEAPGATLGVLHIGTLGNLDQAGGDLSPIFPGKGRFKYLAIRERRNQAQKREVTGQGHVADKCGNQDFHSGLPTGGADTLPSWLG

SEQ ID NO: 1004685 - protein, 72 aa, Homo sapiens
AGITGVSHHVGLKTLLSFNLKDGLQVMTGTWGVGHAPLYLSSININTDFKSEEKHFTPYSLSGLQPEGFLGK

SEQ ID NO: 1004686 - protein, 93 aa, Homo sapiens
KDPRWETGVSGRSQMGSQGWTGPPPRGGGDSHGVSRGSHRAGPHGSPSQPEHGSPNSQPGLPQTPQKGASKGPPLAPWGKGLAGGRAWGHAGV

SEQ ID NO: 1004687 - protein, 124 aa, Homo sapiens
ETWSHQVGQRELELLTSKDPPPSASQRAGDYRSRKEGHRDRVQEKSGKLSRMPGKADTLEGKAPWRELRQQGQMHIPGRTSSVREEQMIPVFQDLVCTYLVNRPGSHRTQQFLRLSGRFLNPSG

SEQ ID NO: 1004688 - protein, 112 aa, Homo sapiens
RQRSRERLHMWRREGGSRVSWGVRARQRLLPVLQVSAEPLQARALQVGSPLLRLRGRLPLARGDLSRRVRGGPGAQILVQGDVILAVVGERVIPGEEAPVRPQVAAKHPRGG

SEQ ID NO: 1004689 - protein, 39 aa, Homo sapiens
ETVIVIWVRISNEVTKISGGAAVIVKGGEWEDGLQGWLT

SEQ ID NO: 1004690 - protein, 89 aa, Homo sapiens
IHQDYGATGAEGAPRGHEEFAYDGKDSHRPERGLSSWTAADTAVQITQRKWEAAGVAEQLRAYLEGLCVEWLRRYLETGKETLQRADPQ

SEQ ID NO: 1004691 - protein, 212 aa, Homo sapiens
ARHRSGSGGEYERSEEGDEPQYRDLPSTATSVNITVTGFRAENDMVNVYQISEDGEQSWIRSTSQTTAPDAPPDPTVDQVDDTSMVVRGSRPQAPITGYRIVYSPSVEGSSTELNLPETANSVTLRDWQPGVQYNITIYAVEENQESTPVVIQQESTGTPGSDTGASPRDLQFVEVTDVNGPIMVDPAENGVDRYRVDVIPVWLASTGRGCH

SEQ ID NO: 1004692 - protein, 152 aa, Homo sapiens
RGRGGLISQTTIEAKVSTGAYKALHYRSLYFSDLIYSGWWNNGMNYSLKQKNPSLTNRENYQKRNIPGVHLKDFGIRLSGGGVENWCMGGAGGLMPIISALKEAEADASHEPRSLRPAGATGQKAISTKNTKMSGVGGCTPAVPATQEAEVK

SEQ ID NO: 1004693 - protein, 196 aa, Homo sapiens
VSLCSRRIRGLVGSEPGARAAEKDQVWAPFYWRFSENRQKGGITWLLGWSTEDDGQGAHLSLCNQYTREVLQSLPLTEIIRHYQWLTEENIPENPWCFLYPRIPGDEALGCYYQEKFNLQEGRKYLKHRLMVVSNRRVDELEQPVELKPEPELESLELELGLVPEPELSLDLRALLKAGWIWGQTRVCGESLWACE

SEQ ID NO: 1004694 - protein, 133 aa, Homo sapiens
MANLTSRRLNPTRRKNLLAVTFPDIIRNYKVRAAENIPENPLKYRYPNMDKDQALGKYNSRPREAPEPRELDGPKGTGYIRTEWISVSEGYSEHRRVTCLQTSSQPGSGLGAWWKMVVFHFSMVMGIGITAEL

SEQ ID NO: 1004695 - protein, 187 aa, Homo sapiens
WETGVSLIHEDGTGWRRWGPGRGCLLRGYDQDAYEGKDYFALNEDLSSGTAADTAAQITQRKWEAARVAEQLRAYREGLCVESLRRYREKGKETLQRADPQKTHVTHHPISDHEVTLRVRGPVGFYRGEITWTGKGDGEDQSQDTELVETRPAGDRTFQKWAAVVVPSEEQRYTCHVQHEGLPKPLT

SEQ ID NO: 1004696 - protein, 133 aa, Homo sapiens
WKAMWLPEAQVDVEPAGGSLPGPWSTGVLSPISSPSSPASEHGAGQRLDRMMDWDGYSPPGSVVMKGIGGQKDGDRSASGSQGSPTVEGEDGTISHEFRLSAEKKPTISLLGSIKAKGKLSGAPQIKGLRLGS

SEQ ID NO: 1004697 - protein, 179 aa, Homo sapiens
VQSRMPNCLQFLPSSQRAIQSALASCCLAPGPSSPSSDPGIFLHSVRARGGHGLCFLLASPLSFGRLGIGRFSATDQPQRGGGIRHSPIPRKASSASAEWPMPFAQPSPDLCPAGSLSSGSACRLCAPSGSKAGNIIFFSKLIGDTPIDPFLMEMLEAPHQMTEACGPILCATRSATLL

SEQ ID NO: 1004698 - protein, 111 aa, Homo sapiens
MVTMELACGGGGGGSRLICGDGRDVGYGPKEAMVSHELGLERLMGESSGPGEAAGRKEHKVESGGVLSWFSCNGMVPRFTVTPRESTYTKIPNISGAEGQAPVVSATGEVE

SEQ ID NO: 1004699 - protein, 124 aa, Homo sapiens
GRRGSGSAQPGSLFPSQPGAGAAVSSEASGGLGLSRGRGPPSHLRPHGTGSSQAPSRRQGPPQGRRASLAQGAGGQRATPRQKPPSGSPGVRAEPGEDVHIQRGLVSIFKWRVKSARDGFENGL

SEQ ID NO: 1004700 - protein, 56 aa, Homo sapiens
SQPPTLAETTGAGHYAQLILGIYVYVDSRGVTVKGGTIQWQENKLKTPTDSTSCSY

SEQ ID NO: 1004701 - protein, 73 aa, Homo sapiens
KKRGLRVSPKGEYRGTIRAQGSLKLQGFKLILGAVPPSEGGNCGVHVPPTPSLVFKIIGIKQGVLVSVAQGGS

SEQ ID NO: 1004702 - protein, 123 aa, Homo sapiens
RNIGGSWVLNSGVSAAGRGLGDTSFGSWLLGLPVRILMMESTATESEACEFLLSLGSRVMWLQDLVHSEWDGTWHYTVALHRDGMEMSGEQSIDSPDFHWRDGKGTGGNPQREKAAELVLEDP

SEQ ID NO: 1004703 - protein, 110 aa, Homo sapiens
GLTLWVAGTIPSILDFFILGFGGDLVASPLTSSPNLAHSLASKWDVDHTRAFFQDFSPATVVIVFFSRRIPREGVSKKMKKESHGNRGIPGSINYRVLCESLSIPVAATK

SEQ ID NO: 1004704 - protein, 114 aa, Homo sapiens
RFHQYKQRGLGRNQGAEKTDSFYHLRGGGSYMENQDILRIAQDQIGTILGPLYHFRIGTQVLQLISIRVLKQVLSFRITIRTEPYRLYHSARGTAKTSGNYTVGFNYSISGWHE

SEQ ID NO: 1004705 - protein, 45 aa, Homo sapiens
MVPSRIFNLNPISLTPPKLSRVRIITSWLDSALEPRLATMVLGLV

SEQ ID NO: 1004706 - protein, 109 aa, Homo sapiens
MGCLGWFNGNGLHQLGVPSGPGGSRGKNKKQKKNTIKRRLYSSVAALEEMQKVFQDILSLLGLSTRPGFSTSDGQSYFQELEEPGGDHSTTLLDGNGLSPRRPRGTGSF

SEQ ID NO: 1004707 - protein, 71 aa, Homo sapiens
GVLSQPKARDSKSDETSEASSLKALMATVPERVAGFPKITQQALGPWQSRKQLLPLPLPKQSLRIQVWDLS

SEQ ID NO: 1004708 - protein, 150 aa, Homo sapiens
GSQGVVSISGPRDPPASASQGAGDNERKPRRPAPFTTFNLRIKWFSSSPDSQMEMWVCHPRKFRKPGPESQHFTLGAGSRPPISEPAIITLTQGLGVLSSLGSGIFRSGVADPGSTTHKLGSLGQVIKPCLAAVSGKQSEGTGHTEALNM

SEQ ID NO: 1004709 - protein, 101 aa, Homo sapiens
GGDYRAGATAPSLNHLKQYNPVRCSGVHNGGETIYHYIPETFPFTFPQEQPKYLQTLPWTTTKSSNLLWDLAFMGFQYAVGIDIEVVGQFVVWAFFQVSGN

SEQ ID NO: 1004710 - protein, 113 aa, Homo sapiens
GDGVLTRFWPGLSDMLSYMQSGRRGRPKHRQGRRALNNFYAPSHVLWAHIPTRTVLHSGEIKDLLTFSHAPSRSLLVRDAGWEAVQEPLSRFGHMQVGDGKGVRSPGQITDKG

SEQ ID NO: 1004711 - protein, 105 aa, Homo sapiens
CGEGVSVFPRGQWQRPRPLLGDHKGLLLCPCPWGAPLWMWGSHLPLLGAQQPSALAALQPAKERRSSSSSSSSSSSSSSSGSSSSDSEGSSLPVQPEVALKRGQN

SEQ ID NO: 1004712 - protein, 85 aa, Homo sapiens
PGRSRLQSAVIALLHSSLGQQRETLNNMWPSQSLFRDSEVFQGRSSSSSVALGLETAAQVHWKGSIPRHSSESSSLLQWSLVAPQ

SEQ ID NO: 1004713 - protein, 76 aa, Homo sapiens
LNLPGWLRLQGAGHYAQLILGIFVYVDSRGVTVKGGTIQWQENKLKTPTDSTLCSYLRAASPGPELSPVSLYRPSS

SEQ ID NO: 1004714 - protein, 69 aa, Homo sapiens
SWVLPQVGSSSFRPSIWHLQVSPGQGRVIQHPGAGHGRSASAVWPRGQFGAHTLVLEVIGLASLGYGQS

SEQ ID NO: 1004715 - protein, 71 aa, Homo sapiens
SPAAECSTFYPFAAHASCSSTSMLLPAALPLAFCSSSRSLLRESTSPLEVHMSALARCVPAPAVMLLQPVV

SEQ ID NO: 1004716 - protein, 178 aa, Homo sapiens
VAGGRSRGPLARLLRKPGLGRRYLVSAVSRGHEVKEGREGHYPQGVGVHKAHDAGKFCFSRGVVANIITQADEAGLELLGTQGAGVIPVKGVEGGPELIHLLRADALGIRGQDRVLYLMDGPGDGGEQLLPAHRDVLQGVVGVLVVEDERLRDERGVALQLINLGLVVDDALLIVPQV

SEQ ID NO: 1004717 - protein, 113 aa, Homo sapiens
CDLEDPCQVLTLRQKIRKIQPVISESHITSYKQNPEQSGGEDAEKKEEDSEGLFRMRIEDEDRSQVLQLFWKKEIQTARFVGRVRKFPQKRVDDDRGGPQKDFAKMMRAGDHR

SEQ ID NO: 1004718 - protein, 38 aa, Homo sapiens
QVYTVNPSSPRLSSITLAYSSNSRNIQAGISSLLSTLF

SEQ ID NO: 1004719 - protein, 69 aa, Homo sapiens
STGEAGEEGWSVWVESVDSEAQWPGLKSQLNLGHWSVISDKLSNTAGPQRTHLSKGDKTVNTSEVGHVD

SEQ ID NO: 1004720 - protein, 72 aa, Homo sapiens
ATSRQHKNGNTCYDHYLLTYEVKKIHSIIRNKNGLRAGHGGSGLQSQHLGRRRGADQEEEESKSSRANRVKG

SEQ ID NO: 1004721 - protein, 121 aa, Homo sapiens
WPGLYLKLNLGSYLDGLFEASKCTQGGKGRACNSLKLGKFPATAAAIFQKAFGVFPQWGKVHQGSDRTFSAVGVHIGAALDSGAMSKLCSKAITSAAMRFGTCPRMKGRTGSVLASGVRSS

SEQ ID NO: 1004722 - protein, 44 aa, Homo sapiens
MPSRAVRHSKMASISQQGLVALKQCKRTRPPLSAWDCPGPWELL

SEQ ID NO: 1004723 - protein, 59 aa, Homo sapiens
IIEVCSHVHAEVWCAHRSESHHIYLRHLLKPNMVTPGHVCLKQVFSMRQIAICASGGSR

SEQ ID NO: 1004724 - protein, 33 aa, Homo sapiens
NFIAARGLHGLATRPPCTISGGPRLMTNGDHYW

SEQ ID NO: 1004725 - protein, 86 aa, Homo sapiens
VETGVSERRPKNAPIYTRARWLTLVIPAFGEAEAGGSQGQEIETIRGNTVKPRLYYKIQKISQAWWRTPVVPATQEAEAGEWREPG

SEQ ID NO: 1004726 - protein, 37 aa, Homo sapiens
SICCLFLRNHHGCCDLYTYLKTVGLQGLIAAQYSGAQ

SEQ ID NO: 1004727 - protein, 37 aa, Homo sapiens
ALYKVTPDMYTNTALLKSQVNHRESSLLHEYCSDATH

SEQ ID NO: 1004728 - protein, 100 aa, Homo sapiens
MSASMDNDLEIDELQNAAWAPWPSSWEQWENHLSGSIVVIHPDTGRDLSPEEAHRAGLMDWNMYVKLRSQECDWEEISVKGPNGASPQCYTDRKSGKEVL

SEQ ID NO: 1004729 - protein, 100 aa, Homo sapiens
MGGEGRVEELTINEKDIMEQNFREHGAGAGEGEEEVSGVRWSSGSSDAVDQVMVIMDALDERAKVLLSDKQHREQLHSISDSSVVSAGIWCIDEQLLSPP

SEQ ID NO: 1004730 - protein, 101 aa, Homo sapiens
LYFNYGRVPIQSNYGLGGSNLGNGGKKSSLQGTSRVTGVCGSGASRVSPRLSHGPLKPHSKYTSPSYHPADLIRGHQKASAVSTQGPEKLQNGTSPGSTTR

SEQ ID NO: 1004731 - protein, 45 aa, Homo sapiens
LISPIDAQRRRSVTWSITWAPQKPPRLDATDPSMPTANLDRTCMT

SEQ ID NO: 1004732 - protein, 155 aa, Homo sapiens
PCSKRVSNSGAQAIWLAWASQRAGIRGMSHKDGPYMLYSFTSQNFTSVLGKRPSIACENDINWLSIIFPNKVSASGSPFKMKYFSIVEVVSGPIKIRRVGNFHSKKKKAIGYWRTSPEFQVWPLNWFTNQRCDLEKVTMSLKLHFFTENRGVYNL

SEQ ID NO: 1004733 - protein, 38 aa, Homo sapiens
MLVRQIQEESLRTQLFTYSSVYNSISMEPLSDMSELVY

SEQ ID NO: 1004734 - protein, 42 aa, Homo sapiens
HQNGSRTMTFSFSLGTSRSLTDQVDHRRSALTKKNHSLKPQW

SEQ ID NO: 1004735 - protein, 83 aa, Homo sapiens
GPGVETRQLSELDDRVRCTPGGCAPQFEPSAATLKRKSLMQNTQDDDHLGQCSAPSSSLIIIGEWVSTGRGPYPGEVTPVDPR

SEQ ID NO: 1004736 - protein, 196 aa, Homo sapiens
HSNWTWYTLGLWLFLLITGFSFTSSHLSTGLHHLPGGSSQKTGSQPYSLGNNYSLFPIKRKGVWVLILKSIYFPSPVLPHLNPKLAIISYPEGHNSIPAGLPVFTRTIIYMAATGGLEYLYQRATGGSRRSPYSWGGGGRIARVQEFKTSRGNRVKPRLYRKYKSQLGLVVPPGVQALRRLKREDRRAGRVSASEH

SEQ ID NO: 1004737 - protein, 67 aa, Homo sapiens
MVPCASSLGERARLCLNNDNENNKIKNKTRHGWAGGSGLVTSVLGEAGVGGSLEIQECKTSRANMVR

SEQ ID NO: 1004738 - protein, 73 aa, Homo sapiens
LRSTLRRTPLYPARVHSTLAGAFYPRGVPLPYAGACLRAGRTGTTLGHSYDGDWTDRWGRDAWVHFLHLRRGY

SEQ ID NO: 1004739 - protein, 133 aa, Homo sapiens
MASCAAGYEQHWLRSQHYVYLCGDHAWAGQGAQEVLVRGGAGAQVAYTGKGNGQGRVRGLKSPTKSKHLKLHRGPCLPALESGHVDADAVNNAGAEECIIPEVSRSYHLGIVGLNMNGYFHVSGRQGAGHSVA

SEQ ID NO: 1004740 - protein, 65 aa, Homo sapiens
AAVDSRRTPLYPRGVPCWYDVGYGHFLTLTTRQAYNHLARSLHGDWPLATVYRLVGLVVCKLTCG

SEQ ID NO: 1004741 - protein, 64 aa, Homo sapiens
WARAYFLYRDARPLIPGPILRSWTWIGYSSTLGGWVPCVRTDPGRYDGTPRRYDGPRDGHGYRR

SEQ ID NO: 1004742 - protein, 42 aa, Homo sapiens
SRVPDQLVVQASAIFSSTLSHICPTSTVLPGSRSSHIRHIHG

SEQ ID NO: 1004743 - protein, 36 aa, Homo sapiens
VIKDPLGAYWVLYLGAFLGATTDVYHGPLAEGYELN

SEQ ID NO: 1004744 - protein, 73 aa, Homo sapiens
MGPEVVPLAAWCRAQESLDLCQWQPTAWPREAASGLDLELERAGRVLDSGTDRDTVPGLDMALGVHNAALGGS

SEQ ID NO: 1004745 - protein, 100 aa, Homo sapiens
LGLMQADNTRGGGIMSGRILSFPGAAGRVAVLAMVSYGPVPLYLGDPSRCTVLTKGWRAGEKSRCRPPSKPSVGAQGIIQEGARRCAESRVLFLVAIPFR

SEQ ID NO: 1004746 - protein, 68 aa, Homo sapiens
STSRVLYLGSKVRDYRREPLCLAETGYFWVPRLECSGTITGHCSPDLLGLNSPPSLTSQVAGTTGTRE

SEQ ID NO: 1004747 - protein, 46 aa, Homo sapiens
MLALGGDDGVESDVREHSFRSGGGWGPIRSLPVEIHLGHISYEGGG

SEQ ID NO: 1004748 - protein, 94 aa, Homo sapiens
GEVVHKDNWRGRTLIRELAAQVLEDRGVGCGRVDSEKDDAVAKKLGLTEVDSMYVCKGTMTVMDVPTGDVFWLTTIGDFRLDCPRRTPVDLDGR

SEQ ID NO: 1004749 - protein, 44 aa, Homo sapiens
GAPSGRDLVQEEIRCLQPHYLPIIDPFPITHGPQPEHKGDAYSS

SEQ ID NO: 1004750 - protein, 167 aa, Homo sapiens
MVTTYSRWYPLNEVRGQVRLHIFSRGGMLTWSRSSLKLPSEGPQALPLQQDMIGGQGWGDRVMAHQGTKFLQKQHRVADAMQLLPGLLVLMQDLGSLMQSIHDHLQWVHSFLLPVAPGQPSFPPLASPGPAPGPGSSAPGWPAHGGCRLEAGFSFGTSQVHPQFNDL

SEQ ID NO: 1004751 - protein, 169 aa, Homo sapiens
VETLHTLQRMFGCDWAGRAPPSAGYNQFAYSGKDYIALNEDLAPGPAADTAAQITQRKWEAALCGGAVVPYLEGLCVELLRRYLEKGKETLQRADPQKTQVTHHPVFDHEATLRCWALGFYPAEITLTWQGDGEDQTQDTELVETRPVGDKTFQKWAAVVVPSGEEQRY

SEQ ID NO: 1004752 - protein, 56 aa, Homo sapiens
GDLEDPWGSIRHATPQLMEVSFHLLLHPSGPRWQTSRDAETRSRNEACEGSPKGTE

SEQ ID NO: 1004753 - protein, 137 aa, Homo sapiens
MGRVFRRKPAVTAEDMQETQAKACEGWGTCKGGASRMSSSRGGLVGPWALWGESIQLCLPCMPLAGTTIPSHIWPVRASQIVSTPFLGGEELSSISSPPVLIEGRRKGNVAKPVPFWLRFVPSVQSGSGAQAEVIHL

SEQ ID NO: 1004754 - protein, 31 aa, Homo sapiens
MSFLLMQGEAVVPKGPEALKVPSVCVVSLGP

SEQ ID NO: 1004755 - protein, 33 aa, Homo sapiens
MGPISLWTPVDLEIQKSPPESFPVWEPKGYGAR

SEQ ID NO: 1004756 - protein, 106 aa, Homo sapiens
FWQGQRCGTLNGPATREGRRHSKRRALTHLLQDWGHGTLSPDLRALPRRVLPTTGLGDLAGSGPHTFRGRPDTTQETTTGTDTDPGTTDATADGPGTRSFAWEGPS

SEQ ID NO: 1004757 - protein, 79 aa, Homo sapiens
GTQPSFLPCPAYRVWGSQGQGCHASTHHYTVKACHFRLAAKTHYGLSIQHEPGPQSSHEPSARGGQPYPFHTHRKPGTE

SEQ ID NO: 1004758 - protein, 158 aa, Homo sapiens
TKICIPLLRGSTRVRVDSCWMWKSEGVRPSSSLFPSKDQPWRIRRDAFLVWDLGLDILKGVIGSTSERDGLTSRGLHEDLHPTSKREHQVRGGLFLGCGQRRGVRPSSSGFPEKIKLGGSGGMPSWSGILALTFSGVSLGPTSRGRVSPVRVYTKICI

SEQ ID NO: 1004759 - protein, 121 aa, Homo sapiens
SIHISLSVPFSLRVLVILLRILIISVPFFFSGPIHVLLDGPGFSEVGPTALLSGLFLSLSIHLGWSNGSPGTRSGVITRSGKPIIISTSGKAIIIQVSPRAPVSSSAPGLILSSSAFLQGP

SEQ ID NO: 1004760 - protein, 175 aa, Homo sapiens
LGAPSVSSRSESGGGPAHREGDVRAQLLFHMLKEVMVLRGREWHKDAISSREGGIDKDSEPPGIRVVFCKDSTVSPEMVVHDHLCLRGGPIEQATVPQGLVAGRILIYFIMGVGGEPHHIFVANFVCPSQSVIVQEAGCSDRWGVGIISKDDKRVYIRRVANPDELCLDIRYNYR

SEQ ID NO: 1004761 - protein, 47 aa, Homo sapiens
MDIHQIHYFKVLLGLWSGRARAVKKSLHPVVYTPISWEGCPQRPLKG

SEQ ID NO: 1004762 - protein, 85 aa, Homo sapiens
RRSTGADESVMLALLMWRSATYRKLVEGEECRLNGEGVGQVNIYCSAVHRLQWLMAVPAVSAVALGLGGGSSYSYGSGLGVGRRA

SEQ ID NO: 1004763 - protein, 80 aa, Homo sapiens
LDVASNSSSGRAIGGSALLEGQFTIKYTTTYYSSRKSYKHKSASVSSRSRRPQALLWLQSPLLRLPFLSVDSKSSPAVPR

SEQ ID NO: 1004764 - protein, 40 aa, Homo sapiens
RRRRELTDGENGGDSKPLFYEVSRGNVLKVTQQQSCEHRP

SEQ ID NO: 1004765 - protein, 65 aa, Homo sapiens
MGLSGVTDYNKLAAFETKTSHDLEHLKPQGVGRHYMGREESKVCFSTDNSDGFGARGIFGEGESR

SEQ ID NO: 1004766 - protein, 40 aa, Homo sapiens
RYTSCLGLEYPDETTTKRKGGISTTQPLGTVAPYFTLVYA

SEQ ID NO: 1004767 - protein, 100 aa, Homo sapiens
IRGSRIISLPLFTSSSSGLNGFSLRFWLFWMVKSFQASYFFRSSHQIWAQKIGRRSRIGIFHFTFQLVFGIFMVFFNLVPLGGFSISSKDFHRLRISVLK

SEQ ID NO: 1004768 - protein, 132 aa, Homo sapiens
RRSTRPRMFDTCEEIRFRVVDESFVELSPQVHAHEMPPLQWGAAKKEAPYTLVGSISEPVLGLLSWWTSNQPWWLDSWNLTSLRERWYGLPVTAQTAADGDAKEIRVSSLTVRQGQEVPTRLPLVLHHLGPA

SEQ ID NO: 1004769 - protein, 177 aa, Homo sapiens
SRGSWQALYLKMSALMYNSSNPVLKIMWPEGKRSIQRRPSDLGRRLPGEKNSMMALVDNLASKEPYDVRGIKPKDKKSPGILDDEGGRHQVEYLGLRKVRVRRAGLAFRQTYEKFLHRYKMISEFTGPNHDLPSDKEAVKKLMEGGGPQDDVAEGKTKIFIRTPRTWFTLKELRAQM

SEQ ID NO: 1004770 - protein, 126 aa, Homo sapiens
QEGREGDMDTVGWLLVVGMSTPGEAWGGDKLWQKTQEGLILGSDQCCGTGSQAECLPGETWQEPVSEAVSGRQRARWPCLQASMIYQMQPVVGLHIGLVHAHGQVATRVEDGIPGVGKLLGQPCAS

SEQ ID NO: 1004771 - protein, 61 aa, Homo sapiens
MRLRNRELTQGGDRALLDKKIEVRHSGTEQARTEVPRVGAETRAREGVAEAHWTGERLPLN

SEQ ID NO: 1004772 - protein, 104 aa, Homo sapiens
FISFFLETESSSVTQAVVQWRDLASLQPPPPGSSDSPASASRVAGITGAYHQAWLMFGILSRDEVQHMGQAGLEPLTLCSARISLLKCWDYRCEPVRPAPARLF

SEQ ID NO: 1004773 - protein, 138 aa, Homo sapiens
RSLQALYLCERASTELTSQEAVGLKRKWEVRKEDSKCRHVPYKKACAVKGKTETVWLEKMTAGTWEAPGCRHSKVRNAEGGLREVAGTETGTILPLELREQGSNDPGGPNLWSLLTASVSLGVAVAGPGSGQGVVRIK

SEQ ID NO: 1004774 - protein, 37 aa, Homo sapiens
MVRQWCSQGCMIYQYGTALVQSRYGLQKKLEKVESRA

SEQ ID NO: 1004775 - protein, 64 aa, Homo sapiens
IPIAKAHPLPGSSRGRGTAPIGGQVRVSKQQRISTSPIRSVRSPWLMRKHQASSVATGPEVPPP

SEQ ID NO: 1004776 - protein, 69 aa, Homo sapiens
LEFVSSQLSSTLMPVLSVHRACNGKYLVSPHQAILSTEPISSKVDSSQALREICLWNQVGLFSGTPIIR

SEQ ID NO: 1004777 - protein, 61 aa, Homo sapiens
MALLFTFNFTVKFTNPGLQFLDLLLPTLQAQLLSLIQTMLQVLHRLFQVLLHPLQMGAGVL

SEQ ID NO: 1004778 - protein, 123 aa, Homo sapiens
MLKTAEGELGGGEVGVSPSSRRGRVAISCSSRVFTSSRILYSWFCCSISQRSWPKLLLHAANHLLDLGQLHASSEPLVLLPGLFSRGCFHAELGNLQLNSPRVPGMVAAGTSRRISASLPASA

SEQ ID NO: 1004779 - protein, 33 aa, Homo sapiens
VRPRYRSHLIVWCCSCPRGVCINAVFYTPLAVS

SEQ ID NO: 1004780 - protein, 86 aa, Homo sapiens
GRRGSHSKRNTNKATLRFWFLSNHQTGTAPKIGYHILRANLVEKKVLFSRARGHVNCNSPSEGQLGKICQNHRCRQGGPSMASSGN

SEQ ID NO: 1004781 - protein, 59 aa, Homo sapiens
YVAQVVWNSGAQADLPGLGLAKVLGIDRRGPPCLATRGYILVYQKLKGKSESLAFDFDH

SEQ ID NO: 1004782 - protein, 106 aa, Homo sapiens
GEGVHVRELTINNKKAVRVEEGRLYEQSTDGAFLPVPELGEGSWAHRVDSAVVEMPPDVVVGGRYPVSPFFLTSGLKLALALPRAKPSQKPTGNATGRAAPNMQSR

SEQ ID NO: 1004783 - protein, 38 aa, Homo sapiens
WGSIQVRAEYYGLGAPLLAGGTHNASKKIHTAAPVRRC

SEQ ID NO: 1004784 - protein, 117 aa, Homo sapiens
SGLRQGGNDKQGFPMKQVSGPRAVSAGYWSKGHSGYRPRRTGERKRKSVRGGMVDANLSVLNWVMVKKGEKDIPGGTDTTVPRGRGPKRASRIGKLFNLSKEDDVRQYVVRKGYGAR

SEQ ID NO: 1004785 - protein, 44 aa, Homo sapiens
SGLIQVLYWRVHEKVRSLGPSPLQGVYRATVRRGDSGGGGTEGG

SEQ ID NO: 1004786 - protein, 176 aa, Homo sapiens
TTKVMITRTEVNDNPPKFRRAVYQRSVSEAAVPGEEVGRVKAKDPDMGEKGLVTYNMVEGDGMESLEITRDYETREGVIKLKKPVDLETKRAYMLVGRVHAKDLDAANSRIRYSIDGHTDLERFFTINPEDGFIKTTKARDREETAGLNISVFAAEIQNGIREAKVPVIRVLDVND

SEQ ID NO: 1004787 - protein, 98 aa, Homo sapiens
GAHSGWVGCLEGRSGFHFCVLELMGQPVQAFVQPVPVGGTGGLNVPVTVTKGMQAQLVCDLSRVHSIRQIRLVGKDKEYSIPELVLRQHSHQLFPGLI

SEQ ID NO: 1004788 - protein, 182 aa, Homo sapiens
READAYWRPSSRRKPNWVGPGVVSYQVEEPSCREVGWLCRGVGAECPVLVGTVWGLQQYWQSQHQQQLLHVPLPGGVITCGDGPPIPRTGPANPAGAWGNWAHQRVLLYQLPYQAQGLQQLQQVLPEHCQYLGGVALTVMDTKFSPGSKTRAKSGFSTGSGGFAFFDWIYLELITITEDQIH

SEQ ID NO: 1004789 - protein, 105 aa, Homo sapiens
VCCGDLEVPLGLHSGMEGKTILPAEVEVLHMDVLIRGCLSRAPEKEPFLGRGLFHGDVRDGEPKDEGPDHSQGHLGVAVHNLFGPDGDQLDALAGNKVQRLVHMV

SEQ ID NO: 1004790 - protein, 91 aa, Homo sapiens
LGLIQDSSILHHGAGVGHREEVDGLPSHFQERSIYQDQEQRILEFREELGEGKATTAHDLSGKLGTPKKEINRVYYSRAKKGKLQKEGTEL

SEQ ID NO: 1004791 - protein, 139 aa, Homo sapiens
LGLIQGGVRSRTSPGSLVLSNENLGQGLHQEGFSILLLWLQNGLIRAADDREEDGCSQAVPWVPLTEENEEARENEQFQQLWRKLGRPPASGQETFGRPAKLSPTQLGRAAASWSQPEEEQKLQPERQPKVPGEQGPEG

SEQ ID NO: 1004792 - protein, 71 aa, Homo sapiens
RVTQEEEKERRRQEKKQRGAENLKRRLENERKAEVVQVIRNPAKLRRAKKKQLRSIEKRDTLALLQKQPAK

SEQ ID NO: 1004793 - protein, 160 aa, Homo sapiens
WDGTTSVQLLRPLACPLVSQRLHVPLGQERGGTAMSHCLQSPVQAARQAGQQSLLNSPAEAVAPLATLQSHLLALPAPDLGFPAQRPGWAASICNSGSRGGHCPPPQELVKDMTAAGKGPWKDKEPIQVHTLGSASGSPVHSWDLPSPTPLEWEPGVVVL

SEQ ID NO: 1004794 - protein, 104 aa, Homo sapiens
MRSTSVRPSFWAQRLPSQSLPARSQHPGLLGLGLLTPGSAPPSQMVLVRPGHPRGVQGRGVPAPHTSGTHSGSSWHGHGSQGPHHRTQSPALPAPVPLKGAQRV

SEQ ID NO: 1004795 - protein, 49 aa, Homo sapiens
LEDPVTSQLSFDQPERGKGAIDAKVHMPLRSPGRSAMSQKLTNGDVPCS

SEQ ID NO: 1004796 - protein, 82 aa, Homo sapiens
IRQAINYGVYRRDGLPVLSEDVEADVALEVKVGVIDHGLTLHLGGIMRVTRAHLKTEHKLPTLVEALIRTDDQLEVEEVVGI

SEQ ID NO: 1004797 - protein, 67 aa, Homo sapiens
MAAVPSSLGSASEGDRWRERERERERESVVMTLNRFEIIPIIWNLPDRILNSFSVILNVSEFSEISY

SEQ ID NO: 1004798 - protein, 169 aa, Homo sapiens
RRGSHIHPDGLYGCDLGARRGASSVGMTMFCLRGQWITSALNEDLSSWTVVDSVVQITQRKWEAARVAEQLRAYLGGPVRGCGSEDTLENGKETLQRADPQKTHVTHQPVSDPDEATLMGAGPLGFYPAEIRLTLAVDGEDQIQYIELVETRPGGDRTFQNVGRCGGWL

SEQ ID NO: 1004799 - protein, 97 aa, Homo sapiens
MYGCDLGPDGCLLRGHDQFAYEGKDYIALNEDLSSWTAADTADQITQRKWEAARVAEQLRAYREGLCVEWLRRYLENGKETLQRADPQKIYVTNQPV

SEQ ID NO: 1004800 - protein, 80 aa, Homo sapiens
MSRGENSYRHVFLGQEPKTFSSHCYWLIFSNISNWHWTEEKARDWDFSMIKHTKRPLVEAQHVSGSGGPHTIHSQSLAHT

SEQ ID NO: 1004801 - protein, 64 aa, Homo sapiens
EEELASLGKLDKRAKKRSKMVSGSQDIWEGIQDKGEQGLKEVTCSDPPWYTNDWRCKCSLPRIR

SEQ ID NO: 1004802 - protein, 75 aa, Homo sapiens
LEDPCGHGSHRFTEKQTSASSHWCVWLAMTGVLTINSPAWDFWNPNEETSPWVWLPLLPFGFSKKVFPMYVMLGL

SEQ ID NO: 1004803 - protein, 102 aa, Homo sapiens
CADGFSESQIMILREPEYQKSYIVPTQVIKMGWVRWLTLVSQHLGRTRPVDGLSSGIQDQPGQYGKTPSLQKNTKISQAGWHVPVVPATGEAEGGGSLQRAK

SEQ ID NO: 1004804 - protein, 86 aa, Homo sapiens
QLTGAATEVHDSVGVVKSLKRALETTFDLGIPQVVLPPLPSRPALEKTNGATEVFNTGIYQYQQALANMQLQPAYSISHTSSHGAR

SEQ ID NO: 1004805 - protein, 82 aa, Homo sapiens
VFVDRQVMVTTDTCDVGTRKGMQLSFPFSSGMTLPQSWSAVEAGDDVLESPGAITRQFPGVSIARSSWVAVMACNCGHESFH

SEQ ID NO: 1004806 - protein, 38 aa, Homo sapiens
MRDRRGDSDGVKRAPRFPAKLYRLSHGVLSTDQSPFTK

SEQ ID NO: 1004807 - protein, 90 aa, Homo sapiens
TPRWPMEAPCPPIVDPDPLIPCDSVWTGRDCVSTRVVKGTMHLEFSSLRRAQWSDHVLLVELHTLSKDRFVYTCNECKHHVHDTLALYCL

SEQ ID NO: 1004808 - protein, 74 aa, Homo sapiens
YNRALYPRWPMAVSASGMALCPSVDAEILPDGDHDLKRCHVCDREGAGCVYEALSDQQIYLEGTLLEAHDGHPR

SEQ ID NO: 1004809 - protein, 75 aa, Homo sapiens
DVVSKGLAMIKLQQYQGCRKIRLLEVSGHTIGALPLNQLNQNLWGQPPSNRCYKMPSECQNVGITEGHPSGVNLN

SEQ ID NO: 1004810 - protein, 42 aa, Homo sapiens
EHTLSPQPAKQMGLQAMPPSSANSGLTFGKDGFYVAHASLDL

SEQ ID NO: 1004811 - protein, 49 aa, Homo sapiens
MVNPVSTKNTKISRAWWTRLQSQHFGKVRAGRSQGQEIETILKMLRPRL

SEQ ID NO: 1004812 - protein, 59 aa, Homo sapiens
STHKSSSVTNDPRNAKHARRTQTPLSRHVKAFCSCFSPSALMTVPARTRLSVQTPPSAM

SEQ ID NO: 1004813 - protein, 109 aa, Homo sapiens
MFPGPLWTYAREYVHTHGMHTIQHLQYYIIFRRSIEYDFRKPVRFTRRPPFHSTHQQTLSSCFTIGNSFPGSELCPFIINICTHRHTLLYGTWLYCTSHIWCVLINRRF

SEQ ID NO: 1004814 - protein, 48 aa, Homo sapiens
MANDRGDVIRILRHFPSMTYELGALHPASLLVSPLLLFWRRDDRKSFA

SEQ ID NO: 1004815 - protein, 48 aa, Homo sapiens
TRFRALLSEETAERVRIPSHDRIRLLGELLCSTCPKELLAARAPSFLV

SEQ ID NO: 1004816 - protein, 54 aa, Homo sapiens
LAGAGVTVFHPKPPQLVISFSASSMQQQQHQSCYGVIALQLHPQHNPVAGNILL

SEQ ID NO: 1004817 - protein, 53 aa, Homo sapiens
DPLGSQQRAPRPKQSRDVTQPANQDVSRRMGKAGRERGREGVYRASNFDRSVG

SEQ ID NO: 1004818 - protein, 57 aa, Homo sapiens
SYFSGGLQVTAGLLFQGAWAIGALQGRDLYSYGPIHQCWTPSSIGTRAIAHVTMGEQ

SEQ ID NO: 1004819 - protein, 78 aa, Homo sapiens
CVTAANLPSSNPSHSLLPDADGSRRETGGLSSSMSPAFTSIRSAPKCLSAFQVVKTPLGRARWLMPVIPALWDGETGR

SEQ ID NO: 1004820 - protein, 84 aa, Homo sapiens
MVLLAVGRGLTGASEQGEQGPMEENTEEEGWQAQLHASGVAILVGTLSSSQVYPPRSPVPGSSQQPCMLSQGYCANLLSSWRWK

SEQ ID NO: 1004821 - protein, 52 aa, Homo sapiens
MYELLGLAFETVQLLFRKCSLKTVLLLAEQMISRIEYIHSKNFIHLGRQALT

SEQ ID NO: 1004822 - protein, 46 aa, Homo sapiens
ASPSRAEQMARRPKRLAVQEAAQLDMLLEKLPQVHEEISGPLHFSQ

SEQ ID NO: 1004823 - protein, 98 aa, Homo sapiens
GETAAKKNPKTASPVEGHEVHIGLSMVKIPKKMKQHETKQMGPDVASFCMNAEDALESKPERKAMGGAMNIVADELVGPFSQLKGQHITMGTEPSKRS

SEQ ID NO: 1004824 - protein, 81 aa, Homo sapiens
MCASALLWGAERGSMTSTSGSPYGTRHLVCFTRIQRATCRSPSSASFLGANAVWVTGLLVTLLYSTGAMCPRLPGLSVDTC

SEQ ID NO: 1004825 - protein, 83 aa, Homo sapiens
MLRASVSWQMKSNINLYLCQSHLPPVLGELCPARITAFDPEYTGTCTLNTEDNGNVNSSALPTHPLTHASSVISSSTSDYIHA

SEQ ID NO: 1004826 - protein, 55 aa, Homo sapiens
GDRDVLDRTKKHLQERLIELLRDKDALWQKSDALEYQQQLSAEREHGTEPQRQTT

SEQ ID NO: 1004827 - protein, 68 aa, Homo sapiens
MRWYPAANGSRHLGLSINGVVSFELPVYIFILLWVLFVSSCRTVQKLFKRNWIRNWMCIRNLIILICV

SEQ ID NO: 1004828 - protein, 33 aa, Homo sapiens
VSLQYVTEKVLLLLYKALSDHHIYLECTLLKRN

SEQ ID NO: 1004829 - protein, 98 aa, Homo sapiens
CTPLATWQLCHATCTPLLQTHRGEDLLELGVLVKVRQFNACFQEPSAQFDWAVEHLAQLLFPHEGLASFLKDLLNLRQPYAEGGKNLLQCGPLFSREM

SEQ ID NO: 1004830 - protein, 33 aa, Homo sapiens
PAAYAQLPEGIQSLLGGVMDGVWSESFHDKVVM

SEQ ID NO: 1004831 - protein, 80 aa, Homo sapiens
KWQRADLACRRITESASLDMSVRALLRNDEAYDKRTLEANPCAHVQKEITALAPSTMKIKIIAPRNGKYSGVGSSGSIRG

SEQ ID NO: 1004832 - protein, 40 aa, Homo sapiens
CPGLCMGGESMSMAHMFSRNVSAMVACRHDGSRMKAVPGS

SEQ ID NO: 1004833 - protein, 74 aa, Homo sapiens
MALSLMALPPPHSGLQTGRYPSDTRGALCGAPLDGRHGNLLMRQLLSASMPCGDHCWASESVPFQARCRWTLKS

SEQ ID NO: 1004834 - protein, 77 aa, Homo sapiens
PPIQVHSHLLLQQEDAIITKVRLVALVPRVVRPFSGCGAVSSVWLYSLGLQSPLLSQVELVINAYVASISTLSLYTI

SEQ ID NO: 1004835 - protein, 59 aa, Homo sapiens
GSLFQESAAGRSRLGGGQCPGPKVPGRFVWLAAAGEKSPLVRSRSACFRCLQKVTDERE

SEQ ID NO: 1004836 - protein, 104 aa, Homo sapiens
VHGCCSRRDCVPAGRSLPPIEKIRRPEKSRAGGGVCLEAFAVDDGRAGLVVLLLGDPHLLEGGQRGQDGAADPHRVFALRRGDDLDLHGAGCQRGDLFLPLGQA

SEQ ID NO: 1004837 - protein, 41 aa, Homo sapiens
MGQLVVLCGRSGNGAIGNVVMIKLVSARVSCGDSVGLEHGC

SEQ ID NO: 1004838 - protein, 98 aa, Homo sapiens
QSKCCIDMIIESENYYTDMQELNSSISPNGPNRHLQKFLPKTTEYTSVSLPQGTYSKIDGTIKHKTMQRLFKKQKQKQNHTTGWCRAVVPCGLGQMKT

SEQ ID NO: 1004839 - protein, 62 aa, Homo sapiens
MAFSSDETCSDVHAWSGVTMSELQDGAFQLDSGAHSEACRGQRGTPSWSHTASVTKSGGSPL

SEQ ID NO: 1004840 - protein, 51 aa, Homo sapiens
MISLMRIILSHIAGVPCWASARCFQVDVVVTQSLETADMNFSVTYWQRFKS

SEQ ID NO: 1004841 - protein, 111 aa, Homo sapiens
ELNQRFTKQGSRLFLRHMILAYSKLSFSQVFKLYTVLQQDFQNGEKTTVEDADMELTSRDEGEGKVETEEFEVSVREEEVSWMGALGAKRKESCWLTQQASLLKNDDGSGA

SEQ ID NO: 1004842 - protein, 70 aa, Homo sapiens
MAELETSPPPNQERFGDPISHHVVWEGEPAYRYMAKSGDEPEDAVMATCALTGSSSLPPAAELPSSTSLF

SEQ ID NO: 1004843 - protein, 138 aa, Homo sapiens
GFESKSEMFSGHKEYWSRVQGQGGKSVPRGPVCLDILNATGSTTGGKIIVGIIMVIEVLDGSRVEHCTNTAINRMCPFHRGFHDVRYLWLLRLSRYRNPQDLQNGVSRVAEVIVRTFMESCSLWDFHLKVIAMHPGAQ

SEQ ID NO: 1004844 - protein, 39 aa, Homo sapiens
MGPQYGCHALDLATPCTATGFSVPVAIPKLWAITRHVAT

SEQ ID NO: 1004845 - protein, 145 aa, Homo sapiens
AAKLTANLHVSAARISEIKYKQDMDRCYRHAKLSFKRNDIFNEITLAYINSDCFTVNTKLSTLAASAETSYLTSLELSLSHQATAWATGQQPATAAYSPPSKLPSYCHSCLHPNPPYSLTCELLPVRHCYCSSATPALLLFYHTA

SEQ ID NO: 1004846 - protein, 81 aa, Homo sapiens
GEALYLRKVVQCTGTLPTFPPKGERLGADKSGSVVWRETKAMTNGSSIIFLAIGLGYEISSSGKGTPGAQRGTRKVEAGGY

SEQ ID NO: 1004847 - protein, 89 aa, Homo sapiens
WPGFSTFAGGGGLPSGPPGPPKKQGHRNTVSASGSLHLPRVSPKKTQFFRDTLKASSPNSFWRHDTHRLSSPGRAPPGASTPSSNSFLS

SEQ ID NO: 1004848 - protein, 68 aa, Homo sapiens
MLAHKVTLSYGGKQHLYPSYNGHISGRASNRVDFFSRTGMERGGCAGRRVQSIIIGSEHSQAIIVPYA

SEQ ID NO: 1004849 - protein, 116 aa, Homo sapiens
MASQTRAEMTSDECQPAEAPRGGHRKQPQRPTPDRGRRTGAGTGQELSPWAERRPGKKGVLGARKEEEGCPVLVKEKWGLKKLVLSQEQKTMWWDGIDSIPESVHLKGGERISKKC

SEQ ID NO: 1004850 - protein, 197 aa, Homo sapiens
LRLVIIEDPLQVLYLSDLANQQCPTRPGQQLAAPPPHSSSIRAARKGGEVSGSTHSRGPALTMRPRPTATISSPSDRGGTLKGHEGVPGHKQAPDSPHLPVTGYVITDLRLSGVHFPHVSGGGQSMSQGHRENPGRCKDKGPSIHSFIRQPFSKHADVIVIPTLAETQTRSKESLDTTSNKQGLPETNNESRSHKEE

SEQ ID NO: 1004851 - protein, 50 aa, Homo sapiens
TGLSPTHSPSPRKARVETKMVTASSQSGSGTYDARIRDANLPSQVWSSTR

SEQ ID NO: 1004852 - protein, 41 aa, Homo sapiens
LIASPKHHFVSDVNDAKILNDSRHWFEVNVADLPEEIDISS

SEQ ID NO: 1004853 - protein, 124 aa, Homo sapiens
GWVMSEGLTKEYDRWREEHAKRRAAVEGPRDKKEEKGPPSSPCLQLASTGHVPAASGEPGLSLQYFGGALLLPPFPSTAHSSSSRPWSTLSKHMRGDRMATRTEGVGCHPAGPGQAGHSLGFHA

SEQ ID NO: 1004854 - protein, 152 aa, Homo sapiens
DPGLEMSEENKADSEGGLHQDGDKKGSCERDAHSAPGYDKVNGHLMRWSPLRVPCVLGVSDVLYADPNYLQSVILGGPFDSSQRRSRYIQVGVLSWGVVDVCKNQKRQMQVPAHARDFHINLYQVLPWLKEPLQDADGGKLKGVPWREQGGY

SEQ ID NO: 1004855 - protein, 78 aa, Homo sapiens
EWSGLCITPRVIQRHHSKHSGVPVHVPTIHTVQGRKRSKPPPSQHPACPAKQQPARASGSPFKASPGIQCPHQLEQGG

SEQ ID NO: 1004856 - protein, 39 aa, Homo sapiens
AACTVAWHFLRARGGLPAGTCDDCLTTWAGPVTTCLTDR

SEQ ID NO: 1004857 - protein, 42 aa, Homo sapiens
YSSIGNASVMALKYYIGIDGWKAPSSLINSGLVISYKTEEKP

SEQ ID NO: 1004858 - protein, 43 aa, Homo sapiens
MGSRGSQSGSPLLIAGEMALSVLFCLQCARACLTGNKGDGWYG

SEQ ID NO: 1004859 - protein, 44 aa, Homo sapiens
SSGSPTTLESPLLTVASVDPFEEGRGLGSRTFVIVPSIKYPVLN

SEQ ID NO: 1004860 - protein, 45 aa, Homo sapiens
TLSRHPPKSSSNIGFQGGQKFSIQPSSPIIISTHQPTGIIFQAQH

SEQ ID NO: 1004861 - protein, 41 aa, Homo sapiens
QSQRYEILTTYVYWRNYKKFSIARAKNVLRRILRKRLEGLS

SEQ ID NO: 1004862 - protein, 49 aa, Homo sapiens
RSRGPSPGPPWREPVLRMSASRRARDHLFSLDGRRMSQLAAMCVGYRSS

SEQ ID NO: 1004863 - protein, 61 aa, Homo sapiens
DTTSSWYPRWRTAPPAALHGPAVHMPPLHLHHSGLDLPAGLAEANMVTPGHVDFRSFLMRR

SEQ ID NO: 1004864 - protein, 41 aa, Homo sapiens
NVLRGGWELSCPPIEKICPAGHMQRRVLYYHAEGPGSMYTG

SEQ ID NO: 1004865 - protein, 135 aa, Homo sapiens
LPRKPPVTLAERGELRKSIFSESRKPRVSIMEPGETGRNSYPGAETGLFSRSRSGSEEVLCDSCIGNKQRAVKSGRVCQASFGELHLKPDRGGAAFRDHQWLEAHRGMGGLGASMQGQEAEVSQGAQASGGSQGR

SEQ ID NO: 1004866 - protein, 94 aa, Homo sapiens
LDSPSGLYSGCRQQPRSGPFQHCARLLVAPGSSWLCPVALQWLGSLLGWRQHGLNFSDGLPSSALESRPSQLPRGGGVTQGFLLGGFASNPCRP

SEQ ID NO: 1004867 - protein, 70 aa, Homo sapiens
YEVRALYRLEILPDVDHDLNAAAKYVTGEGAGCCLLGSDVTTTFTWRAPCWKPNMVTQASVGVKKFSHEE

SEQ ID NO: 1004868 - protein, 59 aa, Homo sapiens
IRLAYSGGGSPVPLHPCGELFKLLKEGHLHGHSPANCTHDLYMIMRECWHAVPSQRPTF

SEQ ID NO: 1004869 - protein, 68 aa, Homo sapiens
LLSHDAIKALMATTFLLCTWHPESQCFLQAPPLGEAEDDGGIEGVSSSQCIHHAWCWESILSGAICHW

SEQ ID NO: 1004870 - protein, 120 aa, Homo sapiens
MRGGAVAADGRIEPGDMWGLHYFSLSGPLIFPSSFSIRVASTVGGEVIIYWKSGSTLASDFSPWHTTGRLIFLQDVVSSPFAGYRTLLGVLVLSGLISGRVPKTLESDRVTLLIEPHFPC

SEQ ID NO: 1004871 - protein, 108 aa, Homo sapiens
RVVTPAGQWISVGTALSLLFFVFFYKNGVSLHHFGNGVAQAEVQGCHLGSRKPLPLRSKRCSGLEPLEKLEWRVPATTPGEIVVFQGREGFHHVGQVLQLLPSGDPLT

SEQ ID NO: 1004872 - protein, 133 aa, Homo sapiens
LIQGRNTTSSGAGRRASLAPGTCPPIPGRSWEHITSEYTLQNQDTFSGAVSFLTGRIVYISGAGSLSWCVASGDVGGTRFSELWAPQDGGVFYGSMAPSRLPTWGHRGLSRYRPQGLNPGEVRLLAESEEVLT

SEQ ID NO: 1004873 - protein, 97 aa, Homo sapiens
APSGLYSGCSDTLMDLVCPWAALSRRTSAWHTTCSPGMAGLVVSVAAIGAVAQCPTGPAPHLSRWVVQQCHKQGKPLKFAYTRFTLVLKAQMLQVGG

SEQ ID NO: 1004874 - protein, 215 aa, Homo sapiens
SRVDRFRMFPLFWGKGKYPNPFSPCLYPFSAFLGKGKYPNPFSPCLYPFSAFLGEGQVPLNPFSFTLSGKSRFSGERASTPTPSLLVSTPSLLFWGKGKYPNPFSPCLYPFSAFLGKGKYPNPFSPCLYPFSAFLGEGQVPLKPFSFTLSGKSPFLGEGQVPLNPFSFTLSGKSRLSRGQATPIPYFHTPTSYLCATIPYFCAQPTFPISGGKNP

SEQ ID NO: 1004875 - protein, 66 aa, Homo sapiens
AGHWICVFLMRAGTLGCHVIELLVRKQDSLVVTVAHTPQNSPLSSATSASMPACGGACYGVPGRGR

SEQ ID NO: 1004876 - protein, 30 aa, Homo sapiens
MGQRARWPNAIEVDGRLLLTLASRQEGDPS

SEQ ID NO: 1004877 - protein, 69 aa, Homo sapiens
LGLYQGGSGFSASSGRGRGVGLGRGGGSSSSVKLVSTTSSSRKSFKKLRTCCKSRPSKGSNPAQVDGLF

SEQ ID NO: 1004878 - protein, 115 aa, Homo sapiens
GARFTVGASFSQPDSLLLSGGACKGGVNSGGSAAYQPVVSGVLPVGQPVRPGVLQLNQTVGTNIRPVNQPVRPGASQNTTFLTSGSILRQFIPTGNQVTGIPTYRRAPVSVTLPV

SEQ ID NO: 1004879 - protein, 79 aa, Homo sapiens
MVQPATSSFPCGWGLIQKHLKTRDHNRNRRLMMEQSKKSSLRGARSILNNKLISKKRERYLRGENPFTDSPEGSPRGTE

SEQ ID NO: 1004880 - protein, 77 aa, Homo sapiens
GAKKGHHLCPLLADAPMFVGGVNHEKYDNSLKIISNASCTTNCLAPRAKVIHDNLGISGSDGMAGGHESCHDTKGGT

SEQ ID NO: 1004881 - protein, 152 aa, Homo sapiens
TVVRHQGPAQRCPARWVIRGSRANNDVSISQMMRDVSIQQTNMVPPHVQAMQENSASGNHFSGQGMSYEEAPLRGAPKGNQMSWGQNPGFPVNRDVTLTSPWWVNLWRSDISAGHWGVNNKQNNSKANKAKKKNALWKKKNSRQDLNSQDTR

SEQ ID NO: 1004882 - protein, 121 aa, Homo sapiens
MRRERWERSYPTSLIKNREEPSSRLSEYKDGSLAQELPARQRGMSQSHIGQRSQSRGSTGAGVHLILLETQNGPQPRFLGAGSHTHRLCTGAHSGGLGTRGSCVALSEISVVLTQHNRVRL

SEQ ID NO: 1004883 - protein, 82 aa, Homo sapiens
DSRRTPPRVLRSRTCRDGDDAGDAGVPLLYAGGQGGYDGDDVPRKPCRTTALWVVTAGTLDGLTLLVIFGHQTTTIRSDAVL

SEQ ID NO: 1004884 - protein, 105 aa, Homo sapiens
AFPVSSAELSFNPEGDVCLTNFHQEICFLGQAQWLTLAIEASWEAEVGGSPEVQEFETSLANIGETPSPLNIQKLRRAWWRMPVTPAAWDGQAGDSLELGRRRLQ

SEQ ID NO: 1004885 - protein, 86 aa, Homo sapiens
DKREASKKAIIFSIYQENSGGLVTFSLADLRTFGYEMILSNGEAPAPNDVRQYVVRKPLNKEGKKPRTKAPKIQRLVTPGVRQQGY

SEQ ID NO: 1004886 - protein, 50 aa, Homo sapiens
MRSTSTTDSPNDTTPLWDATDAGRLKHLVDTHSGTTTVVYFRVGRTLTTV

SEQ ID NO: 1004887 - protein, 37 aa, Homo sapiens
CSQCRSPGTILKKPSELVDRTRGDGPSDNPGVLLFGY

SEQ ID NO: 1004888 - protein, 65 aa, Homo sapiens
EILDVFHSSKDPFVTQPGYNTGNGFKLPGTSGQQTKCWATNDFEEHGFKADHNRPQTGNSHKGIK

SEQ ID NO: 1004889 - protein, 72 aa, Homo sapiens
TIHSSELSDTFTRKRLLKHSSETPHVAVILSAVKLATKWDSFGISKGIPNCMGTKSVHGILLSLFCSRCFVL

SEQ ID NO: 1004890 - protein, 35 aa, Homo sapiens
EDTAVYTCEVASSSSHWVSAEIYYYYYMDVWGKGT

SEQ ID NO: 1004891 - protein, 34 aa, Homo sapiens
KHRNLNHFVLSPPPAEATMKDALQLPPYMFTWMR

SEQ ID NO: 1004892 - protein, 55 aa, Homo sapiens
CLRHCTVITTDNKVAIGQLELLTQRVPHDICSNLWDGHQFILWVFMTLCIPVTVI

SEQ ID NO: 1004893 - protein, 101 aa, Homo sapiens
LQFPRSVPVARLTITNAPARARRAVRPGRAIYTMYRLCDISPLGEAASSPCPGALTGEEGAPFGNGGLAHHRSLALKEARLMPCLNGTFPIYKEFREFFNI

SEQ ID NO: 1004894 - protein, 54 aa, Homo sapiens
WRAAPHGRTLLFERSRRRVVPSVITSLEATDGCEESITVKHNSTLSAALVPLLG

SEQ ID NO: 1004895 - protein, 174 aa, Homo sapiens
GFRMFPQRRSTSQAMAAGETLLYFLDGMAAGRGAPHFLDGMAAGTRRSSLPRRDGGREEALLIFLDGMADGQRRSSLPRRDGGREEALLTFQTVQPGRGALHIPDDGRPGRDAPQFPDGVASRAERVILSTCGRPREAANNFLMKYWKRQPFSPLLFGIVDHIHQVFQHHESNK

SEQ ID NO: 1004896 - protein, 54 aa, Homo sapiens
MSPAVADRSRRQSSDRRVGRMSLFYGIKTSVCRLQNFLTSTVRFTRGDLHDSLL

SEQ ID NO: 1004897 - protein, 56 aa, Homo sapiens
IPGGCGTEAKEESVCGLSHVISTKQQKHRLCGHGASVSSIITRCTVVVYHDHKLIV

SEQ ID NO: 1004898 - protein, 38 aa, Homo sapiens
MAPHPQSRRSSSRLLLGCHSDRVSLLPPLLIPYRASRL

SEQ ID NO: 1004899 - protein, 40 aa, Homo sapiens
SGRGIAVDTALEWQKIAEELGTSRSAFQVPAENSSRHKQK

SEQ ID NO: 1004900 - protein, 34 aa, Homo sapiens
VTLEDSGTGDCLRDWRLSDGTRRCLRDRGGRRGV

SEQ ID NO: 1004901 - protein, 52 aa, Homo sapiens
LSHACSTFGDLEHYSTGACEALCLRKLLFPAKEGVYRALPCLGELILEPACY

SEQ ID NO: 1004902 - protein, 164 aa, Homo sapiens
MDRDEVVGEPHRARGWRMIPSGCYQCCPQRGPARCPSAVGSRVATHSSWGAASPESPSAGQPRAEPDRNTQKSADSPSAGAGSPAKEAGGAASQEWESYTPGVGPGQTQGCTRWGGADAQQPCSRLLHTAVESPPGTGTVPATSGSYQSPPGKPQSHYGGRAAG

SEQ ID NO: 1004903 - protein, 62 aa, Homo sapiens
PQAFFRVPVKVATLPSVSRAGAPPAAVPIINMIFQLSLLGLDLELGLGELERGNSLSPGAQS

SEQ ID NO: 1004904 - protein, 36 aa, Homo sapiens
MLGGKDQARVIVPIQSIQPGCFRWPGSLSLYFDFLY

SEQ ID NO: 1004905 - protein, 54 aa, Homo sapiens
EDPARSGVLAAPQALEDETTTPARRYFFLLALIYGRVCPGDGEPPTLVLNKVSK

SEQ ID NO: 1004906 - protein, 95 aa, Homo sapiens
QQKPYFMYDRNSTNPNHAAVTPWRHQKRWLPYGYMVNSIICIYNIIRVVLQGSDCLGSRHIGWCHDQFKVLNFYTGIIDLFLFTLLWYSGRRTGG

SEQ ID NO: 1004907 - protein, 51 aa, Homo sapiens
GGVDNHTLIPGPCQRCPEPIKSREKKIVLKGGGWGVSYYASSSEQEQRGAG

SEQ ID NO: 1004908 - protein, 97 aa, Homo sapiens
ARGSPNRVLSPTQQLFYNLDNSLEPQRHRAGGSGSIPFHPQGDDNLTDTSGGSGSLSFPPFSSTLEGMIISKTPPRGCLLTPLSTRQGSDNLKKLRR

SEQ ID NO: 1004909 - protein, 70 aa, Homo sapiens
KWWRRSLYDGSPRRPLYTNRILASGVSISGAHHSLIENNRNQLMQARFITSGGGVSYFTLPTTPQTYLRV

SEQ ID NO: 1004910 - protein, 62 aa, Homo sapiens
TTTSSTLAQPRPKREILINQVGFTRYFFFKHNPTLLEKHKGHESGPHNFSLASRVWYPKTLR

SEQ ID NO: 1004911 - protein, 56 aa, Homo sapiens
IEVIIMVTVEIDHVGFLGVGGERTNADLSIESAQWLPPLVTPVPCPPSELSFNANQ

SEQ ID NO: 1004912 - protein, 40 aa, Homo sapiens
MRCALTAYGRGPGVAPPQGAVLVGFLAPPPGTVARRDGVP

SEQ ID NO: 1004913 - protein, 103 aa, Homo sapiens
KDPSVAPFRWASVKQVGVLLWEPREARCRGVGPDLLHVIPVGDDAVLDRVLQGQDTSLGLSLVAHVGEEFREGRGTCGRSWGSEAPGCSVCNVQGVLPQAGCR

SEQ ID NO: 1004914 - protein, 72 aa, Homo sapiens
SGSLQDVALIQVVAIGLGALPRPLIQYSTVEFSHVLGGGDMWCIGGKRILALGLMKCFFIFNITWMDRIKLG

SEQ ID NO: 1004915 - protein, 108 aa, Homo sapiens
VGPGLRSPQGPADRVVSDHVSRPKTLPLSLAPPAHSSEPRSPPSARPKAAGSAPKAGYSNMVTCLRGTYVPRNECSPKSLSAAIVAMQKLQGYASPGKADADTMKAMR

SEQ ID NO: 1004916 - protein, 162 aa, Homo sapiens
MEELLGVLSVGLAPPCRKREAISSEVRPLVSGPLQVGEDEEAAQEHSEDDEEVGTTQLLHIREAHAHNEIGGPVGASLQGQWQLDVDPGLKSSARINQGMGPGPISKKATKPKMATMLREDIQGSCSSSASAMVMSMAQPGMPARPMRCRVRGPARSTTTSD

SEQ ID NO: 1004917 - protein, 63 aa, Homo sapiens
IPDQPQGLPDEPLKTQPDGTVVIAVRVQGFFPQEPLRVTGSESGRGVTEKKFPPSQDASGDLY

SEQ ID NO: 1004918 - protein, 64 aa, Homo sapiens
MYGGRQFLEEGDQARGSLPAIWEKVVRGVKELDEALTEVRTLLHRALPGFEQILTHVQLEDAPI

SEQ ID NO: 1004919 - protein, 91 aa, Homo sapiens
LQCFLEVISAGIPFGLPFQVSTIFPAVFRANSINSCWSRQAMRALVLALGLAHSPMVSIGLPLRRVHGLHQSRVYQQASASPPREHGSPQV

SEQ ID NO: 1004920 - protein, 44 aa, Homo sapiens
LWAFPQREPVKGLRGSLSLASWGPPGGEGKYFSSNPNHPQHSRQ

SEQ ID NO: 1004921 - protein, 43 aa, Homo sapiens
VRCSTYSVTVGGSIQGNTDSNRVHFSGGETGTSSNLWNAGKGG

SEQ ID NO: 1004922 - protein, 84 aa, Homo sapiens
QGKVIVESQSQGIEDVGVPGIFSFRSSEENLQQLIVLRLLLLQVVLVQGLADHSRSLIWAGHLHRGGGWTIRKKTRERLPLKGA

SEQ ID NO: 1004923 - protein, 38 aa, Homo sapiens
GSGCVGRSRGSLGAPIQGVLGEELVTSSFCHGKNTVPG

SEQ ID NO: 1004924 - protein, 86 aa, Homo sapiens
LGTREVQKARNSKLRVSVTNLQTEQYDPLSGTFTYPTAQCAHTPRQETGGHFSGEAVQPHVQARDGVSLSFSIGVSPSKIARTSPN

SEQ ID NO: 1004925 - protein, 48 aa, Homo sapiens
SPNRHLSSRTPFFVPSKAQQAQQPGSNQQGAFPGHWAFLSFAGTQAGG

SEQ ID NO: 1004926 - protein, 101 aa, Homo sapiens
LGLHSGHGGRVSTSPQHRIKLISGAERMAKDLSHVNGKATPSPLWTQMGNRPTIGFILIRKIPKLSGQDYHEMHVGINSLKASVGTGSREAQQHKSGEGED

SEQ ID NO: 1004927 - protein, 164 aa, Homo sapiens
WALAGNSWWGWEGNHLFLLSLSKEEEARGVKLASRNVESYTRLGNPTRSEDLRDYGPSRDVPAYSQDTFNVHEENNSPFLTITSMHRVMEVSHGGHMAVATTGGLTAHRSCAEGAFLTYAYQRQPDRAISSIRSLKNILPGAAQDAHARDEHGQGFYQPPPYLE

SEQ ID NO: 1004928 - protein, 135 aa, Homo sapiens
MNTYISSGWGSEDSSAHAGIRQEVWALVYGCYTCLGRATSSVRLWDLSIPNRQQVSVSPRGMSSGGGYVSPTTSPLIRLDFNIHQSCLESGSFLWAKSCDYRSDAWTSVSGVQVPWPQMLLYLTEDNACLRRPGR

SEQ ID NO: 1004929 - protein, 52 aa, Homo sapiens
PGSLPGQVGSIYFLLQHHNLRRQRDSIGGERGRLRWWMYGSNKGSRFCLTVW

SEQ ID NO: 1004930 - protein, 74 aa, Homo sapiens
MCRNGKCSVLSQVGMSNSVSPGPASACGEETVRCVEGMWQPGGSSLSEIREAHFPSFVEQTWSTPGMGGGSDED

SEQ ID NO: 1004931 - protein, 79 aa, Homo sapiens
TGYKWVAGGLAETSLNNLGFVAIQKVSFWLRVSGRVFGVDWCKRASGLGMVIMGAHGPFTRKGQSGSQQLAGSPFLALW

SEQ ID NO: 1004932 - protein, 69 aa, Homo sapiens
DGRCLEPDVMGFSQVRVGSPEVPSPSKSLAKEEKTLRAADTQDQGAENQAREKLQGALQIRGDKTPSEG

SEQ ID NO: 1004933 - protein, 92 aa, Homo sapiens
ARLSTPNRPRPPSKISGSARKRIACREGGRITPASSRSYKPVDQTIIFLRITLHEGWSLLLGAGLTNRIKGPHYPISCSLAHCRWSGYLGSY

SEQ ID NO: 1004934 - protein, 45 aa, Homo sapiens
HSRHPILSSPSWPHIHRLSCPLSPPQCPQQHSMGIAGSSTSPSPG

SEQ ID NO: 1004935 - protein, 107 aa, Homo sapiens
AGPVPACSEGGGGVFPEGHVEMSRDWGPGGPVKRVWLRRCIFSSSWLYHKEQGGREPGKQALTFFFFSSSSSGSSRPSWVTETRLFPSNSWSGGTQYSSGGSVIYTR

SEQ ID NO: 1004936 - protein, 63 aa, Homo sapiens
RGSPACFGASGDQGHVERCGVSYLSTCAIAHLHPECQHSLHSHVYSGCESDGVSDGMCSIREG

SEQ ID NO: 1004937 - protein, 36 aa, Homo sapiens
ALRSLSTSPVHISSPPAHLQSTSPRGGHRSSQFVNP

SEQ ID NO: 1004938 - protein, 47 aa, Homo sapiens
MALYLTRRDMHLTTTGTVLTRAHQAWPVSHGSGGREMCALPSRAQLL

SEQ ID NO: 1004939 - protein, 67 aa, Homo sapiens
DTGRKSWFLLVGARIIISYYSTTYIWVQKTIPGGQAWWLTPVIPALGEVKVGGSPEVRSSRPVGPTW

SEQ ID NO: 1004940 - protein, 86 aa, Homo sapiens
SSLQGLPLYFFWLRPRECPTGSVGHCPLHLQQAYQETSMRFLRTYGWPGRLFMQQSHKTRFCLHHAAKHWAAQGVVTLRMGKPLVH

SEQ ID NO: 1004941 - protein, 107 aa, Homo sapiens
FWHKRLARDMTSSGLQPRFIFLVGGELIFLKPKLRKRFWKCLWFLGMVNWSIFSLSSSQQRAVVNFVVASYQNIQRLEHSTQISGARGRLTIGGSKRPTMDLVRVPS

SEQ ID NO: 1004942 - protein, 73 aa, Homo sapiens
YTWHAPKRGQFCIFQWVSTESNRYSLDHISARFTSQVGGSILGISHKYKKKKYGLTRLWYKGMVVLEGNYFMI

SEQ ID NO: 1004943 - protein, 66 aa, Homo sapiens
DERSCEFRRAGAGRGRGPGAAPGPHLPPGGSGPGDPVRIHGNITESYPAVPPIGSGESDDPKWGAV

SEQ ID NO: 1004944 - protein, 106 aa, Homo sapiens
GSLPCDIISGMLRTDTGLEGGGPVDGRTLPGTTPCPHRVNVGCGPAEERVLLTGLHAVADIHCENGKTSVGLEICESPTSDPRLALDLTFQHLLRTSGHPIAFQMA

SEQ ID NO: 1004945 - protein, 127 aa, Homo sapiens
LEIPLPGLYLFTSRPGPRAHKSRRKRSQEGRYGPGAASEWNEEGWTLRMTGPSQIPRGAARRLGSLLPGGACTPTPPATSAPISLHGAQGAPSLPWLRELQRQTLTPCMDVHPREGAQAVPSSSRNR

SEQ ID NO: 1004946 - protein, 32 aa, Homo sapiens
MGGRENSSSGLLTSFSVNVLLRGDNILIFLTE

SEQ ID NO: 1004947 - protein, 82 aa, Homo sapiens
GQALYACGSHLTEKEAGGTDVYVPEQGRVSKARRQWLVSHQTELDYLEVVTAPQGARGWHLSSGPTAPLCAPIEFLVSPTHS

SEQ ID NO: 1004948 - protein, 39 aa, Homo sapiens
MPHRYSNFNFICRRQGLVLVTQAGRRGGVIPAHGNLRLP

SEQ ID NO: 1004949 - protein, 184 aa, Homo sapiens
FGSIKGWELIQGIIIYRGGLLRACTIRAKGMLPDPKNTHIGVSGMIAQTVTAGAGVVSYPFDTVRRRMMMQSGRKGADIMYTGTVDGGRKIFRDEGGKAFFRGAWSNVRRGRGGAFGRVRYDELKKVIYGAAASSTHTHTPGEPRDPRRILKRADHQTFEKSSGLPPSRIRPVHGRGRLYDRGR

SEQ ID NO: 1004950 - protein, 189 aa, Homo sapiens
MTPSGRGVTDDRDKGHTAGRLAVRPYERRFKGALTGIGAVGEEFSKKTGDYPSLSARDIQVLALTYQWEAEWVGVSHLKQEPQKVKVSSSIQHPETPLHMSGSHRPYKPKPPKETEKGHSVGEPENREFSSFMCGRNPWPNIDHDRQERWMDRGEDVPSEEAEEEETGFDDRKDDSDDDGGGWIPPSNI

SEQ ID NO: 1004951 - protein, 73 aa, Homo sapiens
MRLEETHSFNAAVQQVDQPHTKGCAQVTGSTDDVASCPDNGQRHEELIYLRAYPSPYSSCTISTDSTVSGGQL

SEQ ID NO: 1004952 - protein, 108 aa, Homo sapiens
WGSIQRELLWKLLNFSSGLFWSLIFLAFITLKRSKSVIWAFLSRASIFWAHRGAAHLVWMSAFGQAGRTYFGGARCGNWRMKSVSCMHWKGRAGLLTGVQGPSTKARF

SEQ ID NO: 1004953 - protein, 198 aa, Homo sapiens
FGAPFMGEGDGNGSWMAPPEARVHLVWPFRRESCMIGNRGDWGRGEKMLRPARNFWMVPLALNQGCLFSCGVYKKVMAQMFPGGGCKHTQDLLQVKTQCQCPSLWEGGNTVKGWFGSIVGTGREKVAGSNRLGSVRRTFQACRDFLIEEADVEGEVKVQVIDSSIFSDGYRVRTVDLLQGFKVCIKRWVSRQVSCTAP

SEQ ID NO: 1004954 - protein, 103 aa, Homo sapiens
RERREAGEGGRKKARGGLQAGAGGPRRAATHKYYGEFSIPELRVCLVAKHSLSLRCLCLPSCPLPHLPEGTPIGRSIQWHAGRPMGSAHPEFYIQDNLVLSRT

SEQ ID NO: 1004955 - protein, 175 aa, Homo sapiens
GSPFGVYHGVTDTRVADSGNIREKDRCCVSVCQGYSALRAQETFMQGDQGRRFYNFLRADNMKKIILSHRQALWGDHVKKPQSRKDTDWSRLYTETSLMQMDDKVMRKFQGYNSLKEYYEEESCMRYLHRIYVPLMRVNAADDPWVHESLLTIPKSLSEKRENVRLVLPLWGLHS

SEQ ID NO: 1004956 - protein, 123 aa, Homo sapiens
LALHTGDYRPRGPVEDAADGLRLAERHGKGAPPPAFSREKIHRDIRGANLLLTLQGDVKRADLGVSGELTASVAKRRSCMGTPQGALMLMSKSSFQPPKRRDKTRGTQNFHHFLKRARNGSPK

SEQ ID NO: 1004957 - protein, 41 aa, Homo sapiens
ARSLPGSLSTFNKSKSGSGMGHLILRARHLGPTPQGWSNGD

SEQ ID NO: 1004958 - protein, 76 aa, Homo sapiens
PTCTGWRYLYPVGRTLTVMWYRSGSGTGGYSVSTGTFGDSAEADGCSGQGTSCNPRKQPGVPAIAATSHWQASSGA

SEQ ID NO: 1004959 - protein, 36 aa, Homo sapiens
DLEAPDEINKLSMLENELVMLKRDVDAAYMSKVESL

SEQ ID NO: 1004960 - protein, 62 aa, Homo sapiens
GGRGPGGHLSLLTREPGNWVPKVLHSGSLICGSVQGWSRQQDPANHQPRPPTGTQTSSPKQS

SEQ ID NO: 1004961 - protein, 101 aa, Homo sapiens
GRGAAQQEVSFFMSQHDGLSSSSCPIRGNIRFSQKHEPYGEWCVPDDLRWNSYLPKLSPFHPRGVEKLPSTKSIPSAKRVGDHGYRGILSRTQQANPIYVY

SEQ ID NO: 1004962 - protein, 155 aa, Homo sapiens
CAPCMGSHAHSIMVSATLLLKPRESQDGPVLVLLISIPGISQCLEPRSAVHTGSSLEVRGRSEEVPGPALAASLQGQIQPDRSRKVTQTLCWASMCLRWMACFQWCLAAPDWESFHGVTVHEPNQIRFLPPGSQSPRSASPPGNGDMCQPSNQTP

SEQ ID NO: 1004963 - protein, 54 aa, Homo sapiens
MRLTISYLRVRKLLDAGDWAMDDDMKAQMNGFYWKALDGLVMVLTDDGDVIYDS

SEQ ID NO: 1004964 - protein, 45 aa, Homo sapiens
VRRGAAQCPPWSLGITFRSGGQREAEASINLKAINTCSLNGAQGV

SEQ ID NO: 1004965 - protein, 241 aa, Homo sapiens
VGILSHHGPSIPEHNITVPFLLVGKTTEPLISLNKSHLQLRALSYIWQRKPRETVQYHTRKEQAVRVFPFGQLPRISEGFSQPCLYVRMEGVDPTTLSVPKLIFVFTPEARKEMWTLILILHMWKEKVHPCDITMSRREGYTMNVEIKCKDRTGSITLLTPNQTNIINFYEVELNECVQCEFDFINTGKFTFSFQAQVCGSKNLVEVEVIEGACSAGIWSISHQRGSKCVMREWSVCRRFW

SEQ ID NO: 1004966 - protein, 193 aa, Homo sapiens
MASGLVLPEETALTGWGHSRQQQEKCEWKGVVGAGELLEEDSEGHAVGTEQVPRQTRGGPWRQREQQAGDVGRGCRGTRVTWDVAETDLCRTPGNLTEKLGGDSDCHAEEQAEGEGRQGHFRNVERGMPEGLEWDTEQADAEGEASGGPWLKTGWGDAGPQTSGEETLRGPVLGDLGRASPKMLVASSGDDSQ

SEQ ID NO: 1004967 - protein, 34 aa, Homo sapiens
PLGIMATASYDTRVYIWDPHNGDILMELGHLLPP

SEQ ID NO: 1004968 - protein, 154 aa, Homo sapiens
CGDGGLTWWGWAANPRDWAQQVRQEPGGMGNPSGDSSASSPADPGAPGSSSKWNSSNTSILGRRSLYGHGDQILPSQQHQTEDSLLFPFGWWGVLGLDLSELITVTEDQIQVLVKSLEGANEDPAVRRDAPHPVINMVQHLAALAHRQGGGSDG

SEQ ID NO: 1004969 - protein, 163 aa, Homo sapiens
MTSPACEGKDYICPENEDLRSWTAVDTAAQITQCKWEAAREAGAVESLTVEGTCVEWLRRYLGEREGDAAARGTPKDKVTHHPVSDHEATLRCWALGFSAVGRSHLTWQGDGEDQTQDTELVETRPAGDGTFQKWAAVVVPSGEEERYRCHVQQEGLPEPLSL

SEQ ID NO: 1004970 - protein, 145 aa, Homo sapiens
STAANSSEHKERGDAGQRWWESSPLVRNPGSPLVQGGSQQALGLSPMHTHGFLQAIPTLQKKTSQCKIGMAGDLGTPVVTGQPLGLRVHTLPRGGAGAPILAHTRGSPSPLILTESSVRTSWCTHGAVSPGIQGGPSELELKGLT

SEQ ID NO: 1004971 - protein, 52 aa, Homo sapiens
MVCKGSSSSPEPGPSIFHGFTVWSSPTVKKEVPQKRVHIPRTKPSGAGMVRI

SEQ ID NO: 1004972 - protein, 93 aa, Homo sapiens
VLVVRGLLVPHGSLDATVLLAQGCRGATGRDPLVLLVLLVPLAPLALLASVVLVVTLTGPGDPDGPHRTGTPYCLCRPVRLSPPCTTGGLGVR

SEQ ID NO: 1004973 - protein, 35 aa, Homo sapiens
MRWHWLQHGRSPRAATCCSSSCRSRKNFGCCLSRM

SEQ ID NO: 1004974 - protein, 72 aa, Homo sapiens
GRGGLSTSREKPGKETDPSAPSWKYKDWKKVRADGLVVVLLWATKEVTSDDRPYKMYSWDKEVQFVQQKGKR

SEQ ID NO: 1004975 - protein, 35 aa, Homo sapiens
ADGNQIQGVVRGNVLVLIRDVAGNLLKSLNGLVDQ

SEQ ID NO: 1004976 - protein, 107 aa, Homo sapiens
GPRWMSPEASDNSRYTGWIEGFPTTTTTTTEKPHCGFYSPHTYYPPGLDSPSFIHVRQRGQSYCCTRLAKQLKGSRTLEWAFHISLFGPLIFTVQIDMVQLPLLKAT

SEQ ID NO: 1004977 - protein, 145 aa, Homo sapiens
RGGSSHSKAKRLPNTLFYVPVIHIVYFTFFPKYYRMEKRTFKNTRTLRKVKKANFIWNNHQIKNYLWRRDRGAQAGNPSTWGGRGEADGLSPGVRGQPQQSETSSLQKTNREVRREDGWSPGGHEGNKLSSCHGTPNGTEGGRPR

SEQ ID NO: 1004978 - protein, 172 aa, Homo sapiens
QTRDVRGSEVTGGGGEGSQSLRVGAAGFECLGVGHVKFPTPQVTLFQKPVDIPVSVGSPGLNVDPLSPTSILGLSSSGRGRSGSHHLVAGVCESKAEFGSGWEQKKELDTIYKAQVGCGRAGGLSCACGLWAANPFLAVLSPLFCGENQEKESPEILKGPAQQCMAQQHIVT

SEQ ID NO: 1004979 - protein, 35 aa, Homo sapiens
LQVDCVCTRAVHASCVQVPSTREHRADLQISLSWS

SEQ ID NO: 1004980 - protein, 38 aa, Homo sapiens
SGRDSAQGGLASGVHAILRPQPPKELVEPDSSEFKSWA

SEQ ID NO: 1004981 - protein, 44 aa, Homo sapiens
CPRGYDRHPPQLSVSYHEQQSDPIGGLRLRSSQHKPAGGSSSRR

SEQ ID NO: 1004982 - protein, 56 aa, Homo sapiens
MNRQAGPPPLPGGLRENRFTAPFPYLCLLESPGFTMDDFASASTDLIFHSATPSQT

SEQ ID NO: 1004983 - protein, 36 aa, Homo sapiens
LVLRDQDGHWSCLVLGVIIWMVPRGVSMGEEDGLAH

SEQ ID NO: 1004984 - protein, 52 aa, Homo sapiens
YGTSAGLLVEGLKKLTSQWRKAEGQAYHSGKSRSKGEGGSRFFKQPALSTNS

SEQ ID NO: 1004985 - protein, 67 aa, Homo sapiens
RQAIEENKQLQYNGQKRNWTHEWDAHKENREARLAAKREGWREKDQHMEDSGKTNESKDPADETEAD

SEQ ID NO: 1004986 - protein, 30 aa, Homo sapiens
MGSSASATVRRSHFSRYSMMLTLSAELLAH

SEQ ID NO: 1004987 - protein, 32 aa, Homo sapiens
MIPETTVVLRQYSTRSKQWFIQAGYPKHWCSC

SEQ ID NO: 1004988 - protein, 130 aa, Homo sapiens
GLLGEHCEWWLLRVCGDPLGRYCVLRTDQERIVLFSPGTCTLLLRAVTCSRGQADSILDPQYVHGLWGSLSLAAQVEGRVGGHRPVFGLLQEVLQALQPNIAWPGTRRSDVPDHPFTGTVPCRTPRVTRS

SEQ ID NO: 1004989 - protein, 69 aa, Homo sapiens
GEDSGTGTVMMTSSDDEQEKKPEAPKQLKKKWRRMNRFTVAELKQLGARPDVVEIWKIKKLIKSWEAAR

SEQ ID NO: 1004990 - protein, 33 aa, Homo sapiens
MTKGLEGGKTGTGRAACNVSAVQAEHIQRLSTR

SEQ ID NO: 1004991 - protein, 108 aa, Homo sapiens
PSPALLCSTCFRPGGRGRPSSVSPESGRFCRGRACTCTGGKWRWHTHRVTFMLLRAAVDHTIGENLLFLQSCVSCHTCTLPVLRPRLVCRALSSGYSPVMEPSPNRDK

SEQ ID NO: 1004992 - protein, 39 aa, Homo sapiens
RLRTGLKTIAECLQIAHQCCQGSSNSYAIEKKDELSPPA

SEQ ID NO: 1004993 - protein, 30 aa, Homo sapiens
VSKVLFQTGRAWAYTTAPGALKDALPCRTA

SEQ ID NO: 1004994 - protein, 94 aa, Homo sapiens
QVPARLPARDTTLKDAQRSSCLRSSTTSRPTVDFQLRLLHQSLAHALAPALPPSSSRSGSSSTSRISSSYLALLVSLLTFLFRLQHPYYTVTRS

SEQ ID NO: 1004995 - protein, 40 aa, Homo sapiens
VLLTEELMQSRKAWAYTGPTAGGREATRPAFPSIVLVLPH

SEQ ID NO: 1004996 - protein, 140 aa, Homo sapiens
VGGWNGRRVWHTSSMGLGMVAVPVWPASIPRVPAPFPVSLLRPVSLLRPVSLLRARVSALSRVSSPSLCLCSVPRVSAPLPCQPPSSCPFALPFHGDLARVEAFDQAGHADLVLGHLLPAWGPRCHLWFSGLSFGFGDSL

SEQ ID NO: 1004997 - protein, 155 aa, Homo sapiens
AAARGREPPPLPLPPIRAPSHTLAPCGTSGFCEEDGACVGEGWLGERDTEGMPALTCPCRCVPCFRPLPPHLLHGSLGSIQRPISFLFRSSSQSGSAPFLTILCPADLCRYPPAFRIQKDSVTQLRPVLESRLLLPLPQDLAEALASGVILCQLA

SEQ ID NO: 1004998 - protein, 57 aa, Homo sapiens
VHHSVQLRPPTHMPLALRQAAFIERLADRTGPEGLEPPGAEVLLRQTTGCTSFPCRT

SEQ ID NO: 1004999 - protein, 70 aa, Homo sapiens
MGVLGQSERGGPVGPARALTLTSSHSAPERPEGNRRVTPAWSAELENMGLRFELRVHDVLFLYATHFFLR

SEQ ID NO: 1005000 - protein, 75 aa, Homo sapiens
SPSSLVQKRHHTRLFCTDMNERVGKSGNIPAGTTVTLKITHPTEFDFYLCSPAGLLGTSRPSLYHVLWDDYRFSS

SEQ ID NO: 1005001 - protein, 99 aa, Homo sapiens
TRAGNGALPGNHSNVVLQLAWSSTTLHEKDQTWLEQLPRIGNLHGLGCCTLNAVTCSSVLQLLIALPGMAGGPGDKLCSLDPVAAGPASRSSILRNPSS

SEQ ID NO: 1005002 - protein, 146 aa, Homo sapiens
TGPRAAAHGMTRRAPWRNGDGTKSNNRGALPAMPSSHDRHASCRVSPPTSMDVPSPVQRWRFCTRHEPLKDYYTLMDFAYVYPWRRNGPLPLQYRVQPACKPLTLSSAPTPSEGIHTSGASECESVRHEAPSPATLPATSSSLPIP

SEQ ID NO: 1005003 - protein, 102 aa, Homo sapiens
MRDHFRFTDRACSCSEPVNLVGTADAGLYLTCSEANRAFVAPPGQVILRSSTPQQKGRVSSVYKPLEWSRDSGGYLMAQHLLVVPKQKSVQNLRPSVKYKSH

SEQ ID NO: 1005004 - protein, 47 aa, Homo sapiens
AGTGIGTLQEQANDGTPYPSGTASLWETQPDARPTGPRAEEERLLPA

SEQ ID NO: 1005005 - protein, 67 aa, Homo sapiens
EYRREPPRPGGIYHSLIIHLWKDLGVNFQFGAMKNKTAVNMPFYISASHGTHDPVSLYPGHHWVLAR

SEQ ID NO: 1005006 - protein, 68 aa, Homo sapiens
YSGQYTSRVSNRAGAINATYRWIDPADRSQARAHRPHPVNTQVGTGKRLLPQTKALSWEQQEKYSLDP

SEQ ID NO: 1005007 - protein, 67 aa, Homo sapiens
ISPDAEAIIQEVLTENSMDSVDCCCSLKKTESFQNAQAGSNPKKVDLYHLERSQVPTALSSVGYIGI

SEQ ID NO: 1005008 - protein, 38 aa, Homo sapiens
MICTPLSPRTLTAFSSSVSQSDISLLRLLAGPDASSCP

SEQ ID NO: 1005009 - protein, 78 aa, Homo sapiens
WEFQREMCHSAPMQPGCGATGTGVWEERLDEGLQVVAAPETLRRPGTDMLCELKTPVALEFSPRGKPTTGRRNFENED

SEQ ID NO: 1005010 - protein, 69 aa, Homo sapiens
STRPLWKQKACRGGESHKPPPPGLTGPLAVPQGGYPDFTAQELQPMSPRAGDWRGGEQLREFWVLNPEG

SEQ ID NO: 1005011 - protein, 51 aa, Homo sapiens
HTENAGAFGPPRPPGPPDPTDSPSAGFDFSFLPRPPQEKAHDCVRYYRADD

SEQ ID NO: 1005012 - protein, 97 aa, Homo sapiens
QQSSNKSPPSTLQQLRRRRHQDRRRLKTDAMTRITRWQPLMVPSKRQEAEPLHQETNQASGSGKKKASSKANKRPENVYATSTPLFMHTHLYSIRMA

SEQ ID NO: 1005013 - protein, 72 aa, Homo sapiens
QSRKVWTTLHHLNAPVCVLERSLQKPPNFNSLCRGMMTTASGASCLRKLNAVSRTYSFVQPKPDDSQIGPWH

SEQ ID NO: 1005014 - protein, 35 aa, Homo sapiens
LRSARVLRSVCFLAPPPNQEAQEAVTRLRPSTSAL

SEQ ID NO: 1005015 - protein, 34 aa, Homo sapiens
LAWYTRRAMLGCIYNTTELVMMQESSPALEDTWR

SEQ ID NO: 1005016 - protein, 45 aa, Homo sapiens
HTSFTASDSQATSCVHSTTLFGGLQTQHGRGSRSSQSSHPWSISC

SEQ ID NO: 1005017 - protein, 33 aa, Homo sapiens
FSFHVPSTASVHSPRQHIISSSSNGPHLQGAIS

SEQ ID NO: 1005018 - protein, 42 aa, Homo sapiens
SPPVCARGRYVTDQTKPTTDLFRRCNLELTSTFTHSFNRRTP

SEQ ID NO: 1005019 - protein, 70 aa, Homo sapiens
MTDSPTTTRCGCYSTRRTGGHWNVDTPLQDVCNNLTRPTLPYALTTGLALDASVPTTPCRRRHVDDVDHA

SEQ ID NO: 1005020 - protein, 37 aa, Homo sapiens
MGALNTLGHTTNHSWGVDARERNTGRGATPGRGATPG

SEQ ID NO: 1005021 - protein, 50 aa, Homo sapiens
WKGSLACCPAGSAGVQSQFRESSTSGVHAILGPKPPEQGGTTGTGEVEGT

SEQ ID NO: 1005022 - protein, 48 aa, Homo sapiens
PRDNIESSTSAPVTHVHIPVVEDGKMDRQMFLATWKDIPNWNDGYVAP

SEQ ID NO: 1005023 - protein, 46 aa, Homo sapiens
CVCGTLLYDGTYTGCDLRTVDVLYSTDDVTTLLTDDTVGYYTRRRS

SEQ ID NO: 1005024 - protein, 43 aa, Homo sapiens
VSRGSLYSRVLRWWVSMDPILGGGTNTLWLMLLRTLWLLSTPC

SEQ ID NO: 1005025 - protein, 60 aa, Homo sapiens
GRSTTDSPMLGYLRVLGLSPPQTTGRTYLYYVSFYAFYGNHGRLTRLTNSTVYATYKNSD

SEQ ID NO: 1005026 - protein, 65 aa, Homo sapiens
ITVPKPSLNSLRATESTAAPEQQQRRARQYSQQWCSTPLWRRTETSPSHTRLGKAYLIVGSHVLQ

SEQ ID NO: 1005027 - protein, 38 aa, Homo sapiens
MIQYYQNDIPTEEGTIRGPLPHVPFKLPHNHGALRPTR

SEQ ID NO: 1005028 - protein, 48 aa, Homo sapiens
GLPSKTPGLSARSQLESCGCPQRPGLSRVWPHKVSEAPAHWPHRAAAS

SEQ ID NO: 1005029 - protein, 52 aa, Homo sapiens
KGRCLALRDRSMQGPQPTFPMQCSGKRKNGFVVLKGRTYEIVEMSTYEDGQT

SEQ ID NO: 1005030 - protein, 146 aa, Homo sapiens
IDISIIWVHLCQLVLMGESIYSSACRRGSVCLSDVCNPSELPSTLPGTVAHCLTLGEATAGGLPDAQEFETSLGNMDETPISTKIQTTRIWDLAACTYESQLLLTADGQRTRLKPRTADGCTDNPDGKRYARDAKDRTRRHSTPGV

SEQ ID NO: 1005031 - protein, 67 aa, Homo sapiens
AHGSPALKQPRLQAHASMSREFLVFLVEMGFHQVGQEGLTSLDLVICPCRLPKGLGYTGMSYRAQPT

SEQ ID NO: 1005032 - protein, 65 aa, Homo sapiens
MSVPLMPAHCTHCTPSRGDTSETLSQKQNKTKNQKLRDQNGRLFGLYMLGRAGYGWEESLIPFYI

SEQ ID NO: 1005033 - protein, 67 aa, Homo sapiens
LQQQHHTHHTPTRPTSSHGHHIIPSSHQQCQQQHRAVSNTGSTQSIGTNNRLHISAHSALHQHSQVH

SEQ ID NO: 1005034 - protein, 90 aa, Homo sapiens
RSKMWDTGVARAGPDKFLIREKRNGEPHGPKLFPFGNPHPESRFSPKDPLVVPAQSGRYPELWVQSCPERAPGRGTLAAKGRVRTPGTGL

SEQ ID NO: 1005035 - protein, 51 aa, Homo sapiens
RKKYLGIQLRRAMKDIYKENWKTRLKEIRDGRVQWLRPVIPALGRGWGVQV

SEQ ID NO: 1005036 - protein, 95 aa, Homo sapiens
GTRLRRTSSPPPPHRSAGSTSASSWMIQEGSSSSSMEARLPLGVAGLLAPAVQVQAHEQIKLLLVAGAIIWVDGSLSSGHRRLPPSSWLLVAGVP

SEQ ID NO: 1005037 - protein, 111 aa, Homo sapiens
LERWALNDHGLDCLPWGSCTRVTVGADDLHELLAIDTWANVAIWWLGLNGHWWVFSFCYSCISTLLVLGSRFHGHLVTGGTSSSVTAFFTARISLEFYSLPHVTHRVKLHL

SEQ ID NO: 1005038 - protein, 46 aa, Homo sapiens
AKPRVRDGPRMHKLRQQQAGLALGPCGASELQADSPAYTNHILRRP

SEQ ID NO: 1005039 - protein, 46 aa, Homo sapiens
MSRLQEVHNNSVDDRYSQLNETYVINNHEVLCHNRMKRCAFCPVLS

SEQ ID NO: 1005040 - protein, 67 aa, Homo sapiens
ARGGSGTVGTGVRAGRGRPTLADTGPSRFCPEPPPGPWYSSCSPFDVSGDSAGLLLPRRAGSLDAGT

SEQ ID NO: 1005041 - protein, 48 aa, Homo sapiens
GEDTRRQRWAQRFKLARLAAPILGGRGTSARSSSEQTVLLMNLQNSAR

SEQ ID NO: 1005042 - protein, 66 aa, Homo sapiens
IIQQVFDTGSIYNPEVLDITEDTLHSRFLEGARNVASVCLQMGYPTVASVPHSIINGIPHEHLALP

SEQ ID NO: 1005043 - protein, 55 aa, Homo sapiens
MVPSVCFLIPPPNKDAIELASRVEQSYQKVMALSHQLHVTTTSLISWNYLRKDLD

SEQ ID NO: 1005044 - protein, 65 aa, Homo sapiens
RGNNLLKHPSSITDTIYGTSMHILTQKARDSMLSSEISLQDSCHSRVRYPIGLSLSEMRHPKVQV

SEQ ID NO: 1005045 - protein, 47 aa, Homo sapiens
NLESNMRLYIYGLAMVPDLFPKRSLRKLSRLPTDYHTWKKQQPPGYN

SEQ ID NO: 1005046 - protein, 96 aa, Homo sapiens
RTSLMLVCGTEKMEGGICASVPEHREGRPLRGTTGFLRGVHSLMRGWCIATSVSPPRTLGARGCGGEELLIPVPDTVGTHSWASIDEDYSAQQDTE

SEQ ID NO: 1005047 - protein, 67 aa, Homo sapiens
MPLSNPQPIAFIFLAICSSREYMSGQKSRLEILASDVVEKYTTIFLSVRSCRVWCQDRSGVMGYDSR

SEQ ID NO: 1005048 - protein, 73 aa, Homo sapiens
CWASRGIIAIFTFVEPVSAFVRRNVAVYYVSYASSVTYLILACWQGPRRRFPWNIILLSLFTFAMGFMTSFRD

SEQ ID NO: 1005049 - protein, 51 aa, Homo sapiens
MSGICESNATTCDIYAGNYDSGFRSQLDFPLVQLLCDYASDKTNAILARRD

SEQ ID NO: 1005050 - protein, 117 aa, Homo sapiens
MWAYGHFLQRHLLCALYGYGRQFLFYNNFLFIPSFILQLSYSSLRWWATRAYPNSSVCKAGTTLDRMPSHHRAHSPPTHTQTATRHQQTSPAHLWGVGGNQSAQKALRPGGRLDGAQ

SEQ ID NO: 1005051 - protein, 105 aa, Homo sapiens
MLAEMWSKQKPFFIGAGNAEWYSYFGGQWWWSLIILNILLEYEPATLLPSIYTDGLRNFCPQRNLQRARLWQLSLSLPKTWKEPRYPSINVLLHSGGCNKIPYTA

SEQ ID NO: 1005052 - protein, 37 aa, Homo sapiens
QTRIFWIGLAEQVLGHCGSQMPHGSSGKAVTWSVAQL

SEQ ID NO: 1005053 - protein, 118 aa, Homo sapiens
HLNLCWDRNRMMASAETPQQGGSSNKVTTSSRKATRDIPNRRASPLLLKEGHKDHPNREAHPRPPRGRPQGQPNRDGISKVLPQLLLESPRDHLPKGAAHKDLHRGSLLSNLGYTDRK

SEQ ID NO: 1005054 - protein, 75 aa, Homo sapiens
DSEDLQTPQSPPPGSRDSLPRFLSSWNYRRVSPSPAKFCDLVEMGFCHVGQASLELLTSSDLPALRSQSAGIMGM

SEQ ID NO: 1005055 - protein, 80 aa, Homo sapiens
MRPRKITLSREYQSEKSMSIVGWNLPSPIGCHEAKPPGRSQISGRLLRSARSYSSGSADMPRIPKRWASLNSEVNKHPLK

SEQ ID NO: 1005056 - protein, 32 aa, Homo sapiens
MGFCHVGQASLELLTSSDLPALRSQSAGIMGM

SEQ ID NO: 1005057 - protein, 148 aa, Homo sapiens
YNSRAQDFDKLAKLVSWAQVTPPTLVSQSARITGLNHPTRPNLIITGSRLDYKQTFYSASWTTPSGLFFPSPGSKWAFEKNPGGAPPSSSIPPFSLPTPGNQLSDLRIPAVFWTQVTSQLKYRSNMNLMTNHSAPPGYAPKPTKPNRL

SEQ ID NO: 1005058 - protein, 37 aa, Homo sapiens
ERIPRSKCPLSWEGLSSSTITNNTDSNRPLGLLSRAY

SEQ ID NO: 1005059 - protein, 35 aa, Homo sapiens
SSPISHLVELNTMLALPKRKKERLGTLCPELRTSE

SEQ ID NO: 1005060 - protein, 60 aa, Homo sapiens
PIITQCLGKRARGNVFMYHAPGRTTGMAGNPNYPYEFSGKVPTVCIPPGLTLYPVLVERS

SEQ ID NO: 1005061 - protein, 36 aa, Homo sapiens
HIRCGYCQLVHADTTYRAILALLNLTGCQVVTVAVG

SEQ ID NO: 1005062 - protein, 39 aa, Homo sapiens
MTSARPLLDKLVSLCCPGPPGEAWASHTGSLRAAIPHSC

SEQ ID NO: 1005063 - protein, 42 aa, Homo sapiens
GGVEQSYGSRYAERTRDKLKESLKEVQLERDQYAEQIKRRAG

SEQ ID NO: 1005064 - protein, 101 aa, Homo sapiens
KLQEEIQLHGRSRDHFGCRRSGRGCSYSSIDIDLERRIESLTEEIRSFKKVHARGSIRAAARLQLQRTGRSQVAAWTCLKPSTSTACPSRASSWRSSHAAP

SEQ ID NO: 1005065 - protein, 66 aa, Homo sapiens
RSTRNLGAHGVPKTGLATVREKTLDKTRCTGHPLRFKPRCARARGLKEMPCTPKPPRSPHDFRNSI

SEQ ID NO: 1005066 - protein, 32 aa, Homo sapiens
MHRNPPGEPEPRLRCPEVAPGQTGATQSRAAP

SEQ ID NO: 1005067 - protein, 54 aa, Homo sapiens
MTCSTRPVGTLKRESTPASVVAQSRFAFFCFWDVPWEARAAMLGPVVACKARGP

SEQ ID NO: 1005068 - protein, 83 aa, Homo sapiens
LRFLVLNFLEHGSEPGHERTGIRPGSWPSGTTWLSISLLDLLCATSSLPHCLLDLTDQLLPYGGAPPLGLLRGIVHACSPAPA

SEQ ID NO: 1005069 - protein, 45 aa, Homo sapiens
RLRQECHTTEKRLSAGQAQGSVAFDYRKRNILQAGLTGCEKNIYS

SEQ ID NO: 1005070 - protein, 35 aa, Homo sapiens
LHIRLLGVASPGLSPGCLPLCRIRKRAWTAQCLTP

SEQ ID NO: 1005071 - protein, 51 aa, Homo sapiens
GGCGTDAEHEFHTKTTSGYAGRLSSAYVGPRIAPASATCLALQPLGSGVGL

SEQ ID NO: 1005072 - protein, 73 aa, Homo sapiens
TGGCQPMNALESYAFNMKSAVEDEGLKVLDHARPTRRRCWTSVKSVISCLDANTFAYKDDFEHERKELSPLRL

SEQ ID NO: 1005073 - protein, 109 aa, Homo sapiens
MVSLLPGSDPFPRHGGLALQPGPPRLHPFPFHPSLGPLRSDNVYRWQLGQPLRPDMSYAERLAAERQHAKWVAALAPDPLARLRMLAVTPHQHQHSPIHSHLHLPQPDA

SEQ ID NO: 1005074 - protein, 136 aa, Homo sapiens
RENTHRGIYLLETCSGESARSRHALFSSQTCLMSKYVKRSLTVPGEHRPRYCCDQVVTLEPDLERLPGGCPGNSPMNPEALFTAGGDAVTYGSKQPSRLYDERCETADAFALWHVGSLTVALQAAAGPASNPTGHP

SEQ ID NO: 1005075 - protein, 76 aa, Homo sapiens
AAAAGKAHTGTAPWPGDIQNAKWACWLTTPPRSTKALLDAFEVCSVELLLARASELQRRAMPLSVSAAAVLYYHQA

SEQ ID NO: 1005076 - protein, 66 aa, Homo sapiens
AHRALRQLEIRRAAGALLRRPALRKLLSERTACYSGALIEQEKAAEQLFQDELAAQQLREEQQRQQ

SEQ ID NO: 1005077 - protein, 38 aa, Homo sapiens
MCADWNSGLNIRKVVTVRHQAVTRKKDNRFAVAVDSEG

SEQ ID NO: 1005078 - protein, 35 aa, Homo sapiens
RFYYLLTEGRGGFRGAAVSHSCSLLPQVPGLLQWI

SEQ ID NO: 1005079 - protein, 61 aa, Homo sapiens
RRPRWRLPEVAVEATTPAAGGGVGLGSGLSVGGLWLQCKVGLRAGRWALRSRGGSMLQRSN

SEQ ID NO: 1005080 - protein, 132 aa, Homo sapiens
RGGHGNKRKQPARSSPCTGGLQLTELDSLQVEHALAVARIQGIERQDLYTSVAWSPACRVPCLITSQMHWLDESLEVKGAAMLASPSFTMCVLSSSRSRSTWLRPSLWEVGCSSDGREPRPLLGCPGRGSHA

SEQ ID NO: 1005081 - protein, 47 aa, Homo sapiens
YVCSRVAATESVHQQTGREVHRGSALLLVLIFLLQFIYMIFPLNPDL

SEQ ID NO: 1005082 - protein, 50 aa, Homo sapiens
YWFSCLSLIIPNKMRMQSVGDYENDCAGEASGGLGGEMAVTTMNPRYSGT

SEQ ID NO: 1005083 - protein, 80 aa, Homo sapiens
VLVDTRRLCTTTTEIILTRDYWSFPVHCDDYPSKRIYAIEYGYRSSSVTIQSHPMWRFLQTIHIERYGNSRSAPPTREPG

SEQ ID NO: 1005084 - protein, 38 aa, Homo sapiens
FSSTLRIRVLFSCAWVHEAFAELQTDINELTNHIDEVQ

SEQ ID NO: 1005085 - protein, 49 aa, Homo sapiens
MVIKLAKELPPPSEEIKTGEDEDEEDNDALLKENESPDVRRDKPVTREP

SEQ ID NO: 1005086 - protein, 68 aa, Homo sapiens
YRIFTSSREVLHAIAARTEAAIRERSAIAYGDSNQCSPIQGAADLMGKPSYPNLSPEHRIITILAQST

SEQ ID NO: 1005087 - protein, 47 aa, Homo sapiens
MRSDGIYCCCCEIVLLKLNEICVCVCVCVCVCVCVCVCVRALRNKLG

SEQ ID NO: 1005088 - protein, 105 aa, Homo sapiens
RILRDIVEGHTQVTRGIVDDTPRFTRNVVKGTPRFTRNVVEGHTPGSHTHASWNDTPRVHTEPSWKGHTRCSHWNACGKHTPQVHTGIVLESTENQFTPGTEARN

SEQ ID NO: 1005089 - protein, 129 aa, Homo sapiens
QDGVLREESGDQAGVQWHDLGLLQPLCSRFKLFSRLSLPSSWDYRCPPPRLANFCIFSRDKVLPCWPGWFKLLTSGDLPASSLSAGIAGVSHRALPRILTVKCCCFNLEILRTEWDEFVLIFTSVFFSF

SEQ ID NO: 1005090 - protein, 48 aa, Homo sapiens
TLRGSRCLSVQRGPHNLEADLIGGLNHNILIHGLVAGGVGEGPVGYRA

SEQ ID NO: 1005091 - protein, 115 aa, Homo sapiens
DLEDPTRVFSKPGDTFPVFPGSFRTMTLRMSTGSVTRQNTSHLGLVDRSPMTETEIMWSGQIKKKPTRRSDVHDIGRAGDMDTSNTLCQLQLAGPGGIEGISPGQQDQFFLGKNG

SEQ ID NO: 1005092 - protein, 34 aa, Homo sapiens
MTRGVSQLSQEAAVIVQCTPQSSVAVLKVRRGMW

SEQ ID NO: 1005093 - protein, 36 aa, Homo sapiens
QKWSCYRHGPSPGESSVPEKLAGKADYHVTPACSWD

SEQ ID NO: 1005094 - protein, 32 aa, Homo sapiens
MAHHLALQCSGRGHAPFSNREGTHHMTTTPTT

SEQ ID NO: 1005095 - protein, 60 aa, Homo sapiens
IRCAQYKKDGARLSPSGVCVAEDGENTPPQPSPYMENANVLARNASICQQNGIVPIVAPE

SEQ ID NO: 1005096 - protein, 80 aa, Homo sapiens
FSPEKAPFLWPEVSPMALSWMANLRMMVQIIPRVIFAVAVHNLYLPRVETMHDAICWAIQVHALCSHVLICVHSHSSPCS

SEQ ID NO: 1005097 - protein, 47 aa, Homo sapiens
PPPSRAEAEVGCVKIQLHPQPTARAEEGYGWWEVYWDVNTGFTRVFG

SEQ ID NO: 1005098 - protein, 87 aa, Homo sapiens
MVLYLEPGIIGYVDTTHGKCLRIARGVQPWVICDGPGFLMNWRKYDLVHMEHVSMSLKTMVERGHTQSKTKTRMKLALRGGSGYTSV

SEQ ID NO: 1005099 - protein, 34 aa, Homo sapiens
VLTGITPVRNFIYEGWVHCLDSFMCLSFAGTHAY

SEQ ID NO: 1005100 - protein, 141 aa, Homo sapiens
GLYLQPDSSLLGDENSVQFCYGGERDESLLGKRKASTGGVAGFEKSSQGLPSFPELIILVSPYQTPEEEEILNKKGSKKIQKKYDEGKKNGKISSLREEQFQQGKFLGEKAVGWEGGSRRDGVCRGTFPWSQFLGLASHAV

SEQ ID NO: 1005101 - protein, 149 aa, Homo sapiens
AGLYLIAIFQHQAMLTSSTRIPDVNMRHVLVWGEGQPIEYGKKKLNYRPYNHQHEYFFRMGPPLLIPMYFQYQIIMTMIVHKNGVDLGRGRSYYIGFFITYIPFNGIGGALFFLNFIRFLGEPRVGVVTQMNHIVREMDQEAYRDGYSS

SEQ ID NO: 1005102 - protein, 96 aa, Homo sapiens
GSEGRRLSQRRSLPESLYDAELSQMQTHISDSSVVLSMDTNRNRDLDSIIAEVTAQYEEIGSKKPGSRGSAFWLQQRLRVRLGLLECILQPFQFVL

SEQ ID NO: 1005103 - protein, 121 aa, Homo sapiens
GKALTSVSSSSSVDTSAFFLAGHSSSSWFSFSSRIACGSVRAYTSIAARRSFLAWRELGQPIRQGLFPLQQLLLWGLEPLGIGFYPILAILVRGSIRTRPFHKSRGIRLLGRTAQSLPFGR

SEQ ID NO: 1005104 - protein, 78 aa, Homo sapiens
HLKSGGRTCSCTEVLCAGSGEARRQMLAQIPRPERWVFIRDKSTDKPPGGGVKIKKSISKSLAGSLIKNLSGRLNDSR

SEQ ID NO: 1005105 - protein, 58 aa, Homo sapiens
RGAPTRRMTLPRLEDDENNEQRTDDIRWRGPRIPESQTKEHYRTSCGLQGYLDIKRLA

SEQ ID NO: 1005106 - protein, 84 aa, Homo sapiens
HQVNGGHVTADHMSLPDDNGAYRCGPPLHSDREYTVTSRREGYVRRAGEGTIGDFKAYARAGVRLDEEAEDDQPLGGVLLSRRH

SEQ ID NO: 1005107 - protein, 41 aa, Homo sapiens
AQFISTHYDNLKEQCLLSFANAIVDSRVSLSLLNGRDENNE

SEQ ID NO: 1005108 - protein, 41 aa, Homo sapiens
LHMVSRTKSLLTTGPTILQPYPSIFTSHRGSSGTERPLLFQ

SEQ ID NO: 1005109 - protein, 51 aa, Homo sapiens
TAPPPISSIADSTMSLKIRNCHAQHGKTSLNLGISIVGQSNDRGDERHLDW

SEQ ID NO: 1005110 - protein, 107 aa, Homo sapiens
GELVIHCKSFMMAEGHWNARAPVHGPASCTCEQADVISIQILIPDSPRLERVKVGSLLQCWGLRSRHGPGSRPHHRSGVLSPWKPSEKEDHDVGLLLMALRNLGLGH

SEQ ID NO: 1005111 - protein, 31 aa, Homo sapiens
MDLQLSCSDTGGLNCIDEQSSGSPHSLESAG

SEQ ID NO: 1005112 - protein, 44 aa, Homo sapiens
VKAPVCPSSMWPPWTLVPQYQEFGFDVGPVCFLLTPSIPTWLLP

SEQ ID NO: 1005113 - protein, 148 aa, Homo sapiens
MGCEMSPGNWPGTLACLCVVVFPTVYVLSAESAFNCDMCSLQHDVSAAAHCLAVPGLMVKIELSCHMNTVWARKIRNTCGLGPIYLVPHWHTLSRPGKMPGFCCVLYCAAFLGRAVEKVDVGQVLTRRGVSGVALGPFLLYVGWRWLF

SEQ ID NO: 1005114 - protein, 38 aa, Homo sapiens
WRESSYPFINPKACATGFFLISDVATDGKSLCNLILSH

SEQ ID NO: 1005115 - protein, 34 aa, Homo sapiens
SETPSQTKSRTKTNINVGTEKGPPFKQRAGVGTE

SEQ ID NO: 1005116 - protein, 41 aa, Homo sapiens
MSACYVAMWDAMSADVCDVYIRWGSSEYYRLSRQSRSRCSR

SEQ ID NO: 1005117 - protein, 106 aa, Homo sapiens
SSRILSAAFFFVTMPAGKRRSSLPRWDGGRAETLLTFQTAQPGRGAPYVPDDGRPGRDAPHFPDGVAAMQRLQSRHFEEAKAGGWEVEVVRAEITPLHSSLGTIEH

SEQ ID NO: 1005118 - protein, 48 aa, Homo sapiens
WCSTGSEYWSRVVVAIRKRQKDGLSLELEISLGNTAEDPFLQSKTKHH

SEQ ID NO: 1005119 - protein, 194 aa, Homo sapiens
SEPDVPEISIVITNVDLRSCIVCWLGSDRYPTGYFEYGTHSNPFPPRSNRSRYKASSWLCVGGTDQPIHSQPFGGARLSLVAEERMRSDSVRHLKVIIKRPRLSSAPKPDGSKGDIKSPTNTSLLRKLISVMLRCFAGIEECAEFEGVFVGYSNAAAECREKRHGLSRWGLPLQSLVLLAPLQKANGCAGTVAL

SEQ ID NO: 1005120 - protein, 119 aa, Homo sapiens
TRRCWGLFDGWSPLFGEPLPKDCSQNSSRILFLGQSFGMLQTFVSYTRDLTGALTLDVGYLGTLLFLTVHDVYFSLTHDTPNAVGLSTTFTFPTLTSSLPLCGLDGWTQLPWTYGDSVR

SEQ ID NO: 1005121 - protein, 57 aa, Homo sapiens
AKWTHWRATDGCRPVKRLPQSGFQICIMRVTIVPFARALRVLRVARGTWRDWMKNEG

SEQ ID NO: 1005122 - protein, 90 aa, Homo sapiens
MSNTLEQKVATFTYTVISSPNGDSSQSSMGHEDEGWTTVGIVIMVVVCCVVGTSWIGVMVINHHETAHLHDYSITNREELNLAADIPSYL

SEQ ID NO: 1005123 - protein, 60 aa, Homo sapiens
IALALVPIRPGPGSGITWRLSPCNSATAGGLPPGAPSGTLLSLMVWLPLAPGRLGAPLTS

SEQ ID NO: 1005124 - protein, 42 aa, Homo sapiens
DYELELVPIRPGHKGWDSETAMNLCELWQPASTKVLCCYFKE

SEQ ID NO: 1005125 - protein, 55 aa, Homo sapiens
YRSIWRNCAMRQIDIDACCHVVLLGCDTTLIRHTPQPSPSSSFNEGLLTVCGHMC

SEQ ID NO: 1005126 - protein, 59 aa, Homo sapiens
IELSWYPHQEDSGWCFYCPDCKARNELMFVDMAGGAVELVQPERASPPHKVVATARALE

SEQ ID NO: 1005127 - protein, 65 aa, Homo sapiens
LHIESSLYHRRCFTRCAARPDGLAGAVIGVGDRADAYSYSHAPHALPEGSVWQLASETAGRPMGG

SEQ ID NO: 1005128 - protein, 148 aa, Homo sapiens
LYWYPMRHFHLPLVPQAPQGRYIRFILGTALLCRVNIILFPYSQSANQMPERLPQSPTLPRHPGAYFILFYFILFWRQSLSWSPRRECKGVSSAHGNLGLPGSSHSPASASQEAGSTGACHQAGPIFLVFEVETGFGQVGQVGLELLT

SEQ ID NO: 1005129 - protein, 42 aa, Homo sapiens
MIRIELVPIRPGHLSWKMAVKALVTEHKAVFLTITSKNSFYF

SEQ ID NO: 1005130 - protein, 76 aa, Homo sapiens
EYLQYSPVSVDIWIGTDSNRDAPWDFQLAQGVDGAGANDPQRVGNLYFLDKFLHVGGRIHADTDKLDLRVFFLQRV

SEQ ID NO: 1005131 - protein, 76 aa, Homo sapiens
KCGERRARAAEPWMSPRDIFPTFISSQGGGRASGLGALLNLGAGEHLFQAGFMVGSEFSERHSSREGSGHGLHSEG

SEQ ID NO: 1005132 - protein, 34 aa, Homo sapiens
MVMALCGGHVFKQGGGSAGMGSSGVVLIRQCIGE

SEQ ID NO: 1005133 - protein, 91 aa, Homo sapiens
SALTLYFLPKSRTKRRTSVSPYLFNTLRGGLVSVIQQGTEVRGIQIAMCADSFRVSTSVDEGYSRPGNALYRGVSERVSPEEVGVCVCALR

SEQ ID NO: 1005134 - protein, 112 aa, Homo sapiens
WRRGSQKGEGLDITGHHIRVISKIFITGTTQKGNGYIACRDELSATGNMAADGMTTGLEFSDEQPYSRTEAGLANSKDLTCIKVSMVLAFKSCTVHLEENIPTHKTENTIGW

SEQ ID NO: 1005135 - protein, 146 aa, Homo sapiens
VSEEPAQPTPSSWTSSLQEGGKIRVWWSKLPSLWDFRLATPADGDQAQVTFSPDGDRCRRLCAYVKKASLPGNRQLYPHLPATSRVGEGRDFRSMSNYSSSPPKSFQSPVGYRAHSVCPTVLWQTEPSVFMGRFKNTKGSCQHLSL

SEQ ID NO: 1005136 - protein, 169 aa, Homo sapiens
MGNIYVEAVLSADPRRGEVGQELVHEVEALVWEQSPEALGEVVVGVLAEGHLLEWWELAVAGPDFLTRGPQILEHLVDRIDFCLPGEQRLLSQQLPEDASQGPYVHGRGVFLGTKQQLWGAEPQGHHERGVGLQRGSVLPRQTEVTHLEDAGVAQKQVGRLEVTVQDPV

SEQ ID NO: 1005137 - protein, 37 aa, Homo sapiens
MLGGLQTHRGLKSMIKEVDEDFDGKLSFREFLLIFHK

SEQ ID NO: 1005138 - protein, 40 aa, Homo sapiens
MAEPVLLGLDLTPRGAGLRMYSFEKLIIIIMIALTSSLVI

SEQ ID NO: 1005139 - protein, 38 aa, Homo sapiens
RPRSAEGADPRPAMDGVEYSDKRFTAKARNTFHGWPRE

SEQ ID NO: 1005140 - protein, 43 aa, Homo sapiens
METEISGVVVYQWNRLSVGSSHPSGDFIMWSSLSVKPSPMGEE

SEQ ID NO: 1005141 - protein, 155 aa, Homo sapiens
MAYEFTVAYLFLRVPLSLLALLSDQGPSGASGPAGPRGPPGSAVAPGKDGLNRSPIAPIGPPGPQRRTLVIAGPVGPPGPPGPPEPPGPSQRWFRIQLPAPDTIKRSAHDGGRYYLWLMMPMWFVTVTSSVDTTLKSLSQQIENIRSPEGSRKTP

SEQ ID NO: 1005142 - protein, 34 aa, Homo sapiens
MIEDRTGWSPYSWGTYRSPMIDPQSLCLLIGRCL

SEQ ID NO: 1005143 - protein, 38 aa, Homo sapiens
LEVSKHASGLDEHIAEVKGQYEEIASAVGVRRASSWYL

SEQ ID NO: 1005144 - protein, 143 aa, Homo sapiens
VYRIFNTQSHLHLVTRSHPAKLRTAPAAYLPDRACLLLTPRDTPCREALLCKGRGLWGEGNLSQPLAYLLYIQEDAGDWNPGVAHPSLCLLHPVPCRGDAQVHWVSFEKIMGPTPWVLGESMKDTLTEPLVWICPSARRGKEV

SEQ ID NO: 1005145 - protein, 32 aa, Homo sapiens
MFSCHPNRQEVLSLKGNEARWGIRSIISWFHV

SEQ ID NO: 1005146 - protein, 88 aa, Homo sapiens
DLEDLQTRIWMYSNLLSLAELTGIKWRSTILEGMGTVDTIISAPAQDDPIHVNVSIPVICKLTCFVYGVVYVPPDWEELWIFWWGDEP

SEQ ID NO: 1005147 - protein, 38 aa, Homo sapiens
HLTICAPFSPAIGLYSLGMCSRLFSRCMEIRGSFCPVG

SEQ ID NO: 1005148 - protein, 37 aa, Homo sapiens
MTIAVKVPIEMVINTNKEAHGTKYLCIMNPDQIKYET

SEQ ID NO: 1005149 - protein, 65 aa, Homo sapiens
MTSYQIFYAVRRTRRHQGTTNEVQFGASISLPGVLIQGVPKPERAGVGCSIMGKAVGVRPADGRV

SEQ ID NO: 1005150 - protein, 41 aa, Homo sapiens
PHTELCHAGLPPLKAGPGPRPRSPRVYGSVVIVPLQNKDCS

SEQ ID NO: 1005151 - protein, 75 aa, Homo sapiens
MHQCDPVESDESAPMLGSSLDQIPFKDLWPDDSYGFPLLLQKEEIPRGTSQFAGSGTPFLWTTQLRGWLDTGHSW

SEQ ID NO: 1005152 - protein, 105 aa, Homo sapiens
MSSRSLQLCFLFKQVLYVSPPSSWDYRRLPPHSANFVFLERRGFTHVGQAGLELLTSGDLPASASQSAGITGVNHCAKPSPGFHGVLTRCLHRGSPALCPAIALR

SEQ ID NO: 1005153 - protein, 53 aa, Homo sapiens
MHAWSPRYSVMLPCRDSTDIWDSKNAVDTELHNLCIFGGYSIAQNCAHASLKL

SEQ ID NO: 1005154 - protein, 43 aa, Homo sapiens
TIAWLENLSSSGRSPWHPQRLLVHSTQVPTSMSTCSTIIADFP

SEQ ID NO: 1005155 - protein, 39 aa, Homo sapiens
STFCLAYHQLMSRRKSKQALRDYKKVQIQLENLESRRST

SEQ ID NO: 1005156 - protein, 50 aa, Homo sapiens
PDTTDHSGSPLCRTPGHLDDNGRTFDALTAHPCVLTDRKRLTTATVACTV

SEQ ID NO: 1005157 - protein, 45 aa, Homo sapiens
VTLIASCSTDASLVSSAAPLQGCCEMEFQERTSGVLDPFLSSIIF

SEQ ID NO: 1005158 - protein, 67 aa, Homo sapiens
CGLMAPHLDSDGALTVHAGLLTPVTVPAPWGFTDYPGMLTWTDTRDGRADWSLLTGYPDARHFVTHC

SEQ ID NO: 1005159 - protein, 47 aa, Homo sapiens
SHDHRLKNKRAKMNQCNRYTKNNNYLLIGKGKVYFLPKLEACVMGRV

SEQ ID NO: 1005160 - protein, 44 aa, Homo sapiens
MPACYATGRDSRSTTAVITTDQTKSVRLVLGYGRGVYIDHLLVI

SEQ ID NO: 1005161 - protein, 51 aa, Homo sapiens
QVQSGPISSCGPELMCGRDTQLLHLGHIGQHIAAYGEDSSRSAFTFIPPVT

SEQ ID NO: 1005162 - protein, 32 aa, Homo sapiens
HSPPLVVPDTPRHLVLSHRRKRGGTRDELAEL

SEQ ID NO: 1005163 - protein, 35 aa, Homo sapiens
RAAAVALDGSRLTRLRSVVVGRLVLCRVRRSTFVL

SEQ ID NO: 1005164 - protein, 95 aa, Homo sapiens
PRQRPRCLLRQDVTYRPCIGSWGPPSIGGLVPVIWVSDQVLRVTGYLAAGSGYGTAVQEHEDASVCRVVTVLPLAPVLQSLVYGQVDARIGGGME

SEQ ID NO: 1005165 - protein, 35 aa, Homo sapiens
MTICSPLSQPMVPADSLLYKGSFYVPHVSEIMGYR

SEQ ID NO: 1005166 - protein, 53 aa, Homo sapiens
EIESRGLLLPQTLGKSQKPQTRRHSIPEPSLTAGPDTHRHRQKTLLRPPEQKV

SEQ ID NO: 1005167 - protein, 115 aa, Homo sapiens
PPFHYDDQPSSISTWVTLQLLLFKIRLVGHCDRCLLAAAVVCATQARVSGDCFALEPASGFPLQWLCYCVDCILDFMWSVDSKTIIQTSFLYICLGEERCFSVYFSRTFKKYFYG

SEQ ID NO: 1005168 - protein, 48 aa, Homo sapiens
RRPFCSASTFCSWYRTIVILIIFSCPLPVADDDADDDVDTKSRRGYRA

SEQ ID NO: 1005169 - protein, 34 aa, Homo sapiens
MGGEADILEPVVGEVARMTERGKNQSTVKHAYKF

SEQ ID NO: 1005170 - protein, 35 aa, Homo sapiens
NCWPECNGYSPGYYGQHIAANTKATNRFFECRKLL

SEQ ID NO: 1005171 - protein, 93 aa, Homo sapiens
DLEDPGYTCTGLTYQTGIKIGGGVPSEQHPPSEQYMLRLHQSKRTTILNGSNNWSKENKSPQEYQRNPILASISTIGLPPSRWDQDIPRVQPL

SEQ ID NO: 1005172 - protein, 87 aa, Homo sapiens
EVGSALTFHPQGQQGGVTEGSAISPQGIWLPSALGASCMVFHSKVSSLNVVCSVLTAATFSPPKVFHPWQAQSWQPTPIIVVGAEQQ

SEQ ID NO: 1005173 - protein, 39 aa, Homo sapiens
MTGGKVLSSVGPNLLVTKELGAAQGPSLGSALNKWFGYG

SEQ ID NO: 1005174 - protein, 63 aa, Homo sapiens
HNIASGTHVDEDWVYQFQLLVVLTPDHTPPECGQNSLICSKNDSCRVTLNNISTMHTLKCSML

SEQ ID NO: 1005175 - protein, 107 aa, Homo sapiens
SHKLQCNSRGGSCTGSGTLDGFQVGHPPLLKSKRKCGVTGCFLLFKPCTLLWRVKSRACGGRWHNSDTSSSCSQSPAVIRTQVDEAVAVLTKPTKLRQAAPESSQQC

SEQ ID NO: 1005176 - protein, 46 aa, Homo sapiens
GRSRGPPLTTGTKRYSLDFYVVIGFYLVIGSLKRLFFKKIKSILTL

SEQ ID NO: 1005177 - protein, 47 aa, Homo sapiens
PTCTGMLHDGQLLPSWFLIPGPAAQYSKGGAGHAFSVNIHGGIFIGI

SEQ ID NO: 1005178 - protein, 77 aa, Homo sapiens
MWPGASVSGSSAGGSSAGKYRVTARERALLSSCQYADSQNPPETYNAPTESSITQQQLKRQWHLNLEHFGQFLKKTR

SEQ ID NO: 1005179 - protein, 63 aa, Homo sapiens
GLGRFGLRDSRATLLYSLTGSVSFFFFPGRRPGSGFGSQSVYSLHLWGSRVLSPILTLSQRVR

SEQ ID NO: 1005180 - protein, 83 aa, Homo sapiens
NALLLCVAQCAMPAPFFLCPSHAGPSIVTSAAQAGHPLPSHAVCGWALLYSVFMAHLFTLGWVGSGCTGYRGGYIFSTANINH

SEQ ID NO: 1005181 - protein, 39 aa, Homo sapiens
SELQLAPVLASGGSGPTPLTFHEAHGLTCCNKLLTNTGP

SEQ ID NO: 1005182 - protein, 32 aa, Homo sapiens
MLYNKVLTYNMQTGGFLLGPFQYVPIRQTRPY

SEQ ID NO: 1005183 - protein, 52 aa, Homo sapiens
QRSTPETNLLLQHILRWRPDLIQTEEVTCLKKEETAMLIPNAIQICTESRRS

SEQ ID NO: 1005184 - protein, 105 aa, Homo sapiens
MDATDGLRGPNPTPGSDRYRDLAGGTGRSAKEQVLRKGTENLQRAQAEVLQSVRELSRSRRLYGQRERVWALAQEKAADVQARLNRSDHGIFHSRTSLQKLSTKL

SEQ ID NO: 1005185 - protein, 161 aa, Homo sapiens
TQCTWLEPQNVPPLAEVPVIPEMGPPWGPQGWLLPPLERGGGSMAPGMRRGWPPLHPLKSSGRALQRTLMFLRGHRPGNFPWPGLSLKEAAPEAGMRSVPRARGTGGRTYQRGRAVGSVVLSCILETHFAESHALALRVAMPLLGPIFDRGHPGGGGDLLS

SEQ ID NO: 1005186 - protein, 55 aa, Homo sapiens
NIQDYGKYQELVLKTGKFSYYPKTYVMGNKFKVHRFTYTLSSPLKSMIEAVHVGS

SEQ ID NO: 1005187 - protein, 74 aa, Homo sapiens
KRSPVTLAYEERAGQRRGDTGLAATASTTSPGGTHPGDQAIMVNDNSDYGSYNGIKLRLIIGIFNLMGGGSGNF

SEQ ID NO: 1005188 - protein, 53 aa, Homo sapiens
KGTYAIMSLNPSNNSQSRCATASYARYGNEAAHDDVISPRSSSIVTASWYRTL

SEQ ID NO: 1005189 - protein, 134 aa, Homo sapiens
MNGLTKMLGISMRLDGRGNGTDVPNVGITIMTERSAANIEKVSERYKSYSPYDMWESIRKEVKGDLENCYLKRSQCTQNTRLYRADRLYRLHEGQGDREIGSLIRIMVSRSEGDVKKLRSDFKRTYGKSLYYYI

SEQ ID NO: 1005190 - protein, 50 aa, Homo sapiens
MEGVLTEGWGEEDCQLRGILLEIILFPFGFIGCMALRKRRCPNLWSQLLL

SEQ ID NO: 1005191 - protein, 67 aa, Homo sapiens
MSSVSRVHTLLLEVGAVWGFIAFAYSVKSRDREDGGQDVTGGPVPMPPRANCLQHLGPVFLVFFHNR

SEQ ID NO: 1005192 - protein, 37 aa, Homo sapiens
RSQHARLVDVLLKTAHARNRTPLHFCKRVKEAAYSMY

SEQ ID NO: 1005193 - protein, 36 aa, Homo sapiens
MGDAPCVLTIHVFGPHSTAVASPPTSLARTLFPAQC

SEQ ID NO: 1005194 - protein, 195 aa, Homo sapiens
MGLVGSVAGLGAAGWHGPQYSRVPQRGYGLPWDVLLFPHFDHSSVYSPLCLSRSDTLSSRLPTCFTRISSQGVLVAMNPHQLHVVACFAAVYCEAALLAYVGLAQPQALGHHLAGVSRPRTRGPMLGGTGGLGQRVYKPDDVIVEAVVADETGACDFGLEGAAPNVVGAAVLDGDEVAARCHGGIGDAVALRALL

SEQ ID NO: 1005195 - protein, 191 aa, Homo sapiens
LSTFEQKRNEEGSEVERGPRCVRPGRRWRVSSSACATPCCVCCPAILIEEAVVAESRVFYLTDEEVINIRQLAEVVTGDDKKRIIDSARSVYQEAMDISKKEMPPTNPIRLGLALNFSVFHYEIANSPEEAISLAKTTFDEAMADLHTLSEDSYKDSTLIMQLLRDNLTLWTGDNAGEEGGEAPQETQKFF

SEQ ID NO: 1005196 - protein, 92 aa, Homo sapiens
GGGPVVNWPAGRRGAGLSPLIPLVLSGEEGALVLLVLLMLLFIAGLMVLVDSVVWSVCLVGDEREASLVFLAPLVNLANKVPLQQVVNVVPL

SEQ ID NO: 1005197 - protein, 34 aa, Homo sapiens
LWKMGTTCVQEWPGGTNRTSITSCDLRRTSVALI

SEQ ID NO: 1005198 - protein, 185 aa, Homo sapiens
GETIIQGFGWLSERCAQYYEGRYADFTSGVVCCKLGNTPPQSLAIMENAIVLGSYACICQYNGIVPIVVACMILPDGDHDLKRCQYVTDERCWLLSTEALIDHHFYLEGTLFKPNMVTPGHACTQKFSHEEIGMATVTALRRTVPPAVTGITFLSGGQSEEEASINLNAINKCPLLKPCGLNFSY

SEQ ID NO: 1005199 - protein, 38 aa, Homo sapiens
LRTYWIERTGIMNVLMRNVTGMRNVTGTFLIPVTYLIP

SEQ ID NO: 1005200 - protein, 56 aa, Homo sapiens
MQSTDAEVAARHGCSIPQVLITVPNSSFSALASFSPFSPNDFPLSIVAIFMSRSTH

SEQ ID NO: 1005201 - protein, 45 aa, Homo sapiens
ALSRLPHGCSIPPGKQHHFNQGSKQRQVQQHRQQAGGKSYGALQV

SEQ ID NO: 1005202 - protein, 98 aa, Homo sapiens
SVPCAGEDGGCWPESGDEWVWVWGVGAVLSVATLSSPRRKLFRPVEERRADGSLLLLQGLLRDALVFLLLQLFWFCPLVSFLGVVVVIRVLVAPLFFA

SEQ ID NO: 1005203 - protein, 56 aa, Homo sapiens
PPDSVRKTGDTRQVRPLWIDGQDGKVISSRELVIQTTRWGLMYPSPGLFPTQPSSP

SEQ ID NO: 1005204 - protein, 74 aa, Homo sapiens
RSVPPGPDFSYGLSPVASALKAWGWEEGEPEGCAVRSMSMLSPGQQPCLSRKATPSGQAGAAASESLFVSNHAY

SEQ ID NO: 1005205 - protein, 74 aa, Homo sapiens
VPTFVAGEVARRQVDIYVREERCYPEFHIQIQAWHWQFLQWMPNGPMGHLPVAWDISAAWGSAATLSYPSSPCP

SEQ ID NO: 1005206 - protein, 159 aa, Homo sapiens
SAYWSASCDFQYNSHCGQCFAPILMTSWSLYYMFSSYTFKYRTFTPECANGTSKFMEMNGRSHFFLSLVRRNSISALICNTFMPAMRLIFHMIGILADLVLDLPLHADHLHPACVQCGLGSSSRSSEPASESLKLYLMTTFTSILLLTTFRTSGISRNG

SEQ ID NO: 1005207 - protein, 71 aa, Homo sapiens
DRVWLAEPLSGGGPPEQSAPSAWGGANGLVNNLTAVIYNPPAYVGLSGVMSNVSAECSPLPHAQPFPMPSV

SEQ ID NO: 1005208 - protein, 91 aa, Homo sapiens
GSWVLWHVGSWMKRWEGCTGVSGAEWPCPVCAQGDNGSVSSHVVLCASSVPERPCCTLLQPAPPCFSSGLPLWVDLSMSLILHVHATACAT

SEQ ID NO: 1005209 - protein, 70 aa, Homo sapiens
PERGSRRAWDVLVRLAFDHHLCLLLVVLYLVRLAVEPVGHVLQQDLLVVVLDLMNPHHEHVVACYADVYC

SEQ ID NO: 1005210 - protein, 77 aa, Homo sapiens
MSSWGIRRTRTGGTRYRICWKSVDPETVPLNSFLYKPTIKNRPEERRGGRRPEGIGELGWIPVMGSSAGWAQTDCGV

SEQ ID NO: 1005211 - protein, 52 aa, Homo sapiens
YTLLWSAVLLSTSQLGYRRHISQYLCILVRRIHHVGRLVTPDSVITCSDSRS

SEQ ID NO: 1005212 - protein, 84 aa, Homo sapiens
CTICPHNLQHGPVPWAHSRACRQVSSMSPCSCKTHVHGQPWQLAWLACSSYAYGGFPFIAQPSCRVPVYLVCRQHSSLVCCKIH

SEQ ID NO: 1005213 - protein, 173 aa, Homo sapiens
GPVSVGCSGIARRIEIDYSPRIPNSMNSRIHETETYCHVVQHRTKYNAVILAVLGIRLSVGSRIGVKPLFACHDPRGSEGRYISRKEETSEPTLFLLLTDDQDVELGSLTGHEQNEKDYGTWGGHLHQCLCDYTHVLAVTVLHAHREKYVHNHNVYNQQRELFFPLVAGMHEQ

SEQ ID NO: 1005214 - protein, 39 aa, Homo sapiens
MSWYPPFSHAQTDRTHASSRNFVTKRAQYPLANPVFDDR

SEQ ID NO: 1005215 - protein, 58 aa, Homo sapiens
MHFGPDDSINLELTLGTCVIVTDALSQEPVSDLPGKHGRVLAFVVPNLLHHLGGWHLG

SEQ ID NO: 1005216 - protein, 151 aa, Homo sapiens
RCMVDGTTFPVATTSLGSDAAFTSALVAAAMDLAASGISLLEVQGTHLPPLGLAPGLQLALRFFALAASIGWLQLQRAHSQTMTWWSSGVYTHSVPFHALQTAWTELSRRNHATRILNSSCQHARFKLLGYGFSQGQHVHSTQFQVSHCTP

SEQ ID NO: 1005217 - protein, 107 aa, Homo sapiens
STYRIHPVQSITSMHASTYQPIDSPIHPSHACHQSIHPSSYLAIIYHLFKHPSHPYIHLSIHSSIYVPIIYHLFTHPSIHLIHASIYPSIHLPTYPSSNIYSAIHPS

SEQ ID NO: 1005218 - protein, 112 aa, Homo sapiens
MRDNCTYGSHRYWDHSAISASVPSVLPSSATMISQPVHNADSRLRSSGSSTRRFSHSFRHGMTQVTQASEGTLAAAVPQTSTGNALVRTCCPWGSGPGIGYAWCSEIGMRDV

SEQ ID NO: 1005219 - protein, 41 aa, Homo sapiens
TGTLHRQADRSARLRCTVTAEASVKPARMSARSRRHLRHAG

SEQ ID NO: 1005220 - protein, 81 aa, Homo sapiens
KRGDDKPCGASLAEDSGQRSDAIQRALPGRKGPRGNALPEQRIAGSREGLTLAEHREENWHLKSRHLKLVKTSLGNLPHSM

SEQ ID NO: 1005221 - protein, 187 aa, Homo sapiens
HIPNQNKSARAGMLWVIRPRFHSDGVGQVPKTSLTKSSQVKTRTKVPIQATVGDQATLPLTWSGAGSKDKSYQVKPSQKQNKDVNTGTPWVIRPCFHSHGVGQVPKTSLDKLQMSGLQRASSFPVYSQCQSYSGAGYARLWQGVPPGAFPTRERSLDCVTQAGRSPLQGRSTGLTGLVSHLASWLGM

SEQ ID NO: 1005222 - protein, 40 aa, Homo sapiens
DQEQEALQNSAFLKLANSVTLSDLQTGVQYNITIYAVVCC

SEQ ID NO: 1005223 - protein, 73 aa, Homo sapiens
WAQSYIPELWKADDESPGGQEVKIHLNNLVKLHWPGAVAHACNPKNFERLRWVDYLRQEFETSLANMAKPCLY

SEQ ID NO: 1005224 - protein, 35 aa, Homo sapiens
EITVSMTFYLIYLRILWILGTITNTSSLYSAVVGG

SEQ ID NO: 1005225 - protein, 38 aa, Homo sapiens
MPLLQLVSGDWFDGAADCATHCSVLFWLVLLRQLLLLL

SEQ ID NO: 1005226 - protein, 48 aa, Homo sapiens
RKQYTGIRNGLKGQLIIGNSSVKLINRFLAISPFSLGLLSSSEKRTQS

SEQ ID NO: 1005227 - protein, 32 aa, Homo sapiens
MTDSSRTLTQAILPILHLVGSFPTHRLLTHKP

SEQ ID NO: 1005228 - protein, 43 aa, Homo sapiens
ARDYAYNPLITGNDSIEGLGDIYTAIPDHSLRTNFLRYSCIYV

SEQ ID NO: 1005229 - protein, 62 aa, Homo sapiens
MAIQDIPSQHPRYMLTNRGKVKTKEDVTLAHDTPDAGSHGGRLFLPQKCKQVAYCAPYRDSH

SEQ ID NO: 1005230 - protein, 43 aa, Homo sapiens
DLHPIHWASPSSIASPSISSDALPPFSSILLHPRAPRMSEGDP

SEQ ID NO: 1005231 - protein, 125 aa, Homo sapiens
PNTQSDYFIVYIVRMSMITLCFMALNTVIFLFTSWSFDPRLLRRLALWRVLVGGPLGEVVPGAFQEEVGEELADRLPVWVGLVCLLEEDGDGLPSLGEVLVGFLEEGGGLAPCLGLALWVSLEEG

SEQ ID NO: 1005232 - protein, 69 aa, Homo sapiens
MILQEPLHLQKAVEADQITHVVDEVRVHSLQEEGGRSRKMSILVYWFVTYNSFSHREFLHYLFIYLFIF

SEQ ID NO: 1005233 - protein, 76 aa, Homo sapiens
MSSGASTTMRLAEIKKRGIRVGYTPDSPDREHRRTRSLPANYHLPDGCRRPYEAVKNGGWPSWQPLWLCGYGLHDR

SEQ ID NO: 1005234 - protein, 41 aa, Homo sapiens
GTLEIPKLLTRAGCCSAQSQIAVSLGPPQVTPVDTRVTHTW

SEQ ID NO: 1005235 - protein, 97 aa, Homo sapiens
NGEQSVDGVTGLRGGTQQNATLYSQAATRDAEFSARYSTDIMQIAQQKCKAISHHGAYEANIAPILTNHLSRCWCSINLGHWSIRVSQEDFSIQGLT

SEQ ID NO: 1005236 - protein, 45 aa, Homo sapiens
GHPNKRRCTRSTTYSGKHKDTQQEDPPPPQGRHKEQPKQGGIPVL

SEQ ID NO: 1005237 - protein, 161 aa, Homo sapiens
MGSVSIREKNYEEKAHDYRQIDAEEAFDKIQQQFMLKTLNKLGIDGTYLKTIRAIYDKPTANIILNGQKLEAFPSKTGTRHGCPLSPLLFNIVLEVLAMAIRQEKEIKSIQLGEEEVKSSLFADDMIAYLENPIISAQNLLKSISNFSKVSGYKINIQKSQ

SEQ ID NO: 1005238 - protein, 87 aa, Homo sapiens
IYRSSNTQLQVRSVSSLGACCQEQAALDSQLCVMLVRSASPFMDGENSHSLLKGLCKSNVIICGKALTVAWRKTNAQWIEACYYYCR

SEQ ID NO: 1005239 - protein, 34 aa, Homo sapiens
SVAPLQALEYSKEGWEYVTGRTNVASQQCACLAP

SEQ ID NO: 1005240 - protein, 49 aa, Homo sapiens
REDPGDRSSVRANRTYNFTQDRVSDHRIAYEVRDIKGIVMVVGKGPGIS

SEQ ID NO: 1005241 - protein, 45 aa, Homo sapiens
RVHMAGTDEGLLKPLTLKRGASSQSTIPIVGIVAGRAVLAVVVIG

SEQ ID NO: 1005242 - protein, 126 aa, Homo sapiens
MRKSKLVTYPGEDVDYHLYPHGPGLNPNASTGQEALSQTTISWAPFQDTSEYIISCHPVGTDEEPLQFRVPGTSTSATLTGLTRGATYNIIVEAQKDQQRHKVREEVVPVGSSVNEGLNQPTDDSC

SEQ ID NO: 1005243 - protein, 34 aa, Homo sapiens
MTGLCVADTRHFLCGQLLLSPHCGLPGLSAMACA

SEQ ID NO: 1005244 - protein, 67 aa, Homo sapiens
KTRISPLLVWDRMMASAGPPNKRQQHKSPPPQRKHKDPNSDASPSSSRKATRDIPTVSASPYYFEKG

SEQ ID NO: 1005245 - protein, 77 aa, Homo sapiens
QGTVYNVEVSVILEESLFIGPESSVLVSICLVSELSDGNDLAFLSSSTLILHSAALGSQDPLRHYHHEGSPRQTCNQ

SEQ ID NO: 1005246 - protein, 35 aa, Homo sapiens
SQCIHQWVHASLYKFRTTREHRARPTKYRTSWSLV

SEQ ID NO: 1005247 - protein, 38 aa, Homo sapiens
HGSRESPASDGSYDWISRHARFSTSFTLYLRLTLALSR

SEQ ID NO: 1005248 - protein, 39 aa, Homo sapiens
TYPGSGYDFPINDKVSTFYGYCGHWDLGTSSLLALLPTR

SEQ ID NO: 1005249 - protein, 141 aa, Homo sapiens
LIQRILKHRNLDLDSIIAEVKAQYEEIANRRRTEFESWYQTKYEELQQKLLAGMEMNSATPKHEISEMNRMIQRLRAEDYNVKETVRPICENAIADAEQGVELALKDAGKQSWAELGGGPAEKAKQDIGPGCYVNNQELMN

SEQ ID NO: 1005250 - protein, 75 aa, Homo sapiens
DDLQDLQTPQSGFFQVICISSPRTGALFTSLQQILPGVQLRASGALEFWLVGSGYKEAVLVRQQERRGLGRVCTL

SEQ ID NO: 1005251 - protein, 35 aa, Homo sapiens
TDRSLRRAQQLDAAFLQRFSALVHLPSRSVTPASD

SEQ ID NO: 1005252 - protein, 65 aa, Homo sapiens
THLAQSVMDRRPDGGARRVGARFGQGAAVGADLVGALRVDVGVAGLDQRLGELIHIAEVVAGEIQ

SEQ ID NO: 1005253 - protein, 41 aa, Homo sapiens
MLTNVLLGDGGPDGGRLLVSHDGRVLTGPVRHDVVDDTVAL

SEQ ID NO: 1005254 - protein, 37 aa, Homo sapiens
EAATRFECPVDCCFRSGLGFLQGQQYMVQQFQVAIAL

SEQ ID NO: 1005255 - protein, 49 aa, Homo sapiens
SPLCRIVSNPQLTPITEISIIAMLSISCVCSIYHPDIYPKVGEVGGAVK

SEQ ID NO: 1005256 - protein, 167 aa, Homo sapiens
MSSVGVYRSPERTNREVCSRTLSDYEFALNLHKSKSNEAKSEHRMAIVNICLVEGYKGGLSRVKRRMQAWRGDGKTWVRWVTIASKRIKYLGIQLTRDVKDLFKENYKPLLKEIKEDSNKWKNIPCSWVGRINIVKMAILPKVIYTFNAIPIKLPMTFFTELEKKLL

SEQ ID NO: 1005257 - protein, 35 aa, Homo sapiens
TNRALYPSVAGRHRSGGGGRGRHRMWSQAAKRSAL

SEQ ID NO: 1005258 - protein, 165 aa, Homo sapiens
DDVIEYLMNESIVLSAYIYYNTCISTSSKKLRILSHCAFFKMTCAYSSKYEDSRECQLMSDRPFTMASQGLKYLGIKLTRDVQDLFKENYKPLLSEIKEDTNKWKNIPCSWVGRINIVKMAILPKVIYRFNAIPIKLPMTFFTELEKTTLKFIWNQNEPAFARAN

SEQ ID NO: 1005259 - protein, 50 aa, Homo sapiens
VPALEQHLKEVGCAQDRVAELHRLSAFRESRPGGAWMHRGFLGGHTGGIP

SEQ ID NO: 1005260 - protein, 66 aa, Homo sapiens
TWAQYICHSTKMAWVSSVIFVLAGSAALSAPSHGQRKVLAGSAQPKKSGPHETGEAFHEPSPLTRV

SEQ ID NO: 1005261 - protein, 90 aa, Homo sapiens
MGLEGPVSILNQACGHQPSLLFLAVPEPPDFNAAWIETIHRADQEVVVLQGLGPCRIHSHLRLNSPLHCEALTKPVVVSAVGVHRGAPVF

SEQ ID NO: 1005262 - protein, 79 aa, Homo sapiens
RGAGSCFDVGSACFILLIFLCSTYLQAPPLAVILGVCQHARGPTYQNGGSVLNICFKKTVLNFTCCYFYIWPFYSTVWF

SEQ ID NO: 1005263 - protein, 35 aa, Homo sapiens
VVQEIAGDCNSGMGVLLLLWRRGVINVGDITFMLT

SEQ ID NO: 1005264 - protein, 39 aa, Homo sapiens
MPGRSTILRSGSLRRAGDMPSLALVGAAPYMTGRTRCDG

SEQ ID NO: 1005265 - protein, 72 aa, Homo sapiens
VEVCCADSCGQESRPMSRRHDLTRDDFDELVSSQCILAELLNAWWPALSASDALARLADPAVAEAVTPDNEE

SEQ ID NO: 1005266 - protein, 34 aa, Homo sapiens
VITLDAWEKGEVVSHIASDNRVGGKMAGDFIAKK

SEQ ID NO: 1005267 - protein, 67 aa, Homo sapiens
DLEAPGHEATIPSHGHALKRLQAGLSLTCYSMAYLKAYKLSLQIPPFYLSYKPDKPYELVQDLAPRC

SEQ ID NO: 1005268 - protein, 43 aa, Homo sapiens
RQGSSGTADRTDTAGRPGGAAYVAPSSSHPTPLAGDPTSSRPC

SEQ ID NO: 1005269 - protein, 61 aa, Homo sapiens
EQQGLETGEKAKYRCMLGVSYPCRKRLVPIPETFVQAISDALLCFMTWGLEVGFSMYLLDI

SEQ ID NO: 1005270 - protein, 55 aa, Homo sapiens
KISVSLTPSLDQVRATVSETHHFDSVFIYIANLTTFYIFYFILLVYDGINHLAQI

SEQ ID NO: 1005271 - protein, 99 aa, Homo sapiens
MERAYVMPGPPYVMNYGQGGPQLIISAHVAKDAWLTLSLHSTELRPKRHLRVYPGYLTDEDTEAQSGTGLILNIPSVPGTVASKSLLSCTPPLRRQDKQ

SEQ ID NO: 1005272 - protein, 58 aa, Homo sapiens
FIKESAQKKNSLSEYCGELISQDEADRRGQVYDKYMFRFLFHFNNDFVVDATREGHPI

SEQ ID NO: 1005273 - protein, 70 aa, Homo sapiens
SSQGAALLAQRCRTENRRYNRPTVVLGASRYHLSEISYNGLLTLPGTHTLQVHILRPKGPMISEGPSFPH

SEQ ID NO: 1005274 - protein, 103 aa, Homo sapiens
MHTWKHDEGQRDDIECKMTPTKNPEDLSMVEDRGLRRLLLVAQVSILCSLISGFLIQESLRAMSRPSLHLEMETMGVAPGMVNPAVIQLHKGVVQSLDSCLMW

SEQ ID NO: 1005275 - protein, 34 aa, Homo sapiens
GSIFSTTWHARRFVFFVSGHSHIALPASQAGTAV

SEQ ID NO: 1005276 - protein, 52 aa, Homo sapiens
DFGSYDRVTLGLTSESSSQPALWPSRDFVTDLTDSCACRTLRGLLYDVDPAG

SEQ ID NO: 1005277 - protein, 85 aa, Homo sapiens
AIAARYPFFLSTGKHISCSSQWGAPKPCALATAIHSAPSQPARVQVRCKAAPLPHMQHHCKANQLPLGTPQEQGASSSSRTCQAM

SEQ ID NO: 1005278 - protein, 102 aa, Homo sapiens
RARYLTRESSRTSSHSNLNRRRTSRLPCEHPGQVASVVYVTTSLILNSKYLPNGKQNTRMGLRTKKHMEDDKKKEPTKTRTSRNEDMYRAREVLVATWAVHP

SEQ ID NO: 1005279 - protein, 51 aa, Homo sapiens
TRLFTFAGSVYSGLFIGLGCIWRPPETGATRHTRTVATRGPLYHDARARTY

SEQ ID NO: 1005280 - protein, 34 aa, Homo sapiens
VHLARQSRRLVTGLKVRIMGPNYNPGEYGGPLTL

SEQ ID NO: 1005281 - protein, 54 aa, Homo sapiens
SRGSHLARQSRAQSLKVSSCTLLLLGQRLNGLDLCLRVDFHGIAGFPYFELLVF

SEQ ID NO: 1005282 - protein, 112 aa, Homo sapiens
IVLSALADEKKQEFTVDIRAAEYHTCHSARGRKIRKVRDSTGARVIFPAAEDKYQDLITIIGKEDAVREAQKELEALSQNLDNVVEDSMLVDPKHHRHFVIRRGQVLREIAE

SEQ ID NO: 1005283 - protein, 41 aa, Homo sapiens
YLSALVRVYNTGETDEALSNVCDVLNLYGSPREYTGFPDPY

SEQ ID NO: 1005284 - protein, 35 aa, Homo sapiens
EDVKTTEGKARGMISYGSSYSRKSTPHGIVHCKLS

SEQ ID NO: 1005285 - protein, 47 aa, Homo sapiens
LRMSPCEEQFMDEFCAASEKIIGSVKKRKRNIEEEEEEEDEEEDYDV

SEQ ID NO: 1005286 - protein, 69 aa, Homo sapiens
PLSSMGLKCAGPLICGFSSTSDNPETARPIVLFWFLILYMKDNEDEDLYDDPEMMDYIHSVFSFRLLGM

SEQ ID NO: 1005287 - protein, 39 aa, Homo sapiens
MGYIPYLLNNTKFAGRGGTCLLSQVLGKLMQHNCLNPRG

SEQ ID NO: 1005288 - protein, 36 aa, Homo sapiens
PRQSRDKVFGRAVLVPHLEGGLWFKLGKASETASPN

SEQ ID NO: 1005289 - protein, 154 aa, Homo sapiens
LARQSQMLEMQVELLCMKDRATELRGQLSSEKMAPAELKSELAQTKLELETTLKAQHKHLKELEAFRLEVKDKTDEVHLLNDTLASEQKKSRELQWALEKEKAKLGRSEERDKEELEDLKFSLESQKQRNLQLNLLLEQQKQLLNESQQKIESQ

SEQ ID NO: 1005290 - protein, 56 aa, Homo sapiens
DSWQSQHFCTAARIVARCGVRKKDRFLGSATSMLYQRMEAQPLGSWLTLEITTTGR

SEQ ID NO: 1005291 - protein, 69 aa, Homo sapiens
MDLLHHFVARGAAIGVTMATSSPAVVQQAGFADVGLARQHHMQAFAQDHALARLGDEMTEVAGQLFQRR

SEQ ID NO: 1005292 - protein, 66 aa, Homo sapiens
RRNADRERAVKPPYPVDSHGEQRVALGLGGPPRGATVLLSNLSSKLVKIWLLTLRYAHTGDTRARN

SEQ ID NO: 1005293 - protein, 103 aa, Homo sapiens
VACKILIVCVDDAERHLRSELEISNDPDKIKLQLSKHNEIQKTLGGKQPVYDTTIRTGRALKEKTLLPEDSQKLDNFLGEVRDKWDTVCGKSVERQHKLEEAL

SEQ ID NO: 1005294 - protein, 51 aa, Homo sapiens
YGIEFARSEAFQKGERKGAKKVMIVITDGGATDSPDSEKVDPAKLKRLPRQ

SEQ ID NO: 1005295 - protein, 61 aa, Homo sapiens
DTNRARSQERGRKGQKAAGGVMKQKKPLVGRKAVSTKKEPHVETKPAEEETSLQQEIEAVL

SEQ ID NO: 1005296 - protein, 113 aa, Homo sapiens
HAHSSFFYRFCSFTSAFLSVKCPKVLSSGRNSRTINFAGSVPAAILSNRCPILWLTFAYFSFFSMHPDGFIFIVYRTKLPFMCTSANLLVQRFCSLELSLFPLAGCQVIYRLT

SEQ ID NO: 1005297 - protein, 42 aa, Homo sapiens
MRQALRGSRHMRVSSYLTYAFPPDSGYGLNSWLRARGWWRYR

SEQ ID NO: 1005298 - protein, 91 aa, Homo sapiens
TVKGERIVTGNWELSTGKAEHSTGKGEPIVLGTGSTVLEKWELTALGTLGSIALGTTGSTAPGNLGRTALRTLGRSQVLGTLDAPDARCQG

SEQ ID NO: 1005299 - protein, 107 aa, Homo sapiens
MTGGSRANADAESVSLGEACDLAISNQLRGDAEGLATEHTCNSKGLGIPDPTRTFLEVMGNVCISGAIGICYGRALGLREDKWSVWESVVSMQAGARIIRKCVLHIF

SEQ ID NO: 1005300 - protein, 52 aa, Homo sapiens
TTSTLGPGAGEDRIRWLLWRQDAELERKKELMCQEQISRWGVSSTSYFPVKT

SEQ ID NO: 1005301 - protein, 39 aa, Homo sapiens
GRGGRTGRKTTNPNQKNNTQKQHNQHTQTTQTPAAAPTQ

SEQ ID NO: 1005302 - protein, 126 aa, Homo sapiens
PAGAAGEIVDAYYALQQKVSELASSDNESLASCEEAGGVKAAQSDWFTRDNIPAALNFKPVVQAIFDGSLIGENGAPGSNSDVITVDGERAFVVRVSGHKPEVIEPYDQVKDRVVELVKRNKALKA

SEQ ID NO: 1005303 - protein, 38 aa, Homo sapiens
NGGEYMQQSGKSHRGSTQSSNRYHRSYVTARHLKIARD

SEQ ID NO: 1005304 - protein, 92 aa, Homo sapiens
MTGYCLTPRRLCHRKTEHKGAPRMHTHTSRASRKPEERETLAVQRREGRATEPLRFCLREHIRIEQEFCPGQTLDTHIMEETFGMLSNAFSH

SEQ ID NO: 1005305 - protein, 46 aa, Homo sapiens
EDRYMTKHACMRVIDVYSPLRCMPSLYKFRLHVSRRADLQISLSWS

SEQ ID NO: 1005306 - protein, 35 aa, Homo sapiens
LDIIHICEILIKAINFDRSSRLMTDLFTPLTTFVL

SEQ ID NO: 1005307 - protein, 33 aa, Homo sapiens
RVNDGSIAVLSVHGRQCTLFLDVYTEGQYRCFL

SEQ ID NO: 1005308 - protein, 122 aa, Homo sapiens
MLVGQRTINYQRLTPETPTPLLLLLYHQDGAAECQIVTTTGAVPGRATMMISTTGINTALLQWHPPQELPCEAAGLTGLAVPAGADRGAAQQHYIFRRGSDQHFTVTGLHKGTPYIFRVAAQ

SEQ ID NO: 1005309 - protein, 37 aa, Homo sapiens
VVNCIIVWMQRVTDRCFLSRRLSQKVIFNCTIQITGE

SEQ ID NO: 1005310 - protein, 39 aa, Homo sapiens
MRHQNAVSFGISQHRATGTFKILEDETHSKDIEPHLYSG

SEQ ID NO: 1005311 - protein, 125 aa, Homo sapiens
MRSLSILQGLPSFRELQKRNWELLSYDRHLPREDCRAVRLSELLRRKCWINPADSDEARKEPQAGPLENPEEVACEVKAGPVVDHSKQGRSCLRPPSSGSDLGESPPINRRGISLSPTVTKEVVS

SEQ ID NO: 1005312 - protein, 148 aa, Homo sapiens
VCRGAGRLSTGRSVCRPEPGAGANHLSITLSHPFLLQEPGLQRLEELRDQQRSQCLVDLHRFHTCISRQRVLPRMQAHMRGFQASLIFTHSFHSCWLDRLPHLPLGQILGDRSWGCQRRGLPGWLGSQIQMVEQPVIFPESKLEGLRN

SEQ ID NO: 1005313 - protein, 157 aa, Homo sapiens
MPQACAQTHNRRGVTYAHNHRPTVCTQMLTYTQTHAHRVHTNTAVTSPHTPMQHPDTHNCRHGRVQRDAHRQYMQTYIHVDADRFPHRNICNQTPQRLADMWTQTQSQCKDSTHKDILHRRAHTGLICTEDTHHADRYRHIEHATTHTNAHRHTSTT

SEQ ID NO: 1005314 - protein, 35 aa, Homo sapiens
AVNSPDCGLFSYRLCADFTPDYWWGLLYDVTLTEL

SEQ ID NO: 1005315 - protein, 62 aa, Homo sapiens
PDHVGVMHRGVKNLLLCAGVVQWCVLGSRNLHLRVQVILLPQPPEELGLQGTCHHAQPGFLI

SEQ ID NO: 1005316 - protein, 105 aa, Homo sapiens
LRIPRYLAFHDSPASQSSVRNEGAVSKRDQNKAEAIFHLFENHRHCSSSGPVDKREIKLVSSRRLPFSKKINPYQISRKSVGRTQRISIFYNLTILFQQLLGNYQ

SEQ ID NO: 1005317 - protein, 152 aa, Homo sapiens
GPRSLRATHHLWRHVLLVFGARGSRDTVWANLEWKLVLAAACWSALSSSCGSGRIGIAILVVYILLRGRLYSLLLAGRLGLGWGQLLLLRLPLPSAVWHAVHLPFVPLGRRAICAIHWPLVILLLLLIHCSLLAGEGAARRGALGGELIAIG

SEQ ID NO: 1005318 - protein, 151 aa, Homo sapiens
EKGYPTQDEGLKSKDFLPQQPAEEKRAFLRVQRFRPVVESQAFKNILVDEMDMMHARAATLIQANWRVYWLRQKLISQMMAAKAIQEAWRRFNKRHILHSSKSLIKKTRAEEGDIPYHAPQQVRFQHPEENRLLSPPIMENKETQFPSRDN

SEQ ID NO: 1005319 - protein, 107 aa, Homo sapiens
MGSVYVRCMYAPPPKGPSWAWDGGRQGDSRVPAHIAPPDVLSREHPDTQLADREMWGSGTAPCLQAGPHVAPQNPPSPGLRDHVYRLAVPLGKMDSIPHSHPSCPVT

SEQ ID NO: 1005320 - protein, 73 aa, Homo sapiens
DSYPIENEIICGESLHESCRYELQDMIHWVKPAPIEPAPSQQQQKPAEGSLQKRSRTDVTLEKGLQNMEVTDA

SEQ ID NO: 1005321 - protein, 78 aa, Homo sapiens
TSARQTLIHTGRSSIPLFSTVTAAGCCWPTPVATIQASTQLYLNYTAYYPRYPAAKRISQSHSLSQSGERSRSPFWGR

SEQ ID NO: 1005322 - protein, 44 aa, Homo sapiens
ERSGNVQLTWKTYVNKEIQHMLSIGVKQHKDSHRKNKARERKDT

SEQ ID NO: 1005323 - protein, 67 aa, Homo sapiens
CRRVLTDVGVRGLGTTVARDSAHFGSRVVWITGIETTGPKRFSILSRDEDTYVGQPGLELLISSDPP

SEQ ID NO: 1005324 - protein, 81 aa, Homo sapiens
GLASRERWKPPHICHQNLTRCQGTIFVQRKLESNDDDDDGRHSCFPQGGILDSCRHEDKIQGVTRGRSKNTKPSRPEDRGP

SEQ ID NO: 1005325 - protein, 48 aa, Homo sapiens
MRHQCPAIFIIFRTRWALGLVPGGEGCRKRGSWPQCRGILLDVDPAEH

SEQ ID NO: 1005326 - protein, 35 aa, Homo sapiens
TLEIRVGGVKVALNSSFVSSCFVSQERSVEIVWIV

SEQ ID NO: 1005327 - protein, 34 aa, Homo sapiens
MSLPVRYVFRLSAASIFVCSLPSWAPAFLTGPSS

SEQ ID NO: 1005328 - protein, 36 aa, Homo sapiens
SGTRAESKPRLLTPHAVLLLLMYHNVLLINSQCLPS

SEQ ID NO: 1005329 - protein, 45 aa, Homo sapiens
GDINLLTWPGLLWDMEEGSEGGGNARVRNHAKEVEGVKNIMTQNV

SEQ ID NO: 1005330 - protein, 65 aa, Homo sapiens
EDGETQTLRPCRDRLNRNRAIYQKTGTHITCEKPPRELCHTCSTPLPKIQTHLWLSHFQQTPILQ

SEQ ID NO: 1005331 - protein, 35 aa, Homo sapiens
SFQHLPALVQQFPSRSINAQPTPFVAGTHQSHLQA

SEQ ID NO: 1005332 - protein, 85 aa, Homo sapiens
SWNDGLHRCGLQHSTNESTLQLVLRLRGGLQLFVNEPDLVRPSLSTVEPSDTIENVHGTRSKTRTWHPSLTMQRFDLLLGKQLVV

SEQ ID NO: 1005333 - protein, 76 aa, Homo sapiens
ADGRLSRLPRTLAGWTILDTIHHKRAFGVTAFNAHGSSSSGGPSSRSSQWYFWAVTGAGRWMVLICKHRRLRTRAS

SEQ ID NO: 1005334 - protein, 61 aa, Homo sapiens
GRVSEKVAIPWYLAWWLHSLSIGQFEGPRKYLSTKRRHSSTDPLYLPRMLNVHVSQFPFTQ

SEQ ID NO: 1005335 - protein, 121 aa, Homo sapiens
TRGVQAECRAQSGSRKLCLPGSRHSLASASQVVAGDRCLPLISTAKRPSSFSNPPQHRPFTGIPRCHAGGRSGLSLPTRPYLRLSLGKKPGTIPGFPRQRPLWPSAVCVPGYLRLENGDDF

SEQ ID NO: 1005336 - protein, 95 aa, Homo sapiens
VQPWHLVSADEAYTEISQIWSRLSPFIGDQSIETLHPSVLVNFEAGRDGHHTGLLPPPIFPMQAPPCREDSDDVHGNQARTSATSYSSGYPRLRI

SEQ ID NO: 1005337 - protein, 83 aa, Homo sapiens
MAAAKVTGEVLDILTRLPRECGKTHRREHLPGESQAFENSLSLQPSQMPSLIAECCLNDPPVACNPLGSLSMSIDGEVPPLIS

SEQ ID NO: 1005338 - protein, 75 aa, Homo sapiens
ERTDSGGTYCVICAFDEDENLVENGLWIKEWNAGLGKTLGWDLLGHVTVYPGAETCILRIQDLTRTKDVFSGEQT

SEQ ID NO: 1005339 - protein, 37 aa, Homo sapiens
MIPELRRSRATWMLLNDRFRKTTLQVDTLNCRASSRA

SEQ ID NO: 1005340 - protein, 48 aa, Homo sapiens
PPDIHTLYCVPASMYLLFQESGHNEGELIWSAVSAERSTLTNDKKNDL

SEQ ID NO: 1005341 - protein, 35 aa, Homo sapiens
ESNEEPEVRAEWRNDDGEARTSDKGWVLGGGCWQE

SEQ ID NO: 1005342 - protein, 43 aa, Homo sapiens
SALSMHGYEKPLIMKAASLSSLFQRVGQVVGVKTLLTVHPTRA

SEQ ID NO: 1005343 - protein, 87 aa, Homo sapiens
IISSVPSEQLELEGVCLCGKGEEQFRPLDDSCQVCGNAGESRRVGSVAVADVHREVDGALPRVPDGSSDPEHPGTLLLMRVGDKVLG

SEQ ID NO: 1005344 - protein, 106 aa, Homo sapiens
MRLNDVTAVRGTHGGCSSVSTAQCEMRVAVVTPISTGSARSSETHLECSTLCRVTRGSSPRLVSCILRSSAASEILESSPQIFDIPAMDFLSEQILRVEAQDQRDG

SEQ ID NO: 1005345 - protein, 84 aa, Homo sapiens
RDGRRRGGRPRAQEDSSGWWETLDPKPPTEWDPAVVWCEDPCTMLPPAVTSTLGALVPSECCISHTIHSVTWVRARATWNASPQ

SEQ ID NO: 1005346 - protein, 59 aa, Homo sapiens
QPPSYPVPQLWKPLAAVSLLGQAPNLAKSSAQEGTLNACQELPEATTSTLQLRSPETGV

SEQ ID NO: 1005347 - protein, 83 aa, Homo sapiens
WYRGCMQSSEGEAGVVCVLRQAGAQEGQHRSPAGPGPKGGWGSMGERRGQVLCTPMCGAPQAGGAPGPTEEAKKQGLQFPAMP

SEQ ID NO: 1005348 - protein, 77 aa, Homo sapiens
VLVVNRMVSVTSGLGLILAAECTRSCGQCAPPESYLAACCNHPPESQRPANNPLSFSSYPLCSFPSCGVPSTECRNH

SEQ ID NO: 1005349 - protein, 133 aa, Homo sapiens
WRSTAVESVHQERSHTVDKRCGRTVNLNLWGPQECAHIIVPVAAGMAALLDATLLMTLLCPVISPIEEALSQRKTAPNFSLPSPTKETILLSSSQAIVFDLPSETVVLILQQVLLLRGIPEPQIPRHISGGTV

SEQ ID NO: 1005350 - protein, 39 aa, Homo sapiens
IPEDTVEQKAESVCTNYSLTRRAGIMNMAAGTLATARTT

SEQ ID NO: 1005351 - protein, 51 aa, Homo sapiens
KETQVGRWRPKLELHLSYLGVTLYVNCEDCLGRRVALPAALSCELSKALGS

SEQ ID NO: 1005352 - protein, 78 aa, Homo sapiens
IERLPSEQLGMNNFMKERWMKLLQLKRGNLDAPLKTQDQVQEDSYLDVVVRQGASIFQLLPSQDQPLLIRRDAFRYLG

SEQ ID NO: 1005353 - protein, 148 aa, Homo sapiens
NLFPSRRELHTVDKASVVANCELELEWGSLKECRAVIIASRSQPVWPALLDVHAVDDFVVSCTLAFRRATIPEEDCSKVLPFLPQTKENPLTSLQSKQCLRSSQRKAANSYFNRCYLLRGIPRSFSFPDTSPEAMYNPLEHHSLVNNR

SEQ ID NO: 1005354 - protein, 37 aa, Homo sapiens
KETHGEEIGLVMQCSKDQLSENFCSRAVLRIPEWDLN

SEQ ID NO: 1005355 - protein, 148 aa, Homo sapiens
HHSRVEPSEHIVELSRQRSKTRKASLPEQQRLIFLLGNSWNMDCTLSDYKIQKESSLHLVFRLRGGMQICAKTLTGKIHHPRGCSPSESIENVKAKIQDQAGIPPDQERLTIAGKQVEDGRSLSDYNIQKESTLHLALRLRGGVYVAA

SEQ ID NO: 1005356 - protein, 109 aa, Homo sapiens
RPGEAWCLSAGGKSWTGLTLWGSDYSVDHYSQVDRCHICLFGSPSLSNSIIHSKWPNNTQTLSRPVKREEGAPWQLLTLGPEVTSLACHASNCAVLSTEPHSGKWLIKL

SEQ ID NO: 1005357 - protein, 38 aa, Homo sapiens
MESLSGAVVTLGIPALWEAKTGRSRGQEMEISQAQWLT

SEQ ID NO: 1005358 - protein, 45 aa, Homo sapiens
PEDPERDTGEEMKTGDPKRPALSQHAANPDSRGTGITTRQQRTRV

SEQ ID NO: 1005359 - protein, 33 aa, Homo sapiens
QRCRHCGVRDCLFVTWITTDGTVCSELVVTGSL

SEQ ID NO: 1005360 - protein, 36 aa, Homo sapiens
DEIFLLCDKVQKEDIEVYFTGPGWEARGSFSQADVH

SEQ ID NO: 1005361 - protein, 67 aa, Homo sapiens
ERTGEPGRLGTLQWWDLLLLDPKEKREMWGPAGPRGATLSPMWNWGPPWLGSSWETLCPKVRPCETW

SEQ ID NO: 1005362 - protein, 70 aa, Homo sapiens
MSERRALSRWWSEPHWGRDGFTLPVCRHTQQASQHLAHPVGSKEAGGNCRQKGQQITHQYLSNAISAPGP

SEQ ID NO: 1005363 - protein, 66 aa, Homo sapiens
TPIEGKNMSLVNALTVTQDGRKIYVTDSSSKWPRRDYLLLVMEETDDGRCWSMICDQGSKVYWTAG

SEQ ID NO: 1005364 - protein, 55 aa, Homo sapiens
TFQLPSTAIRVSHPSRLAHGHGTQQPVAAIGSHKSVVVWWSQHGTPIPPVGSQLA

SEQ ID NO: 1005365 - protein, 86 aa, Homo sapiens
SLSWPQGYKGEKGESGALGPSGLPGSTGEKGQKGEKGDVSASTVLCLGNAMAWDWLDTDEIFCHLGPNGQNGRPCALFGPWVATLD

SEQ ID NO: 1005366 - protein, 61 aa, Homo sapiens
DLEDLRLLGRKMLIMMVGGQCDDDADGDGIKNVGGIPNGLDNCPKVPKPINKTDRDEDGVG

SEQ ID NO: 1005367 - protein, 95 aa, Homo sapiens
HQYQFLEDAVRNQPQAPVLTGEAALLDKHATLQKSTTEVRSSLRQVSDVQKRVQVACPAWHPAASIARQLQSSGACVAGPLHAQQGCTCGAQVAG

SEQ ID NO: 1005368 - protein, 78 aa, Homo sapiens
AVCSRGSLTLAGLPQRAAGRSGSRLGHPLHLRSLLAGPAAACALPPPLVPASPRPIFAGSRARIRPPGPRCFPPPMKH

SEQ ID NO: 1005369 - protein, 153 aa, Homo sapiens
IAYRLSSWEAIQMWSRIRVCPYPTFNPSSDVAALLKAIMVKGVDEATIIDILTKRNNAQGQQIKAAYLQETGKPLDETLKKALTGHLEEVVLALLKTPAQFDADELRAAMKGLGTDEDTLIEILASRTNKEIRDINRVYREELKRDLAKDITS

SEQ ID NO: 1005370 - protein, 102 aa, Homo sapiens
LVIRGSRTRGVQAGGPALRSPCMVGLERAPAPPPTFTGVCLPLCLPPQEATKRQAVRVPNTPPWCPADSPVLSGLSVACGPRGPSPSGQPISLLCVPLAPHT

SEQ ID NO: 1005371 - protein, 49 aa, Homo sapiens
LALDKGVGVWKEGRACGGRRPTDAETGYADRRRHGVIFPQGATRWLLYP

SEQ ID NO: 1005372 - protein, 36 aa, Homo sapiens
REVFALRFLDRLGFMDVWGKGTTVIVSSASTKGGTE

SEQ ID NO: 1005373 - protein, 57 aa, Homo sapiens
TDGLTRLYSLLSTRGAHCPRALRPHPPSLLAHHTDALPFSATFLPARSTTLRVTDWT

SEQ ID NO: 1005374 - protein, 62 aa, Homo sapiens
VEECPLLTRGLGRAFIPFPDFKKGRTALPSIIKSGMALRCQVEDLLFVGLQQQGGVLVAEKF

SEQ ID NO: 1005375 - protein, 36 aa, Homo sapiens
IIKAGRLRPTLRSSQLVLGIAARAVNDAGVVDRIAS

SEQ ID NO: 1005376 - protein, 173 aa, Homo sapiens
MGGWVLRSGMKDKDMINRLWGDMFFDPDNGEFMTDVRHQPRREDELPRTFCHLIVYPIFKVCDAIMNLTREELANTDRETWTIERDSEVHSGTPQGISLLMAVMRRWLTAGDALLPMITIHLPSPVDGPKFIAAGSVYEGPPEDEAAMGLRRCEPKGRSYDVYLARVVPSVHL

SEQ ID NO: 1005377 - protein, 78 aa, Homo sapiens
LLSEQAGNGCHGSWRRPAFRRGRLRWLKQEQLRLLGLAGLWGPGVVAAQALSLLCAPSRLQATLPLQEATPSNGSLCP

SEQ ID NO: 1005378 - protein, 76 aa, Homo sapiens
EDGGWARGSEVQRNLLRYRSGGETGERRAPQWPHSLAAGLNTRGLPQFQKLATLKHKDIPGILPGLRSQALLKGKS

SEQ ID NO: 1005379 - protein, 73 aa, Homo sapiens
SRYLNISDEEMAARRQAWVHPSALYTRCACQVRQARQHREPWGGNQMHLIRSLLAVAAGLLVAGAAQGQTTGL

SEQ ID NO: 1005380 - protein, 64 aa, Homo sapiens
SILKLDVDRGAIRSSGAKGQVRWVGVVGERGGGYKSGPYWRPGKVDLSLGRTRKGESKSHLVAG

SEQ ID NO: 1005381 - protein, 70 aa, Homo sapiens
RGVSGTRGGEIELLDQAAMSGVGGSWWQRIQVLAGGGVVDFSSSSSKFFSSSCGFSSSVFVSDSGSGSGS

SEQ ID NO: 1005382 - protein, 59 aa, Homo sapiens
ILTKEKLLRETKGTYTALAGEQRRVPRIWNKSTPCVVDRSTDLGLRRGMQPNFLFLQEL

SEQ ID NO: 1005383 - protein, 48 aa, Homo sapiens
MAVVRWPVATWCLYHNPQDLLTQDWAGILSGTGLAAEVHQEESLLSLP

SEQ ID NO: 1005384 - protein, 50 aa, Homo sapiens
RHEQYEPGEEKFGYSCSFTCIRKKIPYRPAFDGERPTIVGPQTAIVVGPK

SEQ ID NO: 1005385 - protein, 33 aa, Homo sapiens
MGVPCGKAAGVTKLSVTPPSRPVESSDTSHGGP

SEQ ID NO: 1005386 - protein, 218 aa, Homo sapiens
ESVEFQNLATLKPSNKAFEKKFRFDYTTERALRRTLQEDLVKDVLSNAHIQNELEREFERMREDREVLRVIFPTGDSKVVLPCNLLRMIWNAQKIFHIKKKQKTNKNKEKKQTKKNPRLPSDLHPIKVVEGVKELSKKLVIVNGDDPLSRQAQENATLLFNIHLRSTLCSRRMAEEFRLSGEAFDWLLGEIESRFQQAIAHPGEMVGVWLAVPWRTAP

SEQ ID NO: 1005387 - protein, 154 aa, Homo sapiens
MRGDLEDPSKMAVDEKQKKYFQKQCHECIEHIRKQNWFEAFEILDKLLDGDLTSDPSYFQNVTGCSNYYNFLRCTEPEDQLYYVKFLSLPEVRQAIHVGNQTFNEKKKNKNKKKKKKKQKKWNYVEKYLREDTVQSVKPWLTEIMNNYKVLIYN

SEQ ID NO: 1005388 - protein, 41 aa, Homo sapiens
WCGGDRGSRQKEGHKPREAVKSRTSGSSTDRFYEGSNFLLS

SEQ ID NO: 1005389 - protein, 86 aa, Homo sapiens
EDPAAGAPDVSPRLGLVTLTTFSSSLGSGVISFSMGLLKASVLGQHAGPLGLGPAARAPVGLGALGSVHHPDTLVATDAAALGHPC

SEQ ID NO: 1005390 - protein, 195 aa, Homo sapiens
LSRGSLEAGGLECEDPERELKKQKRAARFQHGHSRRLRLEPLVLQMSSLESSGADPDWQELQIVGTCPDITKHYLRLTCAPDPSTVRPVAVLKKSLCMVRKKKKKTQKKANKKKVPLEREAGLRVCLRADEVIRQDLTVQGIRTEFTVEVYETHARIALEKGDHEEFNQCQTQLKSLYAENLPGNVGELLTTESS

SEQ ID NO: 1005391 - protein, 48 aa, Homo sapiens
LIYEDSPHRRGPTQRNEHLVTTPLDRRTDAGLLVDSPPRTGTLHSSST

SEQ ID NO: 1005392 - protein, 208 aa, Homo sapiens
MAVGPAERAWSLLASWSVSLLPAAFPTALIAWLIAPLPSSATPSAPLHLLWSTPGDSQQIRSPRSATWGLPPLLEKITCHQTAVPFMVPKKKKKQKKRHTEKKKKKLWEALGATPQPYFSFSLSPHTLIPSCVLFTLCGHFTEKVDSAFLSRSTVFCPLTPSLTSSEPTSSCAQSVVSFLCLSSALRLPCPSCPFVPGLRGDGGGIRM

SEQ ID NO: 1005393 - protein, 100 aa, Homo sapiens
SRWRLGGAHLLSLPLSTPHEREHVSQQVQELERVLLGTGRKKNSIYLATVLNPLWEGTYRLWVWDPTDRFWAQVGANSMRTCSSVQVGMPVISEASEGVL

SEQ ID NO: 1005394 - protein, 101 aa, Homo sapiens
PAVPLGRYLLRWGCRRSRSSRGGEAAGARGGRDRTAFQWAVCGGYNSYGGYGGGGGGGYHCLRMAVAVCSSYCVESDYGNWLRLASAATAKHQSSYGPMKS

SEQ ID NO: 1005395 - protein, 90 aa, Homo sapiens
MPSLGIREQRASVPGGCALRVLLWEFPQGSTLATLTLVCASPFWKQSCSALVNASSGHRPLCLPGHAFLCHLKSARTPKGTSLPFILLSP

SEQ ID NO: 1005396 - protein, 62 aa, Homo sapiens
MENLLRRRFPKMDTSAIIYVIKSVSSPKVPQVGSRQEPEPLPFLPLLGVGPNSARSQQASIN

SEQ ID NO: 1005397 - protein, 78 aa, Homo sapiens
MAASEKILGSSYYETGSIRPVVKGAQAHGDTPNVVEKIGDYKRQNPTMFAVEAPESSPDCGASVTMTRVPQCQLHLNR

SEQ ID NO: 1005398 - protein, 88 aa, Homo sapiens
MSPYEYHSGVNHSVYSNVLVQNSRCALLLTWPSDLGLPIPSQWLAVADKIKVALCRGCMNFHPVVRLGTEPGEVVKHGRRRAPGDTPR

SEQ ID NO: 1005399 - protein, 46 aa, Homo sapiens
TLLLWRSARCSPVSPELVPGGMHLRGGCIHVDQAPSSRSLAVRLVL

SEQ ID NO: 1005400 - protein, 41 aa, Homo sapiens
LSEQLGTGTHTRRQSLPSLVEMAFLHVGQAGLELPTSGDLP

SEQ ID NO: 1005401 - protein, 66 aa, Homo sapiens
MIADRPGALLSVEFAGHGSLLSNTGHGSCAAPGSCRTDTLQCLKTVMTGLPVGLAGRPLWGYRRST

SEQ ID NO: 1005402 - protein, 60 aa, Homo sapiens
SDSAANEEDIRLFVLANLAVRDSFQRGDQLFALCGHVNRPIADRCSTVSCYMWCHHHDGP

SEQ ID NO: 1005403 - protein, 114 aa, Homo sapiens
IYSQQSVVLNMGMYYADVTGFYERYGSRMPDHSRAKVVHGTFSGQPALVSHRTWLDVEVPIAVVPTLEGVQQTPIVTWVPVRGRELEHAGRGWSILKDGTLVEIPQELGCIVIG

SEQ ID NO: 1005404 - protein, 126 aa, Homo sapiens
MTGHPAQMGNQAPRSCDWKTSRSLTHLRRFPRRPGTITSAITVTRSGRGQTWPFQNWDNLVTGERDGNTTKAWERSLVKGKLWVHIPFRINSRPGKLSGPSWDLGHPAMILFLKVLLKLGEPRARN

SEQ ID NO: 1005405 - protein, 42 aa, Homo sapiens
RGVLLRRAEEWDSGGSKVTGEVLDILTRPAESVERLTGVSFS

SEQ ID NO: 1005406 - protein, 43 aa, Homo sapiens
MRNARRMDAPPNLPPSTGVLSPEWGQFLGPGALTLRHAPGQGG

SEQ ID NO: 1005407 - protein, 33 aa, Homo sapiens
EGLDGMEGFVLEGKKFGGAGKRSLATSTRRDCY

SEQ ID NO: 1005408 - protein, 33 aa, Homo sapiens
VWMEGLQWYHCGQSLGEEVSLVLSTRDRKTPWD

SEQ ID NO: 1005409 - protein, 42 aa, Homo sapiens
MKDMVRMSNSEVKTTWVDVEYEPGDRVKNQCQNADSYEEWEQ

SEQ ID NO: 1005410 - protein, 167 aa, Homo sapiens
QLAQCGHVLNPGILREVEMLTMGEASGTGGQESLEQIPGGKDFQEPSISGGRKFLLGDGSPEIKAEDSLQEADGICRGESVVTGSAYKTGPGGPGDPRGCEGVLQELRGRDGQETAWASGEVEYDPRSFQSSQGLIAVQRAAGGIGRIESKGKSPWDEHHLASEKLW

SEQ ID NO: 1005411 - protein, 49 aa, Homo sapiens
WGVTTPPPGPRLVSLTHVFYRFFWFGLVWLVGWFWRQNLSLGGQLEGSR

SEQ ID NO: 1005412 - protein, 73 aa, Homo sapiens
LEDPIPGSGYRAKEASPPAKDGHRASRSKERGPETPGNPIPGCLWMGDTKCLSWFGSFYNLKQLSPVYKTRKS

SEQ ID NO: 1005413 - protein, 73 aa, Homo sapiens
IERCTFQPTPASADCSALSFVLHLLPQAAGLDARQQLNLNDYGVREVPPCFSRLIVLRLSVNQITAGGVEVLS

SEQ ID NO: 1005414 - protein, 42 aa, Homo sapiens
IHRARYLWRRGLTIIITAYLIDSLISFIEVIFQTILVACSYD

SEQ ID NO: 1005415 - protein, 66 aa, Homo sapiens
SRGPLQLGPKSLLNARTKPEASRYLTSNYTTRYSNQNSMVLVPKQRYRPMEQNRALRNNGALSTTI

SEQ ID NO: 1005416 - protein, 63 aa, Homo sapiens
PANANSKHYVGTWSLDSTGVDCWRHYERGVCSAHAHEVLRSPSIAELTALLRKYLGGGSFDQC

SEQ ID NO: 1005417 - protein, 53 aa, Homo sapiens
GRSDGSPPAGPQEAGMHSECMQAPQFLPAVSSAATPRCGIPNHMHSPFGGHCS

SEQ ID NO: 1005418 - protein, 45 aa, Homo sapiens
LGKRGKGEPEEVMNEWVTAAGNGDSILRGHPLRVYVEYTSVIVRA

SEQ ID NO: 1005419 - protein, 139 aa, Homo sapiens
LGSPGLGTVGVGPGTAPVSGATLQRYCGWEEDNGLMGWLCPPCLLKSQEARTIGPGLARNAQQCLLALRTLHPATVAPACRTYAVFRTVAHVSGTKADLCTEPASVAGSLQLGNPPNVTMLRCHTGFVQGTMVGGAVAT

SEQ ID NO: 1005420 - protein, 55 aa, Homo sapiens
DKMARWYAMVAKVAPYTSTEPFTIDGEEYIPFNAVCWQYVLFVNRGQPTVGHEGP

SEQ ID NO: 1005421 - protein, 37 aa, Homo sapiens
SQKTLVPLPLYEARYCVYHADFTSLGKGSQSQVPGDI

SEQ ID NO: 1005422 - protein, 36 aa, Homo sapiens
VRTDADWRTGTHSPHCHTVTDCEDDGGGRQLMATGR

SEQ ID NO: 1005423 - protein, 116 aa, Homo sapiens
SAYTSYLPLPCQQLNKLTRAADESDRGMKVIENLGLITIIETIELQLNPTHTEAKHIAEDADCKSEEVARKLGDQFVGDLSCTDERAELAESKCSELEEELKNVTNNLKSLEAHAV

SEQ ID NO: 1005424 - protein, 74 aa, Homo sapiens
YYTSQRFYFVNAYTSQRFIPLNALYFLNALYFLNALYFLNALYFLICLLRPSSSSPLIFGRYSEQKRKKMRKYK

SEQ ID NO: 1005425 - protein, 40 aa, Homo sapiens
SEEELIGAAGTEAGRQAEIWCAGGSFRRQVGAALQSYLCF

SEQ ID NO: 1005426 - protein, 42 aa, Homo sapiens
MTSQLLLLTLILLNAYTSRRFILHAYTSCVAKYKALRSIKRR

SEQ ID NO: 1005427 - protein, 104 aa, Homo sapiens
WAGRGLGWGRGLAGEEGWAGEQGTTEGVLEEPMPCPSHLLGEAPEDLATSGVPWTTVPPAWRTPLGVRKTEDGGRRISSLWPVCAAFTFSLRSSRTVPLFPMPR

SEQ ID NO: 1005428 - protein, 33 aa, Homo sapiens
SAHHRQVAAEYSGMTDHGPSTRPQTTCLSPVTA

SEQ ID NO: 1005429 - protein, 84 aa, Homo sapiens
RESETAPESRGGFQPFVCYLGASTSHLVLVLFAFGFFTTCLQLPMQPFRLGYMVSDRGPWVTARLHGGTASLIPCGSPIFFILW

SEQ ID NO: 1005430 - protein, 79 aa, Homo sapiens
LGWGQRGFGTLVYTIKQMKMYRRLQPRMPRLCMYIHTVCFLESLLAYKLGGQASTMYAAAQVCVYLSGNDVHVGVCNLS

SEQ ID NO: 1005431 - protein, 142 aa, Homo sapiens
MAVGVTGSYSPTYRRVGFVLSDEESVKEMLRQVEGYVSERLRGCGEMVQGKGRKVGGWWEDNDPDEKHIVSYGQKREGRDWQTLESLDELGKTRLQKLGHEIRSSTYYGVDQVGHQLHDTVSQLDAHGPAYPMLPSGPKRTS

SEQ ID NO: 1005432 - protein, 40 aa, Homo sapiens
LPCTRDDKVNARIQMEISKEQELEIKYKDIMRTEIVPCEV

SEQ ID NO: 1005433 - protein, 39 aa, Homo sapiens
RTKYYDKIYYESIDAHTTSVIIISLQTDSTSRHTSTRRT

SEQ ID NO: 1005434 - protein, 95 aa, Homo sapiens
RVWYTPTPSDCSTLADPTPYYMNLLGMIFSMCELMLQLTWCAWVAVYCSLVSFADSRSSEDTKQLMRSFLLSISAVVTVLSAESSAHDAHMVLRD

SEQ ID NO: 1005435 - protein, 79 aa, Homo sapiens
GAEMRTRQKERKYKAGAHALYFLNALYFLNAIYFLNLYTSQRFILPQSLYFSTLYTSSTLYTSYNALYFLNASYFLNAL

SEQ ID NO: 1005436 - protein, 39 aa, Homo sapiens
IEDLISAIVLGAGSDLLLHLSACRYMVVRRSTVLAYRSL

SEQ ID NO: 1005437 - protein, 70 aa, Homo sapiens
YLSMETTCSHSSTGEGASPQMFHTVYPGPPYCPASLSSSSYNYHFNGGPGSLTPRTTLQLPRPIPNLAGP

SEQ ID NO: 1005438 - protein, 32 aa, Homo sapiens
MCREVPGAEGSVSLIQHKITLCQRVDMGSKCW

SEQ ID NO: 1005439 - protein, 244 aa, Homo sapiens
PGGFGTGKTAIAMGMAQALGPDTPFTAIAGSEIFSLDDEQDLRRCLQAFRLVHRLFASSEETEIIEGEVVEIQIDRPATGTGSKVGKLSLKTTEMETIYDLGTKMIERQKRRKRKKEKKKTKEKKKCPLTKGQGPVPGDVITIRQGDGLRSPSLGRSFTRARDYDAMGSQTKFVQCPDGELQKRKEVVHTVSLHEIDVINSRTQGFLALFSGDTGEIKSEVREQINAMWLSGGGGQGEISLECV

SEQ ID NO: 1005440 - protein, 67 aa, Homo sapiens
ASPIQVVSLDVGGDLGLPLVPVVEQLLLSCTCSYLMVSPVAELKSLGPFDDWHPRGPGLLGMKPHVD

SEQ ID NO: 1005441 - protein, 52 aa, Homo sapiens
ALEDPEVSSSTQSKLSRRFSRDVPYTHYPYTLTASPMINTIHQSDTFAIEEE

SEQ ID NO: 1005442 - protein, 76 aa, Homo sapiens
EVGGEAHWQAGHGDGKMLIPGTSQDRGREEDADSFLASHGFRKCLSSSKFSSIAGTLGSLSPSRIPPCRLGTDAGR

SEQ ID NO: 1005443 - protein, 72 aa, Homo sapiens
AGPLTGSVRSLHAGTAVSAVWAAAPLCVRPFTLRDVCLQFNSHYILYCTTIFPRGHNTSNNIHISGAATSYT

SEQ ID NO: 1005444 - protein, 39 aa, Homo sapiens
TGLWVYASSQAQAARRGPRDTAGPGLVVPARPSGPSLLS

SEQ ID NO: 1005445 - protein, 56 aa, Homo sapiens
DITPLERQQVELSPTLCQLASTGHLLRILNVALLWNYSHKDDAGLERSFLASILSD

SEQ ID NO: 1005446 - protein, 123 aa, Homo sapiens
AASLEVYSYGQIKDAFDRNAELQESPTGLTSLSQRLKTARTPGGGQSSRGVQAGNSHALFYHLPSPFYDRVQTLRCLHANLIQANGITSGAHTYELLVKPRASLSTPTETGHGGTVSSSSYNA

SEQ ID NO: 1005447 - protein, 70 aa, Homo sapiens
ISTQYTEDRLERRKGEYISIFIYEREKQAEKMKEKGKSYQLHPSVELLQEAASCEALFSEPFRGTLAGHA

SEQ ID NO: 1005448 - protein, 40 aa, Homo sapiens
MGTIDGKNIYNGSDGKLVCCWRGCCGSGSMVLLWLGGQLE

SEQ ID NO: 1005449 - protein, 103 aa, Homo sapiens
MFLGSHQWQSPFQQQLMQIRRIALHWNSQRSSQREWCSEASEFPPVSPWPLLVGALKTGLPGHPRLGITILPWGQSVSKVMPVSLEVGGAGQVIKTSPPPLPQ

SEQ ID NO: 1005450 - protein, 33 aa, Homo sapiens
TFATTTFSPPPRNLLCSCLGPGVPGSQIESLIF

SEQ ID NO: 1005451 - protein, 186 aa, Homo sapiens
MVFWAMENPVPHALCLESPRPSGFCTMFFEAILAALHTLLDNLTLLVPELDSRLEQQVDSSLLLYSVPFPQLRWKVWILLLNVAPGRSAQKSSVVIANQLDQFRLIQGLADVTCSGGAGRMALRAGSSYTLDLLSTVNLQVCPALYRYRCLAADCCTQSCELVAEELVSWEASLAPAVILEVHTLV

SEQ ID NO: 1005452 - protein, 41 aa, Homo sapiens
MLSGAGPRLYSHTRSHGGEQRWRSRTLALHRPLQWLMKGNK

SEQ ID NO: 1005453 - protein, 79 aa, Homo sapiens
SDGLPTTVLCLVGHADGWGTPSTWTDDLGHPALLGTVFGHPTAADTLRPNDLTDTTLRLDSDPAWVATLDVGTDDSTFS

SEQ ID NO: 1005454 - protein, 70 aa, Homo sapiens
EDQIFRFLRCSPDSAGLTETGVEAAEPRHLCVPHLLVYVKVQQPFPLRALGPAAQVPLSSWGEYMTPGPD

SEQ ID NO: 1005455 - protein, 67 aa, Homo sapiens
MDIIHVGLRAEENKAAPPTPAQDPGLSEGTAVLRHRSPGPIQTPLLLELALKTHGSNLIQVEGAEGR

SEQ ID NO: 1005456 - protein, 43 aa, Homo sapiens
GEYAERSGGVYEAQGVISYMNVVELAGSLEEWRWVGSSGCRVV

SEQ ID NO: 1005457 - protein, 39 aa, Homo sapiens
SRRSFAVEELSESELRLIGGAALALGSCTAGEGVSLGVG

SEQ ID NO: 1005458 - protein, 76 aa, Homo sapiens
MDGAEEAGVSVDLDAPGAAGAAVGADSGRGWVLGALDRLSSCPGDDELPLEHGTGTLGFSCCCVNAIPTIQTSQWE

SEQ ID NO: 1005459 - protein, 75 aa, Homo sapiens
MRLAWMLAYGSGCLVMMQRMWSEKMKVCWRMGKGLEWGLDAGLWMVMYPGHGGRPLTPVTLHVLHIFLHNYDHSP

SEQ ID NO: 1005460 - protein, 73 aa, Homo sapiens
YLYFSTLILLNAYTLSTLYTSQRFILLNLYTSQRFILLNALYFSTLYTAQRFILHTGKLTEKYKALRKYTALT

SEQ ID NO: 1005461 - protein, 56 aa, Homo sapiens
MKWRGADAVFRCPEQDVPFDGSSLDVGMDVRPSEPPWELLAIFPDLQVKSEPSPPQ

SEQ ID NO: 1005462 - protein, 45 aa, Homo sapiens
GPGNKITLFHGGERADVQPQNFGNGFWVPAACGALEARVNAQREM

SEQ ID NO: 1005463 - protein, 126 aa, Homo sapiens
PRQSGAVGLRIWDTSLFPIWRYEMPNKGILTLSAIATLDRIGTDGDCSKPEEKKTGEVATGMAYRPNWLLAGAAFESLVFLTHWVFGEVSLVSRWAVRGHPHPGPDPNPFGGAVLLSLTSGLMLPS

SEQ ID NO: 1005464 - protein, 127 aa, Homo sapiens
DPPATECASRRQRADKSLLLGAEGSSGITQGTCRSPVPDLFDAESRLDTPNQRSSRYAHTSPGNALDLGLSTTHRDPGQTPLKADEARSRLTSSRDGKARLSDSTKTRQELPRSRSDQTRRPRTRRV

SEQ ID NO: 1005465 - protein, 94 aa, Homo sapiens
DLLLQRWQTESSTSLQPLSADTAGVQKTWSETSGCSFHWPGLSPVGMTGRHTPRVYFVCRAAQATNAEIDRQPGSGNFLFPMERLPYTGPAIAE

SEQ ID NO: 1005466 - protein, 137 aa, Homo sapiens
SGVCPQRCRDHRHESSHPAKIYLLSHRKLLIISNYKELVGFISLRYVQDFGKMISVSVEACGLQQSLKLSPAGLRVGFKVSSSSDMLLWLVNKQKETARAQGWGATEGYKYSSGRQAIVPGHRRKRGEDIPLNPQFG

SEQ ID NO: 1005467 - protein, 81 aa, Homo sapiens
YEARIPGSISVVSLIAVREGSGEHHKHVVGSLQLRHMGKRFGKEELWVRGLYETRQKKILLNDWSMTLKLILNNLFRPNLS

SEQ ID NO: 1005468 - protein, 46 aa, Homo sapiens
SRDPHRGAEAGEAGDHQRGEVNPDAIEILHVKKKKARLVVSQVHPD

SEQ ID NO: 1005469 - protein, 65 aa, Homo sapiens
MGGDEDWMMAAKVRRFLFPELSEMLVYVSLVVSVRKMGIHGLGQQTKENDYEARDHDKVITLFYA

SEQ ID NO: 1005470 - protein, 58 aa, Homo sapiens
ALLEDPGLRDPNEKKIVELLSVIPVYIRNDLTEPHKPLTQRLPGISREARDFREQIWT

SEQ ID NO: 1005471 - protein, 122 aa, Homo sapiens
MVIKQVTSRRSVWEVDWGTRDVLNGGKNQENSIQMPGRYQGWPRGQVTQEELRLLQSPGPFLVGHGVGAEKIQLVLADDAEVKVASGAQVVEDARGDGFAHQILGFLLLRTRRGAIRSRGKL

SEQ ID NO: 1005472 - protein, 68 aa, Homo sapiens
VHAITGSQTPAAGTLIDHAWAGAQSAMGRASLIHSRFLLMDNKAPGGMVNRARFHITTSKVFTLSSSS

SEQ ID NO: 1005473 - protein, 54 aa, Homo sapiens
RWRHLLALPGPGVGGLARPCGGRSRACRAPSGLMRAAGSYSSIAQHQFFTSVRG

SEQ ID NO: 1005474 - protein, 66 aa, Homo sapiens
YGLRYKFSRPGGRHCGRGQVVGAEEDRSLLSLCSAWEELRPYFRDRGWPLARALLDVHQKQGGAVG

SEQ ID NO: 1005475 - protein, 105 aa, Homo sapiens
RNEVGHTAAYRQPQAHGDANGTGSKWGTRETKTKAYSKEGRGRAQKVDPAQKETEEVGQGLTNTIDRLKMQVDQLESEGESRSVQTRKRKGDKDKKDGMEGLRRH

SEQ ID NO: 1005476 - protein, 40 aa, Homo sapiens
GAGEEGSGEGRGQSSFQAPKHGGGHGSCGSKPEPSWGSKV

SEQ ID NO: 1005477 - protein, 45 aa, Homo sapiens
MAFRIFLLSQYPNRQISRSGYSGPPSGLGPRSRLALPFEAFLVAI

SEQ ID NO: 1005478 - protein, 67 aa, Homo sapiens
SETGSPGAWPADSQRSLSLGHSSGSGSSYALQEVSGLLVPLRGDMGEAMTGKGRSVTLPCTNGSFRV

SEQ ID NO: 1005479 - protein, 36 aa, Homo sapiens
KRGLFGRVLPPPGRRHGVLSFFFRRSLPASGGTGAR

SEQ ID NO: 1005480 - protein, 34 aa, Homo sapiens
VALTAPESGIGNEVTVSGLHSSSSPSRGVRQLAI

SEQ ID NO: 1005481 - protein, 192 aa, Homo sapiens
LRIPRGRTGAGEEGTSWIPGHKRRPGAAVTEEEHKRYDDIDLDIEELAKDVGAQILRHSHKKDILMHRWRYPSLSLQGIEGAFSGSGAKTVIPRRGVGKFSIRLVPNMTPEVVGEQVTSYLTKKLAELRSPNEFRGYMGQGGKPGVSDFSHPHNRAGRRAMKTVLAVEPDLTREGGRFPVTLTFQEGTGKNV

SEQ ID NO: 1005482 - protein, 176 aa, Homo sapiens
MPHAVRLDRPQSRQPPYRSVLQSTQGGRGLPLATLSQSSIWAGGNKWTDQTRIYLGGMANVTLIDLRGCKQITRKACEHFISDLSINSLYGRSDEKLIQKIIKTHPAQIQQETDLPLIPHGGEPLLDPAGARRPASHSLSALRSLEPFLYGGGREGGGHQANLAAPLPPKETGVAD

SEQ ID NO: 1005483 - protein, 104 aa, Homo sapiens
CLERGKTRTQKDAGNYHDPQVLPAPGNNHSGVGWRSHNFPLLPGAKGLITSQKLLFKPRFSHLFGSKAVPFFMAYSLTPNYPRGGLKKNKRDSPLGGPQKFRLK

SEQ ID NO: 1005484 - protein, 51 aa, Homo sapiens
DDNNLQKFQTSLAVDIPPAQGGTSGNWHLRLQLGFQLASRGNTAISVDAGK

SEQ ID NO: 1005485 - protein, 44 aa, Homo sapiens
RRNEMRVGRPELQNLLMAQSPPGLAGIISTQREKRDKVVMEVPE

SEQ ID NO: 1005486 - protein, 61 aa, Homo sapiens
GTDPVMNGVLQDESRGHGDPAFGNLSRGHCCFDSMWSAGSWAGVARGCGQTLARAQRLSPP

SEQ ID NO: 1005487 - protein, 130 aa, Homo sapiens
VGTGKLAKEIEIGKQNKMAKALVAFSTKKWIKGEKVHGSWNNELGVGVQANDSEKGPALKLNDKHAVVNLVSGVNTQALGYPGSGLGLGGHVCPGEGNHGSGWPSEEWRIGGSFVMYLFSVHLVTRCQNL

SEQ ID NO: 1005488 - protein, 32 aa, Homo sapiens
TSTGFNFILAGKGTEEAGKTVLNHWMLAPTLF

SEQ ID NO: 1005489 - protein, 72 aa, Homo sapiens
LRRQRVAAPRKNYLVSTFSATDPASTLGPFLSTWALRNWAASPWMLNASTMEMPEPCGYYSPPSTNGPGPKL

SEQ ID NO: 1005490 - protein, 41 aa, Homo sapiens
RISSCGGADVAGKDPQVTSSASSSGSGWCSRTRKVFSFSCR

SEQ ID NO: 1005491 - protein, 31 aa, Homo sapiens
EEELKWTRILGEIYILLQNRQTCNRKAILTL

SEQ ID NO: 1005492 - protein, 66 aa, Homo sapiens
AELMLGGTNTLVLHNTCTDSLLADPSMLDLALLTELCQLVTICLTMDPEPKTFQPRACPCYSLPLQ

SEQ ID NO: 1005493 - protein, 40 aa, Homo sapiens
MLIDGPNKRTAPSAREAMGTEGKGLPLVRGMEGGGSSGTP

SEQ ID NO: 1005494 - protein, 69 aa, Homo sapiens
MLYPRFQKELEVDATHPAETISFLVDELDTLHQSVPRIIQNIGTEFNLTASELNSDAGRRPGTCCFTNL

SEQ ID NO: 1005495 - protein, 74 aa, Homo sapiens
GDGTNTPAQARLRTGAVPEKYARFWASGRPGSISAVKSWRDQDQGLSATSSPCHLQSRKRKTQIQVEAISSPRA

SEQ ID NO: 1005496 - protein, 159 aa, Homo sapiens
TVPTDQEGEEIANEMMRQQGVYTQDGPLGAAKAIQAYVAVLDETYPDPVRVVSMGVPVSEWLDDPSGPAGSLTSVEFCGGTHLRNSSHAGALVIVTEEAIAKGIRRIVAVTGAEAQKALRKAESLKKCLSVMEAKVTAQIAPNKDVQREIADLGEALAL

SEQ ID NO: 1005497 - protein, 44 aa, Homo sapiens
MIIGAIYVIFPRISRGIHLKRHLFYLPIHDVRHFHVPNQQTVTS

SEQ ID NO: 1005498 - protein, 35 aa, Homo sapiens
GRLYDDSPTGTGSHDASVLTDDRGGYRRSTLRNSL

SEQ ID NO: 1005499 - protein, 39 aa, Homo sapiens
RSLYDGLPPLSYRTTRRAYFSYTDDTTGGYPDARHRTTH

SEQ ID NO: 1005500 - protein, 48 aa, Homo sapiens
SRGSLLMLLTCGLRVSTSHASPPMRPNTFFQVQCPRPWCAPNKLRNAP

SEQ ID NO: 1005501 - protein, 106 aa, Homo sapiens
LRSRTSLLYRCDPGPHRSSSSSWPVLLQRFDLEVPDDGQLPSLAGIPKVVFLIASFNVPLMVRQVGRAAQAAGGPNGCNSQPLSTLCGPRTQITTYNPAPFSAILP

SEQ ID NO: 1005502 - protein, 41 aa, Homo sapiens
MHALAMPCPCLDPLRRRSPLPCHFIADVCWPVGLGGWASHR

SEQ ID NO: 1005503 - protein, 37 aa, Homo sapiens
VCCRSPLDGSPTSSTSHPATFGRVLDVTDADGTGVTD

SEQ ID NO: 1005504 - protein, 53 aa, Homo sapiens
CCRSTLRRTPRIHHGDDYGTTSVVRATDVWGRTWGGFVLFTPSLLLFTVCYDY

SEQ ID NO: 1005505 - protein, 37 aa, Homo sapiens
DVAESPLERREILLMARKSSVKLQSHKHLKPMNLQLI

SEQ ID NO: 1005506 - protein, 64 aa, Homo sapiens
ESIWAFHRSSEPSPTPLLGVKALQRDGAIYPRSLHSPFVLLLQLRLFDSDCVWTGLGNRTIDWC

SEQ ID NO: 1005507 - protein, 49 aa, Homo sapiens
TSDTRDPLRASAPLYHHLLRPSGTHRSAASCTRRFGVPVFVPRCRGTRR

SEQ ID NO: 1005508 - protein, 47 aa, Homo sapiens
TLRQGVCLLIPGRATAYIHRFTNGGKEKRVAHFLGITESLTGNEIRR

SEQ ID NO: 1005509 - protein, 44 aa, Homo sapiens
PVIYRIPPVGSWKGRSSASLAAEPFLAGLEPSSTSPWSCSSSLF

SEQ ID NO: 1005510 - protein, 78 aa, Homo sapiens
ATEEELIGSQLWLRTACPAGGTGVLNVPVTVTKGMHGPACCDLSSVHSIRQILFVCKDKEYSIPELALRQHSHQLLPV

SEQ ID NO: 1005511 - protein, 69 aa, Homo sapiens
EEELTQVFSGFRATPYAQPGHLPSPADPSGLLTYQVLEKNTLEVSTTSCHKPVSQECQVCKNSPARIQQ

SEQ ID NO: 1005512 - protein, 72 aa, Homo sapiens
MSISPSRVVHQRGYSLEAQRGLPGESGDDLPLNLLQIATPALVSLPSSTWYWQLEDISGVRSRSHFITADMQ

SEQ ID NO: 1005513 - protein, 46 aa, Homo sapiens
LTQRVACIVVAVCEICHLLLVQFIHVHLHVDVGDDLIFVRVALLLS

SEQ ID NO: 1005514 - protein, 53 aa, Homo sapiens
KRGISTPTPYTSGKPTGGGWGGVWTSLCHWGPSGRGSESSLLASLAWGQALLS

SEQ ID NO: 1005515 - protein, 42 aa, Homo sapiens
SSLDFLLIFANGSIHYQKWDMKSPIMPDASPRSRRHGTPHRA

SEQ ID NO: 1005516 - protein, 138 aa, Homo sapiens
ELALFQAARSLAASEWLSSAYQSLRFLQLARTAQEGVQGPSAQSRSPVPPHFLASATPPVKALEPPPTAQMGLPSLLCLPRCPGLWPAQSRLRAHLHLLSPWLPPMTPMALASPHFLKKRHLPGPGPQPGTWGPKQAS

SEQ ID NO: 1005517 - protein, 162 aa, Homo sapiens
ELCISEKYCPLSSGDKIGLSVLKVSAENLPQASLLVCLNLTFCPPKHEHLGDKPRDWFPLPLQGRTSLSRASAGGYSGWAFNFNLFLGLFFLTTPSIILSTMDKFNVTKPIHALNNPIISQFFPTLLLWSFSALLPSIVYYSTLLESHWTKSGENQIMMTKV

SEQ ID NO: 1005518 - protein, 45 aa, Homo sapiens
MRMKNTQSPYCGIAPYIREYEDPRDVPPPTRAETREERMEEEHDG

SEQ ID NO: 1005519 - protein, 56 aa, Homo sapiens
VDLYDGLPTTDELTYDTCDTHLYGLDLTATTRLSTDYVTYDTYDTCDRLTNVVRRR

SEQ ID NO: 1005520 - protein, 42 aa, Homo sapiens
KVESQQASRHRQVSNFIGAVIQAAGASRPWWVTAARQFGQSM

SEQ ID NO: 1005521 - protein, 47 aa, Homo sapiens
DEYQCLQAAVPGPASMGQRPDGARRGGQVLAVTQAPCSRRVRFTVHA

SEQ ID NO: 1005522 - protein, 53 aa, Homo sapiens
TAAGRLYDGLPCGFRGTHPRTDVFTLDDHDTLVVIACTVPPRHVGPLLTSTAR

SEQ ID NO: 1005523 - protein, 180 aa, Homo sapiens
PGVIQRTPSPNPGYQGDFYIQDPIYGEYRYPYLTANNYYSLIGGHQGFITYDDRPHLRVHSLQQVGKANKGHSFISHPEYRNLKSGYAVSVGYHVPGEDQFSQVRRTLQQGPSGQAFQGHIHFPLPGSGSEGRDHSHPEYLLTPSHHQYTPHKSGIHPITYKHQVIHNIYKEGNTFIRGS

SEQ ID NO: 1005524 - protein, 48 aa, Homo sapiens
ESEDPRKPSSLGSQLPISEKLGVSQGQKGYNLEGQVLEFLTEGTRDCQ

SEQ ID NO: 1005525 - protein, 44 aa, Homo sapiens
MWASTGLGHGIGTWPTAHEVPASGDKAGSGDRCPPVDPRDPYRS

SEQ ID NO: 1005526 - protein, 33 aa, Homo sapiens
SRRLDSVGIEADDDRLNKVYKEAVRNKMTPMKT

SEQ ID NO: 1005527 - protein, 39 aa, Homo sapiens
FSAGIPQKQPFIHPSNHQFATVNSSGVPQLAHSSIHGPS

SEQ ID NO: 1005528 - protein, 68 aa, Homo sapiens
YGVDDCRVTAYNTHYAAYLKTYRRQRTYWTPGLWDLGPGLLDLTPGLCGLTPGLGYPTLDIRTSWVIR

SEQ ID NO: 1005529 - protein, 34 aa, Homo sapiens
LVEDPAEAQDHILNQGREEAQEVLAMPVSFMGKA

SEQ ID NO: 1005530 - protein, 36 aa, Homo sapiens
HFISAGSNQAARAAWASPHSFPNTAVVGVTQRTFQS

SEQ ID NO: 1005531 - protein, 39 aa, Homo sapiens
MHSLLAVDVYSPRRCMPPVYKFRRHVSTVHELQISLSGS

SEQ ID NO: 1005532 - protein, 64 aa, Homo sapiens
MVRLFQTDVEEQAPLGGRYIRHLGQVGLCLRLRMKLWPALGTTHQHPASYFRLFGATQEVGRGY

SEQ ID NO: 1005533 - protein, 70 aa, Homo sapiens
MSNIRGSRPTSVGQSNILGSVQHPGVSPTSWGQSNILGSVQHPWVSPTSLGQSNYPGSVPKSLCQSKYPW

SEQ ID NO: 1005534 - protein, 80 aa, Homo sapiens
TPKIQCSFPVPCVQNAISYGKCVPTGGKIHGMQGSGAFGYLSSLIIIMLIGSSVSSTYFTSQARSYEVLKPRTYYIISSQ

SEQ ID NO: 1005535 - protein, 35 aa, Homo sapiens
QSPCTLSLAHVGAAALWAPSSTDETLKPTVYPLVV

SEQ ID NO: 1005536 - protein, 209 aa, Homo sapiens
SPTRGVEPQPGVRPLARLRANLLATGSTAVTGGAGQGEVCVTSSLTQFLLTDNSADLSWRALRALENPNQGRSSNTKEVPSGKKQHSPQLPPVLSQPVDTMPPALQQNKTVLCPRSSVQTHHGAHPGTRCTPRAMVHFHGAHLPQGTPTVVQAHSHYAHPWCMPTTVQPSTVHTQQHGATHPMQGATNMLTQEAVQPKDTICNPVCTAH

SEQ ID NO: 1005537 - protein, 96 aa, Homo sapiens
MTEFHNPDLIYGSLLCIDHEKVCARSRVSALLNLQHGSLCSKGTGVYVEPSYVYSGIFNRPRLHMGAGCSWRHRYAYVATADMYRAREVLVATWAV

SEQ ID NO: 1005538 - protein, 110 aa, Homo sapiens
MPSISILTVALLVLLASLVLRCLRWALLASGLIHRVGVTTGYVLDSGVRGVAFRVWAWDLTVRVPEFFLPNLPLSRFSLPVFLNWNWDSFLEARVFPEEAPGGQMPTAMT

SEQ ID NO: 1005539 - protein, 159 aa, Homo sapiens
VRYDGYTSRKVVEVEVQGIQLDVGHGPGLPGDHRHGCGTGCRWLSFSRASSMYFRPFSSRMALVLKWVWQPAPFQFPGRLGSRVAITPKSSHTRCKDETGHPGRSPKRIPSKGPIWNSQWAGMTSGLVPGILDQSKIVGTAVALSLHGMLQSQKDEFPG

SEQ ID NO: 1005540 - protein, 52 aa, Homo sapiens
RISTAAGPPQVSLISRCGELRIGIFFPRQGLILSPKLQCSAVQWCDHGSRVA

SEQ ID NO: 1005541 - protein, 75 aa, Homo sapiens
PTSGVQAIPGLSLPSSWGLRARATRTGGFLVVLSRDRISPGKPGGSGSPDLVIWSIWASQRAGITDMSHRARTAT

SEQ ID NO: 1005542 - protein, 74 aa, Homo sapiens
DLEDPGDCAGEELSPVVGPLKNRFLRPGPLPVHGPLPIPSPAEGIPGVAYLTYKVVYKLLSGPLHSNSKVYFIV

SEQ ID NO: 1005543 - protein, 53 aa, Homo sapiens
RRVVIPMRAWGGMGRWRHGQCQAKSYLPEGYGEPGLTRVDMAEPETPFFDPFD

SEQ ID NO: 1005544 - protein, 105 aa, Homo sapiens
SDEFGKYNASQGTYGEKKDEILGLRALEEDHFIWASGEMWRRQQNNLDRPEGDSRLTYWYADGRQILLGGVYRSTSYRVKYYLVVLTTTKPPTDSQFDYSLGFRP

SEQ ID NO: 1005545 - protein, 38 aa, Homo sapiens
PLDRVCTGSAFIARIPARDRMNRVLQDRAETEEERSVV

SEQ ID NO: 1005546 - protein, 126 aa, Homo sapiens
SPTSVDMGLRPSLKRVPSYSLREGMPKRTGVQGASRKLNTVEVTGGCTRGSMEDPCPFPVHTLPYGLLTGILGTMLYSKLINLSVSLSSVSRSSKLIKPKGGGVGVTPHVAHKYVYLLCTHKNKTI

SEQ ID NO: 1005547 - protein, 34 aa, Homo sapiens
ATLALAFYVVLVWLQVYLVDPSGVAAWGHAARHL

SEQ ID NO: 1005548 - protein, 94 aa, Homo sapiens
RILVDGTNTLHPKVCSTDGNGEQSLHNLMQWFRESVEGCENSHFSYPNCGFVAQGRKRYYANYKGRKIWQVPPAIGGLQKHFSKFFLGPNGSWI

SEQ ID NO: 1005549 - protein, 122 aa, Homo sapiens
RTGGKDTIKERYKPIRAEGTNYRTVYDKAGQAEGQVKEGYQSHRDTIVLLCKPEPELKAAIPSANPAKTRQGREVVNVLKSLWSNLDEVKKEREGRENDWKSVNLDMTSKFWTARGSGGCDK

SEQ ID NO: 1005550 - protein, 35 aa, Homo sapiens
LFSYRTFTAVHGIAFHPVHGTLATVGSDGRFSFWD

SEQ ID NO: 1005551 - protein, 166 aa, Homo sapiens
SDEVRTTAVGLRADKVDPAGSDGCRASAPSPRVEVYETHARIALERGDHEEFTQCQTQLKSLYAENLLGNGGQSYLAYRILYYIFTKNSGRHHQGAGIPHTRTEGRSLRGPCFGIKDSRGPGATTTVFPGSTAMHLACLATSLDKLADRERRVALRGMIKPVCGAK

SEQ ID NO: 1005552 - protein, 33 aa, Homo sapiens
GANDGLPPSSPTGRPTGGTRRSTLRNSRVTTLV

SEQ ID NO: 1005553 - protein, 45 aa, Homo sapiens
MVSWRPLMDCNWCLPDLGVSSSTRQKYTEGSSFGGLEILRKPLSG

SEQ ID NO: 1005554 - protein, 47 aa, Homo sapiens
DACRGTNIDLYIDGNTPSLPSQWDGIVLYSLGLPFPPVKGNIFPWVQ

SEQ ID NO: 1005555 - protein, 45 aa, Homo sapiens
DRGREEGSCVFNLALVYDLTKSQKYHSFQEWGKVSDASQVLGGFT

SEQ ID NO: 1005556 - protein, 70 aa, Homo sapiens
QSLVAFRRHLIKRKYFPGGEVRSGISPPFVGPASSSKGLNLYMLTLLPFPQPIWVYSSFHNPNQTSPATG

SEQ ID NO: 1005557 - protein, 45 aa, Homo sapiens
TSKSLGLQGAVITLRALHPGHMSKTLSKKNKTPMIETPSLPRTEG

SEQ ID NO: 1005558 - protein, 75 aa, Homo sapiens
VEGVSRSSLRSCRRWTDSNILVLQTKPLSILMGQRDSSFPLIHSNDSALSESWLKKADEKNGSLILQAQPPRMKG

SEQ ID NO: 1005559 - protein, 30 aa, Homo sapiens
MWEPQSGFSQRSGGSESVGGIQKITFTSIM

SEQ ID NO: 1005560 - protein, 52 aa, Homo sapiens
MCLQSQLLGRLRQENHLNPGCGTDPGCWSQDVGLTQDVGLTQGVGLTQDVGR

SEQ ID NO: 1005561 - protein, 93 aa, Homo sapiens
CDRVEELTELELEQNGSMSRADFEERDESKIPEGRALTGGARQCCIGPGMLLELNRMPPRLGPAQYRWKVNKLRRGRTGPGLSPRILACMPQG

SEQ ID NO: 1005562 - protein, 85 aa, Homo sapiens
ERESGSVTQVGWQGGYLGSRKPRPPGFKRISGLSLPSSGNNRRRASRGANLGILSREGVPQGSRALDLQVIRPLGPPRMWDGGTE

SEQ ID NO: 1005563 - protein, 119 aa, Homo sapiens
KDMNRHLSKEDIYAANRHMKKGSSSLAIREMQIKTTMRYHLTPVRMVIIKKSGNNRYWRGCGETGTLLHFGGDSKLVQPWWKSLWQFFRDLELEIPFDPGCGSDPGCGSQTSWVSPTSC

SEQ ID NO: 1005564 - protein, 33 aa, Homo sapiens
TDANFSRWRSTRRPFTHTPWLGVNVTIPSGTTV

SEQ ID NO: 1005565 - protein, 69 aa, Homo sapiens
APEGHQASVFQGQFYLVSLTGGDLELVGRPKEMAVSFKPFRELTNQSSLIHPQANEGGVVGPITEYSAK

SEQ ID NO: 1005566 - protein, 39 aa, Homo sapiens
AAPGRGIPFLRVWIRRSSDDAGALFPRVRGRLQSILVLA

SEQ ID NO: 1005567 - protein, 48 aa, Homo sapiens
IRCGGGAESSNVLEQLTEDGGINSNLYFLLNREKPMFPTSECRILLEA

SEQ ID NO: 1005568 - protein, 113 aa, Homo sapiens
MAVADSWEEACWKTGRGTASVASPPELLSSTECRLWLRSSPMGGSTRKIFKTSEFAEVFLQYGVNVQIFGLGLFQEGAEVVQPIQLVSFIVLHGLLLKMLEYGQPEHVRGYRA

SEQ ID NO: 1005569 - protein, 95 aa, Homo sapiens
LITTPVEHGVLGWLLLLGWLLVVLLLGLDWFGALHRLYLLSSADLDGVVLNTLGAVAGCWGVYCGICCCPCDGNRSRLWWQMSSTNVDRETLDTH

SEQ ID NO: 1005570 - protein, 114 aa, Homo sapiens
RSRVALFMDTCPSSPSRLGNTHKPLPGLIPFSCSVKFSFTESHFEIMHPHPGAEPSKMMFPSYHFISKAWKFCDMSEAPSQQLVPVLTWYGSSITADQNMTEGISVTHSSDCVP

SEQ ID NO: 1005571 - protein, 31 aa, Homo sapiens
MAVGSGCSDPEWLSPGSPGGGAPFSRRWRQQ

SEQ ID NO: 1005572 - protein, 69 aa, Homo sapiens
RGADDYELSASGDYYPEYKLLFEGAGSNLEDKMLEDRFFEHEVKLNKLDFLNQFHFWWSSMPSEKLNGA

SEQ ID NO: 1005573 - protein, 59 aa, Homo sapiens
VDLTARSQAGGEVGPTVTVTPHFFHPCRLTFLAGWAGPHTGHLAGSRSSQFVNPWSISV

SEQ ID NO: 1005574 - protein, 45 aa, Homo sapiens
GGEGEGAAGGRQARAVIEEVDWPTRSSEGVTGTSRDGGQASLEKL

SEQ ID NO: 1005575 - protein, 32 aa, Homo sapiens
MGRAKEKGAWFLAVAFPWTCLRQGGLGLARGV

SEQ ID NO: 1005576 - protein, 39 aa, Homo sapiens
RSRGSRKEEGLSSGRSKHKGGLSTTRCKRRDFPTTPFSP

SEQ ID NO: 1005577 - protein, 51 aa, Homo sapiens
CHSVTVKGSVLSERDYESLVMMRMRMWAERQQLIARLQQADHEEADYVAPA

SEQ ID NO: 1005578 - protein, 177 aa, Homo sapiens
RTWVGEEGHCGGGACGVRLWKRRQDTRWGSFRLGSVGLLLGLLLLLQLWLGLSLLCWGWVGLCTGSFRQLGFLIALPLFLNGGWPVPQPPLYAARKRRKLYNGLMVLGRCKPVRASGYLQDELVGVRISMASSGILIVAVVLPLLILILVTQLLLVLDEIQEWLDTAGYIWCAVSPR

SEQ ID NO: 1005579 - protein, 102 aa, Homo sapiens
IKRDVSRSVMPAVGDLTVRDSSSQLPFISFLRYFCLVPMGCDVYRSCTLDIPSFLSFLFVFFVFWFLSFWFFPPCEGRKAPFYNTRAPGGSPGHKISQHRGP

SEQ ID NO: 1005580 - protein, 93 aa, Homo sapiens
SLTDSPGSGTHERTLRLVGHDDFWSCLGDGPNTHCTTTFTFRFWGTTHDTLTHTLSQQPPFYDCQTTHSPRTVQPLLDTDHRSTRRLDTSYLT

SEQ ID NO: 1005581 - protein, 68 aa, Homo sapiens
RPCLDGSSPVLPSPSSPERSDDAAAAGREGLAEGEAAGNVGQGGAPVASGAVPQGNTSLVNAKKNQNK

SEQ ID NO: 1005582 - protein, 153 aa, Homo sapiens
MRWPGEQIKSIRQDLTGQASAPSSRGEVYETQARIALERGDHEEFNQCQTQLKSLVRRELAGQWGAEFMAYGILYYIFTKKSGDITREWAYLTGEWKEYPWVAHAWALRTGGARGNYHRFVRLYGHAPCMSGYLGDKFADRERKVRLRGMIKM

SEQ ID NO: 1005583 - protein, 139 aa, Homo sapiens
RKEVGHCVLWWLPALRHFPFGPRSDWRDLPNIEVRLSDGTRARKLRYTHHDRKKGRSSSGALGGVCSCVEAGKACDPAARQFNTLIAVCLPQTGNRHKQGAGLYGRLEWDGFYSTTVTNPEPMGKQGRVLHPEQHRVVS

SEQ ID NO: 1005584 - protein, 73 aa, Homo sapiens
LDGSLPLLLTRQDAFPHVSATFSFPCTFDPPFTWLVLSLGVHCLCTPPSLPSAAGVPRSPSSSWSSLFPVCPC

SEQ ID NO: 1005585 - protein, 90 aa, Homo sapiens
SEGGRTQQPTDTKVIRVYPAEGDRNSADAPREKKKPCNQEAAPELRPGLSGDFQASLGREPRLGFCPFLPISSGSSFFLGVAPQFLVSSQ

SEQ ID NO: 1005586 - protein, 84 aa, Homo sapiens
SERGRTISRLLVHYMEGLKVADYAASDRCVALPRGAAVQAWMSSRAALYTSRSGLVLRMARGVTAENGCLGRGHVKLYPGLLYR

SEQ ID NO: 1005587 - protein, 165 aa, Homo sapiens
RNEVGPWAEEEMSAGAEQGGVWGGSVLPPVHGELLRNWILDCLPPESGWGLVVLLGRVQTLPPMLYWTCHGEGVPMPCPPTPVWTCQRGQARSGVGSLPGTLAQRHGRHSPLDPRRAGNSLSFAVGFGSIQSPQVAVCESSYSKFQEREQMVWEYLICRCWCSEI

SEQ ID NO: 1005588 - protein, 81 aa, Homo sapiens
GEKIGVSDLRMNKVTLHGSSIIGDGRAFFMSFTSICNRSGIFFSSSNSDNKGLISRVGGSFRVSRMLLSAGTGVLTSCGGY

SEQ ID NO: 1005589 - protein, 103 aa, Homo sapiens
QLGGSCHLCRWLFLHITTGASKRTGVGNPPGILAKFHSDFSMLNGSLWLGRAVLLLRSPLFFSLALIEAGDFPHVWFVCHFLKTTPCSLAPSPSILALPLALP

SEQ ID NO: 1005590 - protein, 104 aa, Homo sapiens
MVGADGVVGGVHSKWGVREMGVGTNRTGDSRFMSAPYPFHSSGVPSASLPGEPVLMYRVQPLMEQSSVCPNPKVPGYVSSDWTISCSVGLGPASGLPTSLSLVR

SEQ ID NO: 1005591 - protein, 81 aa, Homo sapiens
MTARKWILGPPYSWLKVPLLSAILKLIFSWITAKKKRTRSTMSVSILEGMSYQFPGQHAKQLEFLTRGANQVIKVVHVLGP

SEQ ID NO: 1005592 - protein, 33 aa, Homo sapiens
EGLWAVEVEGKEISSLVPNYLVSYSRLRKYKHY

SEQ ID NO: 1005593 - protein, 116 aa, Homo sapiens
YISRGSLSTWSMGSVSDRNKFPVSEENTNWMSPAMREAPTSLSQLLDNSGAPHVTIKPPGLTDLEVTPPVVSGEDLKKASVIPTLQDLSSSKEPSNSLNLPHSNAAVFIPCASRIE

SEQ ID NO: 1005594 - protein, 87 aa, Homo sapiens
SDTMEDGKNGRERVLFKSQSRQHSSSISKRFLLLGQQSAGISIQQHNQPHQAQAGSTVPASVMCAAVSAQQQQPLVLTPQRQLQPSK

SEQ ID NO: 1005595 - protein, 34 aa, Homo sapiens
VVRGSHPALGRVFETSSGKVVGVPGFDHVKGWWE

SEQ ID NO: 1005596 - protein, 78 aa, Homo sapiens
CSSMRCPMGRKKGAKLTPEKEEIDINTKRSKKLQKKYDERKKTAKISSLLEDAVPAGQASCLHSLHGRDSVAEQMAMC

SEQ ID NO: 1005597 - protein, 43 aa, Homo sapiens
HATPERNTCTYCLSTPALTPVYTVYTPPHLEEPMVKVNMLMFA

SEQ ID NO: 1005598 - protein, 33 aa, Homo sapiens
VTLAEVTDLYGQEKYTLASQNSLEVHIKYMSHL

SEQ ID NO: 1005599 - protein, 81 aa, Homo sapiens
GDSTRIPQHTCAIFLNVLYNVLLRVPVTYYVPSPFFLGLTWVNTDTDDTCYCFLPKHTYYTLTTFGPRPTTTYSGLPNLNV

SEQ ID NO: 1005600 - protein, 39 aa, Homo sapiens
MTRVGSRCCLGPGGVGGACLGPTHSLEPSKEQQIMDTAE

SEQ ID NO: 1005601 - protein, 50 aa, Homo sapiens
ILSGSERASCCLMHGSSPELGVPLQRQVHDAGEAWDLATLDFDPLGRCPI

SEQ ID NO: 1005602 - protein, 31 aa, Homo sapiens
MESEAGMRGGGVHAGPSVTPSRSRVLYCMPE

SEQ ID NO: 1005603 - protein, 113 aa, Homo sapiens
MWRRPRRRLRSMAGLFLAAGRGRCKTLLCSQSMKVLKLGRAVGGSWWAASVAGQCPCVGLIELSGSVGVACQCGHWGPLTLVLVSYLGYGYMGISWPGSLLPRALDLAPLSLS

SEQ ID NO: 1005604 - protein, 42 aa, Homo sapiens
VWVDIYPRQILEGSTVLVDLDSLGMSSGQPGQDPGLPRAEAL

SEQ ID NO: 1005605 - protein, 46 aa, Homo sapiens
GDIAHNGHQEVHTICSIGAVGLRALPLLSGYISGPHLLAEFLLNLD

SEQ ID NO: 1005606 - protein, 124 aa, Homo sapiens
AIRIKVRSASGTRWALTGTGLYALLALVEGCTWRQQWRAAVVVACARRGGPLRVLEALDEAFFEAPRRRGLFPSFLGVLRMLKAIDWRRSACLVEAGAAFFWASVVLCLRPSCRSRGAMGRGKQ

SEQ ID NO: 1005607 - protein, 51 aa, Homo sapiens
MVNVEKLLEFIVKKLLREDGGKTAMGTEERKPAGGIEIFVVVVGRQVNVSP

SEQ ID NO: 1005608 - protein, 60 aa, Homo sapiens
MRWHNGTRSATSRMTFWSKLRGRQPLGSRRKKLKGGSFHVHHVGGGTFVQEEIRVSNHTI

SEQ ID NO: 1005609 - protein, 119 aa, Homo sapiens
HLEDPVREQVRMASMESPSECFPARTTTGSMTPGERVGVDSINEQAGEQDMRVLRGGFLDRHKLDGFCQSPGPGHHQDGQHSRFSLRQPRFSRCAGRRRPGPPGEPVSSPGVDKGEKAF

SEQ ID NO: 1005610 - protein, 33 aa, Homo sapiens
DKTQVRSSLKRKKTRKFPVFGRCHSKQVGPRGP

SEQ ID NO: 1005611 - protein, 45 aa, Homo sapiens
KGRPQLYVSTTLVFSEISAVIAACLVGPSGTSRSLSFHRDCAAVV

SEQ ID NO: 1005612 - protein, 41 aa, Homo sapiens
SIRLWIWVPDNLKKRKERQRYYNPGNPHNVYMPTSQPPHLP

SEQ ID NO: 1005613 - protein, 51 aa, Homo sapiens
MRQVGSLWLCLADHELLDCVAFGTYSPLRVSCGGGFWACPFTLTSRVTCVS

SEQ ID NO: 1005614 - protein, 126 aa, Homo sapiens
TLRIALVTQVRAPSISCKIPDSQGEEMPEGQETLTGGPGDRCASQAFLRTLWPGSTDWVNKPCEICKFCALVCLVSVKAKVVQEGARCGSLLERLGERGGPNGPPRRGWKTEGKARAPHGPRVRRG

SEQ ID NO: 1005615 - protein, 33 aa, Homo sapiens
QQSADLAGKQLEDGRTLSDYNILNDASTGARMF

SEQ ID NO: 1005616 - protein, 45 aa, Homo sapiens
MYTSALPYSYTLRKVGQPPAAQLWGVLAQDGRGSMLGLSQHLPAR

SEQ ID NO: 1005617 - protein, 67 aa, Homo sapiens
DLIYNVGSAADEIHPSVLSAVTGLKGGGGNGSPTSPPLWVPEEGAGGYTAHHLEVMERNPSPAWRPW

SEQ ID NO: 1005618 - protein, 63 aa, Homo sapiens
MHASHFISIIILVKQWKSGEVEMMKESGHISSFWILLIRACISHAEGYHGGHLPTNWGVRYLP

SEQ ID NO: 1005619 - protein, 73 aa, Homo sapiens
TELCRSTWVGVIISSGEETMSTRALAQWQQKEQAIETVTSPRTGDYHQAQSPSVHGHGVGKVVPISTPSNPYS

SEQ ID NO: 1005620 - protein, 136 aa, Homo sapiens
IPGSGYAVTAANVRELTVTVHLEKCRNGRQRPRKDAHLIMPQSTEMAPHSCHSPRGRPWAGHQDTQVSPADRTPALGSRHRFAQKHWNHDSQAAKVRGEDGKGNTQANTSLKSTKREESPAPTAQAPVTVTEGASP

SEQ ID NO: 1005621 - protein, 37 aa, Homo sapiens
EDAASAVSQQRHSIADLLLQDRVSIRTRLRSSSAPPA

SEQ ID NO: 1005622 - protein, 42 aa, Homo sapiens
MQNLSRTMRSNETEDIFKSIPAKKSQRPDGFTAEYFFKEMES

SEQ ID NO: 1005623 - protein, 141 aa, Homo sapiens
LVGLMTRTWTVPAHHQRGHRKVSVCHASVPPPASRLTQLAPPSRKPPTEGAGSPAKASQASKLRASKEEKEDWLSHALSRKKPKAWPEEQHAGTSEALHLAGTAGHPPFAANLSPAHKGLSTQLLEGVWNNCTKRPWSGLG

SEQ ID NO: 1005624 - protein, 44 aa, Homo sapiens
KEQVFVREKESIWTMDSIARTAGRKENGPLKETWLKANDGESGM

SEQ ID NO: 1005625 - protein, 35 aa, Homo sapiens
MAHLVGCAGKAKLRLVPSWPEQEGLPPRPTHALTR

SEQ ID NO: 1005626 - protein, 37 aa, Homo sapiens
CGGAEDENSLHLGGGSCNAAKITSLHSSLSDRARPSQ

SEQ ID NO: 1005627 - protein, 37 aa, Homo sapiens
LGVRVFTSAVLASLYKFRRHSEHLCDLQISVKLELVE

SEQ ID NO: 1005628 - protein, 122 aa, Homo sapiens
TENRAGKIDFPRHLDFHVKDLIKKLLVVDRTRRLGNMKNGANDVTASSVFRSVDWEAVPQRKLKPPIVPKIAGDGDTSNFETYPENDWDTAAPVPQKDFTNLQEFLRTGAHIWKERRVKEEL

SEQ ID NO: 1005629 - protein, 43 aa, Homo sapiens
DANSNEVAHRCYDHLKNSPGLEEMLPHGLLAYLLARVSSLAGG

SEQ ID NO: 1005630 - protein, 56 aa, Homo sapiens
FYKQNPDPGLIVAEAEARRNSGQHLEGRKGELQSWLSLPVQEAILCDLLERPGVPS

SEQ ID NO: 1005631 - protein, 36 aa, Homo sapiens
WQEDYGRWKDSPYGIGPRRWGDNVRVVYKSGGRRAP

SEQ ID NO: 1005632 - protein, 55 aa, Homo sapiens
EQKTGSAQPATEDGSGSSHGSGHGRGRSNHGVGLKRFWHRLLSSMEKGWRENKHQ

SEQ ID NO: 1005633 - protein, 63 aa, Homo sapiens
EDPRCKSSERCTEDRSQSKCCEDFGQQRKNGESNEGLIYPDYSWKGYISKDEECVGTVSWQGV

SEQ ID NO: 1005634 - protein, 55 aa, Homo sapiens
QAEAQKKKVEAEVQVKPLVLLHRWRPQVHTACNAKGCGDRRYRDHEGCERWRSHR

SEQ ID NO: 1005635 - protein, 33 aa, Homo sapiens
GSLWQYNEAEECLVDDKEADVDRRWVSEVIGDQ

SEQ ID NO: 1005636 - protein, 57 aa, Homo sapiens
KCSGAIMGLLEASASQAQVILPPQPPSSWGLQLACHHTRLMVSSPSTDGGLAMVAQG

SEQ ID NO: 1005637 - protein, 70 aa, Homo sapiens
EVDHADNPRQPSPRLRKILMHYTGIDIHSRLLMDRNTACINYVKYSPVLRKGYVGTIDSSLYKQTGEEDN

SEQ ID NO: 1005638 - protein, 35 aa, Homo sapiens
MISEMEFMAYALVLVRCTPVAIGEIRCNEASYDGK

SEQ ID NO: 1005639 - protein, 81 aa, Homo sapiens
YFFVSKLDNAVITIIGQADLEYLTSSDPAIYGSQNAGITGDEPPCLAHQLRVEYRSLEIGDRISDKSAMADLEIPSSSDPP

SEQ ID NO: 1005640 - protein, 72 aa, Homo sapiens
RGSSSSTAFLLALPSSVSLAAQYRTLFVAIAPSNNFLSSNIFLPLASRQPDPAVPGPYPHWVPQLAIQSIHG

SEQ ID NO: 1005641 - protein, 37 aa, Homo sapiens
KAQYNRGELGKDEAKVDVRIDSGLSSVPQQAIPTSSL

SEQ ID NO: 1005642 - protein, 62 aa, Homo sapiens
YCGSHAYLTLCISRGQAAVPAEQLASMIFSKTPSWVTLTVCGCYHKHVHLFLQGTLHEWSCV

SEQ ID NO: 1005643 - protein, 84 aa, Homo sapiens
MPPPGSVRCWLSTKQNEHLVEDYEKLASDLLEWIRRTIPLLEARVPKKTIQEMQQKLEDFRDYRRVQKRPQVQEKCQLEINFNT

SEQ ID NO: 1005644 - protein, 54 aa, Homo sapiens
MPSKPLLEHLPMTVGDLKGAPLGANGLSEGSVVLCGLALGGPDLIGADFPLTLK

SEQ ID NO: 1005645 - protein, 119 aa, Homo sapiens
MHIPKSDTQNRRGSTGFVGGSYIYDPGLAVLGLSWSKLELLQSTLLADQLLKLMSTCRIPSRIMELLVSWHRSLKSDTSSTEIEEAMKRVREAQSLMSAAIEPDKIRRKKKAFKIKITF

SEQ ID NO: 1005646 - protein, 43 aa, Homo sapiens
AVPGFMKGARLLLMLENIDRRKNEIVPIDSNLDAEFRTHTRNS

SEQ ID NO: 1005647 - protein, 40 aa, Homo sapiens
WIWRSEALEGKDLGPALAIGHSQTLYKNWGHRVEEKRVIR

SEQ ID NO: 1005648 - protein, 45 aa, Homo sapiens
MIIMELRNLYRLVYTILYLLLSYGDLTMKSHICSPSLESSRCDLW

SEQ ID NO: 1005649 - protein, 40 aa, Homo sapiens
GLIPFKQYAGTYVLFVTVASYLRPDGPVTLNCNALTGSSL

SEQ ID NO: 1005650 - protein, 42 aa, Homo sapiens
IPCERLAVGDDGRLDERTLEARVRKPAEAERYKLERLAEAEK

SEQ ID NO: 1005651 - protein, 57 aa, Homo sapiens
AGGRSMAGWPCHHGPVATAISGLVSICTCQASSISTAASNHSKHILPSTSSFNTIPS

SEQ ID NO: 1005652 - protein, 89 aa, Homo sapiens
STTDPLERWRLGTNDRTLEEPTRAYLRLQRDDHVQPTPRKTAAMLVAHLPKVAEILKSQFQPLVKNDCVTGQPAVVELDNHDKLLLASN

SEQ ID NO: 1005653 - protein, 40 aa, Homo sapiens
SCILVSPMPQVLTEAFREKDTAVQGNIRLSFEDFVTMISS

SEQ ID NO: 1005654 - protein, 44 aa, Homo sapiens
HVCQTTDYHRYFDGTLLFRAYSLLNTNSVVSLHTDSPGDSSYDV

SEQ ID NO: 1005655 - protein, 38 aa, Homo sapiens
MTDQVSTHINKRSGYDHRLSLVFSTRDSDRLSTVRIHH

SEQ ID NO: 1005656 - protein, 38 aa, Homo sapiens
QQLMGLSHKTVPYFRCQFQVLGAWAPTLLSNLATNQWG

SEQ ID NO: 1005657 - protein, 40 aa, Homo sapiens
LVITELIVLDQNICDVGFKERKQPVFFFTFFVLLSLLCSL

SEQ ID NO: 1005658 - protein, 37 aa, Homo sapiens
YGYRWKNNEDKQDMSQTLEPETKKQFLTHVLVASSGD

SEQ ID NO: 1005659 - protein, 57 aa, Homo sapiens
DGVGRGAAQVEGLAQVAWSSALMECPHPCMELCERFAMHCVHCSSHVDILVMFWCSM

SEQ ID NO: 1005660 - protein, 85 aa, Homo sapiens
MSVMGMPPIFFNIMRRYWTIFYFYLFIYFEMESRSFTQAKCSGTILAHCNLRLPGSSDSPASASRVAGLQVCTTMPNKILVFLVF

SEQ ID NO: 1005661 - protein, 143 aa, Homo sapiens
MIRIELVPPYSLMGGPSLLCAGFCRVETSSFPDGVAAWVEGLSLLRWGWLPGGGSPQFSDGAGGAETLLTSQMWSWPGLRCSSYPRWGWVAEVLPISQTLGSLGRDAPHFLDGMAGLGRDPPHFPGLGQAMARGAPHLVGLVA

SEQ ID NO: 1005662 - protein, 73 aa, Homo sapiens
ARTYLYPPTDQATRTKGRTQRYVQGINQIPRGTVNLQYKVKISNKFYNPVLISDTSFKDNLFSKAYSSFVRLA

SEQ ID NO: 1005663 - protein, 94 aa, Homo sapiens
MQQMLRNLLSPSRSICCVTDGWVPDSSYSVLASPHLLEVWTVESRMDDQRSKPSTSAHGHAMILIFMVLGCESRVISFCIQSGMPGYMVVPPDS

SEQ ID NO: 1005664 - protein, 31 aa, Homo sapiens
MPLKISSGCFGNRRRTLLRSVGFISTIIWAA

SEQ ID NO: 1005665 - protein, 36 aa, Homo sapiens
ESSSVPFTRGWHVLLPWLMRIFRAISADTGSHQAET

SEQ ID NO: 1005666 - protein, 89 aa, Homo sapiens
MAHAFVETGPERIPQETDPARVIDDVQLVFLQNGKKDLAAVRSKDFAQKAVGEECPQTELALLEQRQRQQHEQHHLQTADQLVNAAFYL

SEQ ID NO: 1005667 - protein, 56 aa, Homo sapiens
QCALCRKASATLGAAGRILAERGVDGITGNPEIMARRVEESIGLATALNPLIGYYA

SEQ ID NO: 1005668 - protein, 53 aa, Homo sapiens
GRADKYIYNRYGLDALSLCVWGEARISVSRSARSRGRSAVSFPSAITITRSAS

SEQ ID NO: 1005669 - protein, 41 aa, Homo sapiens
MRSRSDPARVICQIESKSGYFRVRVMRFPAKKPREKRCADE

SEQ ID NO: 1005670 - protein, 66 aa, Homo sapiens
RDRYESSRYRYKAHIWMISLCLESRPVVHAMEILCEDFLTFRRVEIVQISFGNLAGAALVDNLIND

SEQ ID NO: 1005671 - protein, 59 aa, Homo sapiens
TYTNRAVYPPIVRSTFYSIASAVKHHQLNPDPHASGYPSIAIVVVYPKTTIIPPCRASR

SEQ ID NO: 1005672 - protein, 79 aa, Homo sapiens
VHDRIELGTFRVWNDFSHLWQSPARAGVHDEQLRPKTLPSGPASPKRKLEAAEEPPGEELGSSGVGNSATRARLLSSSP

SEQ ID NO: 1005673 - protein, 50 aa, Homo sapiens
MIESSLLPKMSDIRAGKDRYTDPGRIATRWPRTRRRQWLADRVSLSPSPC

SEQ ID NO: 1005674 - protein, 115 aa, Homo sapiens
RQYRIELVPELLMVLSDHGCHLDYGWVYLSQPTDSNVESPVARPSTDTPRNNTWHPSIQSSHSVLTITVVDSLQSTVSVIPVPWEAKVGRWFKPWSLRTAWATCRDSISPKKYKN

SEQ ID NO: 1005675 - protein, 77 aa, Homo sapiens
RLGAINQLMGLNLISLDLSPTSDNSLLFHPLETLSSPGFSMHLNSPSIYRASLFQSPVLAPLHLPDIRTLECPNAQF

SEQ ID NO: 1005676 - protein, 82 aa, Homo sapiens
LYSRLLPGLGTRRTWQLARLSLGGVRRCVLVGDLSWLWFVRLWGYQRAGPPSWAALLTAEHTVCLAQIHKAGVQALVPRNRG

SEQ ID NO: 1005677 - protein, 84 aa, Homo sapiens
ELQVVTTVSIYSCLSYQKNTDFAQRAIMDYPQISKVLEDRDDPMTQYSVHKLSYLRRLALSFRKLLDYGQAKVIIVTQGTQEPG

SEQ ID NO: 1005678 - protein, 130 aa, Homo sapiens
SPALGIFKIKFFLIAAKRHMKKCSSSLAIREMQIKTTMRYHLTPVRMAIIKMSGNNRCWRGCGEIGTLLHCCWDCKLVQPLWKTVWQFLKVLKTEMPFDPAIPQLSVYPKEYKLFCYKDTYHTFTAALFT

SEQ ID NO: 1005679 - protein, 75 aa, Homo sapiens
FAGRISRLPPGQLGHSAIPACFSSHNLCPPHCAQASFHWGGVHSSRSSPVQQQHNIVMLQLRVPQLAHSVLHGPQ

SEQ ID NO: 1005680 - protein, 38 aa, Homo sapiens
QAESDHDDDDHLIKQTQRQTTHKRRRTPTPLTTPTGGP

SEQ ID NO: 1005681 - protein, 67 aa, Homo sapiens
LASVSHGGILILTSNHLSCQRNYKKQAIWSDIVLNGIVEDITISSWLDHVADTFRKLRCEPGGQIRG

SEQ ID NO: 1005682 - protein, 44 aa, Homo sapiens
PAQYPKHSEVLGGPHKGSSNLQIIPFNLKSSMDTTESSKRSSLP

SEQ ID NO: 1005683 - protein, 47 aa, Homo sapiens
ITLCTQCPDEGGTKNATEKPRKQAKEMDEEDRAFKQKQKEEQKKLEE

SEQ ID NO: 1005684 - protein, 42 aa, Homo sapiens
GTSVKVEEWVSLLKSEETPGAQCSPGCPRGPSDACFTTFSDT

SEQ ID NO: 1005685 - protein, 61 aa, Homo sapiens
GRTRGDGSTRQDEGNAREHQKPEDMSDNDRPQSLGTEFNPADTFIRGLSHLHELTAERIKY

SEQ ID NO: 1005686 - protein, 41 aa, Homo sapiens
LRGSPRKIRTSVCLMEEFNSDQNSSLLSEEQSRNNATLVST

SEQ ID NO: 1005687 - protein, 38 aa, Homo sapiens
GSREVVRRALSRPNVVCCGLFFESEPVSASISAILAKV

SEQ ID NO: 1005688 - protein, 72 aa, Homo sapiens
MCGNECDLYRWFTGVALGPFSELVGVSCRNAHLCLGVSCQEGEADILRFCLVLPWLKPHNHSSAPQWAQALV

SEQ ID NO: 1005689 - protein, 40 aa, Homo sapiens
MLVSILCLVDWGLQVWACSRVDQRDLEVRDRRSCIHGKIE

SEQ ID NO: 1005690 - protein, 92 aa, Homo sapiens
GSIKYISAVDNRKTQQFSTSPKNFNIANTGHCELTHRNTRKCTVLKLHNQNSNLGTAPNLPPQWWRLTQKLPCGPFFGRHQAREHRHPDTDR

SEQ ID NO: 1005691 - protein, 53 aa, Homo sapiens
ACGGTPRRGWHVPAWYALNPASAVRCPTHGKVVHPWAGVVGGRLAPVCDKCPK

SEQ ID NO: 1005692 - protein, 73 aa, Homo sapiens
GLHSDVVLREPVLLTYATTHHRDLQTRGHRYSLMHRHTHKDILHRRAHTVTYAWKTHTMHTDSDNIDMHTHTH

SEQ ID NO: 1005693 - protein, 56 aa, Homo sapiens
MTEAGITVTVPTTGQALQFLQPFDNGTGTALEWTCRLLIKGQRGVVPFDHISSCRP

SEQ ID NO: 1005694 - protein, 34 aa, Homo sapiens
LIRIDARSPELITGGRLESQLLGRLRQENGMNLG

SEQ ID NO: 1005695 - protein, 41 aa, Homo sapiens
GARYPELIMVKILSLLKIQKLAGLGRAQVLDGELLNRYLYL

SEQ ID NO: 1005696 - protein, 41 aa, Homo sapiens
MLEDLVVQNLDAFQAGVNERGDGYKLPLVLDLVGRYPCLDW

SEQ ID NO: 1005697 - protein, 50 aa, Homo sapiens
LIRSSSVPEKKRIIRNLKDEIETRRENKHFNSSYLNSDEQNRRCYLPCPS

SEQ ID NO: 1005698 - protein, 56 aa, Homo sapiens
LIQLRRSVPETGSRCSAGDHVCYWRRVTASTYFLPPGVTFDQRWGTPSTTSYPARH

SEQ ID NO: 1005699 - protein, 73 aa, Homo sapiens
SWYPTAPVRGHGLISWNGPAPCRGRVGAHGQRGGARLPLQDLAGAVLRRQGDRMLRGEHQVRQDRVEHQEKHH

SEQ ID NO: 1005700 - protein, 57 aa, Homo sapiens
MMGSKGSDQIAERLVRDRYQRDPSDACEHYSLEVPVVEGIPESYPADFHAGSDASGE

SEQ ID NO: 1005701 - protein, 80 aa, Homo sapiens
MGHPERCKLGLEDVECSQGKRVGWSDCKEKVSGGGARDVGKSSLGLVAGQQGPGRGVGAESLGEAREEVIRWPSRASFLV

SEQ ID NO: 1005702 - protein, 70 aa, Homo sapiens
LSALLRPARGGEMGFTVQHLLDRLQQLCQRAAFVDETVGAGGMRHARIDLGLLRGIDQDRLLRVAAADFF

SEQ ID NO: 1005703 - protein, 58 aa, Homo sapiens
LELGPEHQAKEIVATRFPSCQPHFVGNYIQSFRPKPRPAGLEDSAEVSAETGLGKLQR

SEQ ID NO: 1005704 - protein, 120 aa, Homo sapiens
DGTNTIGDLLELGSLGWRISLGCLGTAGRAGWGPDLEHRSGQCLIRKVALGPGTPLVVPDALGHLCGLQSFIPIAVGTTPLVDVVAQVQDEAVAIVEALPGHRYLGGTDHTPPFDLEESL

SEQ ID NO: 1005705 - protein, 75 aa, Homo sapiens
TLICDDTGLTRDVTMDASKSENSLKTLSTKGDLCLIKLRRQVNLQLLSNHQQQLQADRFKAKQMLVRPVLSQITL

SEQ ID NO: 1005706 - protein, 82 aa, Homo sapiens
RRYQQHGGGTPEFLKAGKEPVLQIWRVEKFDLVPVPNKLYGDFFTGEGKVNPEDSAAEERTICSMTSDYLAGPRGAAKDEKR

SEQ ID NO: 1005707 - protein, 83 aa, Homo sapiens
SQEYALYNICVKELMMLLEKMIRKKDWECVICYGLCYGDQFDFLACMHIYQLDCIDDWLMRSFTEPSCMEPVDAALLSSYETN

SEQ ID NO: 1005708 - protein, 35 aa, Homo sapiens
LLFGGFAGLTSTVICRWRVLGWKAGILTGCREPSE

SEQ ID NO: 1005709 - protein, 35 aa, Homo sapiens
PATLGDLWGIYAHVLLSNSLRLAQGTTSDSIPQIT

SEQ ID NO: 1005710 - protein, 109 aa, Homo sapiens
MAGIRTSSEDLPSVMRIINFLLLGLDFIEELLQGEVDGSPRAGATTPVAHPLDGVEDVRLAAVLVEPKLQPLFVGVLHGPDARVRVGNLKLFGEVGTNWRTVRKLPVPT

SEQ ID NO: 1005711 - protein, 52 aa, Homo sapiens
DGTNTDNLSTNQKALLELRGSTRLGELDDGLLREFKVGTVLLCIPLDSCYAV

SEQ ID NO: 1005712 - protein, 46 aa, Homo sapiens
AVCTLDELDNGNPPKLSHTHAFVWLLSSVDSLMGYEDLNSEIKTFS

SEQ ID NO: 1005713 - protein, 69 aa, Homo sapiens
RVIRGSPSRTNKNECLMVIGLDFHTVNYSSIFDLSSEIIFILAEITYFNIFFKLKSGGYQNFPVRLKMS

SEQ ID NO: 1005714 - protein, 33 aa, Homo sapiens
MDRNPEHSSISGKFGLDQFCGWDGSEAGIPKPR

SEQ ID NO: 1005715 - protein, 89 aa, Homo sapiens
MSCCLSVVKRGHTGTRCCALHFQRLRYSLYPEYEKGNGEILLTLTGKELCPPCWVKLVTMIIEAVYEENECLIDEVYYNLEVIGRNAGT

SEQ ID NO: 1005716 - protein, 106 aa, Homo sapiens
RIVELVIQALVHGTNRDYYSITINYREEMNWEQKMLLNLHKKSGMEGLTLQDYSEHGKHNESVVKEMWESAKNYNKAVEEEDKMTPEQLAIKNVGKQDPKRHWEEH

SEQ ID NO: 1005717 - protein, 80 aa, Homo sapiens
PELVNPHHSSDNSSSDHSSKENQASNDAHDGDGGRGRRLPSQGEGLGQTLMLHMAGVSLLLSRRHHHSRPLREGSIPGRP

SEQ ID NO: 1005718 - protein, 40 aa, Homo sapiens
SRGPGVITQYHLVHARIVMKQLVHLLPSDAQDAPRLVHPG

SEQ ID NO: 1005719 - protein, 51 aa, Homo sapiens
SQSGVRMLGHDEDKTRISIRGVPEGNGVPFLTEEELSAVLQQCWRADVSGM

SEQ ID NO: 1005720 - protein, 68 aa, Homo sapiens
RHPSGEEIVTALLARITSYRSTAVTPLEAFLSAQQQFRCKSGAGVLALVWLAGWQGHRHRHTGAISVL

SEQ ID NO: 1005721 - protein, 68 aa, Homo sapiens
ETDRTRKTLNTSWEITLDEIVSIARLMRLTDSFNQQNSLRTIKRSLLGDCPAQLGCNCLTGPPLPHDY

SEQ ID NO: 1005722 - protein, 50 aa, Homo sapiens
ATQIPQETASGGNWKVTKGIRKPVGSRRTRFNKSSGLGVVDKLGTWTGHK

SEQ ID NO: 1005723 - protein, 61 aa, Homo sapiens
TGNLVAPDTEAHGHMLEAPQNQPVQLDERTQASSWGQVRSHHPKVLHIQQDGRTGPPVAGF

SEQ ID NO: 1005724 - protein, 60 aa, Homo sapiens
MDLPWSSGVSIWVARPPSGPGTAGVRMAIAGLTIARASMAVSLEETMKNLQDDLLVYGEL

SEQ ID NO: 1005725 - protein, 57 aa, Homo sapiens
ESMFPSGGGGTNRRVGVMGADPLRRTWCRPGEMSECLVLLVSVSIWHLPSLLLSLVP

SEQ ID NO: 1005726 - protein, 34 aa, Homo sapiens
MTVRNTGAGTNSGFFNRRILLCLFRFHSVETFLG

SEQ ID NO: 1005727 - protein, 34 aa, Homo sapiens
VSQKQPTSSFPHHRTSASESKVVAPIPAITSAPQ

SEQ ID NO: 1005728 - protein, 35 aa, Homo sapiens
FLLCSYFSGFLLLCVFYKYVSSLLISLSSLPQCKA

SEQ ID NO: 1005729 - protein, 36 aa, Homo sapiens
MAFAICYAVNRRTSSHCSVSCEVQGTYSLEFYVVAY

SEQ ID NO: 1005730 - protein, 48 aa, Homo sapiens
GGSGSEACTLAGIPAGPGRSPVESTGPDSWVSVWTWVHIISQQLVDTC

SEQ ID NO: 1005731 - protein, 134 aa, Homo sapiens
TASDGWLDYASSFDRLIPLLPRRLQYTLVQWISEVSGHLVPLQPQVSHITSRLFVSEISEIVAVLKWNRFSILGHSFGGFVSGMFSCTFPEMVDKLILLDTPPFLLESDEMENLLTYKRRAIEHVLQVEASQEP

SEQ ID NO: 1005732 - protein, 74 aa, Homo sapiens
SLLRRLLPPLTHHNADSLRITIVLMAATHNAKSINETIIRRRIVDPTLRCIELDPYPERIDEAEPCFETASRRV

SEQ ID NO: 1005733 - protein, 39 aa, Homo sapiens
KTTHWPVVIYKQKPAEWITAGPSTVRGNNKLVWVILELE

SEQ ID NO: 1005734 - protein, 62 aa, Homo sapiens
RASFEMQEKLWSGGSFNTRGNSNDREAALLPVSPTNQREALRTNSCVIPLIEVIILALSLAY

SEQ ID NO: 1005735 - protein, 63 aa, Homo sapiens
QTRDGIDIWSVSAGAHVSRELVQGGMHRSGEYTSTRIHVYDIWRSARCSYIEGTCIGEVCMAV

SEQ ID NO: 1005736 - protein, 71 aa, Homo sapiens
MLHGSFLAAVGNLTRGSLPATEWVSSRFLSFWRPAAGELATGAAAWTRLAALHLGCRPTLRRHLAGHPRAR

SEQ ID NO: 1005737 - protein, 39 aa, Homo sapiens
RTFQYRDRYMNGTAQNGNAVNLHMEMPKLHAMWKTRREC

SEQ ID NO: 1005738 - protein, 50 aa, Homo sapiens
EVYGSCGPAELNSSCSADILKERMRSLDKRKSNRNFWNSGPIFPGRRARS

SEQ ID NO: 1005739 - protein, 57 aa, Homo sapiens
CRHDYLDWASLGATSKYGVCPLSESRFSVSFQHPVNDSLVCVVMDVQDSTHVTLYNS

SEQ ID NO: 1005740 - protein, 63 aa, Homo sapiens
GADRIELGTIRAMISRRNFPTTNHNLIGNLLSENLAKGKTPFLICLIRVAPDFMSMVTNGHRL

SEQ ID NO: 1005741 - protein, 43 aa, Homo sapiens
MITDVLIRWYTQRRGNNVVRPRCLDDRPGYGDGGIPLDVDPAR

SEQ ID NO: 1005742 - protein, 51 aa, Homo sapiens
IEEPKGTHPVRVRYVGITDISYPKIITDAQENAARRREQIQQEEAQREISK

SEQ ID NO: 1005743 - protein, 40 aa, Homo sapiens
MVDVPMSTWLLPENIADVLPSEARKIEELRRRLLDRFRSY

SEQ ID NO: 1005744 - protein, 105 aa, Homo sapiens
ENTPELAIAHEQAQDLAAPVHAFDQRRIAIGGGRVAQAELLSDDGRERRAMPGETGSRSSLAGPGSSRGEPDLFRSQRRIGQNPPIPFLGRPMAGASLFALLDDI

SEQ ID NO: 1005745 - protein, 76 aa, Homo sapiens
IYDGSSCAAVGHLIVVTASYRVGVFGFLNSASGEVSGYTSAGCWTSVAALDLGCSPTIRGICAGTLRALCPLASQH

SEQ ID NO: 1005746 - protein, 62 aa, Homo sapiens
SNRAGTGRTLQMSLLPQDAQTREGSWNAVLRISELQRLYHAKHDVVSPQDVLQYMVRDAENP

SEQ ID NO: 1005747 - protein, 67 aa, Homo sapiens
LRRLNGSAAGLVLVMTMAWAAKHLDPRVFLVALPTEADFQLVRDVVLCSLLIFLPEGVDTSLKISSS

SEQ ID NO: 1005748 - protein, 77 aa, Homo sapiens
MIELVPVSGDNREGAGFTAPTSALHGDDLIENRASFIEADGDATVEARRLNNLREGLVIERNAEKSDYKWHRYNYYW

SEQ ID NO: 1005749 - protein, 43 aa, Homo sapiens
VTRYFDQHPDILPCHVLTVQAKGIAWVVAELTLRNEQWNPLAA

SEQ ID NO: 1005750 - protein, 86 aa, Homo sapiens
PVLDYQGRLEMGMDSSSKLLSGITGVGRLYLKIRWEKWQGDQGPECVLELIQALESVSEDRAIKALVLTGAGKGFCAGGDISGMQR

SEQ ID NO: 1005751 - protein, 43 aa, Homo sapiens
MTGRLNGNVDRAESIPSLTIKINHLRLIGDVEDHRQNLHTITL

SEQ ID NO: 1005752 - protein, 67 aa, Homo sapiens
QSYRIELVPGLVHGSQFCSARDPQCCRVRVGELEQDWLPVNKSWCLNERHYGGLQGLDKAEHAAKHG

SEQ ID NO: 1005753 - protein, 49 aa, Homo sapiens
RADRIELVPRHFMTGRTTRVASYRNNNFFGLVDGSELRSAIPGKNQNDD

SEQ ID NO: 1005754 - protein, 51 aa, Homo sapiens
VPQGNGEFTPYAGTVVDLNDNFSAYASYTRIFIPRSERDSSNALLPPQTGK

SEQ ID NO: 1005755 - protein, 56 aa, Homo sapiens
MPKLYDFCSRISNKRGKARLGRVGTTLGVVSIFYLGSFSYQSSTLLPRMYTHQQDT

SEQ ID NO: 1005756 - protein, 49 aa, Homo sapiens
LRKKREGRMVLGVSTPALASTGVASVHQTRGVDAHPTRRPRPVFPKPAH

SEQ ID NO: 1005757 - protein, 43 aa, Homo sapiens
VSEQVKDIYMAAGRQNRAKQKGKHLIKPSDLLRLTYYHKNSMW

SEQ ID NO: 1005758 - protein, 33 aa, Homo sapiens
QRKNQEFLEGTHLWGKSWKPFTFLVLLELEKLP

SEQ ID NO: 1005759 - protein, 152 aa, Homo sapiens
CRHNYELSGPMSLQRRVQPRVNGSFFKKGPLHHHNLLVCHVTDFYPGSIQVRWFLNGQEETAGVVSTNLIRNGDWTFQILVMLEMTPQQGDVYTCQVEHTSLDSPVTVEWKAQSDSARSKTLTGAGFVLGLIICGVGIFMHRRSKKVQRGSA

SEQ ID NO: 1005760 - protein, 63 aa, Homo sapiens
MVELKLSSLCVELKADFVDEDYHFGERLDSHVASEDKKRISGSKLQKEDLTIQLPNDGVGCCD

SEQ ID NO: 1005761 - protein, 45 aa, Homo sapiens
EECAQPNTVDLSFFAAPATVGSWGTVVPTISSLIRLQRDAATWQV

SEQ ID NO: 1005762 - protein, 70 aa, Homo sapiens
DPPATEHLKKGDYCSWSRLFSNRSASRCNRHSWYIIIDIQDSYEDFRSVSKTWPIPGFNTQLIKTRVLIV

SEQ ID NO: 1005763 - protein, 74 aa, Homo sapiens
FFTFVAQDDVGGELTSWRERIARFNALVRRIKGLFQRRLFAKLRGDQRTQDLQEFIAARQLHFEQQAWRFVDSG

SEQ ID NO: 1005764 - protein, 50 aa, Homo sapiens
CSFGRLETHGNERDHTSYPGKDTKITQLPELRKFMCRKAKQEDRKSERRM

SEQ ID NO: 1005765 - protein, 54 aa, Homo sapiens
MLNVRASDYQSILNLRSARNSSRSTGCERKPGIRILRNINMCRMHLAAVGSWGH

SEQ ID NO: 1005766 - protein, 47 aa, Homo sapiens
PELIMVGYPPVDIGIDMLNGVTGLELKGAGLPVRVFTKICMLRAHDR

SEQ ID NO: 1005767 - protein, 58 aa, Homo sapiens
SACTKSKTETHELADRLSSSLNSNQTRIIPSKESEAIHSSPALVVRIACEASVQGAVI

SEQ ID NO: 1005768 - protein, 49 aa, Homo sapiens
MSSTLSRNWASDCAITFQVRPLRLPLVDIRRTEVGLQRAEQRIERHPLR

SEQ ID NO: 1005769 - protein, 154 aa, Homo sapiens
MMVMGCWRLWGLTESIRWCPSYPSKAVSTLVVLQTEAKPRLSRGWSPYRRPVDVQFCLGLSTQGTDPRNFPICFCGNKNAKKAPALELYHQRVKRGSQNAAPDAPQVLFFLSLFFETGFLLLLPRLEGNGVQSRLTAASSASRVQEILLSQALQ

SEQ ID NO: 1005770 - protein, 57 aa, Homo sapiens
HGSERIMVLSCIMVLSCIMVHSCNPSYQEAEAGGSLEPRRQRLQLAEIMPLHSSLGD

SEQ ID NO: 1005771 - protein, 50 aa, Homo sapiens
LCCDVTGQDLNCSFCCLDPSGRPGSTGTGPTRTRYWGYGATRRTLHYYTD

SEQ ID NO: 1005772 - protein, 76 aa, Homo sapiens
KIVPLHSSMGDEARLSHKKKKQSYLKFLWGNQISLDSDFLGYGLKLTITFWLMEWLIGFSGIARCWEFHEGTQDLP

SEQ ID NO: 1005773 - protein, 33 aa, Homo sapiens
LEPHAAIRIIIQELDDLKEVVGLPGRPVFPCSS

SEQ ID NO: 1005774 - protein, 117 aa, Homo sapiens
RYVGPTVRDTNTATMRSVEQSTHQQPEEEKEGVESGYYREMNEDNAAHTRPYAQSVANILQSMVESGRMHSVGKRSKIKDETPQPVARSRCQMACAPFRGGPPRNNKLSRRSIIPNG

SEQ ID NO: 1005775 - protein, 76 aa, Homo sapiens
RETVGPCIEENWVTRTTRFKASQHAQQQCKVIITDKQWDTHITPLCTHNAGTHTHPHAHTQNSTGTHTHTHSAHTN

SEQ ID NO: 1005776 - protein, 41 aa, Homo sapiens
GSSLVVGFRVPIAHVSVVDLTCRLEKPASYDDLGKVVMQVS

SEQ ID NO: 1005777 - protein, 73 aa, Homo sapiens
MCLLGVHSGLLLHPTSAWMPCRTVDHYCHQLHELSWCTYKRSVETQPVRGREPGCLQEAPFHSLIHASRHGGR

SEQ ID NO: 1005778 - protein, 78 aa, Homo sapiens
MRTLLHHGRGPTLGSFNFQGVPGWSSSSTENRSCVSVSYCGEPCLVNLVELWWWDGADAGELQRITSDSGLTAQAQAG

SEQ ID NO: 1005779 - protein, 57 aa, Homo sapiens
VTTNGCELRLRIRMMDANDEASVEGYPRLFSAALSSVEAPLSSRCSAILVSSSVRDG

SEQ ID NO: 1005780 - protein, 41 aa, Homo sapiens
VPAALSDVGRTHGCHLSSHVRLKSPSHCLGLALEHSELVTA

SEQ ID NO: 1005781 - protein, 99 aa, Homo sapiens
SLTLEIPVERERQLSDTPVLWEHRYCWVCLPQRNGVPNTRSRGTITAVSHWNWRTRLLGLSVTKQDLGPVPIVESSRGGLQHPAQPTELQISCSFSLST

SEQ ID NO: 1005782 - protein, 111 aa, Homo sapiens
SAADVVVTLEDPTAHSLPGCRSQLPRIFTSIGEDYDELLCCRPSQLRILMSVRGSLLMLGELITHEELVSRKVSDDLTERAATFGLILDYLSFTPLTFEKEFTEAVEANQV

SEQ ID NO: 1005783 - protein, 57 aa, Homo sapiens
GSPAGVFLYICRQMTSVSGCTVISACVAGILSMLVYVVCIQHASCGFSVSVHHERGC

SEQ ID NO: 1005784 - protein, 35 aa, Homo sapiens
ALSDVGRTHWSHLQDSQLRLKLHSHCSGPGPLEHS

SEQ ID NO: 1005785 - protein, 56 aa, Homo sapiens
GECRENGITLRTMRDLGKKKEAPVGQAEGQVVVCILGLPGEESVLEELVYDAGRAA

SEQ ID NO: 1005786 - protein, 39 aa, Homo sapiens
CTAGAHQQLSEPIRFVMDECVITGGIDADTRVQSWYVVQ

SEQ ID NO: 1005787 - protein, 82 aa, Homo sapiens
QSPVSGPTAHTSLLSRLPFYSYPDLSSTAYLPMLDMCCYPHLSASAITTGLNASAGALSSFMNPDQISSSLAHAPDIPFSLH

SEQ ID NO: 1005788 - protein, 84 aa, Homo sapiens
GVRENGSLSFLPTHPWSSTWTTTMLARAALRRYPDLKLLQVVYLHSNNITKVGVNDFCPMGFGVKRAYYNGISLFNNPVPYCEV

SEQ ID NO: 1005789 - protein, 43 aa, Homo sapiens
RSLLIVSDMCQWGGPASSANLKDLEVTRPCGRGPDDPCRPALQ

SEQ ID NO: 1005790 - protein, 40 aa, Homo sapiens
RGSGREWRVRLPHKRPRAAPCCLLRAPRIHLFNLHYIRGP

SEQ ID NO: 1005791 - protein, 121 aa, Homo sapiens
IHGSARAGLGSVYIYLSTLRGSYTQPPPCNPWRARWVGLGWTTSAHPSRWVDGMWHAQLLPSVASSGKPVRTHCAAAGQDRHQHRPQDLGDQARCAGPCTLHGHLLCASGAVICLHNQSAG

SEQ ID NO: 1005792 - protein, 104 aa, Homo sapiens
MDEECRGRYGLTDGKAEPWRTVVTMFSLQSVGQDDVLAMLVGCSRHSGCNDKLQLHLHTRGGRAKCRVQNSWPGHQGLVYDVASRAGPAGAQCGLTGYPTRRSG

SEQ ID NO: 1005793 - protein, 84 aa, Homo sapiens
YDLRLPGPSDSSASASQVAGTTGTRHHTQLIFVFLVDMESHHIGQAGLELLTSSDPLPGSPHSAGSTGVSPSCPAPAPHILRKL

SEQ ID NO: 1005794 - protein, 39 aa, Homo sapiens
ASPFPSTDNSCCQTRAKYTGVLTELKLPCEMDFSGKDVS

SEQ ID NO: 1005795 - protein, 44 aa, Homo sapiens
PESPFIRRHERRLQRYLPLQARSQANRFRCTALGGSCLLDCVNI

SEQ ID NO: 1005796 - protein, 96 aa, Homo sapiens
LSSWLLSPLLAQTNHRQSHWGHDRRSAVVRSAGGSRLVHEDIDGTPYFLFPLEVLWGAHQEVLPPIIVQVCQANGAAKIGAHLRALQHLPPPQVSD

SEQ ID NO: 1005797 - protein, 143 aa, Homo sapiens
MVAFWTHIGMQEGQPQGQQLEAGPDGRHMPVHAPLGPQLMFRDMERCSRLETDLHLVRAAVLGDLKTLHQEVDPDVVRGHFSRDKGLRRLAYEADREVCFLYLSRTQAKLLLHCHVPDPAISRMNYRYRRTVSSSECQGPETD

SEQ ID NO: 1005798 - protein, 64 aa, Homo sapiens
RAVLGCAHVPAGVPVPLPSAFAHHSDGCRASGPSGVTLSATVGGRARASSLFPKSFLELRIILD

SEQ ID NO: 1005799 - protein, 67 aa, Homo sapiens
TRTHTGTGLPPQLGSFSAISGQLQSYRAACAVLSVVEVTQGYLSTAGGDPNMQLPVYTQDILHMGDT

SEQ ID NO: 1005800 - protein, 109 aa, Homo sapiens
RLCHCIPSLGTRGSVSKRIMAKMPSKGTSYTLWGGMYILQPLENSMEIFQLKTTIRSSNPTSRYLPKGNYILKITCTVYRSTIHNKCVYRSTIRNSKVMETTLGGIRER

SEQ ID NO: 1005801 - protein, 105 aa, Homo sapiens
SSYRVRRRNRHRMQLQQGGSCRKLREVEGRGSWHCRLVGEEQEAGEDAVRALDAHHVVVDIDSQTSSSPPATSAAHRPSRPDVVLDVWTPEGDHFDAAAEQQHAQ

SEQ ID NO: 1005802 - protein, 58 aa, Homo sapiens
AVHCGAFHFIWCTLGSPSTPRFSTRHGAAYRFWASEGLQSPSVRAAEAPCRRTDVVHN

SEQ ID NO: 1005803 - protein, 99 aa, Homo sapiens
SAALPVGVRNDNNEPVFLEKALLVSGPARARPEVEKEVGVFKKEGKTGLNTVTKVERVTRRSQKDKKFCPKNGNLSTLAVIKLAMEVPWCPERYVISEQ

SEQ ID NO: 1005804 - protein, 31 aa, Homo sapiens
MRINVFLIGPRTLHRLVQTFSKIVLTILGTS

SEQ ID NO: 1005805 - protein, 110 aa, Homo sapiens
MADSGGSTRGVFMQPPAVGPEVGDHNCSMPNLGWQRPEEFWLASMWRAWEMQIGGLFFKGPVGVWPALPSVLLLGRPARLSHILELSESDDVLFSQPGMHLPHQQLFLPS

SEQ ID NO: 1005806 - protein, 62 aa, Homo sapiens
TRGVFMQKMCCLGCIWKEDYWVAGWALKGGVTPLPHTHTHTDTPLPPVNVHTHTHTDIPSAN

SEQ ID NO: 1005807 - protein, 131 aa, Homo sapiens
MGRRPSLAMKKSPLYFSLMTPCFRDIFARPDPPERGPHQSGSPWLLCPWVDLTRRASGTAPCGPEALPVYWLSKSGELMPVMAVHSALAVMQFLCQLPNLSLLGPVRHHQLMFQDLISHVLKLIVHQSGPL

SEQ ID NO: 1005808 - protein, 82 aa, Homo sapiens
LSSFIILQSCVNQLQHGVLFQFLPAGGHFSHVRGLIFYPIHYPTVQLWHQHIQASYPLAQQGQRSHTTIVARPSHVHIQQQQ

SEQ ID NO: 1005809 - protein, 48 aa, Homo sapiens
SSSVPAALSDDMSPPGDLSPAQVTVFPGLVRRRLHTHDDDGCRGLLYD

SEQ ID NO: 1005810 - protein, 45 aa, Homo sapiens
HYKRYDVVIAVWAEQKVWCHFTWVAVLRQFRVDLAVVKARAIAAH

SEQ ID NO: 1005811 - protein, 42 aa, Homo sapiens
LVRTLIGAQLPITIIFIAFCCQGLSGIQKCPVWEEVLEDGKG

SEQ ID NO: 1005812 - protein, 44 aa, Homo sapiens
SLLDGPGPHLTPLRGTWHGLQCRFPFTLRATLATTPCDAPVDGR

SEQ ID NO: 1005813 - protein, 97 aa, Homo sapiens
LADSEYPGSREKEQKVVLCGAGSDLMTASAALTWDWAHYPAWSHPAQKTGPPVPVTHCSYVPASSGVGYLRAVGEDTPAVAYALIALEWQIVAVLSY

SEQ ID NO: 1005814 - protein, 72 aa, Homo sapiens
WREKGMDCCNGDSCVGAFAVHAIPYVHMTKFYAAGLVSWGPHCGTYGLYTGYRNYVDWILKTMQDNCTPRED

SEQ ID NO: 1005815 - protein, 80 aa, Homo sapiens
LTLSIPGVREKALQDSAESTGRSDDVHVAFAPTGCSDSSSPLDELQPPLRELCTSLSHQVSSLQCPFPSSLSPLWIFLSP

SEQ ID NO: 1005816 - protein, 128 aa, Homo sapiens
MRETCCSALGHLAVPPPGLLHSKHTYLNVRVCRELTFYLLPEHLQVKGLQSVHSQALEAVIPTYQPCASDLRSLVGQKHSCRGPKDEGLLPSGAALEVTVESCWPPGPGQCPPISSVGLVAPLAANEP

SEQ ID NO: 1005817 - protein, 68 aa, Homo sapiens
MGGLPYSSEPASPRINMENKTTWFSVDIDSELVAELPAETELWLVLVAVGAGLLMVGLIILLLWKCGF

SEQ ID NO: 1005818 - protein, 50 aa, Homo sapiens
RSDGVVLVRESGEALIGIAGRIEEITTLMSEIRASTQEQAVGLAEVNTAV

SEQ ID NO: 1005819 - protein, 48 aa, Homo sapiens
RRLATFFATLESPALGAPLAVAIAIHNVPEGVAIALPVYMATGRKDYA

SEQ ID NO: 1005820 - protein, 69 aa, Homo sapiens
WHQERERAVDRYSALSATSEEEKLKGEVDGNGYDKPGIEVTLRETSLVLRQCLTARLESPEIHAILNPV

SEQ ID NO: 1005821 - protein, 109 aa, Homo sapiens
AEQRLFCFLTPTADFFPFLSYHRLLAVQPAPSHLIRLVVPLLHHLPLSIRSLGFLAGRRMVFRRMVFAYGFSFNMILKFFSGFFFGLCDGSSCVVLEGLFGSLGFSRFC

SEQ ID NO: 1005822 - protein, 88 aa, Homo sapiens
EAEAAVSYDCAPVLQPGPQGHTLSQKKKMAFQKPLGQVFKGWGPLGAYRENLKAGGNLRYENRFLGCPRPEWGPGLNFKTWAKVVPGG

SEQ ID NO: 1005823 - protein, 121 aa, Homo sapiens
LWSCLTHGQGRAQLPNPQFSLHQLPPDAPTVFFVLCLVFFCETQSCSVAQAGGQCLDLDSLQLMPPGFKRFSCLSLQAAGITNVNHHAWLILVFSVETGLCHVGQIGPEHLDSGDPTSGSQ

SEQ ID NO: 1005824 - protein, 158 aa, Homo sapiens
VNRGVCEAARSWQAAITVKAMSSPNLPRYLGSEDVHDKETPQDSLVAPVQPPSQTFPPPSLPSKSVAMQQKPTVNVRPMDGRDRAPSELPELKPVPEQYRQQTFEKTELKVPAIAKFTKVKMPSQSVEETYSNECPLCRRDSEGNDPFMIASFDSDSI

SEQ ID NO: 1005825 - protein, 141 aa, Homo sapiens
SISRALQRSISPGVSRRQWLGYDVREIASVFKPHVGTAHECTTSCDVIITPTWGLQLGRTYSTCHTSTDAPVAWFYGTNGGQSVRTLNDLRPPKSVYSSVQSHLVATRFDWYTGRDSLTLVCNVTDCVRDWTGTDGPTDAW

SEQ ID NO: 1005826 - protein, 74 aa, Homo sapiens
YTAAFSDDLRVDVAAIAGLGGPLLRPSAGNECFPPAAGLCESLLCSCAFFIKQLGSPRYVHIILGHCQACPKAN

SEQ ID NO: 1005827 - protein, 35 aa, Homo sapiens
ESSADLLTGRMVAVVGAPYTLLLLEEKQTLYSQTH

SEQ ID NO: 1005828 - protein, 38 aa, Homo sapiens
FNVKTINASLFIDSLRFRENHTTFVYGTFVARYIKREA

SEQ ID NO: 1005829 - protein, 58 aa, Homo sapiens
IRVKGAALQEVHLYTFSTVQPIPDEDSPWITASTDRIPATNMDSSHTSTRFRLTANSN

SEQ ID NO: 1005830 - protein, 66 aa, Homo sapiens
VAHSDFHRHWVKKNMPQSPALVNTGCFDLRRCITSVRSEDLLHKDCEFLILEKDNTPASKEMELLI

SEQ ID NO: 1005831 - protein, 76 aa, Homo sapiens
NQSVPPLAYGTQSCRTIRRQREAGSTQASSSAEQGKAGGHAWSQLYTEALAKSCWLILCSQVLSSRTLYRFLVFKE

SEQ ID NO: 1005832 - protein, 91 aa, Homo sapiens
KSATKENMDKSNEELRNLIKPIRNFLTQDSAALDSIEAVANEVLKMEMPSTPHARYTTPGQTDYYRDTELKRLSQVEVILHALVLADIARA

SEQ ID NO: 1005833 - protein, 38 aa, Homo sapiens
MTSVSRPQSLGTRCIIAILSILLAVLLTVTSCCVLIYT

SEQ ID NO: 1005834 - protein, 86 aa, Homo sapiens
GDGGTHCAIYEGYALPHAILRLDLAGRDMNNYLMKILTERGYCFTTTDEREIVVTFTEKLCNVALDFEQEMATDASSVLPGEELRA

SEQ ID NO: 1005835 - protein, 64 aa, Homo sapiens
PPNCIHDARLRGVSQSSTQRHLAKSAPSFLYLGTALRHAIQPLSGSLAICPCQWYHALVYLDAH

SEQ ID NO: 1005836 - protein, 98 aa, Homo sapiens
RVKKSVDSIIEASRDCDRVRVNGWVPYSSESASALINMENKTMWFSVDIDSDLLEDLPADNYAVARAGARGYRADGAGADLPPAVEVRASSSEPAVAP

SEQ ID NO: 1005837 - protein, 135 aa, Homo sapiens
MKILTERVNGFTIMAERAIVRNIKEKLWNVALEFEPEMFTVVTSSSLEKSYELPKGEVITIGNERFRSSKALFQAFLLGVESCGIQEITFKSIMECDGGTSARNLYANPVLSAGPTIDPGIAYRMQNGITAIAPA

SEQ ID NO: 1005838 - protein, 53 aa, Homo sapiens
EKYCSRDALEASAARLWHSRRHLFKSNTICISLVLSRFGRGTFELCCITGNSL

SEQ ID NO: 1005839 - protein, 42 aa, Homo sapiens
VGVVFLMSARVGVFFWWICGLMASGVKLQTFTVSFHLLRQRV

SEQ ID NO: 1005840 - protein, 93 aa, Homo sapiens
MSKDIIDKVKTQPQNGRKCWQTMYLIRGQNPEYIQEFKQIYKKKANNPIKKWAKDMNRHFTKEDIYAANRHMKKCSPSLAIREMQIKTTVRYH

SEQ ID NO: 1005841 - protein, 70 aa, Homo sapiens
WARADESRVSLTGARDDGLFSWGSQLVPYAIHVESSEFVYNQLYEGANVIGLQMVTMLREALQAGIAMVT

SEQ ID NO: 1005842 - protein, 45 aa, Homo sapiens
AVPPLPMDRDTEKVGQRALTNTSAHTSAGTGTTGAARHNTTQTEQ

SEQ ID NO: 1005843 - protein, 157 aa, Homo sapiens
MAVVMVYCTPPHPLRRHGAQSLCLVPQPREDGMFLYDLSILWRGRVSTPECIEAMVRGKCWQARYSERSQELMRRVKRFQMRHLHRVKTSSRGGREGMSAYPISILKLRRRISYGDPSSSQWPPGKGIVYMLGGGGGKAFVPCSQGCDRVFSGPRTR

SEQ ID NO: 1005844 - protein, 79 aa, Homo sapiens
MEVKRHNGYSVSDKEILVEAELGKLPNNCAAQTCKLFALIQTLKYLQNQEGAIYINTKLIWTEQGLINSKQKLKSQTYK

SEQ ID NO: 1005845 - protein, 34 aa, Homo sapiens
SNTHGRVLLFSLIFWKAEVPLCVAQAESTVAQVI

SEQ ID NO: 1005846 - protein, 62 aa, Homo sapiens
PAGANGSAVPEHHSTGVSVPTHNLNVITEGTSDKAKLSDSLAKELVCDLSQSIEIIRGQGHS

SEQ ID NO: 1005847 - protein, 97 aa, Homo sapiens
VYLQLSLTGDYETYAMGADLLLDWPSSVGLLIRLSRRFRCGGNKKRRQINEDEPVTAASAVPPTALGPAAKPSMALHLAPPPFFPGLKNLVPVTASA

SEQ ID NO: 1005848 - protein, 57 aa, Homo sapiens
AIPVRLSLLRHGNHDDLTLSTVRDTGHFCWPQHLSWCPRVVATAARNACTTSWNSFG

SEQ ID NO: 1005849 - protein, 66 aa, Homo sapiens
RLNLQPLSAVIIIWRFFYDGRAGPPRDTVGMWGHGEGTADSSPFSSGMTLLTALEAHVEAGMMFWR

SEQ ID NO: 1005850 - protein, 129 aa, Homo sapiens
YEVEVNTLLMTAETQAIDTKGSKESTATNLEFPSRARPGVLRGVVTFKGAKERIVEQISKGHRPAGGQPKGPPALSAMKGGQRRRIPPREKSEPEHCGEKPGQGCVARTIHSGSVSPVAEPKDLDPQKV

SEQ ID NO: 1005851 - protein, 34 aa, Homo sapiens
MSFYPSGGFVVSLTSGVKPQTLAVSVTAVKGGRS

SEQ ID NO: 1005852 - protein, 120 aa, Homo sapiens
AGLHLAFCLLASYRARGAGSLEEADFHSRRMISPSSSSPVTTGTSISHRSISAGRSSSSSESMSTENHVLLFSSVDGGDAGTEEEGSPAIYPDSVEVSVILMKVLCHTRAFTVTLVTDVG

SEQ ID NO: 1005853 - protein, 63 aa, Homo sapiens
TGVCILLVTGTHTVGGACPWQVQSRSECSRGQAPEQWLWSFQHELACLQVGSMSPANIREEAA

SEQ ID NO: 1005854 - protein, 36 aa, Homo sapiens
MVPVSKGRCTVQVLRRESHRNLQKCALGHDIQVLKG

SEQ ID NO: 1005855 - protein, 33 aa, Homo sapiens
RLTAALSDLQRISSTGREVRVVEEAHFHSRRMI

SEQ ID NO: 1005856 - protein, 124 aa, Homo sapiens
AALSDAWRFISLLPLSFIQGASGGSLKKPDFHSRRMISPSSSRPEATGSSTSHRSISAGSSSSSSESMSTENHVVLFSMLMVGMLVRRNRVAQPFTRTRSKVSVILDEGAVPHSCLHSHVGDKG

SEQ ID NO: 1005857 - protein, 74 aa, Homo sapiens
MHMSISAGSSSSSSESMSTENHVVLFSMLMVGMLVRRKKGSPAIYPDSAKVSVILDEGAVPHSCLHSHVGAKGG

SEQ ID NO: 1005858 - protein, 37 aa, Homo sapiens
LQLSLLLAVLMLHLQTAMFRLIFHSHCLVPCAFDHSE

SEQ ID NO: 1005859 - protein, 35 aa, Homo sapiens
SGAYLQLSLMWWYSEPVEQQPALLITYWQRFKSWS

SEQ ID NO: 1005860 - protein, 41 aa, Homo sapiens
ARYLQLSLMGCFVTGAEQTTGTCSPDIPSFYDHEELQILGI

SEQ ID NO: 1005861 - protein, 102 aa, Homo sapiens
VTCSSSLMPRCRCSDVLEFLPSGGFVVSLASGVKLQTFTVSITPLKAARLELLIPPMGFMVSVASGLRLQSFTKSVTAHKLSVYPKNEQQQVISKVKKTKVP

SEQ ID NO: 1005862 - protein, 45 aa, Homo sapiens
SRGRAFDQVSPSRFAAALRDASAALIFPPALQAFAAFVRHRLIHQ

SEQ ID NO: 1005863 - protein, 140 aa, Homo sapiens
SSWVPVDRAKRSRTISPAKRMIAMVMEKAGSQNQRPYLTHPFHRADYMHPNKYRALRGHREQCDNADQPWQRIARQHQLLLLAAWMVKLVRNNRRPCKNQQSCCHKGRNQRMNSRADMRDEKATSCCPDQSAKAPECMTG

SEQ ID NO: 1005864 - protein, 54 aa, Homo sapiens
SAVVAHDIQDVVYLTLATDWSDSERGVPVMRKWSRGVENERGDKANEVIVHVPW

SEQ ID NO: 1005865 - protein, 67 aa, Homo sapiens
MIELGSCGEPGSLRGMIELGRNEEAVSPMGLIELGHVGEPGILEDKRTETCGETGSLRDTRTGRVRA

SEQ ID NO: 1005866 - protein, 71 aa, Homo sapiens
PVMQLSLMPRVPICKGSVESTFIEDTETIDRVRVNGWHTLFLRISIPTINMENKTTCFSVDIDSELVEELP

SEQ ID NO: 1005867 - protein, 48 aa, Homo sapiens
TRTPTEPSVHQQATISREGKVRVSRELPGHTGYLSCCRFLDDNQIITS

SEQ ID NO: 1005868 - protein, 113 aa, Homo sapiens
ADSRGSTAAYDPETYFPEHSRRSKQQVQRGKRRGTSWQKQQDPWVAGAEVWRGSVAFVECSEHSSRKAAEPGQKSLNFSLTTALLRPLFHNFGAWKLSLGSSARSLFTCQPLP

SEQ ID NO: 1005869 - protein, 61 aa, Homo sapiens
MKSHCYPGNCIGSLQHDHRKRRFNLLAQGIFAVSASRVSCMLLISPTDNLGFVPITKVRTV

SEQ ID NO: 1005870 - protein, 48 aa, Homo sapiens
QVDFILRVRVSSGRISKRDVHMISSAYEKDIGSSMVAHTCNHCYSVIG

SEQ ID NO: 1005871 - protein, 185 aa, Homo sapiens
MHALSDAFLDVPVAASPVCWLHDCAMPDSINSVPGASLIIFSLSGSPSQEPDSQAGRPGPRSTNLQQVQGMGDTVEFVQITGAVRDKFHWDVPLGESAGDRTWRVCWGTSRSQRSRSCGYLVCKRSSRPGPSLQPDLMGHHVPAACSQRTSHPSDLWGLLAELGPAHLGVRGLLSSKSCSVAEIV

SEQ ID NO: 1005872 - protein, 37 aa, Homo sapiens
VACMCVVVMSCPQTSDSTLLQKIGAILDNSTLQSEFK

SEQ ID NO: 1005873 - protein, 76 aa, Homo sapiens
RYLQLSSDATLIPAQPFISTQMDIRDFQIVQAKRGGIMPVIPALWWAKAGGSPDLQEFETSLANMVKPRLYQKYKN

SEQ ID NO: 1005874 - protein, 138 aa, Homo sapiens
RIELVYLLALSDATVVTNVTVKAGVWTSTFIEYYRDFERVRVNGWGTLFLRTSIPTIKMENKSSGSHVDIDYGAAWRSCRPNIELWMVLVAVGAGLLLLGLIILLLWKCGFFKRARIRALYEAKRQKAEMQSQASERG

SEQ ID NO: 1005875 - protein, 31 aa, Homo sapiens
MPVFPDTWGAEATGSLETRRFEATVSKVCAT

SEQ ID NO: 1005876 - protein, 80 aa, Homo sapiens
SDLHALSDDPIMNRMVHVLIVDDDVVLGCHVVGYVVVHDEAQQVEQSQVDLLIHFLKAGFQHDMALAFIRLPHVRQFMDA

SEQ ID NO: 1005877 - protein, 35 aa, Homo sapiens
GKLRTILIENFPQANLRHQINTGGVLVSRDKETLH

SEQ ID NO: 1005878 - protein, 39 aa, Homo sapiens
SGGALIMVQQGVSLYTALGTVRTGAHRVDGHLYQGGMHR

SEQ ID NO: 1005879 - protein, 207 aa, Homo sapiens
EVYVGKDIQCEMFSSEGMYNWVFEIRAVPKKALREPLWTIPVTVLKSAGYRSCAVHEGETIIADEYEMPVPAGWISSSHSLLARHQSVSGSNIFLKFKPDHIRVQAHVDVHPGKLHFVFTMGGFLSTATTEVLRKGVCTGGLGLWVASVRQPNIHASHEDSGKALGPKISISPRTTNSFHLPDPSIPIIRVGPGHGIAPFNGFLQHR

SEQ ID NO: 1005880 - protein, 72 aa, Homo sapiens
DDMKIELGTEFRGKDLGAVHGTDLVYSWVGDPGTGSRVTGVLQLCAIPGSGEGEAQLTEQSSLPPELLFPSR

SEQ ID NO: 1005881 - protein, 50 aa, Homo sapiens
MVTLEVSPMQQPPEHHPCHRTLGLSFTHHTALSIHPARKDQVGPSMYLTA

SEQ ID NO: 1005882 - protein, 80 aa, Homo sapiens
LFQSNTRVCTAMCDMHLVNDRYMQCGQHLGSGDTGSGQHLGRKYRNVDMHLVKMRYSEVDMQSRKWRYSNVDSIYEDEIQ

SEQ ID NO: 1005883 - protein, 58 aa, Homo sapiens
VISPGRIIYRLKYHPTGDGTCYEVMVHATGDGYSYHVMYSYQVMYSYQVMYSYEVMYS

SEQ ID NO: 1005884 - protein, 33 aa, Homo sapiens
MATFPGRFLPVSQQPNRPRSCLTHGPLYMQLYL

SEQ ID NO: 1005885 - protein, 78 aa, Homo sapiens
VGRIRVSRIDHILPSPLTKISATPVDSPAIVLTGSTSILSAYQFAYGIRSSCVIMRSVQAYKCDAVHRCRPACYRAGV

SEQ ID NO: 1005886 - protein, 37 aa, Homo sapiens
MSIVSVFASSEMSSVQKGVNDGFLRITACNGLNCGHS

SEQ ID NO: 1005887 - protein, 71 aa, Homo sapiens
LVILQDYTNSAPLEGYEAPAKLFEFKAVVRSVLCEQFLWIKLVEVNGLSIGGDIYIPVWGSTSYCGVSQIM

SEQ ID NO: 1005888 - protein, 43 aa, Homo sapiens
CKTVIAIDVGSQDEMDLSTYGNSLSWVMDAVEAGCIPGLTRYT

SEQ ID NO: 1005889 - protein, 49 aa, Homo sapiens
SNEIARICTGGKHGEQYQVVENYFNQLLEHGNIMSDVQVEQVNLLDVLA

SEQ ID NO: 1005890 - protein, 69 aa, Homo sapiens
MRIPGRLMIQGRSCSAEYIPYEAGTTSSTSPIVCINVPGSPFKGPVHYVTDASKVNVLWARAVAQGLFV

SEQ ID NO: 1005891 - protein, 47 aa, Homo sapiens
YVVSGCLMMSHGCLMDVLMDVLMDVLMDVLMDVLMDVLMDVLMDAMR

SEQ ID NO: 1005892 - protein, 116 aa, Homo sapiens
KILPFGLVVTAELAVAWVKVLSPHSFFIMSSTFLSLSQGPKWPSPLAANLDTYISAKLIQGEGPPCEGQTQSPRYREPGSLMMLPMGRLSHSLQVEMLPYTFSMMLLEKLVDAPRA

SEQ ID NO: 1005893 - protein, 138 aa, Homo sapiens
TRTLVPAVAGLRVCAISVIPTTPCAGVQCTISCSSHRHPGCSAVPPSRIHPTVSRAGVQWRHLGSSHPVTLAGVQWPNLGSLRPQNSRLKPISHLRLPSSCNHRAHATIACSTLTSSAAAGSWNGAPGMISNRFGPCH

SEQ ID NO: 1005894 - protein, 74 aa, Homo sapiens
TAVAHVSIIFYSYGPTYLRLPATVPVLSRSMNFTLLVQCSPELKTAEIEPKADGRLEAGADVGLICSAGGHLEP

SEQ ID NO: 1005895 - protein, 93 aa, Homo sapiens
LSRILSGGDDDWDILSSKKWTSKVTPVLRCRIEGQVSGPSQEDHRLKEAACHISLAEGDLRIESLSQMLSMGFSDEGGWLTRLLQTKNYDIGA

SEQ ID NO: 1005896 - protein, 56 aa, Homo sapiens
SHSYLWDYVLCSNVDGAGSIILNELTQKQKTKYHMFSRYNVEAKHCSTHWIQQNGN

SEQ ID NO: 1005897 - protein, 74 aa, Homo sapiens
ADSMRIPFDCGLRGRMWLSTNSAADASTPVPGAARRPCSKGSCSTLACYHRATMCAQQAPRASQFYRSGGGAVC

SEQ ID NO: 1005898 - protein, 69 aa, Homo sapiens
MVVVVSSEAADDGAAVQQGRRLQWPGVQCCWAQMGGTELTTVLAISPRAATHCDLSCWGSHSLDFCTCR

SEQ ID NO: 1005899 - protein, 66 aa, Homo sapiens
MEHFRCWIRGRDLSLEDVPGAERDYGCDVEDYDAENDVQLSKTLELRVANLDPLELSEGKVLSVTS

SEQ ID NO: 1005900 - protein, 106 aa, Homo sapiens
SNSRGLPCFLEQVCRMQPAVFSGAGLPNAACRVFWSRSAECSLPCFLEQVCRMQPAVFSGAGLPNAACRVFWSRSAECSLPCFLEQVCRMQPAVFSGAGLPNAACR

SEQ ID NO: 1005901 - protein, 51 aa, Homo sapiens
MHDTPRARVPPDRSAALPHRRRVLNAWTTTTGANTRLTRQTCDDSPGDSST

SEQ ID NO: 1005902 - protein, 68 aa, Homo sapiens
LCQKTQIRQHRVFFIWEKNERVNRAPLWELQGALLQLLQGDTYSVGWTCGHEMRPTEVFCSRGIQNAL

SEQ ID NO: 1005903 - protein, 81 aa, Homo sapiens
ALLTESSEKLGLRICDRGSLTSRNFFLCGKQLNHHCGVTHCCCTKTDSNTEGSMTWLGPYSPDLPPVAAGDLTAFHRHNRG

SEQ ID NO: 1005904 - protein, 60 aa, Homo sapiens
RDLMIVLLSLANSRIFYTHIVVPVYSYDAAGLYQAVVLKQKRIMILKVVLHKTVKNSDTE

SEQ ID NO: 1005905 - protein, 55 aa, Homo sapiens
MVAQMEQQDAMAGVESYEAMCRTGGQSHYDSSVGVRRTIGLAACVRTVCKGPSEL

SEQ ID NO: 1005906 - protein, 75 aa, Homo sapiens
HEYSWTLGCQRWKRRACRWHIPLPSGSWHLILVDGGDAARGPKAGGPLQEQELPLALKLCVQLLTGVIVEVSDSW

SEQ ID NO: 1005907 - protein, 76 aa, Homo sapiens
NYTILRGQHGAHVSTELVQGGMHRSGEYTCDQAACLRSWVVNTVAHVLTELVSGGVHRRGDIPVELVACLACSGSC

SEQ ID NO: 1005908 - protein, 66 aa, Homo sapiens
NRYTVARGVNLRFNFTRWSRAANDIIWGTGASQFTWFNSALAGRSVQVIDERTYSSICESISAIML

SEQ ID NO: 1005909 - protein, 107 aa, Homo sapiens
RACEQRNLGDIIEILEYSSKKRLQQLKSELQEWEETKKCKMSYLEQQQQQQMNAKHGASTRQDVNFLSTYMDHAVSIKSVQISNLMRPLQRVQARLDGILMVHVRGP

SEQ ID NO: 1005910 - protein, 30 aa, Homo sapiens
MVVIADMQATHGAPFSRRWRKKGTPYCVSR

SEQ ID NO: 1005911 - protein, 112 aa, Homo sapiens
SSTESSGTYGCAVTGVDGPAPVTSGGRIERQQGRQVLDGFGHQREFEVGEEEAALADHDVLVVQVARARQHQCGDGPAQVAEDPSGLCGVDHVILGRAVRQELHVAIVHVLM

SEQ ID NO: 1005912 - protein, 56 aa, Homo sapiens
MKALCVANARVHPEILPVPGLTLRLYRGLLFFSISSGATRAHGQRRGLTEDLTWAS

SEQ ID NO: 1005913 - protein, 108 aa, Homo sapiens
SGSSWITSCRNEQCRELHSVPSVIMLVGDGYRGKTSPHTPNEKFEGATVLKALKSGYEGRVPLKSARLFYDISEKARRIVESYFMLNSTLYFSYNTHCLPNSPVWSAG

SEQ ID NO: 1005914 - protein, 55 aa, Homo sapiens
YRIQYDVADVHREDVASLRNYSRKIEEVDSPKSSMRTGIHEDPGSMMTPESMRTP

SEQ ID NO: 1005915 - protein, 70 aa, Homo sapiens
VIEDMEAAARIGHPHRMLTWTWSPQPDPQAAGPKLEPSFSEYASVQVPQAVNWDRGWHLAGYRSLEFRYT

SEQ ID NO: 1005916 - protein, 35 aa, Homo sapiens
WCVMQQSVRALRRQTGTNKPFFCDKGKGGNHYWGE

SEQ ID NO: 1005917 - protein, 122 aa, Homo sapiens
IARSRGSTRGEFMHASTHGECGKFQRLSYQVKPSQNQNKDVNTGTPWVIRPCFHSHGVGQVPKTSLDKLQMSGLQVPFPSRCSASVNPSREPAMRCSGKASTGAISYPGALFGLRHSGLAES

SEQ ID NO: 1005918 - protein, 67 aa, Homo sapiens
MPEAQRVGGAGAHQYIVGRIWSDTFSDTLYAKKAEQLRPAVGQSTEDKSSSKDMSSPTDRHPDGYCS

SEQ ID NO: 1005919 - protein, 47 aa, Homo sapiens
MVQQAMFVRIGFPISLYGILLTMGLVFLGNRFYVTSTDTRCVGLNLQ

SEQ ID NO: 1005920 - protein, 72 aa, Homo sapiens
MLSLSSIIFDSNGTYVCAGSLPTVAVLSRDQKFTLLVQGSPEVQTAVNIEPKADGSWREGDEVRLICSDRGL

SEQ ID NO: 1005921 - protein, 111 aa, Homo sapiens
MPSHELYRVPGDDVLLAWGPLVERSGSCMMMRGLTVECQIQPRDDPSGEVLDDAPCKRTQPTMPSDAQRPPKSMTVPVQPKSGSCTHLQKRTCPVHAWASRMEEDPGLCRL

SEQ ID NO: 1005922 - protein, 44 aa, Homo sapiens
YELELCTSLVLACQLPALAREIDSSQPVSIDSLKQSLDMQMQRQ

SEQ ID NO: 1005923 - protein, 58 aa, Homo sapiens
ERDKAEEWLRKTEEEMGFDHSRGCMRWDHPDCPVSVWLPHLPCSVIGSALSSPSNDLC

SEQ ID NO: 1005924 - protein, 40 aa, Homo sapiens
FCTHTSLSHTVANSSSYDSKELELPHSVLQGATGLPRRCW

SEQ ID NO: 1005925 - protein, 117 aa, Homo sapiens
RRQGVPLSLFAGVLSGKLANPIVSAQNFLKLRSNFRKVSGYKINVQKSQAFLYTNNRQTVSQIMSELPFTIASKRIKYLGIQLIRDVKDLFKENYKPLLNEIKEDTNKKKNIPCGYR

SEQ ID NO: 1005926 - protein, 128 aa, Homo sapiens
HRKGCFLGKKDRRKSLCPCLQMSRGYEIENPIISAQNLLKLKSNYSKVSGYKISVQKSQAFLYTNNRQTENQIMSELPFTIASKRIKFLGIQLTRDVKDLFKNYKPLLNEIREDTNGKIFLPMDRKNN

SEQ ID NO: 1005927 - protein, 67 aa, Homo sapiens
QIESSSVPLVLDCSIALLPGDYGYVDERAKVSDGWDEDREEVEFNYAFEGGGDDGGGDLVLLKLLKL

SEQ ID NO: 1005928 - protein, 57 aa, Homo sapiens
MGGSIFTATGHEMPSLTEGQGVQSEDTTAVGLERQRGGAKPLVKPRIHCRLQDSLVM

SEQ ID NO: 1005929 - protein, 78 aa, Homo sapiens
ESREREMELRVEALEEERRRCEQVERRVQSETARRQQLVEKEVKMREKQFSQARPLTRYLPIWKEDFDLKTHIESSGH

SEQ ID NO: 1005930 - protein, 71 aa, Homo sapiens
ITRNNADAISTEPNNLEARYSFRYNGVIHRNIVGFERGSLWQGCRGGHYAYIGSTDVCQLICGDQHQQDVS

SEQ ID NO: 1005931 - protein, 69 aa, Homo sapiens
WDTCTPVAFLITVSLRQVHAMCGHAQRQAARQQSVHFCCDLTVVSTEAHNLIDLGTWGSDLGSNLGQGL

SEQ ID NO: 1005932 - protein, 39 aa, Homo sapiens
DYITGALQIYTDIIYICITCAPSNQWNHLEECLNSQKFC

SEQ ID NO: 1005933 - protein, 184 aa, Homo sapiens
LNLEESPDVSCSIEHKRPPPKSPCSVERYSSEVESKDAVRHLVHVRMPLLVVRWKSLALFMREKKVGLVRCSEDALMPKASAMVSWTFCRTSRYNRKSSSEKMFCILSPKYLYRFTKCFPTDRAPECKSRMDAPPSDPPRESPFSATLRIRSASSLVMTTSVTPLPHFRGVQPSNLLVTVVVLR

SEQ ID NO: 1005934 - protein, 135 aa, Homo sapiens
LRVTGVGGSWCWEAIPQALLPGVYRSHGNKTSSSLSISSSMSKSLQALYTGGLESSGFICPMGLRIGVPETNDRGGTAMVAPLVSAAKFGIKAFSLFLKHDSAVGSMLPSGTRSLWKSPMVAGTGLVAEAWETDC

SEQ ID NO: 1005935 - protein, 48 aa, Homo sapiens
PFAVYSRDNFTTSCYARSSTSLGFLDARVSLHDTHIHSRHTTHERHCT

SEQ ID NO: 1005936 - protein, 55 aa, Homo sapiens
EAPAPLSSLSPSSVTWEANVPCGQSRYPAVICPVWLQSSSMTCLRSSTRSTFSFS

SEQ ID NO: 1005937 - protein, 159 aa, Homo sapiens
WTRATVGSVGGAIHSDLRMGTPMDPVKLDLERPKGAKQGGTYWAHFPMSLWVSPGPGGTTLPVPGRCTSEATPSPPQAHHGGFRFRMLKIQRWPRIGVRGMYPKWLLPCLGFCSKGTCLLVILDGGIFKHSPGMCVAVAEFSLKPPGGILLSHIDGYRA

SEQ ID NO: 1005938 - protein, 39 aa, Homo sapiens
RDSKRMKHETVGPGPRRRLLAKWDCPTKRPPVLRAVSTF

SEQ ID NO: 1005939 - protein, 49 aa, Homo sapiens
MYPFDVDSEDKMASMDFSGDEEQQGEWSILDSVEGVVDMYLSRGNCDPM

SEQ ID NO: 1005940 - protein, 40 aa, Homo sapiens
KCSCSRVRSAIPCEVDAVSKASAALRKEWGQSYSRAKLCS

SEQ ID NO: 1005941 - protein, 53 aa, Homo sapiens
MWAQRGCEDHCTVGRFVATGSRLGPEGSPGAQAYQRLLLHPPSPFCEEWMANP

SEQ ID NO: 1005942 - protein, 62 aa, Homo sapiens
MWLTYRRTEEFEDDRLLWRAMRLLLRRHLQSPYSVPDQPGDTMIWLPLADPRLGTTASHLLK

SEQ ID NO: 1005943 - protein, 32 aa, Homo sapiens
RLWTQREHVENGSFKAAQFIHQCVWRGRASDS

SEQ ID NO: 1005944 - protein, 38 aa, Homo sapiens
SNDNINDTCPSVCGVPLSTLRRMIHLNEHLQWSTRSSE

SEQ ID NO: 1005945 - protein, 53 aa, Homo sapiens
RCVIRVMYITNQNAVQHLWSCLAGPCTPYEVMLVLGHRATPMRSGWRRPYMIL

SEQ ID NO: 1005946 - protein, 141 aa, Homo sapiens
PRCTCDPFDCGTSDASADVQAAPSTDTYWQRFMSLVPIRLDLRLHAGHYAILLAEYWNNGPAHVAFSMMARAEGVCSPIFSTQRHLAKSAPSFLYWAQRSDRPSNPWVDSSPLVPARETTPLSTSDPNIEGVTRRLRTSVL

SEQ ID NO: 1005947 - protein, 71 aa, Homo sapiens
VGSSEDETRRGKEREVGRGKDDKTLKERGQWTLMTGKREGALDEYDGGRFCEPTAMRAWKTPPTHVLHLRP

SEQ ID NO: 1005948 - protein, 139 aa, Homo sapiens
MWGFVSGHGHCFMSHFIIRSNFVYDDGNQPLAMDTSCPPKKPAILLLVDEQSDDISLCKAGVRSCRSPAVCGKDESSLVCYLSSCSVPLQPKLIAVNWDLRKYLLNYLPFVNSGQAWLGHYSISIKGLVYALPEGAGGI

SEQ ID NO: 1005949 - protein, 30 aa, Homo sapiens
MPQGTLTKTEKDERTLDVTTQRGTDRLGTH

SEQ ID NO: 1005950 - protein, 70 aa, Homo sapiens
RSRYSMMYPFAVDSRGNALLPNVPSSWLGNKKDLRQDDAQQETAGKMKQEPVRSEEVRDMANRISAFGYP

SEQ ID NO: 1005951 - protein, 189 aa, Homo sapiens
GLVSPRSLWAVLKVGTPPPHCPVPGKGDPVLTAGPAYFLVETGTNLVKIKGCPSEPYFGSLSALVSQHSISPISLPCCLRIPSKDPLEETPEAPVPTNMSTAADLLRQGAACSVLYLTSVETESLTGPQAVARASSAALSCSPRPTPAVVHFKMSAQVITLTDNQRKLFFRRHYPVNSITFSRNEPQDR

SEQ ID NO: 1005952 - protein, 75 aa, Homo sapiens
CELLYDVSLRLWTQMLVTVTRLPDCMAPQLPRMTLEVGEVSFCLRNGRTELLEKVYGWGASLCPCPTDFKIAKDH

SEQ ID NO: 1005953 - protein, 45 aa, Homo sapiens
DSLHRQVISPAFGTPKAAGNNQDGSGTADPQNKLLSRDVPITTLQ

SEQ ID NO: 1005954 - protein, 85 aa, Homo sapiens
GGGAVDDPGHLCVTSGTVTLYSCSSGPGQAGRSSAWGLQVQLSLERYDRDHLVRMKWPSCATKWNRGHWILALVCPQGKHLQPYI

SEQ ID NO: 1005955 - protein, 40 aa, Homo sapiens
RIPFDVSQSTGSQRKPGSPRGVPCASPHPLLQEVWHHQML

SEQ ID NO: 1005956 - protein, 84 aa, Homo sapiens
GAETALAGSYQDGLRRRDSRRVHQQEETPGGRNLRQIAGEAARDPSLQACADGVRVSLPKSGALVDVEDRSPCVPVGCCLTGGS

SEQ ID NO: 1005957 - protein, 71 aa, Homo sapiens
GSGQTRLFSGCSSDHEVPSLQRSPATTPKLTPEKTAFTQQSEPEKGTEHGASGCEQNISTVNPVFLFPGRV

SEQ ID NO: 1005958 - protein, 148 aa, Homo sapiens
MPFVCARVILAHSSALRASYFLARGVDAGSSCLSGPDLGAYNSVQCVLLGVHQTGVTGLSHHDLDGSLVVLGHWLGFDDWLQFSFFESSDKLAEGVRVKLLWLHGELLPTLVQDGGIDILPTPAEPQVLHLPSIVLFVRNGKGVLREV

SEQ ID NO: 1005959 - protein, 102 aa, Homo sapiens
GSLRCGLEGAQLKPAFLYFYLLFFSWDERRTELSILPYLCFYSGTTVGGVCVCTLVWVFNRIGKKKKNSPPFSSISLPLSVLSTGPPSFFGPVCVLFGSEPT

SEQ ID NO: 1005960 - protein, 39 aa, Homo sapiens
YIYELELVPPLRACGLAGVTHHLFQHRHSASPPSSEKRW

SEQ ID NO: 1005961 - protein, 52 aa, Homo sapiens
YVKTNDKPYTSTIVTNSDLFIARSALIICIATHVELLGFRPHSFTPQSAIFE

SEQ ID NO: 1005962 - protein, 54 aa, Homo sapiens
VCNCQACKLRYWRGGITTLRAGRSCSRQAEARQNCLSLGGGRFTCSQDHTHCTP

SEQ ID NO: 1005963 - protein, 37 aa, Homo sapiens
CHDTIELGTKSGGTTIRNDAMIQVRYDGNLDQRGRKR

SEQ ID NO: 1005964 - protein, 99 aa, Homo sapiens
MRAVEMPMDPKLNKRRGFVYINLEQKKNPVKKVLAEKVPYCHVEAQCEINGGPVPKRSLSRSSSIGSWGPVETCNRREPEAAEGGGWSVEVRRHEFGIT

SEQ ID NO: 1005965 - protein, 40 aa, Homo sapiens
LFLALLQHRDVVAMVGDLIAQRRQGDHQRLLEPATEYAPA

SEQ ID NO: 1005966 - protein, 102 aa, Homo sapiens
TVYESSRYRHLYAVGLSLRAEPAGMLCPAVAGYLLIVCSMRSPLCPFFYSLGHKNTDTNSFSVCITKVYLVLLHHPETMRWFISTCLGERVGCPPLPLPCRP

SEQ ID NO: 1005967 - protein, 58 aa, Homo sapiens
MSTKYQLARSPKAHNNKKDHNRLLRSKMNEDLFASFRAPTILGLPAAVLIILFPPLWI

SEQ ID NO: 1005968 - protein, 197 aa, Homo sapiens
RLIDCCGPEALPRYPLPLLLLVSAALPWMILLRCYSQFPRGITTTAVRGICSEPHGQFLLFFVFIFRQTVFHVPVSSLCHSIILSVEMTKPAAGTDTGVFLLPGIRHTFGSLRARIIFTAMVDRWAPSLFAETHRCPVVAGSHKTQSGCAVYLHHTFIHRHLFIAELPGAVQSRAEFLEYIQYPNSDFLNVSHGRVN

SEQ ID NO: 1005969 - protein, 99 aa, Homo sapiens
LKVLCSGAVVLCPVVSCESSERFLVFLVLLVWNSRRSVDSARLVQHVPWVSFLSLLFLLFFLFSIVLIVIFIFLVSLLPVPPVYDPYAAFSVSFHCRLI

SEQ ID NO: 1005970 - protein, 151 aa, Homo sapiens
MLGLDRSKLLRYSGQVINQSLLQEKPKDVVHAIVLGLRCGTAVEAGGGGAGLHDSTDDTHHCLKPGMFLCTLSHSQCPSKGCFYFIHWATWGICATPCSSQACEEQAGQGRGVLVFCILGMWEQVVQNKSYHTAVLFDPVRLRTGVSVVCI

SEQ ID NO: 1005971 - protein, 40 aa, Homo sapiens
RYQSCPVKPRTWLDEDEEEDDEDEDDDDDEDDEDDDDEDD

SEQ ID NO: 1005972 - protein, 82 aa, Homo sapiens
GVDACVLLYDGSLRLWTQRVREAGSEPSSEEDRRRHMHHKWVMGRNAMTSTVNFENTFCHRGKRESPASPRAGVLLHEMLTG

SEQ ID NO: 1005973 - protein, 95 aa, Homo sapiens
LPMPCHRSLALYPSQCRVKDVKCVEGHFWHDNQIGGETNDRAGPDVSYRQGVCCAVRGLCCPAGFRCAAGGTKCLRREAPRWDAPLRDPALRQLL

SEQ ID NO: 1005974 - protein, 39 aa, Homo sapiens
RVRYSYGEVQLRVRYSYGGGTATGEVQLRVRYSCNVKAR

SEQ ID NO: 1005975 - protein, 73 aa, Homo sapiens
MVEKQSRIKPKDCHSFVSELCTLWEENFTHFFSTSGLPEYDKSQVAVSDMTGCVPSYTYKTHAVLNVSRNHAH

SEQ ID NO: 1005976 - protein, 43 aa, Homo sapiens
MLRVKNPGPDSGYRGRKRKGKKWRAEKWRTYRRRHWKKTKLGA

SEQ ID NO: 1005977 - protein, 50 aa, Homo sapiens
MAQAGEGLLALAKPLCQASLLNCRCFLGQFDPHGNPRMLDIHNLHNYPAG

SEQ ID NO: 1005978 - protein, 71 aa, Homo sapiens
FDCGDSECPRPDGDQAGPTRGCAPVPMRFVIPSDSVEKGGDEASGGYTGSPSRAWLPPRYIFSTTGRFALY

SEQ ID NO: 1005979 - protein, 39 aa, Homo sapiens
QSVPIAAMIACTARRRRFRTQLRDDIPAARADLVDKLKG

SEQ ID NO: 1005980 - protein, 74 aa, Homo sapiens
SVVRCTGGVYATSGLLSDTGMEGVEGVRGPGEVGVLVDLFTDNRGFVGLNSLALGFNVDNFTCSDNRALIFVFS

SEQ ID NO: 1005981 - protein, 42 aa, Homo sapiens
YGAWCRSLRRGTSGLTDSSIEPHAVQVECLGPQPTAWYMGAC

SEQ ID NO: 1005982 - protein, 59 aa, Homo sapiens
RSTVAIRTVIGVCGKATGSVTGAGDESVVAWAGGGGGGGDEGGESTVVDSAITAGNGAA

SEQ ID NO: 1005983 - protein, 52 aa, Homo sapiens
DTCEYCMLGSWRQTSARFASIPYTCASASFPTHSHSLGRGEVYRAQPSTILS

SEQ ID NO: 1005984 - protein, 85 aa, Homo sapiens
MVSTSLKRDFNDLRVLPAETHEKRDFVSAGAWPEVSAAYGAPVVGVLFSLEEGASFLKASSCPLEGSTFASHDHPTFTPEHFVLS

SEQ ID NO: 1005985 - protein, 76 aa, Homo sapiens
MYENKLEEQDLASTVHSRLMKGNKREEQGLGRELWRPEEPMVEEEALIEFQRSYGELFGGSSCKKNHQSRAAIRPG

SEQ ID NO: 1005986 - protein, 53 aa, Homo sapiens
MSIPSMWYSEYTMEGAAQIGAWKGPCEVTRVEGPIRPQQPLPLWDIESRLTER

SEQ ID NO: 1005987 - protein, 50 aa, Homo sapiens
MIYEIFMILMILMILMILMILMILMILMILMILMNPHDPHDTSGFLMILM

SEQ ID NO: 1005988 - protein, 82 aa, Homo sapiens
LVHGFLMDSSWILHGVLMDSSTSSLEFLTGFLTGFLTGFSHGFLSGFLSGFLPGFLPGFLHGFLHGFRPGFLHGFLTEFLHG

SEQ ID NO: 1005989 - protein, 56 aa, Homo sapiens
SDIDSWYWRISRVDRLHVNVILEGRMIAHVVERNLYSVGMHLAGEYTSNWLHVCVI

SEQ ID NO: 1005990 - protein, 41 aa, Homo sapiens
MRNVESKWSIVRDFEDRLKVLGRQRELQGVCECYEAQGIGW

SEQ ID NO: 1005991 - protein, 36 aa, Homo sapiens
HLTAVGPPYAGLVDWERRTTDHFVDGREETKLGWAL

SEQ ID NO: 1005992 - protein, 37 aa, Homo sapiens
MGRCLRHKEYVLHEQCQNEGILKSEIAVGAFHFSNGS

SEQ ID NO: 1005993 - protein, 156 aa, Homo sapiens
RSPIRFCRADVTGKNDQRRSAQYGIKQRCGTWVMALAHNSRPAGWTSRPRIFDKRAFCSSTPISRSNRVRASMSGRCDVDQTTRQGLALSALVAPDTEAVECLATRRVAAVRHQASADTRLGCPGTLKWKRLFKGLPLRSRQREPGRGIRQVVVEA

SEQ ID NO: 1005994 - protein, 53 aa, Homo sapiens
MPWENGADLIFSTLMAQGLIWQRAHVFQPSSFQLTAALKFGYIGMVLSYDINW

SEQ ID NO: 1005995 - protein, 148 aa, Homo sapiens
PVPTYAGTYAWLTTSYSRHVQCSSFHMSINRSVLHHRRLIHRFPLCRGTLEQTYAPIHFTIIYIAVNLTFFPNTFSGYTECAEVIRSNRCVYHMRHLIICGLIHFSNSSIINNFHDLRSLRVEARSPISRRNLHKPVVSIWMSPTGYG

SEQ ID NO: 1005996 - protein, 43 aa, Homo sapiens
ESVPPLHAWDQTLDLARDDAMTPGGLTSGSVRISPTKIYPLYK

SEQ ID NO: 1005997 - protein, 51 aa, Homo sapiens
GIEVDRNDWIYSESELRSRRTFKSLNKTNPLDERLHRLGMSMIQQSSVVKP

SEQ ID NO: 1005998 - protein, 109 aa, Homo sapiens
ILEKVRWSTTLRTGGDLLNSLLLSQMYLSPHSFFIMSSTFSALLGRPKLNLPLGGELVHIHLGKLLQGEVPTCVGQTQKPTCYLRTGSITAVCPLGPRSQPSAGRLGGI

SEQ ID NO: 1005999 - protein, 70 aa, Homo sapiens
MCREVGLHGHTLASRCVGWHTKAQRNDLRLAVGRRHCIMTADEQFLQVPQHPQRRHCDDNGGHRRARYAS

SEQ ID NO: 1006000 - protein, 74 aa, Homo sapiens
MTSTSKRQQLYVASAVGVTHLSLHRMTGVMGLPVLTAALPGTLTVPGHGRPCSRYTESSKRRTCLEERRAGKTP

SEQ ID NO: 1006001 - protein, 40 aa, Homo sapiens
VRALMDAFNFNNMGDAAVPAAPVALHPTSTPSCTSAALGQ

SEQ ID NO: 1006002 - protein, 33 aa, Homo sapiens
PGPHGWSTSLKRDFTIFEYFRRDTEKRDFVSAG

SEQ ID NO: 1006003 - protein, 69 aa, Homo sapiens
YSDWTPRLMDYLPWFVHINFNKGVAPLKDTVEGMCSSAMGSHGKRQRRFYKRRPHTWSEVFNETDTRRP

SEQ ID NO: 1006004 - protein, 71 aa, Homo sapiens
KLELGQCHAAAGSRSVANQWDPRWLGHHAQDLSPHLAPDLARACWAHTSLLVPSQAGTGTSLQWVTRPVPA

SEQ ID NO: 1006005 - protein, 76 aa, Homo sapiens
DKSSRYPVDKSNLIMHHRHFVSMVKMPPKTGLIFYFNRFIFVRVTGEALVNASVFLFRCVLSGSIYIRAGRTRRQA

SEQ ID NO: 1006006 - protein, 72 aa, Homo sapiens
SFVHGTRLSERCPNSVISVSVCYVPVIDIETPSSSPANYSRGVMHLVAMRAFFCLESCTTESRAYKKLNDDR

SEQ ID NO: 1006007 - protein, 67 aa, Homo sapiens
SALYPSMMIDRMYGMVRHCDQKPAWRTCQFIECAVVRSVGATEQGQELGPVPTPQNVGNEQLLQVPV

SEQ ID NO: 1006008 - protein, 86 aa, Homo sapiens
DKLGYWQDFVAWEERSHVWTLPAFITLSETCILRELKEYNAFLPRSRPQDWHDRSTAALDLFPVLIGAWTSSHQFCFDSTVILSSE

SEQ ID NO: 1006009 - protein, 116 aa, Homo sapiens
VTGEELKKIETDLDYSGLNSDHVGPLIVEQTEPFNTRAAPLGTVLTPTIDGRKPLLDVTTGLYDTTDCAVTPYGYTCFRLVNVTWTQLDSTSTFAFDLVTVLRVYLLGRVGFLLPR

SEQ ID NO: 1006010 - protein, 67 aa, Homo sapiens
MAGGRGISKNIGDVRETRKARTFGNFTAAGNFRKVGHVRNFGKAGNAGHFSCNGTFEPFQDVEWGRP

SEQ ID NO: 1006011 - protein, 42 aa, Homo sapiens
RIELVPHLMRGPRFLSLPTDPDLSLGSSLPTEFGVSLAFLVV

SEQ ID NO: 1006012 - protein, 147 aa, Homo sapiens
DRVVYPSCAVAPDHGQQRQDGHPVLHDAAGALWVTEEVTEGRLIPCPPRMAGTSCRKKSVSPTTLSNHHRPLCYHFTVPAWCKCVHTALCTARHCACGCLWVFTHMPTGMPDCVCVHGVSRPLSPLCVFLALSPTLCACPSVRAASD

SEQ ID NO: 1006013 - protein, 48 aa, Homo sapiens
GTYDSGSVGIAIVGKGRQVVQRESGGTLRSSWLGADGIPIMRWHHRTT

SEQ ID NO: 1006014 - protein, 33 aa, Homo sapiens
MVCVSCVTCVAMHSMWPLPSDHAHAWETGMTGS

SEQ ID NO: 1006015 - protein, 34 aa, Homo sapiens
RSRWQVHIQFLITILSSFPNYWLVPHTSVDVESE

SEQ ID NO: 1006016 - protein, 44 aa, Homo sapiens
ARYPPHTPDSFLRLACVGWDHKGLVAWLPAGVSEAATFLMLRGS

SEQ ID NO: 1006017 - protein, 34 aa, Homo sapiens
MHARVLEDALKSTRLQLNDIGRSARSSPCRRNLL

SEQ ID NO: 1006018 - protein, 42 aa, Homo sapiens
QRRRTGQHEHPNDLPPSMIDPLHGTMLDYSSMLDKKPFISTQ

SEQ ID NO: 1006019 - protein, 34 aa, Homo sapiens
LAFELRPLAALTELTIKQGLTHPGFSSSHGASTG

SEQ ID NO: 1006020 - protein, 67 aa, Homo sapiens
YDEMTLLSEYVSCSYVLHSLQQTLPMLSASLSTHTGKGFDVIESLLLLLLTAVLITMGLLHGKSIIE

SEQ ID NO: 1006021 - protein, 39 aa, Homo sapiens
PLSVISNSHIIFYAYTTHQTLSRFSSIAHITRDVNYGVN

SEQ ID NO: 1006022 - protein, 39 aa, Homo sapiens
CQYLMLGIFELLLVRWVNAKIKGCWPVGIWEKRESTLDW

SEQ ID NO: 1006023 - protein, 41 aa, Homo sapiens
VDQRTRLASRYSDASNTDVFRSVQHYVVWMCVVVWMWGTEL

SEQ ID NO: 1006024 - protein, 157 aa, Homo sapiens
MYAWVNHDTATSTSTSHTAEHETSSIIRCAWTGGNHVRRAALDASLSATPLNPAAATLALASPGPLSMLQCCASQFASRANALKHMAGIPEKSLKSLYFSFPFFFLARESRSVAQAGGQWHHLGSRQAPPPGFTPFSGLLLSSWARWLMPVIPALWE

SEQ ID NO: 1006025 - protein, 72 aa, Homo sapiens
MGAREASAYYTVGLYLLTHYMLTLKPFNKRVKIDLEIKLLNRTPPFFKLYFSRYGGGDRPHGVSITGHLGSG

SEQ ID NO: 1006026 - protein, 78 aa, Homo sapiens
MRCDLEDPIQALSSLSIIFFSQMSPCYLSCNITCVTASTSIRTCSPIFPMPTGPTSLSIPKPSQTQYAANSACCSCHS

SEQ ID NO: 1006027 - protein, 88 aa, Homo sapiens
YTINWVQGILLGGPTGHGGRKDTLPGQAEPRKPANTQAVQTPNKYGNKNYIPGCEDVDDMLGKRKQNLKVQAQKPVRTPYNSYLISKT

SEQ ID NO: 1006028 - protein, 34 aa, Homo sapiens
ERESRSVTQAKGQGHDLGSLETPPPGSKGFSGLS

SEQ ID NO: 1006029 - protein, 72 aa, Homo sapiens
DSRRTPRLADAHYHGHGLPTVGWGRTTGVTPFHSTLWFYDTPSLDFHGNDTLTRCTSWDTGTLLARVPDARH

SEQ ID NO: 1006030 - protein, 88 aa, Homo sapiens
SPFVSRVALGSLDRHETEPPPLLRVCPRAHCMVGSDLWFGHQPSLRAAFGLSPAQASGVQKPGQRLGHSLFLSSQTRSSYKSPGRKPR

SEQ ID NO: 1006031 - protein, 62 aa, Homo sapiens
SRSRYWNPYFSWASREVSVETTQLGRPSTKAAIDNTQTRGLGSSEDLFNQAPSWNFTPQDTV

SEQ ID NO: 1006032 - protein, 33 aa, Homo sapiens
GRTSRGENPKGSLRQPKEVRVLDLGSEVYVWQG

SEQ ID NO: 1006033 - protein, 55 aa, Homo sapiens
QKRGFLELNLRPPPKRRCRGRISPDKGQQPLEDISLGLRVLRAAEPRTELEGYRA

SEQ ID NO: 1006034 - protein, 55 aa, Homo sapiens
GLLVETDYTFPLAEKVKAFLADPSALVAAAPVAAATTAAPVAAAAPAKVEAKEES

SEQ ID NO: 1006035 - protein, 102 aa, Homo sapiens
RQPGHITRLVCIRNLRISLACWSPPVVPATWETEVGGFLSLGGRGCSELHLHHCTPAWVTEQTLSQKKKKERKKRKFWNGLLISGIGQSGDARVSASEVGVG

SEQ ID NO: 1006036 - protein, 78 aa, Homo sapiens
RTDEAYGNRHSRYGSGFQAHKASPKLPSRVLQNSLSTIIIFHIAWLLVKELTLQPKKCSKGPRLREFTALTRFPTTLK

SEQ ID NO: 1006037 - protein, 160 aa, Homo sapiens
MMVVTGDEDEDSPCAHEALWDEDTLFGQGLEVFYPEWGNMGCKVVPDGNNYRQKITSGMEPIVKFPGAGDGATYIRVMVDPDAPSRAGPRQRFGRHGVVTDIKGADLKKGKIQGQELSAYQPSPAGHSGFHRYQFFVYLQGRTSHLSPSQENKSRFWKWQ

SEQ ID NO: 1006038 - protein, 37 aa, Homo sapiens
MTPASAPTRHRSLVSPKAGGWQPRMVSQQAEEGLTLP

SEQ ID NO: 1006039 - protein, 65 aa, Homo sapiens
TDEIWLSVETDYTFPLAEKVKAFLADPSALVLLPLVAAATTAALAAAAAPAKVEAKEESEESSVR

SEQ ID NO: 1006040 - protein, 114 aa, Homo sapiens
RDGRVLTGNTNQVMSVVTKVVFFRAVEPQKPSQVQGPTSNGRPRDPVFQNPPPTLLIHIKKILVHQNRPTPQILPHRGPSSHRGPTQMRGGLEEKNQPPNIWRKGGSIREGNWR

SEQ ID NO: 1006041 - protein, 37 aa, Homo sapiens
MNSKSATPSWNYTLWRVGDYVLPSLGRENDEWQNIYC

SEQ ID NO: 1006042 - protein, 57 aa, Homo sapiens
RREHVLDAFDASFKDDLEGVPVVIPFQRKKPYECSECGRIFKHKTDHIRHQRVHTGE

SEQ ID NO: 1006043 - protein, 100 aa, Homo sapiens
MGFHQVGQADLKLLTSSEPPALALSAYFHHHYGGLNVGPLQNSCGNLILKVTVFFGLVWFLETESCCVTQAGVRWHDHGSLQSQPPQARVILLSHPPEYL

SEQ ID NO: 1006044 - protein, 57 aa, Homo sapiens
RSQAMVVLHEEEKLQRLSLTGGRCEDENGCPTLQESSPGVAAAHSSLLQAQPCKMGH

SEQ ID NO: 1006045 - protein, 33 aa, Homo sapiens
MASRMSGAWRGDRITSEFAALQVTYGKLQRVDA

SEQ ID NO: 1006046 - protein, 91 aa, Homo sapiens
DWLSLLFLPVICNAALAARSLLGAESEGHEMVYERDHILHQAVAPTLMRSCVRRPRTAHILFLATSFPQAGPSCDNGTTLRMQCLAATPPR

SEQ ID NO: 1006047 - protein, 45 aa, Homo sapiens
MTHLWVVGAKLVNGTELDQLLVDAERTVPALSRHKSTSPVYERNR

SEQ ID NO: 1006048 - protein, 52 aa, Homo sapiens
IELRYRIRQLLQWHDSLSHKNGYLNLAGLSLVSLNPLPHLNDGLCSKIDCSD

SEQ ID NO: 1006049 - protein, 76 aa, Homo sapiens
NSTVVHNVPGILRWCCVYRALGGDGEDGPNRRRLGSLAPVLVPLAFAFSSSCPLAVAPGRTTGGAASDGLGQVDAP

SEQ ID NO: 1006050 - protein, 113 aa, Homo sapiens
MGQPGSKDLGSPMEGSQRPVSLAVGLTMVLISHREKKSHPDVGLLKCVLLKAKWRTEECHPLQPVMYPPQESKPQSQAYTWKSTAFALLQGSTDISSLHVIRWVFLLNASELY

SEQ ID NO: 1006051 - protein, 37 aa, Homo sapiens
MEGKWAHGVSESSSEQSLTKVQYVGALGKVSPWLDMS

SEQ ID NO: 1006052 - protein, 165 aa, Homo sapiens
DCCVLGTGPPSGSPLSTTLSPSLEADPKDGEGCPMCRLLPSRGKEDSQTSRDEGRAVYRQGWARRPGLLRRDNGGCGGHCAVPSSVSRGLDSPLDGIGPLTGASQLVALISLLLGEAVASGSETDTIGHIVLDESYPSKCILDKSSHLATSTILILSMGRQWTVA

SEQ ID NO: 1006053 - protein, 100 aa, Homo sapiens
SRPQTGGDPMVWRDHQALRGAMEETCGSVLMELMQESERVDLNDSVLINWNIAASTCLGERQDTIGEVGKPRARRRELHVGSGGAPASDVCPRCRRDTSH

SEQ ID NO: 1006054 - protein, 53 aa, Homo sapiens
IGPKELFLTYSCAHYEVDLDRHASVRPPGVSTRTCNRGILEYDVIGSNYGSTC

SEQ ID NO: 1006055 - protein, 38 aa, Homo sapiens
HCPHDWLPVNAAGAPAALCSSERLCGPVALHLYWLKLP

SEQ ID NO: 1006056 - protein, 33 aa, Homo sapiens
MLEKRVTTVMIVVMAEDAMIEAATGAAAATKWE

SEQ ID NO: 1006057 - protein, 38 aa, Homo sapiens
GSHWLLVSASQDGKLIIWDSYTTNKPQDPRGQRQGQSG

SEQ ID NO: 1006058 - protein, 34 aa, Homo sapiens
FRVCKFNSGLRFGHEKRDIVHHSSTNDNLTHKST

SEQ ID NO: 1006059 - protein, 45 aa, Homo sapiens
HSRGSTTSRQASGRTRKKTMRKELTDRNRGRNKCRYCARGWRGPR

SEQ ID NO: 1006060 - protein, 89 aa, Homo sapiens
MRCCGGKLQSIQRGLLGCLKYLYTGELDENERELMHIGHIAELLEVFDLRMMVANISQQLAFMNQEITKAFHVRRNNRVKGVLGQKGTF

SEQ ID NO: 1006061 - protein, 60 aa, Homo sapiens
MFRRRDYYSKTTKTLEHYNYYSAHELGVLSTALRLLIRAELGQPGKPIYGKRTTFTTVIR

SEQ ID NO: 1006062 - protein, 81 aa, Homo sapiens
ITSQCDSCRHVSGPGNTSYEHWWLGFIAFDYSVKSTDRKMVGDVTGAPGLLPPTAKVGEQSGALHIGASSIEHFCSVNHSP

SEQ ID NO: 1006063 - protein, 33 aa, Homo sapiens
MAYDGEEKSGEVIASGLEKWDERESAKQLLIRK

SEQ ID NO: 1006064 - protein, 114 aa, Homo sapiens
AYLKRQGEDVHTDVTEVFVNACGRADAAGGIQAVATDSWARLTNNYREKKKYTEPRGLCKSQEFSGISTSIPRVNTKAAQGSLGSPLFTSQKLILRPGPPFKPLAGQRRISLQF

SEQ ID NO: 1006065 - protein, 39 aa, Homo sapiens
KPDLLMFAALAVQDEVIPFQHAGFNGLDFWGIHMCSIST

SEQ ID NO: 1006066 - protein, 107 aa, Homo sapiens
MPCNCTSIQVTRGVHRVLGTGTWAPDTDDGYDGDDRPLDTTRDRLTGTSRWGPHLTDYWYTKPGTLYVGTTWANVQTRRRFDASDYPRTEDTGLNYTDRNPRNGGGL

SEQ ID NO: 1006067 - protein, 116 aa, Homo sapiens
VRFVRRLATVAPFFNDLHGGTDGTTTANRPHDPGSSTRGHADQKKGRTCKQTTLRRTGHMCPKAHAHHRRTEQAQRGRTEHSEKGSSAQQQRAAAAAQREHVRERQKSAHRHALRA

SEQ ID NO: 1006068 - protein, 104 aa, Homo sapiens
MTPTQLLRKLITPLCIVKYSTAGVIHMILSRISQPTTLLTILGQRILQRGGLSCATVRRLAASLASTHWYRQQLPDTIVTIQTMSRDRHMSPGELHCPLLNEPL

SEQ ID NO: 1006069 - protein, 101 aa, Homo sapiens
VDSRRIPSRTCYPCTGMGMGERSLCYIKISHLRVPDYLGLHDTSASNANSDSLLLTTSYHYRPIWHQPQTLLLPTYPHSTPTSGSRQLQTVLLRTSPCCIH

SEQ ID NO: 1006070 - protein, 55 aa, Homo sapiens
DNGYGHCLLDKPEAPLHLPGDFPWHRTMMLTCQCQRDLRVPDLTAICPHAVRRPV

SEQ ID NO: 1006071 - protein, 115 aa, Homo sapiens
PLVEGCRSCAPRADSWYAGTWCWVQELAAAVDVVEDFLLELRHLLAQQARRGRQLRVLTLEGLHFLFQAEMRSSLRLRHLEAAMRLRSRLRSALMRSCVSMSMGDNGGLSPKLGT

SEQ ID NO: 1006072 - protein, 73 aa, Homo sapiens
SQTGLVPTPSSGASQRLSADRCQAGLVGSLWDIGVSPSPGSRVVTGPVTGDAVQVGAVRDECAVPYTLLDSDV

SEQ ID NO: 1006073 - protein, 39 aa, Homo sapiens
TNNTVNDLCTTFTYHSQIQILVCKPTRNTDGYYQPAFLM

SEQ ID NO: 1006074 - protein, 41 aa, Homo sapiens
IQTLGDADTCWRWLSASSAADGSRCAKERHRRSLACPVAVW

SEQ ID NO: 1006075 - protein, 47 aa, Homo sapiens
SQTRPSLHASPLGCSPDGQLLTPQSSSIVAGVTQLLCPFSQAPPLDC

SEQ ID NO: 1006076 - protein, 84 aa, Homo sapiens
PATCIHFGSLHSLIVTTETHRDTAGIRQVMGERAQRLVPGELTSILTGYVVRLILRHEKNLERSPLLTWTEDGTTTLVPTDGWR

SEQ ID NO: 1006077 - protein, 45 aa, Homo sapiens
MVVAVPMMLSTNEGAHSLFDHRTVWLEYTDKIFRERPRAVTVKRS

SEQ ID NO: 1006078 - protein, 32 aa, Homo sapiens
MTAPAHVSTELGPAASLAVGIMTVPIAGPETQ

SEQ ID NO: 1006079 - protein, 31 aa, Homo sapiens
LTDWPVKLRLQRAMIAPTCTPDLGKTEQDSV

SEQ ID NO: 1006080 - protein, 50 aa, Homo sapiens
DSRDPHKRRRALLSGPGYFTVTAWLAQWASLQVDGGELLKVQLASHARGE

SEQ ID NO: 1006081 - protein, 125 aa, Homo sapiens
LKRQGQGGGSGTPEEYPLSFSDMLQGRTVCGSVKSCRGHRTHISLHGKPTPWLPQGSWGMSHCPWTPLAGTASPWHQSLGQLRKQAEMWTCKPRAFLVGLEGGPSSSGRKLLAPLTCQGFPKKEP

SEQ ID NO: 1006082 - protein, 83 aa, Homo sapiens
MLKAAGKRATIPFPDFCRGWPCCLSPLCHCLVLWALYQFDEKYGGQPRGSRDVSCSRQLCLLTCVPGNRRTGCWPILEGPINL

SEQ ID NO: 1006083 - protein, 98 aa, Homo sapiens
GDQRIRVIPLWGLSSSLTHNILIVLVIIGFFFFQLRALLPPLVILITGSSLPSAESVSVRPTDIRVILLRISRIHIVTFFSQLGKHNKTLTPRKLVKF

SEQ ID NO: 1006084 - protein, 62 aa, Homo sapiens
LVSSPFVGEGTNVAANNFYLGSDGRTVCQLHGSQLYARTTSASPSGSVTPTDDLRGPTHDEP

SEQ ID NO: 1006085 - protein, 110 aa, Homo sapiens
LCRSYVDPCIWYVNRAAVNIFVHVSLWSVMINIMHNPKLYLLNNNLPSPSAHKLCLLGSSNYSCLRLLISWNYRRRPPCLANFCIFIQRLGFTMLAGVVLNSVPQVIHPS

SEQ ID NO: 1006086 - protein, 80 aa, Homo sapiens
MILMSSPFVWHPDALCDGVCQFQLTDLHGHPPSTPSYQLGMYSGVDPFPAHMLLCGLQLNMGDLSTHKHIWSQVSPFHNA

SEQ ID NO: 1006087 - protein, 51 aa, Homo sapiens
ASQVTRGSPYRLAVQVTMSWPSVQASVPVAAAGKRTHSARPGRTPVDKPRI

SEQ ID NO: 1006088 - protein, 36 aa, Homo sapiens
DVIPLGEEGDVKETRRTYVRFNLLMATGTKKNQQVL

SEQ ID NO: 1006089 - protein, 39 aa, Homo sapiens
SLRMRHLAAAILLPFPSDSPILFFLLEITVTTLAPPDQC

SEQ ID NO: 1006090 - protein, 42 aa, Homo sapiens
RLYRILCHPPSYSWKQKWVSASSAIDPDPHTFGDPYLPLVTA

SEQ ID NO: 1006091 - protein, 40 aa, Homo sapiens
LLAVIHAVAADLMVLDRLWKPHVSAVVRASNLPMSVSLWV

SEQ ID NO: 1006092 - protein, 33 aa, Homo sapiens
MLLFQQGVNQTYSPKVTTLGTATDAPTFTEYSG

SEQ ID NO: 1006093 - protein, 41 aa, Homo sapiens
GSRWINVVSPELAVAGLGIDEEVRPPMNSPLSGVTSDGKQV

SEQ ID NO: 1006094 - protein, 55 aa, Homo sapiens
MYNKVPGKMQVAKQSVLAATVVISSCPFQQSDTCLIIPHGREVRLGAHPGTLLTS

SEQ ID NO: 1006095 - protein, 76 aa, Homo sapiens
ICRALTHKPHRRLVHVNELPPGGAEPLPQSQPADSSRSFTRTSSISSGHFLPVDAMTACRESVELAPRIYGSPLPG

SEQ ID NO: 1006096 - protein, 51 aa, Homo sapiens
IGGCKRGEGDQDTSTGFSMAESEVSDIESRIAALRAAGDQTVKPYGKAPEE

SEQ ID NO: 1006097 - protein, 45 aa, Homo sapiens
GSTPLGARLRYSGVIMGLYRLTSQAQAVYLHLPPSSWTTGVNHHD

SEQ ID NO: 1006098 - protein, 86 aa, Homo sapiens
TTASIFTLSQLITGKEDAANKYALRELHHCAWRSLTLCKDRIRKLADQCTGLQGFWVFHSYRRGEPGSGVHLTCSMDTPLKLIHGT

SEQ ID NO: 1006099 - protein, 32 aa, Homo sapiens
EHRITHAAVPGPVQSSSALSECCSRQSPPQGD

SEQ ID NO: 1006100 - protein, 47 aa, Homo sapiens
SSVLQVYLFTLTLLCFPKGLLGSDSSVECADVCRAFSKLLLTLLTGA

SEQ ID NO: 1006101 - protein, 42 aa, Homo sapiens
MSGVGWCQVAAALMKNEVGCLGCNENMEALQGWVEDVEIQLT

SEQ ID NO: 1006102 - protein, 31 aa, Homo sapiens
MAWGMAEFKVWCGVCNVAQSGRVRGMDWGVE

SEQ ID NO: 1006103 - protein, 63 aa, Homo sapiens
MVIPIRQLRNWGRARMAHPCNQSQHLGKVEAGGITLRSGVRDQPDPTMDKPFRLLHIQNQPGM

SEQ ID NO: 1006104 - protein, 120 aa, Homo sapiens
ELTSHWVAGRLVPGGERHTGNGGSLKLHPKTLGSVSYLLPHVVWSGCITSPSGDAKTASQPFPSGGILRSLAILLYGKQLVKNGLIAWSFWRDFKTPNPSHKSFQQRSPLQKEPFGNQGG

SEQ ID NO: 1006105 - protein, 146 aa, Homo sapiens
GRQLRTPERFAETLKVEGPQPTQLEHQRCLLAEALTLAWPCEDTGQKPRTEVSSVMLEQRAPRKRLVADWRGGPLLCQDGFYRAISMAGPALERHGPVLAVERLPDVPRQHRHVCAGQKQQTFLSLTGLHQVAFQGRVAGACHKGV

SEQ ID NO: 1006106 - protein, 149 aa, Homo sapiens
MYQCGKGQCGDYCLVGTDLHNDQKWEKQAGHVGHEGWGLRVVNAERLSPGHRLKSPWSCMLGPKTYHKFMGFKSFAELPQPPLLVELTVEEGQRLKVIYCSSAGFHAVDIDSGNSYNIYIPVHIQSQITPHAIIFLPKNDGMEMLAVSR

SEQ ID NO: 1006107 - protein, 37 aa, Homo sapiens
QELTDSRQVFVLYDDPIEDCPNSFTLISMSSPVGLVG

SEQ ID NO: 1006108 - protein, 83 aa, Homo sapiens
ESSSTGWHGAYQDEHLIQTVKNRVKVAQTRIEGIGCCCGLSEGGSICRPCWHPYPRMMSQHLSLRDLSFVPCPHWLRLISASL

SEQ ID NO: 1006109 - protein, 35 aa, Homo sapiens
MGDTIHMQAVVGASAVPHTVVPGVTCCPLSALFGL

SEQ ID NO: 1006110 - protein, 98 aa, Homo sapiens
MGSILSVEGVCLGLIQICSLFSRVREEEEDDRNVMPGKVIRLSDIQKFLVEGCGVCGKGVKSLVNLRAISYRERNMNSDYAFSLHNIPQWGDFKGPLG

SEQ ID NO: 1006111 - protein, 52 aa, Homo sapiens
YLRMYSHWLQRQGGASTQADSVNITSFQCHHENRVLHTVTRAVTTCDCSPHR

SEQ ID NO: 1006112 - protein, 33 aa, Homo sapiens
TGVTKLGLRTLKKTGATTTTAATRYRQKTEGGA

SEQ ID NO: 1006113 - protein, 121 aa, Homo sapiens
MGDIEKIGCPTLGYSSSLTKLHPGTEYVVSIVALHGREESPLLIGQQSTVSDVPRDLEVVAANPTSLTDQLGMLLLSPVRYYRITYGERGGNSPVQEFTVAWEPSLQLPSAAFNLEWIIPV

SEQ ID NO: 1006114 - protein, 101 aa, Homo sapiens
MPKLRCVFNDISTILEKALVESSECRECPFTAGKIHWLPRKENGLKPLLWLSQLIFPKVIKLHITEVDVILHGKLAIPGVPRLSLNDGREKPASYRCRGAT

SEQ ID NO: 1006115 - protein, 87 aa, Homo sapiens
MQVNVFLTSRIKGSWVQGGDGPEEGGRSHSLREGGKELKKKLQVDGFDCLSQGGGLVLGGHCQVKPDFTFTGEKGPGPGGFNLGVLL

SEQ ID NO: 1006116 - protein, 81 aa, Homo sapiens
MRAAGRGQGQCAQQVHTRPVITNKHAVGTSGYTAASSKDKNTPEASRDGKGLSKDSLAQVFRGRATEQLDKKHNRLRAPDR

SEQ ID NO: 1006117 - protein, 81 aa, Homo sapiens
QCKRQAVYCWKAGATVASPGPGRSLQCIHAEIVVTYLRKDVMQTPYSYTRYRAGWPGGHWGPPPSSPHPVLEACKKAKQAQ

SEQ ID NO: 1006118 - protein, 37 aa, Homo sapiens
RLSDRDGKRDRETDGETERHDGGDRGETAERECWRHE

SEQ ID NO: 1006119 - protein, 69 aa, Homo sapiens
SYSVRQRMCTQMHLRFVNACGEQMQRGGFPGSAHCIVARLPPLPEKKIVHRAQRLVESPELAGLSPISR

SEQ ID NO: 1006120 - protein, 91 aa, Homo sapiens
GQDQTGLRVGHLAHCCSQLLLMETVFDFRSVAFITHQNVLRSGLRPNSERCSLGRPGIWGSCVCAWRPFLLGASGGSRFLKSECRIKVELY

SEQ ID NO: 1006121 - protein, 46 aa, Homo sapiens
PSKLFSVKIVALGGLLGLEVQVRSHRGRGRGQSCGDLERAGRRRPY

SEQ ID NO: 1006122 - protein, 45 aa, Homo sapiens
MVDLEFERKGTPEPIILIYSAVLQLVVVKLQDDMKWGDTGLAQKL

SEQ ID NO: 1006123 - protein, 98 aa, Homo sapiens
MKVRVSHSENVRHKKVVVTDATETRYISGNKMRRSLVQVDAQQWPDSREHQADVRSYTITGLQTGTDYKIYLVHLEVTMLGAPLLVIDASTPIDAPSN

SEQ ID NO: 1006124 - protein, 141 aa, Homo sapiens
TGVGVVTEEELNEEIFHDLRNSHGLSLYDSSVASELETPEDFTLTDDITRNWAAFTSRAAMLQKSVLRGEEAALQTAGHCLSTRPKNEFAAKATEDQMRLLRLQRRLEDELWGQFLDLSLHDTVTSLILGGHKKRAEQLGT

SEQ ID NO: 1006125 - protein, 57 aa, Homo sapiens
TGRWLVLFELRSGAGLSASCLSLHCSSSLCLRQLHASAETDAWGSTSCHGRGLRASR

SEQ ID NO: 1006126 - protein, 34 aa, Homo sapiens
SVRVNNHSGVLKIQEKYSGWGRGCRNVFPGCGVP

SEQ ID NO: 1006127 - protein, 41 aa, Homo sapiens
CDLEDPHLSLSTSCGAGVVVVANIQTRTLKDVGEGEDVGEG

SEQ ID NO: 1006128 - protein, 36 aa, Homo sapiens
HLSSRHLSFSHTAAAKNVGERVDVGEGEDVGKGRMS

SEQ ID NO: 1006129 - protein, 40 aa, Homo sapiens
MSERERMLEGGDVGEGDGCRRGRGCRRGRGMSETGADVGR

SEQ ID NO: 1006130 - protein, 38 aa, Homo sapiens
MSGRRDDGLSDDGTGLSGRRGRRTVERRDDGLSRRGTT

SEQ ID NO: 1006131 - protein, 54 aa, Homo sapiens
DLKLYHGGGLPSLHDAKLIDSCYTNPADRAYSCVPAYSEPMETPVALNYSFYQV

SEQ ID NO: 1006132 - protein, 39 aa, Homo sapiens
MYSFSSKGADLSELTLRWSVFLYTWCRNDMYRPGFGKGD

SEQ ID NO: 1006133 - protein, 125 aa, Homo sapiens
ISAPLGCDHSHLTGLAGRGPGSQWGRGSHHSQHGEGIRNMKSWVRSFSSDSGWQVPNSQRSVSEAPCRNKSLICRNASRTPWVHMGLWPSKSAVTSRKNWLESPRPATDKNGRAGPPGPPEPSGE

SEQ ID NO: 1006134 - protein, 50 aa, Homo sapiens
LEDLCHLVAEVLWSTGMSTVPQMISFLTNQQHFWKLFLSQGYWGAGNIFL

SEQ ID NO: 1006135 - protein, 33 aa, Homo sapiens
LTEKKEVVEERENGRDAPVTGMLMRKTGEQECD

SEQ ID NO: 1006136 - protein, 53 aa, Homo sapiens
GVGRGYYRCKSPFCRKLFGTGALTIWYYLGVRRNITACLSDFLRSEWRRWSIV

SEQ ID NO: 1006137 - protein, 68 aa, Homo sapiens
CTRSWRALDDVVILAVGGTSTSDGTLNTKGATKGSSFSSKFSGSFFSLCLEGSSSSVWSEGRNSRYRK

SEQ ID NO: 1006138 - protein, 127 aa, Homo sapiens
YIFGVVVGRGVAEVSGPGPESYVLSGVWRGFGFGPGLERCNAGHVLGEEVFQELFNTESMFCATAFITSTCCSGEAWNHIFRRLCPEGPMALRVRCMGLAGGPAPIPGGPRDCSQTPLQSAALPISP

SEQ ID NO: 1006139 - protein, 36 aa, Homo sapiens
TDLRWLWVGSVSILTGQAEENCGTDSQQSVAWAEGR

SEQ ID NO: 1006140 - protein, 81 aa, Homo sapiens
RYPDQVTATTKSGANLAHSQPVPVAGGRDQRRRQVLTRVNRLKPEESPSPSPGICVSPVTRYKVEQALHGLWPQQVVPVCW

SEQ ID NO: 1006141 - protein, 120 aa, Homo sapiens
LLNNMAHIWIFGPDNVSSTRDIKSFETSLSILLLVQCPGPRLKQILMDQGIAYNCIAPRQTSTGDAHKWSEAHNLFLLGCRLPACSHYKCLDISRVPAERSKSRNHTRTKCVDVTSESTR

SEQ ID NO: 1006142 - protein, 44 aa, Homo sapiens
RRVHCEHAVEHGLTLVLEDIGERRFLKRTRDGLRLPSVRSKGSR

SEQ ID NO: 1006143 - protein, 92 aa, Homo sapiens
ITALEKGEDSRGSQARETGEWILDRGGDGVRQRLLRFPGICWTWSHVLSCHSDNDDEWLRSGTVEKDENYASLLGTMMDGVSQRMNARQLKN

SEQ ID NO: 1006144 - protein, 88 aa, Homo sapiens
SIVSHLVADGETIGLGTTAMPAVMQMAERHSGQRKGQPPGWTKHNSDERKMGFQKETQKRRSKTTSLPTTLLQTSVIWQHTDTSLNKA

SEQ ID NO: 1006145 - protein, 117 aa, Homo sapiens
SITSSGKGDGRKRVQLPSLPPEAIQQTLSDECVTKLTMYSRHEMNEVLDLELKGDIETCLTAIVTCATQQTSFLAEKLHQAMKGVGTRHKALIRIMVSRSEIDMNDIKAFYQKMYGI

SEQ ID NO: 1006146 - protein, 61 aa, Homo sapiens
MQSALELRMEPPPADSKPAEGRRHPGLLSLPSWASLAYSCLPGPLHSCLGGPYEGSPAPAP

SEQ ID NO: 1006147 - protein, 45 aa, Homo sapiens
PNQDNRTVSQMLSKRWYTLGPNETQKYHDLAFQVKVAHLQQGPKE

SEQ ID NO: 1006148 - protein, 58 aa, Homo sapiens
LAPLVSWMMVPGGERLVLGKGDVGMVMQAKDLRHIMEWEALDVGEVAGGGREVERDRG

SEQ ID NO: 1006149 - protein, 80 aa, Homo sapiens
SRDPKILQISCRSTQQQRLETYGKGAVSRELQMLLVKEGVQNAKTDVVVLRSLDLVLSRGPLSKSLLEKAGPELQEELDT

SEQ ID NO: 1006150 - protein, 143 aa, Homo sapiens
HQVKESGWAISIEIWLETDFLITEPFNQYSKPGMMLEGVEKKQRYVLVSTQDINMATLRMTWEAKVQLKEIWINSGFPDDGALTQVFTSTGPDNNWDVVISLRALGVYPKVCYHKETRKILTSEGRNALIHKSSVTCPLSSQD

SEQ ID NO: 1006151 - protein, 112 aa, Homo sapiens
RVPETEASTVLCVCLNLALSDTISFFLSNVVNFSIGRMSRASSKFIAGICLGVSQIKKMLAADVGVVIHIDCHKNGCGYNEDQDEDSNDEASVEGSPFLLSCTVICRSSIIF

SEQ ID NO: 1006152 - protein, 60 aa, Homo sapiens
SVRTGADGEQGDPSPADTIKANQGHIPAAPGETGSVICWCDQSVAPPRPAGLSVSGRQSY

SEQ ID NO: 1006153 - protein, 35 aa, Homo sapiens
PLQECVHRDLGARTKKMKGRKVKKSLVAHSVGEHY

SEQ ID NO: 1006154 - protein, 126 aa, Homo sapiens
SSHWVAVTASQKRSFRCQLPQIWLQDCTINLVLTFRALSLSGRANHIPGPTLVPLFSVLWNHRPPPWLLEPPSFFLALETGWKRHLPSIWALGTTLLASWFWQPGLLSSWLLEPGLLLPCRLWQMA

SEQ ID NO: 1006155 - protein, 106 aa, Homo sapiens
MCVVGRVKSGGLSRCIEGRRQCMEISEAAILKTCVGGSCHRGGGDRNELSSTTVMFEGGRNIVGGIKGHGVDNVVGWNSGFLVWEPNKVAPRLEAVTDDHIRMHKV

SEQ ID NO: 1006156 - protein, 50 aa, Homo sapiens
MSRRGYKIRKAFLLISRGRSLPENSWNMVRTLSRHHIQKESTLHLGKGCC

SEQ ID NO: 1006157 - protein, 119 aa, Homo sapiens
DPEVVGVEKRSSVICDGRCQINFTVGWTSLANGEPFSTEFLKELSSTGVNEYLMLWSVGRVVPGLLTPDKAVPLDFGFWGPGFPLDWQVFALNFALNFNPSNPYCAGIQGIVDAYPQTP

SEQ ID NO: 1006158 - protein, 62 aa, Homo sapiens
CLRIRVVVGRICCRFSLSMRRMSLKSRADLPSGEELVQQLKAGTVLERVLVLELSCEGDDED

SEQ ID NO: 1006159 - protein, 35 aa, Homo sapiens
VAVGRHLCQAQLFRADSDIFYIKSSFLVISIVSMA

SEQ ID NO: 1006160 - protein, 73 aa, Homo sapiens
CPVWEPSHSAWLISCPLSGKRGVALLATSADQQQLYLCYLNLLEARALCPRDANPCLAEMLPTTSVTGSPFIT

SEQ ID NO: 1006161 - protein, 35 aa, Homo sapiens
TQALLHSIRSSVEDMGVHFMVEQEPSSSSKSCCLN

SEQ ID NO: 1006162 - protein, 38 aa, Homo sapiens
TIFEAGHCDLRAVNSAADPGVAYCEVSPPCSWHYPDCQ

SEQ ID NO: 1006163 - protein, 44 aa, Homo sapiens
VVVGRAICDLHHHALFSIHLTRLFLKRWLSRSESVEEETYQRPR

SEQ ID NO: 1006164 - protein, 133 aa, Homo sapiens
DLWSRTLGWDIHCCTWTLRNWVLPGSALSTFLHVDGVELGIAGSALRPFCTWTLRNWVLPCRKWTPRNWVVVCRAQHSVPYPHVDAVELGIAGLSTQHLSGVTRMLRTTLRPHGLRLVTLETKTQEPQAFLVW

SEQ ID NO: 1006165 - protein, 76 aa, Homo sapiens
TWCSWMMLPGGDRLVLGKGDVGIVMQAKISGIIMEWEALDVGEVAVPVVGRRDLVVDARGAVACAQGRARQGSRSP

SEQ ID NO: 1006166 - protein, 42 aa, Homo sapiens
MAGLTHGAVRAASWSCPSPQCHLSLHPEASPRACTDTSSSNH

SEQ ID NO: 1006167 - protein, 66 aa, Homo sapiens
AWLLSSRIHSYYFFSLENIICVRGSRDTQKRKTSHPNLPSEQCGFGSIFHRLSGLRPGGPFLQATA

SEQ ID NO: 1006168 - protein, 93 aa, Homo sapiens
MGSFCVGKNRMGGALWGVSYQAAVEGSWCSGSTSNTRRRFSFIFRAHSISAHQISSGSGASTFGGFSSNDSFRYVPPLPIPFPAKGPNAGGWD

SEQ ID NO: 1006169 - protein, 35 aa, Homo sapiens
WGVGSIGANEVLLYLQGSLAEPELAYGTLLTWFQF

SEQ ID NO: 1006170 - protein, 90 aa, Homo sapiens
LLHLVAPQEYEPSACACRMETTHSFGIPSISVSTQQPTKKLCPVVAPKAKYNPYNQPGGEGDLLPPPPPPLDDSIVPSIYLWKLFSSISS

SEQ ID NO: 1006171 - protein, 89 aa, Homo sapiens
MRLRLGSSDGMLRTGFAVLVFVAFDENDPRPLRALTPDYSMRDVYRKFDLREDVIDFTGHALALYGTDEKGKLGGGSPLAGPCPILTTN

SEQ ID NO: 1006172 - protein, 49 aa, Homo sapiens
LADPVVVVGRTGPWCGTGRGHLLQMMFLEEAGGTSLSLYLGHFESVALG

SEQ ID NO: 1006173 - protein, 34 aa, Homo sapiens
RSVLQAEHESPHKDTVCMRLCQEIALHSGREPAP

SEQ ID NO: 1006174 - protein, 33 aa, Homo sapiens
LGRSGDYSSSTTALRFSGGHPQVGGEDPCALLS

SEQ ID NO: 1006175 - protein, 41 aa, Homo sapiens
EDEFTEPKRERENGQTPCEEETQAPPSAAGLCLRFASSLSL

SEQ ID NO: 1006176 - protein, 45 aa, Homo sapiens
VPVTLNGRCLRSPPAGKNFGIWLRYDSRSWTTTCTWEYLGPGHRG

SEQ ID NO: 1006177 - protein, 140 aa, Homo sapiens
MCWFRTCKAVLAAGSQLLKLFREEEVVETNLTAGAATRASAKGHPRALVPLAALEAMSPRTLEPIHVRPDTRHCMHGVCSFHLRTSGNGPPPEAAAKTSTEASAIATATAISRGNTACDNRDVDWSNSFSTESAFLALQQ

SEQ ID NO: 1006178 - protein, 114 aa, Homo sapiens
MLWALYPCPDSHVGLWSPAAGGGAWCEVIGSWGRFLMNGLAPSHSAGLVIGFSRDLVVSRCVAPPHLSLFLLLWPRGRVKCYSPFAFRHGWKLPEASPEAEQRLLCFLYSLQSH

SEQ ID NO: 1006179 - protein, 74 aa, Homo sapiens
ENRDYIGEFASFSSDSSSDNLFYAFYLRNIKLLHVLNSIYQSDDRTRAAGTRTLEFQGYNAIFKGLVDYIPSIL

SEQ ID NO: 1006180 - protein, 58 aa, Homo sapiens
MSRYRIQTVVQGTDSLIYKNGFLNLDRPFLGFSEPLAAPSMMDLLQTETVVMAHSLFE

SEQ ID NO: 1006181 - protein, 83 aa, Homo sapiens
YLQLGTSRGNTLLMGVQSLHLSIECWLLSFCNVLSRYFYYAVFNYKVEQNAVPSHIKFSIYPPIPGEESSLRWAGKTSEEIPM

SEQ ID NO: 1006182 - protein, 105 aa, Homo sapiens
VRGARLLVLDADALGCSRSLRICSTSSVHVVRQVTMGDALPLVLIGVLCRAAVQNGPCEVVRGILLVLSGLGDDLGIEVLMHTVVPGDSTGNGSYKYFLKNSFLA

SEQ ID NO: 1006183 - protein, 99 aa, Homo sapiens
VHLVLDADALGLLRVTQDLLHQLCPVVRQVTLGDALHVVLIGVLVSCGGTEGPGEVVDGILLVLDGLGYDLVIEVLMHTVLQVDSTGSGSYKNFLKNSF

SEQ ID NO: 1006184 - protein, 79 aa, Homo sapiens
MKLSDSTLKETLLNGVGYLHEGLSPMERRLVEQLFSSGAIQVVVASRSLCWGMNVAAHLVIIMDTQYYNGKIHAYVDYP

SEQ ID NO: 1006185 - protein, 75 aa, Homo sapiens
CGWLLTWRSDLQQVLSSVKLFLGGGGGGDKFDAGAATPRQCQRPPPALRPLLALKPEPPTLSPPLYADTPTDARS

SEQ ID NO: 1006186 - protein, 136 aa, Homo sapiens
VDENSRVVSDSYSSESFAEMNRSSKEWETVVGGAMFFIGFTGLVIMWEKHYVYGPLPKAFDKEWVDKQSMRMLAMKCETPSRAEISKWDYEEERVEDVRDAGLCLHLRLVLSASCKSMPIYWKPVMRNSCTIANDC

SEQ ID NO: 1006187 - protein, 39 aa, Homo sapiens
MSFRMFRYIYSRDIDSQSPVFGTTLEHSPISSCDTVTPR

SEQ ID NO: 1006188 - protein, 67 aa, Homo sapiens
HLQASEVPEIGTSLHGHSLIPRRRMDTIEDHHRFAMAFLLFSSPQVVALIPIIPIEEANNFHFKGPP

SEQ ID NO: 1006189 - protein, 39 aa, Homo sapiens
MPATPGGSREAWRVPHLGFCDSPLCGAHLQMSLLTTHST

SEQ ID NO: 1006190 - protein, 43 aa, Homo sapiens
QDSRWCGRGEWDRLRKTVSVAVKCLKPDVLSQPEAMDDFILGG

SEQ ID NO: 1006191 - protein, 36 aa, Homo sapiens
MTHQVSLCGRRNSEQRAFATERHPQVNNWHPIRLGF

SEQ ID NO: 1006192 - protein, 59 aa, Homo sapiens
DAYVGLERRLEVAGLCLPHGGSAGQLFLLAASLGQLLPPSRQALLAQLPPAFVDPEVSA

SEQ ID NO: 1006193 - protein, 37 aa, Homo sapiens
MVQVVSCGGWMKSVFRKRKPARDKAGGAPGTAPYPKP

SEQ ID NO: 1006194 - protein, 72 aa, Homo sapiens
GHLEDPAASSEGRDSPASQFHGICCRRSRRCMVQVVIVLAVLHEERVQDEETWTDDNAWGAAGIVPYPKCTL

SEQ ID NO: 1006195 - protein, 53 aa, Homo sapiens
VGVGSRRKSRLEIDISTGRITEAIGLSSTEINGFETIVSITHRQKYIVYRQFC

SEQ ID NO: 1006196 - protein, 111 aa, Homo sapiens
YGFDGHRPVGHSVDYVWGNTGYFYNYETTSRDRHVLGLNTSLTHDDSYAGTDTTDTTRRPDDTTGRFFGTTRTHGLSTTLTLDDTLGDDLEQTDDGVGPREPGLDLKDTQD

SEQ ID NO: 1006197 - protein, 107 aa, Homo sapiens
MSLSPRDPEAGSICASQHHRVASPGHAAAYLGVALQCGAGYYKSLGICRIYTQCKKAQNLSLEQQFIEATHSSRPRLSPRQATTSQSNGKSSPSVSRNMSGITVRAA

SEQ ID NO: 1006198 - protein, 39 aa, Homo sapiens
FHQQGAAGDMRYPAQPSSQPAADHTSPTVPHKLTFFQRR

SEQ ID NO: 1006199 - protein, 34 aa, Homo sapiens
MANSDILVLLTTAGQRGTNTKLELRHHTDYSTGR

SEQ ID NO: 1006200 - protein, 83 aa, Homo sapiens
MVRDLEAEKHGDLYASVPCSLSHPCTTGALGSGGATGANRADRTGGTSRTSLTTITTLASRANGPRGTTKHQEHQGVQRARAS

SEQ ID NO: 1006201 - protein, 33 aa, Homo sapiens
MADVYSPRAVLCLLYKFRRQVSTVLTSKYRSAG

SEQ ID NO: 1006202 - protein, 56 aa, Homo sapiens
GDLEIQSGKGLSGCSCTVIYSSSVEISPLQKCSLTMVGGSSGDRAVARVASFCIWL

SEQ ID NO: 1006203 - protein, 36 aa, Homo sapiens
QVPIAGLPLLTVRPLRSCHAHIMKPHIFMPAAKVPT

SEQ ID NO: 1006204 - protein, 38 aa, Homo sapiens
LERGAGEEVLDSSFLSGEDWIVERDLTVFSVEPERRQL

SEQ ID NO: 1006205 - protein, 30 aa, Homo sapiens
MWALALPALSKSGPRARNSVIWAHSVFPGV

SEQ ID NO: 1006206 - protein, 42 aa, Homo sapiens
FCWKGVGQSSRKVLERSLAERGVTRRTREIPGRRNSMSKGMG

SEQ ID NO: 1006207 - protein, 73 aa, Homo sapiens
MHEAVYLQGSSLGILYRVRVKLHTEVRAADVTVGCTGYTTQKQGFWHIWRFLPDTIGLLNMQVALGQGKVIFL

SEQ ID NO: 1006208 - protein, 110 aa, Homo sapiens
SWPGGAHHVDEYTGDPVPGSEICQSPVGRVEMVGTNWMGPSGRFRQLNEELEKGMGIQVGFLQSASGRRVGSWLNSAGSGRQGSGGAVAHVVPLGDCQSPQVSWAPRVPS

SEQ ID NO: 1006209 - protein, 55 aa, Homo sapiens
MTETEAYLSSGDREAWSACHRIPDQPKVFPLSLCSTQTDWNVVIGCLVQGVVAPG

SEQ ID NO: 1006210 - protein, 79 aa, Homo sapiens
STPGVPYGSLHFIHNLAKLAGPGTLLCFAQSISFSGLPSSRRTSPASTGLPAPSLSSSSFSPSSSPASPGDLPTVTLLP

SEQ ID NO: 1006211 - protein, 154 aa, Homo sapiens
MRATFYIDQEMKEVFQEKQMSTNEGIVTLIKEVDYEEMTNLDFSVIVANKAAFHKSFRSKYKPTPIPIKVQVQNVKEGIHFKSSVISIYVSESMDRSSKGQIIGNFQAFDEDTGLPAHARYVQLEDRDNWISVDSVTSAIKLAKLPASDSRYVQ

SEQ ID NO: 1006212 - protein, 65 aa, Homo sapiens
MGRIQERAEDKGSRGLERRALALLSASEPPLYPTQLCAQIPGPKEDRGFLPPSVLVQVMSHWCGR

SEQ ID NO: 1006213 - protein, 124 aa, Homo sapiens
MQRLQVLMGRMESVFNHGQLRNTIYAGLQDFGQVTLREALRQAVRKKKNVLIRVLQGIRKNIFDWEGGREAPNDPWLKRGEGPQKVDFDIQGCPGVLGGAIPGHQLVHTGAAGGHRKLEFGNQG

SEQ ID NO: 1006214 - protein, 94 aa, Homo sapiens
LEDPCAHLHHTAQLPIVYTTQPSCSTVYTTQPSCSTVYTTQPSCSTVYTTQPSCSTVYTTAAQLLHMSTPHSPAAPHVYTTQPKLLHVSTPHMP

SEQ ID NO: 1006215 - protein, 45 aa, Homo sapiens
SVSEACPEQKVVNKLIQYMISLVQSNRILGAEEKDPTVMLNDRWP

SEQ ID NO: 1006216 - protein, 36 aa, Homo sapiens
MPQTLTALLDSWAVSIFQAAVGAASLIHFPIKSSFC

SEQ ID NO: 1006217 - protein, 42 aa, Homo sapiens
MATHFWTSVSRPGSPQSLPLTHVPPAADVGQGVGGSMHPELG

SEQ ID NO: 1006218 - protein, 41 aa, Homo sapiens
PPSQCSRTLAPRHDGCATSPLPTPRLRTGTGPPSLSPVTVL

SEQ ID NO: 1006219 - protein, 43 aa, Homo sapiens
RLRPPDKPDATATLHDTTLHTRRTTHVLRVRTTSVRRDTTSTT

SEQ ID NO: 1006220 - protein, 32 aa, Homo sapiens
LRIAQEHERYTLNDSTELVCEDTRDSPSRPSD

SEQ ID NO: 1006221 - protein, 41 aa, Homo sapiens
TPFGTHRTCHVSLWTRGHAHSVSRLRLGGGLLLRRLTLHGT

SEQ ID NO: 1006222 - protein, 76 aa, Homo sapiens
TPSKRYLEGSMVLTCRRNLYREACTCSGEYTSTSIHVCVIGSHRGSPVSTEHVWGVMHGSGEYTSMMEACMHARVL

SEQ ID NO: 1006223 - protein, 74 aa, Homo sapiens
YNRARYRSSLSLGLQAAATRPANFVFLVETGFHPVGQGGLNLLTSGDPPASALPKCWDYRREPVCLANHEFQRP

SEQ ID NO: 1006224 - protein, 41 aa, Homo sapiens
QSSSVPKLAVAGITGMSHHARLIFLFFETESPSLRLECTRS

SEQ ID NO: 1006225 - protein, 104 aa, Homo sapiens
MAELLLLIVPILIARAFLMRSERKIVQAIVPLRKGPNVVGPYGLLYNPVADAITIFTKEPLKRVTSTIDLYIIAPILALTNSSFYYERPSTRPNRLFNLKLGLL

SEQ ID NO: 1006226 - protein, 61 aa, Homo sapiens
MRGIVVCSESSIVTGWFMSANTEAQGSGRGLEAAKWLIVAVLLVVTIVGLYYYRDLSLPLG

SEQ ID NO: 1006227 - protein, 64 aa, Homo sapiens
NGDVVDYVGGVDGGVGDTVFGRSLRYSCGVLDGMVWNCWTCARCAQRYITLGSKKSLKTSDLRH

SEQ ID NO: 1006228 - protein, 43 aa, Homo sapiens
VGAWGAASTFGSRSTNITNGARGSSGSGRASGTSIAFSNRITR

SEQ ID NO: 1006229 - protein, 43 aa, Homo sapiens
MKSASGQLAAGRCGESFWITVSDDSFFNIKNQKAIHHFNKGHW

SEQ ID NO: 1006230 - protein, 54 aa, Homo sapiens
ENALSEWLTFHHTRASRSHMPECQVDTGACRTLAACGCAPVTSSHVPTDDMASS

SEQ ID NO: 1006231 - protein, 124 aa, Homo sapiens
SSLTDYRFLTFVIYLTDDERRRSGKAQNHQVGLRGYILRARPIPGQSERNAARAVSSKHATIKTLYFIPCLEDLIFLLVLQMRKSCHCTTTILTKKAVCEVNSTISLLLIGPLLAVAVYHIVDP

SEQ ID NO: 1006232 - protein, 35 aa, Homo sapiens
MIQSSWYLVSEIPSILGVETSLCRQQSSAGVQKCS

SEQ ID NO: 1006233 - protein, 39 aa, Homo sapiens
MSLLADVAFTTVALTTSLLVVDTTLGGLLYDVDPARHCN

SEQ ID NO: 1006234 - protein, 71 aa, Homo sapiens
DLGVHEVSRLAEWNLVRLKELHRISTSSCDSSSPASAHSNCSCSQSPPVRSQGKLSLVRVAPGLRFSEPCS

SEQ ID NO: 1006235 - protein, 33 aa, Homo sapiens
NRARYRHYRPVKWHHRSGGTPDNVVKVPQCTHL

SEQ ID NO: 1006236 - protein, 48 aa, Homo sapiens
PAHCAGSFSVGFSQAGGSWLHAPSLAPSISMASHIHSQHAVPPTPGVP

SEQ ID NO: 1006237 - protein, 216 aa, Homo sapiens
RSVPYVSIVRDKTTKMRISRAISLMNIEVTVLNYKYWQSESSSKSKSLSTTIKSGSSLGCKAGSTYANQEEVIASHNQNHDKNHMIISIDAEKALEKIQQPFMLKTLNKVCIEGRYLKIMRAIYDKPTANIILNGQKREAFLWKTGTRQGCRLSPLLFNIVLEVLARSIRQETDLTGIHLGPEDVKMSLFADDMIVYLETPLSQPKSPEVISNSAS

SEQ ID NO: 1006238 - protein, 114 aa, Homo sapiens
MRSPHTARRSAGTTVISVTNTGLYASRSLLLLQHWITSSTGCFSEWAQTFSIFCLAASSENSRDYVVGAAFGGEVDPWKRRVLNQQAENRLAQSIVQPADKVAGLCTNDSPPPT

SEQ ID NO: 1006239 - protein, 73 aa, Homo sapiens
TSSLGLDHCGTCVSSSTGHTAPLTRLAGTVERYAPDCGDSYKHNGGSGVPCPQGSPIFYLYGVGSESPIQTFR

SEQ ID NO: 1006240 - protein, 67 aa, Homo sapiens
ILFAVPFPCKLLTGREAPWLSLEEPADFAPEPGRKACDLACAKTMKKKAEGTVSTDGRLPRSSSRQY

SEQ ID NO: 1006241 - protein, 48 aa, Homo sapiens
MHTLFLELLEQYVVGKKPKADACCRSETVVERMLSNVDVPSACTRYLQ

SEQ ID NO: 1006242 - protein, 89 aa, Homo sapiens
CAPPGALDGEGPAHSACQNHKPCSAMSPVIMSAAAPPPIPAANSRLGRGDCCPIPEAVCCSDHLSLLPPVATRSLASEGNCQALAARSW

SEQ ID NO: 1006243 - protein, 57 aa, Homo sapiens
MEFHHVGQAGLKLLTSGDLPASSQNVGIIGVSHCACPWILSKSLNLSHIRASSSPAC

SEQ ID NO: 1006244 - protein, 60 aa, Homo sapiens
GGLSTFSAPQAGGPGPHSGASVKWLGMSRFSDVPHRSGSWSQPQRHPGGTGAALVESRLA

SEQ ID NO: 1006245 - protein, 136 aa, Homo sapiens
FAVLFPVFNSQLSSEHLKLPFYQHELLERGPYKSAHGWARWPVPVIPALWEAEAGGSPEVGVRDQPWQHGETPSLLKIPKISQAWWCMPCNPMLVRRLRQENCLSPGEGGCGEPTIAPLRSSLGNKSELLSQKQNK

SEQ ID NO: 1006246 - protein, 61 aa, Homo sapiens
LIWKCYKTWYTVYQSVVSYTVKVAGLRNPLQRVQISGIVHKEITGGNRIQLQNNMSIFDLV

SEQ ID NO: 1006247 - protein, 64 aa, Homo sapiens
VSKDPLWDGGTDFVFLWAQVSPEDQENKGIDSNLHVPKTGTPKLRYRRPATGGPRVRSSGCTEA

SEQ ID NO: 1006248 - protein, 47 aa, Homo sapiens
DILQQRGYAPVCNCTRSRCMQFAELKDKIDRRSGKKLEDGLNSCKSG

SEQ ID NO: 1006249 - protein, 58 aa, Homo sapiens
AYLWDGGGTLDVSGKAESACRQGTGVGALPAPPLHQACSALLLPGVRGKVLGAGCSVV

SEQ ID NO: 1006250 - protein, 57 aa, Homo sapiens
MRLNGDAVGKCGATPFNDKAQTILCNGDDEGWDLTCQLDMLMGGHVVRICLQPSEFL

SEQ ID NO: 1006251 - protein, 75 aa, Homo sapiens
MNLSSDLAAALGATAIPQSCAEVEEYLQAMLAAADLQMNARKRWLRILLKAPAPSALVRPLGGVVMQAGIDLVAR

SEQ ID NO: 1006252 - protein, 44 aa, Homo sapiens
LSYVSTRRCSCVGRYPRYHFTTRGLYDRVLVVQHLYTRMTPTRL

SEQ ID NO: 1006253 - protein, 37 aa, Homo sapiens
TRIFCDRYNPGARKGSEKVKEHHEQSLQMGLTQQLRS

SEQ ID NO: 1006254 - protein, 62 aa, Homo sapiens
TVQAVSYRPRAAGLANPRTSSWDGKTRDAWSPDTYSSPLLLSLTRKLPLRHDSPTGHLQPQT

SEQ ID NO: 1006255 - protein, 39 aa, Homo sapiens
MVSAVALVVALWLGGGSWLLAGGFVWPCAFRVLPYLQGI

SEQ ID NO: 1006256 - protein, 43 aa, Homo sapiens
GTYTASGMADSGASGSTSVLQLSFPGHTKIYRKRMYACMSWTL

SEQ ID NO: 1006257 - protein, 58 aa, Homo sapiens
LPNWVNGEVGPLACDCTTCLPDLYVQLDLAEVTQDWSSFRRFEILSEAALDPCYSLLS

SEQ ID NO: 1006258 - protein, 119 aa, Homo sapiens
ALGRRIEQWSAESTEVYARAGQLSGLLVLLRYFFSSLLIQFLIILGLVLFMVYCNVHVSTESNLQATERRAEGLYSQLLGLTASQSNLTKELNFTTRAKDAIMQIWLNARRPTSAVPKH

SEQ ID NO: 1006259 - protein, 106 aa, Homo sapiens
CWLQSSSLPFLITTIPMLHPTVTADGLETALGQSDSRALTAGDARCHFTGASSGEAVQDTERDSVVYACQCLRVCGMDMETSLTVLPSQTANAPLNRKHPPVTLRA

SEQ ID NO: 1006260 - protein, 150 aa, Homo sapiens
LLDGESRRQALQEGATIVRKLCRQDASLGLGLSPHHLVGAAVVEGVSGQDLPVVKHTLGERLAARVGPQVSGEAKGLVDGQIGLDTNMGVRPPGTPRTRGPASCSKPRRCHRPPALDTGSPQGRMGSMRRDWEVSTLAERQRRAVGMNLA

SEQ ID NO: 1006261 - protein, 48 aa, Homo sapiens
MSALCTAVTFLRTFSCASLKAYSAMRRDLALGLIFRLSNIPAKSHAQG

SEQ ID NO: 1006262 - protein, 44 aa, Homo sapiens
MAKSEHHSPIKLLGSSAVISATHLSSINAPIPRQQCAIETSKTR

SEQ ID NO: 1006263 - protein, 36 aa, Homo sapiens
TRAGTLSLLKTTDKLFEELLFSAYHIKDIGRLINDR

SEQ ID NO: 1006264 - protein, 114 aa, Homo sapiens
MSVLQEDACYNCGTRWPHCNGLHCVPETSETQCCYNCGKPGPLARDCDHAADAALLLLVETLRTPFKKTCTKVTVLYGVVNLVLEPLNVQHSPVTVHLLPLWRVTWHLARDMPI

SEQ ID NO: 1006265 - protein, 123 aa, Homo sapiens
MSILTGCQMLPGLCVLLQAVRCAPVVWGAAPRCQMLTCRCGCCSRLSVARLGLWVLLQAVQCSPGCLGTVPGCQMVAWGCRCCSRLSRAHLGLQGADPGCQRLTWAWGCCSRLSDAHLGVRVL

SEQ ID NO: 1006266 - protein, 67 aa, Homo sapiens
EVFNVQKMRNVLHQTSLLLVREGPRAQGWHSFRINPFQVKGESLKECLGPQYMERDEGYRKLPEIPV

SEQ ID NO: 1006267 - protein, 91 aa, Homo sapiens
ACDLEDPFCGAFPRGLRNNSSCGVEQLRSPKQVLASDLRAMQPCLQMGAAVFEHGVILQSGRTGPRRRRIACALGKILKLGGGTRAAATVP

SEQ ID NO: 1006268 - protein, 46 aa, Homo sapiens
PLCGAFPIIFIISISDTGPDSSLYVASSFSIFTATVTGLVALVLVK

SEQ ID NO: 1006269 - protein, 56 aa, Homo sapiens
RILFAVPFTLQEVVAAQQRGGPLGRLGCARQVSSRKHASRELVKEPAMRSETDMPD

SEQ ID NO: 1006270 - protein, 111 aa, Homo sapiens
DLDDAYAVPFHHFQPFQAGGPVATLGASAEVAGHDAVSLTSPNRSGSWSQPQRHPGGYRCRAVEAGSRVEPVLIVREQALCAWPCLTGIHPIRGTFSLPGTFWTERLPRRS

SEQ ID NO: 1006271 - protein, 101 aa, Homo sapiens
MRQDGDRATGQDGRAGTGRGGQEERGSSRDPVAELPSDGEAEGTADLEATPEARPEEELTGEESEAAQTSCGLLGVQWGGLTHSVTKGQGPELMGGPRPQL

SEQ ID NO: 1006272 - protein, 37 aa, Homo sapiens
SFAVLSTQLSTSTPGHSNTAGSNATASSPGSLLLVKL

SEQ ID NO: 1006273 - protein, 77 aa, Homo sapiens
SSRILFAVPFPTAVHIQVTAWSGGYSEHQHILQSPQRRGETARCRLLVGLGGHQLLHSQVRGLGAKVNLVELGKSRD

SEQ ID NO: 1006274 - protein, 80 aa, Homo sapiens
LEILCGAFTPGPVISRRREKEGGDRRALSKAAGATVCGHALPHTRGIPAARPIHTGGRRGCLNHGVTRFRPGLFCETYSQ

SEQ ID NO: 1006275 - protein, 39 aa, Homo sapiens
MSKWSSSTTLNPSLAGSEDRGEDPTPLNTMRGAGDLHEG

SEQ ID NO: 1006276 - protein, 37 aa, Homo sapiens
MTLTFSESSSGFSKSMVIPSPRRRSEDSEKVREKVQV

SEQ ID NO: 1006277 - protein, 77 aa, Homo sapiens
MLGRLTSSDRPPRSPKVLGYTGVSHNARPLGKFFEMLFLILTTPRDRCAVSCTVCWDWKPSLFGSKPCGVSTQPLHT

SEQ ID NO: 1006278 - protein, 54 aa, Homo sapiens
ALETRHTDLLAYLTFLAYLTFWRLKQQGGAGKGAVQPLRDSWELDCCSSPECPG

SEQ ID NO: 1006279 - protein, 37 aa, Homo sapiens
PLPTESVARRTTSHRRHPAPSRPRKSPSTAVTDSAYS

SEQ ID NO: 1006280 - protein, 36 aa, Homo sapiens
IPGLLAYLDLLAYLTFCIPDLLAYLTFWYARRSRYA

SEQ ID NO: 1006281 - protein, 37 aa, Homo sapiens
TGQISRAALYLDQDQSVLSRRINALERECNARLFNRT

SEQ ID NO: 1006282 - protein, 34 aa, Homo sapiens
YLDLLITSPTNTYAHFQKLVHQMFPKPRINPSAT

SEQ ID NO: 1006283 - protein, 38 aa, Homo sapiens
PCSIHDQVIGLLAAYGGIVCQRREMAVVGAFAAQAVAT

SEQ ID NO: 1006284 - protein, 54 aa, Homo sapiens
MPAVCVKRLANTLLGCMMKRYLIIAVAAGRYSSVTAITMRSTARQSEGAPAYPP

SEQ ID NO: 1006285 - protein, 48 aa, Homo sapiens
TLEDPAALAVYMGINMGSFIAPLISGWLIKSHGWHWGFGIGGIGMLVA

SEQ ID NO: 1006286 - protein, 44 aa, Homo sapiens
YHELEKKQRRLTVALAGHSGAERGTLQAEESARRKLVLVYRVLV

SEQ ID NO: 1006287 - protein, 120 aa, Homo sapiens
VCTGGKRWNVLVQHEQVTVWQAVRALLLAVLVYRAQGNVACIVNVEAMMELNHDHNERDAPALALLPARMDTPGARVMLLAIGLQESRFVHRRQIGGPARGFWQFEKGTRASRGGVWGTE

SEQ ID NO: 1006288 - protein, 108 aa, Homo sapiens
MAAGTCNPSYQEAESGELLDPRGRRLQWAKITPLHSSLGKKRDPVSKITELKIFKAMRDGSRLYIPALGEVKAGRSPEVRSSRPAWPRDDETPSLLKIEKISWPWSKW

SEQ ID NO: 1006289 - protein, 41 aa, Homo sapiens
MASGERCRLRCPSRYQPNDCSLERKPPYSLQRFDSIDTTLP

SEQ ID NO: 1006290 - protein, 62 aa, Homo sapiens
MKDINVKPESMKLLEENIGDMLQDTGLGKDFLGKISKAKATKANIDKWDYITLITCSAIALR

SEQ ID NO: 1006291 - protein, 34 aa, Homo sapiens
IRIEARTLLTSKGESITSMPKTVAAPTKAPKNWA

SEQ ID NO: 1006292 - protein, 58 aa, Homo sapiens
DTEEDDFLVDQVDTVKVLLMNAFRHVNIQHCQKLSSWVLLLKYLGNATAHQFFHACMT

SEQ ID NO: 1006293 - protein, 125 aa, Homo sapiens
CLSLIDLAFNLRYGRFICCDDPFSPEDFYHKGAVLRLWMTFILQMAYPPSSSSDPSIFHIQENVMATGIKRLDRHFTFYSQVTQWKIQSQQRLVRKMSTDKRDHKEEAGDQEVCGDQIQGPATEE

SEQ ID NO: 1006294 - protein, 77 aa, Homo sapiens
RIPLGPKFSSRLDEAPLPSAPGGCCKWTMAASSICSSKFKDSSASYGFGPGLSAALAFWLQPQWRLQAPRSSYYSNN

SEQ ID NO: 1006295 - protein, 79 aa, Homo sapiens
VSTSALAKIRHLAQQLQSEQVFGQVYESPLSPSKTVCFFRAIVVLLNWRIKQDHPWHGCEWLTPCKSYALLGRLEDVWD

SEQ ID NO: 1006296 - protein, 105 aa, Homo sapiens
MDTSWALVPQLVLGNERPKGKRDDPLNIATVPKLWSSLYALNSFLLELTYTLLVSSLSTVIKFFSASLKECGTCYMWDSSYYTTDEAYRKVRGNSVSSDIAHRVS

SEQ ID NO: 1006297 - protein, 34 aa, Homo sapiens
LTSALSGLGTFNMQQTQNFRATDWVLILGSAPGE

SEQ ID NO: 1006298 - protein, 36 aa, Homo sapiens
HKGGGKLGFDYMRPLLGHSKQVFHLPMCSEKCKHSS

SEQ ID NO: 1006299 - protein, 54 aa, Homo sapiens
GKRGNEKLLGQLSKDIPGPKNAIPLRERKQDCKGIIFSLNEESGLSVLILCPGI

SEQ ID NO: 1006300 - protein, 70 aa, Homo sapiens
PETHVAESVSQQILRQNFGSNACDVPVTKTKKKKAEGTCTPTKTSRSSSRNTSEARLPGGHGEEAYQALK

SEQ ID NO: 1006301 - protein, 89 aa, Homo sapiens
CRSAMAVRKRVWGGLRKLTITAEGEGEAGTSGHVGAGETERVKWEGCTLLNNQIPQALTQYHENSKGEVGPHEPITSHQVPPTTLGITI

SEQ ID NO: 1006302 - protein, 36 aa, Homo sapiens
TGGRVIAPRRRACAAAKAQKNLKSESEEDRTLRVIK

SEQ ID NO: 1006303 - protein, 72 aa, Homo sapiens
MDGCRWLTRVIPVLWEARWADRARTLAEKQDGSREQQLEAWVQILRLWGAVVGAQNITARIDEPLVLKCKGA

SEQ ID NO: 1006304 - protein, 95 aa, Homo sapiens
MAVTSVSVMPLVLLVQRSSWPVCYSWQQTGWQVVGLGQKVSALVIAVLLSTGGLCGSQALDPKSFVSGAFPGLCLEGSTSFQPPRALQPADATCP

SEQ ID NO: 1006305 - protein, 83 aa, Homo sapiens
LSSEKGVVRVLGCPHKVLPDRSAVGLEVGIGREAQLGRRAVQDSVCPLLGLESAVGGSILRPTGLCFVDSLLLPGEQRHSGAT

SEQ ID NO: 1006306 - protein, 34 aa, Homo sapiens
LLTSDPPAYIGYRPTVPHAAEMDPELLAKANPST

SEQ ID NO: 1006307 - protein, 37 aa, Homo sapiens
ADRRTLWEAVRTEATHQRGHGHKSHPTPSTWHRSGQD

SEQ ID NO: 1006308 - protein, 75 aa, Homo sapiens
RGRLLLSEPCGEARPPQEHYRVSSASCRALPCELRPPVRALPCELRLLSEHYRVSSAFPDRSITGVSSAFPIQSI

SEQ ID NO: 1006309 - protein, 53 aa, Homo sapiens
ASESSATCETGETCVYPTQPSVSQKNGYISREPQGQRGMSRFGDEHDRVDSTF

SEQ ID NO: 1006310 - protein, 66 aa, Homo sapiens
MRIPRLYLLSAVHRIVRTGRSGNTGIDIYFINKACDESVLMDPQSAVVETPEQKVDAGTEAPNFGN

SEQ ID NO: 1006311 - protein, 102 aa, Homo sapiens
DSTGSDLPLGCMAASMGQVLTLVLDGALWGGTQPCCSGLRRLQRVHEPTGAQQLLQEMKTLLLEYLSTLMPLSRSTKCGSHSRIYLTFGIDQDLTPGLCPNL

SEQ ID NO: 1006312 - protein, 50 aa, Homo sapiens
MTLEAGHWRGLHELHPPLVLSFLTRYTRCQSFSTLDTELLDLLQVALLLL

SEQ ID NO: 1006313 - protein, 199 aa, Homo sapiens
KLLKRGGGGREAVHDPWTQQVRCPSVSMWCWAQVCEQASEQGREGAGITHRGGGHHCTSSFASSEAAQKGILSMRLFKKCRPSSWGPFCSSGSWANMKITVLCCRLDVAALPGSSTHSRPSAHNAPRAQKARVSLRSSFLAMCSWDADSAISRQPSSSSWFPEEVHFLQVRAFPEQGYEGLRIVELELTLLQLSVSFCL

SEQ ID NO: 1006314 - protein, 86 aa, Homo sapiens
VGSGWDDAVSLTYPIDLGHGAKPSATRRYRCRAVETARVLNQFSYVGSKLFVYGQLDGIHPFFGLSAFPEYLRKGARALTKYLLVH

SEQ ID NO: 1006315 - protein, 40 aa, Homo sapiens
VIRRYFMKLTSSQSTRHCNWWVTNRTVLDLRCIRIALYAD

SEQ ID NO: 1006316 - protein, 58 aa, Homo sapiens
SGILQVLSLDPNQLFMLQPRSQEVSSPTRLPQPCSMRHLVSHYLDIASVHRRFHSSRL

SEQ ID NO: 1006317 - protein, 56 aa, Homo sapiens
VLHVEELALERESVLAGGLTEDLHWRGQLLHQWRLLQHEAEDDNGFRWRRGSRTLD

SEQ ID NO: 1006318 - protein, 54 aa, Homo sapiens
MNRNAYDGKDNIALNEDLSSLDRGGQPRVQITQRKEEAARVADQLRAYLEGPVQ

SEQ ID NO: 1006319 - protein, 41 aa, Homo sapiens
DPLVHAVDISDTYTYYYSSTTECTHRPVTQVTQDSLYQELC

SEQ ID NO: 1006320 - protein, 130 aa, Homo sapiens
MSQLTHLQEKQLWLNIISWPENMKQHLHFAIDVLSHRSSRTSRNTFGDVGLLTLDVQLHTEGSCLIMTTEILRSMLYSGSDVIRDLEWVIFEEVHYINDVERGVVWEEVLIMLPDHVSIILLSAAVPKHR

SEQ ID NO: 1006321 - protein, 117 aa, Homo sapiens
ACRIRYLVLRPLTAYILMGMSDHPEQTSYTYVLPESFGTPLPDTIDQMLRVTGMKHRKIPSHTRTVKDGQQKGPHSLKAQTSFIASSKGAHCSGTDSLARNGQLVHDSESYRDKGLR

SEQ ID NO: 1006322 - protein, 46 aa, Homo sapiens
LEVSLSSKGLIGSHVRPSSDRTGSCFILASSPLVSPPHMHAPRVTS

SEQ ID NO: 1006323 - protein, 74 aa, Homo sapiens
LAGAYLHLVAALVVNASLLAEGSTTSGAMYSAEPQGVSSSGVEIGEQSPVEFGCRCPVSERHRSSLGETLVEGA

SEQ ID NO: 1006324 - protein, 98 aa, Homo sapiens
LEEFGGRTLDPRVCLGSRPPATIRQDKPNSGDVQVTEDACAATDTEAMTTKGPAEKVPDQEDRAEQAEQTVNVLAQILKRLKPERKMINDKMYFSLKE

SEQ ID NO: 1006325 - protein, 70 aa, Homo sapiens
SCTGRFVSSIWVDASLCSEALGALLNRHHVPGENPTIQTAFRFVKQENQSSGHIKAKVGTAGPFFKAPKV

SEQ ID NO: 1006326 - protein, 39 aa, Homo sapiens
WCSSGSYTRSLITANEYIQIDLETGRITDFIKFDTGNLC

SEQ ID NO: 1006327 - protein, 34 aa, Homo sapiens
DSILTRTLKPDRKLLTAGLRAFQQEGIANITCLK

SEQ ID NO: 1006328 - protein, 103 aa, Homo sapiens
ATAGWDEVGDAFEKEETFTLSTIKTLEEAVGYIVKFLALHPAERSDKLPDYKNTHSLLLAGVFRGGHDFQNPSRLLLLDTVTMQVTARSLEELPVDIILASVG

SEQ ID NO: 1006329 - protein, 91 aa, Homo sapiens
MERSGISDFVFCVRDTNFGSLAYASHSLTEYQRLLSTNAARDSYCLSAVFGFRKLLGTVRLAGVKVREEMSGSSVYQELRCRDGRLPFTWS

SEQ ID NO: 1006330 - protein, 40 aa, Homo sapiens
MAQNFITICYSLISSSEAPSFKNGAPKTEKSSSPRISYSP

SEQ ID NO: 1006331 - protein, 44 aa, Homo sapiens
EELYSIPNRQIPNRTLLTRQETFDAGLQAFQQEGIANITGLQRS

SEQ ID NO: 1006332 - protein, 36 aa, Homo sapiens
PVSRGSFGCFPTPVEGIEFYTFINRARFEELCSDLF

SEQ ID NO: 1006333 - protein, 35 aa, Homo sapiens
EHQRLISVVCGMYRVSDGIVNPVATQGWRDTNTFS

SEQ ID NO: 1006334 - protein, 54 aa, Homo sapiens
LSSPLLMSSGGGGGDGDDGGCDGDGGGGGVLVMVVDSGDGGSGDGDDGDGSNCA

SEQ ID NO: 1006335 - protein, 53 aa, Homo sapiens
GPVRGASPGIRYDQVAGLYLQQLQNLLEALLAGGGNLATGFQKYTHSLSSPIM

SEQ ID NO: 1006336 - protein, 55 aa, Homo sapiens
CIPGVQKQQLLGERGEEHSPLQRDSLMPSYESERFRQAWTGSSQRSSRHLEEDYA

SEQ ID NO: 1006337 - protein, 37 aa, Homo sapiens
IDFKDGTVAPLKTVFLHDPDEKVPFHIINESTEQRYL

SEQ ID NO: 1006338 - protein, 35 aa, Homo sapiens
AALAPDQHVIQVIRVWRSAAGGRTIVGSRSAPSRY

SEQ ID NO: 1006339 - protein, 74 aa, Homo sapiens
APGVIHRHIHVPITVLIAHVDGDPSSLAGMALEKLSIFVKTVTEGGAAHRDWQDASVNDLLVEVGWNTSGGSDP

SEQ ID NO: 1006340 - protein, 45 aa, Homo sapiens
DSDPGMHCILWMSRLVFTTEVDASLTKFRRDVSTVLTSKYRSAGA

SEQ ID NO: 1006341 - protein, 40 aa, Homo sapiens
MRSFWVLSESPSQPVAPVGWAGLPGPAFNAADVLIFLFMV

SEQ ID NO: 1006342 - protein, 56 aa, Homo sapiens
GIQPVRRAQRSFEDGAVDQLAGVVNANAVSTRRDRAFALGQNAELQARLGAVHAFA

SEQ ID NO: 1006343 - protein, 42 aa, Homo sapiens
RPAIGDGYRRWISVLADACDMDRYGGRDRYDDRGSRDYDSRL

SEQ ID NO: 1006344 - protein, 44 aa, Homo sapiens
SPRRSPVGRHYNAVLASAELVALKMFCRAELYWLHAVSPLGGSS

SEQ ID NO: 1006345 - protein, 62 aa, Homo sapiens
EADCDLMLKQREADVAAASRSLRGEWLEVALRLGPGLSWLSWHMSRCSSRSTMSISRSASSC

SEQ ID NO: 1006346 - protein, 151 aa, Homo sapiens
MCEGAAGLSLDGLTCCGTCSRPEFSKSLQLEYRCCDFQKLRLGIYDIDNKTPELRDDDFLGGAECTLGQIVSSQVLTLPLIAEAWKTCLGGGTITVSAQDLQDNRVVTMEVEAETYDKKDFLGKSDPFLEFFRQGDGTWHLVYTSEVIKNT

SEQ ID NO: 1006347 - protein, 33 aa, Homo sapiens
VPSTPWLLIPRRREKEGGDLASALQGQLVPLSA

SEQ ID NO: 1006348 - protein, 119 aa, Homo sapiens
LQNLVSNAVWDAARQTVLGKANGLVNQFNNTDKFLRDMDSGVNQQISDTAQQINSYSQQIAKLNDEITRLRGSAGREPNALVDQRDQRVTELNQLVGVQVTQQDGDAYTVSFANGLTLV

SEQ ID NO: 1006349 - protein, 85 aa, Homo sapiens
SLGRRHGPIISPDITKVLQYLNEIKDSVVAGFQWATKEGALCEENMRGVRFERHDVTLKADAIHRGRGPDYSPQHGAASYASVLT

SEQ ID NO: 1006350 - protein, 57 aa, Homo sapiens
GRCLIVLQNVGGGEAGHTEMSAAACMRGLGLDCALCPAQDSDDFEALCNVLRRPKAQ

SEQ ID NO: 1006351 - protein, 58 aa, Homo sapiens
DRSTGSLPGIPPLLAGISHAHLRRTLWGAFFSELLSRTPDGLVSRGTTEPATGLNGWQ

SEQ ID NO: 1006352 - protein, 75 aa, Homo sapiens
CIHSSVARISQASVCLLYPDKTPQAAEQVLVYPKRTPKLGPACAYQVSAKWLLEQNRGRSKWRRFRLISDFVEKV

SEQ ID NO: 1006353 - protein, 42 aa, Homo sapiens
GTAGSSSSLLCGHAIISQLFVGLTERRHCEGPILYVTARAVW

SEQ ID NO: 1006354 - protein, 138 aa, Homo sapiens
YSKIQMRSVSNTLYGGSHCFSVARITWVKKLMWELTKHSRSSKASGKAVFPDGNAAVGAAEVDVQLSEMAAMRIWSKARVKKAAKVLQKGTVLLLGGTAHRDAHHVLLSNVALDEAVRVLLFEDLREGGIFGVPTRTS

SEQ ID NO: 1006355 - protein, 58 aa, Homo sapiens
KLIEASHLITATSACLSSIMCEHVIAVLYSLSPDANHSASIQLCVQKLRILIEDSDQN

SEQ ID NO: 1006356 - protein, 69 aa, Homo sapiens
RERHLGCDFFSALSATLFFISAVMHVLSRAVFTHSWPVSRWVDSRKRDSRAEGSTMHCSRAGMKMMLSS

SEQ ID NO: 1006357 - protein, 85 aa, Homo sapiens
MPRAHGLAISGPVVVTGSHPVLRSLFTSDLFLRRSVLQATDDNGYLLAEMISLLGYHPVKDVVKACSGWVNNRSKANRTLASGVE

SEQ ID NO: 1006358 - protein, 64 aa, Homo sapiens
ALEDLLCFGSAQMSIMHPLPKSYYSGDFAGGELPNLYISPSAKYTPPEVRMRRSPNEVPWSRQQ

SEQ ID NO: 1006359 - protein, 66 aa, Homo sapiens
MQTKRGGAVHITYGGWSHRLDRLLNSRSTIQGLHKASQSPRETSPNARQPENTGVHLPPSREEMTR

SEQ ID NO: 1006360 - protein, 40 aa, Homo sapiens
ERWKCDGDNDVLDNSDEAQPSAIEHCPRTIKWKTTVISTY

SEQ ID NO: 1006361 - protein, 66 aa, Homo sapiens
SWMVGSWFWYECHDITVNPIHILCSRFVDAYQHSFIAVIQEDEERTLWAMKILDRAHMSRVDWLVP

SEQ ID NO: 1006362 - protein, 37 aa, Homo sapiens
IPSEQLAARVCIKCLACTTARDEDRHQGGHCVVGEGQ

SEQ ID NO: 1006363 - protein, 34 aa, Homo sapiens
MIELGTAELCSTSQMERGHRLPGQCFFPQEPLSV

SEQ ID NO: 1006364 - protein, 62 aa, Homo sapiens
YDLSFTVRVTACDPLCSCALVPLPRWPSGKSGDRGETGPAGPAGTVVPVGCPWPRRTPMAPV

SEQ ID NO: 1006365 - protein, 35 aa, Homo sapiens
SSHHFGEDAFLPEIFSTISDWTFQESLDLSESYQS

SEQ ID NO: 1006366 - protein, 47 aa, Homo sapiens
VRGETAAGPPCAPGAPGAPDPLALLARVVIVVRLVLLVPPVLSALLA

SEQ ID NO: 1006367 - protein, 51 aa, Homo sapiens
TAGAGSSGTSYIVVQLMLIQLPGSTEESSIPKVACPGLPTPYCPPTSSQGG

SEQ ID NO: 1006368 - protein, 39 aa, Homo sapiens
YDRARYRTGDVVEEAGLCQGVICPSRGTLCWCCVTLVRE

SEQ ID NO: 1006369 - protein, 42 aa, Homo sapiens
FDSDSPARNYMAANVHSSLYGNKVLLVLAQAASAVAMTLVLT

SEQ ID NO: 1006370 - protein, 36 aa, Homo sapiens
ERVCGCRMRLEVLEQEEAEAREKVTHTHKVVRAARS

SEQ ID NO: 1006371 - protein, 55 aa, Homo sapiens
YRIELGTERVMRLDGSLSDLSLTGEEPFPGGCPGGSGSALSAQSTECPVRGYSGR

SEQ ID NO: 1006372 - protein, 118 aa, Homo sapiens
MSECRCSSLKMASVRARNLDYDTLPVLIHVQRANQAADALPGAPTSRASGPSKQAVPMCDEMVASLRGTRRMTALARGLVGVFTRTCRKPVSVPVLPVAPGIPLSPETYAIFIHNRII

SEQ ID NO: 1006373 - protein, 100 aa, Homo sapiens
QPVRTGDAVGYTGCDWTTVTTRDPSDPADVWCLGYEWLSGGCKTGHSAWVINTGLTIIIVGLTLVEVLGYMSLLRFRQVIKLSLTPRDSFPWGVSPEDYS

SEQ ID NO: 1006374 - protein, 41 aa, Homo sapiens
PVKPQGLYELDGLCRRIGTGRHVRDSLMELSVGLDAPTLDE

SEQ ID NO: 1006375 - protein, 59 aa, Homo sapiens
MRSRSSSGTRNLTAEVQIIGTSIYINENFHGGFLGRIWVCDSGGSKIDDRKRCTGAVAV

SEQ ID NO: 1006376 - protein, 34 aa, Homo sapiens
SVSSEHQAGMTTPSGWVLRGQGKTLGLVGDAEET

SEQ ID NO: 1006377 - protein, 76 aa, Homo sapiens
AAILFLANASCPNVIYHWLHGLSGYELQNCLDECRGLRCAPCTNSVFWLNPCANTPLSACHLTPASTCLYADTPAI

SEQ ID NO: 1006378 - protein, 47 aa, Homo sapiens
EQCACWLKLSERAGIDPRTLFHAPDRTPNTSHDCTLRDTFSAISCFL

SEQ ID NO: 1006379 - protein, 140 aa, Homo sapiens
AGRERTDRAIRLEQRLGDLLPALQPALADVTVGQALDMTGGLPDVRETLGLLGISLHAVSEAQPVMQFVEGLERLNYEAGSEIAYSNTGYRLLEAALRSKGYDFDQLVQQHIARPLQLQMRAPESWFDVVPGLVPGYWRA

SEQ ID NO: 1006380 - protein, 34 aa, Homo sapiens
FETDCGKYRRRTAESAEVERWARRHLVGRGVVLL

SEQ ID NO: 1006381 - protein, 77 aa, Homo sapiens
CGPKDNNMDKMSLAEVPNQRDVSGNVHAGEHVGKHPMSIMCLIGLEFISKMYYAPTWIHMNSAELACPQWSSVLVGR

SEQ ID NO: 1006382 - protein, 36 aa, Homo sapiens
MVALTVAGAGLRRIVDDDLAACRKFRSARKQCAKTK

SEQ ID NO: 1006383 - protein, 63 aa, Homo sapiens
GALSAIARGSDSVKRLCVWKPTTRASGSSLPPGSKNMIPGGPNRRKRLSSARSSALLAVTLAC

SEQ ID NO: 1006384 - protein, 66 aa, Homo sapiens
ADSVTNSDQRSPRQLQVQDYRRHIMLAYFITVSYEDSVLQMYSLQLSDVHVIGGRCEEFAYLSPDI

SEQ ID NO: 1006385 - protein, 51 aa, Homo sapiens
RSLQALAQHTDCSLIDVVSMLTCELLEVLAWPLSTDGQVLASWQPESKYFQ

SEQ ID NO: 1006386 - protein, 92 aa, Homo sapiens
LRVMVSSSSGISSVALLQQYSQCLWLRYVYCAPLLTEQERAYARSTDIGELCIAFWEICFLDQMEPDYSVGLDAAPKHARTRTHVCTLAMPL

SEQ ID NO: 1006387 - protein, 45 aa, Homo sapiens
MVSTKSMQQRYNSLQPRGKRAAVPVQGGDTSEAASALQKSEQKVD

SEQ ID NO: 1006388 - protein, 109 aa, Homo sapiens
HVCTIWLCANPSSGRLPSIVCSLRRTARAEWGLPPCSLRWPYLLPGLAEAILSGVWGCRSCLSCHPCLAPSLCCSGAQSDLSRSSAPTRCRGPPCRAMHSGAIASAAIA

SEQ ID NO: 1006389 - protein, 38 aa, Homo sapiens
AEIRDVELLLSFFKPSMVSSKERLNNAIWKSLFQLPLG

SEQ ID NO: 1006390 - protein, 45 aa, Homo sapiens
DYQDVSQSYHRRMKATHCSPCKKVLSSSSGGPITSTGQAHDLLVK

SEQ ID NO: 1006391 - protein, 74 aa, Homo sapiens
ALLSGSRVMAAESWLYRTHAGEASGDLTSRQKAKEEAVHVSGHGLSGETGEEVKGGGGLHAFLYKTQDPNQGRS

SEQ ID NO: 1006392 - protein, 195 aa, Homo sapiens
SRGPLCAQNRRTKKDWNSRQRTDSNVSLNFLTPLRNFIEGDYKTIAKEQELFANKRLDLDAGKTRLKKGKAGETRNSSEQELRITHSEFDRQAEITRLLLEGISRTHGHQLRCLNDFVERQMTYYAQCYQYIVDLQETNWEVFHPNYLSNNNQTSVTPVTSVLPNAIGSSAMGSTSGLVINSPYKLSDLKECSGS

SEQ ID NO: 1006393 - protein, 70 aa, Homo sapiens
MKLAPIWDLYSGGRLARQLHGGTGFWRTEGEQVVDVNLEGARDFSTDMFDFNFGRTKKLKGSLGATGEIK

SEQ ID NO: 1006394 - protein, 73 aa, Homo sapiens
VGGVRAGLTSAYFFVSSGLHLTVYHWNSGFKLFLGDLSFITVWRADSDALAALWAASSAALMALRMSLVGGGH

SEQ ID NO: 1006395 - protein, 46 aa, Homo sapiens
TQADRLSTPAMNASTMLRHAGTVLSVRIMTWCITCYNTKKHDHKME

SEQ ID NO: 1006396 - protein, 52 aa, Homo sapiens
CSFVYSQLIRLSPGGGRPDSCGCLAAGCRLLQAGNLVGGLGQAPFGGKQGNS

SEQ ID NO: 1006397 - protein, 46 aa, Homo sapiens
RISCPRTEQENYGGFEAHQEAILLHCPQLDGTQQCAAGAGPVTSSV

SEQ ID NO: 1006398 - protein, 74 aa, Homo sapiens
VDFCSSRASPLSCVSSSGKLPGSYPVPILIEGVGTFVSVLIWRKFLGVVKDTGLLGRGLGYLETILRYTAVHPC

SEQ ID NO: 1006399 - protein, 68 aa, Homo sapiens
MHSRLLIIGVYVAGKLTTGTSRTIASMRKFKALISIARRSVMMIIAIGSIYRARVIITSGRRSMAIRI

SEQ ID NO: 1006400 - protein, 83 aa, Homo sapiens
MTSALNLDTSSLPGGLHFSGPKVEGGVKGGQIGTPGLPGLEVVVWGPSRVNLGKGGILGNKGKQFPLKQWKGFPQEFLTLSSL

SEQ ID NO: 1006401 - protein, 89 aa, Homo sapiens
ERRRGGSTPLDTEAGTWSRLSASRPAQGLPAEPTEIQTDGNVVIACLVQGLLPPGATQCDLERKRTGRDRQKLTTQPVMPPGTCTPRAA

SEQ ID NO: 1006402 - protein, 38 aa, Homo sapiens
MTETVAFDLWGQVIPGHRLHSIPDQPQGTSRMSTLQAP

SEQ ID NO: 1006403 - protein, 115 aa, Homo sapiens
SRHDGRYYYMDVWGNGTVSVYSASLTAPVFPLSLDSTPKMERGRRMPGTGLLTPGATQCDLERKLDRNVTDRNFPPSQECSVDLYTTSSQLTLPGTQCPDGKSVKCHVKDYRNSR

SEQ ID NO: 1006404 - protein, 45 aa, Homo sapiens
MQDYCCVGGDPSRTRRDQVGPVRPSRPCLGLCSGSRYESNRIMHT

SEQ ID NO: 1006405 - protein, 62 aa, Homo sapiens
GYKVVPRQAGRGMAVQLVAVGVVAGFSVLAGRLQSLAWSRDVALELVTVGVVAVVLTCGVAQ

SEQ ID NO: 1006406 - protein, 34 aa, Homo sapiens
MGTEGKGLTLIRGSGRWRQFWNAQLKQNSTLLPA

SEQ ID NO: 1006407 - protein, 63 aa, Homo sapiens
TQASRFTFLSQGHTGSSPVKITFKPVNPQLGSSFDDVALMEGEPTWMIKALANVGNRGCCRGK

SEQ ID NO: 1006408 - protein, 96 aa, Homo sapiens
SCGEDVEVSGAGAAEARQQDCAPVTQDTDEELRRAGMANSLSYADKDVPKGNSSPCGARRCSMGNKEWVVQADLPLNAGIRQSQQTLYHSNPILPA

SEQ ID NO: 1006409 - protein, 39 aa, Homo sapiens
QERELEQWIAEREVVASHELGQDYEHVTMLQERFREFAR

SEQ ID NO: 1006410 - protein, 33 aa, Homo sapiens
VDENWRGGDCGADGAAASLPPEVLRPRVAVVLE

SEQ ID NO: 1006411 - protein, 79 aa, Homo sapiens
SFSGSRELCQWIFRLTLLVAACKDTLDYYCRKQTKDDEGLTEGRSNRLERQKSGRSFWQVSNRLGTHTNKLQLIAVKSS

SEQ ID NO: 1006412 - protein, 100 aa, Homo sapiens
AERMNQFIFFWGGSLTLSPRLEYRGAISGHGNLWLPGSSDSRASTSQVAGTTGVRQDAGKWCFGNAVSFCGPGWSAVMQSGFTETSCLWGSRDFSVPQTP

SEQ ID NO: 1006413 - protein, 50 aa, Homo sapiens
HLAQEHEHVVQESLQALEAPWGSAVWAEEEVDMQQRASEGPLGNKFPGPK

SEQ ID NO: 1006414 - protein, 44 aa, Homo sapiens
RNLRYSEHTLYSRYLHEAIPPMIWMIHLSLPRCSEPKIMADGWL

SEQ ID NO: 1006415 - protein, 50 aa, Homo sapiens
ESDSVIYSLYTSGYHSPNGLRALLVTAVHFAIIQLLITIHSHVIHRGWVA

SEQ ID NO: 1006416 - protein, 74 aa, Homo sapiens
MRERVCTYHISEGHCLRELSLWVDHYCIFKAFAMIIDTLEEDISRSMTNSTAASRPVLRLVALLVSVALSLEKV

SEQ ID NO: 1006417 - protein, 76 aa, Homo sapiens
MSELRAWPGYFRNHAQSPKRNRREKKRPAAPGGDQAIPLPQSGGGLLPRSHHSDAALEKQAHTDLGPAVSYLPPTS

SEQ ID NO: 1006418 - protein, 44 aa, Homo sapiens
MDGRQIIKPREEPQLAEEKVLESSTRSMTLAERPCDRIPLMSLK

SEQ ID NO: 1006419 - protein, 56 aa, Homo sapiens
MYGAVPVLCLESSCDHKQPRHLNTTRVGTTARTTTGHVLHGETGAHVTHTGHDSHG

SEQ ID NO: 1006420 - protein, 62 aa, Homo sapiens
LEDPGMRNVTGMRNVTGDEERHSRDCRPFQPEKHRHTKGNSVTPIPSSSLGTTWTRLSQNNT

SEQ ID NO: 1006421 - protein, 34 aa, Homo sapiens
WTAGRGDPAGFTSREDTPCTAKPRFQYHPLTARE

SEQ ID NO: 1006422 - protein, 177 aa, Homo sapiens
RAGDSSRILQERELESAETVVQIGRLLPCSCVGVRVAESSAGGLGGTGRREEINFAILDLFHNGTHLTGGHRFFLVLSQVGILSLQQAAVVGNLLLQPASSHPSRILYTWFWWSILAAKLGQLVLHAANHALDLGKVDAVAVLCLRQVGLPGNASMLSWDLGLYLARLHCAPEVRGS

SEQ ID NO: 1006423 - protein, 136 aa, Homo sapiens
MFTLSLCTVDPPTATKEIQYLNAKGALTYTDIAGDPVLYGNLPPREISMKDVFRSGDTAKKFEDVLRVKVGIRYSAFEMYLLLITFLKASPSFRNRLLGDIAKNAYLFGTMIIDQCFHVRSDVAVEIVQVKFNVTA

SEQ ID NO: 1006424 - protein, 52 aa, Homo sapiens
MVRRKTQKKVQREQEKRHPLMRAATSSSSSSESDDDIGRRGRSSSERCPPGS

SEQ ID NO: 1006425 - protein, 55 aa, Homo sapiens
DLEDPPISCTILQAHKNTVAVGCESLSLRPFGSKKPYEQISRKLVTHKPLGLSIK

SEQ ID NO: 1006426 - protein, 75 aa, Homo sapiens
MSCDADARRQFASAHMQALDGAYHELSQNCLCTGRHVRIPAHTVAALTRVVHSQPLASPPGAPASSPTKTRYCTQ

SEQ ID NO: 1006427 - protein, 47 aa, Homo sapiens
RNDKERRCHERQGEASSSDEEQLIPAVAHQSPEMTSGVRRRSSLRTL

SEQ ID NO: 1006428 - protein, 52 aa, Homo sapiens
EEGVGDQVGGRESPLRLRKILSRGVKTSPGNRAVASVTGKGDLGQLGRQCSP

SEQ ID NO: 1006429 - protein, 121 aa, Homo sapiens
LQEIELQSQLSMKHPGGQPGGEENRYCVQLSQIQELIGKCGGAAGQLRCEMEQQNQEYKILRDVKTRLEQEIATYGRLLEGRGCPNLTQLTRKGTGDHPVRCLTICGKRSEDGKGQSSSPG

SEQ ID NO: 1006430 - protein, 51 aa, Homo sapiens
WVTLEDLIGGQLYPYLGAEAVIRGQEIETSWYMVKPSLLKKYKNWQVLWQA

SEQ ID NO: 1006431 - protein, 46 aa, Homo sapiens
QGQPEPNQQPEAATPSLRPKATVKFTESNTAGKRTRCEELGIANTH

SEQ ID NO: 1006432 - protein, 57 aa, Homo sapiens
VILLGLNDQHGMNEDVKVKVSKVWILRSLDSRGGSPQMDDINSVPDMTVLRNTYSWG

SEQ ID NO: 1006433 - protein, 50 aa, Homo sapiens
GERTDTRRLLECAQSQLHIKCTWDEVWWSFESTTIQGTHLEALVSFVSFD

SEQ ID NO: 1006434 - protein, 35 aa, Homo sapiens
AELGKVINDGLFYYEQALLAEKFEPEYSQIKPEVE

SEQ ID NO: 1006435 - protein, 55 aa, Homo sapiens
MVKTHPYYKYKNKPGMVHTTVIPVLCEAEAGGSRAQEIQTILANTVKPRLYYKYK

SEQ ID NO: 1006436 - protein, 135 aa, Homo sapiens
VCGLGGLAGGHSDSFFRRFFSSRGNFSVAPLTHGLHVELHKLVLQAELAVAGGAGEAAHTPGLVEGRHHIAFNHMAAVVADVPEELVVVSLAVGQALLLIVPVPQEWLLTLGTDKVLHVPLVPKRVDHSALDGAA

SEQ ID NO: 1006437 - protein, 68 aa, Homo sapiens
MGYPDTDLIPTEGVKASSKLQIHQLCLTPLKQKPHITDGHMPLAETLSHSLAPQESCCTVMPRVWDPD

SEQ ID NO: 1006438 - protein, 71 aa, Homo sapiens
LNLFGDETGEAETVGQMGGCPYLWVAAVVAESSAGGLLDLLRGGDDLAILDLFRNGTHLTGGHPVLILYLS

SEQ ID NO: 1006439 - protein, 61 aa, Homo sapiens
IAERTARAVWYGVWVKVILIIMRALQTGRHLGYPGYELEGMLREEESVPEHWGTACYGGAK

SEQ ID NO: 1006440 - protein, 37 aa, Homo sapiens
VSAALDVNYLMILPSRRFGIVSWNAQMSNGDRIALLA

SEQ ID NO: 1006441 - protein, 37 aa, Homo sapiens
RIPAGERTEGRTGRRGSAGVLEGQAMNLQGGEGAAKF

SEQ ID NO: 1006442 - protein, 106 aa, Homo sapiens
MGYRVDGQRWGEGCSRFFKFSASGREVKQQDGAKNGSRKGGAQEAGRRSLSYGPSVGLSVAEGRMEKLRLLGLRYQEYVTRHPAATAQLETAVRGFSYLLAGRFGD

SEQ ID NO: 1006443 - protein, 82 aa, Homo sapiens
REEQLPASLEMSREPGIKILLDLKTRLEQEIGNYRRLLEGEDGHLTQYKKEAVTHRQVRTIVEEVQDVEVISSREQGHQNHR

SEQ ID NO: 1006444 - protein, 44 aa, Homo sapiens
MTFSGPGDPSASLLSPNDVSPAALGSRRDLCLPHMTQSCPHSIA

SEQ ID NO: 1006445 - protein, 68 aa, Homo sapiens
MVYVGLNDTSISDSCRAESARSSMVDRKKSLELRTVKNNPRVLQYYPATLLLQQIVVANGKRRYKIVA

SEQ ID NO: 1006446 - protein, 127 aa, Homo sapiens
MSGHQASAWKVWPKGSLAAALLLLLMDEFGDGAGDAAYQGPVLIEADAPIMIGIQVLDELIRAFRFPVVRQHVVQLFLEHLAEAALADLVLDQGVLRHIFVEVSTRTMMASPAPCSSLFPGGTEPKL

SEQ ID NO: 1006447 - protein, 36 aa, Homo sapiens
MQACEIELQSQLTMKAFPCGATWRETDEPATAVQLV

SEQ ID NO: 1006448 - protein, 29 aa, Homo sapiens
MVTSVSGNLDFPDAWDGTVVKESSGSPFL

SEQ ID NO: 1006449 - protein, 31 aa, Homo sapiens
MYSWFCCSISQRKLGPAGPPRLTIRPWIWDR

SEQ ID NO: 1006450 - protein, 83 aa, Homo sapiens
IQLDQRATNRIYQSELMHVQTQNCLVEDLPLEPSVTTADRRHLIVWHVLYGKLSEPMRNRWSWGSRLFCMVYFPSILLFTALL

SEQ ID NO: 1006451 - protein, 34 aa, Homo sapiens
GYQYSLINTHSHDTAAWHCSHGTLELPTVSSSET

SEQ ID NO: 1006452 - protein, 125 aa, Homo sapiens
RENCSRICLDSDQHGTKRVKVKVSNVLILRSRTAGEAPHQMDDIKVFQNEVKGNYSGPQEENISCDNLILEINSLKYAYNISLKEVMRVLSHVVLEFPLQQMDSPLDSSRYCALLATSAKRPGAL

SEQ ID NO: 1006453 - protein, 47 aa, Homo sapiens
QELCVPQNRKDTEAGSPAWTEELNLGGRWTHGAAPDEHGPEVTDLWC

SEQ ID NO: 1006454 - protein, 63 aa, Homo sapiens
SGERTDISCSALAVVPVQELNVRFRDGYHAIPGEVVLVRIGVAPAPVRGRTCGPVGTGRYRTL

SEQ ID NO: 1006455 - protein, 35 aa, Homo sapiens
QNQHMLYRLGSMWRVRPPVTIAHCPQQTPHSESSA

SEQ ID NO: 1006456 - protein, 42 aa, Homo sapiens
VCPRTQPGAAEESALISETPVTFYTQRLSKFFIDQSKKMLRS

SEQ ID NO: 1006457 - protein, 45 aa, Homo sapiens
MVSSLPVSGVLGARRASCITEHEALPKHYTQDSGGTQVYPKSRNS

SEQ ID NO: 1006458 - protein, 60 aa, Homo sapiens
IAGFLGAFPAEYEARVLEYCKRREQQESSELLAAFLKKSGKLKVPDMCGYRQAWPSTNEL

SEQ ID NO: 1006459 - protein, 78 aa, Homo sapiens
AGAVVWLRTVQAVKTSLAKMVKPGLYVKLQKLASAMVGTCLYSPAHSGTAEAQEHMACNPAQVGQLASCSPSIVPTAT

SEQ ID NO: 1006460 - protein, 40 aa, Homo sapiens
KILSGERTGAWKLLDSRPIQPGDAGIVELLYTPGHWLTVL

SEQ ID NO: 1006461 - protein, 50 aa, Homo sapiens
YLLFKESGVSTSCASAWENLDSLWAPKIYQRVSLILASSIQSQVPSTCGS

SEQ ID NO: 1006462 - protein, 40 aa, Homo sapiens
PDCNSCRASQYYFTLAQTPPLSKSRSSTHGQQHHQLHDHH

SEQ ID NO: 1006463 - protein, 48 aa, Homo sapiens
SSTSLPPTQATAMPRPPHGTSQQQQLIHICPSKHTVTSHFVPAFHNSH

SEQ ID NO: 1006464 - protein, 70 aa, Homo sapiens
YSRGSFRRENWSLSLLPPSVKLHLDNNKLDSALRLPDLKLLQVVYLHSNNITKRGCQRTSVPLGFGGEAG

SEQ ID NO: 1006465 - protein, 84 aa, Homo sapiens
GGTLVNEVHLGRIRSSVSPVAQRRADGKTLSSVVDQAPYSAVRKKCIIWSDTGASPSPPSKLKFPSWAILARLEFFLRARGEPL

SEQ ID NO: 1006466 - protein, 44 aa, Homo sapiens
VRITDWRGMHDGRTLCSEEGVYWVGACASVQILVPKMAGEGTSE

SEQ ID NO: 1006467 - protein, 32 aa, Homo sapiens
MAHQEIISCTWLGGSYTHWSLADLLAQQILTI

SEQ ID NO: 1006468 - protein, 75 aa, Homo sapiens
MAHRRLYPAPGSEGPTPMEFADCWHSSLRSNCKVAETLGEGRVHIAHGLLTVNKRSTGTSELELEPNHMLNGRCA

SEQ ID NO: 1006469 - protein, 39 aa, Homo sapiens
NGCAVGEQMRQKQQRLLKNMDAHKVHAGPAADPLQPHHP

SEQ ID NO: 1006470 - protein, 39 aa, Homo sapiens
FVVHAGVGERELLTPEQGCKVWEAQELVYSFSGTTLRIK

SEQ ID NO: 1006471 - protein, 148 aa, Homo sapiens
RAVYQEWCTFVHIGGSKAPAIAHPQQLVPKCVVWLLSHRQCCTIELLPAKDVVPDSSVAGGSGSISQNEDPQELAGVGAIPAGTGPCACPPTPMHQHCSGRGLWPAGASVRGWVRCTVVVAAHGAAPRPQGPISTCTTAYRYPDHPVL

SEQ ID NO: 1006472 - protein, 67 aa, Homo sapiens
MSGVPSRSDTVAVGYRGCSLTQTPTSWAFVAPQEDSFFSHVAREPLGETWRRASGRGWTGLVEALGG

SEQ ID NO: 1006473 - protein, 44 aa, Homo sapiens
MVSDSSVDIAEQLEMRTLSDYTSEESPCTCVAPRSGLLSLLSGS

SEQ ID NO: 1006474 - protein, 160 aa, Homo sapiens
MSQELLSRLVIRDDIFWRITSSITSIVPSSMGLNQCFSVRDVAVSSSLQWLGAKVEHLSPYALPQRSVDPPRESSLMIHEGSSSSSMRRGFRLGFAGLLAPAVQVHAHEQIKLLLVPGDHLVDGLVVGHLVFLLILLLVLQDVLQEGAPIMAGGFWSNMR

SEQ ID NO: 1006475 - protein, 51 aa, Homo sapiens
SARIPISFFFFFFFCLGLVTRRHARLPNNGVRFGRLTELVFSFSGTTLRIK

SEQ ID NO: 1006476 - protein, 50 aa, Homo sapiens
MSCPACHVHRTWRLGLRQLVGTSTPAGDLASSPARTLRHRSRLRRQPHHP

SEQ ID NO: 1006477 - protein, 66 aa, Homo sapiens
VKNSLFLHMNNLGPEDTAVYYCGEKGGVVELPAVLWTPGAGETLVSVSSPSPTMPQESSLLSHLQH

SEQ ID NO: 1006478 - protein, 31 aa, Homo sapiens
EKLSIRGGDPSKVARRACRLGLARRLPRSGW

SEQ ID NO: 1006479 - protein, 75 aa, Homo sapiens
MDSLVTGVRLESICGGRTVAQVSDGTSTGGVHRSGEYTSTSSMFAIFGGEHGAHVLTELVQGGMHRHVVNYTSTL

SEQ ID NO: 1006480 - protein, 74 aa, Homo sapiens
CVISGQHAGQVDEKLVSLKYFIKSQTGIVGKGEQEPRFSPLPAKTCSGCRYEFAIIESKTRTQTGCSQKVEGPT

SEQ ID NO: 1006481 - protein, 94 aa, Homo sapiens
VNSTRVLEDSSEIEPGVQSKASIWEVSYGAHVSTELVQGGMHRGGEYTSTRLHVCVIGRSARSSCDRRNWYREVCIGSGEYTSSWRHACMIGYW

SEQ ID NO: 1006482 - protein, 90 aa, Homo sapiens
IDSDAGGSSKSSTCSIATIVGGERCRTSVKENLYREACTAVVNTRRPGSMYAIFGRQHGAHVSKELVQEGMHGSGEYTSSWRHACMLGSW

SEQ ID NO: 1006483 - protein, 32 aa, Homo sapiens
MRLMSAQLRSARDCGAVPCSPALHDDMSPLLS

SEQ ID NO: 1006484 - protein, 34 aa, Homo sapiens
EELDHGTEAWGVYSTRRAWAGQAWVTAVGRQDHT

SEQ ID NO: 1006485 - protein, 122 aa, Homo sapiens
VRYEMSSRGVIAESTEKAKKSEEDKTTNNLITKWAKDMKKQFSKRTNSQRALEKKCSTSLIIREMQIKTTYSRKKKKAVIKKSRPARWLTPVIPALWEAEAGGSRGQKIKTILANMVKPRLY

SEQ ID NO: 1006486 - protein, 60 aa, Homo sapiens
DREERERTLIALGLVLSWQHSLQLWAGDTLTSTATVLTTSHVPLQQLTTALPATSPLPIP

SEQ ID NO: 1006487 - protein, 40 aa, Homo sapiens
ERELRQRSVNLPWATEQQIEGPRPGYQKLGLLRSSIHTTR

SEQ ID NO: 1006488 - protein, 114 aa, Homo sapiens
PRGPFPLTRDLISVLGVIGDALAANNVRAKQQREILSGYTGAFRCLDENAGDVALVKDVTSLCRTLMEITMRHGLRIRKQADFALLCLDSKRKPVTEARSCHLAMAPNHAVVSR

SEQ ID NO: 1006489 - protein, 125 aa, Homo sapiens
YHLGRLYVSAHKHSLLHLSEHSGEGLVLADIHERTCVTQGLTAGAHSRLPTVLRTLLPQICGDRALQQLGQPDLHLQRESQAQQTSRWTRELSPNLVTKLTNAHRAKHLNSWGDRQSSSFPQKPR

SEQ ID NO: 1006490 - protein, 34 aa, Homo sapiens
KGYLPESLHHLLVSMESGTGDFGYLVLLSHVGER

SEQ ID NO: 1006491 - protein, 85 aa, Homo sapiens
ALHTVMHTDLSPLSKQDRTHNLMVPSQIVNQLTTELQEHIISAVLMPLFPAGFKDKSTVMQRYCDRNTFHTYRYGIVKTDLCVYP

SEQ ID NO: 1006492 - protein, 81 aa, Homo sapiens
GALDGSLYEYSMRSLFRCHVHECRMPSFLLSASSVRRSELIVGTGIARKNEVCSSRELTVSLGGEDICPRNHRTIRSCNQV

SEQ ID NO: 1006493 - protein, 43 aa, Homo sapiens
RLGSLFWLSSFLSGPPPLCPGYPFMYQCSLYYGNARIPTANEY

SEQ ID NO: 1006494 - protein, 77 aa, Homo sapiens
MSQKSSNSSLVRTEIYTERKPDIDPLGTRVDVKQCLIIPHYEKSPRPQDNRIGRNTVSMCVGLTAATHRLAVNTPRA

SEQ ID NO: 1006495 - protein, 39 aa, Homo sapiens
RECYQLTPPSTTMGPDVGQEHVVWKSDPDDGGYSVDKDA

SEQ ID NO: 1006496 - protein, 84 aa, Homo sapiens
CCTARLAASLRVSVLGVDRHSPCILDLFPCTVFFFLVYRCDPVSPIIKSRHPAGVVCCCCCQLPLSSSLKQYTCILLKFWRQRF

SEQ ID NO: 1006497 - protein, 88 aa, Homo sapiens
SSVVEAEDHVRLPWIKQSTGYTCAASGRHGTPKDPSTPGSHFLLTFAQVLDGSEGPGAKVQPIIYPRGHPGKPTGGVLEHQIFLPTRG

SEQ ID NO: 1006498 - protein, 55 aa, Homo sapiens
RYRSWVLDVICSSSMCGRAAAAAGARRSVSSVKLFRRNSRTRCARCGGVKSHVMV

SEQ ID NO: 1006499 - protein, 102 aa, Homo sapiens
SKAAAGSNSLAVLPRKQAGTHLPESNPDTVVSAFIPLQKGAHVHVYPRILSQEHGEDPGFKIRESHGKAITFTPSVKGATRRDIHACDPSKEIKAWEYHTKD

SEQ ID NO: 1006500 - protein, 110 aa, Homo sapiens
GSPRCSRAVGTWEVRAFPGTAGVLSAMCSHVDMDLVSHGSLSQGCLSLPQLQVVGLICHLQCCDLRKIADQPPDIKIRIEKFRISLDLLTVCLVEGSSGDDKYIFIIMHH

SEQ ID NO: 1006501 - protein, 40 aa, Homo sapiens
RIFVRILVTKTATASSPKPIKPESKGVQKYRASTVMPQNM

SEQ ID NO: 1006502 - protein, 44 aa, Homo sapiens
SCLARRPVMMPLRNSYTAGFPVYHLPIRPIYKLADAALDLKVRE

SEQ ID NO: 1006503 - protein, 57 aa, Homo sapiens
MGLNLVLIHLPLVPHSQRSHSRGDTSSSESGTAVKMEKGSQNSALSTALRSDAVTQR

SEQ ID NO: 1006504 - protein, 46 aa, Homo sapiens
GFWTSMGFLDSSSNPRLGPRSSIHASPGTPVISHASPGTPVIIHAS

SEQ ID NO: 1006505 - protein, 62 aa, Homo sapiens
CYDGWSAVERSCVNARSASRVHATTPAAGSRVIGTTDARPTPNLLAIQQEYLKNILIAVVGS

SEQ ID NO: 1006506 - protein, 74 aa, Homo sapiens
GPFVPRTTTSLKQSYPKYGSGLAISLPTFVHHVRGCAPWDLCGYGYGPVRDLPLPPVRTQGFKIGIYFRLFISI

SEQ ID NO: 1006507 - protein, 40 aa, Homo sapiens
CTYTMLLICPKTFMPYKNFRISYSVEVGSWSDSSLSDLRS

SEQ ID NO: 1006508 - protein, 46 aa, Homo sapiens
SIRQEKENPRLPCEEGISHVYVHTGTYMCTCTRDAHGCTNTHTFMC

SEQ ID NO: 1006509 - protein, 75 aa, Homo sapiens
AYWAYVEVERLVLPSSVYSSVQYHMVAIDLMVTGGIVDLVCHVKDASGWEGDEDNISDAQEIENVCTILTDIILV

SEQ ID NO: 1006510 - protein, 132 aa, Homo sapiens
RAVKLHAGRLRVERAHGTWWLPALLDVCGDVDYLWKYCHINFTTVLDVIEDLGIILVRHNSDGRPLVPQANRPGHPVQVGVRVLRHVVLKDDVDSLDVHPPDKQIGGHQDPPLEILELMIACQALLLGHAPV

SEQ ID NO: 1006511 - protein, 36 aa, Homo sapiens
GVQLSVNCLHTPPPGRASRAKNCMQSLTSKCSNPAH

SEQ ID NO: 1006512 - protein, 96 aa, Homo sapiens
APGKLKGVFLSRRTIGDLSSLGDRGVAISNRGGFGVFCELVIFKVLRTSLKALNLPLDETAPLRLEATPKNGEGGCSGLAGPVPEKISPPKASGRV

SEQ ID NO: 1006513 - protein, 42 aa, Homo sapiens
GHLGFWHEVGRGELACVPTVVIEEVLPGGWYLTLWGGCRKPM

SEQ ID NO: 1006514 - protein, 71 aa, Homo sapiens
MPGLEENVAFPLPKGLSRKVAQTDRWNRRGPAAGAAKNKNRGDFMQLYSYFRSSAAYRVRIALNLKGLPYE

SEQ ID NO: 1006515 - protein, 36 aa, Homo sapiens
SSSRQYQVQRVMPAYHALYDEAEEMVDHYAVRSPRP

SEQ ID NO: 1006516 - protein, 152 aa, Homo sapiens
MHVWQRGYIIIESARRRSDYVLWRRFCPGVPHLLWCILFPVVLSIGHLQDASGTDGKVAVNLAKLKLFGHYYVMVICYVYFTRIIAILLQVAVPFQWQSLYQLLVERSPVASSCSGLQVHATGTTRTAVRQEPRRCQMEQYEDLGREALKSQ

SEQ ID NO: 1006517 - protein, 101 aa, Homo sapiens
TFQDGVSVPRCISGYGRSQLLLCTGGSGPIESVVKGLSFNAIGDYLLSSSDDQYWAFSDIQTGRVLTKVTDETSGCSLTCAQFHPDGLIFGTGTMDSQIKI

SEQ ID NO: 1006518 - protein, 33 aa, Homo sapiens
SLSSLRILNLIGKMPVDTAARRDAESVPQNCST

SEQ ID NO: 1006519 - protein, 84 aa, Homo sapiens
LVLPPRHLLSSLWEGGGLLAKKISEFFHQRRSLFMQDIHSVEATVPVICAESLFLTESFQTAHGNGKSDGPFDKRRKRADFRHC

SEQ ID NO: 1006520 - protein, 68 aa, Homo sapiens
RDSRWMGIAGTLECYDKGDGSCDVRYWPQEAGEYAVHGAVHPGEDFRLSPFMADIRNAPPGLPPRQGE

SEQ ID NO: 1006521 - protein, 37 aa, Homo sapiens
MSLDFEQCDRYQLQAAGYMMGLMKGRANPHTCLVEDV

SEQ ID NO: 1006522 - protein, 79 aa, Homo sapiens
MVNAVSDFLTPQNLDAEPGAGILTLNLATTRRRKGMFSWGWDFAPRIPSIGLTGPVELTRRSPIEVSHHVDTMAIGDGD

SEQ ID NO: 1006523 - protein, 108 aa, Homo sapiens
ETTSGTSSNSSHSTFNSGVAPNPTNATTNAAGGALQPTANLFAVSLSLLHLYSSETHATKRLLNFPIFYTQSKRQLEVQCGKEKQVFIESTNHTPCIDTQNVANPKFD

SEQ ID NO: 1006524 - protein, 132 aa, Homo sapiens
VALGEATTVGFPFLGHSGKGQTTGTEKQLGGQGLTDRGEAGCIGATLETWRMKESPQEGLERWPGDSAHRFGTVEELYTHRLNWRVCKLKKKIIQSEKDQAVTVQLGYWHVTDVDFTETFLQESQALKSSLL

SEQ ID NO: 1006525 - protein, 41 aa, Homo sapiens
DRAGTDSILTSTLTRDNTLFSDRLVGGHSDLGEQSLRHYSE

SEQ ID NO: 1006526 - protein, 35 aa, Homo sapiens
ELVPKMTDALCRTVIPAVRRVGLSVSLRHTSRLKS

SEQ ID NO: 1006527 - protein, 41 aa, Homo sapiens
MSWYRSPMGCTGDLLLNYKPQVGARILRTVISWNYQVSLDH

SEQ ID NO: 1006528 - protein, 46 aa, Homo sapiens
MLTRLTWMRNCSGTGCWSLLQGGGAPGIGLLHHGGLVGAGRCGMRE

SEQ ID NO: 1006529 - protein, 131 aa, Homo sapiens
AGRQMGISEATLLNMLNISPFSLGLVIQQVSTMEHLQTLRCLISQRKLCILASGEGVRNVASVCLQMAYPTVASVPHSIINGYKRVRAWSVETDYTFPLAEKVKAFWADPSALVAAAPVAAATTAAPASWL

SEQ ID NO: 1006530 - protein, 117 aa, Homo sapiens
AGEGGLSQDGATALQPGTERDSISKTKRNKTKQRPGNAANPLQEEHNFPPDHYGLPAVGDLLACMQLKVDKEKGYIELLYRCEGMDKSGAAFLLIITHHELRDCEWPNAWGVWGLTN

SEQ ID NO: 1006531 - protein, 74 aa, Homo sapiens
DLEDLVRSWSKEGLSEYMVEFLEEEGGEAGDYFSWEMDEEGNLDGITPFWMDNYRAPVGKGLPYLQFFDLATGG

SEQ ID NO: 1006532 - protein, 46 aa, Homo sapiens
MPCVVKQTGSLVEGILGRGEMGECWWAWEWEAGRLLLPPPPPLLPL

SEQ ID NO: 1006533 - protein, 44 aa, Homo sapiens
ALFRRGAPAFPICSIYLAGRQGKNLHVGARKNVGWKKCGWDDSE

SEQ ID NO: 1006534 - protein, 46 aa, Homo sapiens
DDPGEQVAGFRGWEGAVGFRGLTLRPQRSCLPVLVCLPLSVYGLGC

SEQ ID NO: 1006535 - protein, 40 aa, Homo sapiens
VQGRDGADFAKGGGVLKDGGTHPLSPAIMENAKVLARYAS

SEQ ID NO: 1006536 - protein, 119 aa, Homo sapiens
LERMSCLPTTNDYFPHFDLSHGSAQVKGHGMKVADALTKCLVHVNDMPKALSALRDLHAHKLRVDRVNFKLLSHCLLVTLACHLPAEFTPAVHASLDKSLGTVSTVLTSKYRLSWSLGK

SEQ ID NO: 1006537 - protein, 38 aa, Homo sapiens
VSERAPQAPKPAIIQDCERLERGLLCSPSSGSPGLRPQ

SEQ ID NO: 1006538 - protein, 35 aa, Homo sapiens
SPPHLPPCLLILLILILGLIILLVLCLLLLFCQLA

SEQ ID NO: 1006539 - protein, 70 aa, Homo sapiens
TDYTAVACAYTTFYSNLTENARGVKLLAALLEDEGGSGRPLLQAAKTLAAAESELLRSAQPASAEPRQNL

SEQ ID NO: 1006540 - protein, 68 aa, Homo sapiens
DSRTGRLSDGPDRTVGPVLLVVAGFLSRYGRYHRRLRSDLVPLPLAWPLTYVWVRLLLTLFASGAPSS

SEQ ID NO: 1006541 - protein, 106 aa, Homo sapiens
MVLDSFSGHSVFRISIFLRELRCGSLDGRRGQHRMASQKGHTAQDGRVLQGLEHVERSPVDLHESQHSSMSQVKYNRARSKSEVGDMWTNPDPQSERAEATKRSGP

SEQ ID NO: 1006542 - protein, 147 aa, Homo sapiens
RAGTDSILTRCRWTLSGCVVRQGTPIFQLFSGKDEGSAEHGGVRFVILDLGVDILDGVRGLHLEGDGLTSEGLHEDLHPTSETEHQVQGRLFLDVVVRQGAPIFQLFSGKDGALLETSSGVCCLGSGRRRNNDGDVGLDLKGDGLAK

SEQ ID NO: 1006543 - protein, 60 aa, Homo sapiens
MSFLDPPRMHMRRHTHTNTHTHTSEALTEQRGPQLYDTRRVRKLQLFYAVPGLNKTVLDF

SEQ ID NO: 1006544 - protein, 38 aa, Homo sapiens
SILTVVLQKVLKFSYSGTVLVAGFTPLGYGLTKINDNL

SEQ ID NO: 1006545 - protein, 40 aa, Homo sapiens
RTHKVSSVSPALHAEPMMPQPIGLGQLALPDCASCHWSQS

SEQ ID NO: 1006546 - protein, 49 aa, Homo sapiens
GTSLIGSLSSYFALGLWTYSGQISTTNHPLPCACRSAPLGERIWKEESG

SEQ ID NO: 1006547 - protein, 52 aa, Homo sapiens
AYFLLAIPSGCCLVVAPLLFHASNPCFSPLYFLLLHIFIYQEESVSVVGLGM

SEQ ID NO: 1006548 - protein, 39 aa, Homo sapiens
MGAAQPIRCTNCARCVPKGEAIKKFVIRRHSGGRSSQWT

SEQ ID NO: 1006549 - protein, 52 aa, Homo sapiens
VGCGVYAALETAEPGNQAVSLRLMTQLCSLEMPVDRGVATTSACCARLVHSV

SEQ ID NO: 1006550 - protein, 41 aa, Homo sapiens
SSWYRQILTSILTRDNHSVSDRLDGGASSDLGEQSLRHYSE

SEQ ID NO: 1006551 - protein, 74 aa, Homo sapiens
HVGIDCFPVVIFAIFYKGFFSPLRLYEHGHRASKVRSRTEKRSEGWFGHPMIIKKWLTPNKYDPDSPSFRSPES

SEQ ID NO: 1006552 - protein, 41 aa, Homo sapiens
SYIYRSKSTLTPINSLWKGYEVKSLISLRRQALDIFVALPN

SEQ ID NO: 1006553 - protein, 73 aa, Homo sapiens
PLSLSVSCSQMTKKRRNMVVPNKCAAATCRLFAVGDCARCVPQDEAIKKFVIRNIVEAAAVRDISEASVFDAY

SEQ ID NO: 1006554 - protein, 107 aa, Homo sapiens
ASCQYNEIKLCEMAADSSLGGGPVSMISTSDLWLITPDLLSLAVRFKKDSQRLVVLNDFTFGNVTSDFIIGGENTDDDFGARANKHLAFGSLFGIVDTLESICHDIH

SEQ ID NO: 1006555 - protein, 136 aa, Homo sapiens
LLRTLHTYTPPLHIPFIHIQDTHTPLTRAPYIHMLCTCTLYTYTHTHFSYTNTQNPLYTYVHTHFTYTYHTHTLHTYTHTHFKPSTHICEVPHTDTHNPHPTSHIHPHFNTIPSNINPHTFPPLTNTYILSHTHTH

SEQ ID NO: 1006556 - protein, 50 aa, Homo sapiens
SCVHLSEVFPTVRLLSTARGNEGDISGVIRTAGPVLFISLMRADSYPHFD

SEQ ID NO: 1006557 - protein, 31 aa, Homo sapiens
MSGTGGPLPVSPEAHRRVAFPSLAWATQVPP

SEQ ID NO: 1006558 - protein, 44 aa, Homo sapiens
MLWRRREPEHGVALLLDPGRQTVGKREAVLILRRQPAHKGRVGG

SEQ ID NO: 1006559 - protein, 38 aa, Homo sapiens
DGDRCEESSEHGHPPPQAISDSHHHPAISGDYPGKHVS

SEQ ID NO: 1006560 - protein, 52 aa, Homo sapiens
KTRPETMRPGLRIRDRKMESNDTEGMVGRGLEEPETGPCSSTCLGRGGTGRT

SEQ ID NO: 1006561 - protein, 100 aa, Homo sapiens
HLRTQSLRGLSHSDSRPSCAVPVSEAGTGGCGWPCEPSLPYCWENESSGKPESPHWLHEGPHFSRVSWVWRLCTTVPPINCPRCQPSNSQLNITLWGLGS

SEQ ID NO: 1006562 - protein, 70 aa, Homo sapiens
NLNGAGGGSELLLMWSLLPGAFLDCTSHETASWAWVWAHEHPPSLVCRGPLECTHFTWPQQAPEQGALGH

SEQ ID NO: 1006563 - protein, 40 aa, Homo sapiens
EKLVVWILGAELEKKSILRVAGKSIPAPEMAERGPGPEAA

SEQ ID NO: 1006564 - protein, 71 aa, Homo sapiens
GDVKHVYERLRTSHLHSCGLPRTHSTHSSKEIMSVPGGHTIQGIVEYQEEGTTLPFLRTVPVHREMRHIHQ

SEQ ID NO: 1006565 - protein, 44 aa, Homo sapiens
TLARYPWEDISFFTLRLKARQMFTYRHYKKSVSNLLCERECSTL

SEQ ID NO: 1006566 - protein, 129 aa, Homo sapiens
GEGPVHLPPAQLNGGPGSWTEGAKKDRMLPKEGAEELLEGISEGKAGLEGFGQELRQLGVALSNGGTGSESPLEPPLPLEEEEAYESFTCPPEPPGPFLSSPLRSLNQLPSQPFTGPFMAVLFAKLENM

SEQ ID NO: 1006567 - protein, 46 aa, Homo sapiens
VCVYVVNTLRHPFSKGTVSLCTPLAPHCVLSPGSLEAVNCEDVGLV

SEQ ID NO: 1006568 - protein, 120 aa, Homo sapiens
WGLYRGAKGSLPPQCSDQHQPASAPRMMQAAASAAPPLVAATPYSSYIPYNPQQFPGQPAMMQPMAHYPSQPVFAPMLQSNPRMLTSGSHPQAIVSSSTPQYPSAEQPTPQALYATVHQS

SEQ ID NO: 1006569 - protein, 84 aa, Homo sapiens
EYLEDPMETRLDGDQLRMRLRLLGLVCPDRILSQALPCGQALSATAKLRGRVLSRGIGEALAAFCIYLLFFFFSGFVGGGGSTV

SEQ ID NO: 1006570 - protein, 105 aa, Homo sapiens
VVRRHGNGLAACGAFKKSSKPNRKSGGISAPLGTSPRPYWAGMFWLKTHSHSSQTLEPGLGEVLEPAPGEAEVGRTLGGQPGQVFWHLAHSRCSKHVCWNRTCHP

SEQ ID NO: 1006571 - protein, 47 aa, Homo sapiens
PPGPGGKNNPLEKGFLPPGGPGGKPCLLGQGDFLSMVPGGVPPPLVK

SEQ ID NO: 1006572 - protein, 138 aa, Homo sapiens
ERSSLTLATGFNQRGIYVIQAREVGQKISPDTVLHLILPESPGSHEESREHSLEEVKELLNKLMLMSGKKDRNNTEVERFSEVFCSVQRLSQAFIDLHSAGNMLFRTWIAMAYCSPKQVSLQMDFWLYLVTELKDGGD

SEQ ID NO: 1006573 - protein, 59 aa, Homo sapiens
MVMDGPVLALGLASSTCRDAVRAAHIAAPSAPHPPPVGVGSVVWKCPLWLMRLSVDGQW

SEQ ID NO: 1006574 - protein, 97 aa, Homo sapiens
MIIRATRAPPLRWSTHCTTRPKVPSPKVLTISSEMKESRVGEREGEKVGNELSWKKKGDSNLVVEMKEGEQIQMVTGEENPCVISTTFNPWAVKEGR

SEQ ID NO: 1006575 - protein, 61 aa, Homo sapiens
MELRTGAAYSAPGMAGLVLPDFRYGLQWGLNVWASWLAHQMDESNSYASAELMGQTHDQSL

SEQ ID NO: 1006576 - protein, 74 aa, Homo sapiens
MTFAPSITARTTWSPGVVHSVMEFTLFYIYSNGPVASLNLLPPDLHLVTIYRHLHGPERRIGGDESAPYRLPCA

SEQ ID NO: 1006577 - protein, 49 aa, Homo sapiens
MAHTLYVMYSSQRVLADERADHTTVLKHEQYPAIDEDKYHQRPHELQPV

SEQ ID NO: 1006578 - protein, 42 aa, Homo sapiens
SHPRVSFMSGVLTGVRGVLDRPGLTVGIEGLLGLEGAFYVLD

SEQ ID NO: 1006579 - protein, 106 aa, Homo sapiens
MSLRLVYELLRSSDRTVSASQSAGIAGVSHRTRPLRECLKLLSCKSTYTQAPPTHEQLRGQFTQTESKDNFKVVSGYYPSMAQLEGGHRGEGSETPKFNLLHLTDG

SEQ ID NO: 1006580 - protein, 138 aa, Homo sapiens
ARHPNITHEVVRTFATGQDGGQSVNKIPLPVSKAGSAHLTKQIGLRSEVGVHRPLGESGIRGNASQTGADIAVPFKVVGGYGKYSASHLIAVRSFYCGRHHKLSSFEESRTRSVAVPPVSDTNGILSLGSSPNRSARV

SEQ ID NO: 1006581 - protein, 50 aa, Homo sapiens
YPGWGGRQKECWCMYPILSHQPGHPQLEYGNGATGQMQGGWSLTQPPEMQ

SEQ ID NO: 1006582 - protein, 95 aa, Homo sapiens
LADLMSKLEAAQVFSRTADQRLAQASVLGHHHPGPDTFQEHPRQQLATSSFLLFWLTGMVSVAFLLLPLPDDLGSHGDAHTLPCLLPSSLTCQLA

SEQ ID NO: 1006583 - protein, 52 aa, Homo sapiens
RSRSGMWGRHNLSPDVHRDPHPSETSCLTCGLVPVNTLFMNTCCLGFIAFCV

SEQ ID NO: 1006584 - protein, 92 aa, Homo sapiens
TEEYGDASSCEGSRGRQPSMVVNTSRQQPAPNSEDEGHQVQRCMEEFPGQFWAPPMIGAGGTPVTHFQEYHHASNHKHWVPVAHVDAASYAQ

SEQ ID NO: 1006585 - protein, 42 aa, Homo sapiens
HHSLLVAVMAWTVVMSPSRYQSCIDTLARCAKQLVVQEALLM

SEQ ID NO: 1006586 - protein, 63 aa, Homo sapiens
GAHYYMSWADRLTLSWVLLHTCATVRLQAHGPGPSNCLWCDQPEHVLELFLWGVQRATALAEA

SEQ ID NO: 1006587 - protein, 77 aa, Homo sapiens
AEKLEWGPPGSGALLKDWAGRSTAGHSSSNQLEPPSLGAVPPWVPPLVPMAPHLFPKQQTPPYTDARGSCQAADTQA

SEQ ID NO: 1006588 - protein, 132 aa, Homo sapiens
ESLDLWIGSETVDVPEFMEGWTDASAQGEQVNWATCSQQLPIVASSIVSLYFLELTELFTPGKVGFQCYERNLSMHYVETKEELIPLLMLLSLDFAGPAASVVTCTGELCQTVGTTAVEPTHDNSVNILQGA

SEQ ID NO: 1006589 - protein, 37 aa, Homo sapiens
LEACKSNGCSGLALSKEPQIVGVNASNHGVTTGDGVV

SEQ ID NO: 1006590 - protein, 35 aa, Homo sapiens
SLLRRPRRYTLARAVRAELLPTARRVAFGYRVLQL

SEQ ID NO: 1006591 - protein, 128 aa, Homo sapiens
GPKVGASCQDEVEEYLEVQWEVALVGVTRSGDQEADLDGGPGGSGQWVGLDGGPVRKTVGDKGPLESMAFQSGLSEWKELRGEWTKERRPDEDGPVRPVMVEPGEWSKQVGGPGIGRCLYLEKEEQTA

SEQ ID NO: 1006592 - protein, 122 aa, Homo sapiens
MVLLARVRSPVWCLNHCVSALVLVSDMHRVALCMLVSELHRVKLSASLVSDMHRVKQLRVLVSDMHRVKLYCVLVSDMHRVKLCCVLVSDMHRVKQLCVLVSDMHRVKLCCVLVSDVHRVTL

SEQ ID NO: 1006593 - protein, 103 aa, Homo sapiens
MRVHTAFRVFCVCAGLAVCAGCDLCVVGVICACAGCDLCLLGVNLCVLGVICVCAGCALCVLTVSCVCAGCDLCVLTVICACAGCDLWVCWVCSVCDLCMCCV

SEQ ID NO: 1006594 - protein, 54 aa, Homo sapiens
RTYCVSPSREFTYWRRRRTGCLLTQEKTLHNQPVSALEAPGIHEPHPQRSLLKE

SEQ ID NO: 1006595 - protein, 42 aa, Homo sapiens
CGSVVHRKPQLLPYVVLWYAPVPECLWWTRSIHVLITCLKHM

SEQ ID NO: 1006596 - protein, 71 aa, Homo sapiens
CWGLALNMSLPNSMFSNFFERELEVSYRGSIYTTEIGNNGNSGLLSPRLRGQAPAPLRSLYSPGPSCQAPA

SEQ ID NO: 1006597 - protein, 61 aa, Homo sapiens
LPSSHCFSGDDYNLWRVFDVQIMPEDLDMGFTELDIYSKFRPSRAMRCLRVRLCRSIGCRY

SEQ ID NO: 1006598 - protein, 126 aa, Homo sapiens
LLAQVGTMLETKRKKTTRRRRDREEERHEETEKRETVGWESTSNLILQTTLLRSSLYAQPRSLLSSDFPLSYDASPWPILFFPGPASSPFYPSVLVRSLSPFTSSAFVDHVLCVKRNPGADPSPIL

SEQ ID NO: 1006599 - protein, 38 aa, Homo sapiens
KETVQTTEDQILKRDMPPAFIKLLLEEILKNVLQTSPL

SEQ ID NO: 1006600 - protein, 77 aa, Homo sapiens
ALLQHSTSSWQRVIRDNLERARADSIQLIRKREKLNRETIKVQKIAMRDAGIDSLFLNPSFRKKPWETSSQGGKDTR

SEQ ID NO: 1006601 - protein, 38 aa, Homo sapiens
MTELSVVRACTRWKAEIRVMGRKPSASIFLRRKKSRSK

SEQ ID NO: 1006602 - protein, 33 aa, Homo sapiens
MAEAPSLVKRHGHAHRYPSYLGALMQENRLNLG

SEQ ID NO: 1006603 - protein, 40 aa, Homo sapiens
ISFHISLQVAETYRHTPPHQANKYGVETAICQLARASLDL

SEQ ID NO: 1006604 - protein, 57 aa, Homo sapiens
QYEIPSPSSRSEIPPKSRGAMLGAEYVVAVHCASITTMEKARGIIGPGGEPKQGLSY

SEQ ID NO: 1006605 - protein, 104 aa, Homo sapiens
CTDNVGSKQMQQIRMSFARLWCCWAEHHDALASEALETTSSGNCASYRGNVGFVFTKELTEIRGHVAGNKVPAAARAGSIGPLLSHLCQARTLVSGPRETSFFQ

SEQ ID NO: 1006606 - protein, 73 aa, Homo sapiens
GSTFSFGSTSTFNLSFRSSLNLSSTCSNLNSSFSLNLSLDEDRDRSELVKSFRDDWPLKGSNILENVSSGLNN

SEQ ID NO: 1006607 - protein, 132 aa, Homo sapiens
EEEEQERQFRKQFPLHEKDSADRVAQPTLEENKGTSDGQEEEAGTNPALLSQNSMQAVMLIHQQLCLNFARSLWYQQTLPPHEAKHYLSLFLSCYQTGASLVTHFYPLMGVELNDRLLAANFCLSLSQTLFL

SEQ ID NO: 1006608 - protein, 98 aa, Homo sapiens
SYKADVRDDGLLGAISLEKPSDEVQPVRAGMGFVGPRADLYLMGLCGPRSFHLVTSDPQLSPLAFPCGHFPGWTLSCSLQYPNCRSSAGNKYVMDQKK

SEQ ID NO: 1006609 - protein, 40 aa, Homo sapiens
SYVVDVGMPQPTGEAEAEEEDCLGLEFEDTVSYDHARAFQ

SEQ ID NO: 1006610 - protein, 88 aa, Homo sapiens
MRTSWDRGRDRHCWSFCYETTGPRVASCEVLPNEAILIDFTIEALKQVHEDESGEAQLSFLTGGPVAAASSLERDTERLRELLLYGRK

SEQ ID NO: 1006611 - protein, 36 aa, Homo sapiens
HSLDCHLSPAIGPSQSSLALCWVICSRFHCSCCADW

SEQ ID NO: 1006612 - protein, 49 aa, Homo sapiens
MPVLLLKLLLLKLLLLLQLLLLLLLKLLLLWQLLLLLKLLERAHGLSAQ

SEQ ID NO: 1006613 - protein, 49 aa, Homo sapiens
MTQSAHSAVSARPRQQAAPPRATLVFLRAARAAVPRFVHTCVVGSLETT

SEQ ID NO: 1006614 - protein, 71 aa, Homo sapiens
SSHVWRNWEGYQPANTAIQLTLGFDLSGRCSCSALRLNSCSQERGGGAAAATGTAHGRGMALLGRTQVCTS

SEQ ID NO: 1006615 - protein, 67 aa, Homo sapiens
MMLRHYHHQHRLIDKCKLPKLTQFHGVVSWNQQILRDGLRDSSMGMGKALTQRTIKHPSLIQTKKTK

SEQ ID NO: 1006616 - protein, 58 aa, Homo sapiens
CVSSGSYEASSLGGLRQQVSRRLQCSVGWHSFRDEHPLQQLLVPLRVARPVLLAHLLY

SEQ ID NO: 1006617 - protein, 57 aa, Homo sapiens
MVQTFDIPTWLSYNTCSNKHRLYRTPGNRIVYLYTKNGWESTKICMWCCALSFRGIP

SEQ ID NO: 1006618 - protein, 86 aa, Homo sapiens
NEAEQQPSLQPEGEVFVGAVPLLCLPCGGLLAGGRLASAGPPAGPGSQSLAAGQSHVGNKGNTWAHLGRGCQVRFKPGYESFEFGS

SEQ ID NO: 1006619 - protein, 43 aa, Homo sapiens
MVTDLSCAHDQEVVCEVCCTSQTRGGFEGSIEFFLDAKERGCH

SEQ ID NO: 1006620 - protein, 32 aa, Homo sapiens
MNDGGWKERGQEDEAAFLLQGKALAVGDGLVM

SEQ ID NO: 1006621 - protein, 98 aa, Homo sapiens
ESWDLSSDAVWAPKVNVMAESVGAYVMAAHLYNSWDLCHMSELHCDKLHVYPENFRLLGNVLFCVLAHHFGKEFTPPVQAAYQKVVAGVANALGHKYH

SEQ ID NO: 1006622 - protein, 105 aa, Homo sapiens
SKWSPSSNQRYEGWHSSRKMETSHGDEKNRPGNLWIIKLSKENSLITQFTSLVAVEKRDENGSPFPGYTTKSLERVLAKGKMVDCPGPYMELGRGGTPREAGQGT

SEQ ID NO: 1006623 - protein, 46 aa, Homo sapiens
EQVCISWFYPPSSRRLWDEYEELKGLGRSRLPGHGSLWSDSCQLAQ

SEQ ID NO: 1006624 - protein, 126 aa, Homo sapiens
VSLPQAVCGADRRTAVLLGFLLRSQGYQVLAQEAPCWDAPLRDPALRQLLCGTELTTLQPSEPHSAGALCSGLPEHLSLTKFSLDPILSSPSPWKVGPQSTAFPVRRGFVATIPITSCQLAPPGTE

SEQ ID NO: 1006625 - protein, 41 aa, Homo sapiens
LAAECSTTYRRQPCAPAALLLEHQPDKIKALFRKGQGRWPS

SEQ ID NO: 1006626 - protein, 42 aa, Homo sapiens
SKAGQLPASVTGFRLAIEAQQRKVLASFKSLAHAVIGYFHQC

SEQ ID NO: 1006627 - protein, 66 aa, Homo sapiens
PDLALHWIWKNRERILQFWAIPGPSRNTVFQETLKNLPVPCLIVISIRVLQDSDIFHNCNVCQLAQ

SEQ ID NO: 1006628 - protein, 33 aa, Homo sapiens
YRISAEQLGRRGKLEQLSPEEEEKRRIRKGKEE

SEQ ID NO: 1006629 - protein, 55 aa, Homo sapiens
MMYCLADNDANNNEAWANGFEAGRDSSSMFLAKSWTGDGRRSLDGARVLGWTTGC

SEQ ID NO: 1006630 - protein, 94 aa, Homo sapiens
NLDNFTDCYQLPAHRGIVDEKIFCCHGGLSPERAVYEEQIRRIMRTTDVTDQGLLCDTAVVLTLTTDVAGLGRDSPWSLLIPIGAEVVDKFLHK

SEQ ID NO: 1006631 - protein, 60 aa, Homo sapiens
AGGVPLLRQFLRSEKRNIAHKLGIEHIRKPPKGMLTFSQKMWSAVSAYMPLSATTCAEYN

SEQ ID NO: 1006632 - protein, 41 aa, Homo sapiens
SSARYLRLGQRRKMRRTQRSRAPKDSDEMLLALRADLDGVG

SEQ ID NO: 1006633 - protein, 67 aa, Homo sapiens
ALKASAGRHLLRCQGRSMVQVSLAGSSVGAVSSLASGAGSALSQPVFLCSWPSHVSASMLQLVQSVQ

SEQ ID NO: 1006634 - protein, 104 aa, Homo sapiens
MVHEVPTGRKLKCRFSTRIQIKITFLGRMKLDVWNVLQASVLDYWFPLLRWARPSFTCTCSRTGCHFCPHADDPGAGSTVNIGESPLYQIPRLLPSLVVYLRSG

SEQ ID NO: 1006635 - protein, 44 aa, Homo sapiens
MHLSLSDVCAGPVVRHRALSCTGHECWHLCGQRHHSLSNSTVPM

SEQ ID NO: 1006636 - protein, 90 aa, Homo sapiens
GFCACGYRNSLLPSWACDVALACRGQAQALPREYPEYAVVLLGQIPLPATPSAPGLSLVLMSGCDLVRKGVLDSPPCGSCTPCLRTPPDT

SEQ ID NO: 1006637 - protein, 57 aa, Homo sapiens
TEQLAGKGSYTPPQPHTGTPGAVRLQHPDPRGQWTVIEMTGSFTEGHRATHAEPPSL

SEQ ID NO: 1006638 - protein, 38 aa, Homo sapiens
TVLAIYLEDPFQWLKQFKAGTPPMAGRVRKGWATPGIW

SEQ ID NO: 1006639 - protein, 73 aa, Homo sapiens
ARSLFLDLHAAAVALIQPDSPLFGPEHLRVAAVSLSGFTVRAVGGKKGGVSGGKVGGQCHQGSRIRAHAAAAA

SEQ ID NO: 1006640 - protein, 97 aa, Homo sapiens
MAQQRSQWLAQVQSTDEAAKPGFTASVLPPHSTWPHDSPSRKSTASSHATASKLTTRDARIGFWKVHDPQRMRLLHPLCGYTKGGSHTELKFLKNTK

SEQ ID NO: 1006641 - protein, 35 aa, Homo sapiens
MGVTSISGKAVVLSVYDKGPFSLGSGGRHSFRTGS

SEQ ID NO: 1006642 - protein, 95 aa, Homo sapiens
MGTGGASGELLRYSDRGRWLCSTTVIAPGQAGSCTPSLPVSRHWGSSAHSLTLLLKGRGVHLQVVQAESCARRSAQSSLAGTGSPCLRIFTVRLE

SEQ ID NO: 1006643 - protein, 69 aa, Homo sapiens
YYRSYESGGEKWSGEELEVTGPLKLCACRSVSADRALGMSSTCARGEVSASATSLACVPLTLGMSLWLK

SEQ ID NO: 1006644 - protein, 32 aa, Homo sapiens
ELENPRGSDCVTAGIPRTRSPGALITAVRVHR

SEQ ID NO: 1006645 - protein, 39 aa, Homo sapiens
GPVEDVLSFPTTKNYVPHFDLSHGSAQVTGHGKKVADAT

SEQ ID NO: 1006646 - protein, 41 aa, Homo sapiens
TAQVLVSAVLGQAGSRILGHPSGLLNKGQSWILKKCRSRGR

SEQ ID NO: 1006647 - protein, 67 aa, Homo sapiens
QHEGVGAQLRIQKGIKELNLPSSVISASQIQTTPKFKLVICPDEGFYKSGKFVYSFKVGQGLPCNDP

SEQ ID NO: 1006648 - protein, 81 aa, Homo sapiens
MLATESSSSFSIETLPPPHHSSEHSSSDHMLQREPVPAMMPTMVMVGWEDGSHLRVRGLGKPSCCTWQVYLCSCPEGTNTT

SEQ ID NO: 1006649 - protein, 40 aa, Homo sapiens
MYPTHFDDGEAGDHDGRSLRLTPGPRLVNALSLPTNKTKT

SEQ ID NO: 1006650 - protein, 125 aa, Homo sapiens
TRKPAAERERKKGGRDAYRSGKATGKGGRVRCEPTITVTPQACAESPPPQALCQGQHLHGMRPSQQLCNLVPTRTFLAQLRKQQHREDELKIGQHAGRSGSRLESQHFVKMRQAEHKVKRARPSR

SEQ ID NO: 1006651 - protein, 100 aa, Homo sapiens
PQLRARRSRCAIEDALVKGLIEEELFSSALYDQEKFTTGIGMQCGYVFCEQLSYVWGARDVKRLGYGFLDDRRWMLITLLGFGPVLHAVGTPLALGNAPR

SEQ ID NO: 1006652 - protein, 48 aa, Homo sapiens
WDSSVGSDEEEVSEAVGSTPVASSGTQGHTVTTAGPVTGEQPSTQSSS

SEQ ID NO: 1006653 - protein, 74 aa, Homo sapiens
GRIACQEAEVAVNRDGAIALQAGQQKQNSFSKKKETGPGVTQLVTKNLELVCMTDPGPSKWTAVTFAQAPSHLS

SEQ ID NO: 1006654 - protein, 144 aa, Homo sapiens
GVPARLAALSRVPDCSTNACARIVLQIFRTLLEACDRLRACARVRPAQCPRYFLWPAIPLVPSLSRALSAVALGYNHQGCYPVITTAKTGPKFFLILAPPLGKFLVLLMQIPLFHLMGVVQELRQRSRGLRGSRVPLRGASAEA

SEQ ID NO: 1006655 - protein, 37 aa, Homo sapiens
LVFILVRIERASVLDVLADFAIFFTIYRSEAPVAGPV

SEQ ID NO: 1006656 - protein, 33 aa, Homo sapiens
KSGRLSPEHLIGKYSPVISFLQFSTFCKERTII

SEQ ID NO: 1006657 - protein, 40 aa, Homo sapiens
KVIVNCRIGDSASGWGTVWFYWPCARYLCAYSFGTCALVL

SEQ ID NO: 1006658 - protein, 37 aa, Homo sapiens
IECAPGSEPTSGTNSTKGLLGPHKLACAYSGWYRRPL

SEQ ID NO: 1006659 - protein, 35 aa, Homo sapiens
MVRSYAEGSTIDMGEANCLLLYLSVCSYYCCDLLV

SEQ ID NO: 1006660 - protein, 114 aa, Homo sapiens
QLHTFCGLAGGSTPDSVCLRYHQWSAAEEQRLLPVPFSGIFVPEGHPPDSSRCSPVRGVCRPLLGEECPILLLGCPSVGCTLCLSSPSAMSWVPQLEMQKSPAFCIGFTGCCRL

SEQ ID NO: 1006661 - protein, 69 aa, Homo sapiens
SCAVAHTCIPALREAKVERYRYEPRSSRSCLGNMAKARLYSKIFEITVVSVALCLDLVVQADCPSYPGG

SEQ ID NO: 1006662 - protein, 45 aa, Homo sapiens
CAGWLLVVPDIRLGALTPLCVPLPSLLLAMAPKMLSPFSNEGATE

SEQ ID NO: 1006663 - protein, 36 aa, Homo sapiens
QSTLLRTLTTCKSRFINKAVGSSLGGPQESHFIAMT

SEQ ID NO: 1006664 - protein, 46 aa, Homo sapiens
ITTEDMTIPDSNSICKEWKSSENDMRSNRIIQAELKIYPKHVTALK

SEQ ID NO: 1006665 - protein, 52 aa, Homo sapiens
YSYQVVNGKGTARIAISGVFFVYLDLPSQKVCSFSMGCTPTVVYGVFFSGAE

SEQ ID NO: 1006666 - protein, 42 aa, Homo sapiens
AWFGDCWLCHLDPTGCDPCRLVGLSAMLTETVLSVFVPFLFF

SEQ ID NO: 1006667 - protein, 48 aa, Homo sapiens
LFSVQSLPFTHCKTTTVVTFLHLTCSFGIHGVCTLMSLKFIHVVAYFR

SEQ ID NO: 1006668 - protein, 32 aa, Homo sapiens
MEVSAEYDRLVGELKLDRLLLELKHSNIGPFP

SEQ ID NO: 1006669 - protein, 40 aa, Homo sapiens
QPALEWCVAVYAICFILAAIAILLNPGAVSAGKRIHSLHH

SEQ ID NO: 1006670 - protein, 42 aa, Homo sapiens
LWEEGYWPSASYDADIVNLIKEEENVYRQVVICGKIIYIHEI

SEQ ID NO: 1006671 - protein, 47 aa, Homo sapiens
AAEVTVRELVESMLAPGTLLNGGGSFNFVTQDDGVLPPGLRKDAAFT

SEQ ID NO: 1006672 - protein, 136 aa, Homo sapiens
TYKSTHPSYSLTIQSMTIQLTNNPSDKIYPSNQTPNPYILSFHPFIYPSIYLTTPISLNVCPPKSSIQTSIHPTTHLTNQPIQLIYLTIHPYHPSIPSILPYHPSIHQSIHPSIHPYIPQTNKLKTKVMNQINKEH

SEQ ID NO: 1006673 - protein, 37 aa, Homo sapiens
EAEQRTEEKVWPEMGLTSVTQTGSAVSGADHAYCSLK

SEQ ID NO: 1006674 - protein, 84 aa, Homo sapiens
FPSQVAAANWSRRHVCALHMIVVRNCSSFLTHDGIRQTYCTEPNNLKARNSFRYNGLIHRKTVGVEPAADVQGVVVFINREIRP

SEQ ID NO: 1006675 - protein, 137 aa, Homo sapiens
CTDSAGDLEDPCQLRLSGTMKPNMAVWKQIILPFIQDLYDLHVKSGADHTPHLLQPACEVHNNFPSSVVIYDIKFAICNHVFLITCEKADDDFGARSNMHLAFASLCGIVDTLESICQDMHAHHCGGAERWRKEESG

SEQ ID NO: 1006676 - protein, 118 aa, Homo sapiens
GSIDKPTYATKWTIRHGIISTARDLIGKFMEHVVHLNIFELNLRTIIIYIGVTISFLLYSVTRQQLPLNTPEQQSVSCRQIMFESFNVPGLYIAVQAVLAYGGHLGHLDKWVHVRKRG

SEQ ID NO: 1006677 - protein, 48 aa, Homo sapiens
HSPLSGVESGDYVQKLHLERGRKTKEDTGHSASDPHVWLERRELYYSV

SEQ ID NO: 1006678 - protein, 148 aa, Homo sapiens
ALPVCTWILNCRRPTGPLDSQLVQTRGGWTGDQCGLAPTQRMPQVGGQDRTPPDLGGTVMSYPNPKGALHATHGVRVIWQPLPVSPMSSLDHLRGGEGTQEAEVVLLSGSPHPVSTPVSGGFGYPGALTANPTRSRPFPAHETPTRTC

SEQ ID NO: 1006679 - protein, 76 aa, Homo sapiens
MPSAVTHASYPRHLGRPEVAVALFQRFKTGLGNIGDPILHKKGETIRKHEICEYPRSLDSFLPAEHVRQCRTEESG

SEQ ID NO: 1006680 - protein, 68 aa, Homo sapiens
KMDDDMSVTWNCINEPRISGKRILARQRGGQTAKGYEHDIAKKLDFILVGNEMLLKNFKQLCAHQFCI

SEQ ID NO: 1006681 - protein, 30 aa, Homo sapiens
MDEMRYHRAATHMHVRTRHVLSTYREQSLR

SEQ ID NO: 1006682 - protein, 39 aa, Homo sapiens
MSRVEVVTAERGEWAHSPLSVCALMTGVPEARYSVNHES

SEQ ID NO: 1006683 - protein, 59 aa, Homo sapiens
LGLDFEECMVLPVRGLHEDLHPTSVVREYQVEDGLLTLSVFVIQEMSPSSSYGARGAPL

SEQ ID NO: 1006684 - protein, 59 aa, Homo sapiens
RNHHAFFSPSEPNQGVELVPINVIQLLHSLYNLELLCGFNIHNEHKCVVIIYTYFMAET

SEQ ID NO: 1006685 - protein, 130 aa, Homo sapiens
SSAHAWFGVVLQVCGWASDSPMSFLFKLEILGLEALDSFGVRVDSGRLSRTLVRSLPLGGPASSVIPCSSSFNSSSTSSLVHLLAAFSSFTFPVFRRDFEVSRFYVGLVGLISRIICEWYLVFTDEDFFF

SEQ ID NO: 1006686 - protein, 41 aa, Homo sapiens
LLVVAVAEKREKLAERRGGTWQEATCCYLSIDYADAVYWRN

SEQ ID NO: 1006687 - protein, 138 aa, Homo sapiens
SGSIAGTHVWTGECGGTRKLGDTKNHTEPQTGCHSSGFGELLGLGFLKGCSSSLLVTHNVESGAGHFSLICVTPLSVPPFGGSRVLVLRPGRMRYADSWRVSKKERSFIGQQNSSEETHGGELFLQAGHPDEYPALSR

SEQ ID NO: 1006688 - protein, 49 aa, Homo sapiens
AQVTSSLSCDQLINISLVFLILPNEHLSAPKLCLLLCELWASQLCLPGK

SEQ ID NO: 1006689 - protein, 36 aa, Homo sapiens
PTTSVIYSILGMHTVDLGLCTRRFFLCYLFSSSGRG

SEQ ID NO: 1006690 - protein, 44 aa, Homo sapiens
MYHNLLHINGTSVDDDFHTPITSKAFLHLAEPSYGPAVSADATH

SEQ ID NO: 1006691 - protein, 77 aa, Homo sapiens
QGSQPRPTVGSHAAKPPRQVLPLLRGAQSHRGGQGLRSVGARHETGGQLRLQPWHGIHYGEASWAPESGGDLDNFYV

SEQ ID NO: 1006692 - protein, 43 aa, Homo sapiens
PVLCIGVQPAQQLQWNLTQITQQIAGMNFYGAHGMMNYGQSMS

SEQ ID NO: 1006693 - protein, 55 aa, Homo sapiens
LRGSPSLHLLQLIGVKKKHFSILVDHLCDMEMVNKVGQTAFDVADEDLLGYLEEL

SEQ ID NO: 1006694 - protein, 37 aa, Homo sapiens
EIVPLHSSLGNKNETLSQKKRKKVRLLQELPWVLRIR

SEQ ID NO: 1006695 - protein, 62 aa, Homo sapiens
MTTSSYYLPASHVVDQGSFFILSLRQDRGSTCLSWQCMCCNSWLYCTPYPTGSQVDPSCFRS

SEQ ID NO: 1006696 - protein, 39 aa, Homo sapiens
APCPVIHVAVHVVTFGHCPAQVHGDWAPLAFFLWLSVQV

SEQ ID NO: 1006697 - protein, 51 aa, Homo sapiens
MPLLLLHPSAPMLVYGSCGLADSFSTGSYLGVHGSYVQPGHTRLVADVACG

SEQ ID NO: 1006698 - protein, 59 aa, Homo sapiens
ELGQINVIQLLHSLFNLVLVGFNIHNEHKMCEKSSLFFMADSVVSGNWAGYSVVSGNWA

SEQ ID NO: 1006699 - protein, 48 aa, Homo sapiens
SIIPTRCCCLIVVPLQVQGLSAISRPLPSLLLDIAAPKMLSPFSNARS

SEQ ID NO: 1006700 - protein, 42 aa, Homo sapiens
GPCAAHGGVENQVGSSGFHFQALALRRTHWDLSLMAARVDHT

SEQ ID NO: 1006701 - protein, 35 aa, Homo sapiens
TCCIRLYYNILENTQARNLGVILDTFSSSLILCIQ

SEQ ID NO: 1006702 - protein, 59 aa, Homo sapiens
LCVLVSELHCVKRSAYWCLSMHCVNALRLVSDMHREALCMLMSDTHHDADLCIRVSDMH

SEQ ID NO: 1006703 - protein, 69 aa, Homo sapiens
LKNKNKKNPTIYDTLTANLILNGEKWKALPVRTRTRQGCLFSPLLFNIVLEVLARTFRQGKERKGIQTG

SEQ ID NO: 1006704 - protein, 69 aa, Homo sapiens
MGRRERKAAFKGDSGGPLLCTLWPTASSPMESRRGYSRSLHGSQVSCPVIRTTMRSFKLLDQIGNPPRS

SEQ ID NO: 1006705 - protein, 88 aa, Homo sapiens
VPPRGRGSLRSIYHATGPLEERQIAYVCRDGLMGLHHLHSQGRIHRDFEGAYLLLTLQGDVPLADFGVSGELTASVANRRSFIGTPPA

SEQ ID NO: 1006706 - protein, 40 aa, Homo sapiens
MVTLTVDNVHLEHGVVYWVCEHGRRLVPCAVEDRGAPRVL

SEQ ID NO: 1006707 - protein, 34 aa, Homo sapiens
MVALLLTLILCTLLQLKGSHVHLPIPLAPSGMEA

SEQ ID NO: 1006708 - protein, 69 aa, Homo sapiens
ADVYHVPYGKLKSVIVASVDDIQCVEEFECQCHCGKPQLLRETMNTSPGTPAPSAEETINTIPGNPPRT

SEQ ID NO: 1006709 - protein, 96 aa, Homo sapiens
ADCTIKTDPVTVRSRGIGFVLFKDAASVDKGVELKEHKLVGKLIDPKRAKVLKGKEPPKKFFVGGLSPDTFEEQIKEYFGAFGEIENIELPMDTKT

SEQ ID NO: 1006710 - protein, 38 aa, Homo sapiens
LSPSLLFFSVQVLIHISLCLDEVAMPRGLTLWKHFAMD

SEQ ID NO: 1006711 - protein, 74 aa, Homo sapiens
TLDCVTERDSISKPQNERDNKQKTHGRLLLLDSECSPPRSAEEEEADICQPIHRQAHFRLRPPLSSGAKNPAPW

SEQ ID NO: 1006712 - protein, 114 aa, Homo sapiens
PAVAVISATGLFLCGFCCSLEAGHSGQPMHLERVWELGSVERPCRMQAPVSTSSPIQPDAEPVSYMTDPVRVQGPPLLPEGLGPLRVAKLEKITTLGGFLGRDMDSQGPTSFQG

SEQ ID NO: 1006713 - protein, 101 aa, Homo sapiens
MGASQAHTGGENLFSRACWGRCQPVSSRGLSSSPSRPRDFLTLPGITVQAGRLFSGSNYFATGSLKTARIGGYCQRLEENPGSKGIVGESRAHPVFEALVS

SEQ ID NO: 1006714 - protein, 43 aa, Homo sapiens
CVSVGSVPIGGRIAFAWYRAGHPCALVSFMFQACVMASAGRMQ

SEQ ID NO: 1006715 - protein, 136 aa, Homo sapiens
EEEAQMNGRGTRWEGGPGQVSALLLYKRTEFSEQKDCSLQAGIPPNLQAGLLCAQAPAWCPPSALSSATLSFPGVSTVVLGAYDLRRRERQSRQTFSISSMSENGYDPQQNLNDLMLLQVERMVPPVIPAPREADV

SEQ ID NO: 1006716 - protein, 75 aa, Homo sapiens
SVGSRPACPGSRELRVDLVDFEGYTYFAKYKSFNGGYEAEKYKLVLGAFVGGCLDSKTAPDIGVYPRKQDKASDS

SEQ ID NO: 1006717 - protein, 43 aa, Homo sapiens
SGDPRSGCFLALGRKLGPSIQAQGKHGLLLQNTQRAYAGERRS

SEQ ID NO: 1006718 - protein, 42 aa, Homo sapiens
LWGTWSVQPKRNRTDQKQFGKASNRSGMEGEVTIQGSGAVWH

SEQ ID NO: 1006719 - protein, 81 aa, Homo sapiens
QNTGDLCLWPPGDDTMAHMYSMTLRWKVRRRKTSDLWPITRPAKARRCQHGLQWSLSFVYTVLTEGTQLTRAVREEYRARN

SEQ ID NO: 1006720 - protein, 113 aa, Homo sapiens
MSIPSEQLLDSQGYCPGLGHCLQHISLVILDSLQKCVFSFDSHCQEKASEYIAAILELSALVTKGHQQILLYIDILYYLNPNGQRFRKDGRLVHEFTDAVIQERRRTLPKQGV

SEQ ID NO: 1006721 - protein, 59 aa, Homo sapiens
MQSIPLVAMIPRAIDRATCAKHSGGCMLQTTTQKAQPHMPGRRPPRYFKRQNARRTKVR

SEQ ID NO: 1006722 - protein, 58 aa, Homo sapiens
MPCPNWAMSVRCSSTSASSGSWNEIQPKALTCRGDSWIGHSALPRSWNRYVSSCLEVF

SEQ ID NO: 1006723 - protein, 135 aa, Homo sapiens
RIHGMHMSPANLVFLVETGFLHIGQAGLELPTSGDPSTSTSQSAVITGVSQCARPQPDKFLQSEPRGNSIQSRHWTSRHPRAPYGCLTDIHPHPKGPPAFWNDLALSSSWVNRFLQCTLEYTSTCVSHFFSILAT

SEQ ID NO: 1006724 - protein, 126 aa, Homo sapiens
MAVATIWYLRLTELSSPWDGVPEGGVGCICDVLATWPFQSLGFGESQLTWVDIAHQHSTAAVQKHGQTASLGGSRIHSSALFGTSQLGPPAAPTGVLLLTVISVFFLGWSSLDGGAGHHVCWFCNL

SEQ ID NO: 1006725 - protein, 38 aa, Homo sapiens
AASAAVHGGKGLQSQVHCVMMGGGSVLQAGGGVGTGQQ

SEQ ID NO: 1006726 - protein, 38 aa, Homo sapiens
LAFCHLGRLGSVSEAKVLFACEALKLTTKLQIPRQCAL

SEQ ID NO: 1006727 - protein, 97 aa, Homo sapiens
MSFPRVGVVDPKLGATVGLGKNRHRVEQGGGGHSLPVGTGRTAVLPLCLGVIVPEREELLLQLVPALQAGPQPVRVDHVQVSALLCLAHLLCARSRG

SEQ ID NO: 1006728 - protein, 50 aa, Homo sapiens
ALLSHADLSIPPALSSFSTHAYLMLEPHLLAVFECLWYGFGRAVWVPPTL

SEQ ID NO: 1006729 - protein, 50 aa, Homo sapiens
MKVAGRCKQWPLQHNPSCLHLGTRPAEGSRETPVVGEAWTVQGPPWDAIR

SEQ ID NO: 1006730 - protein, 88 aa, Homo sapiens
SGITGMNQHFTFFQSMFYFLLKPYMTPHCLHKFPTWPLGPSDWPHLPTQSQITLAPAIQIRAHSAGHAAPTAWKTLPNFYLADAYSTL

SEQ ID NO: 1006731 - protein, 57 aa, Homo sapiens
HYHAEASQSQVQLVSFDVLKLRSELEEWRACIAGVPVPAVLHYFIDCGRAAVGRCLE

SEQ ID NO: 1006732 - protein, 86 aa, Homo sapiens
LEDPPVLHADIPEVVVSLVIVTKAWVLSIQASGKNMGCYCRIPACIAGERRYGTCIYQEKTLGILLLSLQKKKNELKIGVEQKVQE

SEQ ID NO: 1006733 - protein, 73 aa, Homo sapiens
SRVQLAIVQSHAITGHCNAMTEELRATPQAQAQVQGRALSRMLYVGIECWPSFHAACRAKDAASEWYSSSNFS

SEQ ID NO: 1006734 - protein, 48 aa, Homo sapiens
VALEDSPSTRLWKETVFTTSPYQEFTDHLVKNHTSSLRCSGLRTRYRD

SEQ ID NO: 1006735 - protein, 41 aa, Homo sapiens
IPNSPVKKWNKENSEGFFYSLTPEQSTQDFCDQIVWEFSPP

SEQ ID NO: 1006736 - protein, 70 aa, Homo sapiens
IREYPQNFYTAAPSLSVCAAPSTLSHPQQIALLDQSKTLAESALQSYTLPRRLVVTQSKQLTPKEALEGG

SEQ ID NO: 1006737 - protein, 81 aa, Homo sapiens
SEGEGLREAGTRKQRITETESAYQELQAQRSDVYCDLNTQRPYYKLALIMTVSNMITWIQPFLKPNLDLIPSPTAIHTHRV

SEQ ID NO: 1006738 - protein, 61 aa, Homo sapiens
YVCRNPTSRVVMIQSSSHASAHMVSEQRMDATLILRSTQESSEEERNIKIQNCKSNKGLGN

SEQ ID NO: 1006739 - protein, 51 aa, Homo sapiens
MAETAHYNPQGVSSFFVPMELVCSFIHISSIISPDSATIGPKQLRAGLQFA

SEQ ID NO: 1006740 - protein, 71 aa, Homo sapiens
SVCVEPPTVCDGLLSLLLHGHLHLGLLYAIVGHWPPMAAIRWHHGQSDPFPNGSYYLISSWSGRQRQVIYQ

SEQ ID NO: 1006741 - protein, 67 aa, Homo sapiens
ADSGLDRWDSPASPSGPIFQKGLKDGTILCTLMNNAYSRVLRCRKINQLHAVHWHQARKPVQASSKA

SEQ ID NO: 1006742 - protein, 50 aa, Homo sapiens
CETPRRLACGIFIASGTRRYNQTQSGSQRQKGDVRSVLASTGSALGRAGH

SEQ ID NO: 1006743 - protein, 38 aa, Homo sapiens
MDARRRESEKSLDHETVYKEEDWQSPTSKSLNLISPYR

SEQ ID NO: 1006744 - protein, 62 aa, Homo sapiens
MVTLRGSRKIELRSQQPGVAPTACDYTKAWEDVLQEASASGHRMVCPGAPPGSLVHDLRVPA

SEQ ID NO: 1006745 - protein, 37 aa, Homo sapiens
PPQYSVVQFTWIESSKLHVLRISLIIRLILTKLHRYD

SEQ ID NO: 1006746 - protein, 109 aa, Homo sapiens
LIVRITCGLLKAHSPSPICRVRWLLKAEEHALEPAFLKLLKSRPLEAKTKPAPFQTKYSQRERSQHAPSFAHFWYLSTLTAGSQRCWFWKSSGLILLLKPAFRGGLDNG

SEQ ID NO: 1006747 - protein, 83 aa, Homo sapiens
GSSEEGGEEGEEAPECGRQVTPGFQSELRAWAMENQYIRHLGQTAESEVALVDTESHQSTILRALNSPFQRGTHIFLKDWTGI

SEQ ID NO: 1006748 - protein, 66 aa, Homo sapiens
MYPQIERGDKLICLSPSGHASCQVHMWTGAMLLCVSKVGGELARLTVLEGHEFYSEVLTEYHGGSQ

SEQ ID NO: 1006749 - protein, 54 aa, Homo sapiens
ADDPSMPCELPHMSVYYTNGLGWSTTMKQWQCVHLEVGSMVAPSMCSSFLDVHV

SEQ ID NO: 1006750 - protein, 65 aa, Homo sapiens
VRSSRGDCYKDGIVYPIWLSIDHYLSRLRLVSEIRLPGASTGLGLFCKRLRRPWSLEVWNSYASV

SEQ ID NO: 1006751 - protein, 35 aa, Homo sapiens
DFALQRLGHAAIQMSMLLGVPYCSISFLANFRFLS

SEQ ID NO: 1006752 - protein, 61 aa, Homo sapiens
SELPFLIQSLALLTLLAAPPDTLTWSPEQADSSLVLILPPWLHLLFFLAINVGVPSGSVLS

SEQ ID NO: 1006753 - protein, 47 aa, Homo sapiens
SLRSDWRHDRMKILVHILINSQRDLSRRWRKRRGEGRYYSFYLIDKE

SEQ ID NO: 1006754 - protein, 45 aa, Homo sapiens
QEFLAVGCAPPGVARPVFGVPSPLHDVTAMTGEVRSPHLSFAMIA

SEQ ID NO: 1006755 - protein, 63 aa, Homo sapiens
VFPVLEFPLVLAGGLLFEAVSVLRVGSCPASVVLFHVRFSQQAELSRSRVHAIGEKVSLVQCQ

SEQ ID NO: 1006756 - protein, 35 aa, Homo sapiens
AAGAWDHLVRVHLGIIPLFLGSHMDSDQISAKPQL

SEQ ID NO: 1006757 - protein, 31 aa, Homo sapiens
MVVMAYSSCTPDLRRILTDYGFEGHPFRKDF

SEQ ID NO: 1006758 - protein, 56 aa, Homo sapiens
SPPETVDSPDRLCLIPGLVLCFSGGECSPPGSTAGTLYVGLILRVHDGQSLLSMAS

SEQ ID NO: 1006759 - protein, 35 aa, Homo sapiens
PLHNYLMFLSTWDRGTVPQPSILKPRPCEQASLSF

SEQ ID NO: 1006760 - protein, 85 aa, Homo sapiens
WPELPGSGDVPEVSLELVATHLFDGVICCRLPRCRLSLSPHCGSVLNKERRVGRQALSGLTSPPHFTGRGLFAPVRIHLSMQTRE

SEQ ID NO: 1006761 - protein, 55 aa, Homo sapiens
MSEKLASSALAAHLPHVFFVFPCYLYYSFSSLEVDSSIPDFLHLAPIIVIRNRLI

SEQ ID NO: 1006762 - protein, 122 aa, Homo sapiens
SSPDLVGIRYGDRREEWCRWGSQSRLRDSGTDDQEEEPLERDFDRFIGATANFSRFTHLGSGDHPLPGCHSAMGLNLAKPCGKKYTQSSPRTENQSKKFKAEIPIKQITSSKKPIPSTPIKE

SEQ ID NO: 1006763 - protein, 43 aa, Homo sapiens
LTAYTMLIFQVDITLPCQLTKNDAVLCAGPMQLLHARALLSDS

SEQ ID NO: 1006764 - protein, 33 aa, Homo sapiens
EYPPQLGHDGSWSSSTSWYFSISSSSTAKPLAA

SEQ ID NO: 1006765 - protein, 118 aa, Homo sapiens
INFFEMESSSVAQPEVQSMCFMRVACEETTKQALCEQHGCLFHLGAGGLSPKRESAKGGGLSLVLTGFGIGGEEPCIAGRGGSHKVHSQGWGELQRTFLRVGEITTYLLKGGGDYQVH

SEQ ID NO: 1006766 - protein, 85 aa, Homo sapiens
KSVGPPQQELFSERDFMQILQALTFSQKSNARASISAEYNVSKQTQILMTCHKKSQCTSIMCFPSFRSSVPYVDHMGPDALMAEF

SEQ ID NO: 1006767 - protein, 39 aa, Homo sapiens
PLLGLVNRVSCVLLYSSDYLHSCFSTCQPQPPDAGVPSS

SEQ ID NO: 1006768 - protein, 58 aa, Homo sapiens
TPDSCVEDDKDALGANSVVCAAGATRLDEILIRGTSGLFPKANPCKLETTKTYREILT

SEQ ID NO: 1006769 - protein, 71 aa, Homo sapiens
RTPRVLAERAHCRWSGLSRYLVRRTGVFSYLPVSMPSYFCQSPMKTLPAARRGLLPEQGPRAQSARLSKAS

SEQ ID NO: 1006770 - protein, 136 aa, Homo sapiens
ILEDSPPVDPCHGPAECPACHLINLHMLHKGQIATMVIIEWLVILWQGSMDRVVANIFELNLQDQRFLTGVTISFLLESVTRQNLHSIHQNTESISQNLCVNHLTYHDSTLQFRQRWPWRPLGHLDQWVNYVNGDS

SEQ ID NO: 1006771 - protein, 90 aa, Homo sapiens
SLSSVTQFTLHANMLSCRKRLIAVLVDSWKIGLEFFKFLVMLPLLIFFLASPCVFRASQTIHLLGRFAVRDLIQPVALGVLTAVHYKAAG

SEQ ID NO: 1006772 - protein, 72 aa, Homo sapiens
QTVQSYPSYATTGCLASFFKEVVRRWYSEKPSISMTCGFFLDLFAIPVHTKEGRWEKLGICALMVGPTPLIH

SEQ ID NO: 1006773 - protein, 121 aa, Homo sapiens
TCYEGKMPKEKRLVRENKAENCREREKTTKSIWKHYRFSLTSSVMPQWNVTWCQMRQKNKAFCYFCNSVQKLPICAQCGKTKCMMKSSDCVIKHAGVYSTGLAMVACFCDDHTRSKVFKRE

SEQ ID NO: 1006774 - protein, 32 aa, Homo sapiens
MPQETGGGTWVESTPAGSVYYRVKHREMYGML

SEQ ID NO: 1006775 - protein, 92 aa, Homo sapiens
LSLSRIPKLLTVQEDFRAIRDVREIKVIDRKDSRMAIPEAIPQQPSGLLLGYFYGHFLIIRQNKGWIIREFSRKRVSKVSELRLPTLFRPYR

SEQ ID NO: 1006776 - protein, 45 aa, Homo sapiens
VICIAALGRLPVNLPGGPGVPLFPVPHYHYEHQCLPTPAAWFAHH

SEQ ID NO: 1006777 - protein, 39 aa, Homo sapiens
GTEAVYLAQTGVVHGPWDKKGCQLGDLFMGAEVGQELAQ

SEQ ID NO: 1006778 - protein, 36 aa, Homo sapiens
RGSPNSCTLIYSLGSQSARIAGMSHLGLAKTPSLFY

SEQ ID NO: 1006779 - protein, 37 aa, Homo sapiens
GVSPPRSHYAYTNTDTSGPLQKRSQGSSSHKGKRRVM

SEQ ID NO: 1006780 - protein, 38 aa, Homo sapiens
MLLVSQRIQFLVPTTAAPPGLLLYDAYRVCQLNEHAEC

SEQ ID NO: 1006781 - protein, 60 aa, Homo sapiens
RSIMLMARLTWASHEKMQEGDEGPVPPPKPGLGEWHPTKDHSWPMITCGHGPWSTCHGWP

SEQ ID NO: 1006782 - protein, 54 aa, Homo sapiens
LPVALKANYEPLSLFCKLRLQKHVKLTPPMMAYPSMTFSWTAECKSTRVQHYVK

SEQ ID NO: 1006783 - protein, 127 aa, Homo sapiens
RVSPPCLCFPDENFKLKHIRAWLVLSMADALLRHQRLPVSSSRTVKTAWLYCQHVVFGKVLEGMEVVRKVEEHPDRQSGINPLRMLLFADCCKIEVEKPYRYTDIMQVPLQKQSQGSSSHIGKRRGD

SEQ ID NO: 1006784 - protein, 81 aa, Homo sapiens
MHLCKFIHEMRQLSPTCSGTGNDDRREEHRSALEEGHCAHGDAVVSPPPHIMPTRTETHAGAFAEAMSGFFKSQREALSKC

SEQ ID NO: 1006785 - protein, 101 aa, Homo sapiens
MLFWATGFGEPIGKRENNSGITLSCACPIISYIFHTLCSEMVLKYTCINVHLGSLVCYGRQGMSSYSRLIMLLRSGPHPRASLLILIPVFPLLYHVTSSSL

SEQ ID NO: 1006786 - protein, 47 aa, Homo sapiens
EISVSLPQNVDDYMNCGFVAQRCRTTLALNHTVLITVFISCAFSVSS

SEQ ID NO: 1006787 - protein, 66 aa, Homo sapiens
NLDSVSRLLWKPGAWQAAHLWGVDVGVLVRVWKLRVQAPHSGAPRLGGAPHDSGVGAAASPGGGRG

SEQ ID NO: 1006788 - protein, 51 aa, Homo sapiens
ARVTISHTRWQSSASEREGPRALLQLSCTLDWSFLLSQVRCFRVHWWRLER

SEQ ID NO: 1006789 - protein, 73 aa, Homo sapiens
RGSPPLPSALHGCSIAFFPPASHSLSLILGARVAATLRGFCVTGSWKCHRVSELRASSISIPGGITTWHLCAT

SEQ ID NO: 1006790 - protein, 45 aa, Homo sapiens
MQAISCLHWRAGAGRDNELGIVGRGDWPGSAAVRMLTVCSGPPVP

SEQ ID NO: 1006791 - protein, 51 aa, Homo sapiens
LCAPTVLPSLGAHRGSCATSSTAAATAAATTVHGSQANGPQPGDDAGGGQR

SEQ ID NO: 1006792 - protein, 36 aa, Homo sapiens
EVQSEEEKREDKEDEEDEEDDDVSHVDEEDCLGAAE

SEQ ID NO: 1006793 - protein, 52 aa, Homo sapiens
YDAEASQSMCAAGRTSPCMSKPLAGAECDVSQHVAHGQPVNGKGTDTVEVHE

SEQ ID NO: 1006794 - protein, 98 aa, Homo sapiens
PPSSGIRRRDALYIQCKNVLKIRRRELMNHHKYRKLVKNDAVPAEDGPGGTPEMHARSRIEKDLRRIWLKAGLKEAPEGWQTPQDLPAGANESGAALS

SEQ ID NO: 1006795 - protein, 39 aa, Homo sapiens
GHVGWVLVLQGGGTAIRGAIILVSSPSSRAREATGGGRG

SEQ ID NO: 1006796 - protein, 57 aa, Homo sapiens
MATLQCVLERPYQSGSVPPTRGTMLLRRRPGQGGTNTLMSTNVSKSHRRNFHKEEKP

SEQ ID NO: 1006797 - protein, 38 aa, Homo sapiens
ASALTCLPSQRDLSAFTWCEGAIWWRCLSSLVLGAGRG

SEQ ID NO: 1006798 - protein, 43 aa, Homo sapiens
SHASTETEKNSGVRGGVTMHVAGTAVHREQEDPLVTQLPKVWV

SEQ ID NO: 1006799 - protein, 44 aa, Homo sapiens
GHGVVASSQHMARTVYCTDVGAGLLSMCQRNILNSQLAATGGGI

SEQ ID NO: 1006800 - protein, 33 aa, Homo sapiens
MNYLANVMSLYEVELNLGLGCVLYLNYCSRNLM

SEQ ID NO: 1006801 - protein, 50 aa, Homo sapiens
RSQEPSLYHCVDSMMAKGWSWSPRTLTTYPSQSGQFKEEESPITQVGIKY

SEQ ID NO: 1006802 - protein, 120 aa, Homo sapiens
SVPTQSPASLRVVFPSRLPPSHRLGRLPRQAPVRGSVEFPLEALSFNGSLRQTRAKPPELLSAPATLRRQAAEHVDAIKGLGRAQQERLCQGVGAGSVGRPLLTGVDRHAQRTQAGLPLK

SEQ ID NO: 1006803 - protein, 85 aa, Homo sapiens
CASGLTATSAAFALLPLLLLGLQCSPRACMSRLAAWNVSILGLQVQGLVLLALVEFPEVFFLSLVNNCENTGNWFSGKRSGILRR

SEQ ID NO: 1006804 - protein, 30 aa, Homo sapiens
MEDLRHHVQASWRFFSAYLPAAESGGGIHL

SEQ ID NO: 1006805 - protein, 35 aa, Homo sapiens
FFWSSLRYPRYCARLYLSAFPVDNPGDPERVVTGT

SEQ ID NO: 1006806 - protein, 31 aa, Homo sapiens
MTGFYHCWPGRDELHTVSSRPLLGGCRRLPS

SEQ ID NO: 1006807 - protein, 41 aa, Homo sapiens
EDPRVATSLANICSNKEPVQEGMCYCEFQLLLLPDDLCLLP

SEQ ID NO: 1006808 - protein, 48 aa, Homo sapiens
VTPPTGPVVFPHARTYATGTWHDTTLPYVPHHCLRRTTDDATTTRDHV

SEQ ID NO: 1006809 - protein, 159 aa, Homo sapiens
MGSVTVSARTGGGERSKMIDKNLRRTERRRRGRCKLLLLGAGESGKSTIVKQMKIIHEDGYSEEGCRQYRAVVYSNTIQSIMAIVKAMGNLQIDFADPSRADDARQLFALSCTAEEQGVLPDDLSGVIRRLWADHGVQACFGRSREYQLNDSAAYYLND

SEQ ID NO: 1006810 - protein, 46 aa, Homo sapiens
SGLAVVRQNQHQARAYSAAQFPPSSILSPALRMVLHHDECRTCGLG

SEQ ID NO: 1006811 - protein, 121 aa, Homo sapiens
MWLYYEEEEFETRLKEKKQEICLMSSGFLGDAVGTNGHKSLPHGLIGMQRYGPTPSYSKLKIPGLNSPIPESCSFGYHAGGWGKPPVDETGKPLYGDVFGTNAAEFQTKTEEEEIDRTPWG

SEQ ID NO: 1006812 - protein, 40 aa, Homo sapiens
SELVDDLVLIANSCASRFPAILLPQTPEELELQARFTTQA

SEQ ID NO: 1006813 - protein, 81 aa, Homo sapiens
SPPFPLRVPSRSFGALQDGSEAYLVGLFEDTNLCAIQCQTCNKLCHIDIRASTAAYVEQRGYETSYYDRENIFAVPVAAKF

SEQ ID NO: 1006814 - protein, 113 aa, Homo sapiens
MNVESIEVIVRRPKRCCARSDWQEDTFPAGGCANNSSLCPASRCLPMLQSNPSMLTSGSHPQAIVSSSTPQYPSAEQPTPQSPFMVSPAPGPFCSGLCAKPPSGVLSTGSPFF

SEQ ID NO: 1006815 - protein, 49 aa, Homo sapiens
NFSSRSSYSAQDISLGTGGAHLKKIREESNTKIDLPAENSNSETIIITG

SEQ ID NO: 1006816 - protein, 59 aa, Homo sapiens
MPQVPNNQFRFGGLREISQAAAVVIEGIGPGQDACQEPGGPHLQQEPALGILAYVKPSC

SEQ ID NO: 1006817 - protein, 43 aa, Homo sapiens
ELGTLAGVVLIVLDELRQAKVCDLARQLVPNQDVGCPQVGGSS

SEQ ID NO: 1006818 - protein, 51 aa, Homo sapiens
MARVIDVAKPAKTLECRSKATMCGTLRLSKESHLAQSYSSAMALHRRALRD

SEQ ID NO: 1006819 - protein, 82 aa, Homo sapiens
MAMLKKKLRGQALALRRGPSAFRLCTQRGLGSWNKDPKRSPILFGPKGFCQTSRMKGHALPSKGWSHGCTKERVAKGSGVTG

SEQ ID NO: 1006820 - protein, 129 aa, Homo sapiens
RADRNLIICAAILKRHYDQREDYPSPLKTNTKLKFKMFFGGEGSYDLHFGNHLLPDTEAVCYSELPRKESRTILSLTSIHLFLRESEAMSPYILQLKKTALILAVQHITIQAITAEAPRPATGAGVLSA

SEQ ID NO: 1006821 - protein, 49 aa, Homo sapiens
ADSIAGWRLALRALDVLLGVYPSLAIVGATDDIYICFPSNLSCCQHKVF

SEQ ID NO: 1006822 - protein, 99 aa, Homo sapiens
SLTLRWMDEEPVAREIAIAILDSSLPLMSSFWSDKTLTVYCYYLFPMYKVALASNTSLFLLQISYQINVLDKSFLLTVFIFGLGQTQLAEGGPPPRESS

SEQ ID NO: 1006823 - protein, 89 aa, Homo sapiens
MRTSLSTTVWLGEHAREARHQRLQFFITTVKTAWLDSKHSVFGTVLEGMEGVRKVESTKTDSRDKGLKDVIIADCRQIEVEKPFAIPPP

SEQ ID NO: 1006824 - protein, 37 aa, Homo sapiens
GSGITCILTDEMLPQDSLTHAHSLLKKQADHHDPHPS

SEQ ID NO: 1006825 - protein, 48 aa, Homo sapiens
MWFVQFQNSVVCSEGAVTRCLECLTPAITQALPLVPTLSAYATGPHFP

SEQ ID NO: 1006826 - protein, 60 aa, Homo sapiens
MRILCMGSVRERDGQGGGERSKMIDKKLREDGEKAARDVKLLLLGAGEVRERAPIVQADE

SEQ ID NO: 1006827 - protein, 135 aa, Homo sapiens
LEDPPASGAWLKELINSEHAIDHFIQKLPSELQGSLLSDKANKRLAYLTYQDIRAVCDFKEQTVIAVQAPPSDEDCEVPDRDLGPTCRYISGSPDGPSKSTSAQSRCRSRYVLPRSLSPLPSSSARALSLTCSAA

SEQ ID NO: 1006828 - protein, 52 aa, Homo sapiens
EEELSTDSRVLFSMISIYVDEGHKKMDLNSYSPITNACKFLIMKSRSDMSYT

SEQ ID NO: 1006829 - protein, 37 aa, Homo sapiens
FVVLSSPRGLGWVLCHYGTTYYLHYYAPPSPFCSSGR

SEQ ID NO: 1006830 - protein, 45 aa, Homo sapiens
AESQCQKRHPGLSVTEENTSATVAEKRPMTSSSWGSWCITSGCRI

SEQ ID NO: 1006831 - protein, 34 aa, Homo sapiens
SAHLRLLIGGELYTLLADRLHGTSAVYITTLSGS

SEQ ID NO: 1006832 - protein, 87 aa, Homo sapiens
GLVGTWWLRQRGLSARHRLCLDLRALVLWSSESVKFSSSEGLQCTLMVGLVLLGPWTPSVCSHWNSLHAAWTSPGKGRRQCGLAPGS

SEQ ID NO: 1006833 - protein, 36 aa, Homo sapiens
MVFRQPLQSRCSSIPAIRRTPESHSSTSVMPCISLR

SEQ ID NO: 1006834 - protein, 34 aa, Homo sapiens
MCASVESAFPPPPVPRLEDIISPCAVWREVASSP

SEQ ID NO: 1006835 - protein, 39 aa, Homo sapiens
SIPPDVWGLASQQHLPAGIYHLWRASSSVKHPPAALQRR

SEQ ID NO: 1006836 - protein, 32 aa, Homo sapiens
MVYKPGCVEEVSERPRYNHAVYRQRETTNMMD

SEQ ID NO: 1006837 - protein, 39 aa, Homo sapiens
DTREFQMESKCRLTTKYFGTFLPEVDKKFPNMKIQIHVS

SEQ ID NO: 1006838 - protein, 33 aa, Homo sapiens
LELSPSLHSSPCAEATWGNKIGYAPHLSLDRGA

SEQ ID NO: 1006839 - protein, 33 aa, Homo sapiens
VHCRPPHQHCICQCGGVSTSMTELHQRVPHERC

SEQ ID NO: 1006840 - protein, 33 aa, Homo sapiens
LKKESEAVASGSIRPISYRTDYGVRPVLRLETA

SEQ ID NO: 1006841 - protein, 138 aa, Homo sapiens
GGRPRWICEGRLKCNVVISAALLPSASQGSLRFSCFVLLSYSRLLCSVALPAKEECSRDSSFKDGGLSHTEQHFLYIPEARDANRTRGIDWHSGSIPGLLGISWIAAPAARAVLGFTARFYGKLSHGRDSLFRPGSFR

SEQ ID NO: 1006842 - protein, 78 aa, Homo sapiens
MLPSAGLEPLESCKPTSDSLNAGELEDESLRLAFMSLVNKYPLLENKPMKQQQQKPFTLGNCGVVAQEAPRNGGPHSS

SEQ ID NO: 1006843 - protein, 45 aa, Homo sapiens
MGFFGGDVTCFEPVPFYMLLLHGSIQGLGYTLSPHLPALPQRGGT

SEQ ID NO: 1006844 - protein, 129 aa, Homo sapiens
LSAGSDHPSPGCRGCSRAAIVPLHSILGNRWTPRLTNEQYKTTNKLTRNRDSMWPAMPNHYLSDTVLPSPACTASLSFLALACISLGMATVLYLSRQSFHGWKPSSACASLFPDESCPLVASILIPLLA

SEQ ID NO: 1006845 - protein, 70 aa, Homo sapiens
PVDHSDKDSTRISSSSEAHRAPPLCYPAAHSASAPSGGCPTSLDHLGSPCQDVTSSELLPKHLSFNYSPK

SEQ ID NO: 1006846 - protein, 68 aa, Homo sapiens
RLLQHVVSPKARFQAKRFSTYPRACQCVRASPARKPSPETPPETGSGPGAEASLEEHKKVNMWQTSYH

SEQ ID NO: 1006847 - protein, 79 aa, Homo sapiens
MHLTTVSRKEGITQEGTPGCRIRAGKSALQLNTRNRARGPRIKGNGHETSVLKRPELEIVLDEAPRVARRPPGFPFDSN

SEQ ID NO: 1006848 - protein, 45 aa, Homo sapiens
MSRGHACIYLRQSLLYEHYAAVPQMQNHGADRLSSTGPNYVSPVN

SEQ ID NO: 1006849 - protein, 86 aa, Homo sapiens
NLQVRVVIRYYFEILRSIYLSISSTVVQCRYIQNRSHCTQQQWHPPFHGSARCELLKCLCDAAQQETVGQLSVRLRYCLSRGVPIP

SEQ ID NO: 1006850 - protein, 37 aa, Homo sapiens
NNSMYDLKASPGGLPCGALQTAQQLTQEATVAVAGPH

SEQ ID NO: 1006851 - protein, 81 aa, Homo sapiens
WCPQHFLFSYTTEDAPPAMWTKVIPVLEGCIIQARRGLPGAVEEGGSLEGPLPGCACILPPRMTQSTGDVIRGKLVVGEPR

SEQ ID NO: 1006852 - protein, 68 aa, Homo sapiens
MALYEVTTRTVRVPRRAWQAPCLVSKNHDPEEGFPAGWGPATLLGPRGTPPPPRPAPASTEESWLGAR

SEQ ID NO: 1006853 - protein, 38 aa, Homo sapiens
IIAVQMSVPGQLSTWMTTGPYSGPFCGRARAAYGFHAK

SEQ ID NO: 1006854 - protein, 39 aa, Homo sapiens
RLEDPGGMGSVNCLSRGNTLLPLGIKGWVMESQAVVALG

SEQ ID NO: 1006855 - protein, 55 aa, Homo sapiens
AGDRSDVVTGKCLCVAVLRRSTSRRSYMDGLLSTTKPFLRHAEHVIGKVAEAPAS

SEQ ID NO: 1006856 - protein, 38 aa, Homo sapiens
MLSSKGPPAQSLSALGSYWTPAASGDTALLRASGESRI

SEQ ID NO: 1006857 - protein, 112 aa, Homo sapiens
VLDRAADGAVLREVRFYGVSSFQMESVKIILVLDTLSLDFCFAVGSFIGKVQFLLVLQLQTDKVLVPLSSAGSQLSGNRYQNEMVLIRYDKGIMKGTHRAKGAGEHLLEGAA

SEQ ID NO: 1006858 - protein, 55 aa, Homo sapiens
GNDLSLYSGGPPLQQAPVQRITGDVCQDVHFKNFGELNESRLLSDQLHLCPGLLE

SEQ ID NO: 1006859 - protein, 121 aa, Homo sapiens
PNQSDCAQPEGYACSDHPQLMNSWGAWTAHCHSTNSSFETKTAWHLPPASVCATPCPAMESLIGLLPPMETFLARKSHILLPQSPSAQGTSTFPLEQGTLHKSINAVLKVPARLSGMKTRS

SEQ ID NO: 1006860 - protein, 105 aa, Homo sapiens
VCRTVAEYAVAVDLAGRLRGAPADLPLRTGSLQYLLRHLRRIVEVEQDNKMTPVETWASCTGLRCFGHGPPRPPMSSPPWWIIPIRPDVIETLIVQITDWSSRRS

SEQ ID NO: 1006861 - protein, 34 aa, Homo sapiens
CNQYMVKSCGRDGFHIRDAAPPLSTIIRINTDVV

SEQ ID NO: 1006862 - protein, 67 aa, Homo sapiens
ASNSVLRFSRASQCILMHLQPSRNPDIYYLRSVQPRRAVIPEPGVAPRLARLTPPILAKKTKRPQPP

SEQ ID NO: 1006863 - protein, 128 aa, Homo sapiens
KIFFIWQENETAAAQEGQVDLILLLVVSSPSPPGLLGFVLFTRAGRTTPIGRAQREVDVLLGIQADKKDGMFTNMLAEPEYCAGGSDTRDVSEMDLAKPSLNDLGLQAFISKEILYLQGQDVIQLHLA

SEQ ID NO: 1006864 - protein, 56 aa, Homo sapiens
LPGLLDTYRVWRSGLPNLPSNRLGPRVELGLPETVGVRLDSGDQLLAGLMEILQRS

SEQ ID NO: 1006865 - protein, 39 aa, Homo sapiens
VTVASGHSSTANGRELVARRNGLVASGNLRQPDDELRQR

SEQ ID NO: 1006866 - protein, 155 aa, Homo sapiens
NSPALGRSQECRQQILSGWLRKELEMQNLFPCVKAHLLSLEGSESEKDDLAYEELQGLKVGSEAPLVDKTQVEASSPRLNPAVTCAGKGTPLTPPACACSSLQVEVERLQGSGVKVLAEQQKLQQENLQIFTQLQKLNKTLEGGQHVGMHSKGTQ

SEQ ID NO: 1006867 - protein, 112 aa, Homo sapiens
KRETLRALFQKRVTGPAPWSLEMEPLSPLRMWLAQKMSQSDSGVDLRWGFSECHQGPMQPAQVPTDERTQRGQQEGPPIEAWAPTPLECCYLGEGPPWLLNLLRRPPLCPPT

SEQ ID NO: 1006868 - protein, 61 aa, Homo sapiens
AGTEAKIWHEAEISYQARSYLLRHGQTRILIPGPDPTSSDTDGHRSSYLYPASLPQTLEDS

SEQ ID NO: 1006869 - protein, 78 aa, Homo sapiens
MGGKRLGVSFGPLRGRTGSFGGCFSVLQGAARGAAPGAGGTERGPCASSAGGGSPEILLAFDHSPSGAWVQKGKGIGG

SEQ ID NO: 1006870 - protein, 42 aa, Homo sapiens
RPRGLIQHTLPAPQVTAKSGLDELVSDLLQEAHTDLERVRAI

SEQ ID NO: 1006871 - protein, 37 aa, Homo sapiens
HRGQQNKNSQATCAPPYIEQAGYITAPDTWAHKVYTC

SEQ ID NO: 1006872 - protein, 44 aa, Homo sapiens
YPQPVREISGKRTRSSIDLMPPPRLTRVGEHTGVSSMLANSVES

SEQ ID NO: 1006873 - protein, 33 aa, Homo sapiens
NLIVEDPRDYTGTVTALTVPFPKIKQTSQIPQH

SEQ ID NO: 1006874 - protein, 58 aa, Homo sapiens
LSSAYALTHTYTCTTLLMHSTLCAHTLLAHTRTHSCTHSAFAPHNLHTFIAHSCTFST

SEQ ID NO: 1006875 - protein, 108 aa, Homo sapiens
RVGAQLAATHRPACFRRAHRAPIAVLLSNCLHPMVLFQRGPDPREGAGLNSSPGSVILYLGPSMTSGLIPSLLASQCLFFLILSPRLECNGVILAHCNPHLLGSSDTL

SEQ ID NO: 1006876 - protein, 69 aa, Homo sapiens
YSVHTTHPPASAHCGGAPADPSQLSLAGSCMGCGDGRGVSAGLCPAPDPQAPQDSCISPPRAHPVPCQE

SEQ ID NO: 1006877 - protein, 41 aa, Homo sapiens
IEPCDASRYITFSVTGLPTPRLLSGPKRHHLLVQQVLADLP

SEQ ID NO: 1006878 - protein, 37 aa, Homo sapiens
PHVTGEQHTRLGPLRKGMSSHTSGPQCKGSSAAHPLG

SEQ ID NO: 1006879 - protein, 40 aa, Homo sapiens
CLHGVGVSRSTKFGSQACAFCPLASCFTSLSLMVSSIWDD

SEQ ID NO: 1006880 - protein, 57 aa, Homo sapiens
TVTRLSAGASVGSGPSERGPLDGSHGYRLGSPRSWNSEADRIVRLLILQWPPGTELQ

SEQ ID NO: 1006881 - protein, 124 aa, Homo sapiens
SPPVCSLPSALWISSFSRRPDMSITPAGHTFFISFWSHLLKQVVISFRVLDVSTEVANFVAACICQVVLSPPQEELFRGEFHQILQALTFSQKSNQSYISAEFNVSKQPNLDDLPQKSQDQIRL

SEQ ID NO: 1006882 - protein, 51 aa, Homo sapiens
PKLQQLYSISSNDVIGCHEILAVPSIFYLLCPDSLHPIGRGLSYLHDAEVG

SEQ ID NO: 1006883 - protein, 37 aa, Homo sapiens
LGLDKPDHFMIPPGTGGAANLYLIFGNLFLMYNLPIR

SEQ ID NO: 1006884 - protein, 120 aa, Homo sapiens
MSLGHAGCPKVLPVTECCTSWHYVPTARLSCCCDCRMDGLTQADKDALDGLLQQVGAAPSVLSLPRGLRQIVLCGGDGPEAWRTGIRDWQVKSRFLGVSHSVQKPALSSQGPPGFRTKLR

SEQ ID NO: 1006885 - protein, 43 aa, Homo sapiens
DSLSQNVCTEAESLCRPTAVCQQTVKEGLGSMLSPPLNPGQSG

SEQ ID NO: 1006886 - protein, 31 aa, Homo sapiens
MARNTCSTLCDRLHGVNPMTHFPVGRLTAVG

SEQ ID NO: 1006887 - protein, 36 aa, Homo sapiens
CCSSCTIPGKGVVRAPWGPGSLIPELISGLFPIVTG

SEQ ID NO: 1006888 - protein, 39 aa, Homo sapiens
MEDQSTDTLIELQLMMKRVQQCAVLMPVIPALWEAEAGG

SEQ ID NO: 1006889 - protein, 102 aa, Homo sapiens
NATPTPRFKRFSCLSLLCSWDYRHTPPCPANFFSIFSRVGVSLYVAQAGLKLLNSSDPPASDSQSAGIKGASHHTQSCNCFIHNPCCQVKTSEIFIPTQFCS

SEQ ID NO: 1006890 - protein, 54 aa, Homo sapiens
PRLFLKVCETCTYQKEPTLDIRSRLVSVGDSHVHPVAKYWAICTSCYIHTSMVL

SEQ ID NO: 1006891 - protein, 75 aa, Homo sapiens
GVRMLYSDHCVAVISSLFPSCSAMLRHACSPFAFHHDCKFPEASQSSFLLSLRNCGSIKPLFFINYPVSSNSLQQ

SEQ ID NO: 1006892 - protein, 62 aa, Homo sapiens
MEVSTVLYVVDGTCTGRHSTAVVEYTYDQAPYKRYKEVSTVLTYTKELSTRGGIAPAVVEYH

SEQ ID NO: 1006893 - protein, 62 aa, Homo sapiens
MEVSTVLTCRRNLYREACTCIGEYTSTKAPSITIFGGQHGAHSIDGTMSREVCNRSGEYTSS

SEQ ID NO: 1006894 - protein, 31 aa, Homo sapiens
MEVSTVLNVDDGTCTGRHSTALVEYTYDLGS

SEQ ID NO: 1006895 - protein, 54 aa, Homo sapiens
GSDKRYMEVSTMLTYTTELVQGGMHRNDKYTYYQDAIYTYIRRYSTVLTYRRNL

SEQ ID NO: 1006896 - protein, 59 aa, Homo sapiens
SPGPACCSLQCPSVPAGGYWRRATLPSENFLSSVPTETGPSLQFRAALSWRRLPPRLCL

SEQ ID NO: 1006897 - protein, 102 aa, Homo sapiens
MTRIPWSATPLWINFYHAECSTTSWPWSLFAVIFPSEIAGQCPGCSECRHFEAQRIIHAIWFLNQAVANFLSCLALPLLFTSIAQHHHWPLGAAACSILHGT

SEQ ID NO: 1006898 - protein, 41 aa, Homo sapiens
YGGEDRWHYPQALTFSIMQGLSVWRQLPHNKLLNIVILGKR

SEQ ID NO: 1006899 - protein, 52 aa, Homo sapiens
YAGCPRYYNFNLLLIIFQVEVTIESRAEHCKDYIVDYHNPCQHVAWYQTDHC

SEQ ID NO: 1006900 - protein, 43 aa, Homo sapiens
RLCSIAQVFIKLLLLQHSVLEICFLMACERDRAAHVLSGDPAL

SEQ ID NO: 1006901 - protein, 77 aa, Homo sapiens
GRVLVLIDATYAAFRLTHQMRCADSLTWIPRCIAWVLPHLDRLVMRTFWTQVTPARVSWTRELRAGSLQHPGNPPPH

SEQ ID NO: 1006902 - protein, 37 aa, Homo sapiens
MTRVLEDLYSKQGSATIYGGQHGAHVVRRELVQERHS

SEQ ID NO: 1006903 - protein, 59 aa, Homo sapiens
MIISRTFERQLTPFHLSSTPADDNIKTPGFHPQRMISRNLPERQLHIPLPTVRSNPQKD

SEQ ID NO: 1006904 - protein, 52 aa, Homo sapiens
KLLWVLQNKQPVVDPISTPGWELVRVPPGAVEVAISANRLSIYRTGGARDDR

SEQ ID NO: 1006905 - protein, 61 aa, Homo sapiens
LDMLLNGIKSDGLPIAGEDFSPTVNGALQTEGSPCLQDSDVYNVVDVWLGCSYIYDAAWKP

SEQ ID NO: 1006906 - protein, 59 aa, Homo sapiens
HINATWPRSSSVRTSVELARNQVEEENGEPWPRCPFCTISLCSPHFKPDWLPLSGTCML

SEQ ID NO: 1006907 - protein, 35 aa, Homo sapiens
IYDFENIKANPQTPHTVTQRRGLEITTEMLVLPRM

SEQ ID NO: 1006908 - protein, 78 aa, Homo sapiens
ISQLQGKRLRGQRMPALSFAHPSFHHTGTLDPGLASTENWQESPGLAITGTHIESLLKLHIVAEHSDSLPIIQDFGTP

SEQ ID NO: 1006909 - protein, 34 aa, Homo sapiens
PRTLSSRQAHFPGTLDFHISCTAFKNPPLNEYKE

SEQ ID NO: 1006910 - protein, 45 aa, Homo sapiens
TEDTLKRTPGISPYSMTLCGPTSTQTRNFIIIPTSKSSERAVIRV

SEQ ID NO: 1006911 - protein, 80 aa, Homo sapiens
HMFANGCPSVLVYPLAPPPVQCAFSFHHILDPRGLSLGSVLSWNVDFISYRQVKNICFKMRPQIQSNYISSRYGYMIGYP

SEQ ID NO: 1006912 - protein, 84 aa, Homo sapiens
DPPGNVVVVLILVPLKDRLLDPLLLRCKLLHSDLHKMALGMYMKDLPPGIVARVLEMERLQYIHQNETVSQQIGEVPVQSGTTV

SEQ ID NO: 1006913 - protein, 40 aa, Homo sapiens
DCRCCSSEATSGRLEGGVFAAGKGREDGWGSLFGIDDVHE

SEQ ID NO: 1006914 - protein, 41 aa, Homo sapiens
CNGDIEGEQHLSGDFQPSLCFRCGVMGVCFNVFEIVNVGFM

SEQ ID NO: 1006915 - protein, 36 aa, Homo sapiens
THNFDPLHVVLKATSIVLMPGGVNKGERVRGCCSWK

SEQ ID NO: 1006916 - protein, 66 aa, Homo sapiens
MCVNGDVVHNTIQAPPQGGVSCGELGLLQPTEESKDQKQFGKCQIRQVDGVENGKSSAVVGSGLAT

SEQ ID NO: 1006917 - protein, 64 aa, Homo sapiens
SERLGRGTNYAIKVSEMKVRPAYTGQDSLHMSPAEVEEATTHNALTSWKVTPTFPMTRLHFSMS

SEQ ID NO: 1006918 - protein, 31 aa, Homo sapiens
MGRGTLYGLNEYLWKVLTPEPGASPELSLLG

SEQ ID NO: 1006919 - protein, 148 aa, Homo sapiens
RVSPPGALDPLESAHIRGFITPGISSRPIWRLRRTTCAREAKLLKREGSPSAPTALTGPDLGLQHGWPWVPLKLKPAHEGLVRHRCNDAGRLTPDIPREELRHTPHLPLAPLPLNEGSITQGPPLNYIPARSSLAPKSTTYPPSSAAP

SEQ ID NO: 1006920 - protein, 151 aa, Homo sapiens
RIPLLDLRENCCYEDCALLCGTVIWAARRHLIGSTLSCFIAPPPGWSAYPEIIRAHDMDFTDIIKFFNERAELHDAQEILRIARDLVHYVQMLIENKGAGASDAAVVLQPGLRQGEVHGSHRPDLPSLHPSPPLFLTKRLLALILQLLRVP

SEQ ID NO: 1006921 - protein, 67 aa, Homo sapiens
VFAYCRILVLEGCVVRLPHYVKMSDQASWLSLIKYVLYRVTILFFFVARQPDLLLRHLDPPCQDQPR

SEQ ID NO: 1006922 - protein, 113 aa, Homo sapiens
GFARSLVSCFSVPPDTQTCCEATADTLQVPERGSTLGDMNALANGKSCLQPMMQRHIHPTARITHGHPDPQSQRGPHSLQPPRPIPAQSLLPPTFLESDERASMHSSLHLKLP

SEQ ID NO: 1006923 - protein, 85 aa, Homo sapiens
STNEVDREDRQMTMGPPSAPPLPRLHSPLVRRSCFTVLTSNLLEIPPTTVKLTIESTPSNVAKCKEVLLLAHDLPHNRIGYSWYI

SEQ ID NO: 1006924 - protein, 36 aa, Homo sapiens
ALQIHSMGSGLRRAVTEHGFKIRAELGAVAHACNPN

SEQ ID NO: 1006925 - protein, 30 aa, Homo sapiens
MLYWVILGRVGDLDLGLVPDLGLVPDLGLV

SEQ ID NO: 1006926 - protein, 101 aa, Homo sapiens
SMNLSQLGDTRTISNQKTKQFAEECLIYPGRAAYLSSNCTTSINNEYTSSLEMGNAGAPVFVPQSFWALASAFTSTLTRGEVTLTTAAKRAQETARAFLFS

SEQ ID NO: 1006927 - protein, 124 aa, Homo sapiens
RIGGFRECLSCSSRVLRIPVESHRRAGLAPNLSMFQSEHVVIMRSPGDGTDSGKAAADTSSQARRQNARNGRNSGMWQIRKGKPLDNTYLMGVDHILLANPFVLLSLGASLHPLSGEIAQVELH

SEQ ID NO: 1006928 - protein, 64 aa, Homo sapiens
RFASLEDRHEKDSESGGGKELSQACEVQSAQKGSQDAQVHSGSGCILPVCPRAAVNAFPLAVSL

SEQ ID NO: 1006929 - protein, 54 aa, Homo sapiens
HWVRPETPCRRIQVSAQNTGGGGWRPRVGGPSLGGTPDCHAREELKPLVSPKNT

SEQ ID NO: 1006930 - protein, 124 aa, Homo sapiens
IYRISRHGFGERTTDVARGLHNSLQLCRCSNFFFSRDEVLPLLPRLQCNGTILDHYNLCLPGSSDSPASASQVAWITGMHHQAQLIFVFSVETRFLHVGQAGLKLLTSGDAPALASQSSGITYR

SEQ ID NO: 1006931 - protein, 36 aa, Homo sapiens
EIVPLHSSLGKNETLSQKKRKKVRLLQELQWLLQMR

SEQ ID NO: 1006932 - protein, 33 aa, Homo sapiens
RHLADLARGRSKLKMAAKNWAFMRKTGSLCFVE

SEQ ID NO: 1006933 - protein, 35 aa, Homo sapiens
IPKKRPILSAMRNLFHGQHAIGPGTQLVQIGIPAD

SEQ ID NO: 1006934 - protein, 48 aa, Homo sapiens
RILRGSRGGRRTCSGVDGRHFNGSSSSESGRNSVSKGKVADLISVRYR

SEQ ID NO: 1006935 - protein, 76 aa, Homo sapiens
QSVIANRVVDMAVQCRVICVPQQLPPPYDLAVLVDDDRRAHDESGCSLAGGDLQVRGVPQTRLVMLRELKSSISLL

SEQ ID NO: 1006936 - protein, 34 aa, Homo sapiens
SRVIPKSELQHDLLQRVKEQNFYSAGTRDPSGVA

SEQ ID NO: 1006937 - protein, 68 aa, Homo sapiens
MDRHGKPSVVSEFFTRLGPAFIRSWLDQSTPYTAVRCVVTLSLRVVYMIRVYLLQGWYIVTYALADPE

SEQ ID NO: 1006938 - protein, 74 aa, Homo sapiens
DPEQREEERGGLRRTSEGDRETPSWGKATPAEEEKTGKVKYSRLAKVLLSNKRRGFLTNLSSLLRPGYRRSEFR

SEQ ID NO: 1006939 - protein, 56 aa, Homo sapiens
PPRGEREKVCMTASMTNWGPARFWRNTLGSEDVHVSNGDTLVLAVWPHSPSLIVIA

SEQ ID NO: 1006940 - protein, 82 aa, Homo sapiens
SFCDPVLACCQVLNWIQDIDTSECAARAGPMCPLRYVGDILGAVIAHSGLVSAPGWSELNESGAPAEVGVLYGFIHTTAEAL

SEQ ID NO: 1006941 - protein, 34 aa, Homo sapiens
MSYPRHLLQTGKDSFSEFARTPGLRIWLESKMSH

SEQ ID NO: 1006942 - protein, 47 aa, Homo sapiens
KWQDHWYEVDCCGLSGADLKLHSGRASGKALRPAPASAQSPPGLQQP

SEQ ID NO: 1006943 - protein, 33 aa, Homo sapiens
MWRPMCRPFNLPLPALARVPRCLDSKTLVGGLL

SEQ ID NO: 1006944 - protein, 69 aa, Homo sapiens
KLEDRIHTPAEREKIGEQEGRGKQITKEDVSRLSGQGRGAHSGEGLVLWHLVFSGDWAQEHIRRLALRA

SEQ ID NO: 1006945 - protein, 97 aa, Homo sapiens
MSNSVQDLVDVGTHRKRAALHSVPSLNSDQPRWLRDRTFPPPGLITEGVWLSIFLLAITNPRCPPSLVSARMFKEPLAILVLQIFRQEHCCPSTAAP

SEQ ID NO: 1006946 - protein, 30 aa, Homo sapiens
MLYARLTWASHEKMHEGTRALATTISQASG

SEQ ID NO: 1006947 - protein, 84 aa, Homo sapiens
LRGPFESQSDGKILAEADRLSTKHWLIGTDKCVERINEIVNRAQRKAGVDPLVPIRNYGPISENGGDQEDTKEDPDRGAIRGPI

SEQ ID NO: 1006948 - protein, 41 aa, Homo sapiens
MRVLEHVRERVRTVKCNRHVRYMWCRACEHVMCVRACVGGV

SEQ ID NO: 1006949 - protein, 115 aa, Homo sapiens
PQSGGLACFTPPAPPPFLSGDEDPKASTLRVRDLLAPIAFHGKVARAYSNLRWLENNRPLLIRFFTTSCSSIVPFNAKSWDLPSCLVTPSEPDSLTSRSDSPMHACPLELGTTPW

SEQ ID NO: 1006950 - protein, 38 aa, Homo sapiens
IESARTPRTLHTCPLSHALTLGAHTATCSTRRNIISCT

SEQ ID NO: 1006951 - protein, 34 aa, Homo sapiens
SEDHLRSSVTDTSLRYMVKPRLYYNILKFTLGVV

SEQ ID NO: 1006952 - protein, 86 aa, Homo sapiens
LGLGCAALVTKAGALQCSPSDAYTKKELIDVCPRESLIKVSHVLSCAPALANRGTHVLQSQTATRWCLDIICCTSDTTNHASPTDW

SEQ ID NO: 1006953 - protein, 70 aa, Homo sapiens
RQSGAGCGSTTLRFLVDRERAVTSVLGAYVFPVISQDHEGRLDLDSIAWDDIHVVPGALKLFLREPPQLR

SEQ ID NO: 1006954 - protein, 80 aa, Homo sapiens
VGSTQLAGQAYMERSGNASSAASQRLSLPLWNSLSYFSSRLAATTTAVVAADYLHVSLDLLERKLRSLWRRPFNVTDVLT

SEQ ID NO: 1006955 - protein, 76 aa, Homo sapiens
PPAVQHFPFIHALVGIRPLVMSSPESGSQWTSTSDLIVNLPQNAASGAVHLMRNLEPCQGLYTSSLMRRATPHVRR

SEQ ID NO: 1006956 - protein, 99 aa, Homo sapiens
MRVCVPLQQKLCHPHLPVLGRHVQSDKSFLGHAGLGCFLFQKGQDCLHIALTGCNVQGGVPGVRGQVGVGVLFQQELHHVCVADASCTVKWGLVILGLC

SEQ ID NO: 1006957 - protein, 68 aa, Homo sapiens
GLVGLVGPAKRVDARHRLCLIPAAGIVSSRGACSISSSEGLQCTRMVRLSSWVQTPMSVPLASYQRDA

SEQ ID NO: 1006958 - protein, 131 aa, Homo sapiens
SPEVAGVGSQPWCPLAWHRPRCLLPTEAAGAATAMLSSISRGMSSSLVSTFGMDESAVYSTASRYLVPVVIKVGLSLRTYYGSDGRRLYRLLWGPCAPGSPLLSLAHASVRPSLNSGASAVSLTSSQILTV

SEQ ID NO: 1006959 - protein, 56 aa, Homo sapiens
YLEYPPASGGQEKLALLPIPPLAHSLTRLADVVIWVLRLGAEDPQTQVVLFNALHD

SEQ ID NO: 1006960 - protein, 124 aa, Homo sapiens
MNSHTFPKPLLVRVAMPFLVRLPLAAVLLFGDHAEGRLCVRKTPGAMAWEVRPAWAPRPGARGCVLVVRQVCCYSTLAGALAELPSCEAWLLALLFEAGVLQAGVVQAGVVQAGVFEVDVVPAE

SEQ ID NO: 1006961 - protein, 58 aa, Homo sapiens
RSLGLATIRGCSVRGAFPPPPPPTRGNHFPLRLLEEADLPVPPPLSSVRTEARACRSP

SEQ ID NO: 1006962 - protein, 146 aa, Homo sapiens
AGSYSRGIPPQLGAWQCGARHVKTASDCGAVEALPCRTVWNKPTVKSLPCDICKDVVPAAGDMLKDNATEEDILVHLEKTCDSVSETEHVCVMQGDSGLLPPCHPGTIIKGEMSRPGVVCAALNLCWSLQKHLAELNHHKQLESGK

SEQ ID NO: 1006963 - protein, 154 aa, Homo sapiens
RARGLVPGACPEGRGCERDVGHYGVPPPQSLSSSGILFGLQLLLVIQLCYVLLERLAEVESRAHLPRTAHFSFNDVQDDKEGKNPLSPCIKQTFSVSRRPVTGPSPRLNKDLLLKLALSFSISPAAVTTSLHISPGNGFPLLAEVRTVWKAVQP

SEQ ID NO: 1006964 - protein, 126 aa, Homo sapiens
SPQHLEDVVVRQRCAPSSSCFAGSINLCWSRTNAFLVLHLCFDVLDCVPRLDLQGDGLASQCLHDDLHPSSQMEHQVHGGLFLDVVVRPGAPIFQLFSSSDQPLLFRRDAFLILDLCLNFLYGLPG

SEQ ID NO: 1006965 - protein, 134 aa, Homo sapiens
RAVWGWLKELMNTEQALVHLIQSCSLSFKHLTEATANKRLAYVTYQDIRAVGYFKEQTVIAVNGPSADELEMPDRTEDHLLIYLTSTLGAHSIVYLCPEDVRSSRTVLPRSLSPLPPASGPALTLPRLSCGGTE

SEQ ID NO: 1006966 - protein, 77 aa, Homo sapiens
MRAALSMLAGNSSACVRCKEGSEALRSILASDRCSSSIVAWIWGKRGRSSRCNLRLSDSRRRMPLVQLLAILLTSGD

SEQ ID NO: 1006967 - protein, 66 aa, Homo sapiens
LAGSFCCGWWLGDRRLYACTWDTRVIDGDATSCHAAVGWLQAVNIPMGRVSSTMTGSCTFDEYFRH

SEQ ID NO: 1006968 - protein, 72 aa, Homo sapiens
MSKPPCLALTHIKVSQTQSLPFKIQCEQQEMEEVGGRKKAEYINHHPDPRHTGSHEKVIGKTLVAFKGGEVP

SEQ ID NO: 1006969 - protein, 90 aa, Homo sapiens
LLIDSRVYPPGDGARMILAHCDLHLLSSNNYPASSFGVPWITGACHRARLIFVFLVETAFHHVGQAVLKLLASTDPLSIGASKAAVDYRT

SEQ ID NO: 1006970 - protein, 188 aa, Homo sapiens
NDRIELCTDSILTRTECRAGMLWVIRPRFHSDGVGQVPKTSLTKSSQVKTRTKVPIQATVGDQATLPLTWSGASSKDKSYQVKPSQNQNKDVNTGTPWVIRPCFHSHGVGQVPKTSLDKLQMSGLPSAISFPGVTASVNPSREPAMRCSGKAFNWGPFSYPGAPLWICVTQAGRSPLQGRSNGGPQGL

SEQ ID NO: 1006971 - protein, 41 aa, Homo sapiens
LDASGRSRVSPCLPIQRHSSTHYTGAPTSMRPPKPQLRWVR

SEQ ID NO: 1006972 - protein, 151 aa, Homo sapiens
DDMIESSSVRSIARARGQGCGFGSVTVGLSRYLYCDCTSSPHLSTTALNPKSCQRLCPQKALSLQIPSRPFFPIGEGLLLGNISSELASWSAPLPAASKHSIYHMILMASVHVLVSPCSLMLTKDKGYRFICASLVPLAQSWDVVLYLSVL

SEQ ID NO: 1006973 - protein, 46 aa, Homo sapiens
MIPSVEDGPVIFILTKLPVVSVGRARMGTTTLDTQCQGLASSGRPW

SEQ ID NO: 1006974 - protein, 86 aa, Homo sapiens
PRQRGAQLSRAVKGKGQTRSVLRTPKVGGHFITSLVDQTTVNQLLMPISRTSVLSDLGETSDIEGGGPTDALEIPKIHAKFPILQK

SEQ ID NO: 1006975 - protein, 37 aa, Homo sapiens
MNRLCLGSWQGEPLGQLQIWGLFQDPCGYLPLVQWPL

SEQ ID NO: 1006976 - protein, 59 aa, Homo sapiens
MTISNLSCHWNCEDDEVLDREDLQDMSLIDLSTKNPKAFFTNHTLVLHVARSAMDKVRV

SEQ ID NO: 1006977 - protein, 52 aa, Homo sapiens
MESVRKFCITAYLITTVKFIAKQILILSGRLLWGLRFFQKEPFSDAAVYGLK

SEQ ID NO: 1006978 - protein, 62 aa, Homo sapiens
MIESSWYRQHPNQRCNSEDLRLLWEVVVLETASLQRLFCGGLDPGPRDSSLVIRKHHKELAG

SEQ ID NO: 1006979 - protein, 75 aa, Homo sapiens
PAARGLPDVHRKLPRPLTHPSRLCQPWLVAQPSPVCLAKIAAGNNTSIYTQVCSNRYAKAVRPEETVMVYSILPC

SEQ ID NO: 1006980 - protein, 39 aa, Homo sapiens
MAAYTRRWPGPSAYSSGYEEAEQVHGAPAGQLCSGLNGV

SEQ ID NO: 1006981 - protein, 43 aa, Homo sapiens
MWLTILTRESQRRRRTLESTKPSEDSLSRTERVHSVQQRFLPG

SEQ ID NO: 1006982 - protein, 60 aa, Homo sapiens
MTCRRAGMVEMVAYPLWRAIHSGPIEVRVDGVLEKRPRAEVDELELDAIEVDKDVSVLDV

SEQ ID NO: 1006983 - protein, 144 aa, Homo sapiens
EHAKQTGVQGLRRSGGKASSSGFAPVHPAPWNSYPTIKQPVAATMTAARAADYLHVALDRAWRAKLAVSFRDRLPMSRALLMPVLLRVLSRSSGSAYQDVSFTCPEQAKYRANHRDLQPPDAAPRWGPPPRAFLRWLPAAYEDC

SEQ ID NO: 1006984 - protein, 54 aa, Homo sapiens
CRHSLLKQAIHGPSKRYSKPHPTTRPASSSSSQISPIRSTPLTPLDQRNPSAYR

SEQ ID NO: 1006985 - protein, 36 aa, Homo sapiens
MSDMQLQQSAAAADLSATLPPQPPHPFSQQQQQEQQ

SEQ ID NO: 1006986 - protein, 50 aa, Homo sapiens
PTGATYTHTRNKAGDNGLQHHGTGKTRTIDITATHGHSPHTEQRHPTPTA

SEQ ID NO: 1006987 - protein, 110 aa, Homo sapiens
MERLNEAPVWVCGVTQDLAKSKREGSKRLYPFTPSYAGLQGWEARPLTVPHSRSEFSVLSTPHAANVACSSLSGVAFPGGLCLENRNCRTLYTHYLQYCLCLPKLLSPSP

SEQ ID NO: 1006988 - protein, 94 aa, Homo sapiens
RSRAWRLCGCLRCTRHTGSEAPCQSGLQDELLATWVGCAREKGLHAFGGRRIPLERACCAQAYSKARASCPTMPWPPSVTEPGQGTVGRSPCQA

SEQ ID NO: 1006989 - protein, 110 aa, Homo sapiens
VTDIGAWVSAQRGSQAIGRPSSRAVPTLAPGALTPPPTPAPGGPSLALILHCNPPAQALYLPLCPGHRDTRIGARAHARLKELLKASPASAVRVHDCLSPHPGPDPACLS

SEQ ID NO: 1006990 - protein, 123 aa, Homo sapiens
TKDGLDAWTMNHFKKTTYCDFCHIMLIGVRIHACAALTVNTLSTNAVCPEHIPGCVKTESKAKRSGEFHRKCELSTLCDGWELRDHILLSTSIFSHHPGLCSCPGEGCSFSRFWFPIYAAFRR

SEQ ID NO: 1006991 - protein, 39 aa, Homo sapiens
MAVKKSLEICPEHPIMATLRHSAEADQSDESVEGSGHLA

SEQ ID NO: 1006992 - protein, 50 aa, Homo sapiens
MNQLTAIDKGLAKRRLYNLLIEPQQGADNCDVSQCHSLAHQKSPRHQVSI

SEQ ID NO: 1006993 - protein, 102 aa, Homo sapiens
RRLGLGTPSHHQRSQCWRRMNRSLVPCESHNSSETCGLPPLVQTYVLPGDPRAVSIPAPIPVWHQRSGPLWAAPCAAPRARAQGTISAVTPLCPSWRASPPA

SEQ ID NO: 1006994 - protein, 141 aa, Homo sapiens
RSLGLGSVGCGHWSQAAWGVAALIAHDPATLQAIVLHTAIVCARTRPAASLRSAKNAAGPSGDPEEPSSGLPRWLKQGPRLCNRCVRCLPGQRDLNNALMACLDYATHATPDLTVPPPSTGTFHEAHSRLIYPAAVLNQAA

SEQ ID NO: 1006995 - protein, 107 aa, Homo sapiens
AVWGLAETVFDTINAETDRSGGSSSKAKNKQLGHEEDYALGKDCIMHGYISKMGNPFLTQWPRRYFYRVPPPPSSRGARAEAPTDACLTTGGRLQIRWTAHRDSRER

SEQ ID NO: 1006996 - protein, 140 aa, Homo sapiens
RSCGLALALNVPVFVVVTKIDMCPANILQLNPVSCYSACYKSPVLPVRSPVLVHSKVWLCLSQTSNLQPLITDVPEYSRISNCYRSRTSDLLHRCSSNLLSPRTSYREEEPAEFQIDDTYSVPGVGTVVSGTTLRGLIKL

SEQ ID NO: 1006997 - protein, 69 aa, Homo sapiens
RGIPPQSGAWFPQAYPGWLPVTTTDPEAVGEPCNMLPFLLPLGGTTPGPGQRLPSCGGTRARTSVIAKS

SEQ ID NO: 1006998 - protein, 109 aa, Homo sapiens
MKVAIGSTGDQKVQISYYGPKTPPVIALLYLTEVVISLCADITRTGKVKPTRAVKDQRTWTWGPCGQGAILLVNCDRDNLESSAMDCEDDEVLDSEDPCRTLSLITLST

SEQ ID NO: 1006999 - protein, 122 aa, Homo sapiens
SRDLHSGRYWQSVLVCTALLQSGSRTLLVLLGVAPVGSDFALARVVLFTGQAAVLEDSYERVPDEANVDDIPTADTIKQFLQETSTKSQKLMRHRVSMLTAADMDQQQLQSFWSLMGEMEPD

SEQ ID NO: 1007000 - protein, 104 aa, Homo sapiens
MYMNSTSYPQRPAYSGRETIYSIASLLIHNVTQNDTGFYTLQVIKSILCLKKLPDQSPVCPELSEPSVSSVKVPPLCCDSGSALAFTCEPEVQNIDLAFRGSIR

SEQ ID NO: 1007001 - protein, 33 aa, Homo sapiens
LQLGLAELQSILDSLKPTPEHPSVPSDITSSEK

SEQ ID NO: 1007002 - protein, 99 aa, Homo sapiens
MASMMGSTVHLVIKMADPSSGPVHADQQCRGNYQYLGVNSQENSRAISTNCNPLGLRSLGGLGGLRSLGLSSTKFSELQRQMQEQFMGSPEIMIQIMAN

SEQ ID NO: 1007003 - protein, 83 aa, Homo sapiens
RIPSGTTEDRIEILAEIVNKFIGVRQNIPQLIYEDYCQSYYQSYTKILHIILETRKCRTLILKTQDITPDTELLDTGGLLHSP

SEQ ID NO: 1007004 - protein, 120 aa, Homo sapiens
RQSRDDLNDTATERGDPMFNMDMTCDWLPKPNIFASCNEIVHSYLPVILDIIVGQMSRPGEVCSALLLCESLQKLLAELNHQKLLVSYLIPELDLIQVVAPFMALIPLLLYPLDGPRLAP

SEQ ID NO: 1007005 - protein, 96 aa, Homo sapiens
MGQSIGTSVPQLMSSTWLISVALSDSVLVTIPGTLLLVSTTTWTQYTGTSYLHWKKQRAPDEGYSIFHSNLHLASNPYEGTFCPQSQRVTYIMNPL

SEQ ID NO: 1007006 - protein, 57 aa, Homo sapiens
MCFAPLSWILWTSFLSSIFCGPVFDNLYIFLTLFSRFYSFFQLLQACGQALLCSVLF

SEQ ID NO: 1007007 - protein, 39 aa, Homo sapiens
MAVLQVQPTQAVTVGTPGGEGELALVTPCPLDLGPEYYD

SEQ ID NO: 1007008 - protein, 70 aa, Homo sapiens
SRRLVVLHTGWWDTAGASLTFKRSHLRAVKEMPDVRQAGHTWSYARWAPGTTTLSKLTQAGRRFPKASTA

SEQ ID NO: 1007009 - protein, 39 aa, Homo sapiens
STGLTARTLSALVRTAASQEDWTLDWAQGSQHTGWLTQQ

SEQ ID NO: 1007010 - protein, 44 aa, Homo sapiens
STWAQRFFESLGDLSTPDAVMGNQGERLMARTVLRCLYVIGLAH

SEQ ID NO: 1007011 - protein, 35 aa, Homo sapiens
TRSNVRLGAKVTTMSGEENTSTTHSDNRNSNQYHQ

SEQ ID NO: 1007012 - protein, 62 aa, Homo sapiens
GVGGSFSWTKSWRTGDDLPREVPPPSPRASYGTKFNARPCEETTKQACVSNKAVYFTWAHIE

SEQ ID NO: 1007013 - protein, 40 aa, Homo sapiens
YQTPDTQSASQVRIRHQDSRELHTVRIRHQHAECFTRCVS

SEQ ID NO: 1007014 - protein, 70 aa, Homo sapiens
QFSPDVPSATVPVLVCSFPEESYLSLCNMHPPGPNRDDVQCVSEGEAAPPEGVQFSVSLVAYAPVASTPS

SEQ ID NO: 1007015 - protein, 46 aa, Homo sapiens
LRQDLESCRTLRKVPYAYMYRDLTTRPPHPAGRRRVKLELWDTSGP

SEQ ID NO: 1007016 - protein, 60 aa, Homo sapiens
GRLSKIISAPMDHSDISLQMGTNKCASQVGMTAPGTRIAAGQEGHLPGHFWTHVGSWTRA

SEQ ID NO: 1007017 - protein, 42 aa, Homo sapiens
AQINDIMEVSTVSSRIDVNLYRECMHRSGEYTSTRLHVCDNW

SEQ ID NO: 1007018 - protein, 103 aa, Homo sapiens
MKRRSTGWGVSTRKEAWLWVAPLETLPVCNHRTKLESAVQCLCVTRDYVHIHENKSFTIVYNVFTPWAFPSDVYKGTLAGRGGSRLYFLHSGRPRKADHLKSG

SEQ ID NO: 1007019 - protein, 57 aa, Homo sapiens
SLRAFLYEHFNIRYWSWNYPRLLAASTVRCEWSGVEGFNSGLIPITGPRKEVLYMLF

SEQ ID NO: 1007020 - protein, 72 aa, Homo sapiens
SSVYRKLGTVRRQLTIPAKMDYAGNVAEAEGSWCPEQPGDGLKLPASDSAEASNSRTDCSWTPLNTQMSKPG

SEQ ID NO: 1007021 - protein, 37 aa, Homo sapiens
IPLHLGLGRSVPSSANSDVTQWSAQTERSALWAPLSV

SEQ ID NO: 1007022 - protein, 35 aa, Homo sapiens
DASIQDTKMPFKNLSRINRKYVGHNLLVTIDPSSM

SEQ ID NO: 1007023 - protein, 125 aa, Homo sapiens
MRGVIGRRSCSGMLWAAADTLLVSSVTPVTKDARAAGSGREVEVVADSSSRCINMSELLLVRSQLISGEAHDLVGDRASQSHPGSRCAWPRASSRREEKKPSSYSAGCQRTKARLEAPSVRLRLL

SEQ ID NO: 1007024 - protein, 84 aa, Homo sapiens
MAGALQCIPCDAYTMKELKMCARDESLQKVSHCPGLRSRSVDPVAPRPFITVIQRSCLGIICCPLTPPIMLRQLLVTAQLAEWY

SEQ ID NO: 1007025 - protein, 82 aa, Homo sapiens
SPAVWGLDVLALLHLFQHFPCIHASVGYSALDDELSEQDPIDHTSDLMVNLPQRAASGAVHFMGNLEPWQGLYSSSLMRRAK

SEQ ID NO: 1007026 - protein, 78 aa, Homo sapiens
PANLLGYWRISRVVQPLNDIWRSARCSRIDVNLYSAGMHRIGEYNVTRLHLYDIRRVSTDLTYRRNLSREACTAVVNT

SEQ ID NO: 1007027 - protein, 39 aa, Homo sapiens
RQKKESEAVEWLAEGPACTGKYLEKDPVLSREDLAMKYT

SEQ ID NO: 1007028 - protein, 114 aa, Homo sapiens
QHHCEDWCNYLCLGKIMVRLAITQCQFDVSVEPRRQETRIQTMFLAWVKMGKSYSRTSQAETGPVRLFGLRAECCDKGDTPGAVKAGPSPPAERSSSLATVTALNKLFHLEGVD

SEQ ID NO: 1007029 - protein, 77 aa, Homo sapiens
RLILTIFGGQHGTHVSTELVQGGMHRSDKYTSTRLQVNDIGRSARFSQYQKELVQGGMHRSGKYTSSRKHACMNKIL

SEQ ID NO: 1007030 - protein, 40 aa, Homo sapiens
PSSTWGIPSQSSCIIKQNVQPSGPGATDSVRTTGEQQLHA

SEQ ID NO: 1007031 - protein, 49 aa, Homo sapiens
MPRVPVPADASQVVAKGLGLSKAYVGQKSSFTVDCSKAGNNMLLEGAAR

SEQ ID NO: 1007032 - protein, 70 aa, Homo sapiens
APANDIEEVSTVLTYRRNLYSGGMHRIGEYTSTRLHVNDHWEVSTVLTVMKELVQGGMHRSGEYHVELQA

SEQ ID NO: 1007033 - protein, 30 aa, Homo sapiens
MRQPANWQSCRFIVTRLPAFYDISVCHQLR

SEQ ID NO: 1007034 - protein, 136 aa, Homo sapiens
PQSGAWLIRKQAVSLKLAVRLLCISHGEELGTLEMERKKRRRKRKRESEITSDWVTWCILEEENRMSVRSLPFVTVMFPAHEAAQLNAVCSLWNSAGLSLRRVGFEFSLCTSVCGAYPCTPRVTAALITACLPLLR

SEQ ID NO: 1007035 - protein, 121 aa, Homo sapiens
VYVCYFKVTRKYNLRNTGYLVMSELGVLGCHLYQLLIHFITSYRSNVSVGVAHSEVNPNSLVMNSRGMWLTYVLGVGLSSYCLTQHSLLQFSCCLDFHIYYTLSGDVRLFACSVRNIFRNS

SEQ ID NO: 1007036 - protein, 97 aa, Homo sapiens
MHHRTPQAMRRLKVFPTRGSSSNAHPVIRVAVEAGSTPSELPLILDGLAQVHGSYPFLPPMVAGSGERVILGTGELYLYCVMPDLRKMYSEIDFLVG

SEQ ID NO: 1007037 - protein, 33 aa, Homo sapiens
GAVLPSPPMATITRASRDLVNAWRAATPWELSY

SEQ ID NO: 1007038 - protein, 71 aa, Homo sapiens
MATLADPGPRRERSGSGPNPPRAPTYRAHGGTNFDCGAPQTGRLPSSNGPQPPAVHPPPIAKHRDSSRNHG

SEQ ID NO: 1007039 - protein, 53 aa, Homo sapiens
IMHRRSAHASSCLTTGLWQAAMFHLHLNLSVQVMEEYSSASLDCTHVSTTGYG

SEQ ID NO: 1007040 - protein, 68 aa, Homo sapiens
ELHQLKRTLFINGISKYAESRKDPRSILRKPIPNLHSFSYSPPGVTIVARLNVPRMQQRNQGASGETL

SEQ ID NO: 1007041 - protein, 61 aa, Homo sapiens
MRLCLKVEEEGAGEAEGEGEGEGETETETTRAQGEEEDPEERHYHTEEGREQEGEEKTENR

SEQ ID NO: 1007042 - protein, 78 aa, Homo sapiens
HIRHQHARAIHTVHIRHQDAQCYNTGYNQTPGRRELTHGAYQTPRRRELHTVPVRHQDAERYHTGALSDTKTQTRFTR

SEQ ID NO: 1007043 - protein, 105 aa, Homo sapiens
GPPARAQRPPRPPIVSERTSPTGGCRKDSTAPPYVGLRPCSASPSSEMDTLEEFLEESNRSFPTHDTPSCRDDLLRDYFRKASDPPAIGGQPGPPAKKEGAKMPT

SEQ ID NO: 1007044 - protein, 164 aa, Homo sapiens
CGDQAETGGWSGTRGAAQWWKWPFPPLSCGHKECCRSPCADTALPPPKLSTTPLRAPLSVPTEGGQWFHSHRCPNGHTPEQSRAGLEGITPATRARVSPSGYSPSSSPENGHSGHQPGLRRTFLRHSGNQTQHRHCGTGPTQEGANRSVTVMPSKLFRGAPGSP

SEQ ID NO: 1007045 - protein, 48 aa, Homo sapiens
LEDRDAHLLFSGEELRAARRSRATVAQLLLDVAHAFPCSAMGLPWVPE

SEQ ID NO: 1007046 - protein, 60 aa, Homo sapiens
DASTRLSVRGNVRVDIRGTEHVSIPVTDRASLRVTSRESLRETVRESMCVSVRASVCPSE

SEQ ID NO: 1007047 - protein, 49 aa, Homo sapiens
HVIDQDEEGEEITATAVTPMDHKVAEAAEEGREGEREFRKKFKVRPLSS

SEQ ID NO: 1007048 - protein, 50 aa, Homo sapiens
MADTMLDGWGRPKQRLEEACTGVGVIRMRTECLKGGRRPTGAMCPATAVA

SEQ ID NO: 1007049 - protein, 39 aa, Homo sapiens
DDRYRPGMDERVYVFYPPWNDKGGGAQVPDAQPLRRAVL

SEQ ID NO: 1007050 - protein, 33 aa, Homo sapiens
MDRSSSSSIAFVSQASLGTRYKWDFNIFGVGVI

SEQ ID NO: 1007051 - protein, 69 aa, Homo sapiens
MLCKELNPYWHCCPRVEQTVKAKQLTPWILEATRMWPSCRWQRASCASSRPDRPMHDFGISYVMVRIKG

SEQ ID NO: 1007052 - protein, 31 aa, Homo sapiens
MAKQEKKKKKTGRAKRRMLYNRRFVNVVPTF

SEQ ID NO: 1007053 - protein, 45 aa, Homo sapiens
LVFDILLAGGRQIVGFCCQHHQVVDDALQVGDLSQHGQLSIHHRL

SEQ ID NO: 1007054 - protein, 105 aa, Homo sapiens
MQFSSGGLVASSRVLEGTSPLSKSFSTALWRVPRFQPDCKVTVVANTANSRKSTLVQPVRAAPRADFPFLPIVGLPHSGFVSLRSASSPMCMRIKAYLLKTQSSY

SEQ ID NO: 1007055 - protein, 45 aa, Homo sapiens
MTEACMVLMVADVYSPAAVHGFPVQVPVDTLSTVLTSKYREAGSL

SEQ ID NO: 1007056 - protein, 71 aa, Homo sapiens
YRIFAAWSVQTGVSPWRECSVLTGERLLEGWHWARDRGGQWPLWAAVVSGHPGLRSHTLVYVWIRLSISPD

SEQ ID NO: 1007057 - protein, 108 aa, Homo sapiens
IILLAGKNRYDYKIWQITVSCPRNVMLNNYTKQCILCYTKHYTKFHNCFKENKIPRNPTYKGCEGPLRGELQTTAQGNKIGYKQMEEHSMLMCRKNQYREDGHTAQGN

SEQ ID NO: 1007058 - protein, 74 aa, Homo sapiens
SEVTDSPVEPRGASLQRTPASLSDAIQRALPGRKWPRWNALPEQRIAGSREGLNWLNTGKEMALEVQTSEACQD

SEQ ID NO: 1007059 - protein, 37 aa, Homo sapiens
GSVVPASMEAEVGGYLSPEGRVCSVAKIAPLYFSLFV

SEQ ID NO: 1007060 - protein, 111 aa, Homo sapiens
MGLYIAIVALLWRHGPEKEVAALELLERIEQKYVAISDLYEPIDDGCESHVFCSCSYDATTHFETTCNELQDIYQRMGSTAFDFENMKRKQNDVFGEAEQLIVGPYRTLAG

SEQ ID NO: 1007061 - protein, 96 aa, Homo sapiens
ATERHWPDSTSQDVVSLGMDWKSSALLAYPRPGQCTEPNLRMNLVNRFRSFMRKLRRMSSESFPMVSILRTEHQAFREASLPCCAPFNAVQPRDAA

SEQ ID NO: 1007062 - protein, 101 aa, Homo sapiens
DVFEEPMSGMREAGIPESPDDSYSSYGSHCTDSLMRSSPVFNQRCQTRMRKIYKAKREMFCPDLLGRTEKVYVLESVSLKSDLTPVLKHTWFVLIPEELDV

SEQ ID NO: 1007063 - protein, 41 aa, Homo sapiens
LSDAQPLWGVCLQQEADELLGILRDFDHSGLWKPYWLRLIL

SEQ ID NO: 1007064 - protein, 144 aa, Homo sapiens
MPEEQGLLRVLHRTVQRVLTTIPQPLQDKLRPRWRKQCLPEVLDVKKGHRGLGKAVWQVDVGLCQLGGVLLVWPNSQLPVEQAERKTVLVGAGTLRTLLQEEPDSKGQYRLTRLRWEASNPRALKYAWCICLKWGFPCWEEASV

SEQ ID NO: 1007065 - protein, 103 aa, Homo sapiens
EDSVKAANWGQAWWLMPVIPALWKAEESRSPELRSLRPAWATWRNPISTKKKKKFTLWRGGGLIAPVPKEAEAENLFNPKRQRSQRVEIPLFHSTRANREKLC

SEQ ID NO: 1007066 - protein, 74 aa, Homo sapiens
AGRVWGQWGRHTGYIRKPHREEVTRRQLYKSDDLINHTEELEGGEELQTISKVTEPCFWYEKVQLPSKTDAKAL

SEQ ID NO: 1007067 - protein, 56 aa, Homo sapiens
AARIELGPGAAFCFDQTLGTAPYHRANFMHPMKPRYTKFHPMIKTLRAPPTELGAK

SEQ ID NO: 1007068 - protein, 56 aa, Homo sapiens
PYVLGVVPGRSGCAIPRSRGCCGLLLHSPSRPAVVAALQAHSVLFALAARGLLSVS

SEQ ID NO: 1007069 - protein, 51 aa, Homo sapiens
PLSPVTGNRMETGLSKIITYRENVLSTTIGQWPSDLEFQLPEIQGQQPAPP

SEQ ID NO: 1007070 - protein, 34 aa, Homo sapiens
QGSSATFSIRASVWLLGMFPTGLPFITQQGNTSS

SEQ ID NO: 1007071 - protein, 45 aa, Homo sapiens
QRSTTLDYGYHFKVNIGLYYAERGCIALPIAAPPYCGTAGMLRRR

SEQ ID NO: 1007072 - protein, 45 aa, Homo sapiens
AQLTDIRQVRTVLYVSDAELVQGGMHRNDEYTYDQAPSLLFGRSA

SEQ ID NO: 1007073 - protein, 33 aa, Homo sapiens
MEAARYSRSRLNLYSGGIAPHSKYTYDLATIYN

SEQ ID NO: 1007074 - protein, 69 aa, Homo sapiens
MKGLKCCGFNNYTDFEDSPYFTENSAFPPFCGNDNVTNTANESCTKQKAHEQKVEGCFNQLLYDIRTHA

SEQ ID NO: 1007075 - protein, 56 aa, Homo sapiens
PDWTTGLTAQRLSLTGEETAKKTDISAEVDAVPAGSPVPECRSTISCEPWQERGTG

SEQ ID NO: 1007076 - protein, 70 aa, Homo sapiens
SDAHPGFKLDLEWTHECVIFIIHTIFSIYPGQRRIWSPIGGGPSENHRAVESARKCQVHTCSLWLVFILQ

SEQ ID NO: 1007077 - protein, 41 aa, Homo sapiens
AHGLMSMLAASIADTCASEIIAGRVTGHCSTDDIRSVRRSL

SEQ ID NO: 1007078 - protein, 44 aa, Homo sapiens
MGLEEESRFYRLQHCGQQVGRHPTAAVVTEKPVDTGEGSTFRMS

SEQ ID NO: 1007079 - protein, 61 aa, Homo sapiens
MCASRSFCSFSYLRPVALLLSCQVSESHTAPSMLLLARSVTIVVEGPACSQGTSLPFSLLN

SEQ ID NO: 1007080 - protein, 57 aa, Homo sapiens
LFPGDPLRMCNADACAFDNASFPLGTDRLGRDVLAELFHASRASLVVGLAAAAASIL

SEQ ID NO: 1007081 - protein, 102 aa, Homo sapiens
STASPDDGLICMSEQARLPVSTFVLDHLQSKRSIEIPRKEPGTGQEAAAPPLTPPLSFPPSFPLGWAQVELTVVPLHPLAPPRLQDWRPTGPQTFHHHHYAQ

SEQ ID NO: 1007082 - protein, 54 aa, Homo sapiens
LPRAYSLGSPCTDSLTDTTLRALATPRFKLCACYATTFYDGTRVSYTVTTALPY

SEQ ID NO: 1007083 - protein, 64 aa, Homo sapiens
MILITIGRVVRLGPDSESNSGAPGCGVDSRQETGGMNWAHGSLPMCKFLTLCAITYYIVHVFNL

SEQ ID NO: 1007084 - protein, 50 aa, Homo sapiens
LVELRDRCPPSAHVRVKSVIIRAFQRNSSTSSETPPMCSSCTVSAGVIAR

SEQ ID NO: 1007085 - protein, 152 aa, Homo sapiens
MQDPRKTSLSTLPTYSMERGEEGDDLRVLISAPGVGKWAHVSLSMLRPWSLGGASLGLGPFPATVPLWQLRLGLKPPILLPSHSCGSVVQLSHLKGFCKLDPIWVWVRPCEPHDNPTLHRAPLLGQTAHLQRHTILASPTSESAEPWASLPI

SEQ ID NO: 1007086 - protein, 76 aa, Homo sapiens
GRGAAAGCLDLMVDLGLRLENIWVTDIEGVVYEGRTVLMDPDKARFTQKTDKRKLAEVIEGADVFLGLSCGGVLKP

SEQ ID NO: 1007087 - protein, 75 aa, Homo sapiens
MRVIRLPHRHTLFPKGGQGSHRGAVSVKMYDYLVGKDKGMRLQREWAATASAKLGLGGWLQKPGLRKIRHHWLGI

SEQ ID NO: 1007088 - protein, 56 aa, Homo sapiens
MRYSFFFFWKQGLIRWPGWGCGGSICGQGNLGLRGPHRFSGLSLWSSWDNRGDPQK

SEQ ID NO: 1007089 - protein, 31 aa, Homo sapiens
MPRRKAPTPGIATVMLVEATPGPSSHLATAR

SEQ ID NO: 1007090 - protein, 56 aa, Homo sapiens
RVSVQIEVYPVAVQWGWADEDISSRAVSVEYVEVMALLDSAEERPGGQILEIMSRN

SEQ ID NO: 1007091 - protein, 43 aa, Homo sapiens
SNELVPNRRWLGRLGEARSACHHHVALGRQHRVDVVGHVADLC

SEQ ID NO: 1007092 - protein, 52 aa, Homo sapiens
RWPHIDSPYTTHNGPHACGRCQRVRNSQIAPERYLSSCYVVSQTRLTEEQKG

SEQ ID NO: 1007093 - protein, 72 aa, Homo sapiens
GSSLNDILEVSTVAHVVDENLYSAGMHRSGKYTSTRIHLNDYLVVSTDLKYRRNLYEGGMHRSGEYTSSCMT

SEQ ID NO: 1007094 - protein, 32 aa, Homo sapiens
MAHETDHALKAKPSSLSLPQAKVSVNLLFFCH

SEQ ID NO: 1007095 - protein, 86 aa, Homo sapiens
ITSESRRRMLQLYQSRPEALEGALPGEVHSARSRAEPGGCCGLIVRVETKPTTCDINVWKILEICSMTGPVSGSFIQWVLYSEYSQ

SEQ ID NO: 1007096 - protein, 35 aa, Homo sapiens
DSTGSYVSSWQGRGYGERRSQLPIEDQPQVKVSFG

SEQ ID NO: 1007097 - protein, 109 aa, Homo sapiens
PQEVLLGHHLCSLKVQSLFRKLVVNAARLATHPSGQWAPLGPKARAEILSKSLGLDWGNPISGWWLYPTVTSLVPRMQHKVPLAFPSAFLEQKESFTIATTAVNVLGHP

SEQ ID NO: 1007098 - protein, 92 aa, Homo sapiens
QPLTEASNVTYLPLRCVKQILPLSYVDIAIPCNNKGAHSVGKLWWTAGSGTFCACMSPFPVNTPGAVLPDLYFYRDPEDIENEEQAAADTCK

SEQ ID NO: 1007099 - protein, 77 aa, Homo sapiens
MDIFVLVWTGLDLVRLVLGTCPTPREWKRGLITHGVPVWALWFWFGLGLTRYDYVFGTCPSPSEWKRGLITHSNACM

SEQ ID NO: 1007100 - protein, 60 aa, Homo sapiens
MAGRGEGQQAEREETENATDEYITVLRTVWSHSHEYVGASSVLTKDTILISSSSTFLKRQ

SEQ ID NO: 1007101 - protein, 34 aa, Homo sapiens
APAYRYLEVSTVLHVSDVNLYQGGMPPNGKYTST

SEQ ID NO: 1007102 - protein, 59 aa, Homo sapiens
GSSLTDIMEVSTVLTYDVNLYMGGMHRSGEYTYDQDPSLRIFGGQHVFSLYLTEACPRE

SEQ ID NO: 1007103 - protein, 38 aa, Homo sapiens
NRLQLNDILEVSTVLTCRRTLVQGGMHRNGRIHVDQAP

SEQ ID NO: 1007104 - protein, 49 aa, Homo sapiens
EDTLEVDSSSLTIFGGQHWCSRSRRNYVQGGIAPHGKYTSTRLHVYVSL

SEQ ID NO: 1007105 - protein, 48 aa, Homo sapiens
TCMGCTLRAVSIFTLVATTLSSQVRAMPADTSSTNTSSLGDHHRTASA

SEQ ID NO: 1007106 - protein, 62 aa, Homo sapiens
MGSCEHWKYRMLLMTIAMMMPQIGAAIQKDDAGSGRALRVRSGKAKEMRKKPSFLHSKYPAN

SEQ ID NO: 1007107 - protein, 69 aa, Homo sapiens
TIYGGQHGAHVSTELVPGRPCTEVVEYTYDQAPAINDIMEVQHGAHVVDGTMYQGGMHRSSAYTYELEA

SEQ ID NO: 1007108 - protein, 108 aa, Homo sapiens
GSSLRYLEVSTDAHVSTELVQGSACTEVVNTRLTRLHIKIFGGQHGSHVLTELVQEGMHRSGKYTSSWRHASVALVLKGSSKSRPGSSLTIFGGQHGAHVVDGTKYRE

SEQ ID NO: 1007109 - protein, 83 aa, Homo sapiens
RLQLRYKEVSTVLTCRRELVQGGMHRSGRIHVDQAPAKRYIGGQHGTHVVTELCPGRHSTAVVNTTYELQACIAIARVTGGSY

SEQ ID NO: 1007110 - protein, 78 aa, Homo sapiens
RSDLTIYGGQHGAHVSTELVQGGMHRIGKYTSTSSMFNVYLVVSTVLKYRRNLSQGGHSTAVVNTRRAAGHACMLVVL

SEQ ID NO: 1007111 - protein, 79 aa, Homo sapiens
ATDYRYLEVSTVLTCRRNLYSGGMHRSGKYTYDQDPSYRIFGGQHGAHVSTETMSKGGISTAVVNTTSSWRHCMHDRVL

SEQ ID NO: 1007112 - protein, 63 aa, Homo sapiens
GGHARCSRVDGTMYREGMHRHGAYTYNQAPVYNDITESQKGAHVSTELVQGGMQRSGEYTSSC

SEQ ID NO: 1007113 - protein, 87 aa, Homo sapiens
QAPFNDIMEVSTVLTCRRNLYREACTELVNTRTTRLHVNDIWWSDTELTVIARNYVQGGMHRSGEYTSSWRTCIAVASGTERYHYRV

SEQ ID NO: 1007114 - protein, 77 aa, Homo sapiens
HSPAVTYSPGVTHSPGVMPGPAVTHSPRDTYGHTITQGHMVYYSPEVTHSPEVTHSPGVTHSARVTYGHMITHGPVV

SEQ ID NO: 1007115 - protein, 87 aa, Homo sapiens
AGCMHADYGQEAPAVVLEALIDGQRAHLVGHVAQFPAQGLLAAVHHADVHDGSVRVDLVADGDVAPGASRAGAEERDAAVLSLEAGV

SEQ ID NO: 1007116 - protein, 91 aa, Homo sapiens
DYRGPHTAREDRGILSDSRHQVTARRQDPGSLAGGLGRRFPREENSLCWAQIHQLEDLLVTILSREPGAASGGPAPPLHEGGVTVYGCLAP

SEQ ID NO: 1007117 - protein, 55 aa, Homo sapiens
EDAQFLSYDNKYHKEQEEADFDNEDQQAQEFPDFDHKYHNSQEDPDFNYKYHQAQ

SEQ ID NO: 1007118 - protein, 136 aa, Homo sapiens
IHIHCLDSIIHSLQEMSLPFPQDSALILCDESQDPDLAALMAGSQAPETFILGGLLLGIFLYSRYFCFTKSSVMSFLRSPRNGCLTPGRSPILRSASQRTASLARLPFMKMTPRITKRRLSLVSLVFPRRRAEESR

SEQ ID NO: 1007119 - protein, 200 aa, Homo sapiens
ASKSSEIHTLLHELQQLISRIRDNRSTHRSHHFIHRDLLPTIFRINFNSFYTHPSFPLDPLHYIRKPDLKKIRGRPPKMRHAVSEMPFMHRLRSPLSKTGFYPSYGMPYSPSPLTAAPIGLAYYGMYPPTLYPPRPSPSFTTPLPPPFYMHAHLLLNPAKYHKKKHKLLRQEAFLTTSTPLLSMSTPSVPPEMYGWMVEH

SEQ ID NO: 1007120 - protein, 86 aa, Homo sapiens
VYRGCPTDCTDCLPLQIHTNDEVQGLTLTAHTTCSEATHPFARTCFCPSSNLTAFPLWDSSDPPASSPPSPWKKNTGQRNPPPPRG

SEQ ID NO: 1007121 - protein, 92 aa, Homo sapiens
QVILMVQIFHCLVCSIKQARSHEWARDMSRHFSKEDIYAINRHVRECSSSLAIREMQIKTTMRYHLTPVRMCDRLKKIMEDNEVLCLGDCCQ

SEQ ID NO: 1007122 - protein, 45 aa, Homo sapiens
MARVGVMARRRQWMTAASGFCTKSPFAGVSRKGGTMEMVQLWVNL

SEQ ID NO: 1007123 - protein, 40 aa, Homo sapiens
MAVISVSVTSYLRTTNPRCPYNNWRSEQGGLMPDGDGMSS

SEQ ID NO: 1007124 - protein, 128 aa, Homo sapiens
RTVPTDSFIHTLTHPSIHSLFDSFIHPSIHSPIYLRIYSFTHSVIRPSSFIYPSISIHLLIHPLIHSFIHPLIHPLIHLFIHPSLSTHPFIHSHSLIHPLIHSFIHLGIHPSTHLSIHASVCSLIHPT

SEQ ID NO: 1007125 - protein, 70 aa, Homo sapiens
RSILPGSEVTDKPCGAPWSVPAEDSGQLSDAIQRALPGRKWPRWNALPEQRIAGSREGLTLAEHREGNGT

SEQ ID NO: 1007126 - protein, 63 aa, Homo sapiens
DSILTSRGAVQCLVPAEKCLQDSPLKHSEPMGVDRGAAFAPPWTPIGLIRGPDWTEAGAMDVE

SEQ ID NO: 1007127 - protein, 138 aa, Homo sapiens
MPADSQREHDTTAPTGIKLAGIMPAIHQSQLKLAAQGRWTSQQDPDHPTQLILDETKLLLRTTALLWSLWRLTSLCTAEAGGDDKPSSSHTPDADYAYAQLKLEGTGPALVTHQKLTSLRTDEAGGLIKQVNEARNLK

SEQ ID NO: 1007128 - protein, 68 aa, Homo sapiens
ISMEMSWTKQAELDKKKVEGAIVLVLSSCASQGSMLQLIAPFGPTPLPSWLSSSCFFSSSAVAAAAEA

SEQ ID NO: 1007129 - protein, 111 aa, Homo sapiens
TRLAHDYYAKEGTRMLRADMNSEMYDKYRQMTHDAAIGSRTHHNLTGKKVMAVSHCETGLPSSHSTCNMIMSYFLNTSLDGTDVWTLIATGVMMLREFSQENIQALKFFEQ

SEQ ID NO: 1007130 - protein, 116 aa, Homo sapiens
HEPAAALLHHRDLVKGPPELAPALNMQSHTAEEGDLRVLDYEEAAAAAEALVTSSPRPPGQRWVWMNFESPSHSPGLRSLASNLFNWTLSYRADSDVFVPYGYLYPRSHPGDPPSG

SEQ ID NO: 1007131 - protein, 76 aa, Homo sapiens
SESSGDPSHPCVHVDRAAWPSVRPRRPCIHVSVRPRHLLRHVICASASSVRPRRAEDRASESSVDEPSVCLRSPSM

SEQ ID NO: 1007132 - protein, 128 aa, Homo sapiens
KWILDTDTFNEGLNEDDYEGNDDRNPVSRREKTIAKTLTDEVNSPDSDRGDKKGGNHKKRKRSHCPSPTPEAKKKKAKKGPSTPYTKSKRGHREEEQEDLTKDMDQPSPVPNVKEVTLPKTVNTKKDS

SEQ ID NO: 1007133 - protein, 122 aa, Homo sapiens
KTLEDPPVWGACMLCACVSSDYECPCSGLERVSLATWKPPLADSTLSWGPPASCPYLDGDLAELVLQSLPRSWTLAKNRESVWLRTPGGGVQVEKVISSQTVSFWLFGCPCLGFQPGRQRQL

SEQ ID NO: 1007134 - protein, 47 aa, Homo sapiens
MCESSHAASLSTPLFTLAQFCSPTDTNDPRTRQPLPPHYSSSSRMAV

SEQ ID NO: 1007135 - protein, 57 aa, Homo sapiens
RPVAQDVALVQGAVPQPRGSGAPSACILVGSTQFFHCSQLVHRGNPVEPQQQLQREC

SEQ ID NO: 1007136 - protein, 96 aa, Homo sapiens
GDSRESRTNGTTWQPGQSLILHWESARRLWVPFFDRAEAVKAKADEWPKTAPKKDENSSGPHATEDRDGESDNSDRVPVPSSQNYFSQAIEAAFMK

SEQ ID NO: 1007137 - protein, 56 aa, Homo sapiens
TQTASQQRTCGEGGLTATEDDAVVVEGSDAVGFYENNEASICYLGETVETEAKLRC

SEQ ID NO: 1007138 - protein, 141 aa, Homo sapiens
EFSSRVEPHTARAHANMPAFDSSAVRLRADTGGETEARALGDGEPRRGTGQAQPTVQPPEAVLSGLSVPGHRMQLGQSHGIPRPPAESDVTQGGSWALASVQSPSVSLGKASRAASLGPPRLSLPRGLATRWPWIALVWAL

SEQ ID NO: 1007139 - protein, 30 aa, Homo sapiens
MSKALTDYSDFPTLHCKMAREGWIGQGALE

SEQ ID NO: 1007140 - protein, 115 aa, Homo sapiens
HSPVRNIFLDEVEAPLDTCDWGSEPTWLPLQPRFPPSADDLPSRGLLALSLKYVPAGSEGAGLPPSGELHFWLKEARDLLPLLAVSVDTYVQCFELPDDSRPSLQRTRAVRRSLS

SEQ ID NO: 1007141 - protein, 81 aa, Homo sapiens
YLTKTLTERDCSDTSTTERKRGRDIVTKLSSEAVDLEHKKCTTVSSCCMNMSYQLSDGNFISIGKERLRCREAICQPYLLA

SEQ ID NO: 1007142 - protein, 90 aa, Homo sapiens
MSKKNHDKENCVKQLAKIEESTPVHDSAVKDDSAPDLMAPHSDQHEHSDTVHVPVSYTDSAPSPDSCSVATSDSFKTHDSFRTANSTKMR

SEQ ID NO: 1007143 - protein, 69 aa, Homo sapiens
DEDSRSQEEPVFGYEDSSSQEERGINNDDSSSHEEPGFDDDYSRSQEVTGISYVVSNPQEEPYLADDAQ

SEQ ID NO: 1007144 - protein, 45 aa, Homo sapiens
SPAIGCDSTAGRTVLSDEFVSSVSGHILAYLIKPNHSPVERYWGP

SEQ ID NO: 1007145 - protein, 40 aa, Homo sapiens
MAELRENMAQGLARARLGVPVWCSSPYGTAVTCGRQPWRR

SEQ ID NO: 1007146 - protein, 38 aa, Homo sapiens
PWRMIWLVSFGSRSLCGRTIEFMAEHLVQEILDSCSPV

SEQ ID NO: 1007147 - protein, 55 aa, Homo sapiens
DGLCLCVFCFCLCTHSRLSDCKTGMCHVLSVCILHCVLSRTHGTDGIGGRAYPVV

SEQ ID NO: 1007148 - protein, 59 aa, Homo sapiens
STLRTIEDVAYMLCFSATGLFDPSKPGGCQSTEEVISSKEKSKYKFPPAALPQEFRCLL

SEQ ID NO: 1007149 - protein, 38 aa, Homo sapiens
RNMPAHIMVKCRLFLQFNIIKLCTNHRSMVLTSYHGAD

SEQ ID NO: 1007150 - protein, 62 aa, Homo sapiens
LAPMEDATRLVAGGRDQTWFHQCLTVYCQLWILYYNVMIFINATTVPVVVKVSNYSMSPSSM

SEQ ID NO: 1007151 - protein, 70 aa, Homo sapiens
KFMGYPTRTKMNQAPESRNLTCATWPSQSRGVRVHYTLPGGLQGLTKAKPLGKQGLQAQIQPETLKGQIR

SEQ ID NO: 1007152 - protein, 56 aa, Homo sapiens
FRATSKTNGRVLNSRSFCPLGEQRAGISVTCLSKLFLCLAEKIPDGILLGHSHFVP

SEQ ID NO: 1007153 - protein, 33 aa, Homo sapiens
LEIPQFKGYPKYIMTPSSSLELERGRNERHATF

SEQ ID NO: 1007154 - protein, 75 aa, Homo sapiens
PKTKPPQRKIPEQTKNKHGKGGEEQPTNQKSPDPDRDTAKTYQRYKEELEPCNRKRSQTAEKEGSPPNSIKEASI

SEQ ID NO: 1007155 - protein, 89 aa, Homo sapiens
PPKPSSHFLLTFPQVLCGRAVAVAKLQPIIYPRGHPRKLNGRVLGQQSLLPTRPARELAFRRLVLSKLFLCLAEKIPDGMLLAIHTSRH

SEQ ID NO: 1007156 - protein, 36 aa, Homo sapiens
GYPMALDGVWAAPKNSRGSGFLCADEMGITSWVPLN

SEQ ID NO: 1007157 - protein, 34 aa, Homo sapiens
DSSRISQVKGYPVLAQDLDIIDVQKLFEKIIYIL

SEQ ID NO: 1007158 - protein, 54 aa, Homo sapiens
LTSLSEMNPVPQLEMQKSPVFCVLMLGAVDWSCSYSAILEPPDCILLVVQFVGY

SEQ ID NO: 1007159 - protein, 121 aa, Homo sapiens
RIPDLCLPLPSSVSLAAQFHPLCRHRSSTGFLSSKFSSTAYIPSLSDDSQPLGSLIPLFQALIQLDLQSLVLLPKLLTQGLQNAGALLILVHLVCQAHELQGHAAQVGEELAVVQLLGTHT

SEQ ID NO: 1007160 - protein, 42 aa, Homo sapiens
RPCLHQQRLIFAGKQLEDGRTLSDYNECQKESTLHLALRLRG

SEQ ID NO: 1007161 - protein, 194 aa, Homo sapiens
EDTRPMPAQLPIKYSPSTVFHFYYLNYLIGKNRILYSKNPTSSFQPAPSNGHLSGELTKHRKTGGKRKPYHKKRKMSRGAQLPTPTLAPATSTQSMFEEVTRNTVPKAACREFLLGLSVVFAKQEIIDVVYNAFNNELVHNKTLVKNCFMLIDSTPYFIDSTPYGQWYESHYALPLGNKKRDKLTPEEEEILNK

SEQ ID NO: 1007162 - protein, 36 aa, Homo sapiens
TLTLLQPKELEDALIVGVDCCDEDEHHLAFEAIGCC

SEQ ID NO: 1007163 - protein, 129 aa, Homo sapiens
IPDYAAPVNERDTLLRLFCHGAWAGGCRVEDIRTTLFDLLLGTQVVGVTTLLLAAVDSTRVKASIALAADHLVAVVFLGKLAERRLNNATSQAQHQVQGGLFLDVVVSESAAILQLFAGKYQTLAVQAY

SEQ ID NO: 1007164 - protein, 172 aa, Homo sapiens
DTRAMPAPALDDFSGLGVYTAPLDGIDAGGSQPEPGQTPCRLAGNLKASLVLLNPKGLPLGPLLKVYPECKQTAGQGSPCEEQEEPRAPVAPTPPTLIKSDIVNEISNLSQGDASASFPGSEPLLGSPDPERGGSLSMELGVSTGVSPARDEGSLRLCTDSLPETDDSLLCD

SEQ ID NO: 1007165 - protein, 57 aa, Homo sapiens
QLTKKEIDVISIPSECLFWIHEPNSKVIIPKCPKNQAFCFGFAFDETASNEVVYRFT

SEQ ID NO: 1007166 - protein, 62 aa, Homo sapiens
GSTPLTHTVSLFPTGRYGQLCKQASGVAPCSDDNYVLLVTFSLPCALVPGLRVDDYITSRSA

SEQ ID NO: 1007167 - protein, 159 aa, Homo sapiens
TRPCLHQHGHSRPFENMFKKEPALTAGAKISKEKKPSPEPEGEVGPPKINGEAQPWLSASTEGLKIPMTPTSSFVSPPPPTASPHSNRTTPPEAAQNGQSPMAALILVADNAGGSHASKDANQVHSTTRRNSNSPPSPSSMNQRRLGPREVGQGAGNTG

SEQ ID NO: 1007168 - protein, 52 aa, Homo sapiens
RQPVRGSMEPHSKEWLLIQGITGETWGECTWETAPQHILFPTWKNLLLVQAY

SEQ ID NO: 1007169 - protein, 67 aa, Homo sapiens
DILNLLPVTCHKAYRDLSYCSHASSAPQLWEISPKNISFIAIRTSLNVGSLSATRPTRWIMMLLIES

SEQ ID NO: 1007170 - protein, 69 aa, Homo sapiens
GSPACMHQGHDVNVFLRFPELRFASEASGSVCQNCSCRVQAVQIVGDLWRLRRDLPVSPQSFESDVRKF

SEQ ID NO: 1007171 - protein, 39 aa, Homo sapiens
MGHKISMLGISHVELKEFKGTSNIKINTCFPPPPRTVDK

SEQ ID NO: 1007172 - protein, 59 aa, Homo sapiens
TTGDSSQFEASTCTMFVKVEPRCKGLHSAPTESSPTLVMTGYKVMLGGQPSHCAFEGFV

SEQ ID NO: 1007173 - protein, 39 aa, Homo sapiens
TRPACASHIRNTGMRVSVFQENFLESEAVALLPRLEPNG

SEQ ID NO: 1007174 - protein, 102 aa, Homo sapiens
MSTVYEACPNAPTGSCTEVHDPSFGLRPRRHLVSFRAWACVCFFQLPLQIGRSTRSILPGPATHVPTGHATDCVTCSSGADDVALDPSSDIYPMTTTEWGAV

SEQ ID NO: 1007175 - protein, 63 aa, Homo sapiens
LQDMLTVEDFDVPDAFQRSQSTESVEVWSASDDLTSAMITHCQVVSLPVDLSRYSMLGILKVM

SEQ ID NO: 1007176 - protein, 104 aa, Homo sapiens
RLRRLRKLLGAWVVRQAAGKGTMSLSPCMAERLVAEVTQCGYPFPPGQISLKLRCHLLARADTARPKPCRHCSSIAPRVKRIGHCVLALVLRPHQAESLALLLR

SEQ ID NO: 1007177 - protein, 115 aa, Homo sapiens
RLTPMPRLECTSTSGAQVILPPQSPKQLGLQASTTTHGLFFVFFCGDSFALLPSLVLNSWAQAVLPPHPSKVLGLQAKPPCLSIIFERGSCSVAQAGMQWCDLDSLQSHPPSSAS

SEQ ID NO: 1007178 - protein, 60 aa, Homo sapiens
SGLRLMKTAVVTKKQNLADCPSVRIQLVILCVFSMTGDTGWSYKIPIPASGSPIFPLVHG

SEQ ID NO: 1007179 - protein, 57 aa, Homo sapiens
LQLLMNYKVNYIQVSKGPLLKSNLHPALEFSGSLGMKADTGALVQWASAHCRCQGRK

SEQ ID NO: 1007180 - protein, 88 aa, Homo sapiens
RSTASEYWDIGAAHAQLNFCIFSRDGVSPCWPGYSQTLDLRRFTHLGSQIVGITGMSHRPRPDPLPLNTSLRPNNKGFPLRNHRAVLR

SEQ ID NO: 1007181 - protein, 53 aa, Homo sapiens
ARSAGTKDAGTITGLNGCCCIITEPTGRPSPRAWTRMGCAGGDADRAHTLTVG

SEQ ID NO: 1007182 - protein, 43 aa, Homo sapiens
MRVGVGGAVSLLLGMNLAGSRDHLQLHHECDVDIAMTVRQHWC

SEQ ID NO: 1007183 - protein, 44 aa, Homo sapiens
QGTAVRSIMKCDVDIRKDLYANTVLVGRHTIVIGHWRTGLQKGR

SEQ ID NO: 1007184 - protein, 180 aa, Homo sapiens
GSSGTAVRYKVNISNKFYNSSADIRYNASRTTSYRKAYSSYVRLDEVCAFCQGNISILKLTHSSKCYAYVEIRIEAFAVDDGGARLVVLLLANPHLLEGGHVRPGWSHRSKPSTCALGGAMILIFMVLGARTEISFCILSAMPGYMVVPTDSTVLAVQVFADVTSHFMMELTLFSWMPQD

SEQ ID NO: 1007185 - protein, 44 aa, Homo sapiens
RSNRAGTRSHMHRIVIKANHCLKRQLQKMFVVFYNSALKEYLAN

SEQ ID NO: 1007186 - protein, 85 aa, Homo sapiens
SGQRLDDRRIRRGVSLGPRLQLPGWLCPEWQVLVTGQLFQAKQENLPILKRASGRRLPLTSRTLTQCTTTLVLVDSGDRTMTTKR

SEQ ID NO: 1007187 - protein, 55 aa, Homo sapiens
VFLPTTRFFPTTVSKSRSHETFFEHQYHPPMGIGLILLQGKSRAKSRKDEESLRE

SEQ ID NO: 1007188 - protein, 92 aa, Homo sapiens
MRLDFRRSGSGKQVSGLLRYRYSCEAPGMVSGVLSACVVNGWRPVVPPGSVLQALKPSPYEAELTDLTAPPEGASLMTVGGITARRDVQVWN

SEQ ID NO: 1007189 - protein, 42 aa, Homo sapiens
RSRSFPYGDDGGLTDDRRVGSTYTGATGPTLAPVTRLTPDFF

SEQ ID NO: 1007190 - protein, 138 aa, Homo sapiens
MAYTTASVRRTRFRRVLVATAGGAAAALVFGAFFDYWPLRATSRFAGAGLLGRGGWLAFRVFVLEAGFRCDARTYGSWCWRFRSVRLDCGSTYGSYSLVPFRLVLYGLSGRPDLLHSTAHVFSLLRLLSRRDGLNAWT

SEQ ID NO: 1007191 - protein, 36 aa, Homo sapiens
QEERTAGRENCRVRAVETSKCEEACYNQWWSLVYDK

SEQ ID NO: 1007192 - protein, 35 aa, Homo sapiens
SGFVLEGLVLSGGHFVFGGSKVDAVPKEKGPAYTG

SEQ ID NO: 1007193 - protein, 56 aa, Homo sapiens
MGNPGKQPGTSKLTSLISLSRGCGGEEQVSGSQGRQWPEEVSLPGISSFEWVCNQA

SEQ ID NO: 1007194 - protein, 185 aa, Homo sapiens
MAGKHMKGCSTLLVHGATGNENHNEILIKSTRKAKIKKTGHIVIGKKVELLSSSTLVAVNVKGPHLFKNHVERPGADGSLPVTPRHFGTATVEADSETQRDWRPTPVPTTGEHPGLYLQHTTKTLRYGCGLHTRLITRRLPHGTLTAGRHSVDSRDGGGYARDAWRLSTHVSLIAVANQTRELHL

SEQ ID NO: 1007195 - protein, 34 aa, Homo sapiens
RCLESGSGGASYSHSRFMEGSSTIRTFRFDAAVT

SEQ ID NO: 1007196 - protein, 44 aa, Homo sapiens
SGSALSLVLKDATEVAVIAQGQPSEYPQKGERKTKYTNHIKPKG

SEQ ID NO: 1007197 - protein, 43 aa, Homo sapiens
MVYCRHETSDLRVSISSVHTWHFGVGLDSGCSLQQEGDISDMK

SEQ ID NO: 1007198 - protein, 102 aa, Homo sapiens
DPKYHPVNGHNCEVGKTLSKHEMAGGFIQPKTVKVVLETLMVVVHVVLVGMTTFDHGRNITYVAVTEMVAIVVVDMVRSEYGCNGFGHDGLNFGSCVNPALI

SEQ ID NO: 1007199 - protein, 144 aa, Homo sapiens
GDLEDPCRKRELKNIAREIREAYRSINSSIDQAEERIPQIEDHLAEIRCEDKIREKRMKRNEQSLQEIWDYVKRPNLQLISVTESDGENGTKLENTLQRDVNSQENFLNLVQENLPNLVRQANIPIQEIHRPPLRYSMRRSTPR

SEQ ID NO: 1007200 - protein, 37 aa, Homo sapiens
MSKPPRTQRLQLNQPPVNPSPSQEEKPFSCADRQNYW

SEQ ID NO: 1007201 - protein, 156 aa, Homo sapiens
SGVRRAVREQVPGTVVNLACVEVRVALEEMGTEVTEDVVTACYALMEEGIQECTRCEQSLLKEPQKVQLVSVMKEAIGAVIHYLLQVGSEKQKEPFVLASVRILGAWLAEETSSLRKEVCQLLPFLVRYAKTLYEEAEEANDLSQQVANLAISPTS

SEQ ID NO: 1007202 - protein, 74 aa, Homo sapiens
AHDSTNSPSIFTHLLNISEALQQCCDLSQVWYQRILPGEAMGRRIQFPIESVHALHSTGPYPGKQRTYHYGVCP

SEQ ID NO: 1007203 - protein, 71 aa, Homo sapiens
EYWEVTHGCARVDGTCTGTACTYSGEYTSTRLHLNDLGRSARFSCVEGTCPGRHAAHVVTYTSTLVALHAC

SEQ ID NO: 1007204 - protein, 77 aa, Homo sapiens
AQCARDVEHRVKGDNLKALRLNDCPVGFQGPVTPFFKPIPPFGKGNAYPKPVTLTAIWKLTTWSAFPGSGVEGAESQ

SEQ ID NO: 1007205 - protein, 34 aa, Homo sapiens
GYHPPSIVSGQVEKVELGLRPRGKMCGIGGACLA

SEQ ID NO: 1007206 - protein, 63 aa, Homo sapiens
MGWGLQEKEQPVDFWEVFEMCAKHIAWSILPGACWLPMEEGRKSEQGTEGPPCKASFLTHPQV

SEQ ID NO: 1007207 - protein, 55 aa, Homo sapiens
MRGPESKEQQMGSIRGCWTVVRTQAVTSVFVSPETEGEGGITVSSRNSPAFNAHV

SEQ ID NO: 1007208 - protein, 75 aa, Homo sapiens
EDLIIPFVGHRHIALSAQYGGLQVSGQPCHGRCKGVQTRWQRVTRDGGPGLPHLPVQGGDTCGGLRGCGSPSGGT

SEQ ID NO: 1007209 - protein, 35 aa, Homo sapiens
SGAHIMIGNQAEGAGDADVTITGSPVSSAWPKKLI

SEQ ID NO: 1007210 - protein, 192 aa, Homo sapiens
RILKASRVGEGISAGQPGRLGVSSAGRCEGRETRGLRQSRQGCTQPRRVTFGTIRGGNRSDLQGMAEYRGWRTRSPLVLNLHSRPWQALGGLLSPIVESLAQLWVVSGACPPCASSGWSAERVRVEGQLGPFLLEADEALVLRVQVLGLVLHKCPELRGGRPGPEQAEQAAERDCSCGMGGPSPAAPGCHSG

SEQ ID NO: 1007211 - protein, 76 aa, Homo sapiens
LAQRRDDVGLRSGAFDSSVCSVGHMVRAFDQLFNMCSNCCNCTRVLDVVIPVAHSYRIIRLNWSCRCKREFGLLKD

SEQ ID NO: 1007212 - protein, 111 aa, Homo sapiens
MLNTAQRKMLNQRSMNKHDKAGHVILNKKCISWKEWSTIFFFTERACFCCARWIADGVIMVHCSLTLPDSSHPPTSDYFVAGTTSMSHNARLIFLFFVDRVSLCCPGRLVL

SEQ ID NO: 1007213 - protein, 123 aa, Homo sapiens
ILTRRRPGRTLRIMLLYKEELDGHGTWSWPGGVTGLLLGELQMTARPPRGRGVAAIPQKGTATRPPPQCTAGADGQLHLPLCPLVHVLLAGRWLTGTQGFASDPQPSGGFPRARGTLRPSGVH

SEQ ID NO: 1007214 - protein, 99 aa, Homo sapiens
DDPYRRVGYLDRSMRAHQLRGGAGQVSSTRITLWWSTRAGPGSDTLPLNHPELGQGLNNWGTEVPPVPARAWMCRFRTKGLLVLQPLYSMPWGHCGLRP

SEQ ID NO: 1007215 - protein, 90 aa, Homo sapiens
CQSDGTCQDAAIGGYKDQPSIWSAGPGKTLVNITPPQVGVLLAKDRPSSYVNGLTLGGQKSSVIRDSLLQDGELSMDLCTKSTDGAGTFN

SEQ ID NO: 1007216 - protein, 83 aa, Homo sapiens
LQAPGYWLESSRVGEHPGSRGLSATKPTGAPLPCSRGEVGGLSPRQRCLLGPQTVAEPTPCQLLKTDYDQYALLYKPGQQGPL

SEQ ID NO: 1007217 - protein, 46 aa, Homo sapiens
RGERASVFNTDTLCCHQSWAREDSSTDHPELGQGLNNGDRSPPSCL

SEQ ID NO: 1007218 - protein, 44 aa, Homo sapiens
ILSSGSLRLELGGGRVRDRGELRGQARRRRVSSVLRVDLAAEHM

SEQ ID NO: 1007219 - protein, 51 aa, Homo sapiens
MFLMMTSVERVSNHDTARSCVSVAHVKCVSISLVSLRLFRSSNLLWMYLAV

SEQ ID NO: 1007220 - protein, 110 aa, Homo sapiens
MRATPDIAARKKRNFILDQTRCVCCCPVGENMCLFAGFQRKAVVFCPIDDRLKSKNTDDEQIVEGKDLPEHAVLIMKGYFYPPYEVAECFDVISYVELHTEEAQRLLEQY

SEQ ID NO: 1007221 - protein, 34 aa, Homo sapiens
MVWTILPAIILVLIVLSSLRIRSITDEVLELSLP

SEQ ID NO: 1007222 - protein, 51 aa, Homo sapiens
MSPAVVRVWPWPSYTTVVRGLTDAPPSSPGGLLSRRPAGLPAWAWASFTPV

SEQ ID NO: 1007223 - protein, 56 aa, Homo sapiens
VRDGYTTGYYTRTLFLLVVFTTRNTFYFGHVTFYDFTDCNDTGPVWGLLYDVDPCT

SEQ ID NO: 1007224 - protein, 34 aa, Homo sapiens
MSINGKRVANNTQQVLEYQTCIKNFGGGDLGAEP

SEQ ID NO: 1007225 - protein, 161 aa, Homo sapiens
MTRRSRYVSDCGQLKNIEGAAGDDIALQSCRQSVAKAPATVDGHVAGGQQLRVTVIKGSQQEALGSLLVLPGGQLCQACGTLELVEDGLGLAVTLSSLGISGVDSALLNVAEHMRPILQVDADLDDIEAHVDDVLGAGAVVPGPGIALEGVADVPTVLVVV

SEQ ID NO: 1007226 - protein, 41 aa, Homo sapiens
LALVNVGHSTVGALPDIVVAVPPLPPLGGSSRRRADGLNAW

SEQ ID NO: 1007227 - protein, 98 aa, Homo sapiens
VAICRRYRRTSGLVCRKVLGPLWSAPPSTCNKTVLSTPSGSSSCVKPPAARESWRRCISGASSLCLSSALHSSRTFKVLFTDHPHEHVEFIQAQPVNS

SEQ ID NO: 1007228 - protein, 44 aa, Homo sapiens
MGQSVLRALAERRSEGTGADGLRLPSWRSKMGVALVVRVPRLNF

SEQ ID NO: 1007229 - protein, 39 aa, Homo sapiens
LTDHDSGARLDYYALYHFAPVRYSFYDGTPVCYTVTAEP

SEQ ID NO: 1007230 - protein, 36 aa, Homo sapiens
PAVTTCTGAVHNMHRLNFTYKLLNMICGDRVGGGGR

SEQ ID NO: 1007231 - protein, 89 aa, Homo sapiens
MQVASYKTLDCAGDYESANPGILAQPGVQVRDVLHGLIQYPEVFSLQGQYQLTEMCLDLHASATVYEELQVQPLLAGYTDRRSPSYPRV

SEQ ID NO: 1007232 - protein, 101 aa, Homo sapiens
LLADLRNMYTPKQTFFKIMTDSLQDHLNSKENYLQVNSVPDQSFSLAIIYYPSSNLIPKPKSNKILLKSATLMASHTQAFHLLCTLERPKFCYTRGTANRC

SEQ ID NO: 1007233 - protein, 51 aa, Homo sapiens
ITGTAVARTLSVSTVRNEADLMFAFLYNALGIPIAAGVLYPLTGWLLSPLI

SEQ ID NO: 1007234 - protein, 37 aa, Homo sapiens
MERGNRWRRRESLETAADHDRILRQIESTDTACIGPT

SEQ ID NO: 1007235 - protein, 35 aa, Homo sapiens
LFGESGRRMHRRMAVKVSVGTPGKAWDTAANEPRL

SEQ ID NO: 1007236 - protein, 75 aa, Homo sapiens
MFVLCTFPMIAKVIPYFVKRGESPFLSYDKVYPLAILTKNDILRHMAHMANQDPVSIIFNLISHIMTENIRMRKL

SEQ ID NO: 1007237 - protein, 60 aa, Homo sapiens
IIFPDDCEFKRVLSDPSGRVYVLEVQGRLQAAFLSGCRNPKTDQDDGALPGTVNELSDTT

SEQ ID NO: 1007238 - protein, 44 aa, Homo sapiens
DPHDTATPINTICRQQDIQNAIIVVLCRKLSDSLCSFLRFHTIT

SEQ ID NO: 1007239 - protein, 42 aa, Homo sapiens
MARRAKPGYKEVQARDGHHVTASLRQDLRTVGPGMRRQVVTP

SEQ ID NO: 1007240 - protein, 31 aa, Homo sapiens
MECKTVGHEPLAAIYYTSAQLATRVAARNLD

SEQ ID NO: 1007241 - protein, 52 aa, Homo sapiens
IEDAKAGTVQTNGVVVWYGSSWLVMTVSTDDHVPPIGSAEMAEKAGLGWSLM

SEQ ID NO: 1007242 - protein, 86 aa, Homo sapiens
MNLMVSRQGVLTLRIAIQIVHTTLETEQPKPAPETPSLRFHHPFHKPETLAPGRHLAMMLTSSTRTRPLPPLSHSQGSLTDLTIPT

SEQ ID NO: 1007243 - protein, 39 aa, Homo sapiens
TLYDRVCSLRVSTVARRVSGVYALALLAVYGRVTRGLLY

SEQ ID NO: 1007244 - protein, 84 aa, Homo sapiens
MVGATRSYAYRVAIHTVNPFCISVWTIVTLGATGTVTGALPQTVRCHSPSDRPTAANWPQAPSISEPRVSRTVTGIFHALKLSR

SEQ ID NO: 1007245 - protein, 67 aa, Homo sapiens
IRTPNDNIYGYVNRASHKEGKWLFPKTMEDFTEEANRGRVLKSELSKEAHGSKARDDMHVASGWAYG

SEQ ID NO: 1007246 - protein, 35 aa, Homo sapiens
PTHSGGVLRIIIREGGRGVSTHSGGVLRLPPRRVE

SEQ ID NO: 1007247 - protein, 64 aa, Homo sapiens
PYRTPPVGRGVTGLATGTTVWVAYDGLVTTCYVSLPDDDRTDDRNRRRAFFDCATTVFLTGGTP

SEQ ID NO: 1007248 - protein, 35 aa, Homo sapiens
AVSIYVGFRNLTALTERRDRPVGLRTCAVRRRHFL

SEQ ID NO: 1007249 - protein, 149 aa, Homo sapiens
VGIKQWIRPVDPDLSEMWYKHLAVVISFNGERSIEGKFLGCICHHCIINLMFNVFLENLKPGILTCSNTITEGSFRSPENLFGYQIGILKRLSQEMFLYPILWNSHFWWQRQGNRQTLRMIQKWDSQFKTMASSSSICAENIKPLEVPQ

SEQ ID NO: 1007250 - protein, 51 aa, Homo sapiens
LAASIYTISNTRKHLPGAASSQHIASKAIQQAAGPWKQLNGTHPPTSTWGT

SEQ ID NO: 1007251 - protein, 79 aa, Homo sapiens
RSRLRARAGTVVRILGKVSHVEGLDDSYDLFPSAMVKPKLLGQELSEADGDGADSARFEELLLQASKDAPAKPDNQTKN

SEQ ID NO: 1007252 - protein, 45 aa, Homo sapiens
MYHSYGSRGAGTCRRSRSSVLNGAQAGVQWRESAIAGISDTLWWI

SEQ ID NO: 1007253 - protein, 40 aa, Homo sapiens
DIEHNFISFLVTEKSSRNRHAQGYGIRHPTLSSTCGGNCV

SEQ ID NO: 1007254 - protein, 56 aa, Homo sapiens
HSIFWTNSDLTVVENKGELLEDIKRDFGSFDQFKEKLTVHLLVSKAQVGVGLGVRG

SEQ ID NO: 1007255 - protein, 78 aa, Homo sapiens
MLLAVQRHLTAVQVENGDSVLHLAIIHLTFSTGEGSTRSHQSGWISDDLITMENDLYQRPLALVEVIIKQERCGGGLA

SEQ ID NO: 1007256 - protein, 77 aa, Homo sapiens
VPRGLSPYAKPTEYTFFSSSHGTYSKIAHIIGYKTILKKSKRTKIIPDTSLDHSTIKIEVKTMKIAQKHAIILGVRG

SEQ ID NO: 1007257 - protein, 92 aa, Homo sapiens
NRAGTVILHRIKISVGRLGAEPNLRAVHAKTSPVKANYYTPIDPTNLTKRNKLPYGITAAILILRVHTQHSRVYRPQIVGSETSRMVQPAIK

SEQ ID NO: 1007258 - protein, 103 aa, Homo sapiens
RVSAWLVHWARGAREWHDVACPEVAIEWQVVQPSERGVVSPVFLAAEPAVQARFRACTKLGQDVLHAQVLVNRRKPEAVCFIPVSAVLGGLSSGCSSALAIDS

SEQ ID NO: 1007259 - protein, 69 aa, Homo sapiens
CIRLGSGGSLESDQAPVFNEYFGGPYWLLTCRRELVQGGMHRSGEYTSPGCMYAFLGRDHGSPILKELC

SEQ ID NO: 1007260 - protein, 111 aa, Homo sapiens
FDTTIQSTHQFSTHIRSATSHSTSQQGSQHSNITTTTASKCTTGAHHSFNHITSNITTQSHSSSITSFMATTFFIATITHSAHTSSAQHTWHHTLLFNTTITRPSHHSTCT

SEQ ID NO: 1007261 - protein, 33 aa, Homo sapiens
PPTSASQSAGITGVSHKARPIFFLFGGNGLVWR

SEQ ID NO: 1007262 - protein, 31 aa, Homo sapiens
MINDKGDITTNPTEIRTTIREYYKHLYANGR

SEQ ID NO: 1007263 - protein, 136 aa, Homo sapiens
RGSCVIPFVKGSDGDMSSAVSYDLRANLSCVGDGCQGESSRMRLAEFRRIFELCSYSLPFTCITRKCSCCRLVLLIARDRSGLLCCDPIEKSQEAYLLVFEHYVNHRKHNIPDFWPKLLIKEEKCRVRILYGRGDD

SEQ ID NO: 1007264 - protein, 103 aa, Homo sapiens
MLENYSNLLSHWIWRQAIEIRVYLTEKNIPEIRASQRNSDRRSKFLVAELDYFQCTLERTKGYQGRYGHQIILNYGQKELVIKKDPFLEKIQRPPKGEFLLIE

SEQ ID NO: 1007265 - protein, 65 aa, Homo sapiens
TISLAPADGGAAMHSSASSYFRRLRRRLRSHPVPLDPTRYDAPLHALTTRSRADLSCCSLHMAPS

SEQ ID NO: 1007266 - protein, 62 aa, Homo sapiens
LDTVTRAHQLRGGAGPAVLQHWTRSADHPELGQWRTRSTRPPRSWARGLNKLGQQCPPVPSQ

SEQ ID NO: 1007267 - protein, 38 aa, Homo sapiens
IPRSAWRLGSSPILTVPIRFRLACIICMGTSLVVLKIH

SEQ ID NO: 1007268 - protein, 83 aa, Homo sapiens
VLYSDLIRRVGYFTRITRASYSFEEERAQLSFNTDSSADHPELGQWRTRSTDHPELSQGLNNGDRSPLSACQGPCSGWFVTKG

SEQ ID NO: 1007269 - protein, 66 aa, Homo sapiens
TTSSFHLALKMPCNFHHNPLFDILSRGTCHVLWGLLCRVPLVLSKLVGLATHPQISVLMVHSAAHV

SEQ ID NO: 1007270 - protein, 98 aa, Homo sapiens
AELRVSMETIYQWFKQAHQDHKASPTTLMGNCAHRRTSILHIVIKRGWKEGTKITFPNEGDAKADNIPADIDYVLKDKPHATVTAENGHQCDLQMPDQ

SEQ ID NO: 1007271 - protein, 39 aa, Homo sapiens
MTDIVLSALVPPESGEVVLSYSLLGSVQRCNGQLPVTLE

SEQ ID NO: 1007272 - protein, 45 aa, Homo sapiens
MSGLSSYSGLSGYSGMWATSGVSWLVGTVGSSVAVWASRGCRASR

SEQ ID NO: 1007273 - protein, 62 aa, Homo sapiens
QEMAELALQAVLRSAVGGLMRSSQVNGAKVVGLCLCHIKELLGHSESLSIRVLRQRTCWLVG

SEQ ID NO: 1007274 - protein, 53 aa, Homo sapiens
MLNIVHCLSDQNKYKEAAHLLNDALAIREKTLGKDHPAVVATLNNLAVLSGYS

SEQ ID NO: 1007275 - protein, 89 aa, Homo sapiens
MIAKGESGRRRQVRKGRANRYKSVGPLPRRRRWARLPIKTTEQKKAPRTLRTPFQYNQDPQMEGAVRSWEDRVGSDGSEVPGRQRSEGF

SEQ ID NO: 1007276 - protein, 69 aa, Homo sapiens
MGNDTDDLADTSSMLLKAFSSWFLASSIWHFLPYLGKGLPSLKLLAILYKKTASWHSFNLDGCSKAKEQ

SEQ ID NO: 1007277 - protein, 37 aa, Homo sapiens
RNYKSELLRIWGADASSVCAPDLRCYSGVPTKGAIFP

SEQ ID NO: 1007278 - protein, 154 aa, Homo sapiens
KGEPGIHVRNFLKIEVSSRIQPGQLLLPAPEAQSSTRTMAAPRTAQTRGGRRRDAAATDQKDSMGKGARPGQARKARRGLAYTLLNNPTLQGLPARTGPVGCQWCPSPEGRERSNHLPICAEACSCLPSSSLPALLPASHQPCSQQVLRITVVG

SEQ ID NO: 1007279 - protein, 128 aa, Homo sapiens
MLTHRYVKTGGEQSGSEGSAQSHSARFLKQSAVGGWVPKFVLGSRLGSTTRVSGETTTTSTRCVQPGSKALGRIPHTLYSRTQTPRSEYKGEIHRLLQGQGFTEDTIVFLPQTDKCMREQEDSPGLKL

SEQ ID NO: 1007280 - protein, 93 aa, Homo sapiens
MSSRTLRRVGYWLRASGCGSIRAARGECPKPQVHPSLKQSEVWGAESRTGCLLGFPDWGSTYSVSVVETDYQYALLYQGRQGPWGGLPHGHPL

SEQ ID NO: 1007281 - protein, 59 aa, Homo sapiens
QDTRRDIQKRGGQLGWRDPASGLGSPIGPAMPLIRDVGAGKNNGNPSGESPLGPWQEGR

SEQ ID NO: 1007282 - protein, 53 aa, Homo sapiens
VLYRSYKGESGYEEEELWPQHCGTRWLEEEALCSGLHRSLEPGQVAEQEEAAA

SEQ ID NO: 1007283 - protein, 32 aa, Homo sapiens
LEDLKGSRVEKGSSAGQAGRLGGEQCRRGEGR

SEQ ID NO: 1007284 - protein, 82 aa, Homo sapiens
MAHLQLLNQRNSSSGREGASPLMNVICKCTALPISGARTSPKYQHSLRLAGCAHRVGTRSSPEEKGAGPPSRESVCEHHQLP

SEQ ID NO: 1007285 - protein, 50 aa, Homo sapiens
GYKNKHVKQNKYQHSSSQTEQECHAGMLWVIRHVSTQMEWGKFQKTSLYE

SEQ ID NO: 1007286 - protein, 95 aa, Homo sapiens
PTSPTGDRQVGLCGLHLVPSHQNARPLGDAGGAAFPSLVSDTLPRLSLLAPSLLARSHSFLRGNSGLVVSVGIFGAVGLFGDSRASRGLSGYVGE

SEQ ID NO: 1007287 - protein, 67 aa, Homo sapiens
RRPFYAWTTRASIPVPKQRNATATGKQSSSSRAQARQAAAKAQGSSSKGKGSSRQGKQQQRQGKQSK

SEQ ID NO: 1007288 - protein, 61 aa, Homo sapiens
TNRAGTVPCLGQFLPFQMGVFTQCLYPHCIQDVTNWLFILQAHRQKELDVSDETWDLDFGF

SEQ ID NO: 1007289 - protein, 58 aa, Homo sapiens
MTAQALRDNSTMGYMAAKKHLAINPDHSIIETFRQQAQAATNDQSVQGSGPPLPFTET

SEQ ID NO: 1007290 - protein, 45 aa, Homo sapiens
EYSSRIVFLAHDRVMSSNIITGVKKLTNKATLWYVPLSLKNVDHG

SEQ ID NO: 1007291 - protein, 48 aa, Homo sapiens
RNTINKAKTTPKDRCHIMTDTSMTGLHLRYTILAEAQSYEILCDCPPP

SEQ ID NO: 1007292 - protein, 33 aa, Homo sapiens
MRGGNRSDRRIGRVQGLEDQKAPCFLNLQLPGP

SEQ ID NO: 1007293 - protein, 44 aa, Homo sapiens
IVGLQPGTVTQDGAEMMASGIGSERSDTALVSCGQPVGSEGSGQ

SEQ ID NO: 1007294 - protein, 67 aa, Homo sapiens
TLAEVGRKLADHILRVHLHLSISIFISSVSAARDKNSAISASSRSHGVPCCTRLLSLVTLMSSLCDN

SEQ ID NO: 1007295 - protein, 207 aa, Homo sapiens
PVSERKGCRLQIPAFHTPVFKAANWEKLLTSSSARDTDPGAVLCRGSWLLQDLFLWTKWPLGKLYGNALYRPPEVLYCRRKKKKPRNILSIDCNVCSCFAGNLVCSTRLCLSEHSSDDDRRTFTGLPCNCADQFVPVCAQNGRTYPSACIARCVGLQDHQFEFGPCISKNPCNPKLPKSQRCVAKPQVWLTTFDKFGCRPYECVSRK

SEQ ID NO: 1007296 - protein, 103 aa, Homo sapiens
RAGTFTGGGRRYCAGSTASQLHVTFPLKFPLDFIFGRTGTCPSAPRNKRAGGSQKALTTSPLTRDRKCLIKFFVIHIAFPSLSNLGSYNNEGSIKMNSTSLLP

SEQ ID NO: 1007297 - protein, 73 aa, Homo sapiens
EHTMVDDFQVLEVVKLSQMSIQVSHSHITFESQTLPITLWYKHFTHTLTHTRIHTHDTHTDNMHITLKCSPYE

SEQ ID NO: 1007298 - protein, 69 aa, Homo sapiens
DPYCVYVSDCCMRKLRPGDPYQLIAKASVEDFSKLGVAFLEDRLQMANGLIAQKIVCEVTLEHVSYVWV

SEQ ID NO: 1007299 - protein, 68 aa, Homo sapiens
DQGSCTVVYVCVMCVPDSAIGSLPALSGVASEPHVHDIRESLSFCVCLASLEVMSSSEFLFEAQELTE

SEQ ID NO: 1007300 - protein, 78 aa, Homo sapiens
MTVVMMVLMVLMMVMMVMMMVLMVLMMVMMVMMMVMMLVLLLLTDDDAGCELVMAWMMTGGDAWYLLMTGDDVCWSMM

SEQ ID NO: 1007301 - protein, 66 aa, Homo sapiens
VVLLCNRGDTSNGDSGAGGDGDVVTVVTVTVVTVVVVTVTVVTVTVTVTVMTVMVMVTLVTFACCH

SEQ ID NO: 1007302 - protein, 70 aa, Homo sapiens
MRKLINVIHDIHKRKVKNHMIISIDAEKAFDKVQHPFMINDPLPKVGIRGNTSLTHDHYYTSRTNPHIKI

SEQ ID NO: 1007303 - protein, 94 aa, Homo sapiens
MLQDRNTTLGILTEAMRRRGREKLTVKKGSKWTFSRRNNMKEEESQLQNIAFQMIPASSSLTWVFITCFQLQVSLVLPSILTFQPQGDVHAPLS

SEQ ID NO: 1007304 - protein, 50 aa, Homo sapiens
MILVEVVVVVMEMMVRMVVEVVSGDGGDGGCGCDVSDGGDIGEKGDGGAS

SEQ ID NO: 1007305 - protein, 65 aa, Homo sapiens
MTRGLGSMIGMYTNSPGRLALWSRAAVSTSNPWRLVLAGESRGFDQLSQSSRALVRRVREVDQFS

SEQ ID NO: 1007306 - protein, 32 aa, Homo sapiens
MAMAEVSKVFWRWCGLLVDRAGAQWFPSGCIL

SEQ ID NO: 1007307 - protein, 74 aa, Homo sapiens
DGGCNDGGDDGGDGDDDGGGGDGDDGGVIGRTSVDNTIIVGSNFICFVCSNCHFISMSSAHGNIVSEEESASRM

SEQ ID NO: 1007308 - protein, 57 aa, Homo sapiens
MFLVVFAQYGSKSATTSCSSMPAAIHSPFVDRSRSHRRCMAEFVAFFKICAAALIAP

SEQ ID NO: 1007309 - protein, 50 aa, Homo sapiens
LCRKMSCTGKQQSGLDGERTDQGWQEEESSLQLWTRGPHRQNRGEGRGVG

SEQ ID NO: 1007310 - protein, 43 aa, Homo sapiens
MPSSRRSQKEHETKTQESISDCTEEGVRVETCALALAKETDLK

SEQ ID NO: 1007311 - protein, 126 aa, Homo sapiens
ISRRLVMVYTDAMNIGEHVSFPIMDFSGYMTRSGIARSYDSSVLTFLRTLQYMFSISGYTINFCYFNAITVCSYFVTRSSRKLTEGPEIRRGFHGKRGRCGFGARDHLFPGVDLSLHRSRSGRRVI

SEQ ID NO: 1007312 - protein, 96 aa, Homo sapiens
MHYEKDQRCRPLRLLQPIAMPKIFTKEPYDTHILNLHVHYCSNPSLIPSTNNMSSTNKYLPSNQHKSRSTIHASHVKPSSLLYPMIRMSIQLKIRT

SEQ ID NO: 1007313 - protein, 76 aa, Homo sapiens
IDLFMAFVEGVKNSGGRSVQRTLKELGLDGSGFHLTTHDTENPSFLTYKIWKQTRLSDEWGEGNTQLRSLLQRDAQ

SEQ ID NO: 1007314 - protein, 68 aa, Homo sapiens
MTRKLIKVIHDIHKRKVKNHMIISIDAEKAFGQSPTSIHDQDPRQSGYRGNTPEHDHSNLGQTHIKDN

SEQ ID NO: 1007315 - protein, 51 aa, Homo sapiens
IATPEEPVVGIQASRYHITLGTSHSNQSSLCKYTHHRDTFPEGEKVDLLSM

SEQ ID NO: 1007316 - protein, 36 aa, Homo sapiens
MDTGGFYRTLSGTRLRIMYDCFDVWTTYYITRLVTT

SEQ ID NO: 1007317 - protein, 32 aa, Homo sapiens
PLRVSSRFRVPIPLRLPLLLRIFIRWFQFPPR

SEQ ID NO: 1007318 - protein, 36 aa, Homo sapiens
MICGANSEGVDKLLGGEQTLDTAFIFDLWFLFSVDR

SEQ ID NO: 1007319 - protein, 56 aa, Homo sapiens
MANTAPIDKDIRWQCAAYILCIMYYNVSGGTFNSTHARETSYGDIGRFYTPELIIF

SEQ ID NO: 1007320 - protein, 66 aa, Homo sapiens
MTRKTTCTPMFIAALFTIAQTWQQPKCPLTEEWLQKWYIYTMEYYSAIKKNEIPAFFAMWMNPSAN

SEQ ID NO: 1007321 - protein, 86 aa, Homo sapiens
TISDGDRTAVASIKAKMDISVGQQSTTFIGCPLSSKQVFPVTSSSPHILVQGGGMRKEKKTKGKEDVEDGQVGILCHTASPSSLRR

SEQ ID NO: 1007322 - protein, 42 aa, Homo sapiens
MSRYSDSLESVVERMYIYSYEYNYKVNLSCWFECVPGELGGI

SEQ ID NO: 1007323 - protein, 40 aa, Homo sapiens
IRRIVAVKSSIMSESHPSLTHTSHKVPERSPSADIYMDGL

SEQ ID NO: 1007324 - protein, 47 aa, Homo sapiens
MPFRKYCYSRSITQKSTVMIMLSSPDSPQKQSPVRLKTRHHVFTTVR

SEQ ID NO: 1007325 - protein, 33 aa, Homo sapiens
VTTGLHHSQSNARSEPCLAIYTNSLRQHQILNP

SEQ ID NO: 1007326 - protein, 35 aa, Homo sapiens
MDISRITVAYISDVLSSLRLWIMAPEHMNSIALKK

SEQ ID NO: 1007327 - protein, 33 aa, Homo sapiens
VVFLQLPTHPHTLFGGPSFPVPSATFSGVPELE

SEQ ID NO: 1007328 - protein, 71 aa, Homo sapiens
CTVIRKLSSVIHDIHKRKSKHHMIISIDAEKAFDKVQHPFMIKTLANSGYRREHSLNIDHCNLVTNPSIKR

SEQ ID NO: 1007329 - protein, 56 aa, Homo sapiens
RSTQTLLVPMASTDLGEKQNALLFLSKHALGLSLVSPGELHFLRKEGCKGKLALVP

SEQ ID NO: 1007330 - protein, 69 aa, Homo sapiens
RILDNSDDDTSNAPVHREQEAAQNLLVPMASNGLGEKPESAAFLSKDALGLSLVSRGEFHSRLKLPEPS

SEQ ID NO: 1007331 - protein, 34 aa, Homo sapiens
CAFYRMSSSMAISTEPINHSCTGLLSTGLRDEKP

SEQ ID NO: 1007332 - protein, 42 aa, Homo sapiens
HTAPFKNVVQCLFLGTLLLQLNNGCRFGNLGYSIAKRSAPVP

SEQ ID NO: 1007333 - protein, 43 aa, Homo sapiens
VATVDGDDIGEVVVVLMEMMVRMVVEVVSGDGGDGGCWYVIVS

SEQ ID NO: 1007334 - protein, 49 aa, Homo sapiens
PYVLDSTRNLLPPPRNSQRSHRFLTSHNSSRYSDVLFREAFSHHPKITS

SEQ ID NO: 1007335 - protein, 59 aa, Homo sapiens
DVSFSVILVPKPITPAHSVQKQHTNSLIQLPLKYLAILLQSVRVIKNKSGETITAQRSR

SEQ ID NO: 1007336 - protein, 60 aa, Homo sapiens
FCLVSCNNRSDHIQVGVRSRLSSTLKASSFSSTLQSTIQTPRQGLRGPSRTLSDLPPLHN

SEQ ID NO: 1007337 - protein, 43 aa, Homo sapiens
MTGTPIVFIFDPLAWEPPYAEGVARLKDKKTHTHTPQIRGTRA

SEQ ID NO: 1007338 - protein, 41 aa, Homo sapiens
MEVPRLGIEVGAVATGLHYSHSNVKSKPKSSTYTMVTELEL

SEQ ID NO: 1007339 - protein, 33 aa, Homo sapiens
MTGTAYALPFLYTARRSDFSNEDKLLLTVIGYK

SEQ ID NO: 1007340 - protein, 48 aa, Homo sapiens
FVLHREDVAAYITKEDGGVLQTQTTLYLTTGASDGISCTVRRRGSSFA

SEQ ID NO: 1007341 - protein, 77 aa, Homo sapiens
ATATRQYQGVDQSYSHLKAGAGAIAQLTFGALGDLDLSFLVTTGQSHQACTMEISLLCSSQHGSWLKNEKPLGNATA

SEQ ID NO: 1007342 - protein, 46 aa, Homo sapiens
TVRLRAGGGLQHQHEELSLRKQVVLAEEDLALRIYLRCKSRMRRVN

SEQ ID NO: 1007343 - protein, 77 aa, Homo sapiens
VAVTVGESGHYHSSSDQGRGSLGQLVHSESVRTQYSVGRGRLVDLMSARTRYQSGGDSSGTPTAPSDLGSRNRAGKV

SEQ ID NO: 1007344 - protein, 75 aa, Homo sapiens
LDHAYEISDGTATEVSDQAMSVIYTTAHGTSDLNPLTRPGIESASSWIPVGFVTLATKKTLQNFLIIENCVGYIF

SEQ ID NO: 1007345 - protein, 75 aa, Homo sapiens
LPRHSNKRHKLHRSIGNLGPGTLPTLEPYMSEKSMHTPGFRDSAWNMPRRPSADLRVFRASEIHTDPEEPHGSSR

SEQ ID NO: 1007346 - protein, 49 aa, Homo sapiens
VIPLFALLYETLPIRCISIPALPALAVHSLHQLAWELPSTARTPGRHSL

SEQ ID NO: 1007347 - protein, 80 aa, Homo sapiens
DDAYTVVYRYSNSISQVNNGTLAFNQNLRGCVLLSSITNHSFLLPNVLLLSMAQCSKGVLSSRCAMPVECYNTLVTYKKE

SEQ ID NO: 1007348 - protein, 32 aa, Homo sapiens
MRTLSWFIFDALYLLKKGAQGVPVMVDAVDKP

SEQ ID NO: 1007349 - protein, 45 aa, Homo sapiens
YRHCSIGNCGQDSVPGPGTSMSLWVQPLKKEEEEEEEEEEKYPLS

SEQ ID NO: 1007350 - protein, 31 aa, Homo sapiens
MQFLPQEAKSLVLQPQMSVSPYCVTVTPQLR

SEQ ID NO: 1007351 - protein, 55 aa, Homo sapiens
MTPLKSPAAGGTGAGAMPQSRQKSLVLNRAGSPGVTGRDPRSSTQESETGLAGWD

SEQ ID NO: 1007352 - protein, 33 aa, Homo sapiens
MVTIIKPSGLEVEKATIFWISFGVIAHRAVFKV

SEQ ID NO: 1007353 - protein, 74 aa, Homo sapiens
ADARLGVVSELQPSAYAEHSHEGSEYASMTYTTAHSNAGILNPLRKARDRTHNLMVPSPICEPLSHNGNSSKYS

SEQ ID NO: 1007354 - protein, 94 aa, Homo sapiens
NSDAINLSSRQTDSPSANSTQEDGIAQNLLTSPLPKAIEPEKMAPPTLTPSDWIPKGQAKYKFAREGPLKHFLLSLRKAREQTVPRCVRKRSLN

SEQ ID NO: 1007355 - protein, 52 aa, Homo sapiens
CLVVRAALPKSKLSDCKHRFNFHIPRWEESEIRGQHASFWFKPPSRLQVAAS

SEQ ID NO: 1007356 - protein, 43 aa, Homo sapiens
AEYVFFFPADVARAGSRFTKQETNTRQSAKRIPALDEGLSSPL

SEQ ID NO: 1007357 - protein, 67 aa, Homo sapiens
GYIADAKKTHGREAFKPPGITSTLGTSHSKPVITLQGNLTTETRLQERGKARPSFHDRECLLRSTSP

SEQ ID NO: 1007358 - protein, 56 aa, Homo sapiens
RVLTGDHNGNSDKAVFLTSYSSLGPEHKPLICRGHSSGGGGRVYLSQKIKLQTMQT

SEQ ID NO: 1007359 - protein, 35 aa, Homo sapiens
RGTYDTLLRDTGLLPLSLYTDANATTPHRTTTLTT

SEQ ID NO: 1007360 - protein, 41 aa, Homo sapiens
MRRRITTVHGYTIIFNPLSEARIKPTTSWFLVGFTSATPRQ

SEQ ID NO: 1007361 - protein, 45 aa, Homo sapiens
MTPWTSERKPRIQPTHYSNIIYDKGDTDYTMEQGQLVQSVVLGKP

SEQ ID NO: 1007362 - protein, 46 aa, Homo sapiens
KLTLRMASKGQGTFSFWVMMGVYSSLPLDPLDVIDRLSREAFLGGR

SEQ ID NO: 1007363 - protein, 55 aa, Homo sapiens
QQRDLDWTSIRKNSSTYDTNENPGAVNIDSASRILKSWFQDALTIRQKCNRRNKN

SEQ ID NO: 1007364 - protein, 53 aa, Homo sapiens
WLRFSPWSRNFHEPWVLPLKKEEEEEEEEEEKYPLHSLVAGRVVDGEQRSNRM

SEQ ID NO: 1007365 - protein, 36 aa, Homo sapiens
HESSGIVGREYVIIDVSEEVEQEEKWEGAYLRNHHS

SEQ ID NO: 1007366 - protein, 53 aa, Homo sapiens
GIRPRGEERSHAAEGNSGLKKLSSLRAEDRWIGVTPTLRACALKPGCSYGNTT

SEQ ID NO: 1007367 - protein, 65 aa, Homo sapiens
VVVLYGDDDGDVMGIGGRKQVYLGMGLSGNRTTGLDICQQRGGGSLDKCGSRKEGRERCERSLRG

SEQ ID NO: 1007368 - protein, 69 aa, Homo sapiens
PLSMAVYTDSLCPVFPVTVHHRIVNVAALCCAGRIFLYIHSPCNSLILLTPNSKSIRTPPPDNRKSVIV

SEQ ID NO: 1007369 - protein, 99 aa, Homo sapiens
KPREWEIIFANKVTENGLIVQNLETPSAAPYQKNNPFKKWAEDLNRQFSKEDMQMCRETHEKMFSVIMVREMQIKTTLFYHRYTSQDGHHIKGVPTRGT

SEQ ID NO: 1007370 - protein, 141 aa, Homo sapiens
MWLFGVSGHGVSPSHEVSWNKKGKKVNFSDALRRLEFDVECMGQCQRIHAAEDTAGMKIVYDVCGPRTRIGRDHYSDANAILSSAEDLAASPGFPEHQLMGPLVDRWSDADHGQPPMLCAAMRQPLTLTITCVQRTSLPVD

SEQ ID NO: 1007371 - protein, 125 aa, Homo sapiens
ITLTGHTQIQCTLTHAEWLALTHKMHACTHQGTLVTQCTHTLAHLWHQRCALAAENSTLSTLESTPKGVWGRLATSEIKSLTHTASTLTWAHTHTQTHLHTPGHALTRMHTHVLSHMHTHTHIPG

SEQ ID NO: 1007372 - protein, 60 aa, Homo sapiens
CALWTNAQTQGGLVRIAALLVLTYAYVPKGKEGLGCSGSVGTSAWLVVLRSLETNSKRVL

SEQ ID NO: 1007373 - protein, 72 aa, Homo sapiens
MAKEGRQTQLIKYCKHSASCKTSSQIQIKGVSYSYPRCCNRQTASTSGQTPRRYTAHVKAKMRVSDQWMTFR

SEQ ID NO: 1007374 - protein, 66 aa, Homo sapiens
MWYTSSLFACHPSILRSFTFHFFFSHLPTLVWSSRCVHGLTDLVLLQLVVSVSAAARIQFLATVTP

SEQ ID NO: 1007375 - protein, 149 aa, Homo sapiens
SRLWVEVVHKRMPSKPHQHLEQLQTSPMESHVVLTGAKSQLRDLPEVHKPCFPKKKSNQCDLPSVACAATALCRLGNGALAGVSLALGVHSYDTPSLRLSYRGTTRTQWPDIPKPSCQQLFHSSPWAQVKVESLNLPFTLPFRPVLKQY

SEQ ID NO: 1007376 - protein, 48 aa, Homo sapiens
ENPVDITLPSEECTTMYMTGGLQLRGRGTSFMNGSSQKDFSENYVRPG

SEQ ID NO: 1007377 - protein, 66 aa, Homo sapiens
MLSPRLLPHAHSRPSALTINQRCTVCQTGLRMKNPAIEPAMRAINALTLTLIMICVKPSTKDCDSP

SEQ ID NO: 1007378 - protein, 47 aa, Homo sapiens
MGGSEPIAGVEYTSSDYMIILRGCNSFTYLKAIVTPSRDVSVMNTDF

SEQ ID NO: 1007379 - protein, 69 aa, Homo sapiens
VLGTKTFAECMKHKDKKSVAAIWMQLESLTLSEVSQKEKDKYHMIITYVWNLKCGAHKPVYGTETDSHH

SEQ ID NO: 1007380 - protein, 70 aa, Homo sapiens
TVVFRGDFITHLQQLDRSTRQKINKETQALNDALNQMDLIDIYSTFHPKATEYTLFPSAHGTFSKIDHIL

SEQ ID NO: 1007381 - protein, 71 aa, Homo sapiens
CPLGADLDTSTRWQLDILLLSHGGLADRGQQAGKGCTAAQAPLLPSYSPLSSTTGFSRGLTHRLYKQRFSS

SEQ ID NO: 1007382 - protein, 51 aa, Homo sapiens
EIGWSKKNSYYPLPPICSSDPMADRKTVGWNVRKVMQTSAPCGEPCVQPPI

SEQ ID NO: 1007383 - protein, 37 aa, Homo sapiens
MEVQARGQSRAAAAAYTTATAHQIRAEHASVTYTTGY

SEQ ID NO: 1007384 - protein, 65 aa, Homo sapiens
SVTCAVVELWSDSVPCPGTSMSRGAALKKEEEEEEEEEEKYPDSLCGRGVVEGNKSNRMIRPMCT

SEQ ID NO: 1007385 - protein, 60 aa, Homo sapiens
MRMRLRNLADATGRYDNDDGDRQYLHNLQEMAKDHEDTRHFYLSPKMNILVILDLPNPKQ

SEQ ID NO: 1007386 - protein, 35 aa, Homo sapiens
VIIDMTVGKAMMKTGMNGRMVKQTMQHSETGINWV

SEQ ID NO: 1007387 - protein, 70 aa, Homo sapiens
SECNRTASIAVSDCNRRASDSGFRMCNRRASSYRLPDCNTAAEYYRPPDFNRRRSITGGRRLHGPRSITG

SEQ ID NO: 1007388 - protein, 73 aa, Homo sapiens
VVYRSTYVLCWGVGSSSRGVCRDEKDPRLRNRKEMRTGYVLNVEGSEEEKLQIVTQPNHTTCRSNAVLLEGGI

SEQ ID NO: 1007389 - protein, 42 aa, Homo sapiens
LHSYHGYSNRVQKARSQICIHRTHTYYVCYFGKYPMQHPLGY

SEQ ID NO: 1007390 - protein, 36 aa, Homo sapiens
NLQPSLSALSSNMQDIREVLARCAGEEEEERLNGGE

SEQ ID NO: 1007391 - protein, 58 aa, Homo sapiens
MANWLIQSSRIDAMNQAVERAWSCFCAFRARIRHFAEVCLAGSAIPDAEILRFPVTVI

SEQ ID NO: 1007392 - protein, 52 aa, Homo sapiens
LAGHSGTAAAQTKHTIPDIVNVLLEELVHHRYELPGFRTLEMAAIGARERVN

SEQ ID NO: 1007393 - protein, 76 aa, Homo sapiens
PSSIICKSDCVEILKKCGDQNKFPEEHTAESICEFLSPADDLESCIPLDTYLRPSALGNIIEEVTHPCNPNPCPAN

SEQ ID NO: 1007394 - protein, 41 aa, Homo sapiens
LGSHAAIGDAVEQLCVEGGHSLAADSAASRETGDVAAVGAA

SEQ ID NO: 1007395 - protein, 102 aa, Homo sapiens
MKTGAFWDSMGAQATYSNTKENGINGELTSADRETVEEVSARIVQVLTAEAVTVLNGEQETEAQHRELDCSSAFSELTKELICLLLQPHQLPQKRLSQCRKI

SEQ ID NO: 1007396 - protein, 36 aa, Homo sapiens
KDKIRRERQSLRTKGYMPCEQKDNDPVNQKIKTCEQ

SEQ ID NO: 1007397 - protein, 58 aa, Homo sapiens
MGQGFYSNRFSVETYKWWVYITQAQSSLGLTVMSVAGETLCSMQGVWVFQVSMSRYIV

SEQ ID NO: 1007398 - protein, 52 aa, Homo sapiens
ILWCTVTTTSKIIDTHAHIRHFPQKQSSTHKPHTYGQTPQLQIPVNMHRHIP

SEQ ID NO: 1007399 - protein, 67 aa, Homo sapiens
DPEVIIHFIRAHFHDLIILIIHISKSSPPNTLTRDLGLPKLESFGGDTTHLTSTNLLLLLLLLRITT

SEQ ID NO: 1007400 - protein, 72 aa, Homo sapiens
DLPDLMLRYGTQMCISVFDYTTDHGNTRSLTTERGRDQTCNLLVPSRIHFRCAMSGTPKKMVVVSLFFSLGP

SEQ ID NO: 1007401 - protein, 62 aa, Homo sapiens
MSDSNPCLADDAWVAESSFMERKYDVKSLFWQPKVGEGEPNRMDRHGRWDPCVGKVQCIHFE

SEQ ID NO: 1007402 - protein, 58 aa, Homo sapiens
QGRDRTHILMNTSQVNSDKPNRNSQNYVSLCRFSILMASSIPPVASIPIATQLEGSLS

SEQ ID NO: 1007403 - protein, 86 aa, Homo sapiens
GALRGYVYTSLQMQIFNPLCQARDQHLSPGPAETPLILLQAVETPPHIFTKHFQLRAYTAIEQRLNTNRGYRSSQFANSWLTSLLL

SEQ ID NO: 1007404 - protein, 82 aa, Homo sapiens
ARSSRAYNVVLPVTRTYTHTRIEASRPGTGSEPQLVTYITAVVQAGSFNPLCWAKGLNLHLCTGPQPPALGFFIYCATVGAP

SEQ ID NO: 1007405 - protein, 41 aa, Homo sapiens
KPSQVSPSHCFTEESADCMLRADMLTVNLIGMASDCMSSFG

SEQ ID NO: 1007406 - protein, 61 aa, Homo sapiens
MIYQLQLDTLLLLNEKCIVWHENGGQEAGVRDGGCPGAESHGEPMVVVRWRTYEGLVDMPA

SEQ ID NO: 1007407 - protein, 34 aa, Homo sapiens
LTTLESQTHISTFRKRNSTISMQTSNKKGSGQIP

SEQ ID NO: 1007408 - protein, 48 aa, Homo sapiens
IVYMGPTATGARTQRQQPSAMLSSIATRHVWNSEEEYSILAETTALVY

SEQ ID NO: 1007409 - protein, 36 aa, Homo sapiens
EVSVGTTSAGSLHLSGGTWCLTCQGPGVCLLRLVLQ

SEQ ID NO: 1007410 - protein, 35 aa, Homo sapiens
ECSGGDTHLVALDNSGAGPSLSPGAPPWVRSASPR

SEQ ID NO: 1007411 - protein, 48 aa, Homo sapiens
SGRICGPEHRVLRYKERLTENPKFTGETALGDLEATIITGTSTEQVDA

SEQ ID NO: 1007412 - protein, 40 aa, Homo sapiens
MAVYAYMTRPGPVLVIFTYHLISRPRYYKTGTTIMPTESL

SEQ ID NO: 1007413 - protein, 61 aa, Homo sapiens
AGKTCMSPHLAGLVLRKLQYGQQSTWTGTYVAVDEVSGRMGPTITSSFGCSTGPPPLLFLF

SEQ ID NO: 1007414 - protein, 41 aa, Homo sapiens
EEQEPPRKQILTEENMATHSPQHSLHKDHPHSSPPKTSPHS

SEQ ID NO: 1007415 - protein, 57 aa, Homo sapiens
RRILENPGLKVATAFFEPISAPGQRCNLGIRDTSAEARLWVRLVLTIPVTTGGSCGR

SEQ ID NO: 1007416 - protein, 48 aa, Homo sapiens
IYVMIVAGHRAALVPTAAAPSPPARPLALHVSHHCLVAPPLPHAPPLP

SEQ ID NO: 1007417 - protein, 65 aa, Homo sapiens
IELVPRDCPRRLLASGIRDSSLPFLPAPTIALMGAPAPAPSMGSLAQRTICKHLFRIQWLPLPKK

SEQ ID NO: 1007418 - protein, 82 aa, Homo sapiens
LDATEARYIDPVIIRVDMEDIRNQRCLRNLGIKALNLRRSLDFRVPYMTVHAPLSSVAARSAIGGARPTSARSSPSTHRYEQ

SEQ ID NO: 1007419 - protein, 55 aa, Homo sapiens
MLGALGRPLLAGGSEDGLGWGSQSTCVSEEQKPSGAGFLPMLLGQPYLIPPHCLV

SEQ ID NO: 1007420 - protein, 87 aa, Homo sapiens
QQHYAYITHSHKPPIVTQQTSICGPLQANPTLDSRPQYKLSNFSNGNRIIDFMAGTTEIPSFGELIPPVNNSHALFHNDSDLLSIQG

SEQ ID NO: 1007421 - protein, 87 aa, Homo sapiens
YSLQKENPADTELTCCVLRPHDLNGRVMWERALVGAVGHTAEYFQYGSPELEAHTLWVQPRVAGQLSQRVRKLMESVSHGRCEGVPP

SEQ ID NO: 1007422 - protein, 64 aa, Homo sapiens
PGIWAGIRGLLDTTNEAALRIGTHTLCWLQNARDNNHWTDLVLLNTGFLCGCDLGFLTVHTGAQ

SEQ ID NO: 1007423 - protein, 43 aa, Homo sapiens
GLNKEAGYIMGVIDHPESRKRERTAGKLVGDVQCRQVEHKQDD

SEQ ID NO: 1007424 - protein, 70 aa, Homo sapiens
LLSILGPLSGRWVCSIQKSLYTLWLFLLICELAYHPSLVIPALLWAHENRLTPRYVYLHHVVCVYTAFFL

SEQ ID NO: 1007425 - protein, 118 aa, Homo sapiens
MWQALTGRWECPVPLCFSELSRYPWRLPIIRGAQACVHPNTHHEYPSSGVGPKSRIPPIPHETVQVTPCPSPVLTVTSFIAHSPGLRPCTCGHRLIHSESALPGDMGSWSILVVARYM

SEQ ID NO: 1007426 - protein, 126 aa, Homo sapiens
VVLVNHCQSLPSHTECSPDIVQVIILNLKELFNLQHDLLGTDVLILGLPFFDMCICAVPSGSVVRAESLSVSVSNEICCPLFACLCHDPSLPSARRDSVQGLIGLSLIRILLPPAPSGSAHMAGPG

SEQ ID NO: 1007427 - protein, 82 aa, Homo sapiens
SNRARRDVYPNSIDVVPGSVNSCHRYSAISEYATVILLGNHVYSLVYRHLEIRRNFIDSNTKYPMSCLPRNITNKYNGCKQY

SEQ ID NO: 1007428 - protein, 84 aa, Homo sapiens
PVASRRVILSTPLHNEVGVYRKTRHVNIRTRHGLYPQSHNRLLVYPRAVRAPGCITITIIIETNFEMIKLIDIAARDCTGHGLL

SEQ ID NO: 1007429 - protein, 32 aa, Homo sapiens
MSKLLATEYTSWPMSTSGLGRRDFLIAKIYSS

SEQ ID NO: 1007430 - protein, 139 aa, Homo sapiens
MATPPEKLLLATSLNVNGPFSEKEYLRRFLSARRNPLASLRGYTRDFRFSIARLPGVPGVLAVALPIAAQGLGLLKGFVGAGSIGPSKVQEPCRGKAIPSLLGTEIVQPNDAGLLRPEAQVGWQQPWGWCPKMPDGTAI

SEQ ID NO: 1007431 - protein, 77 aa, Homo sapiens
HHRHSSLLRQNGVQEEPDAKDDKLLGAPRLAVEHCALNRKDWNDSPNSNYFYFQLISLIGYFKTSKIFIFNFCKTVV

SEQ ID NO: 1007432 - protein, 42 aa, Homo sapiens
MAPSQLSATSASQARVILLPEPPDQPGLQACTTTSSQLLYYE

SEQ ID NO: 1007433 - protein, 34 aa, Homo sapiens
EKRRPAISLSSWWLSLEEHPPLLLFLIAFAAFSG

SEQ ID NO: 1007434 - protein, 112 aa, Homo sapiens
SRDPPKHTAHYFHLTKLKLYTHETTTPYSFLLPVPGNHHLLSASVSVTTPVVKSENNLSCDWLISLSVVSSRFIHVVACPSFLKLNNRPLYAYTTLCLSICLWKDTWVAFTF

SEQ ID NO: 1007435 - protein, 106 aa, Homo sapiens
LLSLHPVPLHVRCIRPCAWRLCCELHQAEWASLDISQRKLYREVMLDTYRNLTSIGKKWKDQNIAYEHQNPRRNFRSLIEGNVTALQEDSHCGETFTQVPDDRLNF

SEQ ID NO: 1007436 - protein, 88 aa, Homo sapiens
MFCGRLNMHMKCTELGSGIQIHQGPNNCIDHTEGILKYMTTKSTLTQQITNVEKPHNHVNIQNWCTTEAARRVKTHPQFVIPYRCKVG

SEQ ID NO: 1007437 - protein, 109 aa, Homo sapiens
TGWADITTVPMQAGNSSFCHPLIIIVFLTDYMTGLRHNQLMNCPPHAPPLPIESCWYRYLRNAGCLLPLQLIQGLRDKLAISPEVQNLQIQVASTDGLYLAFSNSSEGS

SEQ ID NO: 1007438 - protein, 127 aa, Homo sapiens
QGLLNRSESSLSAFLVFSSIVLQAVGAQLVWELRSLLACARLRGNGFKTIIPKKQAKAMGPTPSSLQGYSQQSSLPYGVPSPSVTSQSRDTSGYGQSSYATNGQSQNTGYGLQSSPQGYGATCRASR

SEQ ID NO: 1007439 - protein, 79 aa, Homo sapiens
PLRVYVSRSSLPGGSPLLASPALGAPLCALNAVGLVGACRARRGLSGSSGPVGHVGDCRARRDLSGYVGTLAAYVGPGL

SEQ ID NO: 1007440 - protein, 110 aa, Homo sapiens
MIMVIRDMKETTLNSFGKDNGMPSQLLILTNLLVTCWVLLSELSEVNLNGSGNLRRITGGASPGKIVRIVVRGSNKVVELRKLRAPYMMPYVLCVVDEEEGLIEEVCSEM

SEQ ID NO: 1007441 - protein, 86 aa, Homo sapiens
MVYQGTVETVVHGAQLIDEHRALRNVRRASQTSPQDGIATLVRTQYTYIGSDFGYNFALILRPTVFQYMLAHIVPHIDVYICLCLV

SEQ ID NO: 1007442 - protein, 62 aa, Homo sapiens
KAVVAKSFLPIPLILPTKNLEMVADVIEDVPIYVSIEEGGSRCVVWFHGVVKMNVEAGALVA

SEQ ID NO: 1007443 - protein, 72 aa, Homo sapiens
LVRGMCGGYSSARDIFVLKGEYGRMIYPAIYQATQANSYFLIFPHPNIFNYDRDLLARAALQYDISIVWLRP

SEQ ID NO: 1007444 - protein, 30 aa, Homo sapiens
MCGVHGGGGGPLGRSQSILLRLPFRITRSR

SEQ ID NO: 1007445 - protein, 64 aa, Homo sapiens
MQDDTTCEYPDSCMVLFHEATRRLVVPRGVRAPGCITISIIIETKLEMSQSYRYSTTDGSGHGL

SEQ ID NO: 1007446 - protein, 77 aa, Homo sapiens
SRRVPEYPTSKMRGVSGNTTCEYPTLHGLYHKARTGYGYPSGVRAPAGITISIIIETKFEMIKLIDIARQTAQGMDY

SEQ ID NO: 1007447 - protein, 45 aa, Homo sapiens
MVAVIKEKGVEDVENTRDLFPNEVYRPMPPSSTQIHTLPYAVSKG

SEQ ID NO: 1007448 - protein, 77 aa, Homo sapiens
EICRIQPYHNVYQVEYDDSYRQERRILGGYLETYMNGALKELIYFYEGSPQILSLNYLVVMLRHVEQADGLSYVTSE

SEQ ID NO: 1007449 - protein, 112 aa, Homo sapiens
YSRSGICTVDPAGVEQSDGVGEENAQLMGAVACLSSLNPRIYVLSPEDNTQFKTGSTRPPPYLLLEACSQELCGPSPCLCMRSPLFSPAYSGLSPLSLSQTQGKREWRQGRA

SEQ ID NO: 1007450 - protein, 38 aa, Homo sapiens
WGLATLAQRSALASCSDCASAGSRPIKATQLVRGHGAA

SEQ ID NO: 1007451 - protein, 65 aa, Homo sapiens
VYLVRNDLKTIIVGIFCPMDHWDMVSYRRKGRKNKYKNTVTEDVATRTLQSWCCYNTLLINLSMV

SEQ ID NO: 1007452 - protein, 48 aa, Homo sapiens
DRRCAQWRAVSAHSLRLSHNSLRAPYTLAPEMLVVQRPEFPQSVGLVG

SEQ ID NO: 1007453 - protein, 88 aa, Homo sapiens
HMRSLSRVWVTLSECWYGAVKEIALEHKFNFLSKVIFTFLQKGYTHQQFGQESTPNKGDRVIYNLTRSPYCCIWFPLARTGPRFLYLS

SEQ ID NO: 1007454 - protein, 48 aa, Homo sapiens
VWIDGSFSDRCPGNNTQHPHPWRALPAIKRIARATTHFPTVKAPSSQI

SEQ ID NO: 1007455 - protein, 81 aa, Homo sapiens
IPPVGNSRVFFHFQQMLNIFSQPSTNIPGLNIMPFTHAQTVQQQRPVLQPLSTHSFTPALCPTTMPWPHPFPDTKVSKPQG

SEQ ID NO: 1007456 - protein, 44 aa, Homo sapiens
LDNLDDWSLRTPTNTTRSYCLLLLLHWNGLLIDVDPCRHCTRLA

SEQ ID NO: 1007457 - protein, 60 aa, Homo sapiens
DATQISPKHKGGLGGAKVYNFHPTMEIFKSFQVVYRIGTKITNSVDQILQVYGGIDKHGV

SEQ ID NO: 1007458 - protein, 88 aa, Homo sapiens
FWALAVLEYAHRDREIGGQKTVSFNLMEHKSFGKKKAGNGGMQPGIIDPYMRHFPKGVEKDRILVHRLSDKAWRDGALHMQGHRKGYR

SEQ ID NO: 1007459 - protein, 35 aa, Homo sapiens
QIQQARVQGQSGGPGPAGACIFQHQSSRGSTAARN

SEQ ID NO: 1007460 - protein, 38 aa, Homo sapiens
MGTRFVRIERLAVDARNPKTADVLRRVDQRVDPDLVAV

SEQ ID NO: 1007461 - protein, 70 aa, Homo sapiens
EVCNDVWFYENSFDFPDTLKAVQTPQTSSDYTRDHRFSFCSLSVLDDGTFASSSAQRLAAAHWRRILAPR

SEQ ID NO: 1007462 - protein, 101 aa, Homo sapiens
IDATIIAWRVGFHWQLGLLMGGSWIDTAVSSREQLGVTLILGGSYLIFTSTGKGVINVGLQLRIPRFHIIILGQVQTIGDRKLKSSGQDTKAGSLILSALP

SEQ ID NO: 1007463 - protein, 181 aa, Homo sapiens
VIDATAGVSRGIGYSLVMHTSAGAEGSGQARASPGSGREEFRSAPFIECQGRGTGNYYANAYSFGLATIERSEMSKKPTPSTWRAGELRTHVSRCQVGMRRTKGSRTQLRSQQGGYFFFFWLTATNPRNISGVPHWSNMKTVKCLIGIGVINTPGFMDLYWRKEKKTAKAFNRGIDKHRVP

SEQ ID NO: 1007464 - protein, 77 aa, Homo sapiens
MPLINMYSYSGPGFMSGLSESKQTHVHLRKVDAATLQIIITYAYTGNWARTASTVEQLYAHSWLPTRKNDVVYNRVD

SEQ ID NO: 1007465 - protein, 38 aa, Homo sapiens
MLDSRTIRQLLTGQFPFWGPRAGDSPLCSVQFFIMYRG

SEQ ID NO: 1007466 - protein, 134 aa, Homo sapiens
DATYYWIRLPLLGIYPEEKKSLYKKDTGKGRSIAAQLAMAKIWNGPHAHQSRSKENTVYVYQGILLSHKKISQRILDKATKTIGGGTHTLSKKGGGDNLQATCRRRKRDLPLSPYAKINSSNIQEPGGNGRLLF

SEQ ID NO: 1007467 - protein, 141 aa, Homo sapiens
GVIDATFLDNIKGRQGCLSTIEIGGVYLSYFENVHGFINKPQEEQFLKISTNSVVTGGWQLNVCNSNPGCVGGNGEDIYSSYHGSGPWGWSGKHGEVNIDEGFANPCIHGNGSDRVAAYHGGCEPGYTGVNGEVGSINRVP

SEQ ID NO: 1007468 - protein, 87 aa, Homo sapiens
IDATSHVQENTLLPLFLSSEDDQNVSLGCMAGSQFSHVLTEGFIAVSQQLSMDIFNRIISRHEAKLKHPGTAVLVSSNGFCNSWWDR

SEQ ID NO: 1007469 - protein, 47 aa, Homo sapiens
ATGLRKNPKFMETVAEKALQEYRKKHREEGDVDVALAPTVAWINTGY

SEQ ID NO: 1007470 - protein, 50 aa, Homo sapiens
DPGVIDATVGKSNIHISLLPVLLAVFLQRFLRHGLHKFRVLPGDRGIDKQ

SEQ ID NO: 1007471 - protein, 140 aa, Homo sapiens
TDSPVLSTATSDGVRITGLLTSTTTGDFSVAGRRCDTRRLDDVTTDRVTGQRRYDDGVDLTARLCKPTYYNDLLGFYLLDMTTRTATHDTVLTPDDRDQHLGPCYVDTTHTVTRQTTPLFTDRLLSRQLPDHDGDYVTLQ

SEQ ID NO: 1007472 - protein, 151 aa, Homo sapiens
GAGDLEDPGVIEATCGISKMDHITGSKTLLSKCKRSKIINSLSDHSTIKLELKTKTFTQNHTTTWKLNNRLLNDSGVNNKIKAEIKKLLESNENKETRYHNLGDTAKVVLRQKFIALNEHIRKLERFQVNHLTSQFKKLERLGGIDKHRVP

SEQ ID NO: 1007473 - protein, 84 aa, Homo sapiens
TGRICGQLFFDMSNGKQCCDDIMKIETTAPRKTTQALRKQGSLEHEMAIEPLDNIAAVTDILTQREGARLETPPPWLAMFTEQT

SEQ ID NO: 1007474 - protein, 38 aa, Homo sapiens
QLVPGPKLDSSYTNLFERYFGFSPRPSICRASRGRVGL

SEQ ID NO: 1007475 - protein, 61 aa, Homo sapiens
ISCNSFGFILLETLKVGLQTGRAGAEFTVLLLQCCSRVCRFSISMLFSLRYPTPLIDKVEP

SEQ ID NO: 1007476 - protein, 110 aa, Homo sapiens
MAFVKVSCGVTSQSGFPLIMQKGSPHFRTQGRQEDKQLDGIHVVCNHHQLSFLVLHHGVDGVNSCSKDRWSLRWDVPFASSLFSARGNSLCFFSCLVSGLYLWAKDKVEP

SEQ ID NO: 1007477 - protein, 50 aa, Homo sapiens
MCTCSGCAHQQRHLELDAHVGMSLRITAVIGGAIFKAARACHREVIGNVG

SEQ ID NO: 1007478 - protein, 100 aa, Homo sapiens
QRALLGNERETRLLRVPMWKEEDIRNSIMFCTNEKFFCLEMLVNRVTLIPNACAHMERTCVHFNGLTGYGCAGMCCGLTNVFGRQICYGQMSSPLLHVVK

SEQ ID NO: 1007479 - protein, 37 aa, Homo sapiens
RYVVLTGDVTSSGVSLESLPRTQWCSRAQCVSLLVSL

SEQ ID NO: 1007480 - protein, 32 aa, Homo sapiens
MTIRINSSHKPYLTHTSIYKLLLQLWKTQVVL

SEQ ID NO: 1007481 - protein, 41 aa, Homo sapiens
NWNYLFTTHDTTTTLLGQLHALLTTRLRHYRTWSLTGHVPI

SEQ ID NO: 1007482 - protein, 34 aa, Homo sapiens
YYRRLLQNLTHYFTTLTTLARDRTRVDLLTLIHY

SEQ ID NO: 1007483 - protein, 37 aa, Homo sapiens
SYHRNPGALYTLIILPRFTALFRYRSLVIDVAFYSWS

SEQ ID NO: 1007484 - protein, 68 aa, Homo sapiens
RNHSAGQAGLAVHYACINLVTPYEYKQAAEREALIIAMPIFLPRHQQHMVQLLPDSSYYSVLLQKQIL

SEQ ID NO: 1007485 - protein, 45 aa, Homo sapiens
VSGYALRLAGELTSGRDMVATALVALACGWFCVSPVPSPGYPGRP

SEQ ID NO: 1007486 - protein, 52 aa, Homo sapiens
YDRARYHLCQVCCVLPGSRVPADRDGGREKQNVKRIRHGAGISGNKTIIVEN

SEQ ID NO: 1007487 - protein, 38 aa, Homo sapiens
QRPHHRNRKHSIHKRLELYLVISSANLPDKRPNSTRNN

SEQ ID NO: 1007488 - protein, 166 aa, Homo sapiens
YSVTCPMQAGMLCGDIANCSWRGTGRAGLLGRTTPRHPAWFHLPPESPGEPLGRHLLLNALSCTHTSGLTRVPVAITEQGRGRRPWFCLCHGRGLKWRRSPCRWSTLVLSLVLTDATVRRLRPLEVTRADALAHPVSFFLTSRLTSTRPTDRRAVWCESNVMSAGN

SEQ ID NO: 1007489 - protein, 43 aa, Homo sapiens
MSLLIVVIYTGDTHLERGCLLVYSYYDATYDRQDQTYRPGRAE

SEQ ID NO: 1007490 - protein, 73 aa, Homo sapiens
SSATVSPRLFLLRWPSDTDLVCRLVSRAGGVPFTTLVSLYWYNSYCKAFEISCDLLIFPVFGAFAPSNLQVGE

SEQ ID NO: 1007491 - protein, 71 aa, Homo sapiens
ACSIQSSYSQQTAPQQLEQFQCILADNNFPVHQLLPFLVSLNNCLLSRHSSTRRAIILHKLTLPKLLSLLI

SEQ ID NO: 1007492 - protein, 50 aa, Homo sapiens
VLLVSNPVYPITVFGTCIWILSSASSLVYSSENVKSVIVFSCRTPLRLDS

SEQ ID NO: 1007493 - protein, 105 aa, Homo sapiens
MRLRQDQGTAPQTTVALARRLFCLIGFYDCGISLLLPRPELDTSWAPSESHPRLASVCSMGFIALGAYNALVPAGLCSLALAPCISLKMGGEVLPQLGQSPCPDP

SEQ ID NO: 1007494 - protein, 47 aa, Homo sapiens
RALGIGLWQGFYIDIVVMKLSGPKIEETPPGVSGGGYDFGYNGDFYR

SEQ ID NO: 1007495 - protein, 49 aa, Homo sapiens
MRFPSERTVCVHRPSRRRRSPSAFTTLLVEGVEISTPSPQRMGSLSPFQ

SEQ ID NO: 1007496 - protein, 42 aa, Homo sapiens
RLWRMSRVEALIAGTTLLVTLAAAAALYMGLLAGVLMSLSHL

SEQ ID NO: 1007497 - protein, 64 aa, Homo sapiens
AVQARSSSPGGAAMARPFAPSSVTFLSHYLISMKPNSERQGNSEVNLDRGAITKKVTTLMTKQL

SEQ ID NO: 1007498 - protein, 37 aa, Homo sapiens
HRWPPEYRSWGVHSYNLSYSGGGYTRITGPGEVEVAV

SEQ ID NO: 1007499 - protein, 48 aa, Homo sapiens
PQLRGAGMFGSHTSQHSTRFSGAGIGHVVVMHRVCARMCVPSAGTAGD

SEQ ID NO: 1007500 - protein, 105 aa, Homo sapiens
SARAYLFTFGLSRLILHPLMHWCGADQNITHLDCRMDLGGILAFCTRLACSPPHPPGSQGPGFQEAGMLAGRVGGPPSSLPRWDLQSWLSETGCLDQHLGFWISI

SEQ ID NO: 1007501 - protein, 95 aa, Homo sapiens
LVKGVDGKNLAGGNMFHFAEVQVEEAIILSAYNSEECWAGQSGQLNGSDFQVSVNAHKVLNFEHRYPHCNTCLSFSLSLSFSFFTILLEKPFWDA

SEQ ID NO: 1007502 - protein, 87 aa, Homo sapiens
VRVCEILIFIIHHWVPPRWPLGTYSKENLPCAQSTEEAILVWESFNNQVFNTLLEHKTCYMIRCSNKGIITHDRESLNGITNEERHC

SEQ ID NO: 1007503 - protein, 41 aa, Homo sapiens
MAEMVKTCVVLKIQKLAVHGDVTPVIPATREAEAREWLEPG

SEQ ID NO: 1007504 - protein, 59 aa, Homo sapiens
KGDGGWTGQQPLVWFERIAALVLQHALHHQLFEQQLSVHKKSTITTYFAPDYNGSYDST

SEQ ID NO: 1007505 - protein, 37 aa, Homo sapiens
MQLWAFPPSRKTGKYPVALPAAVDALRSALTSLRTSR

SEQ ID NO: 1007506 - protein, 94 aa, Homo sapiens
WMISAHRNLYLSGLSASPASASRVDGIPGMHQHTGLILVFGVQMGFQLAGQASLRPLTSSNPSSLTSQTVGIIGVSHRAQQWVTFRVPVGAQHW

SEQ ID NO: 1007507 - protein, 46 aa, Homo sapiens
AVTSLCGARVRTHRPWWPVDARNPPLVDVLRRVDPRVAPALVAVRL

SEQ ID NO: 1007508 - protein, 61 aa, Homo sapiens
DSGMIDCLGVRRAVVKNRYKNTVTADVASGRACRAVSLQNTLLQPSIGALPVALNHDFHVV

SEQ ID NO: 1007509 - protein, 126 aa, Homo sapiens
LNLGIGRSEYPDVTGAQPGVETRIASGTLTAKESVLPQLGLGFKLNANNELFASYAENIAAFVGGGSGGPLQVSPESFAASAGLEPEKSKSLEARFRTFGEQYQASIAAYNVKFDNRLLSLNPCSS

SEQ ID NO: 1007510 - protein, 50 aa, Homo sapiens
VPASWCGVTGVRAVAAFPMFSDISEQLKSFIFSNFVPAAGNVIQNYREQF

SEQ ID NO: 1007511 - protein, 159 aa, Homo sapiens
DRARYRQRLPYDAMTVVFPLVRKHGFENAEFRRHLLGQEVLLQLSPERAYGHAYAPDVDNPENPDDKAVNPASMEMRLAICCFKWAWPDTNQMGNKNRNKGFRFKRMKALSHRRSVATSVPSRSTAKGTSWLFSRSSIFSHYPQTRPGNSRQPSPLGNE

SEQ ID NO: 1007512 - protein, 155 aa, Homo sapiens
ELPPSATSADHRYDGARDTGGGRTAGTHPGGPGRLHPAKKGPQHTRSRRWVQAPHVTLQLPHDAQACHLPCTGRCCGKQSGVFTQWPWDSAPPYEGPLHSRVRWCRPWEQLAEHALQLDHSFHVPYTARAWHRAMLQKSVRFSGPSQGLPANWGG

SEQ ID NO: 1007513 - protein, 133 aa, Homo sapiens
ACEFSTASITCWFYMWVIYHRPVARKSRRGGGHRGSVPEGSEGQHTMPCCWRDMELALDVASRDVVQNLHSPIKVSTVLTPPHCRSLSVYLMGSQASVSSSIQWVYHQPHACGETIAHASAPLASGSNSVSHY

SEQ ID NO: 1007514 - protein, 51 aa, Homo sapiens
PTLLRVPKLTAVGADTGLVPTPLLSGGLGDVWYDPTTHSSGDRHVTRYLPT

SEQ ID NO: 1007515 - protein, 31 aa, Homo sapiens
MVVRAVVRLLGRLRRENGVTPGRLELSSEPE

SEQ ID NO: 1007516 - protein, 110 aa, Homo sapiens
MPFLSCHNILKRMSHFLNCHNTQAKGNWSPTTPTCMPNAIPIAFFFICTNVPYSLHGASLLGLTYLYPQLGARHAPSMLPITSSLSTYTTNPLRAENQAPTWTQRAHRWH

SEQ ID NO: 1007517 - protein, 39 aa, Homo sapiens
HLVTCAAVYALTPSMYKGKGTEDVVQFRAGKTNNDIKEI

SEQ ID NO: 1007518 - protein, 173 aa, Homo sapiens
GEERREDTARDDTRRRKSVSRLTRQNPNISPPRTNRQTRHWARKGSERAQWQAGYARTLGSTAPGAAQRVCAEAAAEVCMPYTQGQTRGWENADFTRLLGVPNPQKKSGSEGDVCTFGCRPGSPQTGKPEGRHPWPEPCPAGCQSTEALSWATKQQCQSQTDSLPPLSLLPRI

SEQ ID NO: 1007519 - protein, 40 aa, Homo sapiens
MRECYQSIFTSYFSECFWRSTHARRKFELDANGKNIFRFI

SEQ ID NO: 1007520 - protein, 53 aa, Homo sapiens
WSLATCYPSFQEALRSEVRAHGLESLREHGLRCAGSLRGGQSLPHKRCGRPVK

SEQ ID NO: 1007521 - protein, 39 aa, Homo sapiens
MTFLERYGLLWNDADDLLGHGGLLYDVDPDGLNAWTVAD

SEQ ID NO: 1007522 - protein, 68 aa, Homo sapiens
NSRASDLESPKRRESASIISMHSSTGQHQGQVQSGKSISRSPNLCPRQNKRKGPSKSLLQNYLANTSA

SEQ ID NO: 1007523 - protein, 58 aa, Homo sapiens
MITISISIINTDIFIITIITIINTIITITIIIIIISSSIVIIITIITIVMIITIIIII

SEQ ID NO: 1007524 - protein, 33 aa, Homo sapiens
MVLCIFILVTTLERIRPQNGHMTSEGAFLANVG

SEQ ID NO: 1007525 - protein, 101 aa, Homo sapiens
VGGTELDTLLNEQVEIALTDDRGDFAPRLFWDNGVTLNSIGRAKAAMGEGLHKAYTGERIRKEAVPMAGGKIEARWDTSDCLQYGQTRQGKTGSLRETDGS

SEQ ID NO: 1007526 - protein, 36 aa, Homo sapiens
TDDSSLLSFFRNHHCNTTLRQRYDADGGLLYDVDPD

SEQ ID NO: 1007527 - protein, 43 aa, Homo sapiens
MYPVLTTLYGRVHLGYRSVPRAMAVNEAPLGCEDGPKLAGECN

SEQ ID NO: 1007528 - protein, 45 aa, Homo sapiens
YVRCVGESCAVTLDRARIEAETLRVHGGFCPRHTVKVLHHDPELA

SEQ ID NO: 1007529 - protein, 33 aa, Homo sapiens
PARAPTPIVDLRQETASLCLSYLVEWAIGNSIC

SEQ ID NO: 1007530 - protein, 88 aa, Homo sapiens
NRIREDSLESPASMYTSLWRSATDAHVSTELVQGGMHRSGEYTSTRLHVYKIGSSARISYISRNLSRKLCTAVVNPRRRWRHACMLGS

SEQ ID NO: 1007531 - protein, 74 aa, Homo sapiens
VRLEVLAGSSIDRAGSIYNDIMECQHGTHVSTELVQGRHAPTVIEYTIDHGSSLNEYLEVSHECSDDRQETCPG

SEQ ID NO: 1007532 - protein, 61 aa, Homo sapiens
MTCELRLPSEHYRVRSASRREHYCAELRLPSWLYLCELRFPSRLFLFCSASRHCLTVSARW

SEQ ID NO: 1007533 - protein, 65 aa, Homo sapiens
MTEYNYITYTIKYIRAGHNSTKIPNAGRGAAAALMYVLCMNVCAAPSCVRRVFAVCCVDDVIRMR

SEQ ID NO: 1007534 - protein, 61 aa, Homo sapiens
MKYRAVHALAQLWGQFATRSQQPGMVAHSCNPSTLGGRERWMARAQEFQTHLDNIAKPCLY

SEQ ID NO: 1007535 - protein, 66 aa, Homo sapiens
PRYRIQNMRLPNLLGHETIKEVLEQAGAWIPRGHECSATRYTKKVPVLALRPRSASSDLGLRPIQP

SEQ ID NO: 1007536 - protein, 61 aa, Homo sapiens
TRTPVAAAQRGEVTTVTNNYYLTLYEGQRVIPPALLLLSRAFFASHCSDGCCYSSPTDEGK

SEQ ID NO: 1007537 - protein, 121 aa, Homo sapiens
MGADVISGMVLSCLGAWSGFRVRSGSVAGLDMRGDDSDEGQEAEYVDGPSRLHRGGTVQPVPDADAYQQGGLQQEGGEPEPRRPFQPDLQHGGQDDGGVAEDHPHGESEEERVDDGVIPTS

SEQ ID NO: 1007538 - protein, 39 aa, Homo sapiens
DSIQDYESVTMTASSTAKTSKRSRLDKYLSFTADLKSIW

SEQ ID NO: 1007539 - protein, 126 aa, Homo sapiens
MGSESKSFTTQLSEPVKERTRSEVWEATVFTRILYWSSPCVRFVSRDDQENRSYSCSSKEEVESIFHWKDLINSYNFLVKLTLTCRDSSNTRAQITMRRVVGGTVHIQNLPKDVRLTFIRMRPVKL

SEQ ID NO: 1007540 - protein, 67 aa, Homo sapiens
MNAIRAGTRFEFCYSESSTMPTTLTESHHLPTHPLEDFAFLTRLRRHGIPVGLFYRDVYWKFPLYGE

SEQ ID NO: 1007541 - protein, 56 aa, Homo sapiens
HGSPLTLPGLWFVCWLRGLSAERSGRGSEITWLGRRSIKRAEKAPVKGMGWVLLYD

SEQ ID NO: 1007542 - protein, 102 aa, Homo sapiens
SERVSLCAVERKNKESQWVVQILPLTDRPLQVRGIYMVKGACPGRTMAWDPVQCLASPLKSYYLPQCGGGGPLSKSVLSQLIIIKRPVILWVTILQGITRSR

SEQ ID NO: 1007543 - protein, 65 aa, Homo sapiens
GSTFAKVTDSDSSKKGQYLPKTRLDTLCKPHYQRLVKHLQMRAGSTYTGPFVGKCVCLSLLEEAH

SEQ ID NO: 1007544 - protein, 37 aa, Homo sapiens
QVQQSSQQQHGTRGTHHFIACGQQPSLSVLNSSIAAH

SEQ ID NO: 1007545 - protein, 73 aa, Homo sapiens
LRVDSYTILGGQHGAHVSTELVQEACTAVVNTRRPGSMFALLGGEHGAHVSKELVKKGMPGRGESTSSMEACI

SEQ ID NO: 1007546 - protein, 48 aa, Homo sapiens
MADSPVVTSHSYMQEPGKGSRAQVILIIAHVAYVLITILRVGNSKLRK

SEQ ID NO: 1007547 - protein, 83 aa, Homo sapiens
TLADVYPLNQEPQGKGKDSKEHVSPRLQKEESVNGCGVTTCTTSGFCVAACFGDFHGSWVASVHHGTFKRPTMCTSAKQVSGS

SEQ ID NO: 1007548 - protein, 52 aa, Homo sapiens
IELGTSRTCILGTSSCSKSDDMCMICFTEGASRKHQPIQRDGSHIFHLTVLS

SEQ ID NO: 1007549 - protein, 78 aa, Homo sapiens
ACCCWSSLRFPREPPGLQLHAAVQALAPACRDMFATRSQQPGMVAHTLSSQALWGGRAKVDGYEPSEFHDPWDYSQKP

SEQ ID NO: 1007550 - protein, 37 aa, Homo sapiens
MKSHSVAQAVVQSTISAHGSLRLLQFSGLSLRSSGGY

SEQ ID NO: 1007551 - protein, 51 aa, Homo sapiens
RIVGTSSGCVVGGQEVGGESVCSPESIESSVGMFWTCSVSPKAELVRLHAV

SEQ ID NO: 1007552 - protein, 108 aa, Homo sapiens
QDSVGWRAEPEIGEGEEPGDVTVKKSWQLREREACMTEAQVDEAVIMFDIERELLRAKLNREENRTITLKEEMESVKKIVKELEASHQHSSPDEQFKKPVTRVQRHSK

SEQ ID NO: 1007553 - protein, 78 aa, Homo sapiens
RKILWAPGICTAGGELAVARPGGAVNTQPSPTCPLSVQQHEGLYMAPSGLISCVRGHTLQSRTHAPSLAPFWGSSQKR

SEQ ID NO: 1007554 - protein, 59 aa, Homo sapiens
ARSPWREVNAKSAPRKCLWLVVFSGSELVPGTPSLSGVPHLYVRHMPEDHWGALKEAGG

SEQ ID NO: 1007555 - protein, 36 aa, Homo sapiens
EVPRAGSCGLTVGSPTPLRSCKLTEAEAHEMVILSQ

SEQ ID NO: 1007556 - protein, 39 aa, Homo sapiens
VHHVVLSSSVLLHAPCTSLSEIREILIESDACHGHAMLG

SEQ ID NO: 1007557 - protein, 65 aa, Homo sapiens
IELLRSGASVSQRCMMGVSAPADCSCCGKQGHRSIWNPVSHVPASCFMPGLWQPCEARDGEATYL

SEQ ID NO: 1007558 - protein, 84 aa, Homo sapiens
TPTSATAGNGLWPRGLLRKVRVTCCAFVPKLTSPGPPQCSSTPSHGSSTPSVGRLACGYLEVTALPCADSPHPCHAVALSGYSG

SEQ ID NO: 1007559 - protein, 84 aa, Homo sapiens
QAPRRSSRCMPGPPSPCRGRGQLRLLAFHPQQQCFFHSTLQVAIVGCTSPQAQAFRLHLLGWSGLRSGQAHVGEGHPLDVDPCT

SEQ ID NO: 1007560 - protein, 69 aa, Homo sapiens
AQDTYHYLPFRLTHRRPHWLTTKNSIERSLKALSSYEPLNFHAMFQAFLEMIHEASGYGGSMRVNLPAR

SEQ ID NO: 1007561 - protein, 35 aa, Homo sapiens
YRIELVPARSTRLKGHHRSGGNPDNVVTVPQCTHL

SEQ ID NO: 1007562 - protein, 144 aa, Homo sapiens
WDPNGNCLILVYILTDGMHELSIKFALILPTDLCKKNSKKNVSMSPPRVCTLIKTSVKRIIPHALMDCLGGLLGIIGEICLISCLSSEMNCDGGHSYVRNYLQKPTFALSELYPALINLWEAGKDKSTSLFVQATDIGLPTNMS

SEQ ID NO: 1007563 - protein, 34 aa, Homo sapiens
NELLQDRIFTREPQHTYHYLPFNLPHRRPHLFFP

SEQ ID NO: 1007564 - protein, 185 aa, Homo sapiens
CLLEVLWGDILPWEKGRMHNHKLENGQIALDYLRHRQVKLVNMRNDDIVDGDPKVTLGLIWTIILLFQISDIQVSGQSEDMTDRDKLLLRSQPMAEVYQGLPGDNFTHTWRDGRLFNAIITRDKPLIMDMNEVYRQINLENLDQAFSVADRDLRVTPVLDPEDGDVPQPDEKFMITYVWSLNDAM

SEQ ID NO: 1007565 - protein, 59 aa, Homo sapiens
MKSPRSRFLQAIKASQSNVSSRNALAVATPPRETAVINLYTINDKFNQNYTKPQGLVKF

SEQ ID NO: 1007566 - protein, 41 aa, Homo sapiens
PPHYCLLDRSDCGISLLTAGCLLNEIHIPRSLPGVDGTFHF

SEQ ID NO: 1007567 - protein, 33 aa, Homo sapiens
AAGTVYQSHHSLVADYNSSHCQSPDSNPRLSSE

SEQ ID NO: 1007568 - protein, 71 aa, Homo sapiens
TPSVGELTTTIYTSLPSSIPHQLHLNHTPPSRPHQLHLDITTSIYNLTEQHLNLINLNYTSPATPEPHSSI

SEQ ID NO: 1007569 - protein, 34 aa, Homo sapiens
MRTEEIAALVIDNGSGMCKAGFAGARLSLSPPLP

SEQ ID NO: 1007570 - protein, 33 aa, Homo sapiens
MRGEGSDVLQWLTAVKKQQVPESSAGWVRPRYD

SEQ ID NO: 1007571 - protein, 51 aa, Homo sapiens
MLTERKILGYIQLRKGPNVVSPYETTYNHFADAIKIYNKKPHKTEKSNNTL

SEQ ID NO: 1007572 - protein, 54 aa, Homo sapiens
MGGADLLGQSRYDGQDAGTSPRARAWITWGVAYLGSEAKLWVVGMVFPGELESR

SEQ ID NO: 1007573 - protein, 54 aa, Homo sapiens
MRCMEVVTLLKITLVPCGEEPMPSPHNGAGGGLVADPGPESPQSTFCSSSLSPL

SEQ ID NO: 1007574 - protein, 62 aa, Homo sapiens
THCVPSFTLCVSPHCLLMSPHHLLMSPPSSLVSPHRLLMSPHHLLMSPHSSLVSPHRLLMSP

SEQ ID NO: 1007575 - protein, 76 aa, Homo sapiens
KTAKGDAHEACPSFSYLVCYTCTTDRDSPVLASMPETLPNPTMPGSSALDAKERKCQDSSIWEQAKSRPLAFQSAA

SEQ ID NO: 1007576 - protein, 63 aa, Homo sapiens
LIRGTSVIFALRISYRPSVLQFHAAPLARWPFLWACAGSAAEVSWAIGLASGGPRLAVLCVLE

SEQ ID NO: 1007577 - protein, 65 aa, Homo sapiens
GPPITSLCDRVRAHLHKGLGEQIGMKTEVLVLNEMACSPPHRHVPTLSYNNKALAHQSNYTTTVH

SEQ ID NO: 1007578 - protein, 76 aa, Homo sapiens
PTEVPRVCCGVLPVMVGIRRFLDMCLSESRTSMLGRSRQSEPRVEGMCRIRACSNALMCLEIWSLRMGLYCASRAV

SEQ ID NO: 1007579 - protein, 58 aa, Homo sapiens
LVVAARSVVSSSQDVILEPSVNTRTHMVASRIKTHLRGEKERVMEDEALRVAGPLELG

SEQ ID NO: 1007580 - protein, 35 aa, Homo sapiens
YTSGRYMRWDFTKVGGPGTGTASRGSQDVVPAGLK

SEQ ID NO: 1007581 - protein, 72 aa, Homo sapiens
YKMSYYRFGQVYTEAKRPPGFDRVRNADIGNKDFELDVPEEAYTTEHWLGRIYTVKDLDNEACEGHICDVQL

SEQ ID NO: 1007582 - protein, 46 aa, Homo sapiens
MDKEDTGTGEDTNSNHSPDSSIHSLGIFTRSLNSNGFVNPQGFGWP

SEQ ID NO: 1007583 - protein, 108 aa, Homo sapiens
MCQEVSGGFDPGAELIFHRRMNVLSAGAYRGTCAYFIVNTSQSLFIVNTSHSVEPPSGITLRINAGFLLAAYLGRWAPILLKLWRALKPANHPLPAPKLSGYAPSPCS

SEQ ID NO: 1007584 - protein, 41 aa, Homo sapiens
TVYEVDPPTPLNAWDMICQRMLHAQNTSLYSSVTLYDLRRT

SEQ ID NO: 1007585 - protein, 53 aa, Homo sapiens
MRGWAIRYFVMLMFEISIIFSPALVLGPASAILAACHEVLFALCLVHEVHLDF

SEQ ID NO: 1007586 - protein, 116 aa, Homo sapiens
VRRCRPKHLRSVRDTYTLAMGQGGQEPDSISLTISATTWERVDSDMYIECIIRTQNRLKKMFQKSRQTIGHYHYTQWCCPSPLQTEHEKGKGTGPQCIREDRVSRLLYPNITRGKG

SEQ ID NO: 1007587 - protein, 40 aa, Homo sapiens
SVGPFSEVRLGRWGAVLYPQTSVDVCHSLLIFGAQLRDAV

SEQ ID NO: 1007588 - protein, 31 aa, Homo sapiens
MPAPSMHEAVHRDGQGLGPMGAYREPGISEL

SEQ ID NO: 1007589 - protein, 115 aa, Homo sapiens
YRHQTLDSSDDRTSLLAHVAPPAGEEAFENEMRHFSSLPLASFCASSSFSRAAPSAHLTEPSCSCFTPCSFLTSQLPHQPAVWSTETCPEWGLLINVCFTELSLEIPAATGEDHQ

SEQ ID NO: 1007590 - protein, 124 aa, Homo sapiens
TFLSLVQEAAGAADTAGEEKHGSEVCPPGIDLSPHTPAQGEYGRSQRNSKRLMMGIYGGRGDPLCLGRPACRPRPIPVALWSVILRGGPSVENTSTTSMAPGLALLTTGVSRQLVLRLVMTLST

SEQ ID NO: 1007591 - protein, 90 aa, Homo sapiens
FRDCFCFSLCLMCVYTLTECIRLADVIIILNWGFNREYYSIVNVQESHVAWFYAFTGGCYVARLNALVPPYSVYTIGSLTFGAPIDLMVR

SEQ ID NO: 1007592 - protein, 83 aa, Homo sapiens
AGGMRSDICVTKSMFLDKSDKEQWNLLAYKQTKAKGTESHEEGTSHNPHDKVRHKSTNKLNQNIQIQVSQASIDSRSLRVKLD

SEQ ID NO: 1007593 - protein, 107 aa, Homo sapiens
ETGGSRPAPFSTVTRCDRKAVIKKADRSEEMQQDSGECATQAREKYNIEKDMAAHIKKELDKKYNPTGHGIGGRNFGSDVTHETKHFIYFYRGQVAILRFKSGKGCG

SEQ ID NO: 1007594 - protein, 60 aa, Homo sapiens
DRTLYDGIDFYTSINPCPFDEWNADRFRGTRDPVEKALRAAKLDKSQIHDMVRVGGSPRL

SEQ ID NO: 1007595 - protein, 33 aa, Homo sapiens
MQSQANQTNALGISRGWDLSDAERYWTLRTTRT

SEQ ID NO: 1007596 - protein, 106 aa, Homo sapiens
DKRRTRSGLNGPGEALGKPQQPCERVGAGNINAEGPKLATGKTRSPTIIITEQAGVWSGQLPCTRIQPGSGKNYSGDLGARVARHELYKYINKYYDQIITARVRDA

SEQ ID NO: 1007597 - protein, 72 aa, Homo sapiens
MGRGVVQCRWYGAGSLSTLGEEHMIQCLADRGGAVSVTLGPLHPTPAQLVYDVNCYLPREWWELTGDSCVAK

SEQ ID NO: 1007598 - protein, 146 aa, Homo sapiens
TQKKNGGGSSLLSLTSGESVHSYVTAIFILMLRVCIGGDLEGWTIPLGPFKVEGRVWCTGLDPTVFYLGLLGCGSVVTVQGFLGLWFRSFYEGGNGFCNDVKTKVFGKPTIWHTAEPTALRSSRLNFSDDRLMDHSPRPMACGKMT

SEQ ID NO: 1007599 - protein, 125 aa, Homo sapiens
ESMLISGDYMAWAMCLGLGLIVLKFYLGGNDGGFWVIQWAMATEEYPRDLEGHVLLFGDAITIMGGGYDVGDYLLVRLRLDIVRTRRYVLRLVPHSGHLLWTTYEPARDFPGSNYGLYDVLTTDT

SEQ ID NO: 1007600 - protein, 60 aa, Homo sapiens
MGVGATEGPTLSTSLGELHTPFYNGENQGKRNASRVRLDELKPPGSPAEALNSGGLVLLS

SEQ ID NO: 1007601 - protein, 68 aa, Homo sapiens
LAGEVEAIRGDRPSKYGAPNLSMYLDPLCRPLFPWGLNKKVPLEAGAGVGVGASISCGFFSDDVIIRD

SEQ ID NO: 1007602 - protein, 114 aa, Homo sapiens
DLEDPDSILNQEVKILGGGGGWLMIPRLDQEVKILRRRLADPRIRPGGEDTGGEGWLMIPGLDQEVKILEEEAGCSQADQEVKTTGGGRWLLIPGIRPGGERYWLGTAVGYRVS

SEQ ID NO: 1007603 - protein, 54 aa, Homo sapiens
SGRFQRLGCSDSLFVGFVEVVDALAKAEDETYYRAVAHSLSNFFILVFIYVLVS

SEQ ID NO: 1007604 - protein, 74 aa, Homo sapiens
MQSGLLSSRSSVRWGQSHSRGFPRALQLLDQFWLALHLVMVFLPVPRAQAIPRVNKWLFRGPGTWSCCGASNRF

SEQ ID NO: 1007605 - protein, 176 aa, Homo sapiens
MTRAAWATAGWLCRHLPSLCALGQLDEHGPFLHCTSACRTWVHVGWFGIRRLHVITDGSYGQSVVLLGNYSVATACWRQVSWRVELAQAPRGKWLTAAVDWPDGEPGRPGADGAEQDWVQDDFHHVGFAAVQWGQLKAEGVEYVGAGYVRVRILLSKGARGNIHRMRLLMSPVLSC

SEQ ID NO: 1007606 - protein, 79 aa, Homo sapiens
EDSLGFHSYGSLPGADESGEGLKTELRHHHTSGLWGISQVPISGTRAMVVKPDSDLKGGLGVPYSPSAEGSTGLLSSIP

SEQ ID NO: 1007607 - protein, 43 aa, Homo sapiens
MCTGSVGEGMEEGAVSEAREAMAALEKDYAEVVIDSYEAVGEG

SEQ ID NO: 1007608 - protein, 55 aa, Homo sapiens
RGPEYWRAARSASTTVAWAPEPTVSGDAIAATTAAPRAAAGHSGLWAGLPRPPLA

SEQ ID NO: 1007609 - protein, 95 aa, Homo sapiens
YPSGLPGFVLQSRIGYGRSDVIGESLDRIQKSWNSSCPCYLQIHASYLIHIQKKTWFRPPEMRSEGYRNDRRPCMDMLSKVDSELDGWNGPRPCL

SEQ ID NO: 1007610 - protein, 58 aa, Homo sapiens
SVHWSVDLICFAVSCLDVTLLRLVDRGARTGFFVLVILLAFTLGLWSMMQPSTGLCSG

SEQ ID NO: 1007611 - protein, 62 aa, Homo sapiens
SVGPSVVRPAGSGAQMLRPAVYGRALVKAPLNSRYHQPFEDFRISQERLAETTFDMSMSLVP

SEQ ID NO: 1007612 - protein, 124 aa, Homo sapiens
PGSRRNIHIGNLDPEIDEKLLYDTFQTPYRVILQNPRIMRETDTGNSKGYAFINFASFDATDAAIADMNGQYLCNRPITVSYAFTQDSKGERHGSAAERLLAAQKPLSQADRPHQLFADSPPPP

SEQ ID NO: 1007613 - protein, 49 aa, Homo sapiens
SWVHAPSVTQRHELESGQTRDLTVNSLEGRSVLRSAPHDQHQWDGRTLG

SEQ ID NO: 1007614 - protein, 55 aa, Homo sapiens
LSPLMTPRDSQKNFVDPVTNKKVSYVAAEGTVQNRNNNWSALAFSTEEKHVLPRN

SEQ ID NO: 1007615 - protein, 42 aa, Homo sapiens
TCSSSSMAAAEDINLGNKAIAGEESQSKRQGKLQVTTDIVEL

SEQ ID NO: 1007616 - protein, 35 aa, Homo sapiens
LVCVMQEQFCFPMSSRVDVRVQDQSGERLGCSLGG

SEQ ID NO: 1007617 - protein, 69 aa, Homo sapiens
SEPLVSSTPGDLGRHGFVENDDSLVRRTYIFVETRRIFCDRHELGLERRWTLLGHDDTFLVVTDGTLLF

SEQ ID NO: 1007618 - protein, 36 aa, Homo sapiens
FQVKYGERVRLKFINESMMAHPMHLHGMFVQLENGQ

SEQ ID NO: 1007619 - protein, 108 aa, Homo sapiens
SCYSEKAVWIPRSPLLKSRLRATWVINVAQIGLLSTALWLGQAERMAWRRRYTRSRSRSAVRPCAASASQELPAALPSPAAMVLWPVHSTCPRQKPQLCSRSSTSHGT

SEQ ID NO: 1007620 - protein, 116 aa, Homo sapiens
SLSFSCLCCFGGLLGLAVHELGPGGLGVQDVEASSLVAVVVVRAGSGREGPCCCGNLGHGSGSCGVFSTHAQLVDSGGVDAVDPPLVEVDEENHIVPQAVDPVHNHLDDQGEQVVD

SEQ ID NO: 1007621 - protein, 102 aa, Homo sapiens
SRCVRYHVVGCRRLRSEYCWSGGRHGRLRHPLRFSEREELIYLNDFARVVISDHEAVNGILDFIDRVLLPPEALHWEPDDAPIPRRNVTAAAPGFGYQDLQR

SEQ ID NO: 1007622 - protein, 74 aa, Homo sapiens
MKSTFCCERWTETGTKDLGSLTVLSAAASSLLLVFVCLLGPYQQTRKGAGCRGHGKSEGGGLSVERRLCSLPPD

SEQ ID NO: 1007623 - protein, 53 aa, Homo sapiens
IEPLDARWDVLITRHLSDVRECTVHNVSRKVISWMCGTGLMQRYRPHTPSRRS

SEQ ID NO: 1007624 - protein, 73 aa, Homo sapiens
WMLSDVQASRNPSRRVQWFLPSIPALWEATGAYHLRSERSETSVVDTVKPHLYYQYKNYPSEWCAHVCNPNYS

SEQ ID NO: 1007625 - protein, 38 aa, Homo sapiens
MYARVRVRPGCVYAWGACTGGACEPGCVYTGVRAPRAV

SEQ ID NO: 1007626 - protein, 51 aa, Homo sapiens
MVLACGSRAGRGWAELGAWRLGPGYLVDVQSSLLGGCSSSWGALDSDAPVV

SEQ ID NO: 1007627 - protein, 122 aa, Homo sapiens
FHALPAVFTCTMGLVYCGLPPELPLSSVLAPTVRYEVDTVLRYRCRDGLVQRNLSLIRCQENGRWEDPQISCVPRRAVRALDPEEDPERRQGRLLGRWKGLLIPPSSPMPGPYGGKAFEDTT

SEQ ID NO: 1007628 - protein, 33 aa, Homo sapiens
CRDPQNISLPAYPARALAFHLEGRVQVQFDVDN

SEQ ID NO: 1007629 - protein, 34 aa, Homo sapiens
RGLLESNASLEYSTVLLECAHMTHSGRSPETSNM

SEQ ID NO: 1007630 - protein, 75 aa, Homo sapiens
RKDSVGFDYLEALPSFSSSPACESDTSPSLGELRHHIAWAHYPLAVPATLDTVLLQTDLLSQAHHLRLEIYSFES

SEQ ID NO: 1007631 - protein, 87 aa, Homo sapiens
KDSVGKPSVTPIAFITMKELYHWRETLCVHGMVARAFSLSQFLARTYIRLMLGEEPVSMEATVGEAFSIRQLSFMKHVENYILHSKP

SEQ ID NO: 1007632 - protein, 69 aa, Homo sapiens
EVPAKDSVGYEEAHAMNITQRGNVALTSEYMPPKRRRLIDPGYWLSSFLLSVVLQVFQNYSKLSAMAHA

SEQ ID NO: 1007633 - protein, 57 aa, Homo sapiens
AHCCRLERKSYLWPLIKGHSEVEEQCDQTGAPRTLLRKTVTQLIWAPWSRKYRVAVV

SEQ ID NO: 1007634 - protein, 52 aa, Homo sapiens
PPTVYRMPHLDPVLPLVPGRFVLVHHSLRDQPLRAEVPRLVHFFVVFPELRL

SEQ ID NO: 1007635 - protein, 77 aa, Homo sapiens
KDSVAPWVNGQKRNWKSPSLCKVGFYGMLDMSRITFTLDLIRDNSKTLLNQSLVPEFYVCTMFVAHAFLIPGILSDF

SEQ ID NO: 1007636 - protein, 77 aa, Homo sapiens
ERELETATCGELSPWRQHTEDVICGGASTELGAASWVPICVLLRDSGPVTLPLWACPAQMGKIIIEVTEDCDYMHLP

SEQ ID NO: 1007637 - protein, 54 aa, Homo sapiens
QRHHGGSVTPRRGSAWEPNSRPAIILRHCDASLARAGKRLRTRSADLGKTAWKV

SEQ ID NO: 1007638 - protein, 61 aa, Homo sapiens
MRTIEAHRDLSARLVSYYVERSTCQGYAAVELEEAHSEGATLAGTRHKECLRRDRLAEEDQ

SEQ ID NO: 1007639 - protein, 112 aa, Homo sapiens
RQASLSVRSLICKGAAQSFPSSNLFASYNVLPLKDPSVRRQCLWNVQCILAAHASLRFACLLLLFNVSLEGSGFFSCVSVFFSFDLSNFSISAISGLSDMVAEEKRSEAHEY

SEQ ID NO: 1007640 - protein, 56 aa, Homo sapiens
MIQSSLVPPDYARQSALVMRGTMLTFSCNGLHETHIQLAAAHALKGEMKYRQQCTR

SEQ ID NO: 1007641 - protein, 63 aa, Homo sapiens
DLWAVCVSCICMNIPERGQFRFHVWSGQRGILGPGFHWVFLTSRGVPKIELRDLRDARMLLKL

SEQ ID NO: 1007642 - protein, 73 aa, Homo sapiens
ALYPPYSPDSPRLARQHLSKPRAGGAGAGKPPKRKAFYRKLQNFLYNVLERPRGWAFIYQAYVFLLVFSCRAS

SEQ ID NO: 1007643 - protein, 60 aa, Homo sapiens
SLWARLHYGNLKRRGRRLAWAEHCFLLLLYGLAPPNSVPYPYLSSLKLSTYPQTSSPHLV

SEQ ID NO: 1007644 - protein, 59 aa, Homo sapiens
PTVQGLTLELAGSPGPRVIGCAVSCMALRHPARHLCRLWEVIKSERSIIWLNFCLSASR

SEQ ID NO: 1007645 - protein, 42 aa, Homo sapiens
MIDRACTPKPKDCSLPRLIEREWVQIPTSPDSEEDGGSDGYE

SEQ ID NO: 1007646 - protein, 71 aa, Homo sapiens
QGSVGQKWNTIPLRTSLCRESVLWTMMTAIMKSLNGYEATTVVSYGAGSIHEHGVICLHITRFFFNRRITY

SEQ ID NO: 1007647 - protein, 74 aa, Homo sapiens
MLGFVGRVALSGSGACGRLTLQCRCPSSALTAGRPTAVHPVRDYAGANISFAKMQAPATGSAFVACHLAHVVDV

SEQ ID NO: 1007648 - protein, 108 aa, Homo sapiens
RQIESSRTPRLARQVFFIRFSGHLKNPFNLETHVLLEFGVNFSVWFMDDASPTYSFSLWSTNYSNIEHTGFFFGIFLFFVFICFLGETPGGIFGVGAPKRKKGGPFQR

SEQ ID NO: 1007649 - protein, 156 aa, Homo sapiens
MEKLILGLFMLLRITMPGAYGKQMQGAGTQERVLIEILCTRTNQEIREIVRCYQSEFGRDLEKDIRSDTSGHFERLLVSMGQGNRDENQSINHQMAQEDAQRLYQAGEGRLGTDESCFNMILATRSFPQLRATMEAYSRMANRDLLRRVSREFPDM

SEQ ID NO: 1007650 - protein, 64 aa, Homo sapiens
MPEESNEDIDTFPKAGFNIKTWSTEDSSWTSGMWVAEVPAVLLAELILRSTDGLIGSWTCAGPD

SEQ ID NO: 1007651 - protein, 48 aa, Homo sapiens
PANMQSCRASSSNHAFQAAGISIAPGPAHWVTGSSHIRHIHGPFSWFP

SEQ ID NO: 1007652 - protein, 51 aa, Homo sapiens
VYQPGQQMELLIDVSYALIYHNPYLIVHIEKQSQIATHPTPRSSPMLVRDA

SEQ ID NO: 1007653 - protein, 71 aa, Homo sapiens
PELNSGRGVELTDKGGASLPWRILDTEAKRPCLGGQMKYLNAPNCCHRSLPSGSSMLHCPPTGLLATLLWS

SEQ ID NO: 1007654 - protein, 71 aa, Homo sapiens
LESSSNLRLLRSRLMEYTSAWDGFGSRIKNALAQFLAEGTPEIPLSPYRSDVVETIRLLIQAIARDVRRNR

SEQ ID NO: 1007655 - protein, 63 aa, Homo sapiens
RLARHGQGRHWSPYGSVGPRGNQQCTFHSAHPLCDHGAGQLLVPEVRYSQVMQTHHGHCRASR

SEQ ID NO: 1007656 - protein, 37 aa, Homo sapiens
IADRSWAQSFSYLGHLTLSPLVVSPKRVFVLSLFCLI

SEQ ID NO: 1007657 - protein, 133 aa, Homo sapiens
RLARQGVTPHLLLGGVAAGRRRSSLPRWGGSRVEGLLTSQMGRLPGGGSPHFSDGAAGQRRSSPPRRGRGRAEVLLTSQTGRRGRGAPQISDDGQPGRDAPHFLDGMAAGQRPSSLSRLCSQAEGLLTVGLVG

SEQ ID NO: 1007658 - protein, 37 aa, Homo sapiens
MAQAILVFRWSTKAPATDSFVKVTFSYLLGKLPRQPC

SEQ ID NO: 1007659 - protein, 60 aa, Homo sapiens
RIALVPPTSPTGGWRAGADPHASSRTGRLPGGGAPHFSAGVAAGRSRSSLPRQGGCRARR

SEQ ID NO: 1007660 - protein, 42 aa, Homo sapiens
RTLIEVVWAGGRRGRTGSIVTQETASFWVKHCCSEDASITFD

SEQ ID NO: 1007661 - protein, 66 aa, Homo sapiens
VPLARHLLSLFIVRAHLCRMHVLLSQALTQCCHMCLADLLSELHLVAELLLRLSSETVILLQRLLQ

SEQ ID NO: 1007662 - protein, 68 aa, Homo sapiens
LKALGKRVEVAGVGGVLTCSWSSIDHERSPTRKPHKAHIMGDPWDLAKRVPESPEKTKNGKGYHGNRN

SEQ ID NO: 1007663 - protein, 129 aa, Homo sapiens
ENDRELTLMLDGRQDHFIRAYSLIDQLFQDRFFNQEPHDTYQYLPFILTKQKAHYFFSKYRIIRSLMPFSPYEPLNCHAIVAAFLEMIHEAHQGLDMHYHSADFQQTPTEFMREGDHYRTVLREMRHKS

SEQ ID NO: 1007664 - protein, 112 aa, Homo sapiens
VLYRIYSYSGGSPLGVAQISGLGGCEERSSLFFFSSSFFLDGVFLWPTLKCNGVVLAHCNFCLPGSSDPPASASQGAGITGACHHARLIFGILSRDRVSPCWPGWSQTPDLR

SEQ ID NO: 1007665 - protein, 40 aa, Homo sapiens
MLSLYLGINMGVFITPGTLILRERRMSFACYLVVGLLSSW

SEQ ID NO: 1007666 - protein, 45 aa, Homo sapiens
EVAARSEPRSMPLTLQTWCDTAEILIFINHKKQNLQVTRYSNIGI

SEQ ID NO: 1007667 - protein, 99 aa, Homo sapiens
LVVYVGVDVGGKNESFDAGRAIAGERFCACDLWAVTHVAPFILIRWSQEGPIFLLFLPLRIGLEVTDRCPNDHLDFPQKVFLPLSFPFESILSFNLFFP

SEQ ID NO: 1007668 - protein, 76 aa, Homo sapiens
MSERYGVDVKSHGKAGRSLGGLQQGPVRGHAAGFSLIWVLQYKFKCKVSESGYACFALCVILGQQNIHIFHIAVGM

SEQ ID NO: 1007669 - protein, 113 aa, Homo sapiens
LAGYSQESRPARAHSETCLYKNTKNQSDVVVHALQSQLLRRLTWEDRLSSGDGGYSELRLCHCTPSWVTEREPVLQKDKKNANRLLRGMPCAHLTPGHTEELLPVCDSDLAFA

SEQ ID NO: 1007670 - protein, 156 aa, Homo sapiens
MHDAGICVEIVSRDGVWRCGQDGLHLLTSSSTGLGLPKRCDYRREPPRLAENPLYLISSTHCPAQLWTLYTTCPPGFTERKTFLLRIPATTHNCMTKCSKVLPKSANKIVSLLGIYSPFRAVRLDFYKNHFRTAISYFTSFSAPVIFRSDTDNTFA

SEQ ID NO: 1007671 - protein, 93 aa, Homo sapiens
HHLGQAHQLGTGGFRHAPVRSGSGMQAQASAEPPLHAGGYRASAEPPLHAGNQSQASVESPLHAGNQSQASAESPLHPGDPEHQRSPTALAIP

SEQ ID NO: 1007672 - protein, 47 aa, Homo sapiens
VQGPYLLQGQRGPAKRGQTESQMNGREPGMGSERLKLRSGSLTLPGL

SEQ ID NO: 1007673 - protein, 54 aa, Homo sapiens
DLKLIHYHLDLPKVLGLQVWATMPGDVDKSSLSIFTQPFTNVHTRGARPNSGSA

SEQ ID NO: 1007674 - protein, 47 aa, Homo sapiens
GSVNDGSVNDGSVNDGQMLNDGQMLNSTAVLNHGPVLNDGLVFNDGQ

SEQ ID NO: 1007675 - protein, 45 aa, Homo sapiens
MYCGTGRSQALGFGKTLELGLGKLGPDSPEGFCSGTHSLWAGSAL

SEQ ID NO: 1007676 - protein, 57 aa, Homo sapiens
SGRFDWHASQQMFLYDSHCKPDIMCMTLSVLYPGGPMDTSTGLDGTLILPCTPREVQ

SEQ ID NO: 1007677 - protein, 59 aa, Homo sapiens
MRRALIREQLTVELRKYSNCKDNDKYLNIIALRLHTGDKGRLKFMRQAPKYEQFAMAHS

SEQ ID NO: 1007678 - protein, 57 aa, Homo sapiens
QDWECVIRVDHTLRACVNQFTELESVSVGGGPPPRSDSSISSSAEIRISDSDSSWDA

SEQ ID NO: 1007679 - protein, 66 aa, Homo sapiens
TRETAIPAASFIIRTALYSDALYNQETHNDQIPVLYQPDSSSTPSSTTCSVTLLDRRGILVDVDLA

SEQ ID NO: 1007680 - protein, 61 aa, Homo sapiens
HDHVKEPLGYVCHYIIIVPLENSRTGQCMFYNLLGLMICLALLRASTVLEITGGYRSSNFS

SEQ ID NO: 1007681 - protein, 136 aa, Homo sapiens
MLSVSKLLQVARLPQKLAIIHCRGHQTPDNPIARNALADRVAKQMALQPVQGQFLSLSSFSPLYSPEEKEDCQAQNLQKQGPRYVKEVRFAVLTLKQSLSSKASTTLSMSGTNLSCNVSCLSSFVLVGYNEDTRSR

SEQ ID NO: 1007682 - protein, 76 aa, Homo sapiens
CNGANLIYCNLPVPGYKRYSCLILSEVACTYLRDTVIIPGHTVSYLNKDGVFTVVAQADLELLSSGQSTCLGLRKC

SEQ ID NO: 1007683 - protein, 173 aa, Homo sapiens
RSLIAILSYEPLKLHAMYQPFLEMIHEAQHAMDIHFHSPDFQHPTTEFIREGDDDRTVCREIRHNSTGCLRMKYQCDKCRELLYVDCSTNKPSQAKLRRELAESLQVAEEVEQEIQRDGKVLPVEDSSNTPPMMEQLNEQFNWVSPACKPQRKAKTRTSEGTNGGTTLLTRTS

SEQ ID NO: 1007684 - protein, 67 aa, Homo sapiens
MIRIEPVPPDYPDSFLYSRFFLDSGKELGIQKASRSLPVKKQKSMGWVYYDDRHVIGGSLCAVGLVG

SEQ ID NO: 1007685 - protein, 38 aa, Homo sapiens
PSRQEGAELSNTWMRLLPQSATMMFPLESDSYSCRASR

SEQ ID NO: 1007686 - protein, 60 aa, Homo sapiens
DFLKGMLQAEKLTPPQRKHWPTSSRALCRVPTTSHEELRCPATQDVCILQSLGAVHHAMM

SEQ ID NO: 1007687 - protein, 39 aa, Homo sapiens
CHLDGSPRCLRQVHVPSTAPLCLGLTHLLTDSAPMLLGP

SEQ ID NO: 1007688 - protein, 78 aa, Homo sapiens
SPTSDDRGGDGDGRRLTWLYCYLLRGSFLCPLGYPDDPTPTDTDTSARPRLVTRTLFTRTTLGTRRLDTSYTPWVLRV

SEQ ID NO: 1007689 - protein, 122 aa, Homo sapiens
NTNTLPELLPELEQLIILSSGSRSGHIHHHDSSGNRTPCCHTEIDTDRKCVDCAGPQMDDIWPVGGTDNLVTVWPSAPGEGGWVPLQTFTQHQRAVKAVAWCPLAVQCPGHRRSTSDRHIRI

SEQ ID NO: 1007690 - protein, 71 aa, Homo sapiens
SLLTFCIGFLSFGPVARVSRHEPGLVHLFSWEPGGPVPVSVHHDAPYAFLPLLYVEAMTQDLPSAPKTPSP

SEQ ID NO: 1007691 - protein, 37 aa, Homo sapiens
LSVNDGSIAVSGVSQDGEIADPDCNRTASRTLFPDCN

SEQ ID NO: 1007692 - protein, 70 aa, Homo sapiens
MDWMIADRTKIGQVMYACKCIEYQWSRILYNIISAPYDIIVLHTRRAFILSDSSLLFLHHMSNVAQQVSN

SEQ ID NO: 1007693 - protein, 35 aa, Homo sapiens
MRIRRRDFLIGKISHRPRFTHRPSIGPDLLIGQDL

SEQ ID NO: 1007694 - protein, 73 aa, Homo sapiens
LPRVYVWSCRPNMGSLESDLEVCAVWKLAVLYDTLETGEMAVAKVMQKDSEKNMSLKKLTGQYVDRLGVYSLQ

SEQ ID NO: 1007695 - protein, 91 aa, Homo sapiens
MSKLSGDQVRWGQGGRQPAVLGAFPELQDPRGVPSVPWLRSWAHWCPAVGAKIYSSAKIYSSSKINSSTKIYSSAKIQSSTKIDSSGKIES

SEQ ID NO: 1007696 - protein, 65 aa, Homo sapiens
DRYESSSLPDDVILALMSEIWRVSKSMGDDVNVGLVSKCRSLAAGSVIGQDLLIVNIYSSGQDLL

SEQ ID NO: 1007697 - protein, 34 aa, Homo sapiens
DQIWYSAVVLAVAGAAQVFTFGLVIAHERTQTEV

SEQ ID NO: 1007698 - protein, 38 aa, Homo sapiens
MPPILESWQASVSGTLCPCRCLPGDDRRSRGRSGGDPL

SEQ ID NO: 1007699 - protein, 39 aa, Homo sapiens
YDRPTYLVLWLCDSHVTLRTHTRRWYALDWGLLYDVDPR

SEQ ID NO: 1007700 - protein, 64 aa, Homo sapiens
MSTGNREPGVAPVDYGLTQDEAVPRYPGQSVPLHRRKRPAGGRKARTSHIAFVLPPTWLSGESG

SEQ ID NO: 1007701 - protein, 78 aa, Homo sapiens
DSTLGTLIGKLLDRTVSLVVQGFIEHLLSSGSFLGYQQQRRDQNATLEVRTGHDDVFICRLLGCIGEVSQRGNNQMGI

SEQ ID NO: 1007702 - protein, 97 aa, Homo sapiens
RLAGTKVVDCLRFYDRAGTVYTLPDGRLGLLGFNSYFYQHDSFSMRRPSKRVGRIGLCPIELSYTVYHATSGLVGDYGRFLAVRSPGCLRFLSGYSG

SEQ ID NO: 1007703 - protein, 40 aa, Homo sapiens
RLYSTAFGGLGDLVVTFSAPDAYLRFYDFCYNTVTGDSST

SEQ ID NO: 1007704 - protein, 99 aa, Homo sapiens
MIQSSSCTQCIDSGTGGSLESDQAPCKRVFGAPYEELTVSTELVQEGMHRSGEYTVDLAPCLRYWVVSTDLMYEGYLSREVVHGSGEYTSSWRHELNDR

SEQ ID NO: 1007705 - protein, 42 aa, Homo sapiens
EKEILLGISVTFPLEIQIAPLWARRALSQTLGEGVFVRLHCG

SEQ ID NO: 1007706 - protein, 66 aa, Homo sapiens
YLVFTMHGQALLKPVPQCAMWGLCPGEREQGVEVRVAGGRVTVPGPQKRKQLLRGVGHCGPAVGPN

SEQ ID NO: 1007707 - protein, 100 aa, Homo sapiens
KELHNGKGKQMRNWLRPGDQTPFRSPREKRRKSARGLSHKWPGSQAKESKISGLRDVGTTGEKDTCAFAEQCFLLGFLPTQNQNGAWLGLCTQLETVDKC

SEQ ID NO: 1007708 - protein, 53 aa, Homo sapiens
MFSKYNYLQVELAHGDFPYLSQLFAEAESRWIKGCSELGSSHCIPTWVTQYWA

SEQ ID NO: 1007709 - protein, 60 aa, Homo sapiens
ESDVPLRYRKSYVQDYILTQRNFLLLINSLGSKDVLYRVLRGHSCMLSCAQEPFMPTYTP

SEQ ID NO: 1007710 - protein, 34 aa, Homo sapiens
LTTPFSVDPVCRCVFPIHRGVRVCARVRFNKVST

SEQ ID NO: 1007711 - protein, 68 aa, Homo sapiens
MPAKRRKLRSDIQHDCRKTPYTVPSAYPMPSGAIAEILSSLLYGPISSGERFPPLPSQDIRNKSRIYL

SEQ ID NO: 1007712 - protein, 40 aa, Homo sapiens
LEDLPLYTHPENFPQRKAYDYDGHEKNYGIVDYLDRAVRA

SEQ ID NO: 1007713 - protein, 126 aa, Homo sapiens
AVSTTPPMAQTRRTRPGALYSRPQSCDHLLGAQTPRHSNFGRGKFSEFKAHTAPVRSVDFSADGQFLATASEDKSIKVWSIVYASAFLYSLYRHTHWVRCAKDLSLLSHISKGGELFASGGADTQV

SEQ ID NO: 1007714 - protein, 37 aa, Homo sapiens
CSGTSDQAASSWGSHEPPRWVQLILLQQLSELKKHKH

SEQ ID NO: 1007715 - protein, 33 aa, Homo sapiens
VENRDRRNVTNFSESYKWRQPLLPTIRGLMRVI

SEQ ID NO: 1007716 - protein, 32 aa, Homo sapiens
MRNVTDIFSTENVSSMKAGFAYTHCGIPSGRI

SEQ ID NO: 1007717 - protein, 69 aa, Homo sapiens
ASFAVPSPLPCGHIPTCRGFTELHAESLSASELTKCLKGKADKPTWVSLASAVGAVSLGHKLERKIEKG

SEQ ID NO: 1007718 - protein, 149 aa, Homo sapiens
VSRILWGLSPIILWQYACISVKATEQFCSRDHNVVEQQQMVKCDLSHVNTWLLLLYRDVPKDVNAAIIKKRTIQFVDWPTGFKVGINYQPPTVVPGGDLAKVQRAVCMLSNTTAIAEAWARLEHKFDLMYAKRGFVHWDVGEGMEEGEF

SEQ ID NO: 1007719 - protein, 60 aa, Homo sapiens
MTPGQQAAVGSLKMEAGRARWITPVIPALWEDQAGGSRGQEIESILGNTVKPRLYYKIRK

SEQ ID NO: 1007720 - protein, 30 aa, Homo sapiens
MKPDKEKGFRNVVLRFFCCLGRSSDSGAIG

SEQ ID NO: 1007721 - protein, 50 aa, Homo sapiens
MRNVTFIEDSGRCSLRAMSRACCLDTTTEPGLWPREGIVLRVFTKFGHFI

SEQ ID NO: 1007722 - protein, 158 aa, Homo sapiens
RSRFSDRSWRSNALPNGRHSQFCLGAAKEKYVFRDVVQITCLHGFEVVEGRVDAKSFYSTCQKQWKVEYFQIEMSPVDCGIPESIENGKVEDPESTELGSVIRYTCQEPYYYMENGGGGEYHCAGNGELGEEGAGAEACRNVYQSVESPENALKKNRG

SEQ ID NO: 1007723 - protein, 46 aa, Homo sapiens
MVIIGGGKISKKQKSMTSKLKAKRKINEDSVLYSSKECKSEKAPGY

SEQ ID NO: 1007724 - protein, 53 aa, Homo sapiens
FCGAFSKCWPSCSFTLIPLASVFFRKIQSNIISEDLCCILMGRMVHVQSFVCH

SEQ ID NO: 1007725 - protein, 149 aa, Homo sapiens
LRAFPEIKKSYSDNTEVQWIMRDYYEQLYAKKLNYLEEMDIFLHTYNLPRLNHEEIENLSKPIMSEEIESLIQSISPKKSPGTDGFTAEFYQTFKEELNQFSYKLSPEQNTNKQKNDRERILSNPLPGPGITPNTKRHTSHITSKRTTY

SEQ ID NO: 1007726 - protein, 56 aa, Homo sapiens
MRNDWDEERHRDEERHWYEERHWDEERHYSIYFVCFVLFSFPVLKDPQSLLLLLLT

SEQ ID NO: 1007727 - protein, 41 aa, Homo sapiens
SRAAYHWDEDVTGMWNVTGMRNVTGMRNVTGMRNVTGQAAP

SEQ ID NO: 1007728 - protein, 44 aa, Homo sapiens
MSKSLRFDTTLCWIRSPDSRPYVGFLLLAAVVDAAINVGYKHLF

SEQ ID NO: 1007729 - protein, 48 aa, Homo sapiens
MNSSYKNLHWKKGTIDQKITCCTMSFSRDLCKREKYDNNDVIFRGDSL

SEQ ID NO: 1007730 - protein, 35 aa, Homo sapiens
SRILWVLLIEQQRQLIHFVEFIASEFQFTSKHMRM

SEQ ID NO: 1007731 - protein, 34 aa, Homo sapiens
VSPLRACLLYSSSTREHVLTSKYRELEPGRLYQD

SEQ ID NO: 1007732 - protein, 84 aa, Homo sapiens
MQLSYTTQDETTHIRDKPYIGNACGKAFRVSSSLINRQLLHNTEKPYRCNESGKAFHRGSLLHFYQIVHTRGTPYHCDACGRIL

SEQ ID NO: 1007733 - protein, 68 aa, Homo sapiens
FPCVSHPNNVLPSSTTDAAEAGGPEHLHFYLSRTQMRSLGVELMLGGTDFQSIKRVLWSYPELSPVKA

SEQ ID NO: 1007734 - protein, 76 aa, Homo sapiens
GLTCLLQRPDSSALEAHICMKALSNFSHQTAGRNFANQTYRGLLIPSNFTERHSPRPVTMRFLHPSRRGRTLAKRI

SEQ ID NO: 1007735 - protein, 33 aa, Homo sapiens
PPGIPTPLSITDDLLLPADEVNMPHQWVEGNMP

SEQ ID NO: 1007736 - protein, 74 aa, Homo sapiens
MGAFRMCWLFELIFLNLHLLLIVHGRFLSPSFLCKEQSHQDGRSLTPLHPPLIYLFFQMESRSVIQAGVQCHDL

SEQ ID NO: 1007737 - protein, 37 aa, Homo sapiens
MTTRARYRLCLCSRLLLETGEWGWVLFFPQWLSTIFM

SEQ ID NO: 1007738 - protein, 46 aa, Homo sapiens
LASRSVRSLSSSSFLPSTAALLRVSVYCAAPSGTPLDVALTACPLG

SEQ ID NO: 1007739 - protein, 81 aa, Homo sapiens
PVLWDGGTGRYMGIGKRKGTATCPTCQTKVTWMTENEDFAPAAHADTCESEDSTRHTITALYPELVNGELCSTNTADFLME

SEQ ID NO: 1007740 - protein, 55 aa, Homo sapiens
RIPCEILAHLLCPLSEEALSGALGVHRHLSILVTDADKGHILEGDHPELEPCGVE

SEQ ID NO: 1007741 - protein, 43 aa, Homo sapiens
MPEKVTWMRRMRILRPAAADRESNEDRATYHNACTLNGDRGHV

SEQ ID NO: 1007742 - protein, 134 aa, Homo sapiens
MIRGERLIEWSHLSTLDLDHGFVELILIKKAGDGSKKIKGWWDSIHVVEVAEKSRGSTAHYKLTSTVMLWLQTDKSGSGTMNLGGSLTRQMEKDETVSDCSPHIANIGRLVEDMENKIRSTLNEIYFGKTKDIV

SEQ ID NO: 1007743 - protein, 60 aa, Homo sapiens
DPEGERTEEHDVTDRSGGAGTGTVTQSTWVRGAQQALACPLDRASEQAAALPTPVSHEVS

SEQ ID NO: 1007744 - protein, 37 aa, Homo sapiens
YWIDVLIDVLIAVLIERPGETSWMDVLDKTSWIDAYG

SEQ ID NO: 1007745 - protein, 54 aa, Homo sapiens
HQVQNDRSGVNITGIQISYLYTDFQGCFQSSRISDTKKNGGDLMMRNNAKFIIM

SEQ ID NO: 1007746 - protein, 40 aa, Homo sapiens
IVAVGYKTEQAPYSQTDARCGYGSYVYICVEAHTRAHAHK

SEQ ID NO: 1007747 - protein, 47 aa, Homo sapiens
MEWNQPEYNGMEWTWNWNSNWNWTYELELELELNPDVKLDLDEDLEL

SEQ ID NO: 1007748 - protein, 120 aa, Homo sapiens
DLEDPLEDDRRASGADSDCAFQSMVTGLSSVRVLLLAGVDFSLVWGHFQDQQDLYKSVSFTDQVVGARSLVCLLLSIQEPSDLNACWVEIRHVADKQVVVLQGALLGGGNIHPRVDSALQ

SEQ ID NO: 1007749 - protein, 48 aa, Homo sapiens
MLEDAEGQIFDLLAAQRITGSRCILPVMLSPRGPPVQSVVPEMEESGA

SEQ ID NO: 1007750 - protein, 90 aa, Homo sapiens
MKKNDGRECDRDNNTWYSSTKSCRAGCYCDVFYPCSISGKQVFFFFQLRSSTECVPITRIVYSIIDPSFCVGVPHHNYLWLLLQSLLSSS

SEQ ID NO: 1007751 - protein, 75 aa, Homo sapiens
EKRRRDENQYGQNRRESSKRLREPLDGDGHEKRRPYAKDMKASVEPAPPVSRDTFSYMGTSSLGFQILIQQSGKW

SEQ ID NO: 1007752 - protein, 58 aa, Homo sapiens
PPSSRSVLSLSLRSLTTTVLFFTTQPFWGLDFPHGHDWTTLDLPHLYGLYTLSPSDPT

SEQ ID NO: 1007753 - protein, 117 aa, Homo sapiens
MLERQEELIYEKASHHKDIGRVRTEFEWEDGRKAGTSMYLQNPNWLFVIRIRGITGVSPKVRKVLQLLRLRQIFNGTFVKLNKASINMLRIVEPYIAWGYPHLKSVNELIYKRGYGQ

SEQ ID NO: 1007754 - protein, 95 aa, Homo sapiens
RRGRSYRFLSNSLQKHKLPWSTVGSSSFAVVSLCPSHLFFSASLSTTVSQSHSEPTCHLLGCARVLDPQVVIVLTHKKPQCTTDTHNKKKEDTIK

SEQ ID NO: 1007755 - protein, 45 aa, Homo sapiens
RLSACIKHNHSSLIYANHLAYQRCISKFNSLPISSWDVGKRKQKT

SEQ ID NO: 1007756 - protein, 36 aa, Homo sapiens
LVVSEVPPEDWTSLCFGHGDLDYREVQSSGVPSSIF

SEQ ID NO: 1007757 - protein, 33 aa, Homo sapiens
AQRMTARDVSCRELSPQRAASAVGGTENGESGA

SEQ ID NO: 1007758 - protein, 47 aa, Homo sapiens
PWQPRLANASHHRRAAGVALGDDIIEGKLQGGDRLPAHRTLAWQLEI

SEQ ID NO: 1007759 - protein, 37 aa, Homo sapiens
CSCCCWSPLTIPPACPALDVLYSRVAQEYFYIPQCKA

SEQ ID NO: 1007760 - protein, 34 aa, Homo sapiens
EYLEIREDDVMSQLAVLSRGGSFRDEVGSLLCVF

SEQ ID NO: 1007761 - protein, 108 aa, Homo sapiens
RRRRRVHSLIDEGLYGGVRMGAGCTVTRDMGCGPGGKGWKLADACFWLLSHGRVVARTLAVAVPSETATVPFLLTSLSSVSWLVSLHLLGRYCQRLLAERADSLLSSS

SEQ ID NO: 1007762 - protein, 67 aa, Homo sapiens
ADQVSWFPGSTCSSQPSFRRGLGKDGGCRLSLAGSPKDSAGSLALCSSTAHPVSGGSPVLISTQTTP

SEQ ID NO: 1007763 - protein, 53 aa, Homo sapiens
MHKLYEMHSFDSPKDTVSFFVTLQILDAGKGSAGTVFTAPWPCYSTFGFQKYA

SEQ ID NO: 1007764 - protein, 45 aa, Homo sapiens
SADVTTLTSVTWAACCQCVSLTSGLACTEQPYYHRSPFVHRSPFV

SEQ ID NO: 1007765 - protein, 61 aa, Homo sapiens
EDPAEQLQGEELLARRCAMLEQGTESEAGQRLFFSAEWESQEEDNLGEERRESDEEEIASS

SEQ ID NO: 1007766 - protein, 51 aa, Homo sapiens
MARTGRAGVPSLSVAQLAALIGSTAQVPLQLGVSHAVGSPSSGMAPVVRGA

SEQ ID NO: 1007767 - protein, 44 aa, Homo sapiens
LEILRRETGEGCIFQTRRGGIYQKVTLLARHRQHERFHRGEKLD

SEQ ID NO: 1007768 - protein, 56 aa, Homo sapiens
MGAPSPGVCVCVEEARPLDHLLELVYRTSTKAPPMPRRTLDHAPFEEGLAPPSSSE

SEQ ID NO: 1007769 - protein, 117 aa, Homo sapiens
RGEVCVRNLRKRKEFGEVKISAEKEVCQKMVRKARRKLSIKKERNITRNIGRCTELEFGWARMARKAGNFYVPAEPKLAVIRIRGINGVSPKVRKVLQLLRLRQIFNGTFVKLNKAS

SEQ ID NO: 1007770 - protein, 37 aa, Homo sapiens
TGDAVDAKVTAPQEALEECYVTEIDQDKYAVRFIPRE

SEQ ID NO: 1007771 - protein, 68 aa, Homo sapiens
RALSAAGRSTTDSPTRVTAVGDLTRTFDTLTADTDVTVLACGTPGCPGLTGDRSCLTWCRPDPTVTVR

SEQ ID NO: 1007772 - protein, 41 aa, Homo sapiens
STGSSAGRRLLSLVCDAHPHGGLILVHFLAVFFVLFSQYHN

SEQ ID NO: 1007773 - protein, 55 aa, Homo sapiens
MTGGLRFFCDQVLAMMMQSEKNLCSMTSFGIRWVPHQSFVLVSVLKPASNAEDLT

SEQ ID NO: 1007774 - protein, 41 aa, Homo sapiens
TGDEYKGKLRCPCELHCCQSGTSCTSSNALWEVEVVHQLTP

SEQ ID NO: 1007775 - protein, 78 aa, Homo sapiens
GSSYNEYLEGSTVLTVSTELVQAGMHRSGEYTSTWLHVCDIEEVSTVLMYRRNLSRGGMHRSGEYTVELEACMRARVL

SEQ ID NO: 1007776 - protein, 87 aa, Homo sapiens
PLMIELSWYRVNLTVVLAGIYSSDRAPLNEYMEVSTGAHVSTELVQGGMHRTWRIHVDQAPSLRHWVVHHGAHVFTELVQGRHARQR

SEQ ID NO: 1007777 - protein, 149 aa, Homo sapiens
MDRLVIQTKKKKREENRIEAINDEKGDITTDPTEIQTTIREYYKHLYANKLENLEEMDKFLDTYSLPRLNQEEVESLNRPITGSEIGAIIKSLLTKNSPGPDGFTAKFYQRYKEELVPFLLKLFQSIEKEGIFPNSFYDGSILIPKPGR

SEQ ID NO: 1007778 - protein, 59 aa, Homo sapiens
MYIFTIVIIITLSINLCIIFTKNLSINLSIIISITLSIILTIILTKTLSIIISIIRTKT

SEQ ID NO: 1007779 - protein, 109 aa, Homo sapiens
MVGPEPDPPLETLSPEAARPGTTGNLVQSADDGVTSLIQILPLVLKLVLLGQGVGVQPRDDLLKLVQNLLLVRPLLILPLEPVISKALFMEKAEDSSAYLDDTLSRCTS

SEQ ID NO: 1007780 - protein, 36 aa, Homo sapiens
MSDTMATHQPSALPHGNHQCCKVRAPPAPGELGSSE

SEQ ID NO: 1007781 - protein, 33 aa, Homo sapiens
TPLDDWYHDSYALPSFPPPPVPVLTTVPWIRRH

SEQ ID NO: 1007782 - protein, 78 aa, Homo sapiens
LGGASARLWERLGGECTCCGGCLVVEVTARAVEASWVESVSALCCGGVLGGVGDCTCCGGPSWVESSARAVGGVLGGL

SEQ ID NO: 1007783 - protein, 61 aa, Homo sapiens
IDAVTGLSGSWPPTHSQPWMPCADGGVKMGLPMAPGESASGSSALPGVLPMMRAELRNSTQ

SEQ ID NO: 1007784 - protein, 60 aa, Homo sapiens
SPRESRESRATVRRIGDACLIQVIKNRKKASEPVGEGKVVGGGYNVQQYFTFWPSLARPI

SEQ ID NO: 1007785 - protein, 154 aa, Homo sapiens
RILGEGVSVGVVILCDEVSVKVVVMMVVTEVSGEGGGDDGGEKIVVKVMVMVVMTVSGEGHGDGDTTTWGYWWYWCLLYQYWWYSYWWWYYPYVVRVLVLVQYYYVGLASGAGGGAGACCAGAGCDDSELVRVMVMVMVMMMSGDDYGDGGGDG

SEQ ID NO: 1007786 - protein, 44 aa, Homo sapiens
LSRIPNRVLRLLHRKPFVRQNAAADLRPTRKFSTVNVTNETLPP

SEQ ID NO: 1007787 - protein, 127 aa, Homo sapiens
YVEEEEGVSAGEEEEEEEEDEEDLRRSAWLWNGPCGADEDFLLEHIRILKVLWCFLIHCAVQYPPCSPSALLFTDFGIAVFEIPHQESRGQQSQHILSSLRIVFWLPALADLTEFGFLIAGACVLVA

SEQ ID NO: 1007788 - protein, 97 aa, Homo sapiens
GLPTRHAVEFGMPEGETLVNYYSCSYWKGLVPREDCVYLLVNHLCFYSFLLGQDVSLDGAVGGHNASGAEGHPALPREHLCVHTLRTRSSSSPMFLQ

SEQ ID NO: 1007789 - protein, 159 aa, Homo sapiens
TRVMRLTPDFAFSPRDPKGGDLHMTQFFRGNLAGLTLRSGKLADKKVIDCLYTCKEGLDLQVLEDSGRGVQIQAHPSQLVLTLEGEDLGDLEKAMQHISYLNSRQFPTPGIRRLKNHQHNQAFNDGTCISVPPEMCAQPQFVHPEHRSFVDLSGHNLAN

SEQ ID NO: 1007790 - protein, 147 aa, Homo sapiens
LEDPERLSVLLQASANGNLQLELAQVLARRGQAARGPSAQRLLDSPALKACLDTAVENMPSLKMKVVEVGASWACKASAPDMLGTSLTSVAGDSTDTGRALGGWVGPASSLCGSVHVSCAVHKASVEGPAVGSKRRSLGRTPGTRAV

SEQ ID NO: 1007791 - protein, 28 aa, Homo sapiens
MRLVDPGLYDNRLYDSGSRTHPGVPDST

SEQ ID NO: 1007792 - protein, 179 aa, Homo sapiens
GVLEDPKGDALRRCNPSYSGRLRQEELLEPWEMEVQQSKMVPLHSSLGDKSKKSVLKTNKKTTCNPNVMSTQGPYKRHPYNNYWSSNGNHRVRLGDGVEAGSIGGGLATLQDIIRSLQVSQVRAAVILVRTNFDAFPDKGVAIQLKETHPSWNIPELMRILVSRERAGVGQGWDVTREA

SEQ ID NO: 1007793 - protein, 133 aa, Homo sapiens
KDCDDSGDGDDGGHGSLARIPKSRALTVLMLEFILQQSMPWSEEVHAQPAFTPRCVNVRVLCFGNTKWETSDSTGGIKRSGPSPRSLLKSKTLREASGSGSVREDTGMCEYVKPLSQVFFLPLLAPEGNRITR

SEQ ID NO: 1007794 - protein, 45 aa, Homo sapiens
SSLNNSVVKTLYSLIPGEPRNFITTLIEIKPPAITQYQTPLLSSS

SEQ ID NO: 1007795 - protein, 73 aa, Homo sapiens
ILEDPERVSVEEEETNRLPVWQDAEAAGDVYTCKSLPGMALQPDAELFTWSYLLNPHCPREHRVRPPEQPVHV

SEQ ID NO: 1007796 - protein, 78 aa, Homo sapiens
MLTFVAEEVGPGTYCCDKCDHSHSTLGSFTTKTRFEVPQLRAESTVSSSDSDTSEEIVASVPGNRLQNVPLALIFCDS

SEQ ID NO: 1007797 - protein, 49 aa, Homo sapiens
SSIKFFSVEQEGWCQQAVIERKKLDLTIVDTPLGELKLYSSDMFYSNHL

SEQ ID NO: 1007798 - protein, 125 aa, Homo sapiens
FDGRSRTTRTVYGRVLMGPTSEAEVGRGSDSGRWDRVCVVRWGSPGPPKTRTHSSPYVWRSAPNAMLDLRLAPEPVLNANTVCLTLTCAWACRQIEVCVRSPLNVVGSAIQCIQIAIHDNGNDQF

SEQ ID NO: 1007799 - protein, 155 aa, Homo sapiens
FVPSPIKGLMGLAYEAEKWFLHYFLDPDSRLGTLSDSFCNRMEDRFGYPVLNGLTMDQQRTVKESCRRRVPSILVHACDGLCDHEPVTAVMRVGGREAKTKSANDGDVWQRVGRASMNALVPDLANGSQIIYEISFGHANACVYQSQGTFLTVRE

SEQ ID NO: 1007800 - protein, 36 aa, Homo sapiens
VTLQDRHTGSADPPQARYRMKYLARVTVGPLRARVV

SEQ ID NO: 1007801 - protein, 49 aa, Homo sapiens
MLQQSKILQVIRKKHVKKCLELFVWAGRSQRSLTEKFYEAFSTTLKLGI

SEQ ID NO: 1007802 - protein, 43 aa, Homo sapiens
TIGLVKTTEGQSRRFGQKRKLTDIYFVWETQYLYFLFIHEPVL

SEQ ID NO: 1007803 - protein, 52 aa, Homo sapiens
RVMRLERYTRRYPQIKPRPMHLFCLLEIDIMEGWVCITLLMYVVRCCNRITR

SEQ ID NO: 1007804 - protein, 44 aa, Homo sapiens
MVQLCVIWWSARCSRDRRNLYRKACTAVVNTRRAGGMPACLGSC

SEQ ID NO: 1007805 - protein, 33 aa, Homo sapiens
YRKGLSWLWLVLVSVFHAPAALSVYLGHAAWQR

SEQ ID NO: 1007806 - protein, 47 aa, Homo sapiens
ENQYPESMLSKRRRYDRGVKAPQGALCSLGTHVLWEKRSRRKSDRRK

SEQ ID NO: 1007807 - protein, 34 aa, Homo sapiens
EGVWVEQLKLRAQVGDLEEALARGGANRQALDCD

SEQ ID NO: 1007808 - protein, 70 aa, Homo sapiens
HSVCPHAQRQQEAKKSIDEAYCSAEACMHKLPYRMVMQEQQDSLREANTDTLRISDALARPGKGKEKDSI

SEQ ID NO: 1007809 - protein, 62 aa, Homo sapiens
GSPLVDVVYDTFPDALGCSSTFSRSVGSSVFLPMLCRRSGVLGHPHHPFARVMQVAVAIMSH

SEQ ID NO: 1007810 - protein, 38 aa, Homo sapiens
VTRGYECRWLRSRFTVKLGLQGSRNTPDSGSRVAGTSS

SEQ ID NO: 1007811 - protein, 33 aa, Homo sapiens
RVVGPFHGYCIYFDRKREVTTSRTGFENEPLSL

SEQ ID NO: 1007812 - protein, 87 aa, Homo sapiens
DATVLSEDPLVERRDRGQAIITQVLNIWGLILGLFMSILSSSSQCWSPGPAIDQEASIEARSSARDLYPTYSIFHSSACPRRQELCP

SEQ ID NO: 1007813 - protein, 36 aa, Homo sapiens
RVRAKIRKTEGDNKKSTVMTKSSGKRKTAKEHLRET

SEQ ID NO: 1007814 - protein, 49 aa, Homo sapiens
DVNLTFFSDGLTNETTTTLLCVLLRRTDFCHSPHALDYLVTTHTFTLYN

SEQ ID NO: 1007815 - protein, 70 aa, Homo sapiens
VERVCVSINYKWITRQKYVKQTKELLQEPKIIQGIFLQVRSVNIQDFYRIMIAYSGNWMTALQEYSSAKR

SEQ ID NO: 1007816 - protein, 49 aa, Homo sapiens
SLFMATSASRVQAILSIASLAASVFFSYPVMVIGSGGWFPSSLSGNWMF

SEQ ID NO: 1007817 - protein, 98 aa, Homo sapiens
RCDLHTHDSLLVVCDDYSLYDNVLFFKRLAGAFTSHPQLLEGLGDVHIMEEMCALSFRQELDYWGIDEIYLASCCQGRLQQKKKQMNEELKREGENLQ

SEQ ID NO: 1007818 - protein, 80 aa, Homo sapiens
PRRSLRLILWPVWSLLSSPLLSSWYCCSSPFGPSLLFGFDAAYCLTVWMRASLLYLEPCFLLFVPGSPDQQKPHGDEHMK

SEQ ID NO: 1007819 - protein, 70 aa, Homo sapiens
RWKSVLSKSKSLRFSLNLFFTSRTSVSVPWFEGLRCEVAAALKCSPGPWSRVSAANGGPAENRRLWTRPK

SEQ ID NO: 1007820 - protein, 100 aa, Homo sapiens
MPGVACPSLTSSPDSSPTDHPSTCAGPAVHEDCWFPKSTDHSFVDKLCTEQGIHPRFQKPMQLKDKTAFSIIHYAGKVPATGPRGLCLRGPPVAAQRRDQ

SEQ ID NO: 1007821 - protein, 46 aa, Homo sapiens
PVRYCVHALHIKVPIQANPYAASRKVECTRCPGLGRRQAVLCAFAC

SEQ ID NO: 1007822 - protein, 64 aa, Homo sapiens
SCCLHSCPHLPVGTIFSDVVVRVPVGWRCVCLAPPSSIESSVDVLGTVAVSPKEQLVRITCVMS

SEQ ID NO: 1007823 - protein, 63 aa, Homo sapiens
CEEADGQEEVYKQLMLELETLPRDVSRLANTQRILEILCAKYWKQKEEITTDLVLIRTELQEM

SEQ ID NO: 1007824 - protein, 184 aa, Homo sapiens
SLPRCELPRRSSCWHTKRSLPHRASLPRGHHLRAIRELERLSGLGTHLVIAALHSTGASKRLERGHTQYKEVHLPRDDARSSRPAPQDKGKLADLGKRRREIHLMYWLLLGRMRDRTSAARRNFITTTDKVRNTSTVSSYAHKRGEPRGALLGTRTDTLRPQDSLPQRTLFLTTSVCHLLQYRD

SEQ ID NO: 1007825 - protein, 35 aa, Homo sapiens
ALRGRRPPGSVSRAPLLHEAPGLVEVLLTQPHHPG

SEQ ID NO: 1007826 - protein, 55 aa, Homo sapiens
RSCAALLLLFPLLSSLSRLASPSLPSTDVCAPDRVLAASTGLRAVVIDMTTSTDP

SEQ ID NO: 1007827 - protein, 58 aa, Homo sapiens
MLYVCVYPLGDGTLSDHFPRLHLLAYISDYISCFYHQYPNFHPILGRERHMLMTVICC

SEQ ID NO: 1007828 - protein, 88 aa, Homo sapiens
MTRHYDFYEHSNWVHCPCSGKYWPEPDQKPEPVDKVAAMRYVPGVSTLTCTSSSSYTEDGLYDSSAIKESSGSDPSGQPRPTAVTLIA

SEQ ID NO: 1007829 - protein, 50 aa, Homo sapiens
TGTFWNTDKDPVTKETSNKICRGSTNLAEVGNRLTEVEKIKTVVFNRITR

SEQ ID NO: 1007830 - protein, 136 aa, Homo sapiens
SLSWRRRTDLCVLHKKVSCSNYTPTHILHTLAANRTVWFIPVIHAKQNVLETMSYKSTILRQTDLDKVLTVIHIAYRFLNSDSKTVPLTIKVNASVPLENLGVAQSSPTHKTRLYFSNWPYSIVCMSVKAIDRWNH

SEQ ID NO: 1007831 - protein, 45 aa, Homo sapiens
SVERLLCSLVLGENVMERKKPGLVSIPGGCCAVLSAGVVHAHLCV

SEQ ID NO: 1007832 - protein, 53 aa, Homo sapiens
SNDPLLEKGLLKQADKELKKAQRQWELGLLLWGRGGEHPVDAPRRPYPLFPEP

SEQ ID NO: 1007833 - protein, 107 aa, Homo sapiens
MDVFSAIKHELLLSPSMKENDFAVTLTRDIFEELNDGSVPVYYDARPESVGSILFEEVCILMKLFLYGRLRLRIPKIQQLVQEFFNGKEPSRGINPDKAITYGAAVQ

SEQ ID NO: 1007834 - protein, 58 aa, Homo sapiens
LPTAMHQDWLCNLGCALLSLWAAESCPNVCMASGTAQLWSSACGRTHMVSLALGHQET

SEQ ID NO: 1007835 - protein, 56 aa, Homo sapiens
VGAAGPLRGHSAHRLNAPSPSHWRRDPFLGNRKLLVYCVTQSDVGSHGRCSVDVSL

SEQ ID NO: 1007836 - protein, 79 aa, Homo sapiens
AGRLYDGLPLGTVFSAVAFKWLFCACVCALCMKEKGHSGCGREAGAVVPSREVATSFLFLPIPSLTRQAALAPVYSQKT

SEQ ID NO: 1007837 - protein, 81 aa, Homo sapiens
VDQATAVRLPGREITVTGHGVLRGGGTMLTHDEHSLGSGFVDEMARCYLAEMVMGIDSVHRFVLRCDKRTSNADNILLEPL

SEQ ID NO: 1007838 - protein, 92 aa, Homo sapiens
GLRGKGRGLGWNATWASSALSIQFIQSYFVSDYDPMIEESYTNICRVDGVPARVEFLDTVGQEEFGGNEISVHAVLGTAILLVFVINDRQSF

SEQ ID NO: 1007839 - protein, 172 aa, Homo sapiens
LGGKRRIPCRHRVLVGVPLVATLVLINRGHNLQDVVVGGQGVGGESVCSPESIESSVDVLDLERVPKGELVDDMRHVWVLWLGCGTVCGHVEVAGDLVDAELPLEAAPIVQRDLQGVVDVARVAVGDVFLVGQRVLVGVPLVATLVLVERGHNLQDVVVGGQGVGGESVCSL

SEQ ID NO: 1007840 - protein, 143 aa, Homo sapiens
MQAGAGLQPEGHRGGGRPEGEVCLVHGGQAPAGSAGAEEQLMKQVPPPDAKDTVTPGEEELAQGQGRDLAEVALTTQSPSQPFFCLFWRRSLALSPKARVPWYHHSSPQSPSPRVEQSSCFGLLSSWDYRQHATRPRHIYIFG

SEQ ID NO: 1007841 - protein, 63 aa, Homo sapiens
CLRCMSQPFGLVLLTSGPSDAVLRGPAEKPDSWGSTRSRYAALHDSIFLVSTQRIPARDREYA

SEQ ID NO: 1007842 - protein, 44 aa, Homo sapiens
SANFGSLRGVPSVGRWSRGKRNCGKLSTYKDSITLGYQSPIQIP

SEQ ID NO: 1007843 - protein, 32 aa, Homo sapiens
YVESDVGGRESELSPTLPLCGGICLSRRQLRH

SEQ ID NO: 1007844 - protein, 37 aa, Homo sapiens
CAAALRGLSRTILMCGALIKEETHRRLDDLFLPLVMG

SEQ ID NO: 1007845 - protein, 61 aa, Homo sapiens
MSSQQKLIIVEGCQRQGAIVAVTGDGCESLSSFEESRLGVAMGIAGSDVSKPAADMILLDD

SEQ ID NO: 1007846 - protein, 82 aa, Homo sapiens
TGDAVEDYRWTKMEETRVRIQVATRLEVDAGEDYRWTNDGGRRRMSAGGRTTGRYDRGLTEYMVREDWSVDRGLTDYHGGRT

SEQ ID NO: 1007847 - protein, 67 aa, Homo sapiens
GQREKIGGLKSIYFLTAPPGVGGMSVACSLEEKELSAFGKDSFSPQPVNITLQVTRLIPKQCLAGFV

SEQ ID NO: 1007848 - protein, 92 aa, Homo sapiens
YPSGGQLDEQFYLQAAEAAQNRPAMMCPVGDESQVECSTWSETSQFSPSNLGATWNLGQTRHHPFDTGDAVGTSESDLSTRFVARRLPSWGH

SEQ ID NO: 1007849 - protein, 69 aa, Homo sapiens
EREKIGGLKSIFIYRSAGVGGMSVAWCLEEKSICLGRTLFSPHLKHHRSENRANSHTCRVVLDTLDTWV

SEQ ID NO: 1007850 - protein, 176 aa, Homo sapiens
MAGSVERSDCVARSLCLTAGTACRGPTVSPVQQTSSWRLALECSSGLFLLVCSAGPLAACFDVTGRRCYDELSGDLVRGLPELIVLVRKGRVTNGESEPLLATSGPWGEGTQAYTCFVCIHCHAQCITELPPGPPLLTPNAGCGLLIARDAASGADRLASPQCPRRSQRVRVDRIW

SEQ ID NO: 1007851 - protein, 33 aa, Homo sapiens
NAGKGSIRTLCPRMNGSLSQDDGAGGIGRKEEG

SEQ ID NO: 1007852 - protein, 120 aa, Homo sapiens
RWKRRGDEGMLVFLQEMDKPCGCPPGVCDHGTGDRRDPWYSTVGLLPPVRAMSQRNLNAKTEQGPTGVTMTSNPITWGQIKKTTQEAEKLLERQGQAKNPDSMFLAMLAVVVLCGMFPLL

SEQ ID NO: 1007853 - protein, 131 aa, Homo sapiens
MLMLLLLLLLLLLLLLSLVSRRLAQTDSCWAAEWNRPPAGSCCDGVVAAAVECTELVTGLAVGGISCDGMKLAIGTSVLGGPMKWKGVRQVSVLDWVHRWSLAAGSAYAGGKGGCHGDRPWDAGRGVVQPC

SEQ ID NO: 1007854 - protein, 82 aa, Homo sapiens
WVEDGNVIKSTILKAQESRALGIAGLLPKQQGMLCISALAKSVRPQRGLAGSREACIRSEAWAKPNRKCQITGLPLPNRITR

SEQ ID NO: 1007855 - protein, 97 aa, Homo sapiens
TRDAVDQNCKSYVEALTLPYLRQVTLLEIGPLQMYQLMRLNDVLMKRGDLEVTHTQGECHVKMMAEIRVTPLQAEEAKEASKLQKLGQSPEAASPSQ

SEQ ID NO: 1007856 - protein, 45 aa, Homo sapiens
QDPERVLRLRYAKTRALALQPGQQEENNLCHTHKKKNGTKEQTYL

SEQ ID NO: 1007857 - protein, 100 aa, Homo sapiens
RTGDAVGGPRPLDSLWLDWRGPVARGGSGVLIGTGPTCSSVHAGAGWYGPSFRFQDDFSGTSRQAGQCLGLISKPVMLLLSTAANLSLPDPGAPFPPGTS

SEQ ID NO: 1007858 - protein, 54 aa, Homo sapiens
ILIILTGRQGHEGGFPEAAGQWLITGDWTSGPQSSSSTKNTPEIGHGHFNRITR

SEQ ID NO: 1007859 - protein, 81 aa, Homo sapiens
ERVLLVAKYSESVTEASEKLEQAEKKATDAEADVASLNLPHSAGGGGAGPGPSERLATALQKLEEAEKVADESERGMKVIE

SEQ ID NO: 1007860 - protein, 33 aa, Homo sapiens
HAILQPELEAQAPTVWAATSGHTDYDPSSNDHR

SEQ ID NO: 1007861 - protein, 56 aa, Homo sapiens
RVTLVVGVPVPHSWQAVRLPSIQWHLVSLSVWVCGHHPWQWVYCAACHHVVFCCSP

SEQ ID NO: 1007862 - protein, 34 aa, Homo sapiens
YWIAPTKAARDAIKVYCDFSTGETCIRAQPASPV

SEQ ID NO: 1007863 - protein, 106 aa, Homo sapiens
MHEALCDHGIGWTEDFAPYGGTSNFAQNTMPYPGGQGEAERFMTPRVREELVRDQLLEKRSMGMQRPLGMAGSGWDRALEMERMMQAQRQMDTAMFPGEMAGGEGL

SEQ ID NO: 1007864 - protein, 37 aa, Homo sapiens
SRGSRMGDAVELWRRHHTAGRVLDELTLAGPTGDADR

SEQ ID NO: 1007865 - protein, 45 aa, Homo sapiens
MPSPLPPISTTTTAATKATTTTEVSSTTEVVIPTETTSTTTTKVS

SEQ ID NO: 1007866 - protein, 45 aa, Homo sapiens
LDYITLRLQVHPRNPLFRITMRYQMNFNREADYAHSLNCHSPPVR

SEQ ID NO: 1007867 - protein, 50 aa, Homo sapiens
GGKRQFRWRHEKACASPPGSHTVEFGGAGLAFLGQHRAPSVWGTVWTPMH

SEQ ID NO: 1007868 - protein, 77 aa, Homo sapiens
RLSLRLTHPRWTRYRPDSRPTDTTLGDGLDFLGLRTVLTYELRTVSPPHALAKNVHSHWNVCPGACTTLLLPLENAR

SEQ ID NO: 1007869 - protein, 39 aa, Homo sapiens
GKGEILESLQDGAESPRYAYSNGIDYNDHHHPAWTCRRC

SEQ ID NO: 1007870 - protein, 49 aa, Homo sapiens
RWKADVTDEGVLVNGDRLVDHAVCTSPSMDENYLYLAHGCITCGGDLAD

SEQ ID NO: 1007871 - protein, 57 aa, Homo sapiens
PEQNGDGIPSRTGCSHHTAVDFITDSGQGVKDRTWLEKRRDVGQCGVELLPCDDLQP

SEQ ID NO: 1007872 - protein, 93 aa, Homo sapiens
EPRCGPFPQQQQQQLIKKKSEIPESAVLKRMCFTPPKEKELMERLKKLSVPTSDEEDEVPAPKPRVGKKTKGGNVFAALIQDQSEEEEEEEKH

SEQ ID NO: 1007873 - protein, 63 aa, Homo sapiens
PGFNQEGLWRYLCILTILKPYGNRDFATFQILQRAFAVTPEPQPTFPIRLSLTSYAPSMGIVQ

SEQ ID NO: 1007874 - protein, 42 aa, Homo sapiens
LLVRGRRFCARFLRTDGETSDCCHMNAAKNVLVWHDETNIMC

SEQ ID NO: 1007875 - protein, 72 aa, Homo sapiens
MLWDGAAEAGCLKGSCLSGFFNSFNEATRVLVSGIMWYAPVAIRFLGAGKIVEMEDVGLLYSPPSHKHRRYR

SEQ ID NO: 1007876 - protein, 35 aa, Homo sapiens
LYMIAQEIESGYNYAASIILDLIASHPIRHPLHNR

SEQ ID NO: 1007877 - protein, 43 aa, Homo sapiens
MAFAAGQKTGLSPKGGTKMNMRNSPENEAQRKETRKRKMENHV

SEQ ID NO: 1007878 - protein, 122 aa, Homo sapiens
GKIGLSLLAGSSCLYSEPMLCSSDSNKGEYSSPECRLQSQIPRTGSQPAPSFLSWATVAIDFLSVPQLLHLCNDDCHSPCFKESLGGLTEKMQGRCLELNAPKKSIWPGTVSHARNPSTSGD

SEQ ID NO: 1007879 - protein, 38 aa, Homo sapiens
DLDDPYGCMHVWLGGELKPVPVAQENSASSSRGTRNQC

SEQ ID NO: 1007880 - protein, 53 aa, Homo sapiens
ERYMGEGTYWDEERTGDEERHWDEQNATGTEAKKGCITLALPKKKSVFNFSGP

SEQ ID NO: 1007881 - protein, 34 aa, Homo sapiens
MDCGNEEDRYSVMAKTTKHRTMPEQHWKKELTLP

SEQ ID NO: 1007882 - protein, 69 aa, Homo sapiens
ENTFFMDPPLERQVETIRKLVDSYVGLINKSIRDLMPKTIMHLMINNTKAFIHHELLVYLYSSADQSSL

SEQ ID NO: 1007883 - protein, 44 aa, Homo sapiens
SPEGGTMTYEDGKVSILNQTENENLCEKQPVSNHQYSQNGGSTD

SEQ ID NO: 1007884 - protein, 97 aa, Homo sapiens
MVCGPFIRMWIMHDSNHDDDRMLDAVMIDAMDELLNGLMNGPNRCMNEVTRMNEEWICRMNELDDGWGGIGRIESNEWLNAMNEWNGLNEEINEGLN

SEQ ID NO: 1007885 - protein, 79 aa, Homo sapiens
KYQLTSKHMEDEDSDSRGGEKRFGPFAAAPLLLLNRFQKLLDCDGEVLHRPAIEVRVHCQLVRLFARGIGENPKPDSHS

SEQ ID NO: 1007886 - protein, 118 aa, Homo sapiens
RWKGCADGMRHMEQRDESRGSNGGLVITMCNETMGEHRVHVGDTINLFTNTVCSHIRCADALGELPYFAEKNMHQQIIYTPYFSCLTNVCCASPFSSCSLLPAAPLLSRAHLFPSAHE

SEQ ID NO: 1007887 - protein, 83 aa, Homo sapiens
MHDNVPDVSVDDLSSQCSRFIYTMAPITLDQFTMFNSASLHVAFPRYDVAVPPYDVSLSTLDCRLSTLARRLSTRGYRDSTFD

SEQ ID NO: 1007888 - protein, 53 aa, Homo sapiens
GSLPFCSAVAVGGQVELQVVLPSLSSAGGEVLLGALLYMDTDLGRRVRTLLML

SEQ ID NO: 1007889 - protein, 43 aa, Homo sapiens
ERVMRLLPAPLPPTHIWLMNTVEGDLTDESLTLFFCTLCCSND

SEQ ID NO: 1007890 - protein, 40 aa, Homo sapiens
TGDAVGSTAVIWAPVDSPSQPGGGQEDGSDGFSKICLEST

SEQ ID NO: 1007891 - protein, 47 aa, Homo sapiens
CVELSARRLRGVGGPGCSAKGTPCMCSRADEALLLLPAVSRVGCAWR

SEQ ID NO: 1007892 - protein, 48 aa, Homo sapiens
ALRIPNGVMRGGESLYWWAILSRTLAPLHQLATTPPSPWTSPVAPCDL

SEQ ID NO: 1007893 - protein, 193 aa, Homo sapiens
RLMRLGMVQAVLGLSPGWTSADMVSMKLTQLSFHSSPPESPSSAGLQDALEMRAVVVATQTQLLVNFSLGQLKRGSCGVGGGAFLCGRRAWGQGHPTGTTSHSLPVLPFSDTSKCTGVPPGACTSSEHCPSLGQDGGLVQQHILKNITVHVLDAQAQVCGPSVFHTLMSVSHVVGNADAIGRRVWINSVVVRR

SEQ ID NO: 1007894 - protein, 39 aa, Homo sapiens
TGDAVEGTAGERDLDEVDMSDLSPEEQWREICHINRITR

SEQ ID NO: 1007895 - protein, 52 aa, Homo sapiens
MAMPVPVSKPTVGIDVAKNELVIYHADLDLLEAIPNTKAAIKKWLRALPGSV

SEQ ID NO: 1007896 - protein, 113 aa, Homo sapiens
VFLQDTHRDQSVPHAGIFADDVHRSWVRRIVQLIDDRSGREHIGEYPLVLMIFGIDRNFHPEILVNHLELGGTIPQFVFPYSYYPLDVVLSSGLTGFKSAVVMRRGGSNFQAT

SEQ ID NO: 1007897 - protein, 81 aa, Homo sapiens
PVKREDNPSSPQRQSKLSRIQGSNEGYGKERRPDLGGPGYSIEPDKVGFQGNLIPWNPESWFFSYAIPNPELLPKACLAAS

SEQ ID NO: 1007898 - protein, 59 aa, Homo sapiens
RERGKRGDIQLSRQLYTHKHTQKETLLGYTSVVSLLLLQYIAEVLTSHRSAQKLMRLGR

SEQ ID NO: 1007899 - protein, 120 aa, Homo sapiens
IFLQDTAGQVLLKGNCGGERDPTPWKVTYSTERSTKLEESPDAEKSVAVSWSSEKQSENSTDHLNYWHSHQKLRRLGGGVGTETLALEASPWERAEGVEQRLLGRFMNQSVKFDRADTAW

SEQ ID NO: 1007900 - protein, 55 aa, Homo sapiens
GLHLQHMEVPRLWVESELELLAYATATATRDLNRVYDLHPNSWRCRILNPLSEAR

SEQ ID NO: 1007901 - protein, 30 aa, Homo sapiens
MSIFPGEMSAIDEGVLMRMLKRRVVPLPEP

SEQ ID NO: 1007902 - protein, 43 aa, Homo sapiens
DTGEYFESGTRTLICWVALGIVSWGIWVQQGLSPPPPYSYLDP

SEQ ID NO: 1007903 - protein, 62 aa, Homo sapiens
MTADAKSEAFVTQDIIYTTGDETPSLGDLKLVLLGAGTKELERIPLSEDDREEINALSQSSG

SEQ ID NO: 1007904 - protein, 46 aa, Homo sapiens
MKRVYERFCRGLKEVERLIPERGWEYMWNERLGYIFDLSFGTLEQD

SEQ ID NO: 1007905 - protein, 35 aa, Homo sapiens
KIPSQMRRIECIIYHRDPSADWQADSPLLGARGLP

SEQ ID NO: 1007906 - protein, 71 aa, Homo sapiens
ASPIHGQRLSCSSGKAMSKISRECSTKVQPPGPRVMQSCQDVESPFLVLELAERMHDDPISALARQEALLL

SEQ ID NO: 1007907 - protein, 54 aa, Homo sapiens
AYYSQRFILSQRLYFLNALYFLNALYFLNALYFLNALYCPQRFILSSTASHFHF

SEQ ID NO: 1007908 - protein, 36 aa, Homo sapiens
MGTYYRVEESTKSVEDSTPRVDGVPTHELRNSLVTT

SEQ ID NO: 1007909 - protein, 74 aa, Homo sapiens
EDPNAIYFSSLYFLNAYTSQRLYFLTLYTSSTLYTSQRFILPPTPLYSLKRFILSQRLYTFSQRFIHSCARFAS

SEQ ID NO: 1007910 - protein, 50 aa, Homo sapiens
ALYLSTLYTSLYALYFLYFLNALYFLYALYFLYFLNASHFISRYEVYSVE

SEQ ID NO: 1007911 - protein, 74 aa, Homo sapiens
RFILPRLYFLNAYTSQRFILLNALYFLNALYFLNALYFLTRFIHSHTLYTLSSALYILKRFIHLVRRSPRTGYR

SEQ ID NO: 1007912 - protein, 62 aa, Homo sapiens
ATLYILNALYFLNVYYFLNALYFLNALYFLNVLYFLNASHFISRYEDKALREYKALCEVYSV

SEQ ID NO: 1007913 - protein, 45 aa, Homo sapiens
NALLSQRFILLNAYTSSRLIGSDVLIAFAGMKYKAVRALRKYKAL

SEQ ID NO: 1007914 - protein, 110 aa, Homo sapiens
VGSSPRHILHSWFSRGRPRQNGSVLGAQDHAVTVLPSAILEAPRCRFWAYAGARLCLSLQTWLCAYPLRVGACRVGPASRHGRSKEGEAGCVPQALLSPPSLENTLTTIN

SEQ ID NO: 1007915 - protein, 37 aa, Homo sapiens
PADVAGYSFGSFADRLPARDGRSELSTSIPSAQLVDD

SEQ ID NO: 1007916 - protein, 39 aa, Homo sapiens
MAQVTVFGNREHIVATGITCKIPRTLLLALKASAQSCRD

SEQ ID NO: 1007917 - protein, 49 aa, Homo sapiens
QVISRYRISTVVHHTSLSPAREHDKLCAFECRTIQRVNITVLLSIDFNV

SEQ ID NO: 1007918 - protein, 32 aa, Homo sapiens
LSDYALDGQDDFEPRVKGYSEGNNDFVVIVDI

SEQ ID NO: 1007919 - protein, 45 aa, Homo sapiens
KNQKRHLYSKDLRIGIFSSDFNPDFINTFTITIFLGATYEALSPE

SEQ ID NO: 1007920 - protein, 50 aa, Homo sapiens
SSSVPSRHVVQRVEMEESKSQSDQDAPDEDESPPPEDAPFVPPIHLDPRF

SEQ ID NO: 1007921 - protein, 42 aa, Homo sapiens
PAQLRRHGGDVAIYTEDSPGLKCRPCSSSGYESSVHRFCIYV

SEQ ID NO: 1007922 - protein, 43 aa, Homo sapiens
MVLSESLAGQRRFLVAATDTPGRAQQASMRALSGTSLNSELWW

SEQ ID NO: 1007923 - protein, 39 aa, Homo sapiens
IELGTRRTDGWRYTFKKYLANFGAVMNRALAMLLFLKFE

SEQ ID NO: 1007924 - protein, 61 aa, Homo sapiens
HQRSRSHHSWLLISEGRFGTRGAAASSVSQSPSPHEMGGTYGHEFSQSQIIAVKVVTTWTG

SEQ ID NO: 1007925 - protein, 61 aa, Homo sapiens
MDPYVTSRPDGSAPGRYQSPEYLRVVIISVPAPVVDIRRSIYSRAAGLAAGACAARQKVVP

SEQ ID NO: 1007926 - protein, 126 aa, Homo sapiens
VRGCFPHYSASETGYLTHRCEARGVKETDVVSPQFLCVAPGGSRGQQGKPEPRDAAVWAGTSSLELQQMNSVRCHGCCLVCYFVSNLVLHQDTLRITIPSAEDKAKLLDVCFDYACDAASGGPENV

SEQ ID NO: 1007927 - protein, 36 aa, Homo sapiens
MIRPLRASQKGWDYRREPPHPAIFLPFNMGPTPGLC

SEQ ID NO: 1007928 - protein, 46 aa, Homo sapiens
IGVECVCLAVSPPGSMHPGQMTERGCRSHGAGAPVIPLDLVGTQCW

SEQ ID NO: 1007929 - protein, 58 aa, Homo sapiens
RCALLTLCSAGCQPTCVPFSTLHPVICVCDDTTLVYSWSCLRLTPLLPDRRFHLPDPL

SEQ ID NO: 1007930 - protein, 41 aa, Homo sapiens
MARHRTIETNSSVNRGAIKYALVVSLLVESLCHDEATTSQC

SEQ ID NO: 1007931 - protein, 46 aa, Homo sapiens
EHGLKGNDITDEVLDGLNPSRQMWKELRTPVGGHRTKTSNKALTRC

SEQ ID NO: 1007932 - protein, 39 aa, Homo sapiens
ANRARYRYRLCPIRLGTEEQQLSLAKTFTLKPSTCIDIL

SEQ ID NO: 1007933 - protein, 61 aa, Homo sapiens
AKTAKAVWNTFSQMTLEPKETKLSQSCLPMCLAHQTTPYAKNMREAFDGYYKLVADYRKDH

SEQ ID NO: 1007934 - protein, 35 aa, Homo sapiens
MSRRNVVLLDDGTATLRIKRYNNLTARGVVKSVFL

SEQ ID NO: 1007935 - protein, 49 aa, Homo sapiens
SDRARVPQGWLNARSWLSVSDEGSFCIFSIPTTPLHSPTQYLYWVSSSH

SEQ ID NO: 1007936 - protein, 44 aa, Homo sapiens
DEEGGNWLWRKQRAIRKAGYQHVSGQLTSTKKPPKKANEKTESS

SEQ ID NO: 1007937 - protein, 75 aa, Homo sapiens
GKCADSPESIKAMGSMTVRTISSRSLFLNGTASPFRSRIRYTVRKSDLEAPLLVHYGSHRGVFLDDGAHVTVRTE

SEQ ID NO: 1007938 - protein, 34 aa, Homo sapiens
YVLVAETGYSVTVNNSTQSPGDRCYPLAVGHMGS

SEQ ID NO: 1007939 - protein, 40 aa, Homo sapiens
CSVLGCEHDRISAVRNLSRNLSLQNEIAKETLPDLVSIIP

SEQ ID NO: 1007940 - protein, 45 aa, Homo sapiens
VKAAWNPCRNKWRLTQGVVTLLPPVGRESIVENHFVLQRDTHTYI

SEQ ID NO: 1007941 - protein, 56 aa, Homo sapiens
GSLDVCLQACPLDRPSVYKCRDVGGVDWYSGNLLKYFLYVVHFEYFYNKKMLVAYK

SEQ ID NO: 1007942 - protein, 35 aa, Homo sapiens
MGTFSYARDGEYSDDSLGLGITEERQVTVNGHAAC

SEQ ID NO: 1007943 - protein, 54 aa, Homo sapiens
THASTARTNTAHTKHISHTKHATTPYTTHTRHTTQSTYQIHTYTHTTHHTHTPH

SEQ ID NO: 1007944 - protein, 51 aa, Homo sapiens
MAPSQAALLTPGSLCPGPVTHLCPSSSHFHPVFVHTSPHPFQPCAHTVSRI

SEQ ID NO: 1007945 - protein, 42 aa, Homo sapiens
HVVREQEQELLRQFSDLLHLAWSVLYSGLIRAAVLFYGARVE

SEQ ID NO: 1007946 - protein, 96 aa, Homo sapiens
ECRRTTEDEQAEKQIATRSAASLAILGKTVQVVSKMRKMWCQRVHCQMLALRMLVLGQKNDNKLTRQESCLGNFSSSLRRKVNPRSPDGCGLHSNN

SEQ ID NO: 1007947 - protein, 65 aa, Homo sapiens
FDARYRTLDHVVTVLPRVVACGWTGPTHDTLDGRNQHDFTLNALTCLGPGTPCRRSLYCPHLVDD

SEQ ID NO: 1007948 - protein, 53 aa, Homo sapiens
IRLELGTESRTGGAVTEGGVIQCARKEEHMAEVREDMYVYQKCSETKERPRRS

SEQ ID NO: 1007949 - protein, 40 aa, Homo sapiens
GISLLILLDSTFSLAELLAGCMEGDAEGWWLTGRHGTAYF

SEQ ID NO: 1007950 - protein, 56 aa, Homo sapiens
MHKSHFSSIIDFISQGAEGTCSYRAVPVFVWVKRRTQLSLEGTFTLKPSTLIRYVS

SEQ ID NO: 1007951 - protein, 88 aa, Homo sapiens
VLTLLESSDPPTYCGSLKGFKQACVVNALVGLGGRMGPDSPCLCTPPLSSSLNGGNLLCAVDESKDHMLSVWDLVAERPTVVAVRVEG

SEQ ID NO: 1007952 - protein, 30 aa, Homo sapiens
LCVGRGVCNNRKNCHCEAHWAPPFCDKGFG

SEQ ID NO: 1007953 - protein, 30 aa, Homo sapiens
MPTATLCSKVLGLQAVSTDLAYLLLRITFV

SEQ ID NO: 1007954 - protein, 61 aa, Homo sapiens
YCPATKLAITIMQHQLAVSHSGSTFSSCTQIKSFLQQQSAIHSPSTFQHMRPPQCGKQRHH

SEQ ID NO: 1007955 - protein, 52 aa, Homo sapiens
EIPEIDGFSASCFKTSASWDCVFLLQLLISSEFPPGKDFFLGGEKGEFWEQH

SEQ ID NO: 1007956 - protein, 48 aa, Homo sapiens
CAGSRKSLMAPKHISLTLASWVLGTVFLYVVIEYACIEMTKKSSDNTW

SEQ ID NO: 1007957 - protein, 46 aa, Homo sapiens
LQAEHCTGRESMFVGKYHLVLDFGFDIQFRTYPSFQTITGEAHACS

SEQ ID NO: 1007958 - protein, 70 aa, Homo sapiens
PLIDGFSHIDLVVTESVLSFTRKLISVAYHDSIMNPDYNVEFFRQFIGYELLQDKQSCPKPMLIRMCLAA

SEQ ID NO: 1007959 - protein, 78 aa, Homo sapiens
TGQHGTSSPTVPPCSMGHHHQSLTCQSQGICLSPCVGGPNPGLPMQAHVGHCAGRLSVSHSVQPSATTLVAAFGGYPL

SEQ ID NO: 1007960 - protein, 67 aa, Homo sapiens
HITSTIPPSTVTVHLCSHSLTKLAPFHEPSMLSLAGFRTVCMHSQFSNICSLDTIVRSLRGILSAVA

SEQ ID NO: 1007961 - protein, 61 aa, Homo sapiens
VGAENVLVVVAEVVLVVVAEVVRGGRGRDVLVVGAEVLLGVNVSHGFSIVEGQLSSFIIQV

SEQ ID NO: 1007962 - protein, 79 aa, Homo sapiens
CAWAWAGGCGPCLSCLAVPVLCPFPQLRFPLARTPCIAPVRSPRTPPLPPHPLPPPPPPLTAPPLLHTLSQHRGILSHR

SEQ ID NO: 1007963 - protein, 69 aa, Homo sapiens
HDSSQSFAVVYNWGHCRECHIRWSHKHVIFEIIFLPPAESLGMPLREFMQGNHQTSRLLSVSIVCPCYC

SEQ ID NO: 1007964 - protein, 49 aa, Homo sapiens
MARNARRIIREPECFAGYIPYSTHVTDHVIKTREGDYLQIWKIAGIAFE

SEQ ID NO: 1007965 - protein, 101 aa, Homo sapiens
SRIDGFSAVGIDPVCRILFFGFGVFFGCFFEVESHSVSQAECSGAISAHCKLRLPGSSDYPASASRVAGITGTRHHVRLILVFLVETVFHHVVQAGLELLT

SEQ ID NO: 1007966 - protein, 47 aa, Homo sapiens
WDSNGSRMVWDGENGMENGREWEGEWNGMQNGEWNGNGRTEWNGEWN

SEQ ID NO: 1007967 - protein, 43 aa, Homo sapiens
LDGFSSESATTPGYQLNMRKLSCPQRSTVSGSQGPSEEKPAPV

SEQ ID NO: 1007968 - protein, 67 aa, Homo sapiens
SDVGIMGRIFFIRINYENVILLVTLGGGGLSSIITAIGYAFGSIFSLLGPHFFRGITNNLQHSTVHF

SEQ ID NO: 1007969 - protein, 105 aa, Homo sapiens
ESTVSLGCSFLRSDTFPFRPFILKDVLLMVIVLLNEVLDGNEEVIGNRNKRYIYVMLSANSLGALCPGPRNLWKFELKSDDLGYQGIWAEEISAAKHSMWPLADR

SEQ ID NO: 1007970 - protein, 34 aa, Homo sapiens
MTVSQQKWTWQPGFNPSSAFELFELNLTQALLVS

SEQ ID NO: 1007971 - protein, 94 aa, Homo sapiens
MIPYFTQAYGHKAIELWTATDVSYTQAQTTAYGQDAMQLLMDSSHLYYSNWPPGITASLSRGMALVLNDTTTATVTNQSYSAQSGLLDSSLRKS

SEQ ID NO: 1007972 - protein, 70 aa, Homo sapiens
RNPLSLTSTRHPLLSEKKWRKYKLEKRYSVNDPPDVLDRQKCLVALVYLRHAKWFQARANGLKSCVIVIR

SEQ ID NO: 1007973 - protein, 53 aa, Homo sapiens
MALVHEYWVVLLTSDGGFDMGLGSHTWSPERGIFSYKQLLCKLSHIKLSAQEF

SEQ ID NO: 1007974 - protein, 50 aa, Homo sapiens
AYRIDGSLLSGQVSAPSDSCSVPMTGARGQALEVVRSRVADAAALSCSNF

SEQ ID NO: 1007975 - protein, 114 aa, Homo sapiens
QRIRYNKTPYDCNACTARYHRRHSFLITHQRIHAGEKLYECDECGTVFTWDASLIQHTKSHTGEKPYVCSECAKEYIGTSMLLVHQRTHTGENTYICKECGKGYTMKSTLSIHQ

SEQ ID NO: 1007976 - protein, 80 aa, Homo sapiens
GSLDSTVSLLLMKTHLRLALQPAAPNQDQDQASPLLRPTSRCKLLSVCLIVGDEEVVNQMVPDLTCRMNGKDGQRCYRIA

SEQ ID NO: 1007977 - protein, 118 aa, Homo sapiens
RDGGGGIGAPGTGVKHISYSERVESARLPAIFMQRSRARKAGIGKHVDDQDFSLFFGLILYFPNWDHKRDFSRLGGGWQELGLWHMLEAVLSSFKSALRTELHPRGWALFLVWSSDVL

SEQ ID NO: 1007978 - protein, 93 aa, Homo sapiens
MWHQGYSKPIPLLMSKKGRQHLGQLPADQGHLRTMQHSYPAFDGSSIVCASSSAWTHLALAANSGYDILKSLCNPRDIFLAIGIATQDVHMST

SEQ ID NO: 1007979 - protein, 60 aa, Homo sapiens
ARRWRSGLQIASRRKRCWPAPRCCGFRRFVRQRGQLRGVRQLLLFHARRRQELRSLAVAQ

SEQ ID NO: 1007980 - protein, 74 aa, Homo sapiens
HAATGGADFLDDIIPGHCSPPVIPVRRSLRPSEEVAVRLQKVVSAWQEAANGLAELNCSSSCRALEYQLQHDLE

SEQ ID NO: 1007981 - protein, 63 aa, Homo sapiens
TAELAWISELQKLRCRPYSEVVAWYGLPNVEMGSTLGKLQKKLEAYVDTSNGMEPYDDKSTWC

SEQ ID NO: 1007982 - protein, 63 aa, Homo sapiens
MRHDQRDGGDRIARRGEFLDWARRTERKYLQECLINQERKSEVRRRSDTVVVPTINDAAWLKV

SEQ ID NO: 1007983 - protein, 65 aa, Homo sapiens
MGLELLVTTRSKMSPLLTDSVGGQLCPKTGHAADGDIIAAGHGFGGRAIELYRVISLTVKRGGFV

SEQ ID NO: 1007984 - protein, 36 aa, Homo sapiens
YVLSRGTLTDLDYRLTHHSYPLSNDFFYHVLTLLLL

SEQ ID NO: 1007985 - protein, 35 aa, Homo sapiens
YAIDGFSAGKYHYSYSLGNITSGFTSCHCKSKTDS

SEQ ID NO: 1007986 - protein, 78 aa, Homo sapiens
NLGTHGYLSDTLKKLKITAVDKTEDSLEDAWMVCFKPVVQNNTETSEKVQASGIPSAVGKVCGLHSSCKAPKVANIQQ

SEQ ID NO: 1007987 - protein, 42 aa, Homo sapiens
MYDGTYYRAVTYVLLTSYYRTDDVTTCDSTDDTVSYLRHPTT

SEQ ID NO: 1007988 - protein, 86 aa, Homo sapiens
LELGTISKVCTGGICGRTLQSTMSSGYVDQCDGDSGQVLRGTNYKVVFPQDLLEKVLDRNNFAMLGLGDVVIPGIFIALVLRFDIS

SEQ ID NO: 1007989 - protein, 46 aa, Homo sapiens
MAVSNWIKLIILPVPKSICTSIVHLDDRIWVGDGSSIMSHQVRDSL

SEQ ID NO: 1007990 - protein, 35 aa, Homo sapiens
NSRNVVQTVTGGTSCHPTRGWTFFPVQAQPLPGNV

SEQ ID NO: 1007991 - protein, 45 aa, Homo sapiens
MRSSLVSHPRSNPNGPYYPLQAFLAQKVATQATAKDSYFPVLWAA

SEQ ID NO: 1007992 - protein, 72 aa, Homo sapiens
MWGQFSQFCNRAAQLTFSQHTTVHHINSCPVSQAGTFHGMLVTCMRVRRSGNASIFIQHSRHSATHSQHSTL

SEQ ID NO: 1007993 - protein, 85 aa, Homo sapiens
HSQPVQRLRELERYVLAGLRKKPRKPYTIKKPVGETKEELAWEKEAGLRKAGTRCQRHSSMLLKSPPKKANEKTRVILCTTCSQI

SEQ ID NO: 1007994 - protein, 38 aa, Homo sapiens
MSGNDTAESGECEQGERPAEEAEVASGSKDGMSALTFR

SEQ ID NO: 1007995 - protein, 70 aa, Homo sapiens
AALSELLCAVATFAKILCSNPNTGAVLYELPSNTQWVLRYSVVSPEILLVLSAASYCMGVSSVYYSSMGR

SEQ ID NO: 1007996 - protein, 121 aa, Homo sapiens
HSSSCAHLSSLQEALQVVRVSGEEGCAHCLVLYWHKLCRVSLAYASSGPQSPVTWWACPSEGWLADWMSMELGEVVDRRDGDLLDLGRAASPSVKWVNCCCTCRTSVLCNLLSIGGKCLDL

SEQ ID NO: 1007997 - protein, 108 aa, Homo sapiens
RLYVLEGDAEISVHTVLTRTLRRITLDEYRNVVEELLTGNPHIEKESDRSIADGANDEEAASVCMGQMEPDQVEEGITFEDFLKIWQVIDIETKMHDRLLTIGNHGPL

SEQ ID NO: 1007998 - protein, 57 aa, Homo sapiens
SPTELISHGVSPTRRMPHYYLNFPKPKEEKCNACCTYRGHYQYNRLLLSRFFGNFKY

SEQ ID NO: 1007999 - protein, 64 aa, Homo sapiens
MSRGILSHISMNTYIFSQGRVSTKTKCIQKTKHYDQLEEPPGKKKTDSQNQTPITIIHSIQIKQ

SEQ ID NO: 1008000 - protein, 57 aa, Homo sapiens
YAIHRPQSEITDFMSFSGDSINLDNCSSSAVPGRLLGSASVPGVKQFKVNKAKCGGI

SEQ ID NO: 1008001 - protein, 66 aa, Homo sapiens
MRIPYTNAKVTASLPEPVEDHEPRAKNEQLQTHHLKSRNHSPRRSGSCTAMNQRRPQDPPGRTETS

SEQ ID NO: 1008002 - protein, 33 aa, Homo sapiens
MTGSPPTKRQRGGTSGAGPSWAVPQNGRREKGA

SEQ ID NO: 1008003 - protein, 62 aa, Homo sapiens
RKTHTRTHTHTQTFKTLINIGPLAGVHVVLDLTAGLTIHSSLLFHTFQLAIHSNHIQAWVVI

SEQ ID NO: 1008004 - protein, 60 aa, Homo sapiens
VSLQAGADISHDRPVRCWLSILLIRLLQKVHCDHQHITMHEPVTLGSPSSQGGIQWVAHQ

SEQ ID NO: 1008005 - protein, 76 aa, Homo sapiens
MTRLPYFFSYCRAERADENFYSSNFYLHKPLSYNISGDFCKRQSTDSKLNCYAISPDWLGLLFPSLLLLTTSLLLA

SEQ ID NO: 1008006 - protein, 44 aa, Homo sapiens
EQAVNQSISLSLSAASGSLTHQDSRVACQLIMALAFASWHLFPA

SEQ ID NO: 1008007 - protein, 66 aa, Homo sapiens
EDPALVSHLVLFLQGTMRTLFFSVLRFSQQKEVASGTPHATLIPNRQQLGQAFDCHLSERDHSTPS

SEQ ID NO: 1008008 - protein, 96 aa, Homo sapiens
DLEDRPWYPTHFNPNQLDNPGHALTELRALTQPEGLRLIALSSTNCPSIFRISLASLTDTLDPCRRYLTHCASPGRDGPTAMPGRARYAPTANAIS

SEQ ID NO: 1008009 - protein, 33 aa, Homo sapiens
MKLKPREEFAFAKITERSKAELGLTSMYLPALS

SEQ ID NO: 1008010 - protein, 62 aa, Homo sapiens
SKDRYTHDEPWEAKDVADTCLCGVNLYQFYGPSGQYTHEFDGDEEFYVDLETEGDCLAGGLE

SEQ ID NO: 1008011 - protein, 72 aa, Homo sapiens
YTFLEEEKVADSASSGAQGGTVVSVSPGISFSPFFTMGYTTILIIKFLWVLETKRIPAPPLDSSPKELRAGT

SEQ ID NO: 1008012 - protein, 35 aa, Homo sapiens
YHLETIIDFHKDQATGCIEVRGEVVCARSKGTGWY

SEQ ID NO: 1008013 - protein, 45 aa, Homo sapiens
MVHRQGGEQMTSLVTLYMVVSAADTNIDFQKHPISDMTLTAHDGD

SEQ ID NO: 1008014 - protein, 34 aa, Homo sapiens
MGKSLELSEFNDQTVATLATILCGIVVVYGWYSG

SEQ ID NO: 1008015 - protein, 42 aa, Homo sapiens
CTIHNLEGDVFSLYQFSGFDSSKPQQLKHTAIQEIFRVVSGV

SEQ ID NO: 1008016 - protein, 36 aa, Homo sapiens
ITLISKFQYDLPGKCLGQTLYHSIANDEHGRGASGS

SEQ ID NO: 1008017 - protein, 57 aa, Homo sapiens
QYSPALRGAGCCKGLLLWLFWFTGPIASSGYGNRPFWASHVSAWQCPSLGVASGRRS

SEQ ID NO: 1008018 - protein, 43 aa, Homo sapiens
RATLNTPPLIRTRCTSIFSQSVSSNFWWPYASHRKYEVGVHRP

SEQ ID NO: 1008019 - protein, 97 aa, Homo sapiens
AITRTQLDLRDSDGPPSEDWMQGCLMERVTYTPMTPGSYLISIKYGGPYHIGGSPFKDKVTMAPFRQEPQPPRDNHQCLKTSLTQGHHVPPSMGPRG

SEQ ID NO: 1008020 - protein, 41 aa, Homo sapiens
ISAYIYSQGCAITTYHLIPEHILSYPKRNLKTISRHPIISV

SEQ ID NO: 1008021 - protein, 49 aa, Homo sapiens
DSMENSLITPLSSVDCIGRREEQVTVYPPLAGILPPELRRLTISPYADA

SEQ ID NO: 1008022 - protein, 64 aa, Homo sapiens
IEDADEKLFEDDDSMKVVDEEEDSDEKLFDDSDEEGDYWVVSELYHLGMSPPNLGRHMDHFDHF

SEQ ID NO: 1008023 - protein, 57 aa, Homo sapiens
DVIYASPWSYEAELRDVRIFLFLSVFLVVSLPRIPDPILLCTLTSYPIGRTTVRVHG

SEQ ID NO: 1008024 - protein, 39 aa, Homo sapiens
QAADWVWTDLQALCDSVVEDPPQCTVGVKVETTEDLVVE

SEQ ID NO: 1008025 - protein, 49 aa, Homo sapiens
RDLYTHSTRIGNTSMAVIEHSEETDQKTKKDERVRGCAWFTPASGQGGI

SEQ ID NO: 1008026 - protein, 68 aa, Homo sapiens
KRHYTPIYPPSTPQTRAALPSINPPAPSTHVSISSRWFPCLCPVLLFSFFRVKAALLGWLLAAGYCTA

SEQ ID NO: 1008027 - protein, 58 aa, Homo sapiens
MSTPAVARSQYKYAAEFAILSNIFNAQHKLQCNSLLSMYKVRNLLTASMGGISVYHRT

SEQ ID NO: 1008028 - protein, 30 aa, Homo sapiens
MTKVIGSLHHQWDKATQRVDALVQIGHSHV

SEQ ID NO: 1008029 - protein, 36 aa, Homo sapiens
MTLALCYSCKIFLFLPHVMQAFFIQHIHNNHSKQTC

SEQ ID NO: 1008030 - protein, 63 aa, Homo sapiens
QDIELKLGTKGNQQIALCCKHEIRCKAESKKGKIPETKRQKDENEEEGGGVDGVIPLEDLSSG

SEQ ID NO: 1008031 - protein, 66 aa, Homo sapiens
VDRSGDDLYQAQGAARRDCLWISFLPFSFYFFFLWRQKLGIRQYEGWSPPLIVRKGSQGDDETMCT

SEQ ID NO: 1008032 - protein, 79 aa, Homo sapiens
IPNTLAHRSTSYLLPAAILHTLSIEGPFLGLPRGSRHMASRLASGFAEGAHLALILYAPGALQACMEHGLWSFPEALGA

SEQ ID NO: 1008033 - protein, 133 aa, Homo sapiens
HSKLCGFDISYFISLILCIRYLILFTYLFIYFLRQSFALSPMLECSGGISAHCNLRLPVSSDSPASASQSSWDYRCPPLRPANFCIFSGDGVSPRWPGCSRTPDLVIYPPRPAKSAGITGVKPPCPAGVGLFK

SEQ ID NO: 1008034 - protein, 43 aa, Homo sapiens
GRIPPPPGRIPPPPQSAETTRREPLAARPEAILLSKTRLCLGS

SEQ ID NO: 1008035 - protein, 52 aa, Homo sapiens
SSSSIPSVSSTETTSPGDRVETPVWERAPTPVSASSEVSPDEPMMDSENPMQ

SEQ ID NO: 1008036 - protein, 58 aa, Homo sapiens
MAYLYQAPSASDKQSYNLLLAYSSISHIALVVTAILSKAPEASPVQSILIIAQEEADF

SEQ ID NO: 1008037 - protein, 59 aa, Homo sapiens
SLKKKQLWTVGDVSSSRKNQSNCLPVFLQIQQMTSRTATIGITGEDRRSYFLQGARSEL

SEQ ID NO: 1008038 - protein, 40 aa, Homo sapiens
MRRLLHVFTFEQFSVNEGLVTLWVPWLICKALKPEYCVVT

SEQ ID NO: 1008039 - protein, 52 aa, Homo sapiens
MGFTLLPGWSRSPDLVIRPPRLPKAEEENGVNPGDGACSEPRSRHCPRNLGD

SEQ ID NO: 1008040 - protein, 39 aa, Homo sapiens
ILGDTLHNDACEKVLANVLKRNGNKKQRIDKWDLIKLKS

SEQ ID NO: 1008041 - protein, 100 aa, Homo sapiens
TDFVTETATGGSGTRNRSCQEWRSGIPLAVGCRKKHPQHLQREGWATSPPLLLQSKQDPDPKTRRTATHREYNSELIGIVRGAAVAARGIGLLDIAIQVD

SEQ ID NO: 1008042 - protein, 90 aa, Homo sapiens
MLLAPEDYHMYDPQDRELRTHHKTVQRALGPAKRKTTRRQDLTRASQMEQPYYEAETDPFPLVPIFLCTFLPATLQGELDEARPEGAISL

SEQ ID NO: 1008043 - protein, 107 aa, Homo sapiens
LTMLSSRWWACSFSSGAASREGPHVSISASLLGLATGLGWYAPRTLLCQDNDFPCPCRCGRGCPPSRDHSGQPAPGTTIGERPASALALIYAAPLSSDPFLPCKGNS

SEQ ID NO: 1008044 - protein, 76 aa, Homo sapiens
FFHPQHVLVFNPVSVFHDASCYTVLEKSGGDYDKELTFWDSVIVKINWSNEDSQCLSQNLEYLAVTVTTEFAYLHA

SEQ ID NO: 1008045 - protein, 88 aa, Homo sapiens
DEGLYAREREKNQASPQRGAIAGLADLVKLLAASATTAYTTTSRRTTQQALPNLLRDSTKLIDATTYERLDAETENPNSRHIVHNRLT

SEQ ID NO: 1008046 - protein, 125 aa, Homo sapiens
HGVIDFVPRQLEPVQLLLGENPILTTPAMFDTLLLCYESGVCAPSCPPIRVPWRMMLIHPLSLTELRLGSFGLEVTLLRSSCLPQCHLLSILCSSSLFPWRMVGPGHCLLAVTCARFQVVKGRVA

SEQ ID NO: 1008047 - protein, 71 aa, Homo sapiens
TRVSAGCGAPLGCQGRRAVLETSVPIQKRKAQAGGRSTQPGGSASSAPTPSLLSSCGAPHVVWRESCVVGP

SEQ ID NO: 1008048 - protein, 47 aa, Homo sapiens
SRDDVSSIELCGPLWDEGSVSSIFIAFTVPQTIPGRAKANSFIYAYL

SEQ ID NO: 1008049 - protein, 112 aa, Homo sapiens
SPDNFTISGNARKTVIPSPCTSNHALSGIRLHSTCEPYMCSELDVFFNDVIAEILSGLSSPAWFPAVGTVWSRSALRCATPAQREAEKHGYTGYGMFPRMRTPGTSSDLVEA

SEQ ID NO: 1008050 - protein, 39 aa, Homo sapiens
RPVRMFPMDIFSAEAQIELKSYVYVGGRSELNLAVSVES

SEQ ID NO: 1008051 - protein, 72 aa, Homo sapiens
WPCDDEMGVQPHVYLLCLSGNVYHLCACSCVVLDSDKPILYQYTTTPRIIVHYTPKPKGETSYQGPNVLFIT

SEQ ID NO: 1008052 - protein, 36 aa, Homo sapiens
NRHMCSDSHGHIMLTLTHVLTHGYSCSLSPMCSRTL

SEQ ID NO: 1008053 - protein, 39 aa, Homo sapiens
YEHGQIIQNSSLCLSIEAYVEDGSEWVCAGGAGATGRAS

SEQ ID NO: 1008054 - protein, 88 aa, Homo sapiens
MSEVMQPLQAEEHFLDSWKRFVTQKRMEHFYLNFYTAEQLVYLSTELRKQPPSDAALTMLSFIKSNCTLRDVLSGLLEGCGEVSARPV

SEQ ID NO: 1008055 - protein, 43 aa, Homo sapiens
MHVVVAVYSASRAGPASLCVTGRHLLKHVVNEIDEGPKEKGRT

SEQ ID NO: 1008056 - protein, 99 aa, Homo sapiens
MAIWSNLPASSFSHHQQLLGRTVAGQLREAHYVRIEDADILVAYLTYRLVRTSIVRHAATVTMLLEPYDDSQLHAHRDMGRKHSQRHVLLLARLDAQLP

SEQ ID NO: 1008057 - protein, 32 aa, Homo sapiens
CAARDVSLPRLLPAVLFASLVVWRTSRHELMT

SEQ ID NO: 1008058 - protein, 89 aa, Homo sapiens
VKSTCSGSYSRASASTSSSPLSVALLADLLQYPPQPEIMGIEAVGSIVHRLELSFSAATGAMATTDPKSMEVEVLVGRITIKVHHGRDI

SEQ ID NO: 1008059 - protein, 158 aa, Homo sapiens
GISGLAALVVGLSWGLGLGSAPRFRIWSKSSSTLNSSLWASLWLEAVCGPSHSHQAGGQHEGVTQGGETRRGQDHPIASGGPWMTRNSEGSCGDSFLPGAKSPSSGYTSSSKIGSRGEGLAFTGHYGMFLVGFLERIIARGSHASSSSQDISGSSPFR

SEQ ID NO: 1008060 - protein, 115 aa, Homo sapiens
KIGKNCGEDESAGKGEEMEASKSLEVDGDKQVERCIWNLMRQRNRNLENSNGFANELGIPVFAKKSIKLLSNGLANGLCIFVNLAKSWDGLAYMQARDGLAFRLMRYSRVRSSLS

SEQ ID NO: 1008061 - protein, 43 aa, Homo sapiens
PELSCGDSMLAKGFPTLSPGQGCQTFLSAPRRGWGVSGCPLAR

SEQ ID NO: 1008062 - protein, 80 aa, Homo sapiens
MIARPVMTESVPIILDVPTLLHSPSPETTGSRQGSSPLSIPGEDVRLGDCIIQGDQRYVVAPHHVLVENLLPVLQLYLNQ

SEQ ID NO: 1008063 - protein, 103 aa, Homo sapiens
IKVAPPECRSSRLELFLPPGGFLVSLALGVKLQTFVVSVTALKGGTDPKSQQQQHLAGRTKELSFHSMKSCCCWLRWPAFIPLSGPNHILLIGPFYRELIGPI

SEQ ID NO: 1008064 - protein, 68 aa, Homo sapiens
STACMTSLQCKDGGIPPHYRQTPRWKHYRGDHGRDKASLSALTHLQPHAHLGTSHTHWHTQASILHGA

SEQ ID NO: 1008065 - protein, 36 aa, Homo sapiens
LDVVSYYRNEYSQYSLQLLEAFRAGPFSLATSLYCL

SEQ ID NO: 1008066 - protein, 43 aa, Homo sapiens
SSLSGQLLNLAGPPGPDSASRRPLQSQRLPHSRFFTPSIYLTV

SEQ ID NO: 1008067 - protein, 102 aa, Homo sapiens
HHIISDSNTQPGRYVAHLGEKQNIYSPGTGTRTLTLLDIGPGHGKGAQVCVPGGPRAALLGSWSLGDGRHHPLQHPCTCKPIIDRTAAPLNPKEYRTQSSQV

SEQ ID NO: 1008068 - protein, 39 aa, Homo sapiens
GDGGRTHLRECHRSPRRVLPWASTRYASPDDPFPKGTAR

SEQ ID NO: 1008069 - protein, 48 aa, Homo sapiens
ARYRSADVNILTLQQSPGIVPRVLISTQASASFPSYWRSCPCAEALLV

SEQ ID NO: 1008070 - protein, 39 aa, Homo sapiens
EFSTPARWALMEDVDGYCYNGICRLTSVTVGAEHHLLHL

SEQ ID NO: 1008071 - protein, 62 aa, Homo sapiens
SLSPKNSIPRSALCTFGPGLGRGRGEECPAEGNARCSVCDTQRGGGRQRRGVPETNGNPNGE

SEQ ID NO: 1008072 - protein, 77 aa, Homo sapiens
LEDLRILLLLGNSPPPGESSSSYSSSSYIYIPPQEGHVGQARWLTPVIPTLVDGKAGRSLEEQEFKTSLANMVKPHL

SEQ ID NO: 1008073 - protein, 71 aa, Homo sapiens
MADLLYWLPRVPAPATSLHNGLPPAPRLMAVPLPIASSGAQWLATCNGCIPCQLSPSEICPYFHSSTWEAI

SEQ ID NO: 1008074 - protein, 65 aa, Homo sapiens
RDGSQVTHPSSCYDTFLSITGYANSLPVTDTYPQHPQVTPPLFLYQCFLIIHTSHLGGHHTWEDI

SEQ ID NO: 1008075 - protein, 35 aa, Homo sapiens
KKFNEARVSGVDAVSGVGCSQRRGMQSGALDAVSG

SEQ ID NO: 1008076 - protein, 42 aa, Homo sapiens
MLPITFDVVACYIVTRCRDQGRSGEELRNGTTSKEGSGALDA

SEQ ID NO: 1008077 - protein, 40 aa, Homo sapiens
ELITRTDCINAAHTFTNIPQLHPLSLDCSSLPLAGPKRPP

SEQ ID NO: 1008078 - protein, 68 aa, Homo sapiens
LHPYAADCILRRWMEREDSSRDKSGGTQMMMVVVTMVMDDVTLVVVTSSDKRTLLFTLNGASGGRWMQ

SEQ ID NO: 1008079 - protein, 36 aa, Homo sapiens
KEQEVNSQEYVTFLGALDLIYNEALKGVKINSGVGC

SEQ ID NO: 1008080 - protein, 62 aa, Homo sapiens
ILLLWYDADQYGGPPMMPMMGLLLPGMMPVGPAPGTEAAHGTAYAIMMPGPPSDETILPDPM

SEQ ID NO: 1008081 - protein, 36 aa, Homo sapiens
KAPHYVLSQLTTDNKGNSKAGNGTLQNQKGTGVTEE

SEQ ID NO: 1008082 - protein, 36 aa, Homo sapiens
MVMSGPVPGGSFVCGARALEWQESQYLPKRDIQNLF

SEQ ID NO: 1008083 - protein, 52 aa, Homo sapiens
MYVPATREAEAGGSLEIQEFWAVVRYADRVSALKFGIKYGDLPGAGGPPVLP

SEQ ID NO: 1008084 - protein, 42 aa, Homo sapiens
RAYDLSLIFSEHRVQLAGEIKQSGPPPAEKALSRQGPELLRE

SEQ ID NO: 1008085 - protein, 45 aa, Homo sapiens
MSRILVTEYVGALCLAQIGPGSVSKKCDDMPGTGDWKAQDFSELT

SEQ ID NO: 1008086 - protein, 69 aa, Homo sapiens
HGTRSVLPYSERCCLDGDGCCILVPKPFYESLQAEARATSTPFFPRPHIAPCHLENQERTLLCGSSDWL

SEQ ID NO: 1008087 - protein, 45 aa, Homo sapiens
MNDPRQTLNVPVCRSATLRPCMTQLSSFNANISGKIPCLGLVFNL

SEQ ID NO: 1008088 - protein, 44 aa, Homo sapiens
GGDIDGEHDRHGGQTGSRARIVSGPVESCKPGDACGWSASAPNV

SEQ ID NO: 1008089 - protein, 127 aa, Homo sapiens
ALRASEFLLQLSETMHEQSCPLEKKTSVLPNALHIFNAIRGTPTSTRAHGTTSSSLGEGLHLMARVWGLALSFANSGCFPKPITGETEHREEEIGGERGEERDGEELFTGMRKELLTFGQLLWNYIR

SEQ ID NO: 1008090 - protein, 53 aa, Homo sapiens
WRTGSPIRAPSLTPFSHEKAPPQSQFYFTQAVGVLQELDDLLVDLDHQRQSAC

SEQ ID NO: 1008091 - protein, 55 aa, Homo sapiens
METVCTILPGIILVLIARPSLSAVLDIHETTVSVLSLTVKSGGQQLVVKDEYIVY

SEQ ID NO: 1008092 - protein, 46 aa, Homo sapiens
PDAASASSQYSPYQYIYTSSKYSGFDLYFSFKLTPEWYPSVQVAEL

SEQ ID NO: 1008093 - protein, 39 aa, Homo sapiens
MTYVPDADLRHSLPLLLTTTRLLTYLTTTLHDTHLRISP

SEQ ID NO: 1008094 - protein, 43 aa, Homo sapiens
TRAGASPVTPLVLLPRFSDCVRYSDSCPSTDAYLGDSSTTSTL

SEQ ID NO: 1008095 - protein, 35 aa, Homo sapiens
LGTDYALDGQDDHLSPGVQGYSEGNNDWWVIVDIG

SEQ ID NO: 1008096 - protein, 39 aa, Homo sapiens
RNPTTEHIGRTDLLGCRPSTGDTSLDGLELPSLNAGAPY

SEQ ID NO: 1008097 - protein, 67 aa, Homo sapiens
HTKQHRMRQGTILRKEESCMQETSFLFYLRNCHSTLAFSNQHSDRAAPTHTKDPHEPKGYNSPKAQM

SEQ ID NO: 1008098 - protein, 83 aa, Homo sapiens
MGAHTDMEGWVKRCQNFLGLLLGEDELLILDYPVPLKGGSLLYSKAYSVGESWGRIAGITGRRGAEAEEREASFAASSAFLLP

SEQ ID NO: 1008099 - protein, 107 aa, Homo sapiens
GDDRGSGIVNQIEGEATPVNLTEPAKLDFKLSWFMPSVPYWILDTDYEKYALVYSCTCIIQLFDVDLAWIWARNPNLPPEPVDSLKNILISNNIECQTMTVTDKVKP

SEQ ID NO: 1008100 - protein, 42 aa, Homo sapiens
MGKLLLVGNLGRDNDDVTKVRLRNPTMDSQTSPHVIRPGKAE

SEQ ID NO: 1008101 - protein, 115 aa, Homo sapiens
CNGPLSETLGEADSEGRFDSVIVEAKYKLIQNRGHHSIILLFIYLITHGIINGIIHHLLLHIHDLCLQHKLHHDLQDLGHTFSCPFMLPMALVTSLHGLLAIEWLDLMCLDLEET

SEQ ID NO: 1008102 - protein, 36 aa, Homo sapiens
DNTHTLHDNVYDADGGLLDDVDPARDCNAVAPGPVV

SEQ ID NO: 1008103 - protein, 166 aa, Homo sapiens
VYWCDNDCLFLETTAERLRHYQATTTRTAKLGCKSRNHSWTHIKTEPLYSITLTGPIEQKYDFKSTNKKPRYTGDKKHDEWNGTSHLNSNMDSKWPKCSTYWIQNCRMDKNSPMNYRQLQETHVTHKDSDKVQVKAWHASFHANGYQKQAEVAILTSDQTIFNANS

SEQ ID NO: 1008104 - protein, 57 aa, Homo sapiens
RVGTLYSAVWTVLGSDFCCSENNKPKDRSWMKPPQSLHLTPSQAAHAALAPPYIWLP

SEQ ID NO: 1008105 - protein, 60 aa, Homo sapiens
AKYLRILRCRCQRLSIKTAAAVSNCARRRSKGHCWKHPGSYECLCKPEFTGLTCIKQARV

SEQ ID NO: 1008106 - protein, 59 aa, Homo sapiens
HCTLPCGCPGQRFCASENNKPKDKVWMKPPPDASTDPLPGCPVPLTSTYIGSFSQAPGS

SEQ ID NO: 1008107 - protein, 30 aa, Homo sapiens
MRIKRDIDGADLHDDHAMDPYIGPGKITSG

SEQ ID NO: 1008108 - protein, 128 aa, Homo sapiens
GSLPEGGAGVGDGMRCHLKILPDVKALPMLEGPSQEKYSRTRGLGLLARIQFRACVCLVVHLPIWTQRKGKLLASEDPDSRNGAAMVGSKKDDTGEGILPQLVQSLEHSSDEIAAHEGLSEFFREAIL

SEQ ID NO: 1008109 - protein, 61 aa, Homo sapiens
MCQRAQSFCDSPGEKGGAKRLALLVLALPASGLGEERATISYILTLTDEQFRVQDQFPVTP

SEQ ID NO: 1008110 - protein, 52 aa, Homo sapiens
GATGIDISELNMGWCPLGRSGCGCDLSELQVSWVQEEWLRQSGTRRLTLSRL

SEQ ID NO: 1008111 - protein, 40 aa, Homo sapiens
MRALVEHGLHLLKPRWENTGCSGPWMPDLPGTMSPSGIMG

SEQ ID NO: 1008112 - protein, 56 aa, Homo sapiens
DSVIYVFLGLLGLLALAGTLNQIPPSSSLPGPISRQPLFCFRVSLVWSYQEVYGQG

SEQ ID NO: 1008113 - protein, 38 aa, Homo sapiens
RSEVLGGGSRGRSPTTELVGHSLGNTNPNLAKTAGDIH

SEQ ID NO: 1008114 - protein, 91 aa, Homo sapiens
MRPPPQQNIYPSRCPHRACVTSLRSNMPSPYKHSIHPVLSPPWDLWVILEDTIPTLFQVPKNTTRDNSFREGFHSSLRHKCTRIFVRAALG

SEQ ID NO: 1008115 - protein, 86 aa, Homo sapiens
KGRHEPGHPYNPVRQPNSQDIPPGITVTRTKRAPTSNLRTGHYTNFYIGIPAHASGQTESASHSIPEETSHEVNPSIFDRFYTYYS

SEQ ID NO: 1008116 - protein, 152 aa, Homo sapiens
MLGSLNLGGADKIRIVSRALIGFLITPHLLERLEIINEDMAKRTCEEHQLCVVAVLPHILDTGAAGRNSDLEVLLKWADKYKKENVGVAVDQKLEPSLNLRPRWGWQGSGTRPGPAINARKMKSALLQGSFSEQGINESLRELSTGRGSTAP

SEQ ID NO: 1008117 - protein, 81 aa, Homo sapiens
PPRRRICRTLSSDYILSENAPRHNSFTHPLASLLPVASLRTRALGKGIYSRETRTLHQMMTLPLSPISMEPDTKLGNCQTI

SEQ ID NO: 1008118 - protein, 87 aa, Homo sapiens
VSGTDTFVKINSIMKTLPRQNSLTHPLASLWPVARSGNSGIGQRGLIIRETRDSGIKWMDIHHLSHICYRNQDTKTNGNWHKPISVE

SEQ ID NO: 1008119 - protein, 115 aa, Homo sapiens
SSDYGTYLAEHSRGALVLQVPWSAGAQVNGAKLVAAGPAVLLVSGSPGERGEVGPAWRQMDLLVLLGSQLVNLVLNGDRRQPKGLRFETGLYVGPTGPYGAAGPDGPNWSPRYLL

SEQ ID NO: 1008120 - protein, 46 aa, Homo sapiens
MHSHAHPRAPCQAHTPHVPMHPRACARQFVAESVVMPSSSREEVEV

SEQ ID NO: 1008121 - protein, 37 aa, Homo sapiens
PQFASSISSSILSPHVIRHMCSLYTPAVSQQFTNHGA

SEQ ID NO: 1008122 - protein, 46 aa, Homo sapiens
HPWLCSSYARAGPPEVTFPLHQARRDSLAWSVASTAWGTLRLFSMP

SEQ ID NO: 1008123 - protein, 44 aa, Homo sapiens
SPLFCAVVCYAIMGVATKFGIIMVTPGTVGPTRLPKAGGGILPG

SEQ ID NO: 1008124 - protein, 30 aa, Homo sapiens
MEDTSDFRKQPRLLSIMNRLSRKQNQQKEP

SEQ ID NO: 1008125 - protein, 53 aa, Homo sapiens
MMRKAHPRAHVKQAADLETLLPPIRGNVRLLCSPQEDLTDDQGTCCMATQGAS

SEQ ID NO: 1008126 - protein, 53 aa, Homo sapiens
DRNSLRSPPGGRYMVMNWITVLMYAAWAWGALSPSSCCITIGQRLCTCTTFTL

SEQ ID NO: 1008127 - protein, 28 aa, Homo sapiens
MLEASSSSSSNSPSSSAVASWYCWYSDT

SEQ ID NO: 1008128 - protein, 86 aa, Homo sapiens
GYGSLDVFMTEMAGAMLAPDLLYRSADPWTRLVIIFTIFIGQYPYSNLVGPSWPRGMAQDDQWQKPRASPLASVAREPIHQYVSAY

SEQ ID NO: 1008129 - protein, 89 aa, Homo sapiens
PESTDITFQWRENCSESRPSTPKSYISMPILTRALILDASPQLHTRDTQHTHEHSTHTSTAHTRAYSTHTNAQHTQHTDEHTAHTQGHS

SEQ ID NO: 1008130 - protein, 33 aa, Homo sapiens
THVHSHSCLCTLTHAHTCTYPHTCLCMLTITHS

SEQ ID NO: 1008131 - protein, 128 aa, Homo sapiens
PGLSDACSCDMSSHRSTFKIEKRSEELKGCDVEIRSRVQYESPISTNEEKVDTDDRTEGYLRAEPQEPSHFDSQQPAVLEEEEVMKLMLIHRKSTMNMYPDGARINAIHISTITLGQSDDLIQQHHDY

SEQ ID NO: 1008132 - protein, 124 aa, Homo sapiens
RYIAHPFCVDVCGTWTLLSQLQSSPGHLQAYVGLSQTWREPGAAGSTFHLSSSFTPGGGSALVVSPLQGAHLHVFFWGEYVAKLTNLQTLEIAAVESCLGLAKTFPLSVSTTVSCLPETLSPAI

SEQ ID NO: 1008133 - protein, 153 aa, Homo sapiens
RILCTASDAGLGAHGWGLSSVIGKGSGCKSPIAYCPQRATALVRYNLSVTYKGSLCHHRQVARKENSEAPEEQQADLPAEGTQDSEDMERLDLELSMRLCGEAEPGWGCYAPGGLKCTTATTVMTRVTIITQNGCDGCSLLSAFLDTDAAGAG

SEQ ID NO: 1008134 - protein, 75 aa, Homo sapiens
LTTETPHVTAHTNDTLKMLNHRHYHTAPERISTRTLIAITQHTSTQHTPRHSTHMHTQHTHANTAHTNTAPSRGS

SEQ ID NO: 1008135 - protein, 75 aa, Homo sapiens
MSMSGVAVPEDSVLPGVISLGCPFGCLNTPGTASRAACLELRRFCVAHSPASYALDRMQFGVPLARNQLIHKKLA

SEQ ID NO: 1008136 - protein, 154 aa, Homo sapiens
LRESWLRLQDTGSGNSRVFDPRRPLDLSSTWVFGVRWSPSGKTLAYAGHNSMVYFIDEVESSPAAQNLALLICLSVMWVLFVSERTLIGVGFDCNPMIFAADDTGLWSFIRFLDERKAAPSASKASQLSEALGKLYGQSKQGTSSDTVEPSKPR

SEQ ID NO: 1008137 - protein, 110 aa, Homo sapiens
GGDHGTRGLTGRCSFTLHLETPKPSISSSELKSRGRPWTAVSNSVTLETPERKATKWWHDMVTSLPYELTGLRAVREPSEPSFYLECTQSICEDPMNCEHSGTPVTCPAA

SEQ ID NO: 1008138 - protein, 108 aa, Homo sapiens
NRLVTVSYRSKAVDGDVVLKSRGMRCGKVRDKKKRITLKIDHRDWEDRGGEAFASARSRDSDIFLRVTVCALPVVRHRALSCTGPGAGILVERTHSPHPQHGLTFVTN

SEQ ID NO: 1008139 - protein, 46 aa, Homo sapiens
MEDVSSSDRVLTICQLTFRQRSTSAGQERMPSLIHGSICFDSSRMV

SEQ ID NO: 1008140 - protein, 109 aa, Homo sapiens
RRGGCFFTISLHPDSQNLFAFTWTDPDTLQSQQLTWTVLPQGFRDSPHFFGQALARNLTSLNLSPSHLQYVDDLLLCSPSLKDSQTHTATALLNFLAIKGYRVSPPPRP

SEQ ID NO: 1008141 - protein, 145 aa, Homo sapiens
TGAQHMEDASLHFPTPVIQNLFALTWTDPDTLQSQQLTWTVLPQGFRDSPHFFGQALARNLTSLNLSPSHLQYVDDLLLCSPSLKDSQTHTGTALLNFLAIKGYRVSPSKDQLSISMMTYLGIQLSPGAQAMNPARSALIENLAP

SEQ ID NO: 1008142 - protein, 100 aa, Homo sapiens
RGPGYDSSHGSIIENLPPPSSKSEILSFPGLPGFFRIWISNFALLAHPLYEVAKGPPNEPLNPSHNILPSFHKLQTALVTASAPSLPDISQPFTLYTAES

SEQ ID NO: 1008143 - protein, 145 aa, Homo sapiens
CLSYMEDASLPFPYTLIPKTYLLSPGLTLTPSSHKQLTWTVLPQGFRDSPHFFGQALARNLTSLNLSPSHLQYVDDLLLCSPSLKDSQTHTATALLNFLAIKGYRVSPSKAQLSISMMTYLGIQLSPGAQAMTPARAAFIENLPP

SEQ ID NO: 1008144 - protein, 74 aa, Homo sapiens
SSTVWRMLRLPFPYTLIPKSYLLITWTDPDTLQSQQLTWTVLPQGFRDSPHFFGQALARKLTSLNLSPSHLQYV

SEQ ID NO: 1008145 - protein, 88 aa, Homo sapiens
LEDLVMLRMGSGQWGRGQAGGSSYESGWHKAEQEPGVTVAEAGLDQAQVCGQNSAAVVDAEALGDRLGATAGKGAADGLASTCLAKGR

SEQ ID NO: 1008146 - protein, 52 aa, Homo sapiens
LILPFGLATALIRGDKSELRVFHSHFGGTKFNINVVVKKYNGSVDFFFSPNH

SEQ ID NO: 1008147 - protein, 44 aa, Homo sapiens
GGDGSHGGGSGSVQGDVLMEAADTGESDPRKGVSENIMAGASGL

SEQ ID NO: 1008148 - protein, 56 aa, Homo sapiens
SSHLTVLISLNDSSTLTVLISLTRLHNVKQTLSSVNNLTIPLHITRETSSYPELER

SEQ ID NO: 1008149 - protein, 51 aa, Homo sapiens
IFNWLIFTLVTSKSVMVSILGLPISTGAFPTSGHQLNTFREKRAGLGPQKF

SEQ ID NO: 1008150 - protein, 50 aa, Homo sapiens
IPDAEQMLDTMLPTQLQKHEPVKPLYKLPRLRYFFIAMQEWSNAYAHCNI

SEQ ID NO: 1008151 - protein, 57 aa, Homo sapiens
LSALLVHSTHMQGCWFWVCFAFTCEQWAVSSVLVPGPGYYFLPHRKYSLVHISFSLY

SEQ ID NO: 1008152 - protein, 49 aa, Homo sapiens
SSVRRFLWMLPSFLDETGRWKLDVSPDGFPAHITQELAGDWTWEREHCC

SEQ ID NO: 1008153 - protein, 40 aa, Homo sapiens
GNLIVTEIFCVLHPLMVLLLPGEREVKAGVSQWFPATHPG

SEQ ID NO: 1008154 - protein, 78 aa, Homo sapiens
RRLAFHRAVCKHCTVGRHGEVKSEHCNQGETQGSEEWDTDDGRVGESSRVRARQGNKRLIAVKRRRRNTRDAEDDGMR

SEQ ID NO: 1008155 - protein, 132 aa, Homo sapiens
TGLSIFWEDRKGMKHDNERVKNLSDKRYAGSEQHNPKETCHREKLVYWKNYSSGKIEPISYSPPTSYAQNTGSLHYGYQLKISGDGGCGGWYKGMEQAARREIRVGAPEKTFSSSGNTCPYPQPVSYILYGQ

SEQ ID NO: 1008156 - protein, 37 aa, Homo sapiens
CDLEDPSRYISWDGVRRGIKAKSNGSLIPEWALTQEP

SEQ ID NO: 1008157 - protein, 50 aa, Homo sapiens
GSLETGSQVIISQGKGTIARTGGRSKAALAQPYPSTALESAQSRKHSTLV

SEQ ID NO: 1008158 - protein, 34 aa, Homo sapiens
MVFTFNILTGKMEGVGDVCGFPGLTGKPSNLSTG

SEQ ID NO: 1008159 - protein, 67 aa, Homo sapiens
HDGMCDLITREPESCALSIPSPHENTARMAATYKAREESPHEEPRWASTQSLGNSHVSRSCEKIHFL

SEQ ID NO: 1008160 - protein, 50 aa, Homo sapiens
DNSSSSSSRQSMTAWIDGKHVVLAQSRGHGGGAEELGAVVNPEGLLSTPR

SEQ ID NO: 1008161 - protein, 39 aa, Homo sapiens
MRKFKALISIARRSVMMIMAIGSIYRARVILTSGRRPMA

SEQ ID NO: 1008162 - protein, 74 aa, Homo sapiens
LRMRSYEALFPEKEIEANPEVDSLAGKPNDDDIREPDWNLIARAARFGTNLHPKSIYKSCHILGAGHLVSLHYH

SEQ ID NO: 1008163 - protein, 107 aa, Homo sapiens
RVDIEDLTWGGDCHADSEWKPSPFSHSCSEAQTQMLPPPSPVSRRQRLQSPETILPASTPVPTPATLTVGCPRKCHGQEPRSFTLASSLPGWAPQCLQSSLCRALEI

SEQ ID NO: 1008164 - protein, 76 aa, Homo sapiens
LIRPQVGPGCEYTERSENLRCFSRLTRDCPCTKQHTLSSEAHKNPRTQPDLGRRQDDLLMENSCPLWVSLSCSVTQ

SEQ ID NO: 1008165 - protein, 135 aa, Homo sapiens
SWQCRREVVCHLPVHPGDVCGRGETCSGQPARHSQTGPAPPACSPGPRDAFASSWEPSFALRLGPSQACRPLRQQCPHQAHPVGLVWGLVIVARTGGRSPASCGASQPPTLAVAWDVHGWDDTTLLGHTKLRIGC

SEQ ID NO: 1008166 - protein, 52 aa, Homo sapiens
TGLIPYRHELIAIPHLIPRDTGQQEVLLERDPVKRSQKLDIKNKKVQTVFQV

SEQ ID NO: 1008167 - protein, 34 aa, Homo sapiens
MPLYSSLAQSETLSKKKNHDTSMEVMFWVSLPAC

SEQ ID NO: 1008168 - protein, 67 aa, Homo sapiens
MSSPWNEEDWDMTGTRTFELSEGKGLLAQKIGAKIHLNIPYHKWPNLKAFKQILPSQHFYVLSFALC

SEQ ID NO: 1008169 - protein, 41 aa, Homo sapiens
MIMGPSAFALILGPLVLLALILGPLGLLALVLGPLYLLALI

SEQ ID NO: 1008170 - protein, 69 aa, Homo sapiens
CLKRRLKGMLYTYLTSCRVLGPPAEASQITQQSTNQSRNPDTTNQTEFERSSEGRRLPLGLLCKYSSAM

SEQ ID NO: 1008171 - protein, 114 aa, Homo sapiens
DLFLEDTILLHHPPFRYPPDLYTTLVGRLLEDTISLNPIHCYLLPLRVTPGKYHPHPPSILSPPPLLPVCLIPGRYHLATPCNLPISLYPSGSFRDDITTSSLPCFPTVTIPHS

SEQ ID NO: 1008172 - protein, 38 aa, Homo sapiens
MGSTTSEEKDIGQGTRHSLRSGADAALVGGQLVASTVP

SEQ ID NO: 1008173 - protein, 73 aa, Homo sapiens
MDETTQKKKNWDKWKSVFSHHWVFSKKKITAEIRNLIQKVVFILCPLLGGRLKEHHYMGRTQDGIVHWAWEIL

SEQ ID NO: 1008174 - protein, 38 aa, Homo sapiens
RISFIPLRRGERGNTSKKRLVQSPNFLLHWTVNMPRDC

SEQ ID NO: 1008175 - protein, 53 aa, Homo sapiens
GARDVGRSFRLGEAGEASGTQPAASHPAQMEGGRACAGTCQGGYTRQRTSHRG

SEQ ID NO: 1008176 - protein, 83 aa, Homo sapiens
DASHGDCQGRSHAKPSIVEDVHGNLEATPNLTQHVLQSGTAYSTQMNTLCSCSETPCMPILLLRVAHGLYAPVSRPLHHKSCD

SEQ ID NO: 1008177 - protein, 50 aa, Homo sapiens
MPISSGFLRQFRFGQKGLYRTYFIFRLKPLAVNNGGAELVILLLADPHFV

SEQ ID NO: 1008178 - protein, 124 aa, Homo sapiens
MGGINHTLIVMLLAAVQISSHENHYAFYHIAQHLSSAYDSIALTYPLKVGCGLVTSVGQCNETSGSFKSQYMTHILFSPLELLCQSLSCNKDYKKQSTQPVLNGSVIIIKNKTLLYKLLIYGIA

SEQ ID NO: 1008179 - protein, 60 aa, Homo sapiens
MEETQQKINLELLRISLLLIESWLEPVRFLRSMFGNNLVYDTSDSADYHLLQDLEEGIQT

SEQ ID NO: 1008180 - protein, 59 aa, Homo sapiens
KHPNRKNATRSNGEIYHYIVSTKPVLLRLSEVSSGITKTTAMVKTAYFATTKHINSVGR

SEQ ID NO: 1008181 - protein, 34 aa, Homo sapiens
ASKGHVWLPSLATMALLLLRFSCMGLQFTDRLER

SEQ ID NO: 1008182 - protein, 33 aa, Homo sapiens
IPEPGLTLDVRQGDEVSVHYDPMTATLVVWAAD

SEQ ID NO: 1008183 - protein, 84 aa, Homo sapiens
IARLESGMQNMSIHTKTAGAMQVAELGYGGSQARGSATVWAPALALGRAPGPSGGPGAPGAGFVMKIETRDGKLVSESYDVLPK

SEQ ID NO: 1008184 - protein, 34 aa, Homo sapiens
RESSALDDVVAGGQPSAAGGGPKDRVARTGWVES

SEQ ID NO: 1008185 - protein, 78 aa, Homo sapiens
NNQSEQSREALNLLEKREDRKLQKRRDRRAEKKKREVVGTGVSRLRSSSSWIILLLVVHRPPQGVAVKIESPVRGYES

SEQ ID NO: 1008186 - protein, 31 aa, Homo sapiens
MSRPCSNVFLKQLEQPVVLEPVLSWLCAVCV

SEQ ID NO: 1008187 - protein, 122 aa, Homo sapiens
AKIYRMKSLTQVNHYHRLACGFLQQNVTEHIKPETADKAMATTSQMFHPVEGLGCTLKLRVACDMKPLTCVSYDCWFPPELRGSQTVAGLQIGNWQDLYCPGLVIHPLHTKGHLIPGWLGLL

SEQ ID NO: 1008188 - protein, 58 aa, Homo sapiens
SHLYLSCMVFSDLSRLPYSDLTLPGLLCDSTMVFIHTSRSSTCARWRISEDLFGLALS

SEQ ID NO: 1008189 - protein, 50 aa, Homo sapiens
LLWVYAAAYFVTARWRRAVTCTDFRYCSPLPDVPGWTRLTTRVPELDLRT

SEQ ID NO: 1008190 - protein, 163 aa, Homo sapiens
MGYHRVGQAGRELLTSGNSPASAPKVLGLQCMSHRVQPKTVLFKNSIWLIFQTFTSVLKVCHVGLHPGIPFSSVGFGHAFQNYTGESFHWKYNNPVLKIESGQVEGLPFLASLRLRPPVQWPWSTYMHICTICFMSKSVSTVSDDIMALVCHIVLSLVCGIDT

SEQ ID NO: 1008191 - protein, 55 aa, Homo sapiens
RAGPEISGRENAHEKAMEVNSVRILVPKAAITHDIPNKNTEGSVSGTSERENSVG

SEQ ID NO: 1008192 - protein, 38 aa, Homo sapiens
PVCSACGLYYKLHKYEADPWTMKKEGIQTRNRKMSSTS

SEQ ID NO: 1008193 - protein, 110 aa, Homo sapiens
SSTWGDAVPPGTHELDIAYWSRLDRAGGMPLETVRQQCLPAGRESSSRLQSGSQSQSIGRASFGSGHACRSGVLGGTVKSWNPAREKVPSTPASRIAGDSSSELGPAGSA

SEQ ID NO: 1008194 - protein, 95 aa, Homo sapiens
RVVSYQFPLTSLLYLGPIHHGDTSLADVLVLHWFNAVGCTQATGLEVALNPAQVGRGCGSTVCHMFVYIVLSCTEPHYVNAVHEPGDISMAALAQ

SEQ ID NO: 1008195 - protein, 55 aa, Homo sapiens
MVMHEESTALAWGLRQQRRRPRRCDLDVIGVYSDSREGFQLQHGVIPRITAALWR

SEQ ID NO: 1008196 - protein, 127 aa, Homo sapiens
TWRAVLVSSKSVLLPADIITYSAPEDHPGIVSGVDCAIFESPYPMTMALSVLLTIQMCNALNSYSENQSLLRMPPWENIWLVGSICLSMSLHFLDPLCRTLDQRTVQFVPYQFYSEELPVLAHGALA

SEQ ID NO: 1008197 - protein, 50 aa, Homo sapiens
LRNWYGGADGEEEEDPTEEERERKPPALPESMSANSVMESVPARYGALAQ

SEQ ID NO: 1008198 - protein, 64 aa, Homo sapiens
QLRSDELLGSPAAAGDGHCSLSVPSPEGSCCPHPGSSPCSPGETKQIIKGSVCNPSTLGGRGGR

SEQ ID NO: 1008199 - protein, 108 aa, Homo sapiens
INSGPLYLLYTSSLAPVSIQYHSPSSPHPIKITPPSSPHSILSYTHPVHTPGPVQTLLQYTPHPVHTPSRTQPNPVQHPIQSTALLVYTPSRTNPIQSKELKIGPNGD

SEQ ID NO: 1008200 - protein, 74 aa, Homo sapiens
TVARTCWATHRDMEGLVKRCQNFFGLLLGEDELLIFDYPVPLKGGSLLYSKAFSVGEFLGRIAGITGRRRCVGP

SEQ ID NO: 1008201 - protein, 34 aa, Homo sapiens
MSNGGSARNIISNMMDSQSPTMSTTDTRYSISPT

SEQ ID NO: 1008202 - protein, 103 aa, Homo sapiens
MTFSSLLVCSFAISLPSLLKYLYKSSIFVYLHFIDWRTSSLIRVAQAGRAVARFSAHVQTRALPGPSSVSCLSLPSIWDYRPVPAGHPPTAALAGLLALPLAV

SEQ ID NO: 1008203 - protein, 157 aa, Homo sapiens
REEYRQSPYRTCQCPHPHHHTIIHIYLHLLLLEKKICVLLSEASFSILYSDTLLPETPVCISFSFRPSSFSVHIVSPEADYSACWSPSLCFCNFPRVSSVCCCRSAQIAFHSLLSCLALRQQAATQGGAAVSTKHGDLVIPQAAEPLVLPSCLQQTV

SEQ ID NO: 1008204 - protein, 97 aa, Homo sapiens
RSSSPDLLLRSLTDRRTSRVFSSDPDTYIKEFKYLTQSYELTWHDLYFILSSTLLPEEKERVWLAAQAYADDLHQQDPTKPVGAAAVPWEEPSWEYQ

SEQ ID NO: 1008205 - protein, 37 aa, Homo sapiens
MVHGQRRKSKGLLPPLPAARFHLARACCFRESPDLSP

SEQ ID NO: 1008206 - protein, 77 aa, Homo sapiens
MDSTQVVLQKGNQMASLASWGRVAALWKQQICFTVLSNFSHQTLEGTFANQKFSGLLITSNFTERQQYQAWNDKVSS

SEQ ID NO: 1008207 - protein, 112 aa, Homo sapiens
PIDGQWVGGCSPGCPWGMPGCPGMGCGLELAYLAARCLMKCSQVAGGLAVRGYYSTWLLLQGESWVDLSSPQNGFEGLVETHVPGFEMGVIPYLGPSPVLWQPMFKGLTSAR

SEQ ID NO: 1008208 - protein, 79 aa, Homo sapiens
VMLPVDQHHDRACSVPHLQKVFDRYKSYSPYDMLEGIRKEVPGDLEDAFLNLVQSHSEQAPVYTAERLYDSMKGKGDAR

SEQ ID NO: 1008209 - protein, 51 aa, Homo sapiens
DSITDPGGVVTFGAERLLKFFWVVSLVKRQETRAGMMSGPHLWDVRYMEVS

SEQ ID NO: 1008210 - protein, 35 aa, Homo sapiens
AVVPATREAEAGQWTEPGRRAAVSRDSVSALQPGR

SEQ ID NO: 1008211 - protein, 67 aa, Homo sapiens
IASGDEQRAWMMARLQPYRVETTDGNPDGLLTAYYEPLMDAARQPGNGFNVPIYRTPAGFGARKPWY

SEQ ID NO: 1008212 - protein, 77 aa, Homo sapiens
FDRIMRTWSFPDLTGLITMSEVFIPFSVTLGVSGMTRTRTCCSGARPMQFGHVHVELQHTIAAKALMSCFYTFALPD

SEQ ID NO: 1008213 - protein, 125 aa, Homo sapiens
MSTCCHGSARFVSDIAVGLLEDLPSTAGAVYQPPHQREDAFRKVLYEVDSHRCPRGHTPGWLANILLRNRTGSSHDSMSSREMRSSSRLDFCCVSSMLEGVGIESEKQKEVWESCRNEYFWSLGI

SEQ ID NO: 1008214 - protein, 50 aa, Homo sapiens
MAVNPSCAEFASVTAEERRGLGTSPDPTNWEGPLLLPYSWDGSKDMGAAV

SEQ ID NO: 1008215 - protein, 37 aa, Homo sapiens
ADEEIGCDSYLHGTLQNSVNWIQAATGIKNMPPWLPL

SEQ ID NO: 1008216 - protein, 37 aa, Homo sapiens
RGTHCRLPVPYPAWPAAGGFQLLLLGPSILERQFPAL

SEQ ID NO: 1008217 - protein, 39 aa, Homo sapiens
HYRNSSTSASIALARDCVQHASCSLLQVTAPVLEPAPVH

SEQ ID NO: 1008218 - protein, 40 aa, Homo sapiens
MLGLPVCARCQLIGNWLIETRSYCVSPAWSQTPGLKRSLH

SEQ ID NO: 1008219 - protein, 35 aa, Homo sapiens
VTLRIFRELTFQHDILTSIYIPLRKSTNPGVYFIY

SEQ ID NO: 1008220 - protein, 68 aa, Homo sapiens
TTRDGRDGEEQREGDIEREEDEEEGNKKQKKQGLKDARLNGLPTLKQQRNPLCRVPHEQVQNTQRRTG

SEQ ID NO: 1008221 - protein, 79 aa, Homo sapiens
GRCNETRYDLTKSLPKILGPGDHLHHKDSIEAQDEKTHAPGQAQWLMPVIPALLEAEAGRSRGQEIETILANMVKPCLY

SEQ ID NO: 1008222 - protein, 118 aa, Homo sapiens
MSLWLSDGQLEDRPVLEVSFKGPEQPGWCQFFQEVGVELSVKKHRMLRKPQKGLPKWSLEPSLWRGLLLSASRRGLLPSPSAEELALGTVWRSYTPAAPPLTEMVYEKPPGGVGWVES

SEQ ID NO: 1008223 - protein, 33 aa, Homo sapiens
TLSPTPAGSMTPATRHPAEELGSGMLWWLVVNR

SEQ ID NO: 1008224 - protein, 41 aa, Homo sapiens
RVIQRIPSSGKGERQTVGLTVPICQSMRHCLSSSASWDHYS

SEQ ID NO: 1008225 - protein, 46 aa, Homo sapiens
KDIKEVRALSVNSEQCRHCRRRRSQSRAERGHEGQGWIKEPRHQEK

SEQ ID NO: 1008226 - protein, 36 aa, Homo sapiens
RVRMCGDAAVLALQRVLEEPGTAAQLREGSSILDPV

SEQ ID NO: 1008227 - protein, 34 aa, Homo sapiens
VDLAGIPHRGTTVRGPAALQFCQSSGPSALFPVC

SEQ ID NO: 1008228 - protein, 99 aa, Homo sapiens
MGTRMMLYRVLLQRSTIYVANFWAAGDRARMLRAAASVMDPPNPFTFWNFCSGCRVSSRGCARVNRLDWAHTQLHPLPTCVYSHERLKVYQGQEQRRGV

SEQ ID NO: 1008229 - protein, 132 aa, Homo sapiens
YEDLVNCFGLCRSSAAQPAGGAALCTGISWQRAGPCATPQGDNGSLEATFVKRCCHCCLLGRAAQAQGQSLRVQAHGWVPVWTGLPGHAVSKSQETGDLDCRGPPRKDKIIEVEAEQEDPYLEVIAGEEGGP

SEQ ID NO: 1008230 - protein, 59 aa, Homo sapiens
MFTFRCQRCHIYPHKCGTAAANFGTDLLCNVAKGSFYTGVTEMLRCTTFWNNGMSGRSR

SEQ ID NO: 1008231 - protein, 31 aa, Homo sapiens
MCFSVWASTQLCVPGKQVASYSAPTIRKHVA

SEQ ID NO: 1008232 - protein, 32 aa, Homo sapiens
MVIVLLGLEEQARLEGWRGVQCYRRRRVQRPR

SEQ ID NO: 1008233 - protein, 60 aa, Homo sapiens
LLRMLGLVDGFSGVTLLYPGTIGSVCTQSSCPAHVCRKSGALDRSRCQPVSTVPNPKQYA

SEQ ID NO: 1008234 - protein, 70 aa, Homo sapiens
MRSNQEYTPSSSQGAKPEANIQIQEIQRTPQIYSSRRATPRHIIVRFTKVEMKEKNVKGSQRERSGYPQR

SEQ ID NO: 1008235 - protein, 34 aa, Homo sapiens
TGALTSNSEGSRSALRSLEYLLLPGTALTFEGSR

SEQ ID NO: 1008236 - protein, 77 aa, Homo sapiens
YSEDRREPYLGYQGGGNPVNPRPELQNIEQRDNVTLVSQSQHNRGPLTTKCPALNNCPNTINRKSKANIRLQTRHTC

SEQ ID NO: 1008237 - protein, 53 aa, Homo sapiens
MNRHKENLKSKINDKRMTEICMWIKIGDVIKLHPPMEPLDQKTKAGNSYWLSN

SEQ ID NO: 1008238 - protein, 36 aa, Homo sapiens
VFCSVYLCLACDPGYLWTLGLLVLRFQISAFSVCVD

SEQ ID NO: 1008239 - protein, 54 aa, Homo sapiens
YVVEDHTHLLAVSTGMAITGLDLLLPPALHSGKSNSMHKRHIDLTHHTNRASIY

SEQ ID NO: 1008240 - protein, 37 aa, Homo sapiens
MARMVGLQKRVWLKKVLILLKYVFSWYNMIYQTSSLL

SEQ ID NO: 1008241 - protein, 67 aa, Homo sapiens
SVFLVQMGHPVARVGEGPVPLSQWEEVPRAVDVRVAGGKPHGSLHGGNMSMANRARPTERRYRHVCP

SEQ ID NO: 1008242 - protein, 53 aa, Homo sapiens
QCSSVMLQTALKEGEQIQESGFKPNGIPGGPKGLFLTQVLAIWHVQFLNKSGL

SEQ ID NO: 1008243 - protein, 38 aa, Homo sapiens
QAGLNGDSRVFRWWGAHSHGAACSSAMRFHVIQSCSWL

SEQ ID NO: 1008244 - protein, 47 aa, Homo sapiens
VREDPQCSSLIGQADSGAHGQSPITAEQPRAEGWLGDREMPQSRDWD

SEQ ID NO: 1008245 - protein, 82 aa, Homo sapiens
ATVCANNNHVMPTYKCLAISTKSEFLSSLHPFHIREELSPMCIILIYMAVTDEDTPRTEFDSLPRAMKLLLGSGVSTLVAKC

SEQ ID NO: 1008246 - protein, 68 aa, Homo sapiens
RVGLSSKAVEIQQISLQVLCALVTGRAICASGALRHKDFKLCSQVLSLTLQLPAYQVEDPTKVRLTHL

SEQ ID NO: 1008247 - protein, 150 aa, Homo sapiens
GDRGSSGALPTTSFPLHGFVSMAESWELWASAVGTGLFSNCDSICSLSSFSSGVDIILLLAGVIQAAQGLSQLAHRTVPLPPQVVTQCPDAVTLCYNLVSLLEGPVPPALGHIRPLEGFLQLLAQSLDLFRRIQPPCWSPSIHWSRSLIL

SEQ ID NO: 1008248 - protein, 72 aa, Homo sapiens
FGSLTLGYQCGGNPVNQDRLQNIEQRDKRDSGIPESTQQVTSHNQVSCLKQLPKYNNRKSKANIRLQTRHTC

SEQ ID NO: 1008249 - protein, 44 aa, Homo sapiens
SKDLGSLNLSLQEDNVGKELLEIQEFESSLGDTARAHLYKKIEK

SEQ ID NO: 1008250 - protein, 104 aa, Homo sapiens
DLIKVLEDMRQEYELIIKKKHRDLDTWYKEQSAAMFHGGSQSSLCRARQGDISTELNAHISMCPGGFDPAWRRYNALKFLLVENIVIADPCLWYSLQGSMDHCK

SEQ ID NO: 1008251 - protein, 43 aa, Homo sapiens
PAGCLYDGLPEPPVTPTRTNTTPAVSGLRAGVPVRSTSSYTHV

SEQ ID NO: 1008252 - protein, 39 aa, Homo sapiens
SRDPCGDGSQEHIMDTISMYKALSFFLLDYGKVLTFVLP

SEQ ID NO: 1008253 - protein, 60 aa, Homo sapiens
MDLVLRRSNEEVTSTDLTLVWPDFEVISAHKNPGAATEAQELGTQGVLAETHLQEGTRPP

SEQ ID NO: 1008254 - protein, 35 aa, Homo sapiens
IPLWVYLSASPGIDRVGPDAWCDLSKFDLPEEPSA

SEQ ID NO: 1008255 - protein, 121 aa, Homo sapiens
FFFFLEKGVSSVTQAGVQGGDLTTTSASGVKAVLVSASLVARTTGADHHAGLILVFLVETGFHHMGQAGLDLRPSSDPPTWASRSVGVTGMSRRARGTIISGIFFLGHPGVGNRWAGTFKG

SEQ ID NO: 1008256 - protein, 88 aa, Homo sapiens
MTVLRNKWNGESHRHIYVHLWTRVSAENLMEKAVRLKMNVRRSPGFCENGRCLNNPKELHLLSVMNGLTASPNQDECLDKTGRVTVHR

SEQ ID NO: 1008257 - protein, 35 aa, Homo sapiens
EYRASRFFPDGAFLYPLCIGLGFLLEIVSFLLTAK

SEQ ID NO: 1008258 - protein, 64 aa, Homo sapiens
MYHRRDKDQKEPANDIKEDAIAPRNLPWPKSSDTISKNWDPFTSVHLRKSPRGHPIGPFQALGA

SEQ ID NO: 1008259 - protein, 35 aa, Homo sapiens
PVYVGTSGDDTRVEHACRHPMSAAAGPVARSVPTS

SEQ ID NO: 1008260 - protein, 48 aa, Homo sapiens
MPDLITGRGHSRRLYRRRHRTVSVGFRKIFNPGASPVLASGHGYRSCG

SEQ ID NO: 1008261 - protein, 74 aa, Homo sapiens
MCAMETALCHPGVPPAGTSSTVMSHGALFLHLGFILSSSSSYVSSSELLLPRECPMGLLLPPCVILRHSYTEDP

SEQ ID NO: 1008262 - protein, 46 aa, Homo sapiens
YRCIVQGTRSLQVLSLLRLVTASGTGLREGPEALKTSPGSQDLNGS

SEQ ID NO: 1008263 - protein, 37 aa, Homo sapiens
LSTGKEDNSQHQACWKSHPENPQGFILTTAGMPLKGL

SEQ ID NO: 1008264 - protein, 93 aa, Homo sapiens
MTQLLIHGDVAEQDALNGKADRTKMIKYFGFIFNILFFFFFFGNGVLALSPRLDLQGLDLGLTCKLVPPRVHVILRASAVPITWNYGRPPPVP

SEQ ID NO: 1008265 - protein, 67 aa, Homo sapiens
DVRRVRKKAAPATTTHRSISTPFRGLPPVSLTSVLEQVGIQTTAQTTVTAHYHITHTLDGAVDHERV

SEQ ID NO: 1008266 - protein, 100 aa, Homo sapiens
DESRRCKGDIVPGVNGGRWKGVIRVTERSQRYIITHGGLPPGVRRLREPVILRLKYLVACKLRNTEPKHHPKIYLLYGSQFQPKVTAVFPAGVRSQSHTD

SEQ ID NO: 1008267 - protein, 62 aa, Homo sapiens
LRGSAGEFYYYCEEGYVLAGEDGTQCQDVDECVGPGAPFATGCDSTHKGPSIVVACKDGCCP

SEQ ID NO: 1008268 - protein, 42 aa, Homo sapiens
MILLLLPQGEATIGRVPVTSLLGSVTAALWLYCRGAAGLCMV

SEQ ID NO: 1008269 - protein, 140 aa, Homo sapiens
CPRRMIVLRRHREPGSHGCPVGRLPVSCIRELSTPRRTAFPYLSPSVSGSMKLSPSVPAGPVPWGLVSCWSEKSCENGPGEERAYGCCVELISSLPISIPLSTVQPNKLPVSIPLASVVLPSRAEEGEEHPQSRAQPRAG

SEQ ID NO: 1008270 - protein, 45 aa, Homo sapiens
LSEIVTLFVIDFKAVCSVAPTLPFQPCLVCPFKPLLTCASTGRAS

SEQ ID NO: 1008271 - protein, 50 aa, Homo sapiens
GRLGGWAGLGGPGWVTSRQWLSELEVDRVHPKLVRCAVSLTGQRCWACLS

SEQ ID NO: 1008272 - protein, 41 aa, Homo sapiens
DILPLSRLSPVFVTPASIGLSPNLVVTIALCVCSSACGSES

SEQ ID NO: 1008273 - protein, 69 aa, Homo sapiens
GSPAPVCAPPQLHPQTHSTHTHTHCTHSTQTHGTHTHTHAHTAHTQTHSTHKRTAHTHTQHTHERYTGR

SEQ ID NO: 1008274 - protein, 127 aa, Homo sapiens
TRAHTILPSLWIVFYIPLFSYYTFLLLSYYLTISSPPLDYLFIFLPAPSPLLLTFFLFSPPSSLLLLFHFSSPVLLFLLSCPSLLALPPSPLLLRLVFLFSYSFFLHLLFFSSSSPLAPSHSSFSFP

SEQ ID NO: 1008275 - protein, 94 aa, Homo sapiens
PSLSQRLCWCNFPDTLPLITAFTSPPDPTPHLLINSGNASPSAHELLGLSHFHLPTLAPRPALRSPMVYGSTRFLPTVIPFHFSSFSRYIRASS

SEQ ID NO: 1008276 - protein, 64 aa, Homo sapiens
RGTDATRAPRSHSGPPAERHGTMRRNVSTLSMSFLRAVEQPGSSGSSASWFVRRLRQTVLEVLL

SEQ ID NO: 1008277 - protein, 57 aa, Homo sapiens
QCAAVISAGIPMHLAGTCKASLASVFLHGHFPPRARRSNLPQPGGSRSSQFVNPWSI

SEQ ID NO: 1008278 - protein, 82 aa, Homo sapiens
DVSIISVRSQVYAEMSLLCISTTPPLAQRRRRYMKDSQVLLSSWDAVVNPFCGHLLKDCAIAGTFPPRPFIAGRKQVNGARK

SEQ ID NO: 1008279 - protein, 35 aa, Homo sapiens
MIRLYIFPFNSLVGLVGLDWSVPDAERKTGGSATP

SEQ ID NO: 1008280 - protein, 46 aa, Homo sapiens
TPGVYKCSCEPGYELAPDKRRVRGVMIYRLGNPCCGTDTVSASPRM

SEQ ID NO: 1008281 - protein, 40 aa, Homo sapiens
GSPARFALQAPGRPAPGLKCSARLGFPKGGDYRFERDTGR

SEQ ID NO: 1008282 - protein, 109 aa, Homo sapiens
LCGLLCWSLCRVWLLCLPRTVLPARFSLDLSPLAYFSPCRRKLISLGSFEFPPRKLRFLAFFFPPCSSVIAPLMDTRREDHRHEASLSKYTLTKRHSSLPEVIQNSLIL

SEQ ID NO: 1008283 - protein, 78 aa, Homo sapiens
LEDPDGMAHCNSTSQVQAILVASAPEYRDYRCVPPHPANFYYFSRDGVFTTVTHSWSLINLRVEYKESGTGAVGYASV

SEQ ID NO: 1008284 - protein, 58 aa, Homo sapiens
SVLEDPECTLCSELVTMWFLLYENLTLRSSLMAKAFVTCTQQHKLPYGANFETQVKSS

SEQ ID NO: 1008285 - protein, 62 aa, Homo sapiens
MQALAQLNRIFLQTRAIRIFSKDYSNGYKAGPRGLGKISFSPKLQSYIGTSRGLILPGIWST

SEQ ID NO: 1008286 - protein, 44 aa, Homo sapiens
MLSFNNCTITDALGTKGPSLSMRLLGQLRRNTTAYSPPLSPMWT

SEQ ID NO: 1008287 - protein, 34 aa, Homo sapiens
RGRTLTTHDTHWTTTLYDRRTDTSPTGLDGRTLR

SEQ ID NO: 1008288 - protein, 83 aa, Homo sapiens
MSECRADVAYRWAVRRRICIYGYKYSKYTYAVMTTVPLEYSQHAKLKALISIARRSVMMIIAIGSIYRAGVIITSGRRPMIRI

SEQ ID NO: 1008289 - protein, 67 aa, Homo sapiens
MNPMVQRYKVRCSRLKSTYLSQNGESSRFIYFKFFLYERTEKEGYQSAFPVKISSQLIIPTPTQEQG

SEQ ID NO: 1008290 - protein, 98 aa, Homo sapiens
MAWTQEVELAGAAVRSRVAPGRYLVGGGRQRVPRGPHRLGGSAGLAQLRLNDWGAARNEAPRAAGRSPGRLFTLSSEQARPSARASAITSSGCTVRNV

SEQ ID NO: 1008291 - protein, 115 aa, Homo sapiens
TSCPFQPAICDSFPLSQHLGPAFDTTPKASYLACLESAPGALLLGHGPDRGPGAWPAGPCGHLCSILDYSASGTASGRCTKPPALWPPKPRITCSPTAVARPCPCRFPITYQGLP

SEQ ID NO: 1008292 - protein, 68 aa, Homo sapiens
RTRLRRQVPPALDHLGSMLFSLLLVLFGLCQDLLTRGARCHPRSRMQSFIMGLQLPQLFDGFVPVLVG

SEQ ID NO: 1008293 - protein, 70 aa, Homo sapiens
AHEAGPRCTTQKARSLVDSVLDVVRKEAESCHCLCDSQSYPLPAVWVTGVCGWVPFLIQRDPGRMYPDSV

SEQ ID NO: 1008294 - protein, 110 aa, Homo sapiens
SFPLTRKEAQEKLVAGRDRRPLIAEADLASLIRRFMLVQEELDRAPERLATALHNLEEADKAADESERRMTRSSKNRAMKDEEKMELPDMPLKEAKHIAEDSDRTCDEVA

SEQ ID NO: 1008295 - protein, 71 aa, Homo sapiens
MHYRGEMILLWGMPDGRAVPKTQSSFSWNSYVPSKKKDSDIGLVLHIFHHLSRETGKQLYDSETPSSQAGS

SEQ ID NO: 1008296 - protein, 154 aa, Homo sapiens
MAYVVFMQCDKEVKVRLLQSPGHVSIQTPSGVEGSQAERGGRGRPCPGSPSNWDRASDGIPRARLPFPPQPNSGGGGAAVTRADVGDRFGFKQRKEPSAVNPEGHPALGSRLEKGCVAGVTEPGFDGDGMVWMAPVSPWGSYPVITNAGEVTVD

SEQ ID NO: 1008297 - protein, 67 aa, Homo sapiens
GVSCRSNSWYSHEQQSLSVRCAGSMSGERLAGVGGLEAGRWLLGDVQSSLLGGCGSSWGELDSDAPV

SEQ ID NO: 1008298 - protein, 40 aa, Homo sapiens
VSSPKMSCSPQRELCMSPSNQAQPPGPQLLPSSPRLWILH

SEQ ID NO: 1008299 - protein, 64 aa, Homo sapiens
VLCHDYGALSQLPQDELMPQRELLNVTKKPVPMLHGPNSARLYPALDPALLTLDSAAHGKNRIA

SEQ ID NO: 1008300 - protein, 31 aa, Homo sapiens
MASLEDNHNGRHTAPGNEGHLTSIDSIQEML

SEQ ID NO: 1008301 - protein, 41 aa, Homo sapiens
TYRKDVDRVTCLKQEAGDGEHPRMHRHNKQWRSRDSTDYQG

SEQ ID NO: 1008302 - protein, 62 aa, Homo sapiens
MPIKIELNWGDSHPLTPLRSGSYQLLQLLAKSTLTRMVITAKIIRARTACWTLFSAPYGGET

SEQ ID NO: 1008303 - protein, 42 aa, Homo sapiens
CGTGVGTSGQERTGEGHRMYSGTRSTGASKRRGLTKRGTELE

SEQ ID NO: 1008304 - protein, 57 aa, Homo sapiens
HDYGVNQSPDELSPQRESDVTSTRPAPGPNPPALPSDLHLTSICCHGKNRIVLMNTP

SEQ ID NO: 1008305 - protein, 72 aa, Homo sapiens
VPEHVMVMPVLAGSMENNLGPLMVWFLFLCKRTIYMLPLACIFLQQIPFDFRKHNTWLVLYFMAGGGIQDNK

SEQ ID NO: 1008306 - protein, 34 aa, Homo sapiens
LADAYYTCTHSTQDGCTHTHTHASPQLHTHNTQH

SEQ ID NO: 1008307 - protein, 118 aa, Homo sapiens
MRDVDQASITLRECSLSSDGARGPALVSVTRQVYSRVLSGLLRARVILIVPEAASRPPPPPRRPRTYSSYKRSEPSSGAGALVFTQYSVSVLSTFTPSRSAFTLVPRTCFRIMSVYSL

SEQ ID NO: 1008308 - protein, 52 aa, Homo sapiens
QQQHTETHKDTAHTGTHSTHTRTQHTRTQHTQHTHKHSTQTRSTHVAHESTH

SEQ ID NO: 1008309 - protein, 43 aa, Homo sapiens
MLRRSRDPGVTKNVWSPCIEGEDYKLLTVEAEAAGKKIHENEK

SEQ ID NO: 1008310 - protein, 105 aa, Homo sapiens
MGDVPHFNTHDLGHGAGGSRCNPEQLLGTAEEVWISEVEELRDQLWPRMVKPLTPSKEYKIYSQCVVAWRSIIPCYSERQSVACELKITPRALHAWCDRCETPVS

SEQ ID NO: 1008311 - protein, 80 aa, Homo sapiens
NPRNGFSRILRIHTRRHHITEITDFSTVLTVVTELVKGGMHRNGEYTSTRLHCYRYWDVITVLTCLTELVQERLHRSGEY

SEQ ID NO: 1008312 - protein, 81 aa, Homo sapiens
YNLRKRDIAGILDYTGGAVNRDTDFSTGAHDVRRNLYKAGMHRIGEYTSTRLQCERSVEVSTVLTVSRNLSREGMHRTCEY

SEQ ID NO: 1008313 - protein, 73 aa, Homo sapiens
HASGTGGYHLKSTRLQLNDIWRSARCSRVDRNLYREAMHRRDEYTSTKAPAKRDRDVSTVLTYPHNLSTNACT

SEQ ID NO: 1008314 - protein, 61 aa, Homo sapiens
RIRSSAGCSLLSTELVQAGMHRSGEYTSTRLHLNDLRDVITVLTCRRNYVQGGMHRSGEVH

SEQ ID NO: 1008315 - protein, 74 aa, Homo sapiens
ATCILLVVSRVPGSGERMQQKSVSRSNRMSISTYGLVVPVSHIPVDFPCGQWDASLKLRRIGYMLDPWMSSASL

SEQ ID NO: 1008316 - protein, 31 aa, Homo sapiens
MCLLCQGLRCYYRRGYCMSSKSRKISDYEVL

SEQ ID NO: 1008317 - protein, 37 aa, Homo sapiens
IHRDTEVSTVLTLIDGTCTEQACTATGEYTSTMAPVL

SEQ ID NO: 1008318 - protein, 51 aa, Homo sapiens
MIDGTLYRGGMHRYGEYTSTRLHLNDIGRSARCSPCLTELVQGGMHRSGEY

SEQ ID NO: 1008319 - protein, 40 aa, Homo sapiens
MAVVSGRCCAGGGGYSETLRQPASSEVPTTCLSHLMPPGQ

SEQ ID NO: 1008320 - protein, 145 aa, Homo sapiens
GSTDWRGLQMAREMALSISIILRGLRPLGHRNEKRSEIPYIQAFFILRNHPSLCHSCSTFQILLTSSKPDSSPVTPPTDPADDSSSFEPVDFLPPRQHLILHQSIMILHRMSLLRLYPSPPLSPTNPLLTLSPLCLLPSPALGRK

SEQ ID NO: 1008321 - protein, 124 aa, Homo sapiens
MIVPYRAPCSHIQVTLMEEVGSHGLGQLHPCGFAGYSLPSSCFHGLVLSVCGYSRCMVQAVSGSTIQGLEDSGPPLTAPLGSAPIGTPCGGSNPTFPFHTALAEVLHESPTPAANFCLDIQVFP

SEQ ID NO: 1008322 - protein, 108 aa, Homo sapiens
MQQECINLTMYYPEAKKQPVILEQCVMVIASLESNLLVGLLKDLAQSGGCLYQPPHQRKDTYLLGTYKEVIVIAVRGVIHQVVGEHTPEEPHGLQPRLDEQQGDAEHL

SEQ ID NO: 1008323 - protein, 95 aa, Homo sapiens
IDQSDLHGTLTCDTNDPPQIADFTQYSPPRRPMTKWPLPVCGPQQQRMCDKQRTRPSGHASAAYAKLTLPFSKPNAMSQIALANMGTPSTTSDPA

SEQ ID NO: 1008324 - protein, 42 aa, Homo sapiens
DSRFLWTAHLVAIGSRAPETSLAPGLEPCYCHALSTRGRPLD

SEQ ID NO: 1008325 - protein, 85 aa, Homo sapiens
SYEYHSYTSSIFCSYVLCELISQSRSCCPAGQRKEPTVMMQRFSNASSCGCPMMHSLTIFTGKHHQNRQLDSPRKQRAEPPRSPC

SEQ ID NO: 1008326 - protein, 118 aa, Homo sapiens
RDRFLWCSTTYNFEKEATYGFCPHEALFTMGGNAQGQPCNFPFRFQGTSYYSCTTEDRTDCYRWCGTTEDYYRDKKYGFCPETAMSTVGGNPEGAPCDFPFTFLGHIYESCTSASRIV

SEQ ID NO: 1008327 - protein, 125 aa, Homo sapiens
LLPSLTYGSSYQRKLSYRSALAPLCMLSRREEGESEDLACRLQLFPARVWESWSGLSLLLSTQHQEGQHRFNKELTKERDALQAGAYTMNTLSTEDLKPEKSELEETLRVLVTEKAGHAAQLGRI

SEQ ID NO: 1008328 - protein, 40 aa, Homo sapiens
PRGVGERKPDHRNLINIQATQSTNCVFLYACFILSFWTFT

SEQ ID NO: 1008329 - protein, 40 aa, Homo sapiens
MALSFFADISDWRFQYKGMFCPKHQGITGQSQPFREGMSP

SEQ ID NO: 1008330 - protein, 46 aa, Homo sapiens
DGVQVWLHRQMRLHGCEVHEAGEVVGYGWRVACAQLNLVQGSAGVL

SEQ ID NO: 1008331 - protein, 37 aa, Homo sapiens
RVQAGPEKIPAVLDSEQWKLSCLPDLEGHGGARNLGQ

SEQ ID NO: 1008332 - protein, 52 aa, Homo sapiens
MGSHKGSKLCPEKIPAVLDSRAGKLSCLPDLEGHGGALQLGQGTAGSGVAIY

SEQ ID NO: 1008333 - protein, 37 aa, Homo sapiens
RRVLVSRPDPTGCCYAARRRLGSPDFQEEAPQCDTNQ

SEQ ID NO: 1008334 - protein, 43 aa, Homo sapiens
RRSRVSGTLVCQSSVTQGALLAVPSLEFSKAGHGQYHRLRSQA

SEQ ID NO: 1008335 - protein, 58 aa, Homo sapiens
SVTIVAQITITGQVCGEELCTAVFTLPVFPWDAFLLFQDPALHSDPVSLGSFLLRPGM

SEQ ID NO: 1008336 - protein, 89 aa, Homo sapiens
GSNGGRLKTQRTSLSWLVEVTLCNSCCCCRILGLSRGTFTLYCPRLSHRLAFGEEQAESFGASVSVLSCLHRLGFASCWMLGSCCDPGC

SEQ ID NO: 1008337 - protein, 40 aa, Homo sapiens
LHLCLSDNLRMKNDPLDWNGDHIHTNFRDMYQHLRSMGVL

SEQ ID NO: 1008338 - protein, 43 aa, Homo sapiens
MYRVMAYFWYTKTRALLATLVLTQQTGLVDHPCEGDVTRAVWG

SEQ ID NO: 1008339 - protein, 59 aa, Homo sapiens
TDSAEHGLSLQQNHLQEEPLLYEYLRASLVLLSPQPMCYLCLVTISYFRYMTKRPGLVW

SEQ ID NO: 1008340 - protein, 73 aa, Homo sapiens
MLYEDPRAHLCLPGLSDPPASVPLSSWDYQRVPHACVILYFYVARGFHICVGHVINTPGLNGLHPPVASQTCY

SEQ ID NO: 1008341 - protein, 68 aa, Homo sapiens
VLPPEISSFQPNLLYTRCKRHPDEITAVRSAAPNHQRLRPGCTAPESARRRGSSRLDLGRLASCRPWA

SEQ ID NO: 1008342 - protein, 68 aa, Homo sapiens
PAPAQVCSSGAVILMLSLGLEFAFLYRGSYCDCKCVRSLILLRSLVLRTAKSVGYLLEWLRRLAFMSG

SEQ ID NO: 1008343 - protein, 68 aa, Homo sapiens
SIIECYRSRSDPELLPQLCAAVFRQYAKDIGSLSGLNALPSEDYPGHLLDEKPLINFFVFHNTFEKTL

SEQ ID NO: 1008344 - protein, 43 aa, Homo sapiens
AAAKWNSAMPRFLLDTSLEPPLCGQTLCDKKRSLPATISSPGG

SEQ ID NO: 1008345 - protein, 60 aa, Homo sapiens
MALLIYKPRPTVISSQERLELAYLSFGQCRVECLVREEEEGLGFISGALYVKGSLAYCTE

SEQ ID NO: 1008346 - protein, 69 aa, Homo sapiens
AVLGWRTCAASPVLKITPLKATQVGPIKTLQIDEKDGQEGEGIEPVKIDDSENLCSKIRQPFPHSTLIP

SEQ ID NO: 1008347 - protein, 126 aa, Homo sapiens
YLSEEPEPYLAVYLHSEPPPNERHCSAAHGSWCAGQYSTGKTSFIQYLLEQEVPRSRVGPEPTTHCFVAVMHRDTEGTVPGNALVVDPDKPFRNYNPFGNTFLNRFMCAQLPNQVLESISIIENPG

SEQ ID NO: 1008348 - protein, 50 aa, Homo sapiens
LGHKEIGAQNQKKTEGAQVKKAERSPRQGKKRRGSSQSQVKNGRRLLHQG

SEQ ID NO: 1008349 - protein, 100 aa, Homo sapiens
QRLRPGGTCYHQGRDSPAVCSPSSLYPQRRPMCPRVSPARRAGLRAVSGRGNLHRDKAGGAPGTSPSPHSPGTGGHPASPSRVSRSSRTPPATFLHITVF

SEQ ID NO: 1008350 - protein, 44 aa, Homo sapiens
VTVNVPTAEMLLCTDCCQVWFPALTVVLENNKDNFMSEKRRVMG

SEQ ID NO: 1008351 - protein, 75 aa, Homo sapiens
TLKERYQQDRGHQYAPAHRGCSAENFPEELATSQRYVRRLDFFERPDYYYLRKLFTDLFDRGGSVYDYKYDWAGK

SEQ ID NO: 1008352 - protein, 37 aa, Homo sapiens
TSAAAESGGSDPAQARRPVTQSTNRMAFYLACCSPTG

SEQ ID NO: 1008353 - protein, 49 aa, Homo sapiens
QEFATVRSWEPLDKSTVVGPMAATMRASVLLHAPGPGQAWPTTVSSNLW

SEQ ID NO: 1008354 - protein, 36 aa, Homo sapiens
TSVDNYQLSCPVQSTQHSNQGLELEYVIMHLAHPFS

SEQ ID NO: 1008355 - protein, 113 aa, Homo sapiens
RYSRGSLLSTSSVTPGPAKRVWRHGGHVTALESLIEMGFPSGRAEMALALTVNQGIEAAMDWLMEHEDDPDVDEAFRDSPWTYPGTGAPFPQSKGGLKGIVGSAAGKGKTRLE

SEQ ID NO: 1008356 - protein, 164 aa, Homo sapiens
CLSLYDISPAVVLPLSSQLLLPPLPGSAPAGGTSSVSDLFRQLPLTALLLCCSFWCSFPAMAFLLGQPGAPPPVLSASLRLLLESSGQPHCPPGFRAPSCRASLLDHSLSDRLSACPSAGGAAEVHGGGPGGTENRPDERKEERGVPWHGKARCWPGCGLSVCD

SEQ ID NO: 1008357 - protein, 48 aa, Homo sapiens
VTLQELILYDICDPHRRWFFSDPQPACPSSDPHPACRFLWALYNWLFI

SEQ ID NO: 1008358 - protein, 40 aa, Homo sapiens
RTCRTRDDGPVGLRDDGLTGRRDDGLLGRRDDGLIGRRDD

SEQ ID NO: 1008359 - protein, 86 aa, Homo sapiens
MSRRTTRMMAHCRRRHMHLGYKYPDIRSRNVNNRYSRTIASMRRGALISIARRSVMMIHCIGSIYRARVIITSGRLSMIQNSESCH

SEQ ID NO: 1008360 - protein, 42 aa, Homo sapiens
RRSAQISSSEFAAHYAYRCAVRGAIIQAIYPSIVAVTYNGTL

SEQ ID NO: 1008361 - protein, 99 aa, Homo sapiens
TVLVMAVGTGCTEEVVAVTGEAVSVIATRYCLITAELLMSDQQQTLDPHRSMNPIVNCVCKGSRLYARHENLMPDYLSLSPITPRWDHLVEGKQAQGSR

SEQ ID NO: 1008362 - protein, 45 aa, Homo sapiens
MRILYMTQACILRGFDVYSPLRCCSLYKFRRHVSPVLTSKYRKLE

SEQ ID NO: 1008363 - protein, 38 aa, Homo sapiens
PFIHCPDLYALLLLFSSVGFWIGANDNLNDTSLSYSGG

SEQ ID NO: 1008364 - protein, 78 aa, Homo sapiens
MKYQVVEGEQQRKTCQGKCYGHDALIQLVSAKAAEAIRAAAQTMLPERYSRILHNSFTDGSNSLQDRQTANYTMYVIE

SEQ ID NO: 1008365 - protein, 35 aa, Homo sapiens
MLLLPGEVLSHEGWQVPRTPCHITQQLLVESAEPS

SEQ ID NO: 1008366 - protein, 33 aa, Homo sapiens
SGTDRRQICDTCVKMQLCSIIIIIIRPRFLVQS

SEQ ID NO: 1008367 - protein, 33 aa, Homo sapiens
RHEARSKQTNTETENQTLHVLTAENQEKNNSSM

SEQ ID NO: 1008368 - protein, 40 aa, Homo sapiens
ILLVQRLVRPNRSVIQAYGARYVPSPSRAPVAIDTYQEEE

SEQ ID NO: 1008369 - protein, 32 aa, Homo sapiens
MRANLALLVDAKEIKMHLGALALDEKVAQLEI

SEQ ID NO: 1008370 - protein, 63 aa, Homo sapiens
FSSSCDTVEQSEPAVVSCAPGACWHEDTPYAPQMTEVLTSVCKNLWAPLATPPCLGTHEGNSS

SEQ ID NO: 1008371 - protein, 38 aa, Homo sapiens
YESSSSFHDGYQVLRGGLRVSTDTASAGCCENRRHQQV

SEQ ID NO: 1008372 - protein, 45 aa, Homo sapiens
YGILLLLIEISSTAFLNPIIHKHHGIIDGRALEECRDFLKEAVIH

SEQ ID NO: 1008373 - protein, 55 aa, Homo sapiens
FANTVLSGVPTMYLGIADRMQMEITALAPSYHVSIKIIAPPERKYSVWIGGFPLP

SEQ ID NO: 1008374 - protein, 116 aa, Homo sapiens
PGDIQKSLQKQRQTLTFQNPTTDVGKQSTKETRKPKIHGSGHVEEPASPQPAYQNISQQETSKLHNSTADYNPCVPCPVMQHKMQSGTFLQASMAKPKGFKPPMHSPARGPSWGLA

SEQ ID NO: 1008375 - protein, 55 aa, Homo sapiens
LEDRRELTLEITSWTVDFSKPSHVLNELLGFLESAPLWKVLLRSQEPLEDLTFLQ

SEQ ID NO: 1008376 - protein, 57 aa, Homo sapiens
GSREQFLVGHVEQRCSWCFQELLQVLGDLLEGGQALPQLQRRVPRPCTCERTTLLHW

SEQ ID NO: 1008377 - protein, 33 aa, Homo sapiens
TLKDPRFKARNFPYQTDLSAAMKESWEHGLSPA

SEQ ID NO: 1008378 - protein, 65 aa, Homo sapiens
QCTLDAAGTLDGPRQARESQSILYMFEDSAVLPQPDERVPRRVACFGERGARGLGHEKPQGDVEP

SEQ ID NO: 1008379 - protein, 66 aa, Homo sapiens
GESRQGRDMVLSIFQIASEDETVYPGGVDDKSGSHKDDFYDAIIFEIFTVEFCPPSLSTYTLAEVN

SEQ ID NO: 1008380 - protein, 67 aa, Homo sapiens
VTAVTNDATPSWGHVTAGRPDTTGLSPRQLSTNTLDTRRRFDSHTFTTPPHPTFNTYPTCSYLTRDA

SEQ ID NO: 1008381 - protein, 61 aa, Homo sapiens
VGGERLDVYYVEHLCNVLFSFFDRISLFLPRLECNGAILAHRNLRLPGSSDSPASASRVAG

SEQ ID NO: 1008382 - protein, 33 aa, Homo sapiens
FTYSKFEQTHTNMTHVSRTTGCSHCFRKDMDKV

SEQ ID NO: 1008383 - protein, 94 aa, Homo sapiens
LSGSLTLKVLSCEPSSVWASSVDCSCGTSVGACLSPSCHETEAKPYHAQKAISHVKQSNNQCSSNSISSPSIHAMHPHSQSLSRIIVRQAPSTH

SEQ ID NO: 1008384 - protein, 144 aa, Homo sapiens
SIRDLDLPRTYSESYRSLPGAERERHSMWSRTRGHPSVCAGPGACSGCVSGFAPWLILERPWCLVLRPLGLESLQQGGTTEQLCIVIVGFGAFGGSLVTGNCLCACVGCMLPGLSWPRTGKASPSHPKPLVELLWNHLPKAQGR

SEQ ID NO: 1008385 - protein, 91 aa, Homo sapiens
LDGSGRLPREPSPPGALTSGSLNLRAEGQRQAAESAVFFSVPMCKHCTSFTAQTGTSSPAPHFQAGGLLACVSMAGFTGSLGVTELAIRHI

SEQ ID NO: 1008386 - protein, 107 aa, Homo sapiens
RDPGSLILEIDPCRGRDSTSHHSCRFEEMCQTLLRPGAVRKPADASWKGQIHDSSWGEGPLAYPKCRSCLQDFFNGKELNKRIPDEAVAYGSAVHAGRVDGGQTVRK

SEQ ID NO: 1008387 - protein, 74 aa, Homo sapiens
MSRDLDNIEQRMFLKMNLKKVTLRLFYVGSERGSRADLTVVHRSEKEILPYFLSLHLKRGNLLRCVPSTVGSRS

SEQ ID NO: 1008388 - protein, 38 aa, Homo sapiens
MAVRSCVSFQVERVCCDEVISCNAPAPEPEKLSESSPE

SEQ ID NO: 1008389 - protein, 120 aa, Homo sapiens
IAARVPIIYRRDSMTGILVIPLRLRVPAGHVHDQYHSEPQMTRGQNCSVHRDLGYSIGVQVLGGLEPVTVRTVSVQRSTAPFLSISSKRFRGTLIPPYTPSTRGQDGLIFLTEYSSFHTQ

SEQ ID NO: 1008390 - protein, 129 aa, Homo sapiens
LGANRRTLPGYAPVWGLAGPCIIWATSKRDKDSAKWWQLGRGGKTAETERQQWVRDKRQQWARQQETVKQSVIEDVVKLVDSQVSIVQLPRVGPTALTSQPPTQKLSTPKLGNLERPAPGSHVEDGLVP

SEQ ID NO: 1008391 - protein, 46 aa, Homo sapiens
IEFGRKISLSNLMVEAGRGVSGCDGVLVAFCKQNALRMNRSRVRVP

SEQ ID NO: 1008392 - protein, 37 aa, Homo sapiens
TNSTSKSSEPQENAGEEQRENHNRKTNAPQYPNSMNT

SEQ ID NO: 1008393 - protein, 34 aa, Homo sapiens
VGALHLLRSLFYMKAVLVTRLGKGIGITLPKVYT

SEQ ID NO: 1008394 - protein, 38 aa, Homo sapiens
MSWDPDAECWKKPRYLGASSRVKRMLEVRLNFGKSKVL

SEQ ID NO: 1008395 - protein, 51 aa, Homo sapiens
MTPGVVHASPPQSQRVPRKAPCEWAIRNIGQKPKEPNCHNCCTQDGHLHLH

SEQ ID NO: 1008396 - protein, 70 aa, Homo sapiens
QEDPAPTGVRGQEEEPRAGEKERTGTEYCMGRSENQLMDKGQRYPQLGGAQRRLALYPHSNGSTALRSVG

SEQ ID NO: 1008397 - protein, 43 aa, Homo sapiens
MGASLGLGLLLQVFFRMFTVRLTFGPELLRGSCGIQRVLQRLF

SEQ ID NO: 1008398 - protein, 57 aa, Homo sapiens
GCTQNTNGAFFKVIYQNKNEEVTFRRSEEVKIEPIPVCAPFPFSRHRVLSSGRDYGN

SEQ ID NO: 1008399 - protein, 67 aa, Homo sapiens
LHPEGVGEVVSVAENALWERMTGTGHDQCYSTVGTEAASQFGTVNGKYVKPFTLPEAGDANGPAQHL

SEQ ID NO: 1008400 - protein, 67 aa, Homo sapiens
YNYRQHQVPQNWAQNTCHNYRRPLSTESTLQPNGNTRHSLHTTHYYILSYLHSLAGQVQPFSPSVPA

SEQ ID NO: 1008401 - protein, 30 aa, Homo sapiens
MGVGYACPTCTRGPTHVSHWSPPWQWRNRV

SEQ ID NO: 1008402 - protein, 129 aa, Homo sapiens
GPAHEPHPPHYGRLDRSDGGISRLTAGCRSNEIQIPRSLAGCRWNSPLGNSNFGFLIQRDVLDSNLWNFLLSKGTPGVLSVPWTRFGFFFFLSSFFSIGGTSPFSRLLRLRPVLQGLLMPVASRWQLPF

SEQ ID NO: 1008403 - protein, 77 aa, Homo sapiens
MGFSHVAQAGLKLLGSNDPPTWASQSAGITGVCRRTWPPVAFYTQVLVPLWLAQHTPFHRSSFGTPVAVRLPRTRDG

SEQ ID NO: 1008404 - protein, 94 aa, Homo sapiens
MRGATKTVGMKVLREVKVRAGLQHPNMVGYHTGWIEQCHVIQPRADRAAMEWPSREVLSDQEEDREQGGVKNDESSSSSIIWAEPTRSGGAGTG

SEQ ID NO: 1008405 - protein, 176 aa, Homo sapiens
CAEVYLEDPAHPEGVGHGWGAEVAIAVNLYSALTVASSNYRGIRKGGVVMLILSKARLFRENLIRYGIRVDPIQVVSLSLKDPYSWPAPCLVMAANVLAGGCIPGREAAWGVGALTEQAELLLHVANRATILCSPGAVVLTGEESITPGGSRWALMAHTILFLKLFSNRDVNSWVA

SEQ ID NO: 1008406 - protein, 179 aa, Homo sapiens
MGTASGASDWSGLRERPRPGVGAQAGAAVEEEEREVVRVRVKKCESFWRPEFRSWAVDPQITSLEVWQHILIRALDWSGKKTLGISYRGRDRLGQEVYLSLLSEGDLSTALATASKPYRQWRVDIRPSEDSPWLEDGDIISPKDVMGSDVWLAENRSSLTRAALPFTQSILTQVGRTLS

SEQ ID NO: 1008407 - protein, 55 aa, Homo sapiens
SGCLSNAGGGLFVHHLVLDPSQQWHRLVHMTSPWGGSSPAGHTRPWVLEEVLSSR

SEQ ID NO: 1008408 - protein, 33 aa, Homo sapiens
MLVNNFSQADPDFQEVKENGRIYLKIHYIEMEP

SEQ ID NO: 1008409 - protein, 42 aa, Homo sapiens
NAAVTFRLWPVKVLPTVFLQSCCLPECIRRHGAAHFPFAPLH

SEQ ID NO: 1008410 - protein, 70 aa, Homo sapiens
TLDAEYTHILISTASFDRAPSSDLERFTPTLGNLVVPRSLGGHHTLMPNLVRTPDTAQCTNMPRNSLGYK

SEQ ID NO: 1008411 - protein, 55 aa, Homo sapiens
LANVYLPAECSFPSRRGAGKDSDPQEFSAFNNCEEKERSQPQTPGELPALKGSND

SEQ ID NO: 1008412 - protein, 45 aa, Homo sapiens
MGGLRYTGYYTTLTFNETCFLTFDHYHHYWRHDNVHLCEHDLTFT

SEQ ID NO: 1008413 - protein, 170 aa, Homo sapiens
MMKLWYINGYVCSFCFKQIKRSTSWTNRRALNSNCPSTEKCFTAKVIFPVIGQALIEFSVLLISNIVGISGPDGLGFVELFWIDVLFLNLLLLLLVTILLFFFLIRTNIFNFRFVFRLFLFFFFFFFFVFLFFSLIIAYFFITFLLHKKSNGISNKLRMFLHNLLYSSFR

SEQ ID NO: 1008414 - protein, 67 aa, Homo sapiens
RDSGIPDNDVVNRTRFTSGSRGSRDQSCEHSISFMASNRSEPQNYAKCTFEYLLSLVTKIISQASKN

SEQ ID NO: 1008415 - protein, 44 aa, Homo sapiens
MNETKLLSLIIYKKSTQTCITDLNERPQTIETTSKKTYEETLQI

SEQ ID NO: 1008416 - protein, 84 aa, Homo sapiens
MDPKKTVNQTHQKPLEKENYTCAITTVKARDTKAGKWSRWECRCMYTDRLKTRPFPIHGLMILTRHDRHPNKRLPKRENRLMVR

SEQ ID NO: 1008417 - protein, 80 aa, Homo sapiens
VARYYEIAVVITVRRYAQKVGHAEIRQERLLFIYVQEFLKVGKIKKQEEFLTLGITLATFLSSMFPGGFLELLCHCFRQI

SEQ ID NO: 1008418 - protein, 78 aa, Homo sapiens
RSTGWSGRYHLCSMNVTVGVRTAADFWISFMRKGDSHCVHHRPEISFTVLPARNAASKHSVALDLSTHSPWVEHGGVC

SEQ ID NO: 1008419 - protein, 56 aa, Homo sapiens
DERKGQLKKQREYTFLLGPPWVSRRKEPRSLQYHSQAFGYLRYKLDPAGRYPSLEI

SEQ ID NO: 1008420 - protein, 51 aa, Homo sapiens
DVWDEEVVEMRKYWDEERTGMRNVLGGGTYWDEERHWDEERHLMHYCPVSN

SEQ ID NO: 1008421 - protein, 34 aa, Homo sapiens
MALGDWRSLAIAAAVGKKGCPASWFSLWTPCMIH

SEQ ID NO: 1008422 - protein, 49 aa, Homo sapiens
MSKYWDEERHWDEERHWDEERHWDEERHWDEERHWDEERHWDEELIMGI

SEQ ID NO: 1008423 - protein, 61 aa, Homo sapiens
LWLTRGPGMRNVLHAFITIGKVDGLLPEKRLAPPLYQFLMNGILTVHPMGWLERWWLTCTQ

SEQ ID NO: 1008424 - protein, 33 aa, Homo sapiens
DLEDLGMRNVTSERFLGSGDALLQARPQIRRRA

SEQ ID NO: 1008425 - protein, 49 aa, Homo sapiens
SCRTYWDEERHWDEERHWDEERHWDEEQSVWMRNVTGMRNVTGNKALEW

SEQ ID NO: 1008426 - protein, 133 aa, Homo sapiens
IPICRFHQKGLQTIVNKLCSCSLLRPTHSPYNTPILPVKQSDGSYRLVHNLRAISQAVLPIHPIVHNPYPLLSLVATNTTLHTAIDLKDAFLTISLHPDSQNLFAFTWTDPDTLQSQQLTWTVLSIPSIHPSS

SEQ ID NO: 1008427 - protein, 74 aa, Homo sapiens
EPYLPKSRCIALQVDTRQGHRIKARTPSMAAGSQMLCVNQPDLRTGPSVKMNDHRSRLSGRGLVLKLCSRYEPS

SEQ ID NO: 1008428 - protein, 103 aa, Homo sapiens
GRAGSASRRVCSPSRWTAAQLAGSAGSEVLSPRGLVDAVNMVDNGDGTHTVTYTPSQEGPYMVSVKYADEEIPRSTFKVKVLPTYDARNSDCQWPRTKFLWCA

SEQ ID NO: 1008429 - protein, 34 aa, Homo sapiens
KRQGATSTPGDTANSRSHMPTPGATPDTRSHCQI

SEQ ID NO: 1008430 - protein, 36 aa, Homo sapiens
VSDCLLDQPLSCPTCPKLDTSSSPNWLPPPDLPSFI

SEQ ID NO: 1008431 - protein, 42 aa, Homo sapiens
GSRPVSTISMAWHSMAAGPVAQMAWHIIGSRSSGPISMAWHS

SEQ ID NO: 1008432 - protein, 109 aa, Homo sapiens
MRNVTVNRVQDLRRRPALQQAAWIQEVIRLHTEPGLSQRAPYLAELCPGEPRRPGNSDTRGGAGVRVHFFPNGRLQKRSKLFFRFPLARDPAFYWEPKEEKGLPGLSLR

SEQ ID NO: 1008433 - protein, 35 aa, Homo sapiens
WVESILCGISARNVIPVQMYTVKKIMSCLTSSEVC

SEQ ID NO: 1008434 - protein, 37 aa, Homo sapiens
MRSARKYFGARQQRAHVGRGGQVRRQFRLVCTCVRPR

SEQ ID NO: 1008435 - protein, 115 aa, Homo sapiens
MLHENTVSQGSRCLSGWAQGTLQNCFSLPCQASYPTPCTVPLTLGSECYRCVDTWGCHCVLLWPSSAVASLVSEPLTMQLLAGLYQALGRTVAGGRDLTGVRSHSRAQVPNKMVT

SEQ ID NO: 1008436 - protein, 39 aa, Homo sapiens
SDLLTRDLPPRPPKGAGITGVSHCAWQPVAFNCSAETPG

SEQ ID NO: 1008437 - protein, 77 aa, Homo sapiens
YQDLHTGFEYKVEEQSVDISSEYFSRLEQWFLGTDEVEPESLGACGKDNPINMYWVELKRRGESMKINQYNQSFTYH

SEQ ID NO: 1008438 - protein, 92 aa, Homo sapiens
WYRSLLCFTVSQGCDAFMGDNYCDAINKRAFCNYYGGDCCTFTVKTKKVTHSLCSVIYKVTVLVGDPRPKNTGGKNSGDTGSGYRKDQKLAK

SEQ ID NO: 1008439 - protein, 141 aa, Homo sapiens
ITYPSEHTAGMGVELRAGLEENQARRPSCLEPLSAPEEPPMRGPFWPQIPSLRKEGAGFSVRSSLPHSDRTTEPVASAHSEGAGLPHVELTHTSANVSQKKNAISPPIVNQNYCRPWGSGHMPSCQAYLGGRQRRRGVGYQ

SEQ ID NO: 1008440 - protein, 145 aa, Homo sapiens
GPSLPLLALCGCRLIPLSHLQLGARPSLCSLLDGSFPIFFFFRARSSRLVAQAGVQSGVISAHGDLRFPDSGNSPASAFRVGGITGMHRHAQLILVFLVEMGFRHVGQAGLELLASSDPPTLALQPLRLAPGEHLFTTPRRALNH

SEQ ID NO: 1008441 - protein, 39 aa, Homo sapiens
ILRSTCIHTAVMRPCTVPSTREHRLTSKYRKAGAWSDSR

SEQ ID NO: 1008442 - protein, 30 aa, Homo sapiens
MYQNLWDAAKVVVRGMFIALNAHIKKLERS

SEQ ID NO: 1008443 - protein, 58 aa, Homo sapiens
GERSLGSICKLHLQGINLRCGINVKMFYSYRDLTSSQGSIAHKLDMTERLNFRQMQSS

SEQ ID NO: 1008444 - protein, 36 aa, Homo sapiens
AVPSQCTENFLLDAHRQVQEMEGEQSHDDSSSEDSD

SEQ ID NO: 1008445 - protein, 47 aa, Homo sapiens
GGASFGASSRSVCEMNAGEKISGHVGSSGGRKEGEERKRKKLITPSS

SEQ ID NO: 1008446 - protein, 58 aa, Homo sapiens
HWVRVLELGGQKGMQLWAISKKDIINPDKKKSKKSSETLTFKAEGMHLGKSIALFLIL

SEQ ID NO: 1008447 - protein, 57 aa, Homo sapiens
GDLEDRHTGFEFSVSCCENKLDVLSPALLLKWLVALSARALGSKTLAPPVRSLSSDR

SEQ ID NO: 1008448 - protein, 44 aa, Homo sapiens
LQDLTGIPPAITRFSLLKGASMEGVGILRNKEHGVPVYCCPGTW

SEQ ID NO: 1008449 - protein, 50 aa, Homo sapiens
MTSEERELDASMINWITLVEFGDNGPNGDLGIKFFSSLLTGLKFFSTLAK

SEQ ID NO: 1008450 - protein, 101 aa, Homo sapiens
SCNGNHKKVVPSASNSRMVCSPVTVRIALLTEYIIAYCDNRADEYSSTLSSPSSNAPDPCAKETVLSALKEKEKIYTVEEEDQIFLDGQENKRRRHDSSGK

SEQ ID NO: 1008451 - protein, 36 aa, Homo sapiens
MWKIYTSSSRSREQQHAECVLKSHHGEHETEFIGYT

SEQ ID NO: 1008452 - protein, 54 aa, Homo sapiens
MAQCRRRNASRPIYSEIRSRYCNTGTLEYSSMRKLKLLISIARRSVMMIIAIGS

SEQ ID NO: 1008453 - protein, 127 aa, Homo sapiens
SEDPHTGSSRNTTTFPFVWWDSFRLMSPISRGTKVFPQTVGAHIIVVSFHQPGKAALIGNFLDLNGLYQFVSDTSGIPKGANYQKVPGLRNHGNSYSLMSTNSDSRQARSSLAESLESFLMVTNSSL

SEQ ID NO: 1008454 - protein, 52 aa, Homo sapiens
STGFEFSFHFLDATGHCICFGKNLQKVIHQVSLSSFLVPTLLPDDVITELVV

SEQ ID NO: 1008455 - protein, 39 aa, Homo sapiens
LLGSSNSRSSGFQVAGTTGAYHQAQLLCVFIVETGFDHV

SEQ ID NO: 1008456 - protein, 43 aa, Homo sapiens
CEGGHETEGSNRLLSWALWSLGKKTKHQHLFPDTGDSHEARGK

SEQ ID NO: 1008457 - protein, 145 aa, Homo sapiens
HLNWVEFGSKIIVTSIGGLSSQPLMITLAANEQQSNLCHDYTEAQERTNTARNEQRATLNSITLRHRTGQKLRFVTFQKLGKDSSPQIALTGVEGILAKVESGSLHVFKPSPFSKEDNTVNTFDCLENEATDESFKVPMSPNDND

SEQ ID NO: 1008458 - protein, 103 aa, Homo sapiens
TGFEFHWVRVQRRAMETVLTAKVPETLGIFEEENGIEGQGGSLTGSSPQTGHSTAAEPPGEVTAARLLDSEREGGELESQGDMSPKLRALNPINDLVIFQATF

SEQ ID NO: 1008459 - protein, 67 aa, Homo sapiens
EAKFYDTENSVSRSKAGSCIAMCSCSVSVILLSTCKLHQRGGLERLSGQIHEMWLGVKGRIANMLCK

SEQ ID NO: 1008460 - protein, 34 aa, Homo sapiens
MYAGTDVHSQKAIELLRVLGGVWISDLAVNFNSR

SEQ ID NO: 1008461 - protein, 32 aa, Homo sapiens
MSSAVKRFCSVSWLQNLHVLLIKTGGVEFGER

SEQ ID NO: 1008462 - protein, 67 aa, Homo sapiens
MIKERPRKGSKDLFLSFCRPLDDSRYLCGPSLDPSRGHVSCFFQSGSSQGICELASRLSRHVVRTAL

SEQ ID NO: 1008463 - protein, 37 aa, Homo sapiens
LEDPVEMGLSRLGVARVHGPEGVHCQWLGLSTAWIRV

SEQ ID NO: 1008464 - protein, 122 aa, Homo sapiens
ITDHIQREGMQSGGVCCGLVVATYGCWGWMSVRSRCTLIRQLAGPLFSEDTTLQFYHERVVIMNSILERMCADVLKQTGTQIKFPSTGVDKLPYWTTADPQAVHQQRCWRTLFAKVLDEGLA

SEQ ID NO: 1008465 - protein, 38 aa, Homo sapiens
MVLNPDHVIHLLRLPKWRDIGVSHLCQPIKVSLKSARQ

SEQ ID NO: 1008466 - protein, 68 aa, Homo sapiens
MDKGELEGMTPEIIQKLQDKATVLTTERKTRGKTVPEDAGEARRAQQNTGRWHPTVGLHTCHALPWDS

SEQ ID NO: 1008467 - protein, 29 aa, Homo sapiens
MGDDIWTQSLVNSRAAGRPYWRAPHALDA

SEQ ID NO: 1008468 - protein, 33 aa, Homo sapiens
STFCSGHLSLSKADTLLTHRDSPGLSAMVLAEH

SEQ ID NO: 1008469 - protein, 125 aa, Homo sapiens
SATETRAFSRQLSTCQRGGFLGDLYAPKNSGGTANGGPVSKFADYCRNLVSDIPNLANHKMPPAAAEETPPYGNYNTLPCRKSHCLSEGATNPQISHSNSMQGRRAKTTQDVNAGEVSEVADSGI

SEQ ID NO: 1008470 - protein, 160 aa, Homo sapiens
EDLMVSSPWHLHLALYGAGPALPWMDSEDTFGVHCTLEQAVTATWWSCVGDTDGGERDFFLGGCSRLEASGAQLFFSFFSLFFSSSLHPVLVGLDVDRTPMGPPPASPLRFAALTLGGVMADAADVRGMAGRGHICTGGWWLCCGDTTEWGLRLVAGRRD

SEQ ID NO: 1008471 - protein, 69 aa, Homo sapiens
HLARQSRRLPPKNLCPFPEESGELGLYSWHRSHPCWHGSPPRSVQDLLTESEQGHDEGPLAGTDVAPQV

SEQ ID NO: 1008472 - protein, 150 aa, Homo sapiens
RGLMVGYQCGLVFRACCVKRGEIGDLDVARLQETDKIIEVEEEQEDPYLNDRCRGGGPCKQQCRDTGDEEVCSCFVGYQLLSDGVSCEDVNECITGSHSCRLGESCINTVGSFRCQRDSSCGTGYELTEDNSCKDIDECESGFITASPIY

SEQ ID NO: 1008473 - protein, 88 aa, Homo sapiens
SFGEAVSLALPDPLYPLAPLVMLVACAKGLAHPGPLELLFPELLPSRPPALMKGCTLPYWPAAKKQQSPRGETASADVLEKCPPAPLP

SEQ ID NO: 1008474 - protein, 43 aa, Homo sapiens
ELRRVRGTGPTTTSISGENLRGQARSGWASLANLRKLLAQLLV

SEQ ID NO: 1008475 - protein, 105 aa, Homo sapiens
SACASNAVGDLGHITQLPGQPSSILSSKYLGTTGNNNTPGNFWIFSRDGVYHVGHAALEILNSGDASGLGSQSARITGMSQHVRATLDLRTVLPSISRQRVLIPD

SEQ ID NO: 1008476 - protein, 45 aa, Homo sapiens
KVCCEQDTFHLMCSVAREHVMDTLVRILSRCDIMVLQEVFELFLA

SEQ ID NO: 1008477 - protein, 68 aa, Homo sapiens
ADPYKTTEGEKTTDMGIAQQASITANEMHIVTGISAVEGVNVQRFQNRLHKDVAGKMGDRVARGCSHK

SEQ ID NO: 1008478 - protein, 145 aa, Homo sapiens
LARQSRGAAAALLSVTGPAAGQAGALFARSHEAHSLSVLYKGEAKVVLLKAAYDVSSFSFFQRSSVQEFMTFTSQLIVERSSKGTRASVKEQDYLCHVYVRNDSLAGVVIADNEYPSRVAFTLLEKVLDEFSKQVDRIDWPVGSP

SEQ ID NO: 1008479 - protein, 67 aa, Homo sapiens
DSETEEIWQNRVLKSIRENRLAEHARRIASCYRPKRRRGREQLTQIDALLPLSSREACRTHTPTLMC

SEQ ID NO: 1008480 - protein, 71 aa, Homo sapiens
ILKLRSWVGSPTPLSLALVYHNEVNARLQVPQRGPPVPQGAVVTTVNFVLACHNERLDVPVVGTCEATPQL

SEQ ID NO: 1008481 - protein, 58 aa, Homo sapiens
EDLQHDQETLQCYVMAAQCTGLPPVWLFSFGDPCGDRFERDTRVSLFEGPCAHACTQW

SEQ ID NO: 1008482 - protein, 183 aa, Homo sapiens
GSQIESGAWGRHYTRAVRGSLSVGKLNPVNVSAPDSHRLNKFTVCLPSGKGRPVYQASTCPCERPTCPHAAANWRPVLGTFAFPTMPLYTPQPVTVVSAFLARNVHPLSCRSGSTAILAPMTTTDSSLPVGVFVWDVENEGDEALDVCIMFSMRNGLRGGDDAPGALCDEPFLSCSVARKLSG

SEQ ID NO: 1008483 - protein, 79 aa, Homo sapiens
LEDPMEREAKWRAEAIQDSRESGQPRGPLGPVRGYSVSDPLVESREFTQGGKHPLELLCRNPAPEAFDHCQPAVSRGPL

SEQ ID NO: 1008484 - protein, 104 aa, Homo sapiens
IECRVSGAVLRSMSQQLVYDTSDKDDYHSRTRGRIQNADGEARRSRRTVQILKQTYSKFDTNSHNHDALLKNYGLLYCFRKDMDKVETFLRMVQCRSVEGSCGF

SEQ ID NO: 1008485 - protein, 61 aa, Homo sapiens
VALEDPKLRSGWTQEDHIDDRCRGGGPASSSAETRVMRWSAPAFVGYHAAVMVSPCDRCQL

SEQ ID NO: 1008486 - protein, 61 aa, Homo sapiens
STDRLLRSGWRTVEYYLEGTCVEWLRRYLENGKETLQQRDPPQDAYDSPRVSLTHEATLRV

SEQ ID NO: 1008487 - protein, 62 aa, Homo sapiens
DLCGAQLVLSVSDSNLPLPHNQQADAPPCPAPGPALSRAFYSECFRSESIRLLQSPIHPDLN

SEQ ID NO: 1008488 - protein, 133 aa, Homo sapiens
MRAHGQGQVRLGVSFILLSTMGRDLLGVERLVVPEGVYAHRVDLRPSLSTWKGQCFMSRLQRDVRELGPDQPLGIETRGLEGVQGRRGSLAGVPRTKRAPVSGERARKLGRWCGLPVGRWAMDSPPGSLKFWV

SEQ ID NO: 1008489 - protein, 158 aa, Homo sapiens
MRIYRQSIAILHAIWPFLHIGTITYCYVSYFAKKGTVSLWAIDGSQSIDENFTQTFPECQCILMHSPQMPGKRISYLKVNRACHPRLQIWSRYSSSLLESVSVPGTLNEAVVMTPFSSELQGISEQTLLELSKGKPSPHPRAWFVSLDGKPVAQVRHS

SEQ ID NO: 1008490 - protein, 46 aa, Homo sapiens
KHIRLSLLLLNWGNSLQILDQVELRARYPPSIPHNSPASRALNFGY

SEQ ID NO: 1008491 - protein, 42 aa, Homo sapiens
QDLKLRSGGERVTIENVKAKIQDKEGIPPDLKVRATPPPGLN

SEQ ID NO: 1008492 - protein, 58 aa, Homo sapiens
RAYTEVGWVRISMGTFTNRVSADTSISSSHSLQVQQAWRLGQTILLVAWGMPSSLGSH

SEQ ID NO: 1008493 - protein, 91 aa, Homo sapiens
DLSLPYTTDPAGLLLRYYYDRYTAELAQFLYGGCEGNGTHFYTWEACDDACWRIEKVPKVWRLQVSVDDQCEGSTEKYFFNLSSMTCEKFF

SEQ ID NO: 1008494 - protein, 122 aa, Homo sapiens
LARQSHQALTRVTRTVGLGRSWVGGDEMEAPKRRSGVWVGRDFVRRSEGGGEVAATETGKVCPAGAARTRFRFEPRQAEPNGANKTKPWAPFFAWDTRSGAGSLLSRDARASPSVGPRPSDW

SEQ ID NO: 1008495 - protein, 50 aa, Homo sapiens
EDPHMTSSENILFKTNTDRKLTELNVTAVKIQRLLSPDLGHSTGLGGRIV

SEQ ID NO: 1008496 - protein, 61 aa, Homo sapiens
WSIYLFLTLLVTVLPVSMRAASQGFLILVFLHLASPWRPELFGTGCSSIKTGNLQMNALGF

SEQ ID NO: 1008497 - protein, 47 aa, Homo sapiens
SRGSWQQKTHIPMSQVTMLRNKPSDQAHQSRKSNHRYNDVINPDHEL

SEQ ID NO: 1008498 - protein, 159 aa, Homo sapiens
PGVKIQGNLEQGPILYFLRSTFQESFYAAFPATKRLDCLLKPRILILQKLGRSSSATGELPEKPTQKEVVRPPSSQSGWKLDWSHEAEGAPAPAGWCGESPQLTLDTPASGARGPEPGLWTGLSFFLGWTPSPRSLNGHPPDSPTGSERPAGTEDANRA

SEQ ID NO: 1008499 - protein, 35 aa, Homo sapiens
GSGGQRSPAVITGLYDKCSYISRDRGWVVSVHTIS

SEQ ID NO: 1008500 - protein, 61 aa, Homo sapiens
LEDRIGEELCSGLANSCSASCVAGISVARTTPANYWYFGRDRVSPGLASLVLNSRYQVIHP

SEQ ID NO: 1008501 - protein, 39 aa, Homo sapiens
VVPEDIELIGQTVRISQWPYKRLHRCGERCHMSPLALCG

SEQ ID NO: 1008502 - protein, 134 aa, Homo sapiens
LEDPEKNRRGSGSGKAFGQNERGIFYTPEQDKLTVLEGDILDEPFLKKLQDVSGINQPLYVMDVFGVTHRESIMNVNVKGTQLLLEACVQASVPVFIYTSSIEVAGPNSYKEIIQNGHEEEPLENTWPAPYPHS

SEQ ID NO: 1008503 - protein, 57 aa, Homo sapiens
YEAEQQHALACAPGIYDHAQSNAAYARFHFSTAAASRYQQLLPDSEQALEQAHRASV

SEQ ID NO: 1008504 - protein, 54 aa, Homo sapiens
MDLWWSLTFFLCVMFTLTGARLTRSIFSVPLPPPLHYNNTRPGENKALFTASSC

SEQ ID NO: 1008505 - protein, 130 aa, Homo sapiens
PHTGFEFEEPRVIDLLSWRSRNLTGRVLEAFREPLKHFEAKIEKHNHYQKQLEIAHEKLRHAESVGDGERVSRSREKHALLEGRTKELGYTVKKHLQDLSGRISRARHNELRRHWGAQPGREEASVKDLG

SEQ ID NO: 1008506 - protein, 35 aa, Homo sapiens
SDTMKELCRVVRENVDPMLEKRSVGCRRCAVVGNR

SEQ ID NO: 1008507 - protein, 62 aa, Homo sapiens
ELGGSRAVLRSMYANNLVYDTIETSDDYHLLNGPRGRQSNALMVRLQDWEPAVTEHDPQARP

SEQ ID NO: 1008508 - protein, 47 aa, Homo sapiens
YPEAECKRRSPSIPRRMHISGFLCVNHSDSNAPSPLPVVLHRLGLGS

SEQ ID NO: 1008509 - protein, 141 aa, Homo sapiens
WWECMVGVCVPGVCVNVCVQAVEGKVGIKACGECAGEAPMTVSVQCVSECTLVLAVVGEEVLCAIQSTATPQTPSVSQPQDLPPLLGQHCAQAAATMIWGFLSGQDVRRKTFHSKSAPFDILVALPHPAFLPSGGSGTFGL

SEQ ID NO: 1008510 - protein, 69 aa, Homo sapiens
MNTTLTLVNIFAAIVLCELIASPAAAVPLAAERAHCVDAGFSKPAAVAARDAFIDIFTGDTIRQQLVAH

SEQ ID NO: 1008511 - protein, 156 aa, Homo sapiens
EDPHSARQSRGAAAALLPVNGSRSCAGSRGECRGAMKLTDLSVLYKGEAKVGLLKAAYDVSSFSFCQRSSVQEFMTFTSQLIVARSSKGTRASVKEQDYLRHVYVRNDSLAGVVIADNEYPSRVAFTLLEKVLDEFSKQVDRIDWPVGSRATIHYP

SEQ ID NO: 1008512 - protein, 75 aa, Homo sapiens
LRIPIRRGSLEEALSHCQCLRLSGRFLGAAFILYLSSGRSEAKKLLIPEWISSLVLVERQAVPEVFVLYFSHYGA

SEQ ID NO: 1008513 - protein, 35 aa, Homo sapiens
REAVSKKLWGKQKTYHGKQHWSEETAESDWVGILD

SEQ ID NO: 1008514 - protein, 65 aa, Homo sapiens
MAPTNSRSALVVKLEPGLGKNLIKEIKQVPASQVQTQDGMGEGLPLVNGHNVGDPVTGVHHGHWL

SEQ ID NO: 1008515 - protein, 150 aa, Homo sapiens
VARQSRGMETRAFPRQLSTCQRANFLGDLYAQKNSGVTANGGPGSKFAGYCRNLVSDIPNLANHKMPPAAAEETPPYGNYNTLPCRKSHCLSEGATNPQISHSNSMQGRRAKTTQDVNAGEGSEFADSGIEATTDTDLLSRRSNATNSSY

SEQ ID NO: 1008516 - protein, 56 aa, Homo sapiens
FDLRAYLTSFLMCRLIGSDSVTAALLASAGYGIAQLGIDELICQVSLCQLGWAVVS

SEQ ID NO: 1008517 - protein, 61 aa, Homo sapiens
GSQIEVGCGGHRMYSGTRSTVPSQSGLTCAGMSRLVPVSFCEAVEQPVVLEQWSWLCEFGV

SEQ ID NO: 1008518 - protein, 165 aa, Homo sapiens
PSRISFAVPLLFILSLLLPLGEAPAEPAQRGCLFFCTSIGRGSQPPRWYLLLLSFRVICLLVTFRRVSSKSPALLLNAPFSYFSLAGSSMTSFPSSSLAALCIPLLITVNLCSFGPLVQALPHSSFSGRTDSREALTVGLFSISHRPSLNPFLLLGYPNFSLDSS

SEQ ID NO: 1008519 - protein, 77 aa, Homo sapiens
TFYLLALQQLSPRVPFQEATLPEMLHYSHHYSKSDTHDPHMSLARVLVCDVVRGNASFVRPPATEGCEHAFYDSCVN

SEQ ID NO: 1008520 - protein, 54 aa, Homo sapiens
RIRETTEGNQELQADQDSMSNDVMFQPDSRCLVTYVSILKCGCKNLQEAEEWYQ

SEQ ID NO: 1008521 - protein, 45 aa, Homo sapiens
MVVRVGVKLAVGLVEESAQSGGKSHSSLPISVEDALRLGPLGGDS

SEQ ID NO: 1008522 - protein, 42 aa, Homo sapiens
MVPAPGSHHIDAELSAIPIGIAHYSQKYLDSSDPPALASQVA

SEQ ID NO: 1008523 - protein, 43 aa, Homo sapiens
MVSSLSSAPYTHQLVYARPCPCTARLTDSKRPWGTVQCAAQRV

SEQ ID NO: 1008524 - protein, 39 aa, Homo sapiens
DLEDPLTGFEFWNEKYEAAGESARKLISSKILCDNLGDV

SEQ ID NO: 1008525 - protein, 37 aa, Homo sapiens
ANISAENIKNNFVLIYELLDENLDCGYPQNSETASPN

SEQ ID NO: 1008526 - protein, 41 aa, Homo sapiens
NIMQVHSTSLSSFCTWFTAPFSFSIIITCELRHTVFISPAH

SEQ ID NO: 1008527 - protein, 40 aa, Homo sapiens
GSVTLGSSSRIGGQTGMQLWDISKKDIITPDKKGIQASPL

SEQ ID NO: 1008528 - protein, 45 aa, Homo sapiens
SIGRHDGSSRTEGAIGRLSRVTKRGPPRLARGLTGCFDLINARIS

SEQ ID NO: 1008529 - protein, 68 aa, Homo sapiens
SELYFCIRQLRVESKGQSHTCGQEVARMKRDSVRAGENACGVPTPELGEIPEFLLMVHEALLGFYPVC

SEQ ID NO: 1008530 - protein, 94 aa, Homo sapiens
KGEVLPTPGQENPFPIHDLSASGVLFKLDSQTPLSKKAAAQKLKKGENGVPGEDAGLHLSSPWMQQRAVLGPVPLTRTSRTRTLRDQEDEIFKL

SEQ ID NO: 1008531 - protein, 109 aa, Homo sapiens
MELLTGLASLLSSPQEELEEEGKKTNMRGNRVHCTNLTTVTKIHKKQVVLCLFLLKQWMTQNYESDKMVTGSWDLRYLTMKDLLIVYFVYVGELFCTIEDCNYYLGCTD

SEQ ID NO: 1008532 - protein, 73 aa, Homo sapiens
NSVKKDETTVNMESEGGAHDSAEDGDLLDDDDNEDPGDDQMELIYDDKKRLTKDEDDTDGADGHDDSQAHIGV

SEQ ID NO: 1008533 - protein, 83 aa, Homo sapiens
GIGAKTFAFKISFLYGSKIGRLIVGIPKIIGTSTTFKIAFIITKSIIAIPTGTIFTTPPAAPKATTTPEVSFTTEVGIPTETT

SEQ ID NO: 1008534 - protein, 54 aa, Homo sapiens
ANLVLVFCLPPGLVHEVAAQLTNVLLIVQLYLIQQSHNRGGENIFLITTAMPCS

SEQ ID NO: 1008535 - protein, 68 aa, Homo sapiens
RLQSMMSSRVTQFVQLTSQPNTDLPWRLRLLLLRSPLPVPGPGEQMLSCYVQEDLLKKSSFYFLLVPL

SEQ ID NO: 1008536 - protein, 96 aa, Homo sapiens
MKWMAGLKTNSNEGNVAFHKAEIPSSRMVDEKHLSKKSGTVDKHDHNPPTREDDMNSVEMYPEHKPYGFYKDFLLAAGCKGSRLESQHFGSAKRVD

SEQ ID NO: 1008537 - protein, 56 aa, Homo sapiens
PSGQQGVIKCPQLGGMDHTEKRGRIYLKAEVLMKSSMQQYEMQKIYIPSGSKTGLC

SEQ ID NO: 1008538 - protein, 56 aa, Homo sapiens
VRRVEHAGDVRIADVGFGPSARRARSILRTSSSVGAWLPEVVNDDGKAVGGQTLGD

SEQ ID NO: 1008539 - protein, 45 aa, Homo sapiens
CGACANLAITVPRKRHAHSRGLVHLSDFSLGVSIPKSELLWLVPL

SEQ ID NO: 1008540 - protein, 113 aa, Homo sapiens
RNSKYAEQQICAWFFLWKLRLRGAPGIWGVSLPLLGGASQLGYLAVRDPLEEAVCLFSDLKLHAGRTTTLFKAVRQGHLSLQLALSFFLSFFLSFFLSFFLSFFLFLSWLVPL

SEQ ID NO: 1008541 - protein, 37 aa, Homo sapiens
AGITGIRHPCPARRTGFHTDSKVQTIDDFFEAIACSA

SEQ ID NO: 1008542 - protein, 64 aa, Homo sapiens
YESSWYPMITIFAKWASKGEFVSRYRAVAIFSPGLGNITRLPEEDQAQAQQGVEVPLIAFVIVE

SEQ ID NO: 1008543 - protein, 73 aa, Homo sapiens
KTLLNWLRTRPGRLATLRKGSWTRGLWSVLAVLDEGFQQLLLLQPTLQPVSLEGVFQHGRRELAERTLADVGI

SEQ ID NO: 1008544 - protein, 72 aa, Homo sapiens
KQHTVNPICPVLLSEHSLKSALLGALLSRRRLVERLQAGLDAGYRDSDKHDMREHCLQFLRSTHGNPTVPPS

SEQ ID NO: 1008545 - protein, 80 aa, Homo sapiens
HERMTHSLHEASVEIHHFKERKPGHVSRAGILYVNPQRSGRESVCGQLDETEGGINPHGVNIAIQDYPLGSIRLKIGLFR

SEQ ID NO: 1008546 - protein, 42 aa, Homo sapiens
MVKPEHSTSALEKGYHTTFSQLKMDVVEVCLYINCSHFGWFR

SEQ ID NO: 1008547 - protein, 36 aa, Homo sapiens
MAVSNRLNYVQLSYPHRQDVGYVPARVRHFYETPLN

SEQ ID NO: 1008548 - protein, 89 aa, Homo sapiens
RMLEHVMMTVDTNLDRLVTLEELLAFTQRKEFGDTVDAWETVAMPLAVTVEKLNHSQEDRAAHYDYLNANACLLIYIDDAHEWMNETPA

SEQ ID NO: 1008549 - protein, 69 aa, Homo sapiens
NSATATATSGIHHRDIHGSHPISWLSVFVGLLQLETLRAHAGKRGNNPQDTLNDMPQTNHVLHRLLAGS

SEQ ID NO: 1008550 - protein, 42 aa, Homo sapiens
VLSPGLPKCWDYSMSTMPGSVMEINLLLHYANIMVPFLCWFR

SEQ ID NO: 1008551 - protein, 60 aa, Homo sapiens
IRLPRPPKVAGIADVSHRSWPPQKKDFKKNFSCAGRSGSRLPRPPKVAGIADVSHRSWTP

SEQ ID NO: 1008552 - protein, 114 aa, Homo sapiens
RAEQRGAQVFIILPENLFLPSLLFLAWLGWEHGWWFSSFMSLLGKAFEWRIGLPECPPHWLVTLLLKTRLSTLKNGRSCSIPRTVQMVSSKCPGSQPNVLPEWSSSGCFFACSA

SEQ ID NO: 1008553 - protein, 71 aa, Homo sapiens
TIAAYGLRWRPSPRNWSFSIDSATILLLEGLEGVLRDQLALRALKEALEHGQSLGPVEPLYGPSGAVLYCL

SEQ ID NO: 1008554 - protein, 86 aa, Homo sapiens
TSYAPVGTASSLPPKTCDFVQDSSYFEDFSNISIFSSSADSLWDIWDTPDFLPGDSLNQGCTIWDNNPAPSTHNKLFQLNRPFAGS

SEQ ID NO: 1008555 - protein, 62 aa, Homo sapiens
FLIMMAIPMKDTDSVAEIREAFRVFANAGNGYICATKLLRVMTTLGWKLTVEEAHDMIRNLE

SEQ ID NO: 1008556 - protein, 62 aa, Homo sapiens
EDISLSRSIYATELQRIVERTPRLCKQLHRHSRLWCFGDGGAVLACRSGARSEPGLDPAENV

SEQ ID NO: 1008557 - protein, 80 aa, Homo sapiens
MRNLKLVCHSGILLAFGKWQSDLEESLILNTSADWRWPGIIDLGRDCLSGPPLTLALCRINLTDLHLPGDPLMTRERLDH

SEQ ID NO: 1008558 - protein, 51 aa, Homo sapiens
PEFTSQDLLPYSPQAVRQRFKDTEHLKQSSEPSPAACLHTLFKIIDEPLNR

SEQ ID NO: 1008559 - protein, 40 aa, Homo sapiens
MDITRPIIALDLPSAEAALDFVGRFDGENLFVKVGMELFY

SEQ ID NO: 1008560 - protein, 68 aa, Homo sapiens
EFKQCHIIKDAPCAVTFHPTRPTFFCGFSNGAVRFFSLEAAEVLEEHTCHRGAVTGLTATPDSRLLFS

SEQ ID NO: 1008561 - protein, 37 aa, Homo sapiens
ARYPTSASQARLGPAGCYWNLERLLGHPAQTWALFGL

SEQ ID NO: 1008562 - protein, 81 aa, Homo sapiens
FGYRLALHVYQHGLTVFLGQVTRFVGDFLLHHCIARWIAQKGGWVAALNLGNGPILNVLVVLDVVLQRQFEVLKILEPETA

SEQ ID NO: 1008563 - protein, 34 aa, Homo sapiens
MPALWGGVRLMLFLGWKISLESSAFWISARDSRS

SEQ ID NO: 1008564 - protein, 135 aa, Homo sapiens
LTGNLLLVLLAVRDPRLDTPMYYFLWRLALVDAGFTTSVVPPLLANLRGPALWLARSHCTGQLCASLALGSAESVLLAGMALDRAGAVCPPLRYAGLVSPRLCRTLASASWLSGLTNSVAQTALLAERPLGAPRL

SEQ ID NO: 1008565 - protein, 43 aa, Homo sapiens
LGTRVEEDRHFAFFQVGQCDATLTRWLNHIQHLEEKTIYTRMQ

SEQ ID NO: 1008566 - protein, 44 aa, Homo sapiens
PFATWKPSMKTADTVLDVDRLARAAVNLGRHLTLVRVRGGLHDV

SEQ ID NO: 1008567 - protein, 69 aa, Homo sapiens
LYYTEFTPTEEDEYACRVNHVTVAQPKIVNRDRDMYAASWRLEDAALRKHELQTQLASFIILICLYAYT

SEQ ID NO: 1008568 - protein, 40 aa, Homo sapiens
FINLKIGHELFHSSKGRTEKNSNSRDPAIDRGHNVVTRQT

SEQ ID NO: 1008569 - protein, 63 aa, Homo sapiens
MSGAKPEAIAAADRRAPSCEEDGFAVVVEELLASRYSRSVLIATDLDGTLLTPDGTISPRTRD

SEQ ID NO: 1008570 - protein, 71 aa, Homo sapiens
AKSQSPYMRRDMVLALNSLQVYLAIQFFSRTRPDLAAGDGYSLYDLQDLSDRPTTLHCLYDLPYWCPDNDV

SEQ ID NO: 1008571 - protein, 30 aa, Homo sapiens
MTVCLRQRFIYHTKANCIACTKLRSGYKHK

SEQ ID NO: 1008572 - protein, 49 aa, Homo sapiens
IAFPYFCLPVYHFKLLSSPNCIIRTTPILIFPFSSCVYVNAINYGFNMT

SEQ ID NO: 1008573 - protein, 40 aa, Homo sapiens
TYTTLHTVTTLHTPTNTHPYDIETPYGGLLYDVDPRTACN

SEQ ID NO: 1008574 - protein, 48 aa, Homo sapiens
RYESSWYPNPLPRGIRRGQLSRLNLVVNHRIQLRRENLVLDFGQRQRR

SEQ ID NO: 1008575 - protein, 104 aa, Homo sapiens
CEFGTGGRITRSCVGERQSLTLCPGGSTGAMIYDSVQPWTSEFKLFLHLGLASSWCYGCVPPRLDNFCLWGPSRGFSMWAKLVSGSCTQVIWHPQPPKVLGLQV

SEQ ID NO: 1008576 - protein, 37 aa, Homo sapiens
SSYSPVSFHANLQDSLWYILQDKSGGNKLPQLCLPEN

SEQ ID NO: 1008577 - protein, 114 aa, Homo sapiens
YLGRCVVVLWVLLSVDNVYLRLTDTTTGRYDAPTTTVWDYDDIPVTNPLRLNVTLNLLPVTVKTDDKRTKDKALRNAHRNAHIKGLSRQHQIKSKCSSEIDNWISLWNLKLVNH

SEQ ID NO: 1008578 - protein, 46 aa, Homo sapiens
NVHYRNSKTSSKNSVIHKSQAVYSLDIFYLESCVSGTSYQWEIRLE

SEQ ID NO: 1008579 - protein, 145 aa, Homo sapiens
VISRDAMLFCDCLLLITSDGCSMCRQTPPNVLCIPTLSALCHPLESGLVISTLFGSQAPRAYGACGLAYNRCTVYLCCLQLGAIVFRNSSDSGQCSARASRCLVSGHQTELTAAACRPPRNSRIPDICPPCSHEDAPAQPLALPR

SEQ ID NO: 1008580 - protein, 35 aa, Homo sapiens
RILWSVISKVAGVLWDKVIDVTLNLWVGMVAGSIF

SEQ ID NO: 1008581 - protein, 78 aa, Homo sapiens
RSVSHVRAVERGPHAGDGQWASSELWRTLMQVVCPVVTFRAWKEDLMQCGGPVSSCQSCGKRTSCRVMVQWGIRQSCG

SEQ ID NO: 1008582 - protein, 53 aa, Homo sapiens
EKFDITEEIMSGARTASIPPLARRRRLEPQANGETPQVAAIVRPDYRSHSSII

SEQ ID NO: 1008583 - protein, 102 aa, Homo sapiens
RSWYVSRFCRSPGSLNRYIIRKLRINNDVQKIRCLSLSEITSYTLSNIFSYDIILSDSQFSFNRLMEKRPGGKKKQIHRMARVVISYGIKVNILLMGGVCLL

SEQ ID NO: 1008584 - protein, 30 aa, Homo sapiens
MLPLAQLQLEQLQVSLVSENRLCHWYRGLA

SEQ ID NO: 1008585 - protein, 100 aa, Homo sapiens
GTRRWVRRHCSPCVRWDAMDAEYTQYAERSSLAGVGWGVFGSLDAHLGLLVVRRDFIAYDAPHHVFVCVRVYAGWSVETLDVPKLSVCGRFDFPQDTFTV

SEQ ID NO: 1008586 - protein, 81 aa, Homo sapiens
FELGTPDEVFSIGRVQTPTLFMIYQRHKDILNFKEETFYELTGNFEAESGSYKGKAKIKTTSKDEIDSLYNDNQLSSATNG

SEQ ID NO: 1008587 - protein, 72 aa, Homo sapiens
FWLGTLIKGARSLERARGIDVMAMDKTGTLTTGRMAVVAVWDESGRVVNISDNPPALAVTAALEVGSEHLIS

SEQ ID NO: 1008588 - protein, 65 aa, Homo sapiens
APKVLGIQAVLHHTLAPYALHYENVLFGLITRYIAATQLHWLSWKGAHGKPACQALTRRSICHSL

SEQ ID NO: 1008589 - protein, 89 aa, Homo sapiens
MVDHLGIPVGLGSDSCRLHSSQQTKIVMAEQKAVINTVNSPVEDTHPSGLNGKALSAPEMPHSGNMDFVYTSDQFMTLDEKRNLQNVDM

SEQ ID NO: 1008590 - protein, 102 aa, Homo sapiens
KNIQDLMDHEAVHEGLDLHLRLLYRLMDMSPDASLILQFQNELDGIIQDGVHNITKLIKMSETHKLLNLEGFLSGSQSRLSGTLKSQARRTRGTKSLGSKAT

SEQ ID NO: 1008591 - protein, 53 aa, Homo sapiens
GTPPFAPLSGVEVVLAAEGKMGRDFKYWVNRWCGRGTGTIDPGMGSISAIWEY

SEQ ID NO: 1008592 - protein, 34 aa, Homo sapiens
NYRQTLFYLNKETATSDGAHGPDQYTLHWHSLMA

SEQ ID NO: 1008593 - protein, 76 aa, Homo sapiens
ASVVSGPEPGPPQSLLQQDPTAVVAGHGFAGTCAAHIRPDAGSEPGELTGSSGPPHVAGAGTASRDLCLTVWRIFP

SEQ ID NO: 1008594 - protein, 46 aa, Homo sapiens
AYPIEKDTQPRWNHEADFVAETLGGVVAELERQYNVDLKLKANRNK

SEQ ID NO: 1008595 - protein, 105 aa, Homo sapiens
MGSGHSGVAQEKYAYGRSCGNIWHSELREEAVQGEVIPLTLPHAILRLDLAGRDLTDYLMKIQGPLTPIMTTTAERDHLGGGVITHGVHVALAGEADRQHHSAHE

SEQ ID NO: 1008596 - protein, 119 aa, Homo sapiens
EEAQHRKPMDQKRSSSLGSNRSNRSHTSGRLRSPSNDSAHRTGDDQSGRKRVLHSGSRDREKTKSLQITRERKCMIDQHPRGEPSRSTSSDRQDSTSRSSRTSAPESNRQGHSRTGSFD

SEQ ID NO: 1008597 - protein, 92 aa, Homo sapiens
VHLRPEVPEIQECPIGQESLESQEQRARAGLRERYLRSLLAMVGHQVNFTLHEGVRVASHFGATDLDVANFYVSQMQTPICVHAEALLRCRD

SEQ ID NO: 1008598 - protein, 38 aa, Homo sapiens
PEAFNPERFREKVGTLGGNNLQVLNGVDKDDPIAIVYG

SEQ ID NO: 1008599 - protein, 87 aa, Homo sapiens
SSVPPAGGVERAGAARGFRAPCVSVCVVSLPCRRLGMLFDLVAPSGDTEYDAALPSPALEALGVAFGDTPARLVAFEAALTLARRPP

SEQ ID NO: 1008600 - protein, 54 aa, Homo sapiens
PSAVPLIVRAFERAIPSASDRYESSYMTSTATAAVKFRPDRRFWVVYFCLMMVM

SEQ ID NO: 1008601 - protein, 55 aa, Homo sapiens
SVTLQFCYLQNVHFLFGDHGNQKTMAVQSVWDGGAPSSLGTWGRDFSDHEKRREP

SEQ ID NO: 1008602 - protein, 71 aa, Homo sapiens
ELAELNDSCQLALRTKLRYRFRLLASSVKVAARLGVRPPSERAEKMPGVTCQPGSRVPSQVKLKSRLIPEE

SEQ ID NO: 1008603 - protein, 56 aa, Homo sapiens
RRIVRSAGGDGADDSQGHLIVNADSFEDSRQRVKAVGRKGANPERQIDLGADPHRH

SEQ ID NO: 1008604 - protein, 178 aa, Homo sapiens
MPRRTADDLYKSLRILLQDWPDLLKDFAAFLLPEQALACGLFQEHQAFAKSRKFLRPLEICFADNPSHHQTIIKVLQGCADCLPHEITELKTQMWQLLKGHDHLQDELSIFFDHLRPAASRMGDYEEINWTEEKEYEFDGFEEVALPDVEEEEEPPRIPTASQNKRIQEIGVANHDEE

SEQ ID NO: 1008605 - protein, 73 aa, Homo sapiens
QPADPPGQGNVEEAIPTSYFTFKFHKQYFGTMGFQAPRNDGLDEGEQEADNEVDEERGKKVGGRTEGRRKNDG

SEQ ID NO: 1008606 - protein, 105 aa, Homo sapiens
MHLCMRHEAYLEALYHLQSPLDPRTLLSEVCVEHRTFMDSKMKPLWIMYSIEEAGIGGSLGIIFKNGDDLRQDMLTLQMIQLMDVLWKQEGLDLRMTPYGCLPTG

SEQ ID NO: 1008607 - protein, 168 aa, Homo sapiens
RILGSSDLHQDVDMYGIKYVRDKKEEEEQTIWVGVDALGLNIYEKDDSNPKDWLSWSEIRNISFNDKKFVIKAIDKKGPDFGFYAPSLRINKRILQLCLGNHELYMRRRKPETIEVQQMKAQAREEKHQKQLERQQVETEKKGRETVAREKEPMMREKEELMLRLTGY

SEQ ID NO: 1008608 - protein, 71 aa, Homo sapiens
NWTEEKNMDGTTHAWTEEMKPHHNGSQSFREASHRAHEGVPVALLPEGEGRRMLRWPRWDRMDLQGQIPKP

SEQ ID NO: 1008609 - protein, 75 aa, Homo sapiens
RSWSVISGVISHSGHRRIECEFLKNVGESVAAGLMPLCIEVDIDVEQEGKEAELNPVSPESSSTEEKSSQMQLLL

SEQ ID NO: 1008610 - protein, 89 aa, Homo sapiens
MLMLSDLGRNVFPDFVMLAVSGVFNSGWAAVQVKVSPWFQWVGEQQAGHWTRCSSHRGHAQVVLEHAASSHFEWRPWLKVGTMKGILLM

SEQ ID NO: 1008611 - protein, 69 aa, Homo sapiens
KTTQSALTACGLPLREMTVNTLGDERECLLSRPFIVETHLEDRQITFLIRLHLSAMPCSVNWLDLEDCS

SEQ ID NO: 1008612 - protein, 143 aa, Homo sapiens
QHCVGVHAFADDHVTLYDGDEGRALDATGLLAHNGWLEQCLKAAQPLIVNGDDLASGNSLLFYREELESAGAISCSKSKSTYDSFSLMSRTISRSDVEVKCSLLSSEDFPHVYTLVPARQVPTHDLMEQGIPLVDGPSVGDPF

SEQ ID NO: 1008613 - protein, 38 aa, Homo sapiens
ACGVKDDGLERADIYCSHEALVMDYERAFVHLAEKEGE

SEQ ID NO: 1008614 - protein, 84 aa, Homo sapiens
QPFNVRFFRQVIARFFHQVAMGGRRFPHPPRGTRVFKNTAHLRPGQIHAHQGVHQTDPLRVTFEMTQILTHLAAQIVQAIFALT

SEQ ID NO: 1008615 - protein, 49 aa, Homo sapiens
MRISGSVISGSVISGVASDCGRLSSMNLLCMLSAQMSSDEELSTVDWKN

SEQ ID NO: 1008616 - protein, 84 aa, Homo sapiens
DAPHRRDADRQHLYAIESSEARHTFAGAKAISSDMFFGRPVDAEYEARSRLQHLSEHSAISSSDLFGDMDRAHRARSVSLGNVL

SEQ ID NO: 1008617 - protein, 194 aa, Homo sapiens
HSARYPAVVRPPGGAHRDDLGCPGVGNEMTVVGKHQLMQRCIFDGPLQSYVLTECLIESEIERSSTESIREYKLAGATSSRRATARIVKARRPPSSNSFTEVVATCSIPLPERDELVSDAPNNSYFHINRTVLVLRACVNAELLPLRDDRAVLRPMRAEDADAYAAGTTDPAVHLYAHLPEPEYTPASVTELIR

SEQ ID NO: 1008618 - protein, 50 aa, Homo sapiens
SSIFFFMSATCAWRVAICFSRLCLGFFFFFSWFRKEFFSSSTCLSLVLKL

SEQ ID NO: 1008619 - protein, 41 aa, Homo sapiens
TIFFLNLLMQFLLIQLKLDLTYPGLFNQGIPVGIAQVLVCV

SEQ ID NO: 1008620 - protein, 68 aa, Homo sapiens
MITRPADETTDTAGPSVPTARASDVLNGATVVLIDSDAQPGVPNVCAWRPRAGTPLSGTQTCNQRYEG

SEQ ID NO: 1008621 - protein, 37 aa, Homo sapiens
VLYEVTFGWWLWTVILSKELRPQTGAGCPLWEHFQSL

SEQ ID NO: 1008622 - protein, 91 aa, Homo sapiens
EVESRISCLESSEALLLSAGHQEHGWMKQGSCEAGTPDYAYSYVCDTSQCSSAISSSYLFEDMDGAHGAGSVSLGNVLSTADIARHSRVSS

SEQ ID NO: 1008623 - protein, 91 aa, Homo sapiens
MPQTGRKWRAGAQASSLVRRVTNSQEPDPSYLTCSLSSTWIRHIETRSQLNQLSGIYAFSCSHLFGDMDGAQRSTKCISGERAAYECNTPN

SEQ ID NO: 1008624 - protein, 122 aa, Homo sapiens
RRTHERCRKPLHGYAYASNGLYFHLRILKTSWILKLSTRLGSLLEAHLPIYGYVTQYASLILDLQNELDGIIQYGVHNITKLIKIVETHKLLNLDRLFYHGASYDCQEPYRAKLEGHAAPKL

SEQ ID NO: 1008625 - protein, 122 aa, Homo sapiens
MAPYFRDLCGAKQTMSALLTKYSRSSMRNGVKIIIREDPFLERTTAESFRLIMVHKGAVYTKKYLDLDKSLVETSLLRHFSPHLKHFETTDYFLNVIGCSFKIIFVLCTQCKQGQKNSFLYY

SEQ ID NO: 1008626 - protein, 72 aa, Homo sapiens
AQVISTKLYREPMNSENQDRHFNTSTGGGFCLAIPRGLQIYRESSDYTWRKRKQTELKRFDDPGLIAPRVSS

SEQ ID NO: 1008627 - protein, 31 aa, Homo sapiens
MCPMWTGYSLVVYILGRPKPSLSTCKRYIDL

SEQ ID NO: 1008628 - protein, 59 aa, Homo sapiens
WLYLDKVRALEAGKVNIEVEIRDWYQKAGAGPSRDYSHYYTTIQDLRDNDSGCQPLRTP

SEQ ID NO: 1008629 - protein, 66 aa, Homo sapiens
SSSDPSSNSISLASSSSSSSPSISFIILLIIFRSFLRPPPLHPRLSSVILYLPLRVPLPEMCSLLI

SEQ ID NO: 1008630 - protein, 105 aa, Homo sapiens
DGDPTIGFITEPQVDVITMRQSRDSVTHRHWRSHKRTPAQSRDPDLGRGNATFMDKVVTLSVLSRVRAAFCQTENGAMEVYVHSPPRIPSHIIVGARGLFGYGYA

SEQ ID NO: 1008631 - protein, 68 aa, Homo sapiens
PRLTGNLKAGSRAGLALPKPEGLAPFSKAEKEKNPKVQKRRTSPSGRKNDWAFPPTFRSSTLSGTLCI

SEQ ID NO: 1008632 - protein, 29 aa, Homo sapiens
MVGFDLLVPRAPPPDVSLTAYFEVTRPEE

SEQ ID NO: 1008633 - protein, 50 aa, Homo sapiens
MALGPTLTQRKQALRAETGVRGWVQQELLLGRPWGALKGVGVTDQKRGRE

SEQ ID NO: 1008634 - protein, 39 aa, Homo sapiens
DLTAFRNLVLEHRPLRRWEQPSAIITIFALVTRLGRAAF

SEQ ID NO: 1008635 - protein, 124 aa, Homo sapiens
MPCMSSSTGPTRGLLGLRQFEGLTCRFLEACLPGEAGPWDWVKVERCGKMDMRAGYSRPISNPSLVASQRDGRPLQQDFERRCLSGGGDLSGRKDVTCLCHTLAYKLIDRGNFPAEPIGAVLLN

SEQ ID NO: 1008636 - protein, 120 aa, Homo sapiens
FERPLDAYFEVIGPSLTCPLPLMIQRLGILYLKSCRGLVVLILTETDLQKMEGVLTKPEESGSDILEEQITGVSREQEVTCIDGGKTLPKQPSSQKSEPLIPSAYMDEEQGDTCTICLEQ

SEQ ID NO: 1008637 - protein, 77 aa, Homo sapiens
PRALITGQTGTQSLGKDAKGKSGELGPSVYVSLSLWHLQIGVEHVVVYVNKADAVQDSEMVELVELEIRELLSVPLR

SEQ ID NO: 1008638 - protein, 79 aa, Homo sapiens
VTVSDSAGIGDLLTFGHSLFKTCSPACPIPEGVNVGVAYMGISCCHSFLCNFSAANGGLLASVTLLGAELMLSLVPVLL

SEQ ID NO: 1008639 - protein, 122 aa, Homo sapiens
NLFMVRLAQGLTHLRKGTLTLCPYHSDRQLMNQVDEAGLLTVLGSFLDGRNIILSKSHYLLHGLGAAMQPPMLVTLDEELRPLAMSVPVGHAKDVVGQAGKPKTITRIQTHTTPMVVAHGER

SEQ ID NO: 1008640 - protein, 355 aa, Homo sapiens
AAAAPGLTAPWRLVQCCELEAGELGMAVADSSRMGALVRGGQERTRVDGPEWCISRSKQAPVGASLLGTAWSLCPGRTDKTSLIFLGVNSCQGATQSEPGRWRLGRSAIRRSGAILSNNERPKPVITMPEEQRDPGLGSTEETVLVGGPVEDTVWSPRLGTGPLPRDESPEPLYSWLYARRILGNALETTPISCQFVEGIAEGTFQHSGELAQRDEKTCKSGMKGIELVLVWDRCPRSGVQRTQCGLVPYNMTVIALVGLGTRQTYVVAPIISSPAFAKEPYKNGIVPGRFPHAFVETILVPWKTGWLYVPNAWVGMTNMGNQEFERTSPKYLRVIDSRQVERRVVARSDSYGVP

SEQ ID NO: 1008641 - protein, 104 aa, Homo sapiens
MGYPETWTFHPDVRSVLRFPNPDSFPVWQSDPNYKIPKRAPKDPVFLNYRFPPRFGPGTTNRGAESCRGRTIHNSNLVPHGPLNQLRLPAYCPHWRRIECDPDT

SEQ ID NO: 1008642 - protein, 310 aa, Homo sapiens
ENEGTAGDQCVVCDLEWSQWTAILDLPPAQLRDAHSVLSPAQRKCRRLKFDFQAQSPKELTLQKGDICLHPQGGGQELAGAESTTDAWASSLLIYVEVLPADEIPKPIKPTTTKCLEYGEACVPSNTFNGGPGGWSCPYRKGEHIWLIRNGDRANWYRGTHTGDTGGCLRAYTPWQLTVQVIFGCNARVDSVAFMMTREGEQRDSRSHNGNRARIIHPALRGHRLIYSGARQTPPAQVNKRGSSDNRRRTCQVGRLVGELHQPKSERLRGGLENARRSVANTSRRGWMGTPEENDPGSLMAMVRRSGMRG

SEQ ID NO: 1008643 - protein, 413 aa, Homo sapiens
GSQWQQFSPVGRLVCQQKTIGESHLLIHEVPSCAEHGSKRRSEDDWPRTSVKRSASGRRGERSIYRRYEAKAWLSARTYYRIVDGSGQEGLRLELVTALKYLTAVQNAGRCDGASRREHSGEPERDAGCKLNSAYAERMGDLAALQSGRRVRKHPGWLGVGIRSVPAHLNPRSKGGIEHPENDRAEIDAQGVLFRTPMNAIFETEALRRETISLAVYATRSPNGLVECLRASVITAPNSAGPSTSGLFDIPVRLWEPSMKKKKGEDRKPITNVNDTQTRYAQVRNNNPHTANRRSKSLGRIHWRPIGPQYSPNPLEADRYTFKWTGIPSACSRTWVTRIQVNEREGNGLINSFAADQFQRKETPVAITQSTPWDILRAQVRIGPTDRDLLCSTYWIKPANKDCLVTEAWAHEP

SEQ ID NO: 1008644 - protein, 389 aa, Homo sapiens
RREGGPRLSVWQSETCLVLPTARAAHGSTMPCTPGAPQAFQLPWPVALHLCTIIDCERGSCNAGSERNDRRWITIDGTPDSLTRERNRSRSDSHHAQHRQSRHCHLRMCTTNGNPTLSCTRLAADAHAYLLRLVALKRTKVHHAYIPLPRLNRQPRRYHVHAHQTTHPSTVLKHAAATSLDLLQPTRRLVHFPRSLAVYPAMLGHCTLEGHDSPTDHGKYSQIRFPFKANSAKLGERPPPCGMRTDTHYICTPQGDIRRFQIDDNRHWNHYRSQQKHSTSIVSGNRYTRQGLVHLYLGKLSGDPTLTRVCGALIPLTNGALAAHVTAYSGGNTSAYTDLYTLVYTSCVIHCRVAMIRLEHACGHRLVCVTTRTFVVAASKTFQPSLVLR

SEQ ID NO: 1008645 - protein, 412 aa, Homo sapiens
GLHQLLLRWAWECPGVPVANRGLLCGLTPQGRASLAPLPLRWDPDSLLVACWLEWSECCAAVPWLTVRGFCQPALSQWTLSELFTKLYCIGQGSFGGRSTSGLDNHHHMDRGGHHRSSDHGCDGLRMTTRRDRSMQGDHVSSGSGCDKAHYNQPAYLTGSYLQEQQAIGSSWSTLGWRLKQLDLAETQVPWHGDIAFATDPCVRFCNGPWISLAPPETARNPTRDHQMLAHVLTTREPVVDRDSWRTVLAGSHGPSFTCTAASIYMREATISLWPAPLSSGMATVTGPFLRQVQAHIRLTPGVTILVSPWGIHAGTTLGSLCADLVCVVTRTTTSCDPSLIPNMSWCYRGSRVTFPRGNAVARPPVPGVVVPSGTRTKAPFTVQALRSVECPLPFTAQKGHHPSILRCTAGS

SEQ ID NO: 1008646 - protein, 139 aa, Homo sapiens
MLAIAMHLTSSGSPDTQSLQRKELEAGTPGDRGTTATGGRNNARRTRSRSNAPSREGRHEKGRDLKREHLKGAPPNTSPAYNTVKHGDPPATGRHPDGNTIPMDTDRTQTSRKASTQRGTHSIKDPLPSLYKKQKRPGN

SEQ ID NO: 1008647 - protein, 114 aa, Homo sapiens
MVLTVTGTTYFGGYVTLVAREVGSVTKPWGSHSSTEVLIGQQTIDVVQRSTSRPGLLARRDKDKANLNPQEKAVLDCFPWYAFRLLDIPQYFQGIVVSTAINKVVASSRKNRYH

SEQ ID NO: 1008648 - protein, 128 aa, Homo sapiens
MLRPWSDVGHPLVAMCGGGSAPDYAPWIVARPACLDGKCPIGSRGPCAWTERETVRSPKVLAKSWRMIDRKNGHGRAKRRIALTDRRFVKRCAAPLGRRTRRGSTRVPQLLLEFIFCYIRGLFVRRSR

SEQ ID NO: 1008649 - protein, 134 aa, Homo sapiens
MPLPGRQKQHRPLAELCHWRVQQEVQTQRFNSASMLEPMLTCGLTSVRETRKDEENCSESKMLQMLGNTEVHAQTGLKRRLRGCMVWHLPWHLFWSLSPPEWCDTFPPQGVLAGWPRRVLGSHLLMTVSGELRL

SEQ ID NO: 1008650 - protein, 118 aa, Homo sapiens
MGRPNRYGVRQEGQALYTRAKPLVEPQQKGRNSFGDPPILGVATQPERRSRLSMEQVFRGETYQHWLETPLKSKKLKPMWAWFTQTMAPHREGGHPMPWTRGVNKSITLRAVLAWPPH

SEQ ID NO: 1008651 - protein, 241 aa, Homo sapiens
GGFEKHPEHYCEQVWLQMPGLLPSPCRSTRSTWTPGPGPDHLSWAWAGPAGLLLPAPPGQKEASYDPGVREAREAAGSGGGGARTFGGRLDVSLLPPSGGTPYVSSYWHELHSGAAPWQPWQRQSWSQCPGMQRQLQRGPSSPWTVTRAWRALCCAALWTLDLQSCTSGPSTPQEAGCPQGDYGSENRAGGGGPRIPDHRREKELALVHALRIIVVKSHRGLSSNPGPTEDGPHAGPVRVM

SEQ ID NO: 1008652 - protein, 333 aa, Homo sapiens
TVPSKVDRVLRIIDHEEAEDEMRSTFSKRITSRVNVTAQYVTKYYGSYLTGVNIMDNNGIPGSEVQTAGLFFELGPIRWSVQSRLTNAMRHRVPKGRVPIVLIQQNRHQCHLRHKQLPMSSVSAPKEMLQLAAYGAELVSLYRNTPGLRTDNYALPREPPTDAMGVLAQCVHTGHAYDSKNLTNWASMEEISCLIVKREDKGEEADRYSCRIMDDRKPEQVPGLALKFPNNRHRKFPSQSVRLGSRKAAFNPYRVPVFLKKDGNVFNLGELAVGAYGRSQNTQYPTSTSHTNAVKQATNRKQLSWEQQRKNFQYGEHKHSITTAKEPLRIEVW

SEQ ID NO: 1008653 - protein, 259 aa, Homo sapiens
KWRMTPVQRGGPGGPVWPWDGEPRWLPRRFRQWHLGPGALRAVDVGLVCRCAAELAEAMAEDKDVDAQSPQLGQLGQRTMTDQRPWRRLYRLLPGLLRTSEIIDFFLGDLSQGVRFRRIMPVAEADPVHGQRTTVQRHYRLTIGDYTLRHVRLARVNVLQGKGEDNTAIHVEATQLLGPKLFQISTPDAARGVLRGKQESRQGPDDLYACTRLTTGTRSAGLLTDCEQDINSTRSPRGHQGIRASDTCCARTACLMDGM

SEQ ID NO: 1008654 - protein, 203 aa, Homo sapiens
MARRALTVACEHRSPTCLRALLDSAAPGTLDLEARNYDGLTALHVAVNTECQETVQLLLERGADRRPVDIKTRAAPASFHARWKNKRPLAIVAVVVASHGAKRERAKCTPAVSALHSASGRGLLPLVRTLVRSGADSSLKNCHNDTPLMVARSRRVIDILRGKATRPASTSQPDPSPDRSANTSPESRQLLKSNGLLSDHHPP

SEQ ID NO: 1008655 - protein, 282 aa, Homo sapiens
MGAKSSHEIITENDSAVRTSDPPIDYSGLSDATRARLPGHVSGSVLRSARGMNPVGLIRCIATRCTSANNSHEEIESTQESLGHDPLRRTEGIILVGPTVWSNNRVCRTRYRRWIVGTAPCEKFGCTLTQDNEAVETVGLPTGKPFDDLGHHCLPAGVCESAPRALGGGLGLAENNHCLPLQRNPNTARPVMWATLGGTHQGLSWSIVIPNPVGCYCWEKNSASSSNLRRPRGATLSEDRDGMMWIPRETWYGNFIKGPVCVGRTFVHDSGQCRADSDTLAL

SEQ ID NO: 1008656 - protein, 348 aa, Homo sapiens
AFCVLLSSVLSSTSQPVVPGSLAPPGTSHHVSISQVCPSGSGGSRSFSDASAIDPVCFPAPSFSSVSRSGGWRSVVCFRRGSALRVHCGVGGFMLKPRGHLQALGGSTDHAISIRHLGRVRKRSRNPGSVWLGVEDGWLVVHSGGWCRYVPVSAYCAGRHLCVGLGQGTCRRLAAGALGPMRSPDGAWAHTWVLERLHQNGSCNPRTDAIASVNWCLTLDTPIAAMVTTPMNPEGIPRQRQTAGHSTLAASTTAGIHSVRASRSRGNTNMAPLAECKTQQTVRGLPLHKPGSTMDTEAIQPTARMRPQGDPTQNHNGTPTEDWTENKNSRLKSARFRNPKHTYSAIRY

SEQ ID NO: 1008657 - protein, 190 aa, Homo sapiens
VENPSMSVCSPLSTYGIESHEVMRGQSLRSISPCDSCSTHSRVQLEHPWLIVRLRRDLPHLQASRVPIGVTRDEDQQEETQGQEEGDERGAKGPPVPSERTPLDGLSSPTLPTSFGSLAPAPIDSYYLGLQQIPQHVPSALTPCVSWSNNPAHKTPLVTHTLTQTVVFTSSLLRDRGHSIQSFSLPTPIL

SEQ ID NO: 1008658 - protein, 101 aa, Homo sapiens
MCTVSSLQIGYPQPDLHQYPIISSTGYITSPGLVLWRRIYTFPLAEKVKAFLGCSICVIVDCMPPVAAATTAVSCWLRAAPAKVEAKEESEDVGEDTGFGL

SEQ ID NO: 1008659 - protein, 226 aa, Homo sapiens
PALGLLDAFVQMLDQYEKLAEKNRKDSEDGSHLDRGFDTASVATDSELVQSGKSEISELRRTLQKPGRLELASHKLQHMKRIPLDETAMEETKGRYCMQLAQIQETDLAALEEQLAQLRCEMEQQNQEYKNLARTEKTRLEQEIATYRRLLEGEDDPPLLLPVLLWIRSHAHACGRLQPPSAPGHGGTRAGGVHPRAGPRTRRGAQPAQAGGPPVAQAHGVPSRPL

SEQ ID NO: 1008660 - protein, 88 aa, Homo sapiens
GCYRFTLMGFVPGPIPRPPPRVATVAFILDIAHCVCLGSLSTVGTPADLRRFPHPLDFRHLSASLPTPFGFLGRGEGSGGQASRLGGH

SEQ ID NO: 1008661 - protein, 153 aa, Homo sapiens
MVSHLCTNPVGPIEPTGAQGFSGSTYSRMNTQPVFSNAYTQWDLASNQCRAEQLTEFSLEEIYSQARIERNQPTNQEDLLRPSLRNPGSRNGTTDFHQLKEAPDGSVESRDSSLPRSQKTVHVGSGLQGARLFTPNVAPSPDVGHLLQQRLEE

SEQ ID NO: 1008662 - protein, 138 aa, Homo sapiens
HVFLHTRHKFSWDIRALWALSALCGSLLLVVYAHNTNPCGGISPNRWKLDSCVSPLYYISIQVGWSPSGVVYLLNQINGFHFLGRELSILAPICFLRLAPELNTGEGHSIRVQAIQRRAPISPMPDPGFLSRSRPFLC

SEQ ID NO: 1008663 - protein, 229 aa, Homo sapiens
MLSLHRSKPYRLLINISPRDLAPRSIARVVGDPIPSGMGILLRIIGLWAAPAQSTASNRRVYVRGMQSYSLYRSCGLPKAPDAYLFNIGAPTSFTYAPDCRIKGPQPSRPPPSWTLRFSVVFTSRSELETVNAGWRCSPPAPLAGPEAVIMRPHGSHVDCWLHSSLPVQEAILYQISMERPDPAGHLTLQGQPACSYTFSPFQVLSLLLRGSAYRHTEYLRLGFRLSKA

SEQ ID NO: 1008664 - protein, 107 aa, Homo sapiens
MTAVWEDHESEWSSSPLAGGPAQACICRGSQMELLESNEIASGKAGVGKRQCMEWMASLTVFMQPVHTERMAMALERRMDKIEEGRPGLVAYACNPSTLGGRGGRIT

SEQ ID NO: 1008665 - protein, 217 aa, Homo sapiens
VLVPGIACFNVSDHLVFSRKDPYESRVNDFVVHSQGSIRFKPGLSIPPAHGLDRASLERPVVSRLPLWELLGSPIRLLLPFAVPVIFFYGASPLRCWLVGDAVNGIPCSFMGYYAPSMLPVLQGAGSHTSGPLQPCQRKRRIMGPSPCRVSRSRFELIGLNHGGPWSPDLSSGAASCAHCGFSAQGLKQLLSPSSAPIPWLSPGHSATPLEGTGTTP

SEQ ID NO: 1008666 - protein, 214 aa, Homo sapiens
MCERSNNTLLLVAHIVIYVTQYNVGTWRLSSLLVNACSFILSGLFNVLINDRPAYSFVVITYFRYTRPYGRCDNTIVCDVLPESCFNPWVCLYSSSCVFSMSVYESVCVFGIRDIGCLRFFVFVNFLSLWYYLHLLYCILRLLCACSWTLSLPCLFLFIRVLHIVFSTVCSYVRLYTWPASLLIPLRFATACSCFAPVLPVYSVKSVASTLSYV

SEQ ID NO: 1008667 - protein, 118 aa, Homo sapiens
MVVSSGYRGVVPRPEVCQAAPLSPSNRVHLHTLNVNATHHCRVRPPSSARCTLAAVLSPSTLQVRLLRRLRTQELEQVGCRPWARRVRPLPATWGRHRHLKDLCTEGVLFPCSYVRPA

SEQ ID NO: 1008668 - protein, 148 aa, Homo sapiens
RVKSGPEHVEGQVYRARKRVHGCGRTPGCPNGEGYDACGVTLPCQASREPIPPARWLRANVAIAQDTVVPGPHTQAVVKHPEEAGKGKAKTLELPRMPIAGGNPEIVPPSPGSQVRSHIQPAPVSTYVRRSKTHEARATLSPPTQSPT

SEQ ID NO: 1008669 - protein, 193 aa, Homo sapiens
SHMASRPRPGIRLGLKEGNRRSLSSGLRRSRSAQEGWTGNESFSGSRDPCHSAARRSSGAAGAPVPSVLPEVATSAKPGEVWAEAVKVLSVGALPTPSLPGPPGLDPWLTLPGGHLCLHMCCRQDGQAASGVRWGGTVSTVQRCSGKGGYLCGMKLEEPCRLECRAKSVPLSSPDYEFLEIFVHALITRGTDI

SEQ ID NO: 1008670 - protein, 150 aa, Homo sapiens
MQNLEIERAVPATALKASLENSLEETKGRYLHSSWPRLQDDDLAALEDADWPRLRVRAWSQHEPTEYEDSVLDVEERALELGDSPAQPTRLSGGARTAHLLLTPQFYLWIAVITETVTSLQPPNPHARYMDVHDGKVVSTPASRSFAHKN

SEQ ID NO: 1008671 - protein, 70 aa, Homo sapiens
MEKSDLLLRFIAENCTGAYFRTSFHVLSTGSQSTLTYKCCEPPPRQVSRKAASDVVLVMYQNLYLAVNDF

SEQ ID NO: 1008672 - protein, 136 aa, Homo sapiens
CAWRMAVHPGRSVLSCASQASWRPGPCKEMVELCRISVSAPLAYPQPTRVLEKGCTEVLLLRSGRVQSAVSGWEFVCGQAPCSGQPLPVREVTGRLCPAAPSWEVRSPSARPPPRLGGVPNSSLRTGHDDSGSFVE

SEQ ID NO: 1008673 - protein, 149 aa, Homo sapiens
EISELRRTMQNLEIERQSQHQHESILENSLEETKGRYGMQLAQIQEMIGSVEEQLAQLRCESGAAEPGVQDPAGARRPRLEQEIATYRRLWRGGRPLPLPVLSGSQSSRDVTSSSRQIRTRYGVARWKVVSTHEQVFAPRTEAGPARSG

SEQ ID NO: 1008674 - protein, 203 aa, Homo sapiens
GRTYGGNVVSTGLMKNSSPLSFGPTVFAFGAHTRRFGGETARVNRVESFVDNYVYLPTSPNVVSGTGYTAGDIVGTTEAIVLSGPLTPRFAPFYSTSTEDSFIEHLLLPRQYALRPNQRIVVLMGESPTHSSVSAPPVPSPSPVPYGGICTEGGTFMWRFWGSPGSPTKLSAVPLCQPIVLRATAAMITMLAGGSSQDILPSN

SEQ ID NO: 1008675 - protein, 81 aa, Homo sapiens
VLDELNLVHEPTCEMQIENLKEEFGHTEEEPRGGDERQVRPGGGEIKCGDGLCPQDVDLSGHPQRELRDQYEKMAEKNRKD

SEQ ID NO: 1008676 - protein, 89 aa, Homo sapiens
MRSYKFPLTTESALKNDRRLYNTLVFIVDVYSRTSTRLKQAVKKLYDIDVAKVNNLSRPDGEKKGICSTWLLITMLSDVAQIPSGGSKL

SEQ ID NO: 1008677 - protein, 100 aa, Homo sapiens
GLWHPSVWVPLTLLPPFSRFRVPAPCPSLVTVVCSRCPLLAVSPCRLECSLLERSLLPLILFVTPSFLPAVFVDVHFFCIVFFSRDTDREEVVGIQSMSQ

SEQ ID NO: 1008678 - protein, 123 aa, Homo sapiens
GSGSVGPYVAVWCCMPCALSGCPYYGGLLHCGQGLSWERWLAPIRCLLAVCCDGSVAVSKTGRKVCPGGSDLGALPLVGFYLKFSCSVIIEVFGDGRVIQTISGAARPLPSFCTEVAQLIPNT

SEQ ID NO: 1008679 - protein, 325 aa, Homo sapiens
GIPFMSFLYGSFLFSSSALPARGQRLLLCSFHLLGCHLLRYLGRGTLLALVPPRGFCCLRIFYAVVLFEPFLFSPEGGYSSLVFFPRVHYLFHVVFSIVALFTPNSFQRFPFGRLICWFQIVALMCSSDPFTLNARVSAMPFWVWHLEMASICNYAAKVLACWSGHLATELVYKAVQCMHGCLWSIPVIADGRNPEMWVILRKPWPLGHSTVMMGSSTVACHHCRPLVQYVLFTMGSRLEENIAVWVLSDAMDNAPQQPGQIFQVKLTKSKWPRECLVLCRTKGQSTNLSHYLIAGIQHSCQEQLGSTKRLDPSPSHDVLWGALV

SEQ ID NO: 1008680 - protein, 85 aa, Homo sapiens
MSFILFLESSLDQADCRTTFSWFPGEPHSQPLVLSVPQFYILLQISLTGVTTAWPTARHQSTPKWFPNLNHAMTEAITPMANICY

SEQ ID NO: 1008681 - protein, 76 aa, Homo sapiens
LDAPLCYSHRCDSPLHIRCASLSPLSRSSISGNSRWLSEAKLRSLYYHFYFYSSMQSLYIGTNETLAFELTFAGAF

SEQ ID NO: 1008682 - protein, 176 aa, Homo sapiens
TRPRWFCRALTWIAALVVSRFPLSGFSPALYSIVGRPFSVPTLPAVVGARPSLERNHIRAGAACCLHVFSGVLSPFPASFLVFPVLARRSSPVWDPPCVLFPFGREPSRVNLLLASNPLPGISSITYDSAPCLACNNVGAVAALQQVLSPSFLVNCRWVTYINWGVLAPVTGNPPP

SEQ ID NO: 1008683 - protein, 152 aa, Homo sapiens
MSSSNPGFVGYTKTLLHSVEQVVANQVFKAPIRPARLPPAYLFPPPGGDSWHDGGPGGMRVMADEVASWIRGGPRWTCFMRWSVVEIRRVAFRWWSGAWIRGGFGGRNDELDPGGSPWTFDGYRWEEEEEDVEDLDKLDKGEHRQERRDRPY

SEQ ID NO: 1008684 - protein, 113 aa, Homo sapiens
GLRVTTMRRISDVYLTRHRSFRTVESTIESTYMELEGHVELGQRHVSLLAPGPHMPRSRMPWDSKQEASPEVAPSGGRATDTTDNGPERKQTLGTRGSHPVNFRRTEDSVGFT

SEQ ID NO: 1008685 - protein, 65 aa, Homo sapiens
MAAPPTFGTRAQHLLGKILPSTGRRKSRKIATALGPTARYRPGYLTPGRRRNLGTLQGQGMLNET

SEQ ID NO: 1008686 - protein, 195 aa, Homo sapiens
RVPLCAAPTSPFGQSANWSPSLPCKVTIITLLLRANSSLLFLARSAYRSFNHYGVDIFSGTKSPTRQIFRGRLPTLPCVSSTFLLSTSGPKCAPLCQAAFDLAKELLFPGLVLQPNAFPHFGDQNLSQLIPSRESTHWRQERAPMGTDARIVQAAVSCHEGRHLVSRVDLDHYRVISGTGMQDDDTALTLEAFGV

SEQ ID NO: 1008687 - protein, 227 aa, Homo sapiens
FLCMSPFAQLTKRAPFILILLLLYHYYFDYCSRQMVRLCAVIPLPTACLISIRCQPYNAAPCILSSLWLYSIDIDGFVHQVFLRNNATGYGFFQVDGVFLFGTLNVGVFPFATVFVRRGVLSWYRDGCYVSALLVCRRVLPPPRVMRRKKLGQLWPLEREWLRTMAMGTVLCATIMCGLPLHRIRDKRGLLARLQDATLGCGIPRDMCMLSVRERVYKVTENGVRAM

SEQ ID NO: 1008688 - protein, 106 aa, Homo sapiens
VSYFHSPYFLFCNRNPFSLRTTWVRSTTAVCSISRCTCVIGPCPHLTCLRLLMFPNPHFLLWRLNGIPHSVGQSCIALCLVPLRNDKRVLRQCTWMTLPRVLDDHA

SEQ ID NO: 1008689 - protein, 138 aa, Homo sapiens
MSPRSLLSLLVNTVLESAYDTTTALLQCIQFATYKDLCNGCYFCTTPRFCLLDTLVEAVPDQLEFRQSSDEYSSINACMNPDMICKARQYVSMTLHFLIQRLLSSLYTWSLRCLLGSLRVSSYRHRSIAVIFSFLIWI

SEQ ID NO: 1008690 - protein, 103 aa, Homo sapiens
MPDSGRGAFRVVDTEFYILGRSEDPSSAGGGEVMPHPSQGEPLKYIFPALRLCHTCLSHVHLPTLSPAACPDTPPVVPVKTSHLVLVCMVRKQQHLSQRLFNT

SEQ ID NO: 1008691 - protein, 69 aa, Homo sapiens
HASLTMPVWIAVKSWAGPVLRFSLHPLSFTYPHLAFLIANVDMYAMLSGRYLIDHLSGPISYNYNEQSG

SEQ ID NO: 1008692 - protein, 214 aa, Homo sapiens
GRIRLQSRKVGTKFVTSNSRNWAKDNVAVVLSVAKKFNGSWVRRRKPYLHTKHCQRKLQELKNGTSRLFNNFLTDAKRPALPEIKPAQPPGPAQILPPRFDPKDSPTHNQTPPGPDALWSAPAPDLRAMELVLSALQSPQEALHTPMPQYGSWFEGTMMPSRGQGGYPGNPRNRMVRGDPRASCGISGPGMPQIDVDFSLSRPPLLSPDHPYWT

SEQ ID NO: 1008693 - protein, 151 aa, Homo sapiens
EAVLPSRPLASSYSSYSRNNSRLVIKHATQPGGYYYKILSNGEFLGYSTIPCQLGSCTKILCLTYFRPKVVANIIIDILLSFGFPARIFVLVHYQRCKIGDGAVSYYVVCETYCCSLSCRQEIQEACADAVYTIMDPSVLVYLLRYNMPCK

SEQ ID NO: 1008694 - protein, 198 aa, Homo sapiens
VNGWAPPSALGPAVKVYKLLSVIVCPPVCQPGMAPMPGTAVQLQKLNNQYFNHHPYPHKHYMPDLHPAAGHQMNGTNRALPRLQPQAQRRQQHPLAARGGSSIPGGSGSSSGGGAGSSNMRRRQRQRNMPASVAQVPVAMLAPIVIDTDFIDEERLMSLVIEHGLGPHQRSCPNIWLGAKRVGNLMDRTSCCKQQAQQ

SEQ ID NO: 1008695 - protein, 173 aa, Homo sapiens
MLTLGVPVRGILDLHGSGLLRLDLEDKRSEDDYRSDQLGRYRLLNGRVSRSLEIEPRLRRNERNLEIVFPSTCRSLSNELVGIRLRSDDLSVGGVPIEPGDFGARINAIELRIAEDCTYTQRFAVRTRCVNRLLRGVQDAHWDPERIMGSTQLLRNRMVPIVHSFGFGTNGFA

SEQ ID NO: 1008696 - protein, 197 aa, Homo sapiens
RAQHDPLVTVSLKVHPTWSLSGLFGAFSISEDNEWKCGNERHLSEKGFGKASRFLPVEERYRHKDSCELGTLMIAISRRKAGSASSYDSVEDCRATQAPEHFTSESSAIIGPAVRHRYSWTSLASRLPCGTPKEEPRAASAARPCASAERNAIVCPSCLSTECRAVAIGLGRTKLSMFSAMLPASLRHWVSVIMWLV

SEQ ID NO: 1008697 - protein, 78 aa, Homo sapiens
TFVFMVKGGSPCGPEFVLSISAISKALVAYYQKYMDEASKKDIKDTLIQNDQYIAGRLASFDRVSPKSLEATGACARY

SEQ ID NO: 1008698 - protein, 466 aa, Homo sapiens
HRSDRASVPYGPSAARRSEMLSGEEGGSRRRSAGCRRQLTGTASAVPLAYTMAAPENGVMRWPQQPARPVRRPAEGSAPVEPAGGSCTPRKDRASVGHFASSWGALVRTPARGSAMGPSPPAPYVLSALAASAAPRHWTTLRNYARTILPAHAEPAPRNPMARACQSPRPTGLKKDTTDARLRLKHALVSRPFSTKARGRYCDSPGTRQHGRQGQTWPKVGPMKDKEVTHRKTGYLPHDTMRNAPHLSVKASPHTPFHGPPRLPTRVVNHDWHSPALAHSRIPLISERSGFGTRRGSQPQADFYMPHQTGARWDPLLPLCPVCVNPGVAFSTLYCVPHKCIKPCTSRTSFGLVLCPLDEALFKPFVNLQTLLGTTASSRQIDIANPPITRYPRIITHHISLEKLSTANCNPPVHSHTLLRRPTSGFRDIVAAFIHFSPIERRLFPTTLTANFAGQRLINVEYPKPT

SEQ ID NO: 1008699 - protein, 99 aa, Homo sapiens
ILYRGHPLLLAASYRFHGLQKVGYGSFADGPCNLPSHSCCNKDLGSVYHKVGIVSPIREFCLLDLEYTGSPSWLCDGRLSASPHSLPTLIVGEIAKFWL

SEQ ID NO: 1008700 - protein, 123 aa, Homo sapiens
LSPPCLRVPLFLSFVALILSLSSLSASDSLRSPLSTFPSGCPHAGGLTGGSPVPVSLVMFLRACCSALFVCCGPILVSLLVRVAAMSSCLASSQRVHIGVYFHHLLSCPSQSLSCAVHHSYPS

SEQ ID NO: 1008701 - protein, 301 aa, Homo sapiens
TRTVPSAVTQFQDEVYKHLLERSSRLHVTLMGADELGVSSDDPVTRRTLRLPVYGAEALLDRWLAKWEPDPREFAPRTGTNSDRLCVHYDSEVAWLAFSVVRELEVVGTKQLELESWCWYNSPFPWGPVLTQVQRNQRGHVRLHQKDFLVAPGLASWRRSPLVSQGWSESPSSENSNEELLSISCNSARCFTRTFTTEAAECQVHARSASLKSLSIVLHRTIRETWEEDSRVISLGTPVVHENFSLGKPVQWCPLFKECETTIWSHYNPRTGFACMGVSSVAATWGTLARNLEVCETNVYA

SEQ ID NO: 1008702 - protein, 282 aa, Homo sapiens
VFLSTLRVFAFLIPSLVVTRPSLADPFLISATRIWLRLLRNCDIRCLLTRAILTLYCGVLPFGISCAPFIPSCTSLLRFFLRVVGYPQFSLVFSLCCSWLPSGIDSSTGIALCSRLSLRYGLASCDGPLLSLVYLPSILCSVTESHMVSVSMDIQVTTPDCGIIRPCSCVDNDTPWSTPSGNRAAERSPAVWGCSSRLSEVLCQVGIVDQVRPWKEAASQSSAAVSDSSTWMAIPDHAATADQGHDAKGHGQPPWSRSCDAERAEASSAYSAKDSIAEVPAE

SEQ ID NO: 1008703 - protein, 154 aa, Homo sapiens
MHDTHKTNKEQTDQNRDPTAQRTSYKAKEVKTKGVTGRSSQSPDGQNRGDAQMREGEHRHQPGSPPATTTDPAQRHTHHTIDLRDDDPAGEKSGATDHEAEPANITTTMGAQRHETQRERPAEQHRRPTSSRPAGHTSLRRESGATDRERDQPR

SEQ ID NO: 1008704 - protein, 70 aa, Homo sapiens
AARASPTSTTPCSTAPSPIDHPRAEEYERTAPDWQAAPPAAPVRDPLGEASWAPESGGDIESLYVSAQGL

SEQ ID NO: 1008705 - protein, 214 aa, Homo sapiens
MPAGEGTKGPQLFQARFTRTGSNNSWPGLTGTAWQRRWHAPVNGLPPSKCTQSSCYWRSPMCCIISYDEYRELRKDTVTRTDAIGHETKGLKKGRLPREVLRVALRDPPHPVESHCRTVVRLIVTRKPPRVGWPPNRYPCEVSYPPFSPRQTGPGGHSWGTLTNDPTWATRGKPPRGNQAKNRRQGTPRERREQDLKNPGDIRSNRRNTEEAAE

SEQ ID NO: 1008706 - protein, 217 aa, Homo sapiens
VSPLLSPLPLFSFSHLSFSFLFYACVSFLLLSSLFSCLLSLSFLILLTLSLLYPSLSSSLFCARLLVSPSWFFSLSWVTFGVLPSSLFVRVLPLFVLVVFSFLSFASFIFFAPLLFLFFPFVFLFFWVLSSHLVTLLILCISFWFLFLSFCLFLSFSCNLCLFFFLLFCPLLFARLYLFFHRSSILCFRTSSLVTYRSSVTLDVQAALRGSPIRAVD

SEQ ID NO: 1008707 - protein, 167 aa, Homo sapiens
PRVGRSSMDGGSGYRRGGCSIDSSELSLRPSPTPSSAFGPRFAASGSPMSYSSHLTFIVQDERVSVLVNALSPKLGYCYVYEDNEVSSSLEGESIIIRHLHYKRIHHQSFSTLLYPWCGQTSHQTGLDANTTPLYLPTIATDALNPSYACSQRSHPLVSTRLILALP

SEQ ID NO: 1008708 - protein, 141 aa, Homo sapiens
RQETLKKAFSFMIPWLKSGKLFPGLRNPRPEEFILFKNKIVIKKLDARKYEENLKAELTNWIKNGQVKKVKRVLKNLSPDSLSSSKDMVKMFPLLVEKLRQMDKLPAIFFLFKNDDVGKRAGSVCTFLEKTETKSHPHTEC

SEQ ID NO: 1008709 - protein, 72 aa, Homo sapiens
FFYYIHNNTGSSTQMLVLGRNTLVGVLPIYPCYTSLVVARPVYYSPVGSYTYIHLGPTYVVEYTWWQRKTLF

SEQ ID NO: 1008710 - protein, 150 aa, Homo sapiens
MVFLSHGANVRHAWIVPTLDPELLRLSKVGRHVPTTEQVLQDRELVCGSHAEDGTTSKYFVSTSVLMRSERRLFGAVVGRRRPVTLDMLDLGAAQGKLGEGPGRSWWGQLTRPRESEIQIEYEANEDMDEGPGVGEPASQRLPQRRASYL

SEQ ID NO: 1008711 - protein, 113 aa, Homo sapiens
LIPRSPDSRPYYLRRRSLYSSSFSLRLRSPDYSPFFLRPRSPDPLPLLPQTPSTESKPPAPLSLRLWMLGPTIPSFLRPKSHDPPCHHLPTARAWQILHIISRKENVGGTIRP

SEQ ID NO: 1008712 - protein, 105 aa, Homo sapiens
MIESVKRQDEGRAEYTPGNKYNTPNTNKHQNKDDTNGQEDGRNKRTAKRRQPENAKTKTKKQRCIRAAATETGHTEHHGKHTTKKGKQKEQKRTKERTRTTNDEK

SEQ ID NO: 1008713 - protein, 115 aa, Homo sapiens
TRGSPTRRDQWVTAACEGTVSSVLQDLGRREPHPFSLCHHIRTACRNSCGIALSFKEGREPFSDPSRASPVLPRDPSLMTLRCLSPPEWRGRDADPVGDRGVCGGAIPRKAALSG

SEQ ID NO: 1008714 - protein, 179 aa, Homo sapiens
MYGVIFYMSLLQRMVVPCSRYHAPNKSTTQVRWRSKVRLVLIAAVTCGQGSLNGVGQRGRSEQAVSTPLYRCTMTKDPCASRVPVCLVGTWLRPPRDATAVSRQPRIKEPVSIETLRQTVRFMSVPLHVCITWLAGIPWHDYVYEPRTNVIGRRLTWMGMPFLHVPVTPRDDADVQTWQ

SEQ ID NO: 1008715 - protein, 52 aa, Homo sapiens
EPTTFMVRREGHPETLQSWHIKVKRVVIYPQSHEEPVKHTPLPKAMVVANGY

SEQ ID NO: 1008716 - protein, 145 aa, Homo sapiens
MAHLQGPIFLAAAGSAAHAVFPVLQDPASPPMALELVNAGGVLRFLEQELETITISGPAGAKKCHFYYNISEVKVTELQRDIFRARYYQPQQELMLTNHQVPPWGNAASGDSLLYWFFYDGGYINSLSMRCDPSSTGLELSLGSR

SEQ ID NO: 1008717 - protein, 96 aa, Homo sapiens
NSSSFPWSRAWNLSPSHLCHRSQDPCRRHYRACSSSLESPSEPRCHVRLRLQCDSTSEMAAKEPSSRRWTEFTSRIQKLCYGLTLWIYVDPALDHR

SEQ ID NO: 1008718 - protein, 97 aa, Homo sapiens
MGYRGEQQGPSEDLSFFWAHCGNLETTKLLARSGALEIEGSLGTPYMGESGEHGMRNLAKAKLEGLCQGSSRGYTGLGLRPSLSRLKGDKSVKSQNR

SEQ ID NO: 1008719 - protein, 244 aa, Homo sapiens
RLVPEPTTGDDSDAATFKPTLPDLSPDEPSEALGFPMLEKEEEAHETPKPHMRPLHEASALSQDPRTQPQVAARRLPASAVWRRGPDSENAGSRWVIQGQDPTVQERDRRSSDNPYLIRRRDKKKSRLPESPGAKHVSCPERHLGICQVYPGNDRGLLVLGCQMDMAKEEAKTTHALERYHNFNREKPRPPEVKTHGSSEHTRGGCYRGKGHKTQNHRATMDLQQTASRKQGGEENEHTPETES

SEQ ID NO: 1008720 - protein, 271 aa, Homo sapiens
MSLIHYSQNTVAKHCDFLHFKEQWGIAEVKVSTVRLLHTHGLSSTALPIISSKHRARGACASENMLASMRVSPWNSHGKPLKWKPTRVDPLYKIYTCTRPKRGTLSPYAFLARYHLARTNFHGKCPTSLTFLTIPKLGAVFAYNPNKISPRGAFSHVYTPFKARIASMWRPPCCVGAPVWSLPPIANPPQRCTPPDYNMVCQTFPFYTYTRPFCHTPPVVGGRHISVITNSSSTQFVGARHNTNPCSEHADSLGTVAFYVALSSYGGNMSR

SEQ ID NO: 1008721 - protein, 190 aa, Homo sapiens
LKRLAEQNGLLGSARCHLSLLAPTISAPTHHASVGLLDMPSEPCALTYPLCGGNRGPKCHWPLVRDEVTFSDDACVACHQGPAFLRRGMVCESAFVRRSRRGQWALIEPRELDGRPPSDPSVQQSTAVCERGMYCPKWKATRSPINRCSIAAKEMKKLPGLLEGRSIHSTRGHRGRRGIADLVWTCRSRS

SEQ ID NO: 1008722 - protein, 157 aa, Homo sapiens
HSERYLHKTPLLRRDTQDQTSACLLSCEKQPRNHRRGPLSPTNDVHPKAVTTLPLHNAPHTKPATQHTNHMPMMARCNTRKRIPRPPHTICPRRPKMRDNPIYYITSSFLRRIFLSLLPLQPNPYPPIMRALPPNRHHPAKSPRSPTPKHIPITRIR

SEQ ID NO: 1008723 - protein, 246 aa, Homo sapiens
YASDAIRLGSVMSSAPASGSVRARYLVSSSTGPDFNGIAIVWVHSARVGVQNYLEEAAERLNSVSRSLFYPSPCRYVRRCPAPVSERGRTLTSSAGQAGCPSLPDVLAEVLWHSDLRGPRGNQGVCGPPRVPGEISRFVDADWSGNLRVPCLATWLSAAVDDGCRGALERIAYVLVDSRGHTALDMVANAGKDRRNTLRSVNINDIHVPSSPCGEARCRALCIALHPGSPDSHRPVPRPFVYTPRR

SEQ ID NO: 1008724 - protein, 355 aa, Homo sapiens
MLDPPKAAIRDSRNQPVVRPEGATGPPSPPVEIPQTTINPIPHPWGKRSEGAPIPLTRDLRTALYPNGRRRPAPNRSKPKVPVPLAKPISGRQTLKPPKDFPLWAEPPYGRPLADTLGRDHPARFPKGDPKKSPRTQPRERPRPPPNGTRKKSAPHFNNRKITPANARAPARPRAVKPAERHPKKPPKRNRNRRPHPKIPQWGHKNALKTLFFPTPTPISFVDAPRVFPSPRFGGAHPPPKDERRDPILHVCRPLISGPPVRESAVPKKGARGREGGATPGRFQQTTPDLFKKALYTPMYIPPKKTPKKNTPNNYYGPHTQAPQRSGGTPNHPAEKKDRPTPPPRGVKHQRGPHL

SEQ ID NO: 1008725 - protein, 113 aa, Homo sapiens
CQETSKCATSKVLVMLDQPQIQKFKKAFTMMDQTKNGFFDKENWQDLLASLGKNPPDEYLNALMNEAPGPINLTMFLTMLGEKLNGPNPENVIRNAFACFVEKAPGPIQENYL

SEQ ID NO: 1008726 - protein, 126 aa, Homo sapiens
VQPLWKSVWRFLRDLELEIPFDPAIPLLGIYPKDYKSCCYKDTCTRMFIAALLTIAKTWNQPKCPTMIDWIKKMWHIYTMEYYAAIKNDEFVSFVGTWMKLEIIILSKLSQEQKTKHHIFSLIGGN

SEQ ID NO: 1008727 - protein, 90 aa, Homo sapiens
MYTVNGPPDTCARGTRPFRKAVRWARERPGAYSGTEGGPTEATSAARERQQRPHINGNNCVQTPSRQVRSRDYTGATTTAQQRGDAQHTN

SEQ ID NO: 1008728 - protein, 133 aa, Homo sapiens
MYLVEKNMMEQSDKRTSLMTDQNSMLWILFLRMIKKQKMIWQLKRAALLDEKIKKGKGNSAPETTGGKQTLEHTARQDTQALQLSEERQEDKTACTEHAENSIQARIYEGGNILTTNGQIMAYTYVKPRSSST

SEQ ID NO: 1008729 - protein, 256 aa, Homo sapiens
MHGLKPLPQDCSGAWHVVNQLARKSADVRPGKQARDRPRSGGPSGHRALPTVRYHTKVRAGRGFSLEELSVAGIHKKVARTIGSVDPRRRNKSTESLQANVQLVKEYRSKLILFPSKPSCPKRGRPVLADRTCNVRTQLNRTGFMARSGSVYKKGESSSHHLRQDEEYSKPFRNLPLCAVPRPGLCGNTGKKEPSDAARTRIVRHDNIEASLGTWEVHKGYRRLHSVSSGQGPPQVQLGAPLVPDRFGPAIVSPSQ

SEQ ID NO: 1008730 - protein, 378 aa, Homo sapiens
EAASDCHLAWAPPMRFGAGLRLRARAQILCTSSTWAPTLTGVASVEGGTQRAALWSRTTVERGRRADEFPVEPVRFTNLQPHGRRVPTPLSNAAKPWTSTRPLRPVPALPAPRYLARRAPSKQQAPCRTTRAHQGILARPSDVPQRLSNASVNASTRFTGNHLTLCNRGLWTNWVLSTVRCIEGLPECYGTGKPELSWDSHPPGQEPWALPLYGYAPIAMLKRAGTQRRNAIPDFRSHNKHAEVSMGCSFYPNGYHGIWRPKAPPELALVRYPPVVDRETGPWLAPVVGTLPGIFTPQSGAKGGPSVPPFFEYKGPLDNGNEAKWEKAIWEYITLSNNVGGTFMGKKDNKITFSPSGLHYETTGYTRVGKIKPGRTML

SEQ ID NO: 1008731 - protein, 193 aa, Homo sapiens
LVGVAACDITTVMWRMLATVSVVAPGDIAQPRMCCKGALACVAAWSHDGTACPVVLCCWRRVPTCVTCVTAVCHYTAQPLGVLGLVHDRYMHPWVMSMVQLGADDQDLCGDGCVLCVLLMLTVERYLKVDGDVIALQVHAGVDEKLPLHVAVLDAVVMCNNVPFQWNAPVVPKCARGPFCLGCRWLELWNRPW

SEQ ID NO: 1008732 - protein, 91 aa, Homo sapiens
LLSDSAHLHPGEISSLVAHTKPVWWSLHSNANEIWCHHSDQVTSLWEINPLSSCSLLHEKDPPTISAPQTNQPKEHLTNFKSDLLSLAAED

SEQ ID NO: 1008733 - protein, 388 aa, Homo sapiens
HLEEICILFPLPKGRTLKLSGPRWEQGKRARGTRMASEVKAEAIAWEFGATYGPVGLRRDLWCCHVLYTIDRSGFTRAPCLRGLYKDVPAKHVRLSTNPATIATQLVCCQCPHVISSSHPRVRGRTNAERTWKPRDMKLAAVTRTHSCQLVETPMGQCATAEAELPEHSIVVDSSAKTPNAYESTTETLEDSLIGGGPRPKGRIDPNLRDAPRGLGEGESQATQARPAYKNAQAHYAAYGTFRLLTKNLREELINSSLGNLPAPGKGVRWSHSIGKAKFHSFGVSIRSYVPYAQTHAERFVNLAIGLGLELECPVLARSWGTRLCQKEDVPGGGFRPFFNLDTSDRDVVLALAPLGAALVMCLYPRKVGTKTRGVFVVSPPYNMAAHN

SEQ ID NO: 1008734 - protein, 382 aa, Homo sapiens
LLSECPAAAWMPSWATWRHLWSPAMGFHLPHGGGITRRGYLNKDTHEQLSEPSECAQTTWTTSTDERLRLHSSVLRRCRRDDGHRRSCLLPLSGQPAKLTFRWTLRKQITMEELDALERVMDEATENADLLERAMNITSRRFTQRTYEASCLGQGNQAKTYSLEIVLYDRELAQQMAAEDYYDVEAKGPMERKGANTITRAHEKQDTIAAYHWARDGHVTGTNPGYTTFQYPKAHPNQQREAWEQRMHTGWARTGPRKTRNGGATKDRETPAKLTTAEHNAVDMNEDTRTTAPATRTQHGELAHGEHPLYPTVPATDPNAINPPTNTEATTRQRHGGPWQYPRKSDKPMERTPAQPAAKRHRDKRTTGEGANQTTNTRTSRR

SEQ ID NO: 1008735 - protein, 50 aa, Homo sapiens
MFHYEEGMGMAGPKLFFFFDGTKLSSQEPATELGIETWELNEGLGLPPTS

SEQ ID NO: 1008736 - protein, 106 aa, Homo sapiens
TKQEVNASWGTFLRGLAECVRYNRLCYVLHDFCDFIENLHNSVFRLWITSVDLCEGYICVEWVPPCVAYKLYFFHSVLQVKLTKRKEVVFTLNGLVGLLLVRLSEH

SEQ ID NO: 1008737 - protein, 214 aa, Homo sapiens
PRDRKMMTIWTYSPISRKTNMQVPDKTGSVVVFNGVDELETRYRRLKLLRGQQRNVLWKRCSISCVSYELFHVPRREGPCHALVNGVMNDWDCIERVNDILADYMGYCLWILMLSIAEVHDERDASALVDPMECTDRDRRSREVHSPPASLVPRIHVIYSPDSCKHIKTIMACADLRQKRRAKTSNRSIMYATSLQSETELLGYPLTQCALQGR

SEQ ID NO: 1008738 - protein, 105 aa, Homo sapiens
MKLCVTVLSLLMLVAAFWSPALSAPMGYNPPTACCFFYTGRKLPRNFVVDYYETSNLWSHPAGVFQTRRSTQVWADPKGSSIHKHLINRELNDIRINPKSSRKVP

SEQ ID NO: 1008739 - protein, 449 aa, Homo sapiens
KRQSPFSTWGLVCATGREEWGRVCSSLISMATADGTLGPQNPDTLILWPEGPDHVTPYSGFHTQPRPSPMTRMDMHLFPGTHLTPLLDLPFRTWPPCTLQHPSSDPHPSLHQMRILHSWVDGPGAEWERHAHWQDGYDTGTWKSRTIRRYWSTSNRRNHEIHTMMQQGNREERMNNNRSKTNGTKQTKITHLYTTKTTGKNNTEHYQKDSAICKINAKEKTHGVEEHHSTYQGNATSNRMRERDYRERATKPGQRHSRNTRRHSKTRRPPMKHTENQGPDSDTQHKQQHKQSGRRGTPVNGAQSTHEITPTITHTDKHGESNSPPKLGANAQTVSETQIQYTKQLKHNRGNDSTDYRRDEKAHALEKKGQKNHAETAYRYRRNQPKDTKVTTPYDTHIDKATGYTNIEEYETIAATINDKKGGDTDNEQSTKRKTQQQNIQTTHQSTDK

SEQ ID NO: 1008740 - protein, 440 aa, Homo sapiens
EQQYGCRWVYGVAGWRLENGDSPEPPAPDMARVVGYVQTGWTGRPDVPVSRRSCLAGQAGRQEGMTNALEKEVRPISNAESDLRPKTRPPHSSSILFLFFLLSDLPTYLPSSYGYHEPPDGCDWLLQFPRKIALAVLRASRSGPVEPSCQCSVLLLPEVLPPLRDFLSARASSVIPLLCAGQLKVRCRIAVVAALPWRWCKERKGHTTYWGVPPGHRWHRLQTRRGEWHRERAMYLVLESPAGYINLLCKRSVTMGARRLAKMFGPRFELILWCQTPTRGTSSGSGEQALRRCYGLAKGFTALGSCTVGGPLGRIVFPLSPNKRHLGLGRYGVGPRNHADLGKNLGMNYTTTRTPDPLAQPQHNPHPDETHPRERRPKTLRAQCHHKPARLRSAPHLRPSRRSRNPTAPLPTRAGPTPRRRPPQVGQHPTTTHHAHANPC

SEQ ID NO: 1008741 - protein, 306 aa, Homo sapiens
MAELHLQHEPISSLEPDSLTALGLRSSLQQPPPVCRVTEPEFDGSCLAGESGALTMSSSPVNVKKLNVCLELTEELKKDALSDKGLKAELMEQTPGCSWTTRMAWGPTRPWSPGNWQTRPGRGFRWCARGAGLEQEARGTAAMKEEEEAGRGGGMESPHLDGDQMELGEENRGRRGADDSGPMEEEEADSEDENGDRIRDYHGQGGTMTLRGTNSDRDAERTKKRGTGEPARHQTDGRRTQANSPKKKETVDDRRRDRRVNEARRDHTHDMNKREEDGGHQGRDGKGTKAQKERGKKEGDRDKGEK

SEQ ID NO: 1008742 - protein, 240 aa, Homo sapiens
MKAFALVPTCGIYTLCHPRKRFGTLCLWPVGPLWSMRTPRKSGQCHDNHSKGGHWNGPHPGGVKRSPVVTKETPRACAIVLTRGRPPQERRRPPTVGWGILYGAKRRQQAGSAQMALRNAQDPRWCAINQEKWVRTKGRHINEAPLVRVPHFASKERGAPSRVVTVRAQPLEGPTETWNCGVATCVVERQEHKSPIRPFGRLLQGGERTNRRPEHFRYTCPLNTGWRRSLGCSPPRFSTQ

SEQ ID NO: 1008743 - protein, 143 aa, Homo sapiens
SRIRRAEMAPRKRGRTRTNNTRHQPSDLRWLDSRKCTLVVCHILLHSFNVHSICPMITDSLSGRGTTHRVLLLYMVGIDRNSALPYDSNSVTYMHAYVGVPEECASQSVLRDAGVSTLTVLLVKSILRPTKECDNKDRYELHV

SEQ ID NO: 1008744 - protein, 352 aa, Homo sapiens
LDGALSEEPRGPELGSLELVEDDTVDSDATNGLIRLCLNQRGTGQTVRREAARYSNERTMTRQAAGPDSENERVSCFHGHHQVGKLRITTIPPPMSQADATSELTDTTARTGNADGLICSQYRAQQRLHNGFLANSEDHATVHDSFQCNKYHDLNGSTPRWNLSEPTDDRSCVLCYALTTTLRQKQPRGLKKLLRPAQGRPERPDNGSQTQRTAASGRPNVNNPPPHTLSCHPATLTLFTKLLPTLPPTARPRTRPPHPTRDSHHAAHTLRPPPNRTRPRHEPAHAPTLTLGIHVSSLYPYLHVTPPITLATSFPTRTPCPASPMYTWQALTLALPSFTPSLTDYYAFTTQT

SEQ ID NO: 1008745 - protein, 169 aa, Homo sapiens
NFPVSASQVARTTGTCHHACGPNTLGGGGGWITWGQGIGTSLASMAKAPSLLKIQKLAGRGGAHLWSRLLGRLRQENRLGPGDGGCSQPRSCHCTPSSLGVRSRLSQKKINYHFLQKIHLHSSRRSLTSVNQAGVHWCDLGITATSASQIQVSFLPEPPEEVGLQARTI

SEQ ID NO: 1008746 - protein, 290 aa, Homo sapiens
ARGPQKHLKRVAAPNALDAGYNSTGCVSSSIPSTVYPIKYERVSPPHHFPEETDLSVPCTGRMRVKKICMQQFIKILDWLRSDSDITYPCWHSWMSSRVDNDEERHFRLIYDPKGRVCCTSVLSPEESQGIKLVQSDDKIFVGYKTESLIWCLMHDPYHPSTPDLPHQGEMIAFRIDLVDWQELLMSSSTITWLKLCMVDVEVANLENYIGVITKVRQAPWISMKQWSTLKRLPMDNGYCHSTFQACVVIWARAAKPWIFSFREERGIRLTIAARREDTQYWRPKQPQVR

SEQ ID NO: 1008747 - protein, 87 aa, Homo sapiens
MALTRLLLTNDSLLHAKLIRELLSPAQPLCAGTHTAASSRPRRIQDHARALHFALLRASGRTLNQQQAGERTALLLAPRIPDPTSRT

SEQ ID NO: 1008748 - protein, 231 aa, Homo sapiens
LSKSPCALLLCAVGVWGSWLMVRYITSVPMPRQYPQALPVLELASRTYFYSLTRESSIIASAQSCHGHEIYLNGGHLGPRTSWTFVLHYSSIRLFFSYYSSSGLSSDHDSQLRTIKRLEVRRSAPPQSMGRLGIGAEEVTSLRSPFALTLSPHRKEAVYPLRQAVSHQPVLGSFSAILHSSQDQQNVGEASWIHVYPYKRRSSNRQPKVGQPNVYTLDLRENPQQFPNFQN

SEQ ID NO: 1008749 - protein, 111 aa, Homo sapiens
MYQRDASPTAIRPNSKYTLINYNGIGEYAIGYERTIILDILSLSCISLPTSNSLKSTNSARKYLAAFLIFTPYYIASSKRVQNIIRLIHTYTHAILYTIVTLKHSLGFINT

SEQ ID NO: 1008750 - protein, 77 aa, Homo sapiens
KQNNQYRDAETNRTRNHHRTAQGTIYQPQPILTLVASLPRAIPRNNPTEPIPITYTYSATTPNNRIATTLVLTTPTY

SEQ ID NO: 1008751 - protein, 281 aa, Homo sapiens
KWLDDAVCSVGGALGCPVWPWDGEPAVCASCWSVSCSGILVAWGLLAVDWGRGLRPAELAGGKAEDKEWMPVTKLGRLVHGHEVIKSLEEIYLFSLPINGTQRSIDFFLGWPLSRMTVLNDYAMCRRQTRAWPCAPGSRPFVAIGDYNGHVGLAVKCSKEVAPAITVVAIILANASPFVPLCRMKATWGVNNDSANAPHCTFGTGDSAAAGFLLLGTASSLEPTVPLGHIVSVTLLPLKQPCLTDWAGYSIELPPRFESWVSATADPGPTSANGPPLDAPF

SEQ ID NO: 1008752 - protein, 188 aa, Homo sapiens
EGQCSRSVRRGVMVRPKVRPEDVTGCSNRHVLTSRWPRIPTSPSTILPYGVFSTRGDPRPRIGVAIGCSDPGPQTSSRHLFTGTCTVLQTPGCLQSDYIQQLHGPWVRLPGRRQRVFLQNLLVCEPSQGSEMTPTLRKCAYIIHRIHAKMHHSSTTRTNTTRLTITFSDRHDNQTSRIMYKRTTENAV

SEQ ID NO: 1008753 - protein, 104 aa, Homo sapiens
MANELLYVGTTLNAERENAMSEPESEARYRIHPMTKEIDPRRDRVNGDLAHKASPDKNGMVIEHDHETIISKNVTIGKYPKLVIFEKRLEEREECFKLPQIKAL

SEQ ID NO: 1008754 - protein, 65 aa, Homo sapiens
MNRQLHEQQKQSAKGRNGAPMRSQKRNSQGAQKYPGTHKRRKPREITLKKEPENTVHKRPDNPAN

SEQ ID NO: 1008755 - protein, 305 aa, Homo sapiens
QPRVIPRAQCRLLPLLALAGGPDVRCCCCCWAMAAVGRWGARALVRRASCACGCDCVPPREQTAEDWTSEPSLASHLYTDDMFTHEDPQRLLTLRHVLRALVWTLPAGCIATWNDLWRQIQHAWKMPKSMLAKVDLHVPLRRVLLHQWVCEDTPPYSFYKPGQEAVKYQGPRDFQDTGLNCDAVQTLNEEPVTPEPEGGTCTYAPDASCNGWYELSASKYEPCTLTPSANTTLVQLLRSRDYCTPANMSPLVFQSLVDAQSLTPEDLVRIYRQHLSTAIGTGNSAHGCTPANSLTHPSTEKHTRV

SEQ ID NO: 1008756 - protein, 151 aa, Homo sapiens
MGAWEIPMKEHLFTSDQSSSTKLTMELSHDTQLRQEALTEGHNCVTKSHDILGSKCTISCYSVATIVGEQYACTDCPWISPLARKALPQSVQSVVRLLGGFRQLNSKLGNFSTPIDIASAGIVLTRHRLEDSYHTGVHNGKIAQLVLHRHR

SEQ ID NO: 1008757 - protein, 175 aa, Homo sapiens
MHNNRKTKRKRKEETKETKGNREGDRKRTEGEGKKRKEKKNKTRKQEKDTKRKNEGRNEKRQQRRKEKKQNKNTEKGTAEDEEKREQEKQDESKKRQTKANKRQQRRGGEEGGKRSKKDHKQKETKRRRREEREGTERTDHTQKKRTGENRSEEKEEGQETRARQKAQDERERRA

SEQ ID NO: 1008758 - protein, 94 aa, Homo sapiens
GSSSRDSAPDSGEQAAASLAAAAEAQGENLSAVFSRQLKRRTRKHTTCAEIVHGVRVLGRALLRGPWSAPATPEWLVAAQLTTGAEQRRGEAGR

SEQ ID NO: 1008759 - protein, 224 aa, Homo sapiens
MGRSGGYETKTTGVKRKEGGPPPRAGGHTIIDNHFHDANISEKHPGNTTLLKKPPPQRSHTQEKSIAGDNPQRGYTTVESDRRKRIEAHNSAHRRVRGNTPEKLTQRNKHPTTEGQTKRRLVRDKDPHEIIVATPKGVSGKQRRERYNTRTAEKGTDKPFSVARRVDPSSKDRHTHPSGRSKTPPQKRCSGTTKEARRVEDPCEGGSTPGGEPIIHNNHNDVAD

SEQ ID NO: 1008760 - protein, 184 aa, Homo sapiens
MEGHAWYQSNGLGEACAGHVHDKSAIDSEQGGYTELSAGGHGLPHVTVALRSDGQRVPGGLKGIARLAPRDHTKASLTIAQDDNQKAQEAVQDQILEAIDEAHLPTKGRKRSSRLIRSHCMEKRRRRALTQAQGPVAPLNKWLRICVDVNAPCALTRPMRLVPRHLVDLETIIGDSIVAELFGI

SEQ ID NO: 1008761 - protein, 149 aa, Homo sapiens
MVVQRLVNMLRFCLVDMMSEYLDRASRVQFNASSHLFYHEHATEHRRKDADVHPDVARLATRALVSSQGSARTSAVSRAFVSGAPRQCCHKQNYQEQKIVTDILLGKRKVALCAVPKGTPKAELRLIEALEVQPARLVRGSIFVAEILY

SEQ ID NO: 1008762 - protein, 144 aa, Homo sapiens
MGLAIPCTESSCHMTRGRTGLSASPQQRIDIHRAEPLWLMTGNLATTLRDHTNSECYRWAELGTGRLLRPQRRNYTLTDAYPTGKTGRIGSKTACQDQDASVSVKEEPRSRGAHGEWEGHNKVREAGTTTTSDETGRQKRRGPK

SEQ ID NO: 1008763 - protein, 227 aa, Homo sapiens
ALLCVPGGSHYPGPCLLNRLQVQYAIGRVVKAQAGLPLVAEQRLPLHLDGSSYKRVIVRKATLPPKIHPAHAHMVMQWQDVPLLRHMAGLDSSHGRHVDPVLLSQAEVICKPDMHVSQSLTARAVVSRRQWKNRVKDVAEHVTSITTASCMDDKSLVNAAVPEGILRDLRQNRWPVDASRWVTVHGAILAERKYRVSRELALDSSPDHVVREDESIAQDVCVRDVRM

SEQ ID NO: 1008764 - protein, 224 aa, Homo sapiens
MGEIASYDKAKLNENGGRRTNEHPVLTIRDHCRQDEGGVTHFRNESWYGFPNPPSLFETPGRGCGGQTPTARWTRATECCSCRTLVRSCPCRLPTVPVAVILNGIPPTNSGPARNSPGYVAARLLYRTSELLYLNYIGSNNHQDFDGLGPGQREKPRRLIEMSVGGCWERPEGSVNWGRTSTLACLAWYADTSMGATTGGLNVSWILRTLARCRMDIPGFKAPG

SEQ ID NO: 1008765 - protein, 115 aa, Homo sapiens
MRLLISIADQYNWLLLARPTTFAIIDNLKYSSFTHTASITSPFYSRPHYHHLETLTYAGYWQGGTRPYVYNHCTQTSQPFLNNPRTVSRTANGMHLDTYLPNTQLPAALTYAGSI

SEQ ID NO: 1008766 - protein, 113 aa, Homo sapiens
GKNPWFIPSVGPFSRKRPLPPLGWGTCGGRWDFPGKLSGEAVRWPSSVILALLPHFFPGRLPLPGVQRHIIIAALKRRQPGVGELPYRGLRREGFVYPPKNPPSPRDTKINSL

SEQ ID NO: 1008767 - protein, 393 aa, Homo sapiens
PVYACCGANRADCSVEDRRRSVVCRACYLPWAQVLLLLPRSLAVPLLRTAQPLPGVSCLILSHQEAHPVVRRPGDSSVTACLGPSELQCGLRDRSSQPNLPRWDVVGFDCLCTPYSDDFDDMNRSVCQRYTYLRTHTVPLRQCEHNESGPGMCDQLVYAHGTAEQQSPVMCAHNLYLLLTGLATELNVSHHRQYTLNHSKRACLVLYMRMSARTPDDGCRRRSLRVCNDVGWSTQNLVQVSLGPTSTFRAHATFRMTPPHTPACDCLAISTLGLRRNRKLPIVQRNIVATCHFPSAALRTHTCLGGISLFNSVSTPLVTLHHTTSATFIPHRSVPTSAPFLNGLRQKSARASGTRGRSPPNVSVSQHVGLSRVGTTCPLVHHSAPCRTVIALL

SEQ ID NO: 1008768 - protein, 69 aa, Homo sapiens
MRENFCVNLALETVAYSYAYAAPWAPSSYYGCDLQPVTLNFTEDQTLHFHVATSYGLEATCIGGCYTTQ

SEQ ID NO: 1008769 - protein, 365 aa, Homo sapiens
MPVNERCDQERFPCPCPANAPLQRIRIHVHSQRSIMVSTTDPMDSNLIQLTGQSFSTDAAGSRGGSDWNPPSGSPAQTACTRGGSPHIRSHQTETAPRRTSSPPPPRRNATNHEVPGTSGYPCATRYHHSERARFADTSAPRPARLAHDTRRYPNEHAGIETDDGTGKRWTYPPAAPPHPTTPETAAHAPTTPRNRSHANGSHTRERTADPPPPPHIGTANTGSSHMHPAPRAIGHNQLQHQRDHPSNTPTPTPHPDTTANPLPNCSSAPRTHQTGRITHHNANTQRHHNTRQKPTPTRPATLAPPLGQPPAANHNTLHNAQQENTTHITTHRKKSTTGDHTTKRHPCTHHSDTPTPHTGDATTH

SEQ ID NO: 1008770 - protein, 221 aa, Homo sapiens
MVRYRRSGVGPLKRAGASPPVWRRLGRGPPTAREGATQHQVCAAPRNRVHLRALFFGKDAFEVLWCLKNPTTQGARGRGTSRGGTSRGILLRIPEGGFLLGIAPKTLVFAHVKKAQRPPTPGPPGGPPEATPHVRRTYGHTLSWGCKPARDPLGVALKKGDAQNFPRIYVGYPLAPRMRGEPPRRLHTGSPPSPDQGVCAAQKKGVIYTPECGRPRRPARI

SEQ ID NO: 1008771 - protein, 247 aa, Homo sapiens
AAGRWRVRGLSGRYRRGISAIAAPVGRTALLRTLSLAVSTVSFVQALLVRAGDCEVSRSMARIVPCRCGLSEQSVFHAHIATGWSSREIDRGRAQIGEHLQKQVMRARRTFSVAICGVSKAKQSRVGHCAMLDPVEDTDGEMTHEGASLFILAYSEPWVCIERDLTTIEGRMSKGSGLKAVGSSLGDIVAEAVGLEGPHTIDERTRDCESLRDACQENDCISCADCGSLTYPGMPPGVRRDTSLLGP

SEQ ID NO: 1008772 - protein, 144 aa, Homo sapiens
EESGDKYGNNHDDSEHRGLISVITWPEGWSGAVGTEEPGIRTVSVCMWYCVNKHSKRRNESMLELMSELLRVDIISQYVRKDLNGIMKVNIVEIMLIALFVAASRRKYVKYRTAVDDIWQELQSLRELDLYDNQIKKIENLAGR

SEQ ID NO: 1008773 - protein, 374 aa, Homo sapiens
VRIERSHQQARPDTFPDYGDVLRAVEEAQLPDTDSGLLHGTSSIPASWHQDAIHDDCRAIEAYMEPQVTIQMLDLQTFGWARLNEDALIGRRGIDTCSYIKIAVAGARAASRIREENMPEAVLGQWTCWAGDWRVHSYHIVIARVALGKDQNKLKRGRRNERDRYRTRRTSYGRHKPDKRMHIRQPCMNKEGNASGKRSLAHVSIYPLGWKEGLTSKPRDNWVHSLRGGMTPFSDPLPKKRPLKRTKEIDSRKMYTGKLHADEEKIAHVDKEAKGHRGQEARGNGKGGDNGNNARASGRENAELDKDKMYVEIRKGVSGNCALRWGHHQQNLPTRGKPWLQGRNEVNKNLVRDGPGSRCKTDHTGKGGKQAQRA

SEQ ID NO: 1008774 - protein, 79 aa, Homo sapiens
LIAVRRLRRNSESGGPLWLTIDRDLVERLERGEGRLEAEYLIALTCIAGMQMSPSNSRRRSPMMCQGDYDVRMACMAHM

SEQ ID NO: 1008775 - protein, 68 aa, Homo sapiens
LRNDVEHNVARMVIGGPYNLALITSDLTSMCHRSPKRCLLLQRSSCGAPYAWATVLTTPDELDLLNSA

SEQ ID NO: 1008776 - protein, 135 aa, Homo sapiens
MCPCEAQGMCRTLAGPPPKNREKGQEGILSLRNLSKAAKALCQHRGFQNSWPSRNVVQKDDIRGYSATPKLRKVGAAQRGIREAASQPPGNSQGSLQGATVGPGALKRSEAQARRKGPKTISHPGQRKEGSIPET

SEQ ID NO: 1008777 - protein, 102 aa, Homo sapiens
MNDRRGCGRRVRRMEEMRRCTEKYACDRIVYVETGAEVEEVDQHEECKLAGAEEDKSGCCIVELLEEAIEMEIMGGQFMSENKYCFLQFVDNDFMREVISDR

SEQ ID NO: 1008778 - protein, 299 aa, Homo sapiens
RDSTWPCGHETASTPLVFAGNTGELIFLVPGPPVWPQRLVQGRLVMPVSKLGNVRDSNGADRPFIGHGIRQSMQWAFFPYGYAFTTGSDDANVQPLSTCGPIRSSSCTRHDNIICGNHLWCLLAQQDGCCSLATTDVQLATSWDAMKGDRAGGPRWPRTTRRELPRGSRTIGNGMMATGLSGTSLSVNDHGSYLARSPQLGQGQEGPLPMHHDYRPGLRGWRNRQPPSHRAHRGWVHVPSDTRSWFLTGGRTSCGDKKGMEWGKEEEQEALILLHALVVEASPLLEGRRQEVEPQGWLF

SEQ ID NO: 1008779 - protein, 69 aa, Homo sapiens
GRVGEEDEEELGEEERGQKRKREPEDEGEDDELSGITYFEKFLLGFDCFYPYPLSPHPSNPAPLKLILD

SEQ ID NO: 1008780 - protein, 423 aa, Homo sapiens
SSRRLMRRLSMNGQVSDGNDAEPFAMSDIDHLDRGLDIRSTYVVASFGLCTVHITGSPLDGSCAQRCPLQRLVMGSRFMIPIKNAQGSLVAKGISELELLELSGQVCDEDARILSPWKALQRHIAKISACGCTVFRRSADCKVENRSQIYSKCPNVVVTLNAGSPAVCETRDMNSSDLCTTQLDPIWGREILQVCLYENYSGHEHLSQMICSCKDYAKWNSLEETELGEGKPTLSIERYLRDTSRQDDLAQVTEDTFSRVTKDGTMRMRTPRISPAGNGNPLFSEGIPLDILLPNRSRGLLRGDLRRFRLASQFLQQPKESKVNSSVDARKTGSTWMDNLRRAAEERFKVREVVVVLVAPKVIFLVNGKLRRSVMSIPGNGVFPTNKTARVSTIVKHFFVMVPQRMGTNIVGERNNYIVAISC

SEQ ID NO: 1008781 - protein, 107 aa, Homo sapiens
MVRSCRQRRVGRIHLARKRCVVTNTARSQVESANTFPCVTKTYLPSQFTPGGCQGRRIPWGVKHNEVPGRRKWRQVIFGTLRLEHRWLRNHVGANGSQRLSLGCVWG

SEQ ID NO: 1008782 - protein, 271 aa, Homo sapiens
ADLNQVDEELQMCQNKSPSGPVESVTSGEQPVGVEGGAAELRPTSTVEEVGYEQTSILDIMRSKQRSVPCMGALCVCSIETVGIVEPEMKGPPGLSYLGPCRAQLVGSLLLVKQIEEQIQEERGSAKMAEMMRFGRLTAGCMIRTFLQNCEDEDRGRGTMNAGTEDARTRSSVVNASHYPEGSGARTVVMRGGREDESEDGYQVSYDYLGYGEKMVCPLLHAHRVGCCDLARDPGTLKLDKPHRRTPHQKRAYRILQPCGDKGTSCGDMCT

SEQ ID NO: 1008783 - protein, 192 aa, Homo sapiens
MSWHTRAHLLNGNKEDSIVNLYHSYKRPSLDTTVDIKNNDTVRTNNQQDRMSKMRRDKYFTEPEDKAHTMEQAKERENTTQKRTGEEPAGQHMENASAPTDARIHALNMGSGNKSTTEHSTRCGQHRLQPTGWRQRRNRYQRKKTPAEHTPRTAPYHQNDRRGNNERRTTEQETRKKGLPKRSKKGTEHAEE

SEQ ID NO: 1008784 - protein, 226 aa, Homo sapiens
LKVFSIFIPGPCGGPGREVYKGVTGPPGALSHPGASRPGGGPVNRAEGIQNRASKSPGHLISRGPGVATMGGTGPSQSTEEKGSTCGCAPRHRGALNEAWGGDRHKTKEAFKRPSLPQKGGQWGQWGTTIHPEETQGESPGRTPVGCGPHAPNRGSGEGSNKGRRVDTTPRGVRERGPHTVSTPFGGNKTESKGSTKQRYSSGGAPGANKTHPQQKTHRKETHIGN

SEQ ID NO: 1008785 - protein, 460 aa, Homo sapiens
MRRTSSRSRAAALIFFFLEIEFSLCCPNWIAVVQSRVTATSASQFQAILSPSASQAVGITGLCHKVMRPFALMNGLSIIVGVWYSNLKSECLGNFIWYFQVRTGVFTPIPGHVLVLELPDLNVDPPVYSLPKYWDHMAVSHHCDLAYIRSQSNMQRLNPQGIVGPKILPRSDKEQLNISIVTSCVSIEDKDIICTYEFSSYTVLNFDAINNIASICCFAQNFSKSIQNYGWYHSVDLVDYIEDCALGPLLHFVQGYLHVISLKQWCTANNHAKIKGDQLPDRGHWPQVVSPDDYERDPQLHVHTRDTALDATPKGKNQLRDDYIDSEHRTRKKNTQALTEQKHEPAPTNARSELVLGRYTCGEREKNDTPERPALATPHGAQDPDGRDTDVTNTRGLHEENDGGPHSASTEQEKAPSKPPRRNGRDDREDREGYDTTKTHDEHADKHERVNRESDDESDE

SEQ ID NO: 1008786 - protein, 104 aa, Homo sapiens
MTVSVLRSISLALSPEYAVLLEKLVPDSRAEKRLTYAGASIVCHSRGGTLVPLSVDLDTLLRSKMKKGEITKTDRTHRELEDALGNGKILKIGQKGTSKEREVP

SEQ ID NO: 1008787 - protein, 157 aa, Homo sapiens
MSPRLWTGNSPPGENNDALARLDSVEIELPGCCAFALEGAKETNPFRSLCPHFPVQSKTVWDTNNRLGGNKFLRPTETSPNSYRKEGRTKGDSEFNWPGELAEAHTDRCSVGYPNQTVPLPQVNLTQRKAPREFGFRFHTEEKRYAREPEPELAVGM

SEQ ID NO: 1008788 - protein, 114 aa, Homo sapiens
VPESPEQLLAHRAAALDFSLGLGCLPTGQGSGPCSPPCLSLLPNPWAPVRPEPPRASTTSCSTAPSPIDHARAEECERPAQDWQAAPPAAPVQDPLGEASWAPESGGDVESLYI

SEQ ID NO: 1008789 - protein, 121 aa, Homo sapiens
SVIFYFLKRKSSWARWLAPVVPALGRPRWVDHLMSGVRDQPGQHGEASSLLKAQKISRAWWRMPVVPAAWEAEAGESLEPGGQRLQWAGIAPLHPSLGNKSETPIVGKKKQKERVTCETPF

SEQ ID NO: 1008790 - protein, 235 aa, Homo sapiens
MPSWTHGSSTRCVQIAVGADCLGGQRGGKWAHQSSWSITSSTMTRAASMTMLYEEYTRTSQELQMKRTGIEAFNETITIFEEQGQTHEKCTATEYLERFRALQGTRRTTMQTDPAELRAAQVPHLAEIHEKPHEAGASSCGAQDLGTTERSTSRMNTALKPDTHAASARIRRTSTIVWLTPDNGARPRNEQSNDAGLGTPTTWQTERRKERTLMEETTDRISTPPTKANATRGTA

SEQ ID NO: 1008791 - protein, 241 aa, Homo sapiens
ATEAAWSSRVGLRLSGECPQDRWRSSRHESSTVRLRNSSTDSCHTNIIYESALATRYSHQLWLDFDFPSGVPTWTSPIPRPSIPRHDDDGNQINAWSNDQKITLKDSGTSLPCGIYDGTSTVYPLTVDHLCFETLTESSLVPSFKRRNKWHLLASISSIGHFTNQALNSAPYEIRNRIRDNLHSPSSVLTPNSYEYANALLRDGRCWKSGASQKNRKNAGHKASIQCTYRQLSNGNFAQES

SEQ ID NO: 1008792 - protein, 65 aa, Homo sapiens
IRGAMWALCTTREEGPHWRSGYMFAWHTIRCRCLHARDVSAMAPDDESSSDALGSHEATRSSVSS

SEQ ID NO: 1008793 - protein, 198 aa, Homo sapiens
ELEPKWPTPEKLWDWDMWMRILNNAGAESDHPTFRSYTWHRRLNMNGIHELLRTQSTRSSVSSECGQSEKKLMSGSHRLLSEAESGQQKTLVKIFLPDTEGHTYVAFIRMEKDDDFTTWTQLAKCLHIWDLDVRGNHRGLWRLFRKKNHFLVVGVPASPYSVKEATLITHNFPGANPKGGGEPQEPQNRHETSSRNLR

SEQ ID NO: 1008794 - protein, 183 aa, Homo sapiens
GFQKIRRRNGGAWCPGQDPDVVKPGADTVAFFNIRVDTQWPRRDANGMVLAVLHGLTSDGLDPSNDSQEASGGQTLGNCGDMYNQGSMGCRGRTVADNDAGRPGEGMGMAESSGVCPRTGGEENEWVLMTIDNMVKCIHGENGRPHKRIYAQTGLRGVTGEFEARTQVPFLGPPEGDWPREHD

SEQ ID NO: 1008795 - protein, 118 aa, Homo sapiens
QNLPYSEKMTVLLVYNGPHMLEPNTWNLKAFQRRRRRITFTQPFINQHSHTAAGHTCGNFYCPTIHRFITVIGSNCTSPQAAFTQNTHTQQLFLAQPAFTITNQRCITWQPYNDHYPK

SEQ ID NO: 1008796 - protein, 70 aa, Homo sapiens
MYADFHGRYWMALSSDSFARSNRLKVLRRLTVTAVVPSFNIPLTARVCQGGSHPGAPAGPRFPKLRTVAL

SEQ ID NO: 1008797 - protein, 36 aa, Homo sapiens
MGVHRAALTLLVFPTLALLEHRLHSVSPTDLIEDLG

SEQ ID NO: 1008798 - protein, 519 aa, Homo sapiens
QEVFLLWNVAQCRGDAFRHMNLQKSCENSIDAHQGILVCCDPPGDMVDFVAAESTEGPYVPWAAEEEEDMGRLPPVSLRAFLHHPVLGPVPAVNLLDADFMSSKVLISDVKHACVHMAVTCNVPEWLIADALLRIGHACEADVDLFDSRPLGRGQEPTESVTLGTREFWPGRHNKKHPRHGIGTMTYLHTKDNDWRHTSKIDRSVVVPKTQTVKQHDPVKTVDPEIGGTWGQGPSPKHEARRMGNGSHEGLGKGHLEHRGIPYRHRTDENKGHTGEQFSRTDEYDSDKAAGKEKSRGHCVLGAMNDNAKRHTIHQERPVTFSVGTQRTRLANDRSTTRPRVNDWPRGHDNTCTGSAQEEQGPGRGQTKGRAHNHENNELDTQQQGRYTAGAVRRIKRKRPGQVATEQRGEPKSTGHITTHTGGSRNENRKDRKRRREQPQHKERGTEIETEEKGKTERREHHTGGHTEQNRGREDHQWKSRRNTRPKGKDEEEEAGKKSKTQEEGEHRHNDENKGIDEE

SEQ ID NO: 1008799 - protein, 216 aa, Homo sapiens
HTPMHTHSLFLSLSLSHTHTHTHTHTHTHTLVSALYDAGLCVYRTLVDLCYSFRRFLYLCPLPLLVARACRRMSWQRGGSCSEGSLGAVCLVVSRSTWLVPYPGLSGQPDVPVDGDASAVLPTLYHAEPRLLLYYSTYMTLCTKTRPPQGTNDFMSVVTPSYSLVPARAKRRAGRNNLPPRVAPLDQMTYLLHPSSRRYHDGGCRVLLHLLLGETR

SEQ ID NO: 1008800 - protein, 313 aa, Homo sapiens
MSMKDFGGDEDRLGILVSSCTGNALEYKELLQGWKLPEKFGALDSVVTCELMHTCNIVGPKESSTMSRSWSESEEQIVSIQVPFETKPAYTKRNTNRTETTYKPKTLTKQLETRDEGHESKIEKKKTRNREPTKEPGETRANRSTQEETRRAQNERRPVARATTPSATRRYDEPDTTKRAHTESTLSKWKAQGGVTGVAREVTGGRPSEAGGKPVKHRRENATQRTDANTAPPTDRPHAEKHGRQDERPPNTSRQTRHKTRDTRHRDRERPKPTTSTRNRDRRRKNAYRDSPEVDGRGTHHDVDPTERGTRQS

SEQ ID NO: 1008801 - protein, 386 aa, Homo sapiens
MPRWPTTRQLQPRGELCSDDPRCSSPNAPDGDFVLQRSLVELREMLKRQERLLQQRVKLGSRVSHPPRLLQASSYPGRLPFPFHGTSDSLFPVERVTLGPQIETISHSDPYRATLDRQGLADGRSLCHLSWTQENIHFLAKHFGALHPERYTATHRFGPRIMANTCTEACPNVARNCGKHSFRKEKQVQPVIDPVVKGYLRKLGSAVKWRTKRHICQTSLESWGLHGTTRGPRKSLEPRTNVRSTDFIQLKVSTAQLIRSRERNKRTSQRLQSSRESPSNTKHPTGNTWERTEPKTHDETTGQTPPDKNNRRRDWKEYTASMSNTQADHSHTPRSKTKPGQGRNTAHPKPEQPKEARPPQPATPRSQKYTTDTKTSPDSNRTTNDE

SEQ ID NO: 1008802 - protein, 71 aa, Homo sapiens
SLSVSRIARSASAPDPRSSCPPARAPAQMNARCVVRAGSSCVTALHAISDEEARTALSYTMPMHDSSHSHR

SEQ ID NO: 1008803 - protein, 303 aa, Homo sapiens
PVNGAEQAGSLDPGPPVPTSMAPSAHVDLAVPPVLAHPIWGSGWLLEWPCKSGAEKCRTMTSVASELSPWAQRDGLASSYVGDEILKGHTQDTKTFYSVPDTAHPIEGSQVRHESHVDTMSEVAQPARMRVTCLLRPKRVHPVCSQEGGNRHPLYDDVTLEAVAQGLKGDRAERPNAQSWNADTKSAHKDGEQAGRNAVINRVHIQSDQSLTTNEQQEVQIENLGDRKAMYTRSSPLQEIVPGSRKNGVESLLIHTRQIAEEGVDMTRRGQRGKRENETGDHNSRNKQNDGKKRRSIKRGQQQ

SEQ ID NO: 1008804 - protein, 155 aa, Homo sapiens
MCGTESIKPLDLGVRMLTASKASRIHWISIDTGHRNEVKRGSGLCEHWEMFSTRRRWSKASHSLAASRDSPLVTVVDTEREQTGNLGPPSTSCERPHLGYPRTFGSIAKQRPTLKQSYNWHGVRITSQPLVITNSATSLLCVTTPTVVPRCTSPM

SEQ ID NO: 1008805 - protein, 383 aa, Homo sapiens
NFFQGFIKGFDPRVISTHIEMNPRKYFRDLEGMCFYNMLLANRDRSDAEKRPVVQATALQPQAPTLCGNNTIVLRPIVPQVREVTGAPRRKALWRVFPYPSFVCCAPKHSIYVPPKLCVCATRGTEICDPYKPTIKSVQEKLYLQRSSERERHSHSCAPVCARTVCVRDRPQERAIMQRAHNPRGGPDYLVRATTCVTKLALEQRRRRVHNARVLCATRRGGGEFYPTQPRVVVVLRRRTKEGCRDSPPNKSIALTSSAVMACPPRRMSPTHRARAHHQGRQNMTERRTTQRGDYTHPCGALNTSEGPRAWADHQMEHHHTPPSTRYFTHNTTYYTTNKHLPTDSMKNPPRGGRKSPTHREEEKGGGQHHTTLLYNKTDSRNQ

SEQ ID NO: 1008806 - protein, 189 aa, Homo sapiens
MHHLFTTAPLDMHTTGRLSLSLDVIIYCLLPLETVTTGHGASTPRALDGRGLILSFSPGLALWAWWHRIRTGRMPSFSKVLGIKFLKISQKRDAMGHSAVIRVPMVCSLLGAGGRLPASPCDVIPALPVGPCPVALTGMGGPLESPGPGTRLPWRSDQTSEVTPLLHVCPCSLSFGTPEVPGPIVDRWG

SEQ ID NO: 1008807 - protein, 148 aa, Homo sapiens
MPTRAPARESPAGALYRKTSQLLGDIEINWSTHTHVVDITRTSPAAKSPSAQLDESKSAQLKFLSDTVEKLKDEVLKEKYTQRPLESTVPTDFATFPSSAFLGTKEEQQDDTVYMGKETFSARLVCGQRHRLVLTQEQLHKLHSRLIS

SEQ ID NO: 1008808 - protein, 227 aa, Homo sapiens
MAKGVSLGLVIPGLDLSPMQETLWPRQVLTAHLALEGCPAAGLGTGRPVGQPQYPSLEASRWHPSMSFLPPWARPSSGQHRSSHPAPLHTHGQPPPPARHRHADALTRTHTQMHAHLHMLHAHRFTHCTAHAHTGSCTAYTHAQTPCTLFHMHSVKHSDASISHAPLPHPKHALSPHAPLPNNTHSRLHRPPPAPTKAPASGHAVLVPEPLREVRAAEWPAGLPWRR

SEQ ID NO: 1008809 - protein, 194 aa, Homo sapiens
TSENGSRNTYLVHCEGCARRRSAGLQGVVVLEQYRTEELAQAYDAFTLAPASTSRGGRTPRPPACPRKAPRGHQHMPGLDLGPACGREGGRAQPFHPIGSSSSLKFHYEETFMRRFVRQTMRENREQNWEPGEGAGSPLAHKEPPAHRLGPFKQQTQGPGSGGRKGVTYGFPSAVPDRPTARAAECRARTRYAP

SEQ ID NO: 1008810 - protein, 113 aa, Homo sapiens
MSSPDGVLTSAESVVVSHIFLFESKTTVVFSYWSHQGVECRWRKSTTRTQIVDSMGSSNPPTLASRVAGTMGMHHHTQLTYMIFSRDGASLCCPGWYQSPGIRRSSQPGLPKC

SEQ ID NO: 1008811 - protein, 133 aa, Homo sapiens
MTTLPPPFTSGEGPATAHMAYLGPYWAQSNNDRHCRSQSKLGPLAFPHQLQVLGAMGRAPSLHRLTTAQWGMILSGICPEAVVVLRVWTWSVALHQWSCLPRGEGAVRQGRARAIDFSEPARGMKTPRGSTLR

SEQ ID NO: 1008812 - protein, 212 aa, Homo sapiens
VLCGGCPRAGGVCVAYLWAACRSRSFHVSLMRFFSLFAFYPGDGYLLPSRQVALSSLPLAFFLATAPGPALPRPWRALPFGSPFLVLGLPLYFLGSAFGWTLPQELDRVQGLFWPLSSAVHPLCPLGHRRRARCHVPCGVCARRPGHAARSLVDYAAPGCARPVVHETAAPPSTSIAPRFSYAPRPPGGDSIAPSAYYMSCSFVSSGPGSVN

SEQ ID NO: 1008813 - protein, 69 aa, Homo sapiens
TRYGETIHSTSASRHGPLDVMESPPPAAWTTTASVHWVYPYIEIVFAKQSVALLARCKAVCDTSARSNR

SEQ ID NO: 1008814 - protein, 118 aa, Homo sapiens
MDRPLGVRSSYIVMGTTERLPEEVLSLVVLSVPCALSCRGHYTLMHYPAFRYGAKRQGTNFDGKYVSPSRTDAIIVLACVWLHGAESIATQRVSMIFCLLLPISQFAYHAKQLSFGAG

SEQ ID NO: 1008815 - protein, 106 aa, Homo sapiens
MGVWFMGHSGHIGAPLMGTWCQIAFQVGNTCACSSGPNDSALCLLFSCGDIGFFGEWYLLATLRAIDSLNPRLDVLEQRSSWKVKVGSRLTVPSYGTNPRSGPMFG

SEQ ID NO: 1008816 - protein, 110 aa, Homo sapiens
MQACCVPRLRLSRLVSWSKLDHGGNDTLAPFACVEARMLDVKATGMPSANSTSASGCETASTRDSRSCHASSWGPRHTVSRLGRHYKVQMSCEDMHEKNSVPNCGSPSML

SEQ ID NO: 1008817 - protein, 201 aa, Homo sapiens
MNGSTRVQLSRYGVNPSEIDRAREEGGHNTVKTEIDALVELCNLYYSATQYITDPTGPGTTQIQACRKLSDWGDLGAVTPTLSSKYMLETSPVGSELLILKLIRINLTQRNKCTPRDNSSKSRILESISTTMGLRPRLLGSGHPDGAAAIKGSYCSTIKVLRDLSSDRSNPGRFLSTSNSSLYERTRETKAILHKTPSAVN

SEQ ID NO: 1008818 - protein, 122 aa, Homo sapiens
DRACVLHFGPFWSSRLAWAFVGPRIQTSPVQALLAPCNAGLSTWAQWLREAVTESLYAVLANRRCARFSLGLAALPRGRARDCSPQWPEPPYPIHGLLCGLSLPDEHHPLLHGAQSHRPRKG

SEQ ID NO: 1008819 - protein, 42 aa, Homo sapiens
MTPGAPGGPRGPLGPWDGTAVASRGGFGSAIQGRVAARGRGR

SEQ ID NO: 1008820 - protein, 192 aa, Homo sapiens
YHPVPCGTLETGHQTVGFCLDTRGGYDVPCPWPTMAGQLLIVKEHCDAIYQSAWDRCGDSIVPTGPSIGHESDYQMQWAFFPNGYALTTGSDDATCTPLRSCGPIRSSSCTPMTTSSVASPLLPSRAAERLTARWLTTTFNCNIWDAMKGDRARSPRWPRQPLCSCLRGHRTMAMDCWPTGFLGLLRYKIWN

SEQ ID NO: 1008821 - protein, 180 aa, Homo sapiens
VSKGRFFSTRARRARSKRLLVAAPPYAEFSMPERSVGKDRQQCRRTPRAPLRRNRRSARTWQAMQPLPEAPQKADGEGEGDAIPSPRPLPTRAWRCRESLGAVGSARAGQPPIPYRPPSLPASRPNMARLPCSLAVVSCPHAWDALPALCCCRGEQSCYLSFRGPQLKCQPSFPSSPRQK

SEQ ID NO: 1008822 - protein, 102 aa, Homo sapiens
PFYGVFFSASYMEIRAIRCCPFYSVLSAHVADCLAGVAHTDSEVLCDDESSVSVLVDKRNIESPGTLSRFGRWPLPLGATLSDNAEGQRALTSGKYTRTLYM

SEQ ID NO: 1008823 - protein, 111 aa, Homo sapiens
MDIVQDTPHTTQEERKNELHRYAILQTRARPTLTLRRNYARLSLSAADMHCLIDGPGKAARKWGALAIQQSAADSVSLITGWEGTVASSVGPMGDTLQYLRHRVTDEGTSP

SEQ ID NO: 1008824 - protein, 276 aa, Homo sapiens
WRFLDTRHCFKEGLPISLKNGRNRVCGKNTSKNRCCDRHPVPPVIAWRLGKKRFPAKCGPRNRATRERSAPPQHFAPGGKIQGNQWAKNRARAPQRQKILRSALDPRNPNCGGCLTESKLEGTFHTGGKKLKEIPRSYWEEINKGPGIFPRRVDGPELKGQKVANGGTRDAATTNNSPHHPHGRDPQSPVKQEEIRALAAHRGRRSLEEAIQFINQREKPPGPHMFSSNDKENSGMGSYHGKKSFETFSHRRSAGEALMKRRLKVRYPPSPQDDQH

SEQ ID NO: 1008825 - protein, 66 aa, Homo sapiens
GEIKRGPSGYRQLIDSGQLLRGTRSYRLRSGCKAHILGAVDIWSMGLSLVELPSGRYPIPPPDAKE

SEQ ID NO: 1008826 - protein, 276 aa, Homo sapiens
RDGTAGGRRGQAGTANVAREILRRQPPQPQHPEQEIRANKAEYLTKKTQADKRWRSEYRCMDEILLTAERLSALMKDDARRGLIAIQINNDPPAARQHPACSTLANYLLHASSWYTNPYQATIDGVRSLGTSGQNVSDIIFRYSSMEDHLEIHGVDPAGSVTSAPSAPDTLGCYPFVQNVTPFIFPECPHVVLCEWQHPQLIGSKIIRGPEDQTVLLVTVPDFTCHADRLPCELCARLACQPISFSGFGAEDDDLGGLGLGPDSKKVVLTREAQNG

SEQ ID NO: 1008827 - protein, 231 aa, Homo sapiens
EDQSDQRVIIKLNIHVGNISLVDPDLEWDMSEKENSPEKFALKLCSELGLALVDVCHHHTHTASRGHAVARHSEDLTAITERETPLVPLVAVCHPCNTGDADQWLPTCWRLMTAAEMEKKIQQSQGLGTRRRDEASKPNTGPQAMANQPYRAKRRPTEHLKKIGPHFLHLLARTEARGQPSASPDGSGEVWSGGFQVALTRHTFTFVSHQSCPPPHPPYPSPVSGVRKKPF

SEQ ID NO: 1008828 - protein, 77 aa, Homo sapiens
PLREEFWMQMFGPYGVGGPILCNNPDTKVAYGGFQQQQVAYGSGREILNRNQSLYRTEESPESLDREAYTGYPPEIV

SEQ ID NO: 1008829 - protein, 135 aa, Homo sapiens
MVDQGHAVLASSCFGYTSVSPLAVSMRCHLGTLCFTAALVALEGTPRFSDGLCMRMIWPDDTASTWVLLLATPGASFVQGTTCWWPFAKTLHATLTPTTLLEGDCIPPKSPYQEFTDHLVKTHTRVSVHKELRLQ

SEQ ID NO: 1008830 - protein, 208 aa, Homo sapiens
MLNSTNTKGSFHTRAVNVHRLNSSSFLSVLHLYAPIHLSLLRTSMPPTWWPIFVFQFPNWNHSFFGQLPLREWVIPPTLDHMQVSQVGPQFPSSPQPPHDSKPRLVKLGHPSLRRETNPCLGRSYWSPRGGVYFRRKRMFKWPHCSFHTLGRPGHIRVHSCAAHRSYTPLLKVLDTRGIVYILVSFGHLSTVYAHTLHKCVASRCAGP

SEQ ID NO: 1008831 - protein, 271 aa, Homo sapiens
MRVVCVMVLSCALVDPRVVALVMAALPCVVRLLACPSDAALARSLLRRGVRLRASCRASAARGRVRRLCGIPCPGAAVSLDYGPVLFGTLSVCRCRSQRWPAGGLRFLPAPSRRPTADCPRFAVTRVRCLLFLRYAGSSCYRPILFVPSPFFLLAVWVARGVAPVRLSLCDCSDVSVHALSRGNSGVPSPSARRRFRRVRVETLAACSRPAAVDFPSVGLAECLLCAIVDPLASPQCTWGYCTRLWIYEFTCLLERDRVHTYGLCAATTSL

SEQ ID NO: 1008832 - protein, 163 aa, Homo sapiens
NEDLKGSNTQGVYTTHIYVLGQLVRSTRGMALSHLPCGSSLAAPRPLAEQVPSVTTPSLMPRGLGRRGSRRGVHVHIYHPSHSPRLCTCLQGALPKSLLVIKPQTGAVFLASGLSVGKGDCRGRAGKGQSGFSLGRWGQQEMTNRGQDLGTWAGGKGRSFLLG

SEQ ID NO: 1008833 - protein, 261 aa, Homo sapiens
DAAFLAPLGVPLPVAAAACILLALSGNGACPGACGLAWLVPREALTAPVVTAMVPANPTRMNGLAECGTLGEQAPTEPWGLRRPAGSGKITREFVPHAGYTETINRGATVTHIASPGQHHDCTASINTSGTGHTVNTFTKTENRFAFDTFSGLSAQLRWSPSDRNGCMPCAKVDATEDNPTQRASEAESLTRGHCNPTQEAMEGALMPNRSNRTLRMGLLPGAATRGGAPTAGNEYVDRHEKSNRPLQSTSTHPGSRAPPE

SEQ ID NO: 1008834 - protein, 118 aa, Homo sapiens
MLPFGHRGLPPTTVPANTIGRRRDFAGNTPQTGPMGRWHIGRLAFSAQPPFGAAHLGNQSGTAGPRPSRNPHQTSRIWLTHNPPQNYPLLGLNETLLTASDFGVVGDIHRINTLCSLN

SEQ ID NO: 1008835 - protein, 81 aa, Homo sapiens
VCPVFAIGCLARLACPQAPGDAAFPAGSRLAPSPSVTDVPMSEVSEHSADGAAKDRALEEIVSRLSSLNLSATMLVSRIRP

SEQ ID NO: 1008836 - protein, 260 aa, Homo sapiens
LHTDQRANHEGSWPSHGTRQAPIWSLDSRVAAEDKCSTCEHRLRQISATMILHKYPFTKSYTKTHASTLHTRRLQTGEGTQTNRTTIKTSEHHKDPEHDTREHMKRKTSKKQEKTHEAQERTASTTQENNPDTQGATQTTNQMTTRKREHNPHKNHNTTRDTEAPDTTKQHSKTHHTQELENRKNHPTTQRTEPTRTQQDTTAKRKTKQHTKNPPSQHTEQNPLEDKRRDKQTKRTRQHTNKSHAAAKTKTQHKPMTNTQ

SEQ ID NO: 1008837 - protein, 82 aa, Homo sapiens
MSNGVCATMCSPINDYFPRPFKNMPGHVPTPPEPTGPEPTSTFIPRVAIILTNESTHQTTYHLTSTDKPRLYRRAPTSTIGA

SEQ ID NO: 1008838 - protein, 128 aa, Homo sapiens
EEEGGEEEAREEPLKSSKNAEPVGKEEKELELSDFVMTSDPLEARACLAVCELNACPFQLPVTGWSRSCSPSPAASTAAVKGGHQAAAPAMSLARGVAAAALERGRWRRAQDAVSAAAAAGPEPLPGA

SEQ ID NO: 1008839 - protein, 330 aa, Homo sapiens
MHLLGRMSHLPMKLLRKKIEKRNSNCGSGTSSFSGCSNLTLRKLKMDDAHLTETTGNVDTVQQINNTSPCTVGLSETHTWRHVSRKQWDNTNRVTKVSPGQSTCIKAKWRTAAHARTSHIPDTPQHRHTDRQTGRNKHGDTDLLKPCIQQQDKAKTHLGKAPQGSNHLPGTAQQHCGPAGPTVTTHNTDKPHSGGRQAPRTQLCTAHRIDNASPLSPLRATPAEPAQTRHLILASNYHNRLLGTTPVKSKHPWRKRARKHLLAKGKEYKEHCAVSTHTTLEPGKNHTQQQHLSITRHLQGNQHGHLQNPDLTQKPRTKGYSNAQRLSSTS

SEQ ID NO: 1008840 - protein, 379 aa, Homo sapiens
LVLDRERRPLCIFFPRFENKPFYSKSLSVALMTWSMRVSDNGRQVSFKPTEIVHKTREDHVTVHGCNAVIIGQSVAPFVFHLISQRERNTRGKGRILHEAVSRCLVGSEPCGHIVGSLENSENIVPLPIFRGQHEAPRGVSTRYAKPWTRQYCVAESPHSLHTPIRAHKQVVSFTRGSSRATLLGAGSGHYKVSAIYHQMCGERRMWGSHINDTILSFKHRIETSPELRVVRKPTLCLNIPVALLRGHDPKDTWGAPYTTYLHVGISTTKKERHTKGYSCYGAVRRRTSGTGGDISSVDLTYHKKKAVDVAWHQQRQHRNHTSHKDYPHISPPYRGTRGLITSYTTILRQNSGILSQPFERHGKKDYMYHSEGDRKIHV

SEQ ID NO: 1008841 - protein, 232 aa, Homo sapiens
MAGDGLDLVGAGDGHAHACVHEGAYQVRLCNGGDVDHGARWTDMLARVIECRADLALSRQAARVKHAVGEPSSMKCAGQCCTGSYFALQAEPSHLKGLVTAHLVPPVRALVLRAQLHQSPARSPLTTDLIWAKMLSSKEAGVTSWVPPVGGGNMKGGDSAYESLGLGPGIAYSILDVRDVQGTRLLRLRDPWGPKLLERQAGPDEEAHWTGAPALGSSCRTASSEGVYWMEV

SEQ ID NO: 1008842 - protein, 127 aa, Homo sapiens
MGRRRRQEGERGGSKEEGKAEEDESGRREQEKKDRATPRRKGGEVRREREGDTGAAVGGRGTSERGRRHSGPRKKKEKRERGGRGRTKPKERERRREGKKEKGGEQGERGDERDREEETEKGEKREG

SEQ ID NO: 1008843 - protein, 116 aa, Homo sapiens
MLYGELLEDRGTTVCPGCRGCSSQIGKVGNHTYTACAGKALGPQGSTPKGSLSPRKSGFQWNTGAFDRSRHTVSIIPPRISKPFATKTPQPIVLNSNGSGWRTRTSGFRTRDNRWV

SEQ ID NO: 1008844 - protein, 269 aa, Homo sapiens
MATQTLSIDSYQDGQQMQVVTELKTEQDPNCSEPDAEGVSPPPVESQTPMDVDKQAIYEASTISIISFVCLKHCEQSTQGSEGTTSASFDVDIETFRNEQQREGPGKPFFVKIQKPINLTGQQQSRFSRIHLLELAPGERTLQRFLQSIHCLSEHTIMNSEHSVEWTKPGKPVLTSAVPAGFTVPSPGTIKPSGTCGAGVPLLTAGKRTHGDGGQGGTVYHAVTVVTPPRPNCVTQTLVRLGQLGIQNSHLQVLLIPDLKHLASRRCSL

SEQ ID NO: 1008845 - protein, 57 aa, Homo sapiens
MGQEEDTLKATTEKKTPRYTTAATPYTTQEATNHHQINEEKTGTPGKKRPGKHIENT

SEQ ID NO: 1008846 - protein, 108 aa, Homo sapiens
MIDASREGKPRTRPLAAPTTGSQEKDARTANHTKQSTDEDINNTSHATTSPPGTALKLTLNARALRHAERQPNTGTHTLPKPHAGKATTPTQNLTRQDQNTNKHAQPH

SEQ ID NO: 1008847 - protein, 207 aa, Homo sapiens
MDGVEEKKKDVPCCARIPLRKHSEGISQSLKIKAPENRSLPTRCFERQGGSLSMKEANALSRRNIRQMYMKLNIRMAMDGQDTRLATSMYLQNPNWRLVIMRSEVINGMDAQNGSERCCCFFAFVNIFNGTFVNARTKASINMLRIVEPYIAWGYPESELSVNELIYKRGYGNTINHRKRIAERDNALIARSLGTIRDHLPWRILIP

SEQ ID NO: 1008848 - protein, 129 aa, Homo sapiens
MKPPLCLRLSVCGSSWERVILRVRSCHWRGVRQGLYAMQNQKPARSRVWTGNALLLKIREASNVRARCVSDIRSRLGRGSFGPVGVAPRVSASGALATSSVNPESIESWGVDETVDSVKGHDDLNTIAR

SEQ ID NO: 1008849 - protein, 200 aa, Homo sapiens
IKYTEESVKRGLEFTLMVVGEVWMGKVEHYSTHYSSQIVLLREYPGPSHRIKNDCTGWNNPKSESRKVVTVRLRIVDTPGLGDAVDNSNCWQPVIDYIDSKFEDYLNAESRVNRRQMPDNRVQCCLDTSLAPSGHGTLKPLGYGVLMKRLHEKSEYHPTSVAKADTLTPRGMPKEFKEDMMNGKKSKNIRIEEYTNFQKT

SEQ ID NO: 1008850 - protein, 37 aa, Homo sapiens
MIHHSLLRKTLGVDKNDVQTQRFTEDEEGYQGVWGNV

SEQ ID NO: 1008851 - protein, 198 aa, Homo sapiens
MLHTSPRALRMHPGGLAVRVGLAGVHPAQHPTDPEADPHGAWTIHSIRDIQRSYSRPPSVFLASVRCLPGSRPVSYSTNLAVVPALLHEWGDATMLPAEFLFSEMGVPWLGPVAGDDAQVPLRRAEGTHDSTHKLQLASEPGRVHPDGKLVVAPSRVQVHQQHPRKQGRVPITLEVLGKWSRWTRELKRGWTEPRREM

SEQ ID NO: 1008852 - protein, 82 aa, Homo sapiens
VQLPSTCTSSSSYARAVVPSKRQRVSGNTSRRGKSGFNSKKWTAGIFQVWTVDKEMTFRPLTKELTQIKQTSGFSPGKPGKN

SEQ ID NO: 1008853 - protein, 220 aa, Homo sapiens
MVAILLNSWNSVDNKQAWFLGGLYVDPDVVVHGPYSITSLEHRRQRLPAPMTRVGGRYSRKCSKICEPCATGTELQEQVARHYGIQVSYQASPIGEKDIMAVDLLINGPVEVSFHRVYFGLPDLQSQECTKQVTGEMIVVAMPSAILGWGVENGDTLLAWIAELLEALTGCDNGFVLKSTSAGQESLWTSQSEVVAGLPRTDQNWGTRIYSAEGPVVAST

SEQ ID NO: 1008854 - protein, 370 aa, Homo sapiens
MLKAKIQDKEGIPPDQQRLIVCTATQLRMMAVLLSDYNIQKAVDPCTRSCGLEKVVMQESFSGMTSCSRRGPSLDRVGTLDAHSCHPFRQHVRGANRIHLVAYERHGQLHANPGRRQPKKVAPHSLCLPHVAKAYGVGEHGTVRPRHSSVFGTYTMNPICDSTVRNDGTVCEAPPLRNALAFPHETAIRLDKKDQIGVKLGPYEVHYTKMRTVEHHSWSATGRTNPVHPQSQIAFPFDARGMEREPTQKDGNLYPHSSQHTQTCFQKLVWRQHENFAAERHTLHHNGQKAVYQFEPPPQPSVAAPVRQAGEDSTASPLCRDLAATTHRRDRDRVKRKMAQHKADARYAQSSMFEPDHTQVTCRHRNRLTS

SEQ ID NO: 1008855 - protein, 194 aa, Homo sapiens
MRGGMSCNTHQEAHCSFIPEKPWETSEPAREERNNIQMCAALRASNTHRREGLAASLLEPARPRTHAEGKKLANNIQTVRRNQTPGRTTLRRCNTSSRKESHVVHVLKISETKNPINFLDTIFGEPDGEHIRLFTKLVKNHHLQLSGEDHRPITKQIEGHQATDGLTNGTQNEFNNNFYQGPLDRPNWHFPWPR

SEQ ID NO: 1008856 - protein, 129 aa, Homo sapiens
MPRHAQNILLDEGPRVYDALSPDLNVGHVRKVVLEYKLRRRSRSKAGYPSPAAQLLEDARMCKAFGVVACRRYRYLRVNTPLATFLACQYPIGSTSVVGLQVSLSSLSKRTASRVQRLVLYINDTQNRC

SEQ ID NO: 1008857 - protein, 95 aa, Homo sapiens
TRPARMNTILSNQTVDFPDDVDHYSERDAQFIVNGPQRIPAMDFISLVNSRTHPFLEEKKKQMAPRLTNGGVHRKGPGYRADYCVRTCTESMIKE

SEQ ID NO: 1008858 - protein, 242 aa, Homo sapiens
KTVPGSVESGLCCEPVSLEMAETLSVPSVILERLVRVRALTLRLVMRPVELRRLSDLRVDLILLGWMLMETVNVGLDACNQERFDWSCADTNGRLTRCKVVSPERHIEITSEGNKNNHQRRSSNMVRKPERRRVWKITGCEETLWGWTGRTVTTSSGELARTSTSWISVMWMTAEIDYWNALQTSLSKTSDADSPPGGPCSGLTVEGAKVEGRNLTRSYPAATLQGTHVRIERRRDTRVKQL

SEQ ID NO: 1008859 - protein, 129 aa, Homo sapiens
RKRRAEEYDVRFGELHQAELWPLLHQMWRMIVGTLRYGFEPDPLIGFWMKAMNEYFSSSEGVEQVVLGLYIVRGDKCESLDEIDEETDSCDLIRGIFEREPCKFCSDTEEKATIAWSICKVFVRESDDC

SEQ ID NO: 1008860 - protein, 83 aa, Homo sapiens
MHGARTSTLNVQTHSSNRLPNGPMRVNFQHHTHVHYTSGYRKYTLATISRTFMVQAHSVEDVRHRENMVATVKATQRMYSGGN

SEQ ID NO: 1008861 - protein, 126 aa, Homo sapiens
MIYPNSVFLVCDADEIVATSIGTDASQESCTVTLSTGDRHVSACMCAYETPKCIARGPYRRAALGKKLAPDYWERELRSHHYPGGTVVGPLLSATQMTGTLLHARTPGGNKLVRLGTRHSMGAPSR

SEQ ID NO: 1008862 - protein, 60 aa, Homo sapiens
MTENRPPHLRDQKMSMRSCMVQPAPQDKQTYCGYGRADVQVIPTEHIANKPQLTVAYRIK

SEQ ID NO: 1008863 - protein, 249 aa, Homo sapiens
MDEKVFTKELDQWIRSSLNECKQLSESQVKSLCEKATRNPDNTGHSIRARGSMSSYLSVDDVHGQLSHDSSVAQPVLAHSAAHNHARIQTLLRSLMGQTLTRLSTTATHYSPVRHTQLTRALLALYAFRFTVEPAVSRFLLDVDIQLMTHEQTHTTASTWAASILTRFAHLLLTRNTLLGTHSPTHCYTAHTNLLPLRTQSFPLMHRYSLTPTSPLPPRGCGLGRPGLLQWSLPPRVWFLLAGQTLTKS

SEQ ID NO: 1008864 - protein, 230 aa, Homo sapiens
MLGCCVACRGSGAGAGGAILCPGGLVRECLVDVVPRGGAGDYGNGLESEELEPEELLLEPEPEPEPEGGACPAPGPPGSSGPWAWFGAPGSQEEEERAGTRSRVTRGTAPQDGPGARKLSTRSSHAHCTERTLTTAHQRAHPTHATTHQTGLLTSTLPGKMLAPVIMSIAARTLPRLDTPRNQSYCSADCWELWGATCRKELGRVTIQWLVVQFDIGGTILVLSSIYVAI

SEQ ID NO: 1008865 - protein, 69 aa, Homo sapiens
MVEDGLRNRPGFLTYRNEDTDSFQGTLEHSLSNNCGIRPGARKPKFVTPTIPRDEANNLHVGCTSPADC

SEQ ID NO: 1008866 - protein, 219 aa, Homo sapiens
MALVHVWLDLDSVPSSGRLISDDHGIDPTGHLPAGTATCIWTVSPVYYNEGHSVGKYVSSMPSWCASRNLVTDGISGSPSGSFWTRIFHTSSKFDIRVQFVACHGYTTTSWPKGAHVSDRERAAWSRCVRTSFAREMMDTANERDQYEHSRTCSARGLSLRLGNPNLHLVMRVGATKDFCMVNLRGNLHYHFYTRPQEMLRYAKANYSTLGNTGPIPIR

SEQ ID NO: 1008867 - protein, 70 aa, Homo sapiens
AETEAGAGSASYGPRLGFPPRVICIPTRSYSNGTQSMQICKSLTEYSKEKHLILILRIRRARLRNFLEFC

SEQ ID NO: 1008868 - protein, 192 aa, Homo sapiens
MALFGDPLPSAAWRGASCRCSQCCKIRVTSNGSMELVKQGAGCAILEQELETISIPDLRGQRRPLLLQQSLSVKVTGAATDIFQSIDFQHSSRTLNASEITQCTPLRAMRFPDDQLVSNWFFYEWGLHQRPQLTGVVPSRTGLETLPGSRLDRMTSVQCLLPGLLSQECKADFEGNLAQKGSMMSLTSFIDL

SEQ ID NO: 1008869 - protein, 186 aa, Homo sapiens
MLQIRDGVRQLVSQEGLKNSLTCKVYACNFLPDGVRGIGEDYGVGLNQRGPKLCLCKLGLEPFCRHGWSPQWRFRAFTLIDFSYFCKINSLNGLLIKFQGCKEGGKLSWELSATCQWQSLPSPFEPLIIFASAIPQDLLVVEKFMTLSMDQSGGQTEREEGRTRRSRFCIHVVGYTQISFPTLEMF

SEQ ID NO: 1008870 - protein, 91 aa, Homo sapiens
HWVQQQGQLTGSEVSSGMPEQVTQSRALQLTRDTTQWSARIRHSRLFRVGMASVNVCLVSVSISVHSQLYRMSLAGIASLITPRLHNHCRP

SEQ ID NO: 1008871 - protein, 104 aa, Homo sapiens
MHKQAFYTRNKSTRFSSLTCHLVFSSCNSNRAIQPRNSECCHRGSSDSAFPIRFTVLFSPDTQAYQNTIISTHTYHQNFSQTNFIIRTDQHGLIHGQQNNIYLD

SEQ ID NO: 1008872 - protein, 110 aa, Homo sapiens
MFTLDAELVRLHYACIGCGLLVYTLVARLKLDIGVQLDRSPLVRTPTLRMARTKYESYSSRTGPELPKDRSVHPIAKFRKRKEEMRGFPLVCLFVTSDRKVMLPVSEQWQ

SEQ ID NO: 1008873 - protein, 105 aa, Homo sapiens
HPPLKGPVPIGGGQPALSPESFGYWRSDCIVSPSSRVIQWTHAPRHKTTSALLDRHPQSWRPLLVRPQVTRHSLHGVSIIEPTMRRRGLERTQLRSEFDVTQGDP

SEQ ID NO: 1008874 - protein, 106 aa, Homo sapiens
MWRTTRYSNSIRHRAWLNDSMQRICITAQEVRPFTRAQDNNYRHCILTCVLYLIDPLAHLSYICTHSDSTHTIPMTIKYAFNNPELIFSIGRNYHQRPSSLPVTDT

SEQ ID NO: 1008875 - protein, 103 aa, Homo sapiens
AGWAARDCWRWLAGTLRWFPFALLSLARGHYESPLTPLLTEPAEPTIAGRYSTRELRENAPQILPPHDISLMVRRISYVCVVDCSIMTDIVKRYKNSTSMRRQ

SEQ ID NO: 1008876 - protein, 130 aa, Homo sapiens
MGLAINDSLLSAVPSKDPVLNKKPLTSVISREWCAKSFPQLMLIENLCLALRRSQGNVTYLTLQRPMTSDDMLSRIVVEVLRHVQKCNPCEYLRVCKSCSGSNSGSWADSRPCALEVEPGRLTCVNLSDQ

SEQ ID NO: 1008877 - protein, 73 aa, Homo sapiens
MEIPPVELPPEEPPRLSVTLIAMSYELLPYKKMTGEQRRLHDSMMKRTRIERCTQGANQVLRNEMKMDTYMDI

SEQ ID NO: 1008878 - protein, 165 aa, Homo sapiens
MRTVVTSDFPFAVSCNSGERHPKRSKPILVEPPTHVEITDRTVKHRLISFTRTIANEPWAGPFPSYTDPPQETRLYIQILSLEKPTVPSFLAEHGVNTQCEAARSANWIHRKQHSPFLLRPPWNVNYPRVPQLDCWRVHEGNYRKFRDTDCVTRKREVLNSPFRV

SEQ ID NO: 1008879 - protein, 98 aa, Homo sapiens
LLDDDQILSCTKAHNVSSAYGYLHDNPGPTVQYREYHLRLYYDSVQLTCRSSRYASIVQAIAVLLRTLQTCRLCKYGALHIGKHRLVQGLPVVLAGFS

SEQ ID NO: 1008880 - protein, 419 aa, Homo sapiens
AGTVITGHCWDPIWILRITCISTSSYLCWILRSTTSDPDSRNLSRRTYRNLLVRFICRTNVASFLSDRLTLGCVLVLSACDRRSTCDTLATNQCPVDDLLPICSLVQSTLWRYLVQRVTDSKVMDLLREFADITKKYGVLEIGVVSPRTPRGVSVESANRWVEQAQSPCQRRAEEENFPQTGTPYVRKGKSVSKDDTVTLSVKDREGHFTFSVKNDRDPWTRDSAIIVLRNMVFWHIRSAFRPPTGDNEFAGLAVPTTLAIAEQDRPRFPIRVPLLNKDRVPLRKKGNIYTPRNRGRSPKGVTTLGKNLGSGHVHPDSLKQLQLPSRRGAPPCGQKNNIVETLVSRRNTHLPVFARNVSHSQGAPLHMTQLRYHWGQRIDTRVAPPLPTHDKPRTQPIGRWYRRAKWAHISYAMNTQRS

SEQ ID NO: 1008881 - protein, 84 aa, Homo sapiens
RITRTNEPHCFDPGQDAGRLLILLCGAANYNTIGEKNPFHVRNNRVPDSCCINVTVRLLRHSISNEKAIHKERVVVRATFGVAG

SEQ ID NO: 1008882 - protein, 252 aa, Homo sapiens
VNSPEWSAQACSPRRRRYPGPAGPELPAAQIGSQWLIDQPHWTLVLWYKWSTGLSRHGLSERSLISKMEKKRSNEHEQPLFRLNHKKAMAIQLLFMLGKTVTMADFSNVAASQLNTQNFNFLINDDNTQLLHLNICNFSLIIFACDHEACPTFWLLLLVVSALWGRNHLGRPTGTQHILCTNGRNVAWAVPQLDFGTGGHSSFTQLVGHFWNLLHYGRAVSHRALTCYHRARNRLRKIVPVYVATVCPRDKR

SEQ ID NO: 1008883 - protein, 220 aa, Homo sapiens
MRPVDADEAREPRRSRAAREPRPRPAGNLASLERERARAHWRALRKLLEIQSLLDAIKSEVEAEERGARAPSTPPAAEAEERCGSVCAEAERKAAEAARMGRRDRWKLHQRIAGLRVVGEAGEAGGSGAERGRECPAVKALGRQEWGAQKPCHAPPAELVHSFFIGGQLDELCSPDKESWLLGQAQTKKSFRLSPCFSAAFSPFSHSISVPSWRMTSALR

SEQ ID NO: 1008884 - protein, 170 aa, Homo sapiens
MFDYKLNPNGPPNVVAKAYSGGQSGDVLSYQWPLNLASAKGPSYWRPVENERSEGETGRNRLSVAVHDVWKQFEGDYNTCSLVQTPKEACGSGKKPGDQTRGEVAEGAPPEWNHIFVGRRKAEYWQSGIRDTRGRACRGDRVSGGDRPAGLHPNTEKRAHLETWGPRGDT

SEQ ID NO: 1008885 - protein, 342 aa, Homo sapiens
GVSLLDLWLTLYLLQQQVIPQTSLPLLHLVSLSNLPLPIPTVDSFNTDEAENGFGIQDAEMSLYACPELSELRVSQVTDMNEQEDGITRHSCLTLTQLTTKVSYRHKDDLVEKYVEELSRKQISLWSPAWKPKETKLVRDNVMNYLTQDARLTYYDKRKTARGSNDTYGESCSASALQDKIEQRLQMKGEDRTLTSILQEDVHWTGKHGQLRCINSSQLPMAKEEETKYAPLHDTTPQGKEDTRTRPRATQRTATQHKINDSTVTSELTLSNKPCNTGPTTRKEPSGKAQSNANRTPEPPKSKRENGTQTNVTSSHSQMGALDIHTGLQPTTTGHRTKHRKT

SEQ ID NO: 1008886 - protein, 409 aa, Homo sapiens
MSQHVQVNTGAISESISQSKYMHHPSFINIPSSCKVCFPRYEIILVLIFQNTTIRKIGTNPEHNKNKDNKKLRGEALPQSTSTATAPGGSWPRQRYSSARVLGTTGNSQVETHQCATPQTDRQTGTSTAEYTKGHTKERQPREALRTATPSETRHTTQGGTYTHKPPENVETIDTTLRSLRKIQKTQTPTIRQRYHTLVPPKLGTTEPQERTSHTKTNNTKDKRNAKQARTQTKSTKEDKDKDIQIPGSTNTASRGETRTEETREQTRIKNIETTEKQPKTQSNHPGHHDSTHPSAAAYRQRTRDNRHRNSADTHTNREQKQQAATNNKRGGTKNKASDYQHTRNPTPTRNRQRAHTTTQARKAASPLPTRTPTQSKNTDRERQAKRNPGQPREQTRRDTNNEAPPDRT

SEQ ID NO: 1008887 - protein, 334 aa, Homo sapiens
PEKGFFFLSKYLAIRNPKRDAPGVGQILGYPFPKLKQGGREVAPYTLLLAQIRCPLCSLLVAAFHRAQGPDLLPWNWGLAPAHHIACAMCPHRPPFFPTTQERFTPVRGEGRDLCVGVQDHSETAKYRRDLETILLAGCGYTPRQVQCATRRILSREQTTCVHTPFVDTPYNTTYSHTQSPWSPQRSVLRSVVLETQSREQTHNGGGNSSENITPLVRAGRPNGRHAKPIEECCARRIVEKTLGAHHAEWFTSISLFARTKLWVLPPPNYSCFSRRRCCRRTQTAGVYLTVCLARAEYQLTTITAILEWFTIRGEVSSICFPHLNDRPPTSFNR

SEQ ID NO: 1008888 - protein, 598 aa, Homo sapiens
WLSKGVPRPDMHPGRCPPHQQVWLLSPTKRCLLQPLTWQHWRAFHWLGPCTPALPDDLQAPRPPLSKPRTLSDTLICALSTHTAPTSLNQRLPHTPPDRAPPPCACGLCANPLSRACAPPLAPRWLLPAPPHRLRATPLRPPAAPSSPPARRASLALPSAASPRPTLTHPSPGPFPSLPPYPPKRRAGPLTPCPPPPAHSRHTPLAPPMRSRPPSPSAGPPTTPRLTLAPLASQLPTPFSYLHAPLQPPHFQPHSRPPPHAALPHALPLPSPALPPPPPPKRSPLPTAPVTTTPTCAPRPNAPPLHLLSQALPPLPRLRFHIPQTQLPPFPPSLHPLTYANPTTLYPNPPLNPQTAIQPHPPHQTHPLPHITTQTQRRSPLGATGRTHLTTTPMCPHSRPPLKDPPTYMWAPPVRAPPHCAPHTRASALSPPSEAKAPLCRQTTPKPTTNHHKPTHTAPTLYPTTTHFGLSTTHTPPPQKHTNPPNLPSHIQLCANFPSSHTTPAHTPSRAPSHPHEDTLSRSPYRDNQTQQAETTSPTQRPHNQEDTINRPRTTTKTPTPAQATTATIRSISQQLKQTTSQNMSTAKRYSRDHTEAV

SEQ ID NO: 1008889 - protein, 62 aa, Homo sapiens
MPARSCFTHVVPASYRARNRLDACERVYRCGALNQARAQVQELNKRLDDTTTVAQNVVDEPP

SEQ ID NO: 1008890 - protein, 172 aa, Homo sapiens
GEGGRERVKKSCEASPLFLRPPDPDPPLREGERYIYGEEEEEESECTGHERERTDRLKNRRGTPQQVPRQDEGKSPRRGETPVDNLQDIPTSTATLAPASERPQTANHAPRVKAQTGAAAHPKAHTNCNGPAPGCVHNPSAATPEPASLPSPPHPINPQRCARRHDGRHPRH

SEQ ID NO: 1008891 - protein, 272 aa, Homo sapiens
MGISRATLAHSAAKPGCKRKPYHKKRKYELVVCPRLFIAPRLCPGRIHHMSVCGEVIEETIAVSHAWFGAVGGTFLTGCSRDVTSLCKYQRDHSMIGTTDDSSNYTRLCSVPSTLDDRNCDLCFQSTMQQPVTLDEVVYRGPTNALPLAPLMNGEPRLISVRRSKEELLKQQYNRILTKGNFPGQHQLLHSTKGTQSGKLAQKVRGKSLPLAVEFKIIPKSSGTTSFLAGCILPFQMGPGYQGDWTRSPVIGRYLVGLKDGGKEDRFAERLP

SEQ ID NO: 1008892 - protein, 191 aa, Homo sapiens
MADQLTEEQIADVEGRAFSLFDKDGDGTITIQRTLGTVMRSLGIMNPTEAELQDDDRVTVDADGNGTIDVSREFLTNDWPDEMKDTGQWEEIREAFRVFDKAGNGYVRRRRAASGEVTNLGEKLTDEEVDEIIREADIGWRWSGQLSKSMYAIDDLDEVKGSPGQVADALFVVDLSSSRSAQSLFKTPLSS

SEQ ID NO: 1008893 - protein, 360 aa, Homo sapiens
DVDMVCASFIREDSLMSMKLGRSWERRERTSMIDTAKSRIMRGFGGMMKSWRPVMGSWWLDGDLGIEIPDRERSSLLMKMMIGRCNRAGKPDHLCYSRCMESMIKKPRPRHRGLTACDVAKCMSWMEPDWNHAVMEKQPKGTFLWEAVLHVTQLIAREAEADIYHVAHSREEHPPTWRPITNATSSRSHTTDEDGQREGPPVTRLAYQDEGTISRTLEQTFLRQRHSVKNQRETRITLHQQMHPAKHIRIRVHRREQINAPSTQDVPAHRRTTKTWTHSNGEFKAPVARLDATWTPTEHKREVDIRSTRTTTRMGENTHTGETTEKPDRGPKTANNCEQREKEQGAQQRKAHSPFRNKES

SEQ ID NO: 1008894 - protein, 228 aa, Homo sapiens
MLDQRTVRRSDIEAYAMMRIALAFWVARQLKSSSERCFMRALSSRRRSPRLPSVPWARRHLSIARLEWKTGRGRGRADVGFHPSPGTPRSLPVPPVLPISGINRRRLSQVHVKRRDTLSTRIPFPVYPDGLRMDETHPMGDGPDPSMAPQGWVRSFGRRVGLEVLGKNQIQAVGVINHPQWMRSQTRRGLLDGSTVTFGMTGDGLRQGLRRGLLASEEELGPTGYPWS

SEQ ID NO: 1008895 - protein, 301 aa, Homo sapiens
VGTGPRCLPSVPAAGSRSAPVPGLLILGPDFFQVLRVCCSQRSAKPEKEEQPVQNPRRTGKGGEISTWKNSTVKMKEWLQTKDRWNHEEQPQDERKPEVTCTLEDKKFDNEGTTENKGKTGDEDMLTGYAGQATTSEGRGTKTESQQREGESEMAGRIREQRENQSKQGTARECTGRARDVKPQGCQERAQADGCMLPRDKAKQKHTHIQGLASITSTQALQEGHTLDTDTLPPTDGDRDTDNLRPTMHSGSPACPRHKTHSTTTSRPLPGGKPQKHTQDTPITPKGTHAKQRQTHRPPEK

SEQ ID NO: 1008896 - protein, 95 aa, Homo sapiens
FLTQKWCMGKHESHYLGVYPEEKKSLYEKRYLHTHVYSSTIHNCKNVEPAQLPIQVNKWIKKLWCIYTYHGILLSQERNNGIHSNLDGFGDHYSK

SEQ ID NO: 1008897 - protein, 252 aa, Homo sapiens
MQVMQPCGIFGKLRNRPAGFIATDLPSLAWPSVDVDFARVYHGDSAQGLVGPGINFEVIVEETTMISSAHGELTRPRERVLGSRSPNPSEPYNLAKRIPKPSPRGVYQGCNIVPVGHPKPIICHVHASEENVTDERHYEGTKKDPDCRKSLLGSICFSLLKGKGTKTRYIPFARGLWELDGGVVVPGGTILPLIRNAYEKVKIPKNLNPYGEAYAQKGWAWGAIQSKGGSQSLNHTKRLGNPQETGMVCCYN

SEQ ID NO: 1008898 - protein, 46 aa, Homo sapiens
TRRKPYGQRFFKYDGQFLFVFALNKTELWVLKKQKKIEIRTRQEAG

SEQ ID NO: 1008899 - protein, 193 aa, Homo sapiens
ASESARRQVGSLVERTHRPLFPGVFPKCRFSNELTLDKLDVRGKRVGDEESTSSVPMNEQSDNKQPEDEGLSVPQDTQDFCLDKWSPKIGYLRYCDQLRHWTWLRVHQCRRAKIASLRGQIAVYDHSKFSTGVRHVHVLERDVCRAPEGGTEKRMMTITRKYGIERVIGPIHDVEMEPSRIAMMRGTEKWYTG

SEQ ID NO: 1008900 - protein, 162 aa, Homo sapiens
DSREIWWKVSIAVLRGLVYVRDEAPDHATDDVKPSNILVNSIGEINAGDCSVVQRAERHSTSMVPTPSWRTRSYCGSGAVQGHHYSRASRNIWELGPCPLVDAGRRTGIAIPTVTDAKELEAKSYGASPGFDEGRRRAIIRQSRPLDRGAPTEWPPISVCHG

SEQ ID NO: 1008901 - protein, 189 aa, Homo sapiens
MDPGCTNLEGIGRQPNLIEGNYRLSDKVYTVQHARRTRMDTRPMTEATDQTYETRTRAQDNHPGGPLPATRRITDKGNQTHAGGTQQHPYQGTQKIISHTQHHWKTQKQRNSMVTSNTHSTATNGDPHHESRTDGNTSTTHQTCDEHSTSATSTKKQHHTMRTNKDNNQRRQEQATRARQPNADIEHST

SEQ ID NO: 1008902 - protein, 491 aa, Homo sapiens
MRSTVSLLETQNVDLRFTRCLRTHTVRQTCTEPLQPIRLAQDPRLTLDYNYDNYPVQQQEQARYYETGNQKITKEHRPHRTNATRNKENAKGQSRQGNIKNTHGHTRQPDRELNIKNTNTQKETTEHEPQKVGQTYTNIDEQNKTKKEQRERDGKPEEERGKTQHKGTNATRNEDKNDAARTGTERPSRPRDKTKRKASRDSDTRKKGTRTTVTTTRKDKKCKEARHTPGAAHTRNSKDIRRTTLQKDRGRPANRQHKQHNEYAKRQRQETEERSSQELEEKERENVQRNTETEDKHLHSPQPIRRTRTYTDEHRGTRRKKNKRQGHDTTRLAKDATRDQTSTAERGRKHRDKTDDERQANTKRDRTHESARTAQQQASKTPTTEATDSRRPRQERAHDRRRRTSAPQATRRAEPHTADAARSAARPASHRRRPQSQHRRSEPHDRSAGRAHVTRDAERASARRPRAATDDRPRTRAPDTQPHSNPEATET

SEQ ID NO: 1008903 - protein, 257 aa, Homo sapiens
WARTSAALCQPMEFKNGYISPVKARSRSTRELSAVPGPHRVCYEDATMVPPEPPDAVPQLSVSLCWGRGRWLGACAAVRLPALCACLCGRGDPADLSRWTAGILERTDACGDVVCKAFQRTVVPTLKPTQCCLRLGRSKPYTVDHGGWHKTRRAIKRRQGDTAFEGKPTVAASPFDSGGLLPAKCTHIENFGSTNMDWATDGRFLPLGRRRIQRSRTRYTWFQAAELGDFQQRGRRGPPHPRIAGGNIGGRGDPIPA

SEQ ID NO: 1008904 - protein, 719 aa, Homo sapiens
MTMDDIAHKKPMMTAYTTTTHNPNDHDTGPAHGGPDNGENVIALATVTYNDVGQHPNTTSTLATTQRSQYSVEYPTYNVPHRLTDIGYKYWSLSAVTSSPKYPQYLTTPYHLERTYLGAKHEATYHLTTGAAHLTGFNNLTQPKPTKPLTSGCHANVATTGGRLINRYNPSNGTQNTVFYYLIFPSDVNTLALCSHCYYASLPFLAATIIFLPLPIPILDLFKRQDALPTTSLTFYYPYLYSIQLFLSSLPPPFPSPPPLPYCIPSPLNLPPPPLIYSTPFSISPLSPSHPLLTYQSTTSSHYTSTLIPLSYHISHTLHLTRGNCHSNRPTRMTHSTFAIHYPLHPPHYHPHTSSHLHHAPHARRHYSPPPPLTHTRSTTLHTLTPTTPLAPPPLSPPSTNSHPRHYLPIPYHTHSLLCFPFSILPRTSHPPPLLTHYSSTLLLTSLTHYPTTNISTHSTSLTTISLTPHLPLFHPHSAHLSHTFHSQHHSPLSHPHFNFYTLSTPSIITDLTQPLPYSLTTTLTTHALCTTTPPTIGLNTPLIYLHCTTSTPHSVLYYITTTTPPLHYYTDIYHHYTYASPLSHTITTAHTYTHNTTTTYYTSPYTSTHTLLPTLTPLTRRTLLYSPTTHTLRPHTTTHHSTHTHSHYTYLTHDYISHSLLTTPTLSLSHISLSHSDTLTLPLPQSHSHSYYTLTNTHYNSHSLTTPPHSLTTQLTIS

SEQ ID NO: 1008905 - protein, 170 aa, Homo sapiens
MAANPLPTLSHLQPLTHSPNRHNPSLIPVNAPAPPRPLYPPAPYHPCSTSSSTPDALRYLLPVSHPHFLPISPGISTPSHFTPASPEHYPPLPDPTSTNLSSPPPIYYHTHFSPQTPPITQHDHMTRTPPHHHHHCTTYSHPTTPSPTYTPHSATTHPLPTTPLHPSHIP

SEQ ID NO: 1008906 - protein, 246 aa, Homo sapiens
SNVMIAKRIVKTLGDTVTGLDCASETEIQVVQSLGVPPERIIYVNIVVKQYLNIKYAANNGVQMMTYDSEVELMNGCQSTWPKQRWFGGVATDDSKAVCRLRCEISGATAQNQQAPFGTGERAKVIDVVGVSCHVRKRLYRVLRTFVQAISDARCVVDMGAEVGFSMYLLDIGGGFPGSEDVKVKLEEISGVIKPALDKLLSVETLEENHSVSPGRYYVASGFTLAVNIMCQENFVFNGPDGLDDE

SEQ ID NO: 1008907 - protein, 234 aa, Homo sapiens
RAQRGSGMAAGGSTTAEATRDGGSFSRRRSQELVAVWAKQDWSYSSSTSSSRKGVLCCCGPFVDANMREASDPPCVRGLDSCSLEIANGVNQQETLNYQFDAFYGEMEYISRTSMQVQVQPILRHLLEGPECHVCLPYGATGAGMTHTNAGQPRAILVVIPQGSHGAPADSLREEGAMVPDHGALSVTMSYLEIYQEKVSDLAGPCLRETCVNPEHDLPGEYPDSGSLRRSPIR

SEQ ID NO: 1008908 - protein, 62 aa, Homo sapiens
MNKEEAKNDSEEKLGNKNGRRGTRKKQKHKKQDKEDDDTAKQTTKKQKNKTAKQSENKNTKE

SEQ ID NO: 1008909 - protein, 197 aa, Homo sapiens
MEPREANSDFLLMFNDTCLSCAEASSNARGPIVTLKLWTGNGAIASNGCQYDSFVGDLPLCTTEESIRCCATRNRHNCHPSYDWALGQRFIRHATWSVLSREVQLILDYYYKRANPCKIRPITIAFRRNNWPPVTLSSGRTGSNNDRHRFRGAVSANDQCAAPPSCVGPQRDRALAPERINSNPSVATAAVKQTYPF

SEQ ID NO: 1008910 - protein, 33 aa, Homo sapiens
MVTQCKQQVLDGSHAQISFIHAEGATLNKVFRV

SEQ ID NO: 1008911 - protein, 153 aa, Homo sapiens
MAPTLPPQARKNTKALNSPKEGGAEEHKNPIEHRKDPHTEDNKASCKRAPRAAALGHRGHPRHGEVQTFAPQKPKRGDPTRMASPRYPRTEQKPFSVERGYSTGGNIRRKCTWTRPLDVLSLWAYQNHPPNSHVKPIMSFTRPHFHDIVEIRS

SEQ ID NO: 1008912 - protein, 139 aa, Homo sapiens
MYVTLSGNSSSVHDWYTGVLENNLVMPWLIKTGRCIAEGMWSVDSERFFTGVNPYALSNVSSTGIQVVMFEQSDKSRHPGKYNNGMVIGSQRCCVAAIRVVARDVYSEFVYGSESYDFPEVVYPVRPTMVILDAEWRFD

SEQ ID NO: 1008913 - protein, 86 aa, Homo sapiens
GSGGPLVGHGCFTSLAHSDANVIAVRKKAVTVAICLYQKGYLAKQILVEFQDCFVIARYLKDRGNEKKFRNETDIGAQPKEDIDSG

SEQ ID NO: 1008914 - protein, 114 aa, Homo sapiens
MREPQQHKHEDKENKRRDEADERDESPDIKRHRYKTARASARPLTTTRQWDEAKRCKGESERQQDGTERRSRADKRGEDDRRKTESQREGRPHGGEEGDAQRKRENERKRQTER

SEQ ID NO: 1008915 - protein, 110 aa, Homo sapiens
MVHWNKTIKNAPVYVSSAKLGQSQGCVYRLGRFEDSSVLFAYWECTRKQNECATSQGAFLEIESWTNMVPGSSYQLFVPPKRWCYDNLKIGEFDRNIREPRAMPHWLPGP

SEQ ID NO: 1008916 - protein, 363 aa, Homo sapiens
MYHHRVVVVKSGVTSIYRATRLYYKTNGREGARVNTKHGVEWENKKRKEGDTFCVKRERDPHYSSGGGGGDKIYVVKKQDSTLNERNIYIKELYCKGNKFETLFKEVVYKRWVTNTNGNNIVDRMSDKKKIVGNKEGREIIDREKQFILPQTETSPYYYILRENKKTKRKKRNERAADKTTKTTTSRRKGEEGKETKKKKERNGGEEREKKEKRRGRERGKREGKEEKRRKKEEKRREREKEKAAEKREKTGGKKEKEATRRKHREKRRREEQGKAEKRNRKREREKRKDRGKKEEVKEEMRGENREIKRRTERTKKKREDGEGTTKKPKSNKQQHEKKAREEETRAEKKTTNEDKHETEQKR

SEQ ID NO: 1008917 - protein, 177 aa, Homo sapiens
STKRTIVQEFGEVRLLTMGKGSFKYAWVLDKLKAERERGITTVIISVMENLINHARYLWCTYHLSAPGAQRLLSKTLYYRDILTAVLCVSWSSRGVAAWVTCCIDWLSSTETGACTRRSMSLSASYTLALCKQNCRCSTITGIATCELIALLGHEEAYRGITSLKGYVNVTYTNYRT

SEQ ID NO: 1008918 - protein, 115 aa, Homo sapiens
MDRQRNLPDITKKPVLPYHTSLETKKSRARELPKTPAQDAWVYPKAGNDATMEHLHQWSSLWSKSKYGYHNDTAAEPRASVESDMPHTEGVPHMVVGYHEYRTTYCLGYPKGGYY

SEQ ID NO: 1008919 - protein, 376 aa, Homo sapiens
PLAHKFLLGSVRKKPGGNGSLPSHPSTQKTPSKGQLEAPKPVASEGPWRQTNGCSDLPVPRAGCGSVAISCSSRDLMSMTPLVLRNSAAHYQSRHIRPVGLQYRLISAVEYAPAGLQSAPRVICQVCLSRAAFMPSCRLRSLQSSRTLEGVAPERLLVTLDLTHLEKHASVVARGDPPGSQISLRLPVCVDTRGSGITIPGILHSAIERSIMGLSDMCRLQRLLWRKIPVCPEKLNIPTSQHETLRGLPHLAPIRGTVIYASIRSPIYQGCRAQADTTKRAHQKAWTSAQGGAVPVGTKGSRTQPERPLWRKARRKHGHHPAQNSQKSKVPGPQTMGPAKVHWRANREVGVQLRRNNPETHHMAGRPESWRARHRE

SEQ ID NO: 1008920 - protein, 268 aa, Homo sapiens
MKSFHKHSCNPKLTRTVASSGTHSSGLSADLLPELQGAVAPVPLIDNYYHARAGHTNTTLCLPVLKRAHWAPGTAHHRSSQNLPVTCAGTRNGWYQVLEDCDDASTGRPFGGTWAPNETRGERNTRDSADQNMAMDTNRHWTHTGWYQGHETQRLGKPLPKGTPAAYPIRGPAQRQISLRLADPKRLERTPCVQHRGTPLYEATGFPDNIGAPNGKSGNKGLGGSRQLLGELEGENRVETDIRGGETEIGGEPNEGGVSRSLVNATQL

SEQ ID NO: 1008921 - protein, 93 aa, Homo sapiens
ANEEKQTYTPMLKKASNFKKMIPYRQPIIIFHVLQLSQQLSGINAVFYYSTGIFKDAGVQEPIYATIGAGVVNTIFTVVLYSGGKGRKKDSAL

SEQ ID NO: 1008922 - protein, 174 aa, Homo sapiens
MLEDRRLTQLLAENPRLLPNALGTSAHALRKPGGLHSPKPTGRQRSTPQHRTVPGNPRTRPSTGTHHRRSCRLPAHLDTSKPLEPTTTGARLLHKHQRPHSRSTLRALLLCKPRCPVHPAKLDPFRLLAITVAFLRVSPRPSPPSACPTVLAQCLLLCRYSDSWATTDSCYPRR

SEQ ID NO: 1008923 - protein, 269 aa, Homo sapiens
MGPFPGRPEQEGRERSTGVGQRRGPAQDGGGTPRDHGSEPGPRARGTQRHDEVTQEWPPYNHTTKSIEASQGNQRRKATGPHGRFRSAPVNAPEDPSERGLGRSLGQEQRHECSGEARKAGEMPPRQGRKPGHTVTREDPRQEIVAGPRERALNKRELGEHRRSSRRKHQRRRAELAGGTKRDHRGERDRNGRPNEGREHRDRNEKWIMTRETNGGQDRPGGGLAQYGGRPEKGRHDERGGHNGDEWWGRRTQRIGAKDRGAGHGARER

SEQ ID NO: 1008924 - protein, 45 aa, Homo sapiens
SWKIHLCDLSVRHHLLIQLPVICSVKPPDTVVTVSACGTLWHQYI

SEQ ID NO: 1008925 - protein, 53 aa, Homo sapiens
MARTPRSDATWNANGQDPSSPKTTPPKRPRKPELREICGAHQQGGGRATKREK

SEQ ID NO: 1008926 - protein, 128 aa, Homo sapiens
MIDRDSISKEKKTAECACDSRPVDPSTLGGEGGWNMRSGVRDQPDAIMVRDPGLYLKTTKTTWVRDGHLLLPAYSGTGLTVQVTTWQMTNHGNVASGLHLDTWKHSMDKWTNPNDRWYRYSNDRHTYA

SEQ ID NO: 1008927 - protein, 156 aa, Homo sapiens
MYRDDSRRNSLEWRLPVIDDKHKSGRLEFSIAGRANDCFACSKFSVSSSEEQITCNIQVTKVTQVDGNMPVRFATETTFPSGSSMKFCNTKKRELKRKIFEINKEDANDWVKSFCPDVQATRALVFWYNARFYWAQGSLDVTPCFSVTETFFDKEM

SEQ ID NO: 1008928 - protein, 310 aa, Homo sapiens
MGFHCVGQDDLDLLTWGSTRLGLPKCWDLQVSAIHVLALISGFFIRTHEFHHVGQVWRIAVTRFPTGPLSFLSLASPSHTSSCHLAARGDPDTLRPYTFRLSLQEQYACSQTPDDLTTNTFRSYQRHPNITRSIRANFLQHSRPPSTHWTITRTHDPTSHFTHYHSSKLPRIMTLGAQQQHASRSSTNTPAAPRACHNRTPTPQPLTHHYQHTNFKHSHLRLEQPPRHPPHRVTSQHLHHPIPPTNPCSSPRPPPHPPTHPPPPKPPTSIYTPSHYNPHPHQPPQPHQPPHTTSKHTPTSPPRTTTSTST

SEQ ID NO: 1008929 - protein, 116 aa, Homo sapiens
HASGFNTKVCLLLFFFLKKAGFIGPSERISRIFYRAPKLKHISNFTLQPRHHLQKFRAKAGGISQRLDLGFCANWVLVSLKPSLGLLGGIRLILSWLQVHLRGNFFNIWGLFRGTN

SEQ ID NO: 1008930 - protein, 108 aa, Homo sapiens
GPPAPRRPPLPGPGLRMLAQRLVRPGLLPSGTPANFARYVPSAAGHNDQISTDDPSEVREILLKRRQAAMPDDDATPHARPNGTETSTQNMRHTRKHKRPETPETSEA

SEQ ID NO: 1008931 - protein, 369 aa, Homo sapiens
MREIVHIQCGASAGNQIGCQVFGQVISDEHGIDPHMAVTTEQTVTYARVEENPTRLHTTCKPLGINAHYDSGGADPSLGVLARHVSADVDFEHKRSLDPTIWTQESYQTRRTTLIDMLRGRHKGWDCRGTLTIGGQREPSISNTRRGEGPREALGLRHRPLTTLVNCRDAGAKRRASRTYAVLSPLTITRTHQYHRATEALNTYYVREGQHNLAEGTQSAQTGPGTPEERQDKQPERQAGTDPEEEEPHAPLARDTIDLDQSMTRVGRTTRPSPKTSPETETDKRGKRVTQRTRQQDRERGDQRDHNAEHARQTHTKHARGDTGHTEMSTRRHTPRGEGPEPTEPLAADDGQGNLKQRGPTKQTHTHTE

SEQ ID NO: 1008932 - protein, 296 aa, Homo sapiens
MKNRRDATQDKQANTVERWAHNEQDYAESSTRHQQRRDNTQQQQPKAKQHTTDEKKEKGRKNTTGKRSNTRTKARDERKTPIPDTKQLRTKENNNTAHDKNEKLENNIRQKERTKQQEQSKKHDRRSRNQPQTKKKEEKTNSEGANQRKNRTTEEKRNRNNTEAEPTAASKEHITHTQASSTEDRDSNRRNGEDEEDERQKTSEHKSKEKKTQTKQEKRESRKTRSTHKRGHTRNRKRNNTNTKGRGNRRQRNKRKAEDVMESRANKQKRNRETIMNRKEKRHEHDHRHTHKQPNQ

SEQ ID NO: 1008933 - protein, 314 aa, Homo sapiens
LKAERGTVVSPLISPCGNERPAKYYVTIIDAPGHRDFIKKHDYREHLRLTVLVLIVAAGVGELRSWYLAENGQTRRAVPFVAYTLGVKQLMVGVNKMDSTEPPSSQKRYDGQSFKEVQQLTLRRIGYKPDTVQHVMPSLLGFGNCVINQCLGMPIGCQSNCRLRVQKGLRQMSSARNRSAARLRYPTLALMALDVRSLTNQAAVPTEQVPVRLPLQDVYKVGGIGTVTVLGEWRLGVLKAGYGGSPFAPVNVTTGCNKSVRNATMKLEWKLFLGDQCGPSKVQECVWSRDWYDVGQRLLGDQAKMEPSKWDSQV

SEQ ID NO: 1008934 - protein, 214 aa, Homo sapiens
MHTSQNDALHLDTEEFDRFTFILLSLCTLATSSSPLLRMYLRHPALRPASPALLLSPVLDPARLHPPTGLSPPSPSLSSTPLHSPFYPSSSLTTSLPTPLTDPPHNYDSTPPPTSHSTPNSHTPLTPLPHTLSHPPSFGYYPPLGLLPLAPLPSRNLLALLFLFFCWSSFFAVSPPRSCPLLFLLISLLPAPFLSPALFNGVPRCLSHTVALPL

SEQ ID NO: 1008935 - protein, 231 aa, Homo sapiens
MPPHYSAATPAAAACMHAATHAGDSSEQGVPRHLAGRPERADPCAPSPGHPRSCNVWWPGTQHVSTLTADCRLDFISMEGWPTSYLRGRNLHLADLRYRGEQACWAHTDGHLTPTDYATANQRASEGNTHTPTSQEVGGDRQQHRKGKDKKSCEVELRSIERQKQGTEHNTISVLAKKYRRAERNQRKKPPIGQDTRTKQTRSNTAEPQPNVKQRNKGKTERTIERATSNT

SEQ ID NO: 1008936 - protein, 212 aa, Homo sapiens
RLAADSGTQIVASRSSDPSSKSDTPTRVCTETTTSVTCELGGIRVPLSVERRRTFWYLARLKIASRTDISSTYLNKSPEPTKRTELSPSTYIDKDTPEPQEENGGTLGARTLIAHCGCHSSFAEPTIYEQSKRNPMASARDTQYDEQESTSTRQSELLRVPPNSSRIKVPQTPNVHTRRRPAFTPTVTAPRYPVSTEAQIARTPVAISAGNN

SEQ ID NO: 1008937 - protein, 264 aa, Homo sapiens
MVSGPVRLGGTLETGEGRAPVGGTPQLQQLRRGAPCGPCPRRAYNHSAGAVVAHGKKPGLGPRGVASLWQGRGFPQVLAVWTPMDACAGGRTCGIPCATAPVCRGPLETTVGTDTALSPGAFHQRASVRPSISGSGDLLPGVGLCQFVPTKSPPWGLSPNVGLCVGPPCVQLLSTRQAPLWRHTIVRKSRSTLAMEPVAHTSIVQVVPASECPRTMPRAENLKVVGTWAARMPKAPGQCGHFHCRIWPVERPLGGTRHVEGHLV

SEQ ID NO: 1008938 - protein, 163 aa, Homo sapiens
MLTRLVSRLLTSSDPPPPASASQSAGITDVSHRAQRFGISIVGHGEKRLEAKQGSEIHGKCQGGTLQAYGPSPVQKGLGWDADSGYARMARRHTCRRGSQGPGPARLPGHGLSLNTWAGTEQTKLPYSQPLRTPRAAAVAGRGAGRNAGLTTQDAGANPRDPD

SEQ ID NO: 1008939 - protein, 272 aa, Homo sapiens
MCGSLLRTPGCLALVLACPRASPECSAPEGQCLRSDPRPCAPSGWAAGCACLMHVCRTATPAGCLSLSASLLPGHLLACHFCSALEAACWVRVGTPECWEDAAADYACLPAQCLSVPSCAVAACVLLRCKPGTRSMDVLHKNPQGNTGDSRCPDPFGNMATHGERFQDADSRARPKVSTDFKKPHIEPDVQVIVLRERQRNLYSQAGCPLKTPRVVLPWKVLRCGSGTGGVSPLLQVHTRWLLCTYARSLVTYSLVPRSDRPRVSSQCHPWQ

SEQ ID NO: 1008940 - protein, 118 aa, Homo sapiens
MEPKIDIVRCKPGKYPRWPARVCGEPWRVPRARCSLQTPYVAKHTSALCNSCRLASARTTNPTAKRQFCTVSQGGGQQHRLILSRPSKALDGDFTEENRAQCRDSKQTLCMEAVDKSE

SEQ ID NO: 1008941 - protein, 305 aa, Homo sapiens
MGPVDRQWHIRSCTWVEDNMAYVNGEMKSVGEVKDTDEAWSRRSYLVRSSGELCSQAVRIIDGATRRRPCKIISYSSSFVARGPWLGGAEPLEDDVPCIGTLIAFKIDPVGIELFVGGINNYRCYAATKSHVFRKGLTEDHHFWMKQTAGPDGRPKQAFEENHGKSTLRTTRIRPLLVMLRIRSSSPFSPDVQPPVHKADRRPNPHQALITVIEQGEGTLHLMTRKKAIIFTDQGRLAAGAEQLRSTFSRIGLHLTVKNVVQGLVKRARARVMEREMIQDCVNANIGGELQDSWSLVEYWGITGR

SEQ ID NO: 1008942 - protein, 225 aa, Homo sapiens
RSSPAALLRAGSSTKFTANALALGSRMATTVPDGCRNGLKSKYYRLCDKAEAWGIVLETVATAGVVTSVAFMLTLPILVCKVARNSQTGEKNACPTQVFLLSLPGLVLGHLAHFASSSTEEQGPTLLLLDLFHLFSAVVMLELTKLVRGRSPFPVGLGLAGSASQSTYDIVDRETRQAFDFRPVEEIVPPLVLWGLTPSLFTLVLRRKLGHYQSLPCSVRHLLSD

SEQ ID NO: 1008943 - protein, 237 aa, Homo sapiens
GRVTYVHRHAWLTLEEAGGPEGLTLCTLGSPCLDPHGDLLAMACSTVPIHRKHILNELKYQCVPTRRYGLMFIRLPSETGMHGYHSPCPGAVPSDHSGSVMARNWDSSFQILKLALCKTAVGGLPDNRHSAPPHPELSLAIFPRCSPTPWQKAGHALFPADRAGFPTWLQWTYQKPCCISVVSTCPVPCPHSLCPEEAKLVSLRRAHKGTLDPPESRLVCSGRKADSEVGQWALQGT

SEQ ID NO: 1008944 - protein, 187 aa, Homo sapiens
YLRQLQVLDYISRFLSEDNETLVDVCYLEACASCAQTWAKKEHILQPGGDPMSIINLALVLALNAETVLVMPIYRERLMHAEPWRCRSVSSQSLTRVPVDAGAMLTHYSRLGLRRPGLRENLATDLPARYFLDTRATSQVGRGPDRAGKASTLTLGIPYAEERGPPGIADSMEDCETVAPYCWGPQS

SEQ ID NO: 1008945 - protein, 69 aa, Homo sapiens
REWALKVMEPEGVIESNWNEIVDSFDDMNDSRSPFSDGIYAYGCDEGPLAIPRQADAHIYLAIKRRYRL

SEQ ID NO: 1008946 - protein, 147 aa, Homo sapiens
MADNPSLENHRFKSFNNKVPLMCDNQCDRHRNEVTVELRKNTRDEHLLKTREMFPKKNSLEDSDVDADFKAQDVTLKAILQNATSDNPVGPIELLSSASNEQLVIQLTRKSSRVDDFNKIWDLTNSSQMSRKGTDPPTLQLASCLRH

SEQ ID NO: 1008947 - protein, 114 aa, Homo sapiens
MFCFTFCSLCGWGESSRVETPSLGGDTGPARAPPVEKNATNSGRLAKQGPTETRRARERNIHGETTPRGHEGTPKKSLTQGSERREGVKNREYNKERYQTNAAHEQHTQERGGH

SEQ ID NO: 1008948 - protein, 178 aa, Homo sapiens
TSCDFRVAMLYFSLFGAARPRARDVGKLVTDGQFRAQHRKADPRHQNWGSKQGAGQARRACRHSDPDDVGSGCSRAEGRGRVGGPGGSMGSENFMQAESALEGPGVLLLKQQVLGGIIHGYTRYYAGSRRVGGIDNFENRFAAEAVTEDTYVEAPLVALGISRGNGSREGKNKDHKGP

SEQ ID NO: 1008949 - protein, 304 aa, Homo sapiens
PGDPLRRAASPSLVLAQPCLPRSLAALLPAAPQSGGCPAAPHCGPAVQLPLTCLCLRTCHWSCPAACAPDTCVLCCRCGAPPSRWSACASPSLLCHLRLVAAAQFLTSRGIAGDMHKTAHWMDHLEAIRRGGLPSVAPRGSGTPPFSQLRKGLHTGGPITGGTTYRRIRKIAGPPAMTSPDLIWRSDYRRPSVNSGERFPEAAPPIDKHLNRTNPQVVVVAVGHRAQKPVGHLAALYGRTHGDGYTTENFGDNRELHNACQRTASNQVVCEIVSQALVKKSGVGKVAGGNQLLDTRCDRESDPR

SEQ ID NO: 1008950 - protein, 165 aa, Homo sapiens
MQHTPQPLDKNQHKAEHTEKNPNSNQSGTNTQTVHPSGHERHQSAPSMNKRKQTPERVTTPLQILPTRRPKTRQLTASERENRITTTKPQRGAITSTRRPYTSHSEWQHKWAPKDTGGYTQTGGAWRKRANNNTRQQQKTHQLGENRRPPSHWKHTQEPKKTNHS

SEQ ID NO: 1008951 - protein, 308 aa, Homo sapiens
MRPTLFHIAIVAEIVDRVSRLGACVDGVGPSHIVPGHSLDQQLVVLVIGAELGYRQRLIVLRAPERGEPCIYERMGYEPKWGKVCARREGGLLQRITIQREQKNNGIEVNTGGGVKQSNKSCIHGAFPVNNLWVPKKFRMAKGPLPLGIHMAQGQSDGTGTDGCMHFQGKAPDWLYPLPVGAQMKSRHSPFGLTVHNDTDTVSGTPTNVWDHKHRLGKAKLGTRTGFKHVGFPGPTGEQRWWFEHQEGTVVFEHGWTDRSVKSICYYFHKGVRRTTANVKGVRTSCAATHPKEAHPNVVTPCTEDLCR

SEQ ID NO: 1008952 - protein, 393 aa, Homo sapiens
GASGRGVPHVSLVSYINRPPLSPFLCSIYCVLIVSLTIPSNDTDGTCVRGVCTGAKGERGRVLERRKEQTKASPQSSQDAQQLLQAPEASSQKRSEGRGARGSRKGGRLLRDPGSNLDYNPAQEQHIIPDGRCLLEKREPANGSHYTWTMWARKDNAQSIAGSVTRQRDSRTRAGKHRPDRTPKPRRPHGTTGHTCTDNSKKTIQENTRSRAKTTESTIKQHRTIMEDQDHPKDQWGHTRTTSRQSERGNGRSTTPKGGQEGTAHRGTKEEHRGKAQGRDYTRTRETKRQSANTHGRNTTGTATRQDAGDIGTGATEEKQQREQKQNKDTTQKDIKRHSTKKTSMNGKHHMKHTRENKKQAKESKRTKTAHQANQKTKEAKSHKSHNTNRQNN

SEQ ID NO: 1008953 - protein, 107 aa, Homo sapiens
MSPLCSAVPPTFQWHTTCTTREAYPAFFRSNTSCHQSAPIQSCTVHLTGSTCNTTALHDTAADADYLYVTPTLPGLRTCLCQGSQYPSCMSAHRGHLAFHSTTLGNS

SEQ ID NO: 1008954 - protein, 44 aa, Homo sapiens
MGTHEMVNHTSGIYVRVNVGHWTTDQAASRHTGLNARRVKEADI

SEQ ID NO: 1008955 - protein, 50 aa, Homo sapiens
MNARPLIPPRATLSRLNPPRTAPSHTDALSGPTGGPKCTLNYKLAVPKPG

SEQ ID NO: 1008956 - protein, 497 aa, Homo sapiens
DNKEGEDRSVIHYDDKAIELFKDEATDGGGDNKEGEDSSVIHYDDPGHCNGCSAPVTRHAALQAHQTLPGPCTCNHLQLYSKVAPVMCVRGKQAPWAAGTARASPHAAQNPLNTRKTTSAANSLTLPWRMKTRPAGHPTFMNARTRHSTALFAHRHNSWGPHRGRPRRTLPAHHSGSPHYPTAHRPSPTCQWHPRTYPWGQRRNGQPTGPGTKPHGPRTVTHLPPRAPYHATGTRGRHATGTLGATEPRARQEKRQPPDATSDPPDRQSQGGTLAQHPSPHTTTRTQQDPLPHWHSDPATDRQAATAYTGTRTTPHEPRHTRPTHHSLTPDSTTDPHTSCTHLTSRPHTWEPKATDPHTSHTPTTQPSTTQLSTYLNTQNQHASHPRRRHHPLHEPTYRHIQEENTHRLTLTQIPKSDSSNYQRHPPRPRHTLSKDIDNPYTGHDSSVDTHTAQKQALEQSARPNRSCKRANRRSQYTHYATPRRPPAQQADMTEQL

SEQ ID NO: 1008957 - protein, 225 aa, Homo sapiens
LSLSLQKGPGVQLPIFCPDLGLLISPVSANYKGPSGLMQQAMCLCVAHGLMPREPRPAPALTCCRLARPGSPCGIPAYGAPRQIGESRETRALCEKRPVRGPDQGPSVRSREPCTGVAKHPAQETPVVHAPVLCSQNKPASFSPVKTSPPRVLHGHTLAQKPCACGPSVPDRAHKLLGTLWNISLKNSAFISELAVLVDQAPRVVPPVAERAHSRNHSCETGGQK

SEQ ID NO: 1008958 - protein, 438 aa, Homo sapiens
VDVTAMAEGERCAALPTSKRRRLGKTILTNALEPGGCDSGNVEKYYIQRNDRCLLTLRATRSRHDCSELSPDPGDYFGTHWDWYFQDLCHHHAITYFTPRLRLQLLLEPAYHVTKKRERPRHGTHLVPDYSTLCTLPLLIATTHVTHSPTLRTTPLYAWDHTLTWTTPPRARHSFPPSPTAPAPFYYQPCTTHCPTPLHLNAYIPPHGHIGYPYEHTRPHPIAHSPSQHGWTFKAATIPPLKAARNALPGLPSTFLRTSRNTDNHLNILTRNVPVLPTITPLPSRDTASQHAGPPAMTLGNPPLAHQARHLHVATIFLAQPTPPTSLIQTHQCTPNFPTLSPNPYHTLPSILHTPSLTHIPPPHSSPSHPCPHTHPHRLSYTHTHHPPFEAFPTTNHKAPQQKTHIIHTHTYHTSRTHIPTPQLTTTPPQHILQPTSH

SEQ ID NO: 1008959 - protein, 355 aa, Homo sapiens
MASSNTEYQCIPDSTIPQDDYSLLSIPTTRWRAVVAFQCSHSGLYGMCDVCEKPMPELLGPVCWFNTNPSSYRGIYGSSRRGLSIQCTGMDADSGSPGYPYYMNYLYDERHSGRDRLVVHVWLLCLDLLPECYLHLSHELRALPLRCARGMCISDKLGSRSSIGEWVNIVVAHAADEYQRGFRQSPSDMTSIVDPRQHIRCQFNVPTCLDTLVELLPALSSLATCLWSPLARQRTPSGGYCTCASSKRRVGARYSTRLKALVLPTRGGSIAHFTMRHEFPSGKPAYTCWFTSVRAEMVTVKMPPLPCLACFAPSAQQRTCVVGGARQLGDQCPHPLASCFYSTAYGSRDEEALWR

SEQ ID NO: 1008960 - protein, 258 aa, Homo sapiens
ERVGPRKNTSSEKWQKQFSMPHKEEKKSVGDLRVSIANPFWSGPWSSDNDTSRLLPLLKHDLTNQLRLVTELRTDHLSTLYWAHTVILDTRYFFHEAVPRFTTFHDSYNWFANMERLLTDNTLAYSIHHFNTRYSRTTSFDVGQDTTADCEDHGRQRLKTLPRGGRNFPSTNGLLSHADKPRLCNTHSFPSDDTTRHLHPKRGHTNASLQQPPLHALRSLTTCVCSYHKPGCDHGGTSSVTLQSERTATHPYLTSAVW

SEQ ID NO: 1008961 - protein, 301 aa, Homo sapiens
MVVARAGEAHAQRLAIESAVTAGNSLEPGLAKDLVNALCGLYLLDYLNKHAAWYMSEGLMDSTRYRAMEEHLNQHSDFLATHVALLIDAFGQGDASRAAIASADAYPDALAAKLQWAQRLNLTTHLNLRAMAYEELVNISQTFIFTWALSNFRILVGHLGNGQHISIQEPPHVPHARHPVAPQPVSRGIALSAPLASLLLIDDEQAYSVRAYNLASAPLGQQPLNQIASKAGLALTFSRRWPRARPRTRVRAHVDCARALRAALRRTGLTCTTAARTHRRCHPTGYGPACYISAPHRPEVL

SEQ ID NO: 1008962 - protein, 266 aa, Homo sapiens
ASKSFLPIGSKACKASLKKLPMGWQEQQVWQKPLFTLAGGPSTLSLALTKALTVTALTVSLSQAVYSPSPASGPPSLWEAGHRVAHPSFCDYSSHIPHLGKLSLQASSPEKWGLRCGRRNPGHDSIQKGARGHQPIHTLPEGPRGTSPHPSGPTRGEINTPHKLNSNRRADSPRKRYPWNRQKAPHADHTTEEHRHSSPAAQQRPPNTPLSARPNTSMRAPSSRAATTPVGSRKAPPPETPKPSTRRRHNTNNIAPKPSRLGVDTT

SEQ ID NO: 1008963 - protein, 362 aa, Homo sapiens
GQNTGVVNTTPKSHTWELAKTHINIVVIGHVDSGKSTTTGHLISSTCGGIAPKHTHCNNICSTGRLLQHGQHRAPSSYAWVLRITLTTLQRCTRAYPPWIISLLATWKHSTVSYCDQYYTESAPRDHIETFTHKTMTYQGPSHGLTCAVPDMSAAGRCVHIRTAGHLQEHGPHPTQHARSALTHWDVNPSTLSVSHTQLDSTEPPHNTRSTEIIDGQLAYQDTSMHTSTYTDTLVASNIHGTTRYALICTPYHGSETLELTPTIDSDAKSWCYTALATEFQRGTATNDARRTRRTRPTAPDGKHQPLACEKHHKKWQSVPNQHQRNLPKTRLRRRICHELIYRPLAGNSLMYRCCDRQATHL

SEQ ID NO: 1008964 - protein, 226 aa, Homo sapiens
MCLMRLLARRSAPPRAPPRADSGSFIARVAELSLLLNPLDRITGVPHHVRRSRNTSSEITTKDLQEKKEVVEEAEYGRDALWIMANASERIDGAQDADNEGESKQEDEECESDEVGREEEVCCVRPGMLYEIDDASRLDYSVKRRSRCKHSMAEFLHTLQVAQANASDNAQKRTFTYVSDKHTGPQEKQHYGMIIQRARQMSPMSRVAILASRVNRTSPVVRLSGY

SEQ ID NO: 1008965 - protein, 102 aa, Homo sapiens
EPSDCTTRHVPEEESGPSEADWYYCVMRNERTNQELKDDPGPSVVGQRVEPPEIVYNLRQLTRTRLPKYSGWPRGAASVGVYGQIPGGGYTMHMRALLGALA

SEQ ID NO: 1008966 - protein, 164 aa, Homo sapiens
TVSPWPWGPKEALKAVISSAEGIGCLDNKVTVVYLAPALRIRTGPQPRLRECYLPRESLITIREYDCKVLSLHVGGLTVIGTIQYCKRIAVRKFRKAKGFRRWYDPLVPPARHSSGMIIRAISRTPGELISSAWFYVRPKERSNFRMVHLNDRLRKKATQYDRL

SEQ ID NO: 1008967 - protein, 166 aa, Homo sapiens
MSEWDACGCLVGKEGHYLAPDRHVAMWSVVDKTGVEGHAELRRQHDMSSFRHATYYDIKAEETHRYTISTHDDKGTNCPQEPRRRGEEVTSHNRYARVRPQPRGVRLGQMWRDETKGRDDARKDIQKADQEQPSKSTKEREERRNKQTNKKTYKRTIINKNKRVTE

SEQ ID NO: 1008968 - protein, 284 aa, Homo sapiens
AGSSRSPDFPAAPCWPGMPMCWCAAVPCALEAAPVRELALRWASCGMWPVSLQAAELWILHDERFGDIFSLLCVVDSLVGEEMADSVKTFLQALARGNSKIQSGVYVPSQTLDARIQANRERSHASTEGQSSVLGTRPRAPEYYNGSKESEANIIGEVTKYIRRWKDAMEIGLEDDAGLMRVVEVAKGGKIRRCRRRLHSKEKVREISGKEGREKRKLTERPAKESPDRQDVRNSDDTRNGQTKSHRDANRGKEQPKEEGEQQAQRRGEDGQHRTTRGTARQNA

SEQ ID NO: 1008969 - protein, 145 aa, Homo sapiens
MDGEWILSDPVSREEAEFLVPKESGCRVFTQRALVELGYGHWMTGTCKYFGGKRRDVYTWENLVGKPGIAFNWKIGCVYSCVTELKGHMVTGTFTNMDTGNLHFSATIEPRRSGKIVRLGRKIDSDGTGYWFVAVHSKIARGWFG

SEQ ID NO: 1008970 - protein, 260 aa, Homo sapiens
APRQEARLCVFSAESARQKLDQGRRALSDLDLMLPMPAVDLQRVIRTSSSFPRELFMQLRDAHLQEAPTVSRAPWGTMKPISGIAMAKNESPEKGPRRSFAGPALLGPHDSGRALGLIPTSLRSRGTPSQTFAQLDSSGDLDYCLVAQVAGEGNPFAQVDYVPDPNVHQGTHQDPRDKGDACDWARDATSEDEGDAVEHCNHNQALAHLAPHRHPEMTAHKTTRHITKDPHRQPRPAQPPTTPHTSTNTKIPHTPHAAHA

SEQ ID NO: 1008971 - protein, 217 aa, Homo sapiens
MGTYEGQTERKHTFVASGNHLWLWDIRKTLYTKKSHINETFPILYKHNTGNNQKGDSTKRDKTRGGRQKPIQHGAAEKEKAPERGTQQFRTLEAIEDTPSFPKKQRWAPKQVTQGKAPFQKVEKAPKRNERCPGTVKPPFLPRENIKGKGHDWEPHFFPKEENIVTDKEFTTPHGVAHIIIPTETHARIVWCTHHTGESGTRSYSCDDHVSRRQRTT

SEQ ID NO: 1008972 - protein, 206 aa, Homo sapiens
MTEHQPSSQHKPPSKAPTHRQSHNRTTPERPCIGATTHAREHAGIPREYHVGTRDDVHEAPRDHTRHWHGHTPMAEDGGTNPRESRSAQGPNNGRAHDTLGTHHGTQHQGPHGPSDKSADKPTDGPGERSTRARAIHKQGKPVQRHRCEDERTPNNPAKGNEATVERDRPGTRIGPAAHRHGTREGTGEVGGGTEERRPRQARRQA

SEQ ID NO: 1008973 - protein, 121 aa, Homo sapiens
MKQGFLRNVVQAGRLRPVAQAVLLPSVSQRCWKLQGMRLWKPSQGQCTFHRDSELSLSERSNGLESPPHGEKLVWLSCLDSDSCKVRPFRLGRGGEPCHVHPSIAMDILLDSKNLPAWCWA

SEQ ID NO: 1008974 - protein, 268 aa, Homo sapiens
EDSERRRNHNILERQRRNDLRSSFLTLRDHVPELVKNEKAAKVVILKKATEYVHSLQAEEHQLFAGKQEKLQARQQQLLTDKLNRSDLLDASQNWTVTATMHISILPPPQTNIVSTLNECRLYFQIGPLSSFGSGLRQQDHQCAGSAWDLGAACIPGCWVALQASSTSPSMTRAKPLGDGMGASGAVERSPCVSQVSKQPGKSFPSLTNGAYSSTQMPHKGLCHLIPLGNIPGKYHWTQSAFPYTSWRTENVGFSRPVSDCKFIPNYC

SEQ ID NO: 1008975 - protein, 147 aa, Homo sapiens
ERERECSCVGTIHRGVFSQPYGLDTETCAARCSSDAGLTSATWGTAISDSPAQGDISAAPSHSGLSGASRLTLPYRHWQPQHLARSAARTAAALHDDQAIPAAPRALRRLAAHSHGHPYLNLSNLQHAHPSSHAHTQPSVSLLRISL

SEQ ID NO: 1008976 - protein, 412 aa, Homo sapiens
MSRQGHGIIQTLKKKALYLHRSRDEFMVHHREPRTTARSRIGISSKIPTRGHSNIVRVVATHWLGPRSGTHDGTYGLDATNPTAAITIFCANPLLSLREDRPTHLGGYFHIPIFHSNFALQGFLYLSQSFSSTTISPLITSSGDHDQPSLPVPPRLSSAPPTAPPRAERDVDGCRNHTIIQHTAAPRHIDCATSYPSTNRSPPGDGGSLIKRDYNHSPASTQPATAASTARVCGDNTTTHDGASSPRAAPPPPHPRGCLLENTTVLNLSYHSSALSWIQTRSGRISFANSPIMLSERATYAVCGGLLIMLTSLFRSLVPVHSPKRWTGCPPTISPVGAHSTRPSSNSLARRSGDHTAQRTTQLCMWRYNRILQCGPALVVAHFFRCFALPHHTRAEGVVSHFATLYSATLVE

SEQ ID NO: 1008977 - protein, 161 aa, Homo sapiens
MHDLGVAPICRTRRVECAQPRTKRRPETVRKYMHSCVLMRANRILGHTQSALGSTMGAPRERERTPEGGDAWSAERAFTEDPSRYKDPQHIGSTEIEARPFERLSVVVWKRVHQCYIKRLSRVPLLYNISMMPEVFRSLLYERTRVCAFTYTYLADLRCAS

SEQ ID NO: 1008978 - protein, 107 aa, Homo sapiens
MSPYYTFPPSSLPLYNSLPPSPDPPIHHLPNNSPPTTSYSLDILTINSHITLPSLHLILLSPQQPHQPPTPHNHTPPSPTCTLSIYTSSPPSPLQPSTPITKHTYSL

SEQ ID NO: 1008979 - protein, 371 aa, Homo sapiens
GTSPSLAVLRHRNDHRDPDLSKSADILIFYPRIVCQSHPARPLDARAPGDVHITGAMVGSYSSPSGETDDPGQGGRAGPALSLRARVSVLFAATLSPPGLRAVRGNRHWLGLVGLCCILGRFRTEPVAHLVSVQTPLDLHPREGLPHVRGAENGPEEHVTLMTQQHTKGRLDNTRYPLRGRTNQATLEQRPPTIFDTETLVDHPRSPHLEPHHRIPDLTPTDRTDTPSTHPAQENPDSSACTSIPYEEPLRIPQLHNRAKRRHRTYNGPTNQHHQINYTTIKLPRPIHDTDATNDLTDRTTLNLMDSAQAPSTPQEDNETTEHPANNRPKHGWARTMRTRRLLLTLLQLLTPENTNNKRSSHLNPRHVRQR

SEQ ID NO: 1008980 - protein, 338 aa, Homo sapiens
LSFVPGNDFEMSKQPRLLLILGKLILLHHKHPERKQAPLTYEKEEDTGPRGELQQPVEWWCATAWSMLRENTLDYTRQHLAGTLDLSPYPARICLPVLDGLHTLGQFCPSADAPDPFSHPGPPLPLLSPHEALAPCEHPQPQPQPSRTTTVDLTSGPTPLQPPGERSSLALWCASSVTESNPGCAREIGLVATACPTLCLSADIPGTLFATCTRTNGARISGTSLPLPTRTALDPHTSCQPEGHAHASSHRRTDPLEPTQCGTLMQAGCPRDAALGTNGEDEATTSERSHLERKSPVHRPLYRLNPGMKPMTYPRSHSDYPAFGNRPPTTSRSKPPPH

SEQ ID NO: 1008981 - protein, 401 aa, Homo sapiens
RPLSPSSAAARPSAAMALNGLRAREGKGYEVLTRVLPGLLNSGTKQFKLLGTSMIRLAHRATGGSAMSDPATDRTPQACTPESGGPHTSLHAHCPGRLRPNASFALTARYQPTTCMPSTIQRHDAHRSDPTHPTAPPPPIPNTSKTKYKHTTDSTPNPRTSPPPTLPTLPPTHYTTTTNHSLTSPPITTTTPYTYQTHNYQQNLTHYQTNHTTTTQNNHPHTQTNNHPPYHTIMTHSPGYQNTHSIRKPPCHTNPKDHYTPTHTTPPDHNNNTTRTSPRTYDRQHLHTNQHPITPTHPMTYPTPKRHHDHQQAHQTPTKTPSRAQRRQQTHHITHLNTTPLHTTHPNHILYCRTSPTPQTPHPYSITHNSTQRTTPHPHSIQHPPAPTLTYNPTMTQQPYI

SEQ ID NO: 1008982 - protein, 359 aa, Homo sapiens
NLWPQPLPTLPLPPLTGVSVYGALQEDPLVPVGGKVLESQLPSLELGRHRLLEDKLAEWFMELRWWEISEPLQRCGQLVRMATSGSAQQRTPRLRLAEANRGWTGQESLSDSDPEMRAACCRGAKAHAHALVEHKEATVMLQNETHCRTTPRRQGRAPERIPRTSTPPKKNPKETQSLGTRSIPTRRQAAEGTETRTARRATPAAMAPRATPRHPRRLRSSTHPADLPRHPLSALDEATDNEPPRSREVRGAPRRKTTEMESAPTTGHDMQRQRAMTTNEDPESNGTTTEHAATDEGPRQLNHRQRRAEREAGVTKEGDREERTEGDEEAEREKRKGARRNEDAREKKYRSKENAELKR

SEQ ID NO: 1008983 - protein, 615 aa, Homo sapiens
SGRSVGTVWVSESKPTVAHVLRIDPLFSFKHAVREVHAWQQERRWTTSCRVQSHEDLTQASVVPLTQSKSPSRTCQSHGKTCFPSPRQALSSSLTWLFLDVRAMPHHTHSPAYLHHMHIAPQHTRSSAQISRTQARVTHARPPHHIRRTTSNPPPHRTLPGVTLRITTTLPPLTPAEYGNRPHTRPNFMRTTLHPPQQATPATSLNKLTNKLTTYCPAPDKHPKQSEEHPTTCILLALIHLFTNNAPNVLTTIRRPTAHPQFPVYIPKGLGNHTLPVPLVTTTSANRPQAYPASFDNPTTDMAQHTFHDVRATHNPNKRTLRLNQGQPHQAPIPPATTTSHLTNPCIALNQHSISPALRSHRYTVYHSPPFLSATRSVRVRRSHNSETERQGPTTAGSHSASAPPTYSAHSAHTPPTAAAPRHGTSPPPQPPHLTATPGQHTLVRPHHVGGAHQHDLQDATRAPQPIADAPHTTAEAATATHNTAYIHPQELATMSGTTNTKKRRTPTVPAPDYIHTLTIMTRRTNPAHIRRHTRYHPRRHAIATPPHSRHAPTPHRQQTTWIKDDTRIANSHAPPDRDPHSIPAQCTVPNSKRPSPATRQPTTPPAPNTTHKLT

SEQ ID NO: 1008984 - protein, 318 aa, Homo sapiens
MNLFVGMWTVETGSRWVSHEGSKIHAVDNTNIRNDPRTSRETRPVIIIAKTTRQVRKDKKRPSLKRGRHPEEANNTIDEDTHKGNRADQQVHTDSTYVTQTTTPQRQSDSPRCILRTQLHENAHYHRREKGQPGGNKERNNCGDSGTRQIVMSARSTRMDSRTPHICIYKKERGMYENEQGKNRPEASYQRIVDQSGQAIHTSMSDTETEHRSGQHNDRAVRHPAETDMHRPTPTREHPEQGEHRPLINNKTIKQTPPSKVNTTADTEEKNNHKQGHRGQTDHDDALTNSNTTETLKSKDSTDEHMTDDSKTIHEKHV

SEQ ID NO: 1008985 - protein, 130 aa, Homo sapiens
MQTDAWDRERNSRRRSSEDRNKATQERSELPKWKLPEKDKDKKGTGNCTGDINTEAARNIQTNLLNPGGKETETDQTTAEAKTEKKGSDGKQNDKSRANIKERGRHHRHTHKRTTRDTKKGRAKPEGTPA

SEQ ID NO: 1008986 - protein, 242 aa, Homo sapiens
MVQTTETKDSGGEDYTPQEICDKYQIIHADIYRWLLTFSFDYSRSHHQSPQQTKIAQDIYQQQLKRGCVLQDTVEQLRCEHCARFLADRFDGGRCVPSVAMRSARGDQCDKCVQRSVNAVELKKPHMYTVWRSCTCWCSSSQELYSGPDITLEKDCEAVVACTDMDMANDSETSHGTVYKLVLGIRAVVSIANARGTPETTIIWRNLVHRVKSDEERGVRMYSVQNHDGLTGISRQIHKTRI

SEQ ID NO: 1008987 - protein, 118 aa, Homo sapiens
TLRPAACPSAPPCAASLAPRRHHEPGLLVQRSWRVLLARTFGWGPGLPGSAPRVSSPVFRAGRRFRLSWCSCQASVTVPIVYPGVVARRGRGRGPGVAVGHHGRGPPRTDPPPYERSR

SEQ ID NO: 1008988 - protein, 239 aa, Homo sapiens
AVAVEVGVLDAEVDLLTETGVGHVEVICDCLARHRTRTILDSCGTSCACTDLSVAWPRTEKANAALRKRPGAKQCAQSGWWAARSVSFLGFTAYARRQMHVFCEYPQYAVSPVCRGNQGDTDHQSTRGLEARPWTTPSIEQDYDRDSCVTLAVEPFTACTELLTLVSQAVEPGDLSKLSDIEDGRPNMRAPFWLNANETGLVSCPLTLRVIDDKNEMGSHCVNEDIGISQRGIQRCKET

SEQ ID NO: 1008989 - protein, 248 aa, Homo sapiens
MPVIPARLQTGFVFQEVSNDISRDDVLDEERFAQLLDSVHMEPNTRCACSVWHMQVPDFIARVCAYLSFNKKTAHKRFPRYLAGQHRIHSLLVDVKANPTTRRYTATENSPQTPDKNMDLRTYQSVHGLRTNVGAQGRTELSLFEQADTPRFQTKHNVDLLPRTTDSVCHHPPTLVANRYRSFKDLRMPEMLYSLSVRSMDLVPSIGIKAGHNAIPRVVFVSKIVPQRNLNPLVATGHCPERMAESSR

SEQ ID NO: 1008990 - protein, 200 aa, Homo sapiens
RGSGSCWGAVVPVSGGLYEGCSHFIREDSSRMLPHTRAVPVVAPAADVTKPPAAKDAPWGGFLGFLEASISTIVSYVPVRGLRLCPGPVGPLMLSRVCILATPRFWEDPRTMGSQQRTEAEQGPLSLGSLNPKSLCEVQGGREHLGLSRAVRSLVHLQGAEVSAPDQALSLLPSHTWGPFTTRNQLMQVKATVETALAVP

SEQ ID NO: 1008991 - protein, 192 aa, Homo sapiens
MEQRLLVTDFFARRDPVSPGTTTSSLRSPSDFISACNLRDHLLGHLLLLGPASTAICGLAPILSNQSMSSQIRQNYIHRPWRHDCPHACVQFSTCTDSYTYLVSGLLFIDRDDVALEGAEPTFFLADLAEDDSAAGYEPLSPSRMPKPLQSADSTPSSIPGTISNKPQPSNRLTLEDNILPTNDHIKTPFVQ

SEQ ID NO: 1008992 - protein, 218 aa, Homo sapiens
MRRTRSHTQVGTIARSVVHVTGYTRRRKTLDVQLYLLHDSDGLSINPPVIKTKWVLTWSGTITTDPTRQETSLDTGSLVTHSHAPTATPDLIASLSCETVNYGLYSPMPAISHGFYPTRTSCAHEHGADGPPSTTNAPESKPFCSYSYNTSSLSPQKQHDALPIAPNSHLISPNLCDDNTRTIGAHSATLDDHSTSGPSTTSSRLWNSERRIAMCHST

SEQ ID NO: 1008993 - protein, 190 aa, Homo sapiens
MARESRVVFLLLAREGACEKGAGTVSRQADLHAFLSSLSSLLLDKAELVQTRAAYSIARLDTLCLEPPLQLAFTPGTPLILTSAFFFFPDLAALRKGPREHAVECRGKFRHKPAKKGLYSKDVGTMVIHGASLSDGSVTKEAWAQPSYYTQLHREIAAFSRGGKTGCTAPVFSGTPEYCFPTLRNPVAEL

SEQ ID NO: 1008994 - protein, 138 aa, Homo sapiens
WKWSLALSPRLKHRGVISLTTSASVGFKRFLPPSASQVSCGTTRHCATTPWLIFGILNTDGVFTSVAPGIVSNSPVNLQVDSGQPSVPSQKVRGNLQSVVDPTFAKRLIGRPLCISITIPFGSFTTPSVHHWLITHSP

SEQ ID NO: 1008995 - protein, 131 aa, Homo sapiens
MVPAFPGTYHPGQLPLFAPLKCTHGAWPYHLDLGTFGGNFLDTLKPLARNNTPFPGDTHGVGPLPTFAPKPPFGGLQYTYPLQTVCGRPPIFEVALMMFPLMESPYRGVLTTWKTPPQEPPSLVYDSGEGT

SEQ ID NO: 1008996 - protein, 304 aa, Homo sapiens
SRPWGELATDNIILTVPTANLRTLENPEPLLLPSGTARLTAGCGATWELSPIPFCALASDATCSARRCRLSRGLDALHGIPPLHCCPILAAPAARSLIERKQASISTDTYTPPKHNHADKPTSHCDCRSEPTRSSPHCTALERHSKNPTQAEPTLTLRDDYPHTTNNAAQTGQHLALNPPSAAALGFGIGSLRVDPICKGNRRPPLKPRSTLRHQSQSTAAPHAYAPKQITNSRRSPLRASASHPPPPTPRTTYPARRQRQRRKQARPSHGNIASREAPFGKPPHHTRGDKRHLYTPPRTESRS

SEQ ID NO: 1008997 - protein, 279 aa, Homo sapiens
ADSNVTKAPRSLSEVRIIEWADAKKIIPDRGPLGERSLDFECRSEVSMSNRAEWSQQARTTRLMADSPPRYQVGDGIVVPKMTLGSRGIAVLERSSQWPRTSHVTRESPREVGGWAYISRSPKLGLGAPLASPRREHWANFFGPTPLPWVFERAPNGTGNISSPQMGRPTIPIPALSGYYTDLGESTVGICARLTKLGRQTARGPKEAPQPSTQVGLLPPKPRSGASLKSPVGSPSKFGQTTEEAANLSGLNISPRRSTIGLRVSIWGGPGAPLRSTGE

SEQ ID NO: 1008998 - protein, 258 aa, Homo sapiens
MAPDPVAAETAAQGPTPRYFTWDEVAQLLSGADVSWCASDLTVTVYNISDVHPRGIQWVLPGSSATTPGRMPLDPFVAFHVMQGPCEDVYVSSLRDWRTVSRCSPALSPPRIDELDTLQFRELPGHMLAAACGLIARGQSMSCYLAAPCCRRLACLALVHACRQPLRALRDVLLVARFLPSLCGCVLRVVNVFPSSPAALCSAPAQPSDRLGGTVIRHTSQPMPFYEMGIPLIATHPESGAIRVPPFTGVAPPSTLGM

SEQ ID NO: 1008999 - protein, 147 aa, Homo sapiens
MGRDELTTPTMVAAIPIAISVKHYRALGLDMERGLEGAADREGPVAAWELLAHKTAAGVTDRNLSPGLLGFLLRRSPPKSTQGLEQPSTQPEEGRAPPPALGGGVWPFLPFPRPPEAPSQFSVTSSGRKASRCPPELLWAQAGSVTS

SEQ ID NO: 1009000 - protein, 483 aa, Homo sapiens
VCFIGRDITFHRAGLRSVRFLVPPFCFQPHRPGAWTPQLYRTHDSVTLPREERKPSKELTYSDLGNSKRIMYLECQKLIQGLWRIASFSLADKWPSAAQPVTEGTLVPDTMTCLYETYIVNLRLHVGVLRSLAYKALQSYEFCTLSVTDTRADRLAPATGLGPRQLGTHYKTPSLSLSIIPSNYNYSNHPTANYNKTTDHHITAIHTSNINHLHPQTSLSNAPIQQPIISPHTLATNMHPLKLTPSAADTLQTYHQLIPRYDTIALAITNRTAAPFSPLTVVRTPLPQHLHNSKTPPHTFTSATPTHMTPTHSHPFLITTTPIPIPPHQPPNTPLPTAQPHHTPTWSTTHNPQFVLPSPNPPSPHTPTRPHAHWPTNPIGIEPSSHPTTTATQHESSHTPPDPANQFSTSHDQTCHHTATASTRMVNPIHTDSLRAPTLSPAVTSPFYDVTSTTTYITVTPPTTQTNQSSTTKPGRNIYAVDH

SEQ ID NO: 1009001 - protein, 197 aa, Homo sapiens
PVIGLRPNHLSEQCKTLSPVRFLVCGQGLNRVLSRAPVEKTLPVMDCTHSTISTRIDRTSPLPGLSQRALYSNVLLLAKRGNCTRTDDLLRIECKQTYYEFGGGLELLADEWLKVNHLGTEAPSLAVVHSRHILRSAVARPLELGSDGSSNCKAPVNSMHSRTCTCKYVQPDPPILLILCKRSHAVAHDMSPSMAIR

SEQ ID NO: 1009002 - protein, 491 aa, Homo sapiens
MPKGKTNRPTAKEGGSGPSCREDSTEAEATVVNPLFEKRPNNFWHSDRTSSPKETSPAFCEMAPYIRLHAAESHPLLQPAEHVPPADLNQLTQALRPAHKHAYLSLHLPPGPTQSYHAPRRTNLLTTDTNGPSNCLAPPAAPHDTNGPASAYTTRATAPQQNTQYATPGPLRQPSSSSTPPRSNPTLMRWRNGNHRTHGLSALAVRAALSADHRNRLRQSHPLPNPRRPLLLRSDPLAPPCSPPASPNSRGGSPPCSPSSHFPLPPAGPPAANPHTWAPTHFPSRLPPTRAPPATPLPTPSPWSPRPPSSAPTQEASTHTLHRRQKRHAHNTAASPLYTTPLHNRLRRLGETRRYFTRGSPQHSHPQRGHHSELTRQHPQRQLPPAPGPTNLPASLGAQNLTYPLCEHSHQQPLPGTDASHGIYITPAKTPSPGTTNTRFPQREALTPHAQTPLAPPHHNNLCAAPINQLRYTTLALPTSSHPVAPPTFTT

SEQ ID NO: 1009003 - protein, 463 aa, Homo sapiens
ERPHCIASLWAPRNPPSVACCCCCSCFRACAGCPPGADVGCPTRMDDPLLTEESLTQGLYYHLCTSRRSSDVSGDWMVHFRRDSLLLLAICCARTISVAVDTALIALMMLCDFLSGSSTLVLLSISVLGLDRFNLCPLCSLFILSCWDFLASSGPLDLDRLIPKGLPTRIVNHLVVIRFLAMFSPLVVPAVLESHPWAHRPSEVSRAFTLFPQGAPDGPPWAELSSSTFPKEHGGSKPPVGTAYWRPHVYPAPAFAPAFSSWNRTTFQLPGLYPLCSWPYTLVATSPSATTPAVVSDFAGVSFSHPWCAMLAWTPITANRLSGPLTRAPYAHRALMLSYRRLLRSPPVPAPDTRSVSPTGPARLARLTTPFLYPARLRPTPPCPCRTFWTPGPTVVYPPSLTCLLTRQPVHTPFYLHTMTHTRSDSLPLLSRPSTATLVTHQLLSLTYSTLPRTTPPCLLSLF

SEQ ID NO: 1009004 - protein, 592 aa, Homo sapiens
MLKQLASLSPNFPRTPLQRFSAQLLASADTLSHNHPTATQTTPTLASDSPPQPPQPRPTLPYCALRAQLPPSTLLCTTLVYPTLTRYTLAHRTLLHRHPTRGTHDTLTTHARPPHRPPTSDTTPRPVPRHAASRPLRLLAPPNFRTRVPQLCATHRRPVASARTPPALSLTLPRHPATRTPVSTAATCTPHPWTRRTAAHARPTPDEPTSTPPVPTALPRKPHHSAYVTRSHTGTAAATLPPQRGSSTAPHRATHLAARCNPPARLAARPCELLALTPPVPFTPFAAGSLPRAPAPRPPLPLLPPFLPDPPVPINGSSPPPDSPDHVAALCTFLGPPASFPIFSRRYSPRLSASLDTRTILCALLPLGPHPVRRPNPLPTRPLVHTHGAPPFLRPSVGSLAPTHSDLITSAASRDNRATLREAASPPSMRSERSPFAAPNISARPQLFLSQTHHSPFSPVLPRSSFASCRRPPARRTCQRRAARTIAPLRVATRTHTQHPHHASSTAHHTHRPRHTAEAAGARHDPQPTPSLAGHTDPLSDAPPTTTQAPAHYSELYPPGLRARTNIPPATSGHPPTPPLTHPAPPQRRRDH

SEQ ID NO: 1009005 - protein, 321 aa, Homo sapiens
ARCEVNKCSPLSRRGLCGQQGRMWGCHLQAASDGRVGPSCLTCVVPAAAMAGSCTMNSENDAWVPVLALHMTGPRCEEHVFQAVSSQDTIASILIRLLLLPAAALLVARATLVLLVYNACCTPQEAKGAFHALTALTHTRATDTCHDWKTPHPTQIARRRDQPRIDRAARPNCARLALLPLARLNQASPKLSTNPRVVMPPPPTPAGPTCPRSATPPLGLANGTEAHAENPPAPRAAPEAHRSTTAEPPLPPLARPLPPGPHIVPPPTTPLTTAPPFLSAPQHYPFPALAHTPFHHHVQRPLSPLSPPGLRDCTVTLSPQI

SEQ ID NO: 1009006 - protein, 374 aa, Homo sapiens
YNLWPQPLPTLPLPPLTGVSVYGALQEDPLVPVGGKVLESQLALSGAWGDTRLLEDKLCRAGSCELRWLGDFRGAVRRNWSKLRTTPWTLTLNARLQNWLSKPLQQHVGTLVSDGHPGLSTATQPQTQTGRTQTGAATGQDKPAGHVIPEHVRQLARRAAKAHGSPSRALAASLALRGTYCTPSLARSALGVLPCTTKGYLGAAHYMANETTYRAETKRCRHHPHRPRSATRTRPRQPQTTLTHRHKTAQVNSHSPYYRHYPNPNLAPETKKTHPEHQMRSTTHYGTDRALSHTKIRRRAKSIQKRTIGSTPYEPREGTQSEIITPDRPNNEIKTRSKYRPNHQQRTDHTTMGPPTKGNKPQKQATTRIGKDEH

SEQ ID NO: 1009007 - protein, 249 aa, Homo sapiens
EEEEDEDYIAFIWKMLYEFLNKYLWNQEWWFILVVSAVVDVNQKNGTSMSPKGFPLRVADVDCIQNVARSVVYPPALETLPIRRGSIPSSENGAGCTYNATLTAIGAGPIPGCWTVWRHDTCTLTSSRLSSLNGRRASLQHPVLPDLCSSLQMTFTGTSNTEDISSSFRSPTATSRRSHTLPLPGLYYQDGRTHMALSLHTENTVSRATPRESRLSATLDLFHSTTSALKPTNSLHSRGKPRLPTIRDK

SEQ ID NO: 1009008 - protein, 39 aa, Homo sapiens
MKAVLTWQESHQGTLECQFESYKIGSRTYGRDTIPNFTL

SEQ ID NO: 1009009 - protein, 324 aa, Homo sapiens
ALPPLTGVSVYGALQEDPLVPPLQRCGQLVRMAIRAQHSNAAQTQTGEANRGWTGQESLSDSDPEMWELLQREKDRQCRGLELIASEILWGSRGGGLHIRAAVPTPRPLPTHLALPPAPSAPSMLPALPPGPPPNLRPLHRPFCHPPRSGLMRRSDLPRLGDHLTPAAYTASSPRHTRDIKHRVHSPSTALMPHYPQPPRTWPVLELTTQPGTCTCVRHSTRHTRPQSHRWATNAPYATTLTRHQHPHWSRPLLSSTKGSHRHPLGIDHRTPRPKPTTSRLSGADTACIPTRRLHTPLGTIRHHPLRPTTAPNTAANATAHKHS

SEQ ID NO: 1009010 - protein, 241 aa, Homo sapiens
SSPTSRDKSIIMWKLTREETNYGIPERALRGQVPLRNVDVVIYLRMASLPSQAPGMDTLRSLGSHKGHHIEAIVGHTKDVAECGLLRLDNRHDCLLDLEIKPVRCYGIPWVCAQYTGQDESHSEWVSCVRFSRPKSEVNPTHRLRVAGDTAGQGMEPGLTARLNDQSHWHTGYLNTVTVSPDGSLCASGGKDGQAMLWDLNEGKHLYTLDGGDIIQGLCFSPKPYCCVLQQVPDQDLGFRG

SEQ ID NO: 1009011 - protein, 240 aa, Homo sapiens
MAFTSLSSLGQSIREHNKKDLIPEIVIERFNSIAEFGGEIEVSGFAGLGAMDRSRHVLPKVGVFALPLGCLSCGPFRFRQRQVHDQKRNSIPFRDLSQVIDVEEVGETPWGYQFGDLGRTLGYLDPKPNACAWNPREPGQFGGQIVNPGSHVGPQLDGDIGTITSDRNSGAVPTLVACPHGYETVETKIRGTTSPASSTRGRPSNANIRDRCGIPRRGVHNNLVLAVHIATHTLSTVLDF

SEQ ID NO: 1009012 - protein, 202 aa, Homo sapiens
MWSTPVIHHFAKVEEAHTHIIEDKSGLNPYALSKALFDTSAAFGNILSCKVVCDENGSKGYGFVHFETQEAADRAIENNDMDMLLTLIAKYLLDRFKSLKNDEAELGRYEAKEFTNVYINAISGEDMDLMSALRISSGKFGPALRVHSTLLDDNVGQSHTEPALVKPRNKAWQHAHSKPVDTDDTDNDPNAHNTTAAQPKNS

SEQ ID NO: 1009013 - protein, 131 aa, Homo sapiens
ATLAISNLLKTGSESSIDSPHEADLLLHVRKSRMNSDGGRLSMAIRCPVSSKLSVVKTTCRPYELCLFTHACGKRGVAFEDNARLSCGTCSHQSIIGREAQSSKGETGHVTSVATFSTRTGEVRQMLGHHV

SEQ ID NO: 1009014 - protein, 382 aa, Homo sapiens
RRFQSPEGLDLDAWINEPLYVTASQSDERPSARLPRGVSSGVQAPGLSEADDGRAGSCCLEARKQEQANNPFYINELAIATASGTMDTPGVEHIPLWLQIDLSVPLKVPGPAYCQDHVCEAGREDAPAPGRTLAEGQEEETEAKDKRSRRGERQPTRPHSHRQPTQRPRHTTRHSGQLAPKEEQHNRAQTATALHQWPAARRERRRTEQTGADNRETRQQEDRPAVPRAGRARATAPPDEDERRAKVSDRRKNNKGENKKNTLTQLKDTTNAATQRTTETDRQARTNRSAPPHRHQRTHGKEEHSRKCKEGGGGERGGERRASGKAAGKEEHTRPGPRTPRGREHDRQTNKQQSTHQAPESEWRNAERPSAAAGSGERGRGG

SEQ ID NO: 1009015 - protein, 246 aa, Homo sapiens
TEPQQFEPLEERLSTGDIYLLENGLNPLPLGGSKRPTGCLSRAFSASPPYSQITSGLSVLPVLDNPPVQEGSEASEIAYGHRDPRYMNDLRVVTTTDTTTRLETDCHKHIPGWKDQRRLTMGDAILLWTYSLIILHTEDSRQGHYVTTTKQRWVTPSGHTGHPRGIRLSRTRHSPRTDQKTNIGGTRYTHTPTIDLKAVTTLHRYIIIEESDDTERSTHKRGTKNTNQKKEETKRDTREKDKTRTQ

SEQ ID NO: 1009016 - protein, 116 aa, Homo sapiens
MSPCHAKKEASVGAVECPVSSLCRGHGFHPVDTLWPTEESVASQRRRKRSPFSNNGCKIFRSEVVSPCGFKPKRISLQGAYKHFQGPGQVGKPPIPLQHRPPIKPECGAFVNIREY

SEQ ID NO: 1009017 - protein, 181 aa, Homo sapiens
MEGIKIEHQLELGNLQCQAGPGDRHAREVRRSALLREAAVRPSEELAGLAAALAGPCWSVQASQHLAGACSEAQDQLPVMPSCVCTELEQTVTVEYLVASAQCYRRSSSEQISLCRDTTMLDYELCCSGQKPSGKQEVESLREKLLVAENRLQAVEALCSSQQTHMIESNDISEETIRTTG

SEQ ID NO: 1009018 - protein, 147 aa, Homo sapiens
MLVMQERSELELSLTLPVLYFLGRGQVAAGESAPAGEAARMAEGGYAKVPSCLSRHSHQAIRTEEREHVFRLYIQKKEHTQHRVSAGALTGRPQRPSTGKHISGKTGSAQSPKDPKNPVCETQHDCPDGIATLGCACRQHTEGGSQH

SEQ ID NO: 1009019 - protein, 234 aa, Homo sapiens
LRPRGSPLLPVCTRLYAVRAPAPARNSSGDGGRGRRTVVDCPVCKQSASPKTSWRIISCVIVAEGDTTPRMRTNADYCEDNAPAPATVWSARRPLCETCVEAHQRVKYTKDHTVRSTGPASLGMVNVLSIEVHKHEPLVLFVRAVIHLTCRDCQLNAPQGPHSNSSQRMPVRNPAHSPGTHLVKRLGDQHLNIEKKHPKEVRSLNPHGVDVPNACAQWMSQNGHYLQIHERELQ

SEQ ID NO: 1009020 - protein, 366 aa, Homo sapiens
FQEVLEGLYFLEVEALQEVSEVEEEEVEEPVDLPPRAEDDMDDLVEYSMILLSMMFFQGTSSQYNREDLAPRSGGPPPNEICAFMDHVRSTKLGYLGDRNRALRGFTQLRKTIIVYIEMSPFSEMCETLRRRVFGRPLFNYWYPQELLHGRIWVLCQRIHSVTCLRGDRRFYSRNGRFGLTSYRPLTRHASQPPALGTSLTVYSCCTYHYGSTTQGLTIEFRTSTLIHNSNAKAVELSYDNRSDLRPLLRSPLASRRTPTCQGLLPPQPRCPPVDLQPVNASRENLVREEFNRPTNITCVTVDLPTALTFPHQSGTLSQGKPRHRLWRQRQVYSDMALNLPNRGARLTMHTLASHLGTAGKVSRQV

SEQ ID NO: 1009021 - protein, 285 aa, Homo sapiens
GSTPGSPQYPGPVSPAARGRPRITLTQEDLGMNPVGNSDGNGISTVPAKITPGDVCAARARSYTYLQLQPAEPRTEQGSERPEVGWGAPSCKRTQTGGGPVDPGPCCTSLMSTSHERVSDGLLTGSSSDILTGSTALFQAFHGVPYMNSHFVSSVASVSDAVCKLLTMVSVVTDPRGAGHFLNEVRSWTHEFLNERRRRTSRNERTARGQRRVTNARQLLLTRSHQGNIPLHPAPSGHLTLCPAEDNLHKQTIPPKDLVEPTSTGSYYHRLSADPNKPTGRSSQP

SEQ ID NO: 1009022 - protein, 231 aa, Homo sapiens
MREVYSRRYVAAYSSSRSYLYPGETTFAITLDTVGSIDPLHMRTNEFICPLTTFGVYSGPWRDRALARILDFDGLQEFNFVSRCAHTVANHSIPPNCMQWRARYMSAYSLNTGEQVEHSVSGKFRMHGIFRGLPLRTTRKAPMFAHQCSTEFSCAHSSMRTAANSTTTPDALPYHLGAGGPEVHFQNFTLWVPIQVAPQSGRTDVARGDFFAAYRVARRAIHLHFIRAITH

SEQ ID NO: 1009023 - protein, 148 aa, Homo sapiens
GALRILYDNDQSSCDKLDHVDDEPTNGSTHETMTLARRQLTNSCACRCVLVVRLTGQVLPISSSMVHENPWRRSLGSQRSGSTIIKTRACMLWAIYHLGVCVECRPCLLDDIADSIVLCESQRIQRPVESIVRYYTVDDDAETIYMCQ

SEQ ID NO: 1009024 - protein, 284 aa, Homo sapiens
PAGHQAAPGVIRHYAGHDATDPFVAFHINKGPCEEVYELSPDVETCLKEQGQSLSPPRNNESDYDEFRGVCGPQGERIEELIEVPRHVYFLLYLVCTSCCWMVLAWLILGGLWRRSFMAFLLVCRCCSGAVQAQAWLVAACFGAPVGLQHLQQWDTMLATVINVIGTYCQGGPPVKIGRNRTSALVQAAVPRPNLASRKTQTCNDAYPSSLRFGGRIHTRVRALGRQEVIKTILPNNLHAPEYFLPEFGPRVLGDFSNFPSCVYFHMVISADTEVRLYLEPAMT

SEQ ID NO: 1009025 - protein, 269 aa, Homo sapiens
MCGGGGCSGLGVQRLGSRRADVGRVKCVRASWNRMPLKMADDLDFETWRCMWASCHLPNARCSAFTVRSGFCECSNVAGHVRSSRCLLRRLASTAIAKVHSEFGIQIIVYVGTKVVKISARANLIDMDVPKDRTYGMSFHAEFEIQDLVYRITCSRNSGGGTKRTFVLPEGDLGTGMIEQKVLTVGEDEPDHMCWSVNDIGRQLVAINVYWRSLTWFPRIGAMVSSRVGTFGTLQRVRFYPKPGPWFVLVLGLWTSTNRDMTRENLGIA

SEQ ID NO: 1009026 - protein, 84 aa, Homo sapiens
RRVEYVDQNVVTITAHGFPCAFLCSCPAATSLEQVEELLQQSFPNGINQRHSAGIKTSMRSFHCVFAIDVESVEVYHLVSRKST

SEQ ID NO: 1009027 - protein, 210 aa, Homo sapiens
MAEGRRVEKKHDEDTHTEGGPEGPHKRGPPVRHPRKAERGPREGGAVETQKVHPSENLAKPGGTTSDDKKTRAYHPEKDIKKKHREKTARSITHLQPEGKGKHKRERTDKQPGAKQGEHKKTRTTHENTEEKYRVDTTHSEEKKICAAENHTNIKREREKDKSKSTRETNHESQTQGERNKKKNIGGEQPAKTTEEAQEPEKGKNAKRGE

SEQ ID NO: 1009028 - protein, 190 aa, Homo sapiens
MCATRSGGDNPRERKGVTTSCAEGDPQNNPTREEQLRRSGTRGVATLEQVVANTNSGKSLAKDHKCDRSNHTVVSKPQPVAGQVAEYDSSGGGAHTEEATPQQKSSRANMRRTNPRINKNRGARPAIKKTVASSKVMQQQGEENPTFRGGLHTTTALQCAKPPPRRAPQSRANQGGPKEAHNNTAGHGGT

SEQ ID NO: 1009029 - protein, 396 aa, Homo sapiens
WLKLVEGLRGPGTGPSGLGRGAAGKSDQRQEWSRRRMLVQDWHWGPSRVRGTRCLRSGCRVGGPESMWRTRPHSNWIRSRQTQRSPCDGLWQGMNAGLDTEFLAGARGAPTTGGSQTVALGVAHVSVNIVDLIHERACSMRALEGGLECDLASCSTGRNEASGPGVEEVTGTVRCTRRQVKLTRSDGLDTGELSGVRQQESCQLGVQEQQGYLLTGEYGRPELTMLFGGARGWKAQVTAVWCMPFLVLPLVDLCAPKDGFYGNVVKSTLRFAHLGAIKSPIGRGPKVDFPKKALPLEGTGGWDGGGPTNLFPQRERLLSWDEVFIWGARSPIVSTEETGKVRSPDWRVPDRCDSNGSKLESEADPDMGAQDTGKNSHFIQTQNWWILTNTEMYTHE

SEQ ID NO: 1009030 - protein, 266 aa, Homo sapiens
GKRRGWQLLGQSPGALRQPPGVCARVAQLSRLVAPTRPRSARGDPGGGQREGPGPVQENGAGPPVRRHADAAAQEAEAADNVQRQQTVARHESSSPVASVQRPLTHWDLHLDTAPEEHEVQMRQHTHHRHWQHSINNGKTLGEQPNTGIIQAPEPPPRIRTKEEPWCLARHTACTSLSHPAGLGTTPNTCRHGHQPGQPRTQDPYWTTFPSPTNLQATTLPHIRQHTAHSHQVDVQLSLTNANSLLPPKTRTRTHLPTTTEAQQQH

SEQ ID NO: 1009031 - protein, 144 aa, Homo sapiens
MGAPIGFSTRMDHPGVPVNPFMRIRPNTTLALVSGVSIKDCCTRTRVHTRKEYQSHNTADTPQRRKFQMRGTHCKIHQAMCPLTRYIQLDRNGVSTISRKPIHVNPTGGHHWIKHPIWRAKGTLFGGTHTTATEWRIHRTNSNY

SEQ ID NO: 1009032 - protein, 204 aa, Homo sapiens
GASDPKRLSFHQSGEVASVWRESQQWTAHEVENLVGMAPGREKWLWWTGAGCPERRLRLGVRGPLPSSNLKYSRGVLRVDDAAEGRSDESSGTRIEGVASGGTRSALTLSHHRTKVAWSAGALTPVGDFATEDKQRTQNAHRERTSAEGQYSQKSTEGERKRPRETSPDQQRTGEEEAPNGKRSTPNRTTKGDHANDTTEEADE

SEQ ID NO: 1009033 - protein, 231 aa, Homo sapiens
VPACSSLGVSSFLLVTGHALLRSQLAHCPFPSDHHHQQLLAANPIYPPCDHHTDQTYNKHNTRQMKSGIHNVEHRGSDEARKNHTMDHQDIAENNTHTRATHTANKAPIGSDERKRQNTQQKITRQDCKRQRALHTHTKKRDRRNKTEQREEKQRKSRSTAKQEKKTRQGHTRHEKKPRKDKKEQRRKTQNTEAQRQQERETTGTNNIHTKGKRDNKKTDEDTRRPGKAQT

SEQ ID NO: 1009034 - protein, 324 aa, Homo sapiens
MWAAGSGWPFVAQHSNAAQTQTGGSNTVVLDSASEMPVWTRDPEMWELLQSGEGQACVVAWSSLPQRYYGCEPELWWMTIRAADAMTARDLEQPFDRGIRETRGAVNCSSPYIRGSQRPNLSQSYDESRILEIIQADRDRWELGTHDRIDWCQSCDAKRELTTCTRTVATAGTITPTVPNPFRFAEQSYMAALSKGIRKQRTECMAYVRKVDTVNGYAKAHKKHIGAVADYLGSVQRDVATHVVDRRFEPVGAIAVTVFACRQASPQQGGASIVTELHADGRQPRRSGTNELRPSGRTSMYWTVTQQHRYELESTEWDVGLNFE

SEQ ID NO: 1009035 - protein, 385 aa, Homo sapiens
GESSDVRGEWWRQASTRGASVDLGSGAPGAGRCMLWPRGGGSWLEESCSTVLALSPVWPECTSVMLAMLHPLACDAPYGDAPLEAMPLCGPCPDHYSVRILGLDAYVTWIHVTLFAGKGRDNHRREVASHCYNVQAAKLPIDPNGQLGTFGNYTPSGTLRTGELWTPPSVHAEKKRLLDNCPRAVHEGNSPVWEPWQAANLSFATQVSSLCQSHFEGRPWRQEQLPMEQGGPCVCTIWGLAPFGYLGIPPRRTTQHEVKRFGQRTSERRQYRSFRAQSRNGVATQYTAQERLQHVSAMRGDLPAVKRFSPTVISLRVSRGGASTRGTCNAWVCMGLANHWDDYHMYCLSAPGQHLGSECSAVGTGPWCDRTIGILLCDSVGHKPF

SEQ ID NO: 1009036 - protein, 205 aa, Homo sapiens
ELKRDGPVMMHVEEMPCAGSSDCILEFPSRNFTLPCSAQVWCEGMNEKRKLYNAYRFFFTYLLPTVPRLHCVLCCDSIVTRQQEMLAWVGVTIPWPSLENGACTCTRSGAVSSRTPTESRRLPMYQKYPIAVPSPSEDYRLLAILPPREHVSFQCSTLAEELWMSVRAMPSVAAIQMVTKQTTLDTVEQAEVIFCTDLDWTPSGR

SEQ ID NO: 1009037 - protein, 154 aa, Homo sapiens
IYSRGSRAAEHVPTISLAAWVEAESQDRGLAIRQDMDATVVTAPRTIEPDRILRRALCVLIFAHKGLSFYDRTLMVIELHRTCRFFRTSLVLRRPDCIVWAQLSERATETYALLATYTPAGYALSELQRTPGGSHQIEVNQHAISSRAVGPTRP

SEQ ID NO: 1009038 - protein, 434 aa, Homo sapiens
GCEEPAARPQDRAAEPAAAPRVTCDPRPLTPFGSARAPQCPARAGATGRMSVRAAEGGAASAAAGQLGPSKYSDLEYRCCESDAGLRRITDELSLAVILLDSDKHHLLLDPGLSIWRRFLPITQAFFRGTSQRLLPCIQLHGSPDNTLTSKTNIPNTTPTRPTAPIALHTHRTKPYTERGTRLHLTPPTHTLTSTARASPLRGMPYTNTHQPWNKPHSTSNTATGKATNDHHPQQRATRAYAQRRQTEDTATLQHLKSNDPRRDPSGDRNREATKQHKLTRTYTRHAPPRTDKHQRRRNHSHTAEKHRRTTNPKQTTGQTEAHTTQHKINNRSSTAGKRPVEQQVNTKPLTNNTKTKPTAQQQIRGGKKRQEYTTHKPPEHPHNHNTKQHNNQYPPAQLTTEADTNDHTETTNTANKKLPKGESPSTQNHHDKR

SEQ ID NO: 1009039 - protein, 223 aa, Homo sapiens
LTTCVAAYRLRSPGHGSVASTPLCPRPVPPTLTTPALSASHTILYTIQHEAAADLSLLQPWSLSTYTPMVACLRPTEHPTEPYVTSMRECTALLSCADIMLHQHAVPTRLDMYTAMDRCVRGMGAWHRVSLHPRVVGPGTGPRKHSWRNYPPGPLSPTWNSLIGASSGAKTPREGTGAYTSRRADRDPLGNGGQAYHTALADRPATRQSDITKLLPNPTWKAL

SEQ ID NO: 1009040 - protein, 461 aa, Homo sapiens
ASRRGFLLTNSAWTEPARSFPTCRPGVHSQPSVTSSSHPRTAPRYPAVESRRPGQRNPVGDVRASAYVGLPMTDTGLHHRQVRQNLPPGLRGPPSRRQINLEALTPPTLLACPMSVRTCVPAQACGLCNGTVGHESNLAIYRMLDEGSRGTMLSTSAWEGWQTVELMCVPTSFASRDNQGNRERVTRLGKNAWLELQMGRVDMNIVGNKHSVTSPDAISMVTYWHKTIEPGMYRPKMETRSQRSGETLTLGSDSAIESLVLLPSTALEQTHNHDTLTFGIIETAGRHPKRVRTHPHNRANDGHGQILGLRWPARPENTYHRFDPDLAAATPLVRVSTTRRVHLEHSLHNTTQAQRSENNYPTRYNTPPLVRPTDTVHAPRHGRRTTQCTAATADSGTDVMWPQRNTHTVSSSNTCARLTQTRADTTNTQQLRRASNERDTRTRMTDTRPAQHDTHTAEHME

SEQ ID NO: 1009041 - protein, 319 aa, Homo sapiens
AVFLRRSRRACSAAMAPSLEWHGLEAPLPQWTGSGCVATWFNQPARNDPADVSALCNANGCACICPAAPASGPILLPIVRCPTGSGTTLKCALPGLRLQACEDAHVVCLAFTQKVARTTRHFMWIRGRREQSPRTSLQCQLCSELKEYRSKLILFPRKPSAPKKGDSSAEELKLATQLTGPVMPVRNVYKKEKARVITEEAEELSEPSLSLRMARAKRPALRPYGHTQSHRNAAETRMLTLKTIKALLGTWNQSGDNAGSTRGCVTRGTTGSGDGGFTACDFLLARGIGGLLERQVKGLDNALLSVMKDMMAGWISDLM

SEQ ID NO: 1009042 - protein, 285 aa, Homo sapiens
MAGTRHDTGPMNLDTGCIGMTVKKCDGRPVDEGPGDEEESDWVHCGQTSFTVRIFKVCVPCGMDCPQVRDRNADTGERQRLPRRGHGLRSLAAEAERNTVGEGPGESTLDFLTYRREDGSPTRIAMTWKFFKDGVKDNKVNNHRTLYATLTGKRFLHLANNGGQQDRRHESHWVRTTDTTKEINLVSHLMIQPMGPGKAPQERGDYMNRNVFRSPPKRDMAGTVQLMYDYTVGGTYTFGIGAKQPDPKSTVICLEPTRYGAPLFTKNTLAVNACEGRPGKVLHTS

SEQ ID NO: 1009043 - protein, 72 aa, Homo sapiens
AAPGKMAAAVVLAAGLRAVRRAVADTVVRGGTVRGAAGVTDGNEVAKALARQTSLVVSSPPKLSFSPVILGQ

SEQ ID NO: 1009044 - protein, 277 aa, Homo sapiens
GAKTIVFGDMILSADSASKATSALPHQHQPRCPVNSRLRGRTPEGTAGGSDVDTLTVTRTDRDETHTRRAALTGRGVATDDGRPADPAYAGHGHVSRETPGRRDLERDRHSRGLGASASTHRPDRHAGRPPRHYPPRHDGRADSRYGDPAHAHHDSRTRHVGHTRYAAHPRRRHPRPQQNDDGPDSADLDTNNHATNRQAHAPLHTHKRTLTHPRPTNGPRNSTNRYAWKAHRRTNNRQQRTRPTQTGAQATESSTATRRQRRAPRAGAPSTRKPDH

SEQ ID NO: 1009045 - protein, 392 aa, Homo sapiens
CSNSTVLSVAMGLVLLQKCHVGDSCASAQALTLLKVSQQKSHVDDLDPAESELLLSEMVPECLEELDCKPLPNTGLAVFSQAQRPWHQLAPKMAMTTWTPVPNKQFDHEMLQAMLLAVLPVKHADGELQPCVSGCCRHHWDLSCPLPVNPRLHLLQRHVPEYLQELSISPQCSNWPELEAQRQALAQTGDWHKGPQAGVCNWGDKERTLGHTKRRQNVPIGGASARTKPYKCAGHLVSPVDKDTSHIVALPFDPRVAVRKYPGVAKARPENKVGRVWAQRGPIASPAIGDTLEEKRRIGTSDRRRDSSQYSRPAGGGYCTALVEHAQGNQGWGKTPSGSESQELGGVAKVGRNAGEEERVRQSGEKASEEQEGTAEAMDEEEAARAEEDGEI

SEQ ID NO: 1009046 - protein, 295 aa, Homo sapiens
CASHPNGYKCSEALCCCSCRRHMTTSIRQYHLLQLHQGAPPACSVRLVPHLTAGCLACLVCRLLQCWDLLACLGSTLGGSSYSRCYSLWLWMVCYGSSYGGVRPGMQQTDTVRRHKQREKPQKHKPIAQPQKADTQTEDNPMRRTDQTERRRDAGQTRSAREHRKQKERENRTRRPNPEQDNKGTKRGTHRTQETRKEDNNNRERKATQQRAKQKKNKGGKKDETEENQKGGAGRAEENHRQRREGEEQRGRAQEGNRRQRRRRSGTASTGGHRPQRQKRETRKRERTGGRHGQK

SEQ ID NO: 1009047 - protein, 178 aa, Homo sapiens
PSTNYIVHMHTSRCRAPMGLSGEQFSPGPSVPRLPSAHRHAYISSAASHGQGLNISQRICSATTVNPGVRVPLLPIGVLLGTLGVSGLFGSSRAAPLVMLLHLYPIWLSPIGGDLGARDCRTEHYERQAGPDRPTDTTISLGGTFNRTYVSLGRIKSKGGWNRNRVVWAVDLDARGKG

SEQ ID NO: 1009048 - protein, 257 aa, Homo sapiens
MKGQTPEHPHRANDHAHTDPRGNNKPDATKHVPWQRHATHDGAHRPPPQTDLGTEPEPLHPTAALPPAPPPSPPPRQHRPPHPHCHLQDTQQRPNHRRDAQTHPHHRDTLARRPPCTPRRNPHHTHPTHPPPPHNPPPHHTPRPHTDTPRAPQHTSHTQNTPPPHHTTHAQNKRKPRTTPQPPSNTRQPPDRHHGPPHPTQHRTAPPTTHRDPAPTTEPTQPNHPEHNTPNEPPEHNPTRNRTNPKPNTNPPKPPHP

SEQ ID NO: 1009049 - protein, 95 aa, Homo sapiens
PHAGSGSCAGRTLLAFLRCDGLAPGVSAPAARVSLGSLSTVQAVAGSRLPSLLAWAPVRRILATVTVPCGISRHLAPPSRGTSHGSERGVTGERD

SEQ ID NO: 1009050 - protein, 345 aa, Homo sapiens
MRECISIAAVGQAGVHDWDNWPCVLELLTCSGTRVDPSPDGQMPRVDDRPSGEEMTTFNDHCTVETGRWQSTVPLGTCVSVRAYGKPNRSIDWKVRHSGHPYRAGVVPLPQAASLQQCEGNGMHSIVTKCPDGGNITANWCIRHGINWRRYDGAGRENVQSKARVMKRKGAQTEVASAGGTFRKGVHTRTRAYTKLEDENRRSSPRVFQTHSLLDNSNWCDDQVLRPSFRVSKFGRKGKVTIEALGTLGVAKIFKAPSKLPREWYPSHGLGDRFEEGLRFTQKCSSIKANETAKPPKKARILLGEGPTYLGNLRSAPFRHCGLTNLQLGHGAPNASSGIDFLGSA

SEQ ID NO: 1009051 - protein, 163 aa, Homo sapiens
MWMNDSTSFQAESRDSANCTELAGETYVHSLLVDWDRTVVLPKPYLSSTSPSEHATGSHDMHGIVEYPTSGHAKVARTQKTRICMPKHDAKLERDPRRRGEKRQQDEVSGGIVREGKRRMIGMVRQRRLYCTINATLVEEKQKDIDVNRGCVEFGKMHDGSDK

SEQ ID NO: 1009052 - protein, 249 aa, Homo sapiens
ATVPGVVVQACNPSYSEELRQENRLNLGGRSCSEPMIAPTAFQPWATKRDSVSNRKNRDRHKQSPGESVMLTRIDANSDAQLPHPGTGAGQCLWRPRQGFARHWWVSWSAPAGRSGRWVLEMTPGTGTIAGSGSSCMAWRSRARREDGRSAMGYGAGPWSHLYTPVHSHQPSREIVDPWRSEQDQRRLTAGPSRQGHPRERHHAERDWRITRKDRVGGDSKTRLRACTTGMGDHKRLEQLGARSRTKRR

SEQ ID NO: 1009053 - protein, 226 aa, Homo sapiens
QAQRTGVTHGPCAVMLRAEKKSSSGPEPLCLALSWSPNPQSLESGPQIQACLGAEPQSVELPALWTLVLWNGKVFPYHMADPGLSGVDLPILPLPASNAARVHGWGQELLSGLERTPWSMHRVHARTVPWCEVTAGSRQGLRTPSANLRCPWEAPLVLVGAGFCGAPTGNPSTGTARWQPSVYPCIVDEARGIHVLVRCVLVLLASTCSMYFHRSLGQLGALPRCS

SEQ ID NO: 1009054 - protein, 180 aa, Homo sapiens
MDHLVSCDNWMNINLREVICTCPRDEWTSSGLDARCATSADSTDQVPASIPDEIIDHGQGGGGGQRHVAVESLLSSHDCHEKCRGMGAAGQKLCSVARGQQVGSPGIMLAGQGQKRSLGRVQVRVKTVKTPMPRLGMRASPIHARGGAFRVLLVLARGFWSSTGRRDRCSERWHATIRCP

SEQ ID NO: 1009055 - protein, 131 aa, Homo sapiens
MEWTPKDIRKRWEPIVKEVFYPKTFRSVPLGKNLEKALGIASGGKGRGGDLGWDPYFGGARADRKRPGKEQRGLGRQAKGVVDRSNTFGLRNSPEPTKVSVNVSSFTTKFVGGVLAPGEIGLGSALGVQCR

SEQ ID NO: 1009056 - protein, 201 aa, Homo sapiens
AEPCGSGRPRECTWPWTIGQQCVPVECIRSGDILHPCANWSSLGNIYPLWPWTQRGQVLWLVGTSRCVRCSVWRCASQARNGRIREVMHLGPRACPEVCAPLTLRHSVVSVSSWFTILATSITMTVRSSRTPCGHTDVATVRKCVGCAGPQMDDIGPVVVLITWSIVVPSAPGERWLGFLWRRFDPRSRGCQGTASMVWPG

SEQ ID NO: 1009057 - protein, 94 aa, Homo sapiens
MGDTKGAPIPGYEVDNTVARFHSWFDKGFLDPIAQALAAPDLVRKDLQAVRPDRQQRPFTRLEHPARLAEGMRACAGAPKGPPHLESRGFPGYG

SEQ ID NO: 1009058 - protein, 285 aa, Homo sapiens
MEAEACGLCEQSGGGGRLLRERAGRELHDCPGPGFQSGGGARRRRQGALEAGVGGIGAGQTREAEASDPDALAVNTTEYRWIGWSGAWRAVLLTGADTDATNGPGAASRASVVSDPEQKKARRACLTQLSWQKAEVQRSTSGQLALNVMQGPMAEGREALLLRALVTETWVTWIAGSTGGDRERAGSSERSEDLRRGDRWESQWMMSQRIDGLDNERLDLRLESAWHDGGYAERGKTHDSEEANMGDEKLVRDWTVEQEGRGVPEIGFWKGDWCKGLSKKLRIEC

SEQ ID NO: 1009059 - protein, 299 aa, Homo sapiens
QNVLLITLITNTERRHPGFEATFFQLPRMSSCGGRLRKAQGTFKRAAVLPRPTTQPNIDCDMGTVVGAQQASDVKVRFIDSSTCWSPGCACGHLHPRTTWRSMGRNTAERGPSSASPCKSNKITVARVQLRSVPTTDDRHSSDLTYLSFDSSDPCPGAVHVPHRGGVSGKELRCDGWAELTPTKGMSSNWQSAMPVDQVHVHRKQVTAKAPLLGLRQCERLRSTTSRGDRECELVPARGTLQRWSTIVAKPGVLRHKGPGRWHKVTGQDSSGDRGPERRTTKTQREHPYSPWDTKLELN

SEQ ID NO: 1009060 - protein, 184 aa, Homo sapiens
AAASLLEPPRVPSVPFPPARLLPSARAASAGRFHRGTRNSYRMIQNIQNHPLFRPLLLMQVRVMTCVPAWPLRIISIYRTSPETTAGRPLLLSTGLLHLHYDKTRQLAERVQRQHSFALLTGTCTSRRIPGNSWTQRNFPAYKRVTPNAKNHIVQITSLPEIWDTCPYVTRTSKPCKKPTTARL

SEQ ID NO: 1009061 - protein, 185 aa, Homo sapiens
QLGIGRLTCGSCARSAEPQCSRPGLVRRLALTAPTSQEQPPAPLCRQKDQGGEARGGRWTGDLTIDPYYLGSLITRRTLIPCPTVDHSQLQVLSDPFGRFQKSRGTHDLNCTKVQTHLTVLANLGATPQGIVYHGGCAFGPHWLVAPPISYPPFGIERDPRLRLRNTKGFHKVFDHRHRHFGRHH

SEQ ID NO: 1009062 - protein, 278 aa, Homo sapiens
LRCLQGDQKAKMSERKVLNKYLPAGFVTHSKIPKFKLPKDRQYVGAAVMWPPFNIEGEDVAEKYFYRGTEISSARKETGAKGGHTVGRAHSFRFYIQVCTRVPVAEIHLSRQTLENHRLHHVEHVEPTRNSQAEKLREEEDKEGRKRSGRTQEVTEPMKVLGEPGPGTPSWNMEVLEKPHRELKDLNQGKAHVDLRGLMPEDGNRRVGGRTEGGKQARKEGRRRNTRGTPDRERKARKTEQDGGDRRPRTQKDWRVDTLGPGARRLRAQPQGELGMRG

SEQ ID NO: 1009063 - protein, 105 aa, Homo sapiens
QSARSRSSRSLLPSGAHAESGVMKPVWIQIKTDSSAPSTREILHSSIKDSRLRVRTDRDIVYDHGMETGHSDLMNEAKLERRTSCNTMFENSYSKAGYQPTGEET

SEQ ID NO: 1009064 - protein, 78 aa, Homo sapiens
IPLMARCNTDKSRYHRCSTHHLSDNRPSGKRDNASYIHLRIGVLSLRMDLVMHPCDSDRPRCLARVPPPIEEGIVVAE

SEQ ID NO: 1009065 - protein, 352 aa, Homo sapiens
LQPCQPSVGDTAVFLRSRFQVDVQRLLPQSCPHLQPQAWVGGRAISLPDVWILAGGRVPMRMVEKRTLPENPDPWHGCQAGLPMVMVVTSHMDAGQLSVMLRHGVTLVLVLGPETSLRFWATADLGLRQSRLEERRRASSRFHVIEQHHMSDPIGKPAGCCVWHRWALPECLFPPAAAHCLRSISPELVFDPKHKTLALIKDGRVIGGICFRMFPTQGFTEIVFCAVTSNEQVKGYGTHLMNQLKEYHIEQQILYFLDYADEYRHRYFKQQGFSKAHPGAQENRYLGYINGLRGKRRLMEFEVESPDPVNGVAHIIKNAQGFFKKLIAAKGQTEVSRAQSSGGEQTRKAQVK

SEQ ID NO: 1009066 - protein, 307 aa, Homo sapiens
GNPALRTPPRPAAHSQPYRTPTIHRTLRTSPKAPAAAYQRRAATAAAAAYYLKYAAIDDRVHLQQVAPELTTSDSIRPALQPPRYHLGATNAYLTYSPWYHSTITNYLHPRIHCSAFAHILSGPNLTYILSRSLLHCIPHAAPTGLADTSALDSLCFAKPTSQGSALDPPIPLSMPITSTLIPSTHSCADPRPLARRRLLSLSSFPPPATRCLLPYSPISAPPPPPSLATFHLPPLPLASPPLSRPHTPFSSYFSSISLFAPPPQASALLTPSPPLHTHSPPLSNSHLLSSTPPISLLLSPPLSSPL

SEQ ID NO: 1009067 - protein, 241 aa, Homo sapiens
AFIFRSGIMLCLEKTLSPRELWHLVHRFYGSELGSHTVMDEDICLPLAAELVLGDPRRKWDDVIALSDHHLLVGQMAADMDPMLSWVRAVSHVTPKLSRASLRLQTMGADGGIDGGEQRMSMPDHDASFQAEIMVNHRCAESPDAQETPSHALTVAPSETLVAPFVTPWIDPRWTRRFISDEELQDVNLRFFDSRTWCDETGHRPFGALDRLAFPRNAFFPWARHYSVQVRTHSRWYLIAN

SEQ ID NO: 1009068 - protein, 85 aa, Homo sapiens
AAPRRAWVPPLAGSGAGCTRVAVHAVGVRCFPAPAGAACAPPPAERPVPQGPCLCLVLQLCCVLHDTLHESPSVAEVLEPDASGV

SEQ ID NO: 1009069 - protein, 219 aa, Homo sapiens
GEEEVDVAGGKRGGCVLEPFPLPHPRELERQRNDVVSVSTHLFLFPSLRTPCRVSVSLQARGCGRRQRVMAMFEQMRANVGKLLKVVSDRYKSVRTWRTPGALCRRRRPWENAYDLEANLAVLKLYQFNPGFFQTTVTGQILLEGPSPTCRTRDFYPVQVHDRPGTIKKNGNPTDFVPRGPAGDLSFPGASGKALDENMDLLEGITGFEDSVRKYICHV

SEQ ID NO: 1009070 - protein, 72 aa, Homo sapiens
QVILNIYFRANGLRSNSGPRRGSGIGSKWRRHLQGQKRYQENEITLETHKDLKRQYTPVPISKELEEGSRVA

SEQ ID NO: 1009071 - protein, 640 aa, Homo sapiens
PEGQVPLAKQPSSPSGTGSMVEQLSPQGGEQRHWPGPDEQPLCEAALTAANFSAAKLRESSTPFSTITRNPAHSSKVALAKLLTPVHQPISPPSQCFFPHANCATSTHAARPRSMGHCPTPLRLSRTPHTCTPAPRAFPRAKQGHAAQLAPCRLAHPGYSLLFIAYTLFCRHNLHAFAPPWQALPLFFTPPWRPPYCPSRRPNFGGHSASPFSATFLILVAENRSPLVTFLIPRKHLASTHRTNLYGRDYEQTYPARSPYTPNRMDGTPPLNLCAQPLSRPNLHTYSEGHLRRALRLGNPTPITDVFGPLYSRKWSDHPTPLWRCQSHTPTRLVRTYWDDFPPLPANNPVVPLLSPPKIAGLKLPLNIRCIKQAPLLNNLTAARPFGARRTSTHPTYVIPPHSSSETPSRTSYLPEASNYFAGSSPPLVVSSSRTAILTHLFCAGRSPHLIRVARRPPHMSVRAVCRLPAVTPSPPSVLWALYGRLLSRSARRLHIASPPVADRYALRYVIAPLLPWVFYPRRATFSVRLYTAGQSTRYYTAPPPTIVTTQCVKQCWRTTSGHNKLRHCRAHSLHTFSPPRNDTRYPPQQSTTMRSHYIPRYTTASSLHAATLPRINYSIDLHGIYMIPTTIVHRINRPY

SEQ ID NO: 1009072 - protein, 391 aa, Homo sapiens
MGYDIEQAVLVLRAHWDNQGLSDNSSTADQTQFDDDSRISQKRSWGYAEALSLHHKTPGIVSHRTKGLIARLPRRPSFMLNLLMCEETEDAVSLQGNLNDFYGYALRRRCLTSPRTWALQHGAPGRRARRPGQSGQRIGKRTGPRCGWVASVMGWSLRIPDKRPFLGSAQGSEATRLARSLAFAYGLRIPLGRARTSGRVTTHSAFGTFSLGGCTLGGPAVRHEIPGVAPTALEATLVIPCDFAWHVGRAIAGMISGPRRGGDRGTRVGHLAISKCVQSHGMTPFDESIRSEGPWDLDTNCLRSKDKPLCLVETAFAGAQAGLGRGPFPVAGAVIPVAPRRTAGFPLCTFGGASLPGGVGCDVPLRVVRPFTESAASLASATVAGLPAALW

SEQ ID NO: 1009073 - protein, 380 aa, Homo sapiens
RSDELGPVAMGRVIRGQTDGRLEIVMFAAQHSEDTVKALLGAVAAAGRHFSLTLGTGLQILSGFGSQRRSISLHPGVGCCPPFCLEVDLPGDPVTRVVEEQVRTRGLVSVTDRHASQFRHRGTSSGLVICGGQTQRAPSIQQQVVGTTWLTLRPACGQAPSDPFGGGVNQSPGGALTLVAADATGPWARMAGRADTPLVLSGRPILRGKHLSLWRLPPGMYFRFPPSNIPPCEGTLEGNNCKPPGYGLARTSFGRPTSSGDVLSVSENGGPHFHSPFSWDAPSPAKALWSPATGGWPRGPRSAIGAQRALWGPPGNTSLPPHEEPTPTITVLTTPSVTLGGPRSDPTIYPPPETNLPSNTRAPRPLGRQQRCTSAPRHKD

SEQ ID NO: 1009074 - protein, 102 aa, Homo sapiens
MMGHRPVLVLSQNTKRESGRKVQSGNINADKTIADIILNMYGTQVHDEDALDPMGGIVMTIDRQLPFFDEIQCPASKRPRSMIWNYALRPRDEEVRRWDHIK

SEQ ID NO: 1009075 - protein, 432 aa, Homo sapiens
CSWKMAASVVWSGQLPPGPQVLLRARRIAGPVLRYASLAEYGNASPQAAPASVPGRRMVRPDCDNRAAMWSSDADPLRPHCTSEDVLDLTVRDARFPKNRAQRQVIYTEREPDLLDAAGSTGALAIRGPRARTRGPSGTVARMRRKRRVGRTAIACERPTPSLAPYTGKASARGAPPERASSTVTSPQGGRAWTPMGGNCLGAGHTRLVCARTFPWESGRHRLDGREAKTVGSNTFVRRTRYAYPTDKQTLSQRQQGRDNTAGSQHSARHPCPASDAGGKRKLTAPAAQPRHATWATLTIARPQQGAVASAPQPHTTPRPPPQLPRRAHDTMTAARIQPHTGGRHNNAAPPRHTDTHPTTEAPCPDTTDSGATTQRPHCRTHMRDHVDKTTLGPPPPGDRHTTSTQTRRHPPTTTRTPTTDPNNPPPPHTNH

SEQ ID NO: 1009076 - protein, 42 aa, Homo sapiens
MPALRHQGAVRATSAALGAERISAHARQNDPGQPGPADNQTG

SEQ ID NO: 1009077 - protein, 117 aa, Homo sapiens
MHLTVGRIGGSGNEGATRVGFGGCPLPLELTFWGNSMGPAVPSCPRKVDPPGKGAAPKSLDNPLRVVNCPKQRYSLCCRRVKGSKMHVELATFGNVGTICRDHVAVVYHTIVGYTKR

SEQ ID NO: 1009078 - protein, 188 aa, Homo sapiens
MQALFEQISELVPCGLQALALLVDESGTTCPEAWVSREQQLDGKTLAPSPHLPGWHGCPDMVLREVSGIAPPWAPPQTACTEDCPHTPSEEGPKWCPRVQSTPRYSQKQGAGAQFPRPGKRGRACAWQGQSLGGEKGLPHQSQLLCLIQDALAWLGGLIAWSRVQWEPKPGMPGPGPSMSWDSCLYVA

SEQ ID NO: 1009079 - protein, 135 aa, Homo sapiens
VSLVRASKMTNEKKEQLVVPYKGPSSHVHAYSSAHNLCPMLLTNGQGRIKKFDQFEYDECEASRASQGQFHEMRSGLQMPMLLPEAVCECYFTVLSCRNSQVNSQSMAHLHRPLQSPAIGNLIRSARDPLDFDAP

SEQ ID NO: 1009080 - protein, 162 aa, Homo sapiens
MVQKDVPEKNTQRGPQGGGARHTTGAQVSSRGSHWGGQRGLRFRCGGADHWLPAGTAPNEYRYGWGERIPREWHSNHKGNTARKIPIGGEPFSHSPRSKISPFVSHTESPHRHFQVEATSGSTPLGHYGNMGKNAKKDVNTYTLGGAKCGSNYHFGVGVQEI

SEQ ID NO: 1009081 - protein, 127 aa, Homo sapiens
MRAPECGPETEECDLPWHSHSEERQILTLECPRRFKVHRRVLKLVRGGPSHVEAPATRAGSEALLGRTGWTQAGSARGQGVAVKLSSTRPINRKDGRNERKKMPMDRHYGMCRRTRDGVLASWVNML

SEQ ID NO: 1009082 - protein, 157 aa, Homo sapiens
MEPEVFALDTVALLASRGYRLRGTRAMASEADSAPRLRCPDCGLQRPRKRPLCCGGSVCGGWGACGRGAGLDSHRPLGDILLTSVWDMSALLTHHALVVDSFLYLEGLLLVSICSMVTTCNLWSKVAAGAHGNFMQVNFMNQLLSTEFGDRPSRPCT

SEQ ID NO: 1009083 - protein, 65 aa, Homo sapiens
MEHYDRANRSIRSNTNNGTLKAPFKPGHAHGLHAPHEGPTSNTKGPQFANTPHTQEEHLAGQHKE

SEQ ID NO: 1009084 - protein, 452 aa, Homo sapiens
MHVYAGFTSSCGQRRDSSRRASGSEQHVRHEQVLTAPDVCMHPRGTDPAFTRTDSNAPLTCAADVDTGQQTLGVPIANANTPYVAGPLSPLCAPFDSNMISCDIQEPTNLCVYDTAPMTRRTPNITFNACPRHSIPCENPHWLPNATLDGPNAASMANSSHKRPNLSARHPLGNMGKRIDPADALLSITAPPSSRAPATAGPPTRNATTATPPEPSSRNPRTLQAPPTAHPGPTHPPLRPPAPDPKPPGTPPSTRYLSSLESLQSLAPHSPVTTYHLSISTLYALRSLQPPPPHPNHSVPTTNPPNPPNPHTPPTSTTPPTAYPILPRLPQTTNLHHTSTLPTPPITSTPDNTSPFNSRLPTRSPLPPLSPPTFSPIPPPHPTTTPPPVQPPPTQTAGQTTSKPPQQWPPAQPTFSSPPTKLPNATHERDPTPCTHQYGRSYTRLAPREQIR

SEQ ID NO: 1009085 - protein, 103 aa, Homo sapiens
MVYVDEPVISLDMFINGSKLISAPNSWYTRMLRTVICLIASVRQFALETRCIAGPCSEHNGQRDVELRGDLGPNLEESTKLLALSKCCRPNNCNPFDIEVAHR

SEQ ID NO: 1009086 - protein, 391 aa, Homo sapiens
ASCRDHVCRGILWLEAEEAPHGRIAVYRSQDLGIQARHEPSEALLGVAAWLRGTQGVNDGDMNGVADGGAPSKPGPAWISSTERQWGTVVCEPVGPDMMPRSVSHARSPLRDYCRTPPQALRAQSLASGATDRGPTSCREMRSKLHLGKRGPHWALNLHKRPWRLALIAANLSRATDDETPSAVALWHRTVHIPQSRLPNMPWKTLQGSLYASASLRPEFSCPRPMRRVCGHMDQSKGEIVARARTETPLGLILVGPRRIQSLEPGRPLVRAQGPCRRKRSPWAGNCSATEVERLLQEMDAPLVHGTLTYRVTVYYRYGVEHIYPRVCASQKMALPRKPGASDDTWRHDQSCKWLRVAKARRPFVPPKDAFVTKCRMKLISPYAQWTHAGR

SEQ ID NO: 1009087 - protein, 182 aa, Homo sapiens
MSEEEDDEEEDDEDEVRPMMMWRMVTRWLVEGRRWKAVYSDCVDVLEESVLSIRFKMGSSGLGEPGSDEYGWSDVSMLLIGAGNTREAIGHGDKVSGRHECESGSSSMDFDDTRLGWSQTWTPLRQLGEVHGYIRLYRTVGAPHNDPSPLALRDGRSIPRRTAPQNYVGLVVPTRLAMRAPK

SEQ ID NO: 1009088 - protein, 168 aa, Homo sapiens
GSLALGKLRKCFGGFVQFSGLSGVYYVVGGPVRKQHFKPQFAASSLSDDHRLEDSLEYAAKIENQPERSVVVKVECGQDGFRHIYCSSQQIMSGQCQGREATENAMCSGKESYGTLLVLAIGTLPVVRVMREATRKNTLVCKRLTMELDGGLGKQVSSCPWSVCRPPA

SEQ ID NO: 1009089 - protein, 136 aa, Homo sapiens
MADYVRCSGVGPGCPVLALRHGGTACGFRVSVSSQVLHPEDRSRGRCHGAGARSRGALRRPMPDGIKEVGIALYLLDVWVARCGPTDIEVSHMSRESADLIVVSSLGPIKRIQEITLTSRSLGGALLSSKGIDGSR

SEQ ID NO: 1009090 - protein, 107 aa, Homo sapiens
MVRRAACELNVPPPPGSHGESARICRPRRLGRPWGPDAPEARAGGGTAQRHGVPYMMQRPAVYADEPGAAGGAEGPAGGMETFLRVRANRQTRLNARIGKSETEEAR

SEQ ID NO: 1009091 - protein, 281 aa, Homo sapiens
LPEPLAHEQLEGRSPSCARAEAVCSPSLRAFRRQQSAHEGVKPEPLAEKCWLEDFNVQSRRYLAMHQVMCTIRRLGRSEVPANGDKYVTLCVPCVILKTDYSGLVQPRVLRRGHSRLLSEVQGREPSPEQFASSVNERIVRGARLRRERPIYATCNQHCAEILLWKSVWSLKEDTMRDLVTAYVTASAGCAPTWHQEKLGWTGGFGLLYPFGEPRVGICRDRRFRKIGRSRDARQAGAVEGICDGEATEPNQGRIDVRGGISPARRRSRGKSDLTSGHTAM

SEQ ID NO: 1009092 - protein, 111 aa, Homo sapiens
GRRWQSIQAEDESAKLCKRRIEHLKEHSSDQPAAASRCGSRQAHWIALHCAGAPAAVAALLPTTGLLPAWPRLQPPIRATLPDIIGPLSPSTGPKHAGCAPPLPCAQPPCT

SEQ ID NO: 1009093 - protein, 325 aa, Homo sapiens
IQGGPDDVLGFLRVVRFVRILRIFKLTRHFVGLRVLGHTLEGQSPMSSCCLSSYLALGVLIFATMIYYGWVALVARPSDPRGNDHTDFKNIPIGFWWAVVTMTEQLGYGDMYPKDVVRHAWVGALCAPGMACSPSPCRCLSSSDKFWHVLLRWTMAKQKLRRRKRKKHVPWADAAGVSHVLQCLRRVPPGTEAAGEYRPPGREEGHDRAGNGQTLSGMAMPTQSSSDEAGSWPQPSPWGHLPEHTKEATGHCERAHDFEQGSSRNAGVPLLPWSDSGATMDCRPSSSVTVNGDISTSLDLSRFSVSTEGMMPSKRLESLYAHNGR

SEQ ID NO: 1009094 - protein, 253 aa, Homo sapiens
RGVMTKDAGPRVFRPRVEGDPDGSLWCAAILWLLCSHRLAPKSPHQTIEKQKDITPRHSNQTRIHITSYPTYIPPQNDNQHMQILLLNLNHHINNTMKNNHIQRHTKTHTHMAKQRINMHKKRASNLRTTHDTAKKENETKSMRPADQHQGNTHTTPTQSTQGTNPTQDIRSPTTTHELARISTSNTLTSTVNTEEIRPPTTPRRPTNSLHHRPEQIQQENRTERTSPITPRKYHNDHPHTTQKPHTGKHTTQ

SEQ ID NO: 1009095 - protein, 67 aa, Homo sapiens
MTTLDCHDCPYVTCEVMALHDVLMHATESPYEDSIAPLKLGHIGKGGLTVGESKGDEDSSGGDMERS

SEQ ID NO: 1009096 - protein, 147 aa, Homo sapiens
MQALLARSGPMENPVEERAGDATIMSWALTGRLRLLVHQPIRCSYLTYESGPRSRCVKASQRTHENKIARQEERRCGATWRALDEQLGSRPMGPIPMPNRWLVSNNACSERKSRKRTGRVTRVCQRIRLDSCVDLDAKERGPTYSST

SEQ ID NO: 1009097 - protein, 253 aa, Homo sapiens
ERKQEEVGEPAICARAPTEPVHSLGKGHAAPTNVVENPLPETDSQPFLPLVAPLVSHSSTMASLRRARAVPEGAANAVTTFVNPHKSNHIVGRSITNDSAVLSLFPVHQRMHPQCLELVNQAWTKRRADYEGGCQNQGWAQIPDSPGGRLKLPWAKEPPGEKFPPGSARMEGQIAAQGPRIPWWAQKAVENKCGGSKERAMSTLGGCPDGHLWTNPGVPATEARREGHGPYCGVVNTQHAKGSTFAAKWPGFP

SEQ ID NO: 1009098 - protein, 155 aa, Homo sapiens
RSPPVDKRPRVRGLMSAPPSLLVWPVGAKLAAVPRPLTPTRVADTDHPVPGCAQCVSLMTDAPNWAIQLWVCLAMPQSSSSSSLASHPDARIVPSSIHVAWLRNPHGLHQSPTTTISKHPPPNPPQKCTPPTLSQYTCHKHTTRPDTPHTPPTTH

SEQ ID NO: 1009099 - protein, 242 aa, Homo sapiens
GERRHCSCCPGGACDDGALPPACLPVLGLPNPDLMLFMLMSTVLPMLYDVSCVCCVLCPECLRWPSCDCDAAWLVSLNPLIEVALPILAAAVLLMMCPGGEMDGLRLCCACVLARWTRSAPSHDCSSGTLLPRAVGPVSHLLLELGLARLLSSGAYRVCHAVSETALPAPRLLAEGGPYWLQGRSCASSSASAREVIAVVMDRVHQTSTSSETLQEICRKQGVAVYILLDQALLSQISWICA

SEQ ID NO: 1009100 - protein, 98 aa, Homo sapiens
LEGDLRLGRVCWALSLPKSLSSHGAPVDVGIDVAERRLAACLLTCSAAGDIRRKIYSVTVIIVFFSTHLITPLSHGVAGLKGPRGWTVEARHHVVENR

SEQ ID NO: 1009101 - protein, 171 aa, Homo sapiens
GAASASQYAERPAVTWGSRSGQIAADVRLRFPEVKVGEVDPVTRCAPNALSMLYLSLRLSDGWRMLGCCILGAALLLLLLPACYLPAVTVWAVSPGLRPTPVSLELGGPGASAMPFDLVSNAYAGAGLHLLTCCETTDAELVAADLGTLGCQLHDHLAALRVKSRTALLPD

SEQ ID NO: 1009102 - protein, 494 aa, Homo sapiens
MAQVIQLAAWFHGVMVSFQALHAHQTTSHGGPTVQGLDAICLTFTTILRMRRYPGTFAAALTLSMVAAMDAPCRTDSMVATATTWCGRDCMRRERHFTRMVIGTVRGVCLEKIIGAVVDDKPPLFPKFPYCTECQGARLWVDVSTMWSLVIYLLATPLFVEAIPTQRCEHNFRITHFSMRSLQCSPVHGLPCEYCAMQRAELWPPPWDIYPHVHLLVSFPCVVVVPRNQTNVMSVNTFICLATHNLTGINAPTSVQRRGTDHRDREVTLKILFPQTSRAPHLGPPVDGVAPPNGLWHQLEVLAEFVDAHTKQLLDNRRNTPLCGFRVAETIGEQWLFAPETNVIPHPGDRPVKWPRLPLEETRRAARCRSHAPLIEYRERVGTEHDIWRRVPGPEGTTLSRWQPQDIPPASREQSAWFTDRTIGVSENSPTHPEGDWRRFSATTANVVPVARSTHGTTVAVWWSGASVVRPNGSQIHPFGPRRWWETKGTLRQG

SEQ ID NO: 1009103 - protein, 196 aa, Homo sapiens
MTRGFMAWGISGGSSIDNIAHCSRGGSSVAQAACRYFPTDDPGPPSSRFGCRTRPMFGPRVCNLSLAFGSQKPPARAARTPGPARGLCSQDPGIAQTSVSPSKVILPGEAPAADMRTSCDQAHSARALETPVPKKELLLPWNNRQGAMHLSTVQQRIATNVLFNCPNGQSQGNNYPRGKDSKGALDPSLCTHAKLT

SEQ ID NO: 1009104 - protein, 251 aa, Homo sapiens
MPAGAVVEGPGCGMSCVCRGAGSELLRLCAVDVAWLPVCCQSCTWAPVPCCTAASVSIPALVLLIAAWLEGRLPTMTWHNDIGCCTFLQLELITRGCLSASLLEHPMTQNTVDHHELGTWLVTSLLQGRMPTVSSCASRHINSRANNGREGLVPKDAGASTKEREAAPAETDMWPRKPTHEGLELRDEKFAGGADQDFEIRSIEDSLLCFSRINTPELPRWQEPRMGNVRRDWRSGFARNGGGAQGFRRRG

SEQ ID NO: 1009105 - protein, 226 aa, Homo sapiens
ETDAALSRERELQLPVSMASCSGRLCREWSLSEQWCCVQSAAVTEQFAVLLCGCCCLMCLLCASCRMPVSKLDDPLHLLLYHAPHDYLVMQWPMCGLVMPVSTLEEGHAQYLTSLADASALVAALTLLLPPWLLDTIINVRCHLAPVFPPPCLTCLIDTCNGVAVALVLWSSWVQLAGPCRLCVHMQCQPVLRTPLQGILQLGQELKPKSLDVRQLRSMGPWSNKE

SEQ ID NO: 1009106 - protein, 108 aa, Homo sapiens
DTERRNIAEVSLLACPSCLRSESPREAGADLDAKLDIERGSRLFERRDLNRAPLRSRVAAAMEDTAHGHVVPESRSIRRDSHRRLRSGAAGCSVSIMHPRWRRVGNAV

SEQ ID NO: 1009107 - protein, 245 aa, Homo sapiens
PRHAWCPLGPQGPQCATWRGLGLWEKGALLALEGSQCLKVLKVAALELDGPTKDMPVPIKGDIVAPWAMNVAPWGLHVAPQWPHGKTWELGRDRHGFTSAMRWVPCGAYRVNHVDPGSPCVSRVASSVHHGRPRSFYLTDGLVRRSQLVTTVNGRSGPPRAKIRRPPSKSPSPYNDKLVSPSEFHIEAGHSHKGLEPMQAFSGIPAIVNLMPIVTSEASFPHDHDNGRNHLQQHECNCTTTIAQH

SEQ ID NO: 1009108 - protein, 231 aa, Homo sapiens
MATSRYEPVAEHCVVGSLWDSVQGPVIPTVGHICGPQECESPRLEEEVEEAFPSAQIRDGGRLLQADWEGGIRRSPRVLSRLDGRLCARSTRYMTWENARDNRHGVESSETKDLKDSSLGQRALAHAGLPARDRSKDLMRQVSERGLGYASVPKGIRFTGESDSPGRQHLLGCTQWVAKPSPTRLGLNFLEPGPMTSLHGYAEWVTLPSPVVVEHSGYPEIPESLAAVRRM

SEQ ID NO: 1009109 - protein, 138 aa, Homo sapiens
MRARGTKWEKTDAAVEMNRINREQFWEQAKKEEELRKEEERKKALDSRLRFEQERMEQERQRARGALSVLLTGSGSSQIEDAQGGIQQTLEADAGQVGGVNGAVYLLVTIGTDGGRDPPLNEVQSRRWRTAQSAIIAP

SEQ ID NO: 1009110 - protein, 281 aa, Homo sapiens
STVSRIFFCVASRSHIAQYTMGERESSEFNRISDRIRASCVYLWVCLINRLEYNVESLLVHHMNRLSLDHRNYCVFIIVTKIMYSHTNWTNIPTGYTVYRTDDEREKLRSSECEYSSLSTLVSECMRGTVAETFKLAVRLAELPDGTLGRSSSVGGRVELNSMGSKGLGVAQFVAWVRDVSEEGIHSVLLYPHFVTRIAPLIVPFIGVVESPVEQGYDRIQACIVFEYSEIAFLLHREPNLVLRYPVCPDGSFQGPTFAYLCERHSIEPLCRICQIILSHH

SEQ ID NO: 1009111 - protein, 232 aa, Homo sapiens
DSKGHGQVGMRVCVCRAGEKEEWVDSGELVPGDCLVLPQEGGLMPCDAALVAGECMVNESSLTGESLPVLKRHCPRAGPYCGEHSGVTTLFCGTLILQARAMWTARLGSWVTRHRVLHEEKAGLVSSIFTPGANQLRSSINDKALKFCGLPVYCAGLSFGASLTGVLSSSSRKRGACLLAMTTCKLPGSFEALGDTVDGRPPCHHGLARAGLGVARSIGAEAALREERGYTE

SEQ ID NO: 1009112 - protein, 270 aa, Homo sapiens
KHPGTNGPGGWQSHSGPQLPAPQAQPQTSETGGGVSGQDRYYRATSIRPASSLPSVPSLEVHSGVPPGSNGSGAVEEADGVRVARTGLAWLHAWLDAPWCCVAACECLAVGKPRPWRLAPGLSPARPLFGSDFEKEHSMHEECGLSRHELELRPCEAGAEEWHGRPQMPVREQLRGAVRLRPVQCCASRRITGWWGECSPSMLLPVLQDTTFRAERSSPKYPLWFRQCVRRRPGRWLARCSTMLCGSRARHWDSSGFKVPRHMNAGMDQE

SEQ ID NO: 1009113 - protein, 182 aa, Homo sapiens
MAIVSHSLRRTSTPLRSVGGPFAKVRLYRCRANFATILFSQHNATRYYTALSDLDPNVGGSPNTCGRYLLTNYTEFPPHNLAFISRLGKDQIGDTISSWPFKENRPKVLLNYREPVTPALSYHHANSTNLTNWLGSVVTTPFGHTPAPTPPVSDTKKYSQYTQDERYQLHASSYCNIHAYRR

SEQ ID NO: 1009114 - protein, 389 aa, Homo sapiens
SDRGLQRSFGSMSSCSDCRASWHGHRPTLGNAGVPGSCSSRRLRSAASTVRTEIPGRSRSRTSLHACAAPYVLGPAILEARRSAYEPNAGLSEVILRDQTWTIAQRMRWYSAATKCNMACRLKRLPSLPLAFRQCLGPITRLRRRKANTSLGYAKIVAINNVKLFPYVVPMPPVTYGPPDSESPEQIRLEGAQHRGDTARIKASAKLLPPKTLGGTHDYTRVTDLPRHNRTDTLRHEMQRKTPSLVTEQNETYLSKRIIDGVWGHIQEPAKRPPLSTFGPPPHGDPPLGSDNIGRRSILRIPAVSHRYFGQVTNVPSCLYRAVIPYIESRGKQSGQRDTRAGDNNPTCGQPPPTSLMREETTSVRRSYETSPRHCFCPTLARAPPPSPS

SEQ ID NO: 1009115 - protein, 206 aa, Homo sapiens
RRDSYPCCVGVPVSSPCPDQTRVGALSSPPVLHSESGLAVNGLASVHPGSGPLRPGAGKMATAPSRDCAASEDTIGGPEDQLYPVDSNHFPPPFGPHSQRTTHLPTVFYLYYLVSPIAHKCHSNQTEINQKYHTNNLEHYRIQGPSSSKQMRLWIITITEEKGRKDRKPKRTQKGNTQHKETTHSDTRDTDKRPPLRTRDNYKLKQ

SEQ ID NO: 1009116 - protein, 292 aa, Homo sapiens
MRDILLLQAVTDAATKSERLCLRDVISDDAGIVPLSGTYPTEEQSDSASVVTHLMVYYRCRHYLSEWKYSATVASVVCGIDSPRSPIGALVASRGPLSGMTFQAWNNFAFSGPDAGCWDTIWCQRVHYIRKALRAWCARLVPGMLRCTTRARTDAASRISTCTVRYRNACILTSLLALRDATGSLGDSRLSSYEQFESHRSSRVNAKLPPLDHVRLAHCNYSRPYLRVLVGDVCPILPTKILTGFQRTDTPIGPGKVAHYNTYRHQSRCAFNDVLTASSPRVTTATDPRNGN

SEQ ID NO: 1009117 - protein, 117 aa, Homo sapiens
MQALEEEQIITGANAEDGNTVLMDPSDASKEHFSRDYSSFKPLHGCSWMENPGNDLRNHRGHAVDMPVVNKTVTHGERGGPVTQSPLPDARLCGAGTWYQGENAGAGIGTGCPRNLG

SEQ ID NO: 1009118 - protein, 102 aa, Homo sapiens
VRLKLGRRQSKAKRAGETQNPAGCRCSEWKSKMQEHAVPTCSCAPQGGEKVNAKEALEDKRNAICEEMADTADAIEMATLGQGDELNERAESLQQEVEALDT

SEQ ID NO: 1009119 - protein, 202 aa, Homo sapiens
QSGASAFASSAEPYRSDTMGKVKVVIQGLGRMGRLVHQGLLLNLPGTQVEYGGHIRSDASCRLTLLSVRVSSYIDFLNDRFLASGKYFHWQRVKRAREREEGICPCEVEKSPINRSFARSRRSRIRKIKREGRMAWQREVPSGGRPKRGRCFEHTYWSKETGGNSLMARRREHNIGDQCDSLPRVRRREWHTSVVAVHWKLG

SEQ ID NO: 1009120 - protein, 285 aa, Homo sapiens
GGAASGQDDEPDPSAPVPPAQCGRRCLLFVELNVGGEFHYQHPWCTLRKFPGSKLADDVRLVVSQGLHRIAEGRFFIELALSDLISDPSVDYHAHWAECPLASTSREVYREAQFVLKIKPLVKLLEDMPQIFGEQVSLEARFCCKCRATAENLELMVRLARAEAITCTERPACLCAWWKLRSRMQYHFRASCSLLQDHEDVQGLLSGFGLHAKAGSLRQYVRMISSACPGQNAHLVRAPGSYEGGISFHGFISLEREPPTMRGQRNFAYLDPLHFHFQPFYPGWM

SEQ ID NO: 1009121 - protein, 273 aa, Homo sapiens
AFVAGISQYSKLLLASKEQVLHRGSSGGESSSYEQQVAEEKHHVAELLSLFEDSISRMALKTREGGVCSVVLALVKQKGGHHGCGGCSVNNVVLMAPLCEWSLYFKPRKGVHGSICLPVDEERHGMFVARGASPSRNSCSPSWLGRARKEGRVISMRLTGSRQEDCDDFATEGQTDDYLIDGDQCVDVSQDHVRMPHYGRNTRLFTNWPFENRRRTPSILHDVCLARSRVEEEGAESIDGAPGNPLLVSCCQLALRGPRQVTGKVLGTRDAAE

SEQ ID NO: 1009122 - protein, 158 aa, Homo sapiens
EEFCTLIACSVWAEHGDMPPQDRVNRCPVAKKDNTSDQDEMKPAVILGEEDDLFRPQPGAFSHWPLRYKKKSRSSVHQMIQNNAYILNEVSDLYECLRSRRKRPEIWNEPLESQRGVVLGPRDSIRHVRPAPVPVEVVQNVLVALIKSLTMLPHSRAK

SEQ ID NO: 1009123 - protein, 250 aa, Homo sapiens
AWAGFSCTLGPAWAEVTRGSIPCDNGQEVCIRDIAQLAGVCHGAYLMAVREGTPQCPWVVQRCRACMEGWCHWQPRCPLGSDESSACSIGVVSIGSPNDPSWGTCSSLWHIATGSVIGNIPVSVAAKVVPLARGRNETSACSGKCMLLMKVVLQGYPIGSSYCLRTGNKTGPEGSTRLLRTIQDGWLRGSVAGRIRQRVSWTGEPMGMTMAWVNVKRAGKAVGGTYGLDWWPCGTMAKDIANGPFIRSFL

SEQ ID NO: 1009124 - protein, 118 aa, Homo sapiens
RERTSLEFLGFFFPGCGAAREVVYSTLEAMPSKVPLHRCRSSDAKKQRHFWRIANADNGLFKVERVALCEMIEPRTLHYKLLDASFCFSARTQICCCRHSGVPVLRGWLAHVCPNFSA

SEQ ID NO: 1009125 - protein, 357 aa, Homo sapiens
CSESCADLSAGAVLLRAGARVTRPTALSLNYEHLLVDCPGLLCSDPSAGQLCAPVRPLTEGAVSQGKPDNTITMTTSHQPQDRYKAVWHYLLHAGSGNAAPRGISSHDGHSVFHKTDLDMSQNVSLVHCLNWARTPMRSALPPASHPLPSKPQPPLTATLPNNLSMSPISPCPAPLHAHSTLPSNLPLPCIPGRVSPSSFPLRDPCAQGPGMRQSLAGLLLVIRPATPCAEQRMTRLWRNCPPGAPIILGSTPPQLHSPRTSAWLRISPSSPSMQLAPHSRLRRAGPSRLAPRTVLRPSVPFSFGPSPHAPSLPGATPPQCSRSNALGAHRGAPYRPAGALPSLSPVPPLVRPDSTV

SEQ ID NO: 1009126 - protein, 443 aa, Homo sapiens
GILADEMGLGQEHPDHRARSRTSWTTQTAVIGPFLDHPCRVSQSAVQVGGTASCDERGAPLPSCRSVVYEGHHRKYAKTRALLSAPSVPRMWERSTVVQQNDRTEYDHPDDEALFSGKDRVSRRYIAICVHRMRRPAMTERYQLQCVDGTSCSNNCTYCRQTPPALASYDLESNYPALPCTSKAIPQKVCVVWRPRHSTTWSSWSLPPITSSFHKKGLREATAFPNGKVAFCKEGHTTVFCSQWEPPGGTDHGLVDHLAKEGVRGKSPIGLRVLVRRGRIMPPLHAASLKRATFPIGPPERQFATRNGTGTHKGHHRGSAPRKRRDPPDDPLRIPKQLAERPRFCDGLGSSGRSAFLHGGHTTKHVSPNWCTVRSGLGTWHRGLLADIADPLETGPNGWTPIVAASMESDPIPEATHYAGNVRIAQTNHANKKWPNATNRTAI

SEQ ID NO: 1009127 - protein, 69 aa, Homo sapiens
DVLVTQRTGNFCMGGSDGGYIICDDGNQGHRIVASGKTSRYFISTSDKCNCFTHINLKSQFILHVSVGV

SEQ ID NO: 1009128 - protein, 149 aa, Homo sapiens
MGARHGLSPLNVIAEDGTMTSLCGDWLQGLHRVCGPGNKIMSVLSERGLFLGSSRYQPMVLPILQPFWGCDRIPAEEPVGLSAARKLGARAAKAVESGGPGAQSLLPPEELPALVFPYWGLVCLPAAVVGAIRIPAYLVVEDHAQGRRG

SEQ ID NO: 1009129 - protein, 210 aa, Homo sapiens
NGLKICEKFGPNLDTCPEGTILGLRLDSSGGLHLHVNGVDQVVAVPDVPQPCHALVDLYGQCEQVTIVNPEPGLPVGKVLEPKEDMEKADMVDGIKESVCWGPPPAASPLKSCEYHALCSRFQELLLLPEDYFMPPPKRSLCALAPTPRDPLPLPREYALPFGWCRFNLRYCSILSCRPLKGEPGVGFEEPGENCAPPREEQPPPVLLSP

SEQ ID NO: 1009130 - protein, 165 aa, Homo sapiens
GLLMGMCLGVVCATGAAAQSMQIAFVPPAPLPQCPAGVPSLATQCSGILVTCGSWAGDGAPEQPVHGQHHPGLNSTQDWNSSDPSYLPSDMTLSDHCHADLTGSGLPLDTHLVPLLLVILPLQDWHTSSQHLTPPLSVTIPDCAQALSPSACTVIHPSLEAREGF

SEQ ID NO: 1009131 - protein, 388 aa, Homo sapiens
DVAGHHHADELTVPLPQWCAGQRGAVSFAEVLRQWPCEDLHKHEPRSVLRCCGLLPERLPVVTLKPECMLLLCAVRLCGAAVVCAACRTVVCPYLRCSGPPLLPHLPRDTGHMAQAHSTKGTDMVLAVAPHGLDMATLWHLRGIQKVEPDSPTMNCDAPPNPVDPEVHLRCQKERPSAAEKARGGPNIGTNVGHQSGTDEERRAIDHNAGSCTHQRPRGPGALWHGLKSPRATFKGTQETDSPTKVYGPRDTKQARPTDGPVWGTRPAPQFTFRGRGPPYRRHRTRTRSHDSLDAPRNRAHFQPPQNAFTAGITRSPEGTCHIGCPGIPHPPRGLATGPPLAHLGHVRANRPTTCNLAHMAHTASLPKVALLSKNEVGVPAFHTGSPP

SEQ ID NO: 1009132 - protein, 125 aa, Homo sapiens
MSAGTGRHAQDGERLRTRRVGHESPAGWLARTRRPYRTFPGRRPECAELAHRVKRLDASSETSRISHFTWTRENFPKDMTRCKARKESSKVVQKENLEGHRDLHVHSVRLHGSPSRHVLHCNGWV

SEQ ID NO: 1009133 - protein, 202 aa, Homo sapiens
GCVGTGAEAALEEVGACDGSGLASPREPVALGPGCGGGPVLAGGSPVAPAHQPWSPADPEVESQMTESGHRDAPGVTSQWTDCRRGELNRLRRLITPGIQTPYLVAALDGGSESGRGHWLNHPGEFDQDKTLYEWTLKELFMLNASNPGRCAKGSVVFEARGSNKGRQIRHYNTTPNRKSCVGPIRENSFRKPLAVKAQKVH

SEQ ID NO: 1009134 - protein, 226 aa, Homo sapiens
GVLMLSHLRREKPLGPDWLVASGERLPVRHLRCCLLLPRPLYSIARRAPSTSNLPGGQGEQCVPGGEMGGAMVLLYASLGLLESDRLAVGPQSRLDTFDYDWYNVSDQADLLNDLGNKGYLVFGSYLFVCGSYWPTTLLGVSFFRVHRSRTVTLSNHGHILNVARSIAIIRSYFLCPGWATVKMRAAPGSTARGESTSMYGQSRLWELVWLPSGVMPGWYGGQAGE

SEQ ID NO: 1009135 - protein, 273 aa, Homo sapiens
MLLARSSDEYTLTLRHSAGNNKLDQGLPPTMGTMASQSQLTFCSVVDPHQSHTATKSLAQYTCQAGPPRLLYTCCPMYQQDQIVKGGQAWQARGTTRVKGLITRQLTMDKTPAAVMTQALLTEYHTGAYPRAACRVTGVTCRNLPVLSHADLHSTDYFPQVKRLGRTNVRTDHTTAPHTGNITRWEDGLYTGAHSPAGPTPEHASGRTWCQRPGKSRFRIGNPSPEGPGSFLTIPPCTFATGRKAPHWTHRDRRCGRKALRQCESHALGGSPP

SEQ ID NO: 1009136 - protein, 135 aa, Homo sapiens
MALVAIEAVGFPNRATIWAQPVGHHKPLTYKAACDKEPQKSRTEFWSANQPRGPLMHVGQIKRALGRLGFFPFTQRIRELPPYYVGLVTAGTVGTAGTTSAATLAHIWFPSAGQLSSKTCTQRRKNTSLFEISRA

SEQ ID NO: 1009137 - protein, 251 aa, Homo sapiens
CSGGHGLRRQQLQGPLPLRALRYGTVTRSRVTCNRCFSWYAPIPNVPHCRAGSAEPRKPEALDLLIPVLGLATRSLTEPCQDIRVACNIRGKIQFQGSDHSIVKAGGVTAISPIAVLPRWRWPGFPPVARRTRPERLDMRSNQEGTSESLGFEPERFLMYEEAKILRLSGKPQNAPEGYQNRLKVLYSKKATPGSSRKTMRYIPSLPDRILDAPEIRNDYYLNLVDRQFWDCTGRGTWTTVLYLLEVQATR

SEQ ID NO: 1009138 - protein, 287 aa, Homo sapiens
ATDLTWYAKITNDLLGAESDQDGEDDSHAHVKYVDGLGYLYLLVTWFPDDRQWLRIMTASQDQSSSHRTLSRICGARTGTLNVLASGYTDHSQIVVPWREDPESSLFTSDQHVECNAVKTQLATSSHYAVKRSWSHRHLRDLLKIWIVQCVMARQGIALWCPHALPVLMAKGAISVWTLVRGWKPNKVGGRMSYRGLRGCGITTNSYLEYETGLSQYRSDCPVVGTRNSTQYGGSKRQSITRLNRPHTLHVPGKKAHTIEGGGNAIRNSVGTKGRGYKKDDGFSLGS

SEQ ID NO: 1009139 - protein, 98 aa, Homo sapiens
EHFKIPQKRFIIQVSLRVPRGLSVGFLVAERGTPVASKIFGTRSERWVSYQQGPVIWDEDVFRSPSWNAYIHILSGNRPPGSCGRWDLDEIRINSGAT

SEQ ID NO: 1009140 - protein, 172 aa, Homo sapiens
MKEQGYPKEPCLLRAQGAITLRNDQDRLEVSYQPRQFDTQRPAKYTEGMDLLSEEHAGRQPAGCTDNGTAAPHPILATRPESSTAYPGDDHGQPATALTHNTSEPNQHTPGQHRQTTAMITPQATYTTRTTATNTNDPTGPGTPGTRGHVKDKQPQGQGKDTLTNYTCTGTR

SEQ ID NO: 1009141 - protein, 418 aa, Homo sapiens
GDKFVLRSAILQLWHAGVSKYEISNEAVVNILYELITTADKGALPQHGQGSLSQHGPLPQHHNFLQAIQTTIEPGQTELCSRSECPHPYIRVPAPVRQLTPWTWRPEGGTVELIQGRAMARCNCVSHAVPKPRGVTRSFRITSSTSYTVPNTQKRHPQMHGSPDVPRPGLKTQEVQEDLIFMRLNIISPGPWSGLQQRQEGASYHARPVTGESHHMGGHYLIGGPLGSRELELLSYQSEIQNNRRFATGKDGKPPEGCAQGGIEHTEPTQRGENKRKESQKQKEYRGKETPERANRHGGKQQRKGEWDNKDPTGDTHTRRTYGAQKAPERHGPMKSKGRDIASGEEHNMAQGTNQEHTTGGEAKDYHSHKDENNHKKHGKATHRTNLKGADNPHNPGTKNTKQHKREAHEASKEGERD

SEQ ID NO: 1009142 - protein, 335 aa, Homo sapiens
DNALRLYLFTGSITRCLGFSAVLNKQREIRTRRYTSALMCIKNGADKKSWVMREETDCSPKTSDSSISQSVELRPGLIWTLTELARSSPSHRNPSGWQQMTVPEEIYKADVSIPLEALGEGTRTIRSHLDSFLTPTRGARNIREEHEYWTTNKHYPEQAPEDLAVGSAARAKESNPHWSSLAIESAGKGLSPHHRKKRNAKRWPRIHRIKKDRHWKVFKSDSNSYLETSPYSRNEHPTRDTKSFNRLGARGSAILGPGSREGLRRNYFAEPRYVLMSGTDSILVWHLFGMRLECELFVEKTTMWVVGISTLIRIGNCHLQESVARKGGATMKVSS

SEQ ID NO: 1009143 - protein, 143 aa, Homo sapiens
LGRRLGGERVRDRSRETPGRPAPPRLAGPPASTFPGAAPASESDTCRGLGTGRAVNAAGEDPMSWPHGQPDWLPHDETHRRPPPVNASKPQWKKPDPSAETHGGQARKDAKQCGSSKEAERKKTKTLTPERVNTYQGKKKTTK

SEQ ID NO: 1009144 - protein, 217 aa, Homo sapiens
MPVRISYKNQGRFKSRDLRVTTNMLVVQLQRNTAVIMLSLAKHCHAAHGLYQTSPNYPRYAQYSPQPHQHDHTRPTTRRPQPQHNPNTSPTPGDTHTHQNHPPSPHNTPNQTANHTQATTRDPTAARPPTVNPTTHTQCPTNQPPQTTRAPGSHTHTTTDTPPPHSTPHTHQRQQPQPTPHQPPPPTTPPHHTHHPTRRPPTTHPPRPPPPPPPPPP

SEQ ID NO: 1009145 - protein, 186 aa, Homo sapiens
MAVGRELGLSAKLTVSPGDLIRRNLVSTEELNAESGEYWRSAIANCEVSDGSNLPVVKIRLRPHRETAGRLMEKDPQSVCSERQAALLQACCVRYCAVLWLTGKDDMLDLTSVRTCNDYEGILLYDADQLCENSMGLSELGTLGPNGPILEQLLRRLLRYPASQATTQAPSGTGGIGVVKPRAQEG

SEQ ID NO: 1009146 - protein, 239 aa, Homo sapiens
MRTATAADTTVVALSVRHPTPSLLQTSLQRAENSAAYKKTPRTRRPITLRRLSSRGEQRQQAPRQSFAPPETGFMTQRCRTNHVCCTTEQTTTLQAHGVTQPTLQHSQAPSTTRVAPQRRSSHNNVDVSVQATHPPDDAPPSNMSAPPTEFATPRPGILNPAAGDNDENLDAWSDHPQPGGSTMTNNICSRINTFSRLVESSATTARGETPRSRTTNACHQGEHCSATAVLQERAIIHR

SEQ ID NO: 1009147 - protein, 204 aa, Homo sapiens
MPSEGSAAKLECRYLQERREDMRHACEPRGCTDAWNWSSLDKGDTGLDPYATSEIASMRTAVLVYNRMPGSLSVPESLLGNRKRNSGVRRRTSRGLIPVSSRVAVSPLVLTDCYLLTPALCSILPIGPRESVTVSDNYWCDVRAFARKSDRSREQSFNLEGSRPGGTAMLWVRRVRSRVGHGRKCPEQRLLGRAPMGVPPRRSQ

SEQ ID NO: 1009148 - protein, 151 aa, Homo sapiens
MLLNHEGVARTHPNTKNKLYKLHPDRTYWCYGRGSTQPSLLAPREGHTIAMTRGSPVHNTAHPKKTKVGPYTVDNASRQAMRDTQNGERPFPDACGPMCGKYLLADLIGNDHREPRTNFGPHGQRTTPIPYSTNSMHETVHRRLTSGRTRK

SEQ ID NO: 1009149 - protein, 365 aa, Homo sapiens
GETETAIAPGACLTGPPIEAVERLTPGTVLHLPTCLPSPATPAGQGEHVCSPLVRCVARACTWRCLRGDWASRDVRALRCTLYLIDTRAHLLISDAEPCRTKECLASVVVHARRGLSSHVHYRASDMRIIKCLCSPTDDPILVLLRGHRHPTPTLLLVTSPELRAVLLGDPNGESQVEEQRGTSDYLLPHDSTRSSTRASNYTSTAGRMTFVGPQAPQLTLSNHDTQLCTCSTPSGGLADTWKSYPRWASLRSRLSTVAGTLALIVEVHPSMYIPGNKPSRSWPPLGTHYFLCCADTWPLPAPLIDTGVAPQAKSVTAGAASGLTIGRNPAFDKAGVPCLSPAIALSGENTITTIRHVPVGTYSR

SEQ ID NO: 1009150 - protein, 442 aa, Homo sapiens
IVIKPIDKKAPDFVFYAPRLRINKRILALCMGNHELYMRLSPSLYTHVRCQPDAQAQARAGEAPDSRWQRAYAGKHEQEEAVQHGEQQGDKQKDLTLATTRDGSSTRDDVLDTSTIQSGPQDPRRNATPREQKTVRKRQQHPPVGGLLRDTNGRHGNPATTSSMAREKHAEDRALGKNSLSRPRSGQQPLQNQNKHWTMNEAPYKRKAHQSWPWAHARPIRPGGTHTHGPQPTETLSQEDNHKDIRCHFGRQQIGNEETTMESHDDIRKTSRTHHKRHEINAQLRTHNENTTNTENRGKERIENEQLEQRKSEETQSTTRKLRATHNNTTGGYTNKRKTCTEYEQTAKQRSPTHEQNMRKDTMRHGRSVARAHRNDYDTNPHDATRMEAKENSQSDKGDRHTSERRTRKVTQRRREHPHNHNTTDHTLHRPPQAEHTATNNN

SEQ ID NO: 1009151 - protein, 290 aa, Homo sapiens
MSMCGHRVYHPPGPGCWHWPVARTAPTIVADLCRQSSDYGDLGLLWGTPDSNNPQTGPCLSGVEWLVGSQTSYVACVSCDTPSRARPPDLAGSRIRDGGIVPWQSLGLPKFPGEWTCPLAGSVNRGPEVPRLPEATLHSNLAGHKMATMRDRRPLKEGPISSHNHHIQGAYQTRHATRQSQVIFPQNHGIDGSPETPAAMETNHHSHENGQQYPGRDNYHMHVKMGPGTMAIGDQRTRHMGKWPNVPWYALRKRIEVHMDIVTGTTKNFMVRGDKTLDEQCMSVGCKLGD

SEQ ID NO: 1009152 - protein, 199 aa, Homo sapiens
MPAPPWWRLPPRGPEADASRWARGLQPWPGEEWTCGLAVTLVDSVCASVLCGCGTLHVAVAVPWWVRGASAAGLDQVLPMSCQPPATCARAWLTATTAVSAGQTGLAGRPQGLVAGRPGLGTCPQDGTAGPPQAAETLIENREQLMRRTHKAGLTATFPLRTVNGTWGLHADPVTRRLPQQLQTSLAFQGPHTYEEPHA

SEQ ID NO: 1009153 - protein, 377 aa, Homo sapiens
DQEMMGTRWSKLVSRRKAGTVQHSPTWILESAFKSELCCLIEAVTLVWISYVTSLALSQIRIITVGIKINATNNVCHIVTGINHMMNCPRYWRLRAWHIPNVLNKLRGYLLDTILSQASLHLCKQQSEAIGSALSSLTSPLCCKTLTAPSTTCRSTLFLSIYIPAVTPTCTHTGYNSTANISVLTPYTQPHHIHAHLHNPEQKLAFKNHTKSPYKTIKREPKPTLPDVTIPPSIASDHYHLTIELCSSSTALRIEQHDTPKAHANDPCHETHGYAPTAHPHLPPPTNLACPMKNNTPPAHPHTQNHSAPSYDLHKLALKLQDQLPTPTPTRHLQNTTHRHYTPPTIHHAHTPPPDNHTAPPTHQSTSNTANPPPTQY

SEQ ID NO: 1009154 - protein, 106 aa, Homo sapiens
MPHYNGYDRNSSHGDQSDMGLNKPPGPSLSLPQNKTTRILSSPSDIAMGREAIPQYDTYVPEPLGTHTAFDTRTRAGNYPPFSENPPNGGKMLSDSAVWDHIRTRP

SEQ ID NO: 1009155 - protein, 383 aa, Homo sapiens
MAKRTNQINKRNVRVQDLHAVIRIILWIDVISTFLIVFAIREVTKIYTTGQCTRLDDQKSIVSSDSSNLAFDITVSTEDMGFIVPPLLLEVNHFKLALSLALPLEHDIRKIDTRYGTWCFLFDAPSTFTRHLLTEPAIPSIYPAIILRLFDTPLPCHHFFRSNALSLFSVRKSYDSGAILGYLPSSQGVEALATRIYNFRLANLTGTLTFVLTHDMTPVYPPIQPAFFVKLSLTFSRVNTKPFFSARSTWRRLNIRLRRQPPPVYGTNQNPTSKSSICGPFVRTTKVHSIPFRPNCDSTYGFSPEAYVGGEIRFLYAVLRKIPLLCYTHEHFIRPFYHPLSVPANEMSPLRKSFLRREADIKHTRILQDAFKSCCTRLRSLLD

SEQ ID NO: 1009156 - protein, 144 aa, Homo sapiens
MGPPSTEKEAILRRPGGPCWRRRQKSLTTRAGLGPRPEQQAGAACTPTSFARLVELSCSRDDSSRPCRGMALGPSLLSPEPLCRWSYAMELAVCVAGAGGHPGQDSAVDELCRSFTPWIHGPPGGLGRASWLCSTCEHVIAPLD

SEQ ID NO: 1009157 - protein, 205 aa, Homo sapiens
APVSSLSPSPSPARLLEPCEPAVVVPHVLRRPCGLLLPNAAHGHAWVRMLADTRARYLLLLVAACSLLHALGCIALSCSALTHMPRHRDTLSTKPDACKSDPTQDNAYRYPIHIHYDCAHAHATPASKFTARYPLSAYRTQNPITVFHILATRDPNAVTPRNKVRHVNYTIVITAVSSTANTAPCATVTWPRVATCPVTGSSCTH

SEQ ID NO: 1009158 - protein, 328 aa, Homo sapiens
GKKSWRPGGGLETSLGGFDSFLFGLNFSAITGSSKWWWIGVGGIHIVTPGSWRVLSPTITTFRFESEGFLKLSEQLFKLFTVGVFRSKLEVSPYRVTRSVSHVVGASAISGLTPRKITPRGPFREIGPQTTGLEWGHRTRSTHYTAPARQNDCHSAKQRAISRGRTEPAPPPPRRPPRRATLARTHTSAQQARAPPTPQRNRATTLTRPSVNEAYRNTNVDKTRGHNNTPKAPRKHRSLHTRTPAPHAATERSLDPTKTKNGAQAGGEPARYRDRTQTEQRHCSLPRGGPPKRNKRDPKTNTPLRTYVGKRPTPPTRDGPKTPQPQQP

SEQ ID NO: 1009159 - protein, 136 aa, Homo sapiens
MRSLIERGGAQNRGRLAKRVNREHILEISSASALLVRKHPRGEHSVAWDALEEARQGLGIEVHVHVRIAPDYSRRVQEPGYSPRPQHYPKPAPGKADQAATGSTTEPRKNCGQWGPWAPSGTTNRVAKREQRQGSW

SEQ ID NO: 1009160 - protein, 75 aa, Homo sapiens
ERPGFRGEGLGSDTEPSLLLQPGRRTNTLREMSDVVTDRDGRPAGRECREIGGKYRRRGRRKKPKRAGADGHPAT

SEQ ID NO: 1009161 - protein, 125 aa, Homo sapiens
MPFRENEHNVNGSCRNARPLVNKAKRDHVADRIRSSRSTIAATVVQVSKLHSLKNRDMHQDHSKPRDPEHQWTSQGPASDITISDYDDGRAPKTRITIAINMPLPVLMGTLINQGHHFAFSLARD

SEQ ID NO: 1009162 - protein, 214 aa, Homo sapiens
MLEGFTKRLAIVVSHRDSGKKKVWLDPKGDQVNIAICLSVLVRQIRKLIKRWARSSCNACDGPFPGSDCRNKHLGPAGTGTAHGHTRKRKGTGNARMPEKVTWMRRLRILLPACSEDTVNRKKIDRRHVSQTCTCKVNGECVPKLSGFSWNISQKLNGRQRAARSSMAEQAECPEVKTKEARKRREERLQAKTEEHHSRFYPWREETKKLRTGN

SEQ ID NO: 1009163 - protein, 426 aa, Homo sapiens
ILDACGTRLQVELWLVTPAVYRNNHGSYSSGNLRSDCQRLHSLGECYNAVSSLARQQTRTQWIRRSGDGSADMDEVGKDVHGEVRYYSDVAGGITRVPQARETLSTMRVIDVHLLTLMDCMRMFVVIVRTSVRCLGREHDLSVVLIWRIDSFREICNDVRMKMRDGRKSGELERSRLKYGRCEDTRVHGACQARESLVGTPAFSVVSKGESYQRGVILFVRNWLDSRQSTRYGTAATAVKRKRKNSKPRGKHVHERPAVASISTHALDRRGEPFARERAGLRKTGTLDSGSGPSVQEEHWESTQELLDTWVRGNRTTHLGNRPTEGAERYQQEDHIGRQHPPMNQGPNATRQGQEKRGNNRITGGNTPGAATPDQLRTGIHMRHKKAEDFQHHTQRQRTYDKPAHQTTNGPHGAKPGETTPLQTRQ

SEQ ID NO: 1009164 - protein, 329 aa, Homo sapiens
AGNRYSRTPEHAFRTQGPASTLPDLRAWVPCFRRSDSTAPRFWHPSPQMSKSQAARVPASRIQASRDHGHQNLDLLQSSDIWGHSSSWSQGPHVHTRETLVFPAPRAKEPGTLRTPSVTDIWHTGAEQRSLRRPAWGTSHTPASTEPRNFSRCELNHSNGALPKLQSPGACDSHSVLGNVGSWEGATSRSPDHATQGAYTKAPGATTSMVRRITYIEKSKGGIAQGRRPNRHKRGGLGKLGPVTTSEGDTPKRTQRQAKRRGLNSGENYPGGNPRGRGRTDRNAEHPNTMGIVSLGVEQVCEGTEGGNRDDEATGGNRGQYDTERHQTG

SEQ ID NO: 1009165 - protein, 183 aa, Homo sapiens
MELVEVGDYFTFHRHRVWEKPLRMVKPRRKGRPTMAYLITHRPDSIGLWHGLAWYPLYCNQEQPLPKLRGQPRRHEARLSNTYERRGNLWANHIPGKPPPGQPPETAEPLPKNYGAYPFHKQHGGSWGHERGTKRWDAQGTLYGDPYMGKSSMWPSVGIPMHPGIFPPSMVGACTSFDSPTQC

SEQ ID NO: 1009166 - protein, 128 aa, Homo sapiens
GVTSSCTVEPPGENSGHGSRLIVRVCSNSARSDPEIWPQYDAGSVSVSTRRIVGLSLSWTRCSSFRGLSGVIVLNDKTSDNSCYKNKHVRKNEQIKPKETREGRINYRVREHKKGASQLGVMRASSRV

SEQ ID NO: 1009167 - protein, 110 aa, Homo sapiens
RVAVAPASVGLAETHPFSVAGRSSALTAGPFLTSVSILSRDVCACKTRPFAKKLGRRHLGRNRGRSYVRRWWTSSYDEGTTIQIATMPLEVRTAVADHDVVSGVWCQTFG

SEQ ID NO: 1009168 - protein, 194 aa, Homo sapiens
MRRCGASGSGCARMALSLLPSLRQIVATILPPEDHDGSGDDSDNFSGSGAGALRDITYVTVDPLQLEGHAAPDGYSHVSRSHRPGGYSLTPAPPCRLERGPRRERLYSCQKVEPVLTGREQEGITAEPGRTPADPEHSISAQRHTDKHEPWSQQRSNRHRAHASWQHESSTLRTSKLTSHPKRGWRPLHEKAVR

SEQ ID NO: 1009169 - protein, 61 aa, Homo sapiens
MHQRRKPGAEEKRRETEQEKATWGAGRAMGQQGNRREDREINREATRNRRRGKEQGRRERK

SEQ ID NO: 1009170 - protein, 134 aa, Homo sapiens
QRRGCRLCWGLVLFLSRHHWPPAAAPGVLPPSLDAVPGPLCSARSPVPRGPWVHGATWAAWVKLASLLGACDWCGLRAHDRPVIGRLLRVVLRRLSVRAEADRRPCALTEDLRMSREEVWEMGHWIQSSSLALQ

SEQ ID NO: 1009171 - protein, 202 aa, Homo sapiens
SRYRGLGVATLCGGCVQCDDPPEWEAGLWPLTLLLLIAHSGCPCRALQGMVPRRRLRVCDGLAGGLLVAQECAVSGPHLRLLDVPERVAAVGRRRALPFLHSPVFCALSSASHPVRQLPDSQWTALAINGRQHMDWDTNHEPFSGQPNSTSGDVLLRPQEGLGTPSSSRKSHGVNAGQGQHLTSGLVWRGEGGGTRSLSNAR

SEQ ID NO: 1009172 - protein, 280 aa, Homo sapiens
RFAYPRLIARVVACRGVGGPPKLVSGSVRVLTVHEGWLTPPRRAPDHAAEIGSLREHYVRNGATAAAGAQSGPSYAKKVALWLLVLLGAAGTVSVVYIFGNEPLGGSQDIGEPKDSLDKFRDTVDSKFLGVTSTSQPHRGPLHGSFSPQHLTSAPCTEFRFGSPHAKASISTYHITPRTPSLHGKTRLSLNPTANPQLPPIRLYTGSAVTRLVEFPFPSYTSPSKRLRIQPLQSQPSALRTSASYTATVPRTNNDPIPRTDSHYLTHGPPLHKPPFCYIT

SEQ ID NO: 1009173 - protein, 134 aa, Homo sapiens
MNDPPDDRMSLWRCIGEAEYRPGHPRIGRQSVGDKEKLTINPPAEERPRGPRDSTAVANTRQRDVTPGNNNGGPPSDRTPPRTDRRHNKGHHISTGHPAHAAHHTTTGPMSHANGQEKDAQQHTEAKATQRGTQ

SEQ ID NO: 1009174 - protein, 228 aa, Homo sapiens
MRYWIGGAGANRTKEYGHVEDVVVLASPWPRHVLTCGPALVPGSGLTCSMATLNQMHRWGPQAALGSWPHGRPGRAKGVVLCTFTRKPKSPTQQSQVLSSAAQHWTRGVCFIPGEGHTLQEQQIVLVEGGPHQDLPGVKLTVVRCMYDCVPRPEEVRLGAQVGWGALKNMNLPLLACNKGPPDLAFAPLEAATHGFKSCSALPSGPLLGIGVWGCKGALCSTPLAPCV

SEQ ID NO: 1009175 - protein, 264 aa, Homo sapiens
REEAGANRTGACCYLQAERAAPLPGSASAAEVLLRTGTANGFQMVTSGVHEQGPVSDWLIASVRWRCRVLCGIDLPTIVIVAHYDAFEWPLLSLGADSNGTAVSVLLELARLFSLAYTYKRHARRYNLLFFASGGGKFNYQEPSAGWKDNLDHTDSSLLQDNVACAVPDTVGPWQQPAPARVQGRSGVAPCSTLSAGTETVAGAPVSPKVPVLHWCTHAGSTCGGVLACEHSVRANPPNAGLRLSSLESHVDGSRRSIHDVAPG

SEQ ID NO: 1009176 - protein, 351 aa, Homo sapiens
AVPKGFTVARLGGAAWRGAEWTQVPTLAPCDRVGLRDPRLLATCDQRIPGQHECFTTLLHVSGVYNGAGGDTHRAMLPRPLNVRLECPCRDGVEQPDRDLRPGHQHTAPFFTPCEVPPIPGTPSASMPHRTHAPQCLAFQSVIAQPWPREERAHHSCSLRQPFPPPEHAPGPLEPCNSGILDIPSGKPWPLAPRLFTTVPRIGHHHITPLSSPTPRAHQAQDAVPPSALVGTNPSQPPTRPLHPTLPGTAVTRRALSEHVAHTLSRATTLASDPPATRPQRPAPVLNRSYLASYPTECDTPRATSRMSPTSANCLVLTSSALTSTAMTPSSSPPRPPVRLNTVVDSGPEPT

SEQ ID NO: 1009177 - protein, 344 aa, Homo sapiens
MACCLAPGLISCVLEFPVSWVLARSCSCVVPMLLHACLPGSGALLPCFCCSVLVCGVDASVSIAMPCDATLPACRHLHLVPGWLKRCWHACGFLQTMRTRARSESRRRAQYVLYPGRIFPLQDCRSPRKAKGESRIKPLELALLDGGVLEVTNAKKAEHHGSSKWDLQSRLLRPAESWWVGPDWSHACSLRSQNSPLLTGTLGRTDMGGSQIELTPPRTTGHQRVLNRSTASMSVRVAGTDNCRSMVGRAGEQGDGKGCCLRQAAIICDGTEGSDNNPGLAPARTRWVQWPPTRAGGNTVGDYDILWHSSGVGRTPAYLHAVARFEECRTHEYRKDCGSDGDSC

SEQ ID NO: 1009178 - protein, 444 aa, Homo sapiens
SQHAETRFLPGDAETCTSPPMTVCLYVLSGSSTVPVYTCKEATDVIIIHSKKLNYTTTASVHSGVSCVVWEAPRPPDIDKTELGGDTTEYLVVHLNGLPGEDDSQYEMDMFDVRGGVRQMTWQGYLPQRVHARATVRKRGGQYTDCTLRCPERRSAVIRLTRGPEAATDGALGAKCKPRRKPDRTSGPNKASHKRDAESPRESETETQAGTGHLQRPTSRRHTQKCPRVIAMAQNKRTQNTHATYGVRNARNTKVVCLEHRTQGPEHREGRIGRSDHAERKTMPPVNSDEPAVRSQVRKTPTEQRDGRQKARQANNTGAQHSTPEPKNIGDRTDKPDRRTGWKQLETNVDSTVGAHLTPGDTNGPRPDGEKHRPGGTRRHRARKAKRRTEEGKGAKMDHHKRGVPQQRGRRETRVEHLKGERRNTEGNTAGKSEGRTGKLTRDK

SEQ ID NO: 1009179 - protein, 352 aa, Homo sapiens
VFFENTIVSCIARICKVRRRCGELVCYMQRWTSFLKAQLLCSLCPDDGFPFNCAAVMSFTLSPMPHVTGCCHPFSIVCVFTYPMWHMGELHEVLCLVCVFTIERDVQTMSSVVPLQLSVEPVMNTARWYTCDPHLVDHTPGPWSVASAKQMPWEQDTINSSLDGPQNLLLLKLSQWTTSLNGLGMVRQTCHCIGLACMTPSDSGLPTAGCWHCNSPDYVSIGPLADEKPERIVPYVALGAHLALALVACSVQHNKWPQVRSQVGVPPRVVISEPSHIFEGEMTLAKRFRYRPSYVCDHSARLATEKCLASPLEKNRPPGGAHIGVVHSRAPVRTVRVWSVRVPKGLAHSCRA

SEQ ID NO: 1009180 - protein, 431 aa, Homo sapiens
MNATSGIMAVPDVCCLGTVNCDVCTPRCCCCAPRWAVFKTPSSWRPPGVASQEAPCPASMQLQKLNNQYFNHHPYPQEALHAWICTLLQGHQMNGTNQHFRDCNPRAQLAGSSTPWRLAAGSSEPPDGSGSRLGRAGSRARHEHTGWTVRASGNAARHIARNLRGPNGPPSAIIACLRQMVHKTPPAFYIGRSERFLHMSFGADRNHWRSTGTAIKAAAKSRDSILACVSQAPERYRHSRTSTRCRLSMIATRQRRRQGTTAERGRNFRNAEAAPGRNTLEHIAAPPAQTASISAAAAEFNPRRTQPVARRLQHTRPGEDSSTEYRQTTLMAHTGARSREPGTWHAAHNAASNPDATRPPGTQQIGEHTPEGPPQALGPRLNKHPLQTHLDSKAKEGKPRPRTTHHPPRPTSAEHSERAARRAATGARARG

SEQ ID NO: 1009181 - protein, 326 aa, Homo sapiens
CGADAVSPFCCQESLIRAADGIGARRPCPGPVHSSPHEKPDSIGSGILGGACSRASRARSLKPMNHHMPWGRPWRAAMLRGARPTAATRAAHERTGQSVPMHSGHVLNAVMHDWQHMRWTPCWQRDHPRAYTVLRTRSTRQSLSGTQLYLFGVDGAREMNACPDKHVWSYKLGAIRPGGVNSMTHGQAHEISIKWTSTDFVQGLGYLNVSVQHSEAMAEPKFSSKLKIGPDGLRRPIWETVRVGLPQTSTRPGKRNTTPWGKGTLTMGGRIPCRKRRRCDIQRDRNKRDHQTAHERPKTATDAKKTPGETSPNDRRRAATRSGHRH

SEQ ID NO: 1009182 - protein, 84 aa, Homo sapiens
GLPSINCIAPSYSGDYSRANLGQNRYHLYDLASDVDLAVSPHINYRRVAYPDIAPLQVSLQELSAGRPLLTRRVDIRLPSYIVV

SEQ ID NO: 1009183 - protein, 270 aa, Homo sapiens
MDKWMSYGSVCVCRAHSGEPVGPSNPPVTGDLGMPGMLELHDVTDGLRPSKPPVSHLMSHKDKASNKRRDEEQITRDCMEYPTLNVRWPPLSQGAGHQVTNGAHSSQPTAEENANPNEPNWHGDNINERRGTERQSRRRPDRVTASKRDDRRAQRAERGGKQRSRTPDKRTPEQHQKREAERKKTRTKHERRERTKSEKTRTTKRTKERRTGGKKGRGEHRDTRAQTTATQTKRREEGTSPGGGKRKKKRDRTKKERRGRGTAGREEREG

SEQ ID NO: 1009184 - protein, 205 aa, Homo sapiens
GERERTSLEFYFLFFFGGPKFLYWKEGSNSKTLQGLVWAHNFYTKGQGTPKIELTSDPRVHRGKSSPHRAQRGGKKLRPRRELQTSTLIIDERELPKGEGCTMGTQRGEQILSANHKGPKSREGGIHHKIMKRAEPTRVEKNQRGEEESQPAKKKPLMDGKQMGGNNKSTNKRHSIGNDRTQRITERGAIKKKGSRDKINQKERN

SEQ ID NO: 1009185 - protein, 111 aa, Homo sapiens
MGSDRKRPKRSFGTSRWAQVPLRSQFPNVRTAKPEVSRLDAPQNTAERTISKQVASHFLHHETLQIVGYTTVARIGDTVPQSVAPGYPLRETLYGWRPPLVGRGRRQRRSY

SEQ ID NO: 1009186 - protein, 158 aa, Homo sapiens
VRAWTWDGSGRLSVVARVRTPIQAEDALVLAVLADRASCGFYARHSEFISKRPGVCPHCLALWDRFSSSSTSSSPSSLPRKHSPKPQIGAALSLGVGDREEGFDSTKPLGERKASGHASPWTADNSGFGPEEDTVLPGATWGGLIPLPNFELLSDPEG

SEQ ID NO: 1009187 - protein, 338 aa, Homo sapiens
GGGPGGRSGGGPPGPAPGLTPGPPPRGSLTRVAPACTLQGLPPPRPGMTGPNGWVTSHYGPATPPGACDHAHDVPLTQNTWRLRTCTRNTSVDFQRCQKDGLITKLKNSYLSKKGEKKAIQVTQGDEEFTKSSREEMDIGFVALLGTWRSNVGRDSRDRGAFTLGVRSLAEQAHRSTQRKCNYPAVVGHSLCPKKDKASTQKHTCGTRSQGYPMDASEDKQKLYTRMELGSHTQNDAVRTTSAQPARNLRTPTELTAGIATARQQHRTSSQAKHKQRALTHGVPQPTTGDEAPPDRAQQHNESGPSHELHNHAEYRTLTQKTQAHGRTYPQPRVHTDE

SEQ ID NO: 1009188 - protein, 192 aa, Homo sapiens
MQSVGVVNRLGSFRLALLRRLEDMALLKGVPDVRSSLLTPLDLVAMSIGCLVQELRAHVHVARSDVGRLLTGQPLGGQIVHACSPSPSREAEQTTPCEVTHPIRAWVDFVRVQLVVVALESGSRVLDYALTEPQVRISGPEMRNRAVNASYRGSYGLRWTMTIGYNATELSGYRKVVLKDIEKRAKAHLAID

SEQ ID NO: 1009189 - protein, 250 aa, Homo sapiens
KDPSCLEGAFTGGRNSSGVKRSAICIQSWWRGTLGRRKAANEERGRYMIIRRLIRGFILRQAPLAAPMNAFFLDHVRSTLLCVRPEAELPRMSWTPRGPSHPPALREASELLRELCIKNMVWKYCRSIRPEWKQKAEGERAWLDEIFKGKKDNYPQSVPRLLHQNIGLVTDEIRTTECYAGLWALSPFSMRMPVVKYDRKGYKAYDHGRCCSRPRPVSNREATPNAKQRTRLSKNVKRKSLYSKTERTDI

SEQ ID NO: 1009190 - protein, 122 aa, Homo sapiens
MGQGGSPPGKFFHSHPQKRTWGPGSKKTSPKWYFSWQPQEGSTWSKERRPQIATVHWSGIENQGQESLKDRGTPHNTWRQLSLGPQCATSDSRRHSPLGDIFQTEVVTPPIWTLSEDKGLRM

SEQ ID NO: 1009191 - protein, 440 aa, Homo sapiens
QRHEPPVPHDNGGGTMTAKTERCHEENKPPSRHAGVKGSSVSSGQMCAGSDRLRKMRHKSRSQGEVGEDGWTVPRPWSEAGDLPVRSPANGSHDIRQVVQQPSVVPRRLYRGDGTLCGATRITMGAHCVRIRETPRVTDGLFVGGPGKAKPGPCVLQVAGLDCDVEQHMTGPKHEVWLEILENPLLQELAHSPRRPLATPTQRMVRPEMRQHATANGESDTRGETTRPSDVGASKKSSSDQTSYDGHGLVRTAEHQERVRQGETRLCADLSHRPNGGPPSVAMRAQRHYARSSLLVTRRHIPGRVNVAQEVAAGPKDQQNRRSTEPCSRLVTCAATRQHDEALLDVGNTTGAHSSVSRAHKSGVLNSTQSTWKHDSTDDTARSIKQQKETPTRLDTRDLGLVRRELKCTISSTHCGGFVNDSSAIHTGKESGNGHSDTVV

SEQ ID NO: 1009192 - protein, 355 aa, Homo sapiens
ETPEALGALQLVCVRAAVSVTALPPGSRRSDAWWWRSANWPAPCDVGGCRVLVHVPSCGAAWCVCVVPALCSAALASCCVPLARTLLPVASLLLADALKRRGSWPEIWLPVTLGHAPLLSRTLWHRQPCALTSVQAARQRGRASMGAELLLAGLRPWDDPVVSELLENDYGRAMAAKEAETRTGFRGQLKPGVPARAKAAKEDETSDGQASGEQEELAPRLPKQDLKWGSPLPRICLLVQLGHLQAFDLVKARPWTWRCPVYETGHNGRPALAQELRLTVIYRDLCERGSSQCGLQRPDVTSWFNPGDPFGIHANYIGQCGPGDTIHFKNLLVLAPLNQGRRPVLCIEADESGKL

SEQ ID NO: 1009193 - protein, 79 aa, Homo sapiens
MKESGDIKKREVANEEGGEKRERGKKSDGRRKREEEEEEQKDKEKRRDREGERRRSRRKEKRTRKRNTQCSRGVQEERA

SEQ ID NO: 1009194 - protein, 373 aa, Homo sapiens
VGKALARAHTLWSIREYHTGERLYVCNVCGNDFIHYSGLIEHQRVHSGSTQALQMCAVWARRFVHSISTCIRHPESTRPEQQDLFAMPQAVWAKAIQIRAPSLHLADPAGIRPRREKGAYASANEMWAHPSIKAARAVHSPIIQHPTQQVQTVCKCQRNVGTGHSDKFAIRTLYFETNQEKYQHREEKTPYECQMTQWDNDRSISRKIQTHPVTKDYRTENPSTLAAEAGTLYRYRHTRTVVRRQSRVYTRPKNSEEKTMFDPHDKSTARPVSTLLATDDNHSSTENMDQTAEEDCKATKPISAYYQRRGIAPQPLQNNSEPTHQGKTTRTQEPERTDEDRRVNGQGVTGHWVGGNTEGRNATEKETQNNPPS

SEQ ID NO: 1009195 - protein, 145 aa, Homo sapiens
MARLEKHASLQGIVVAPLAWGCNALLETPRFSQWAPTVGKWSGILWCLHAPPCYAQQRFLEHKGAPQGGFIAPQNPVGAPSNFLRYRNRFDLLQKIVLVTITRKYCPVFFTKRVYQKLGPRCSTTKTTVVFATHREDPCVLQERT

SEQ ID NO: 1009196 - protein, 226 aa, Homo sapiens
CAWPDVWGAGVWPGWRPLQSTELCPGGGALRCVQCAVRSEACLVWCEERPVPWAEWPCPVVCQQPCFQPPVCASGTLEPSGEASTSLGLQHTLCCTSCPAFGLHGLLQTTLPGAHCHHLAWRGPRYYSLWSPGKGKVMVACPRLGLSYSKSLNPGTRGHMGLPDLLRGLPGVAVPQGATGCTTPGTQVARDLLLLDFGGTVQAIAVPGWYAGCWAPVQDGTLVGPR

SEQ ID NO: 1009197 - protein, 369 aa, Homo sapiens
GVLQCVPSGTGWVGWAAGARSRGAVLVLAKVDMLLLGGLMDRLLWAGSSVLPRSSVTCCCLCLTHADVRGSCAQSLAPAAAAALAVLLHVLLDMLLRCCWLALMGCNGDMYRQLIVQQVVYDNQGRPSLEESLPQGLKLTFLDDKRQGKFQGRLGAAFRRELKQQVASVLPRRVLAGGSTEGWSLQAAQPDTALSNAGYTSVRGVRTRAASSMRDERCECAGQRHPHVPRHSHEEQAFRPRARLAAAHHAHLAPTWPVIASQANHAPCQRCGEEGGSIPGRQDACATHVRRLEHEGRVRAFGTLGLHQAGEHIEEPGRKREVIYERWRPQAVDQTRQQSYHTKTEDWLLRAACWATSHSWVMSKADAKA

SEQ ID NO: 1009198 - protein, 171 aa, Homo sapiens
DPGVRPCISGHDAIELTVSVSPQLQDVDKHCCRYCCCLAGPFVAIGRLRWPSNRLHMLQISYIPRRPYQRVVPGATAFVWGDTYRTVRVKAHDTQSLERSIQADSHPGEVAPEELGAAVSANEVDPAKLAYHGIRVSTGPSMQTWMSTTETDALDLFPLGRDSGWLSLRAC

SEQ ID NO: 1009199 - protein, 103 aa, Homo sapiens
MEEMNAMLGRRRKATPVGEKIAQRMNLLNEEPEARVPDPECNLCGDPGEKNEQAERCLTDESLHSYQDGPSFAEYRECTCYSAELHVDYSDLQRVKRGASGKR

SEQ ID NO: 1009200 - protein, 320 aa, Homo sapiens
VYVPPRWAALLYARLLALDMCGVCLVNTLVGPAHHPHDTLACRALAAPGMPMSGLHCVVRVWPAGRALTRHPHTSALDSRRHLDGSAAARTTGILGPGELGSWRSRGLHELHNDHMHNHAAIEIRHMSRLAFGEDLRVHIVTPQILTHQPPRTEPRATELSHYHGRDTTSRKDKKTQLTPNAHDSQLRDTPIPLNNKRTQHQRRIRQTDERREILALNMPRHTKRPMIPPREQRSKARTKEPRTMTHTKEKNSHNKRKSNKQTQGEIEPDAKNDEHSRTNRGTMRHPTEQNCQITKTYNWTKVARPKDKREDHHRQTTTG

SEQ ID NO: 1009201 - protein, 147 aa, Homo sapiens
SATGTKMEAFWGSGSEFGAGGPAPGKFNQISIHSANSFSGLRASCTFTEGSNYTADPETPMCVTGNLSPSGVKFKGEGGELPKNISWNSIGTSLGPRFRKKFFLAFSADLNKQITSGWGVPSWAEIRREFLQLFGKAKGSLRAKKWV

SEQ ID NO: 1009202 - protein, 179 aa, Homo sapiens
MYAFYSLLIYLLLLSLFRRDGGAVAAAEPGDPAQRCPNAPGSLGALVPARARVCETETDLAWPASSEPEDGSEGAAEGRSAAVSLAEALLVASPSFLSVQTGGVQRCCGVPGGSWVLVWRGSPSLLIDVTSTGSWALLVMASDSHQRGGSALLQGTSVLVLLGSGPPSPRWYPTFPEKK

SEQ ID NO: 1009203 - protein, 140 aa, Homo sapiens
MSVVGRCDMWDQVPRHLLRVCVCVCVCVCVCVCVSASEALSSLMVSELSNLTLSLCVSTYQLLPRVRVCWTTMIPLSIYSPSPSMWCALNDEHLLSPTWLSSHESADTDEASVYSTGPLEDKIGIAYAVPRPTTLITSSQ

SEQ ID NO: 1009204 - protein, 142 aa, Homo sapiens
MIGGIPVYSILGPTEGYSNRKTGGTLKQAFQQLRNKPILPVHHVWKPLGRGSITTIGIIQTHGYSERVLLRWAEAALQSTEFDVLGHSITLVGSNKQTEEYKNTRCNREPPVVKRISRSAKRQENSRPERLSRWYKYIVSQH

SEQ ID NO: 1009205 - protein, 243 aa, Homo sapiens
YFTVSKNLLNKKVGSRFSFGSLGWPVGLWHASTFSGPLERTLGLGVAVRGSRGAFAEIARYTFSALCEDPESRHSCPQPLRGSSRGPSWVPKGCRDSCAPLCPVRICGLLGPGVVQRRECATLPSHVGITLLWTRHIHRVSVPRKPAAVMSFPGTESFIFRIIRERGTEGGRLVRLINNLFNTTGSNVRSGYSWAKKPVELVTQAALQVRYPGSGGSLRQNHSDLDMARCPHPMMGAPCSGGD

SEQ ID NO: 1009206 - protein, 319 aa, Homo sapiens
RSHFGFLTLGYWLTVYCGVLRAIMSVLTPLLLAVLDTARPGGSQCQRCQDPFVACRRGSLRILGIAPLRLTSCFVTFLPASGLDPVTAGTMLQDGHEERGPFCPSHCDLSQHHRPILVIVTAFVAWARLDHVIQFQSPLLAIMTFDVSMVTSLGVTDPAWWGPPCNQLRIYFTTVNAQTKPSTFPGVLNFPVRRHTDVPGHWRHGPLRATLTQCAVITKSRSQNRAGISPFNVKPTIHFAMTPRLNPCTFTATSRKNDAHDHKTQRADGAAQIDQGAPNCTNPVPDTHKASDHATMPRKHAANPPMPPDDPPKQARPTG

SEQ ID NO: 1009207 - protein, 266 aa, Homo sapiens
MRTRQQTDTQSKRRTKKPPREHTPTCKPPETAHKITQAQRHARRRPRADNSTPCEPIHNEGINRKDIYTLKETNTTEKGHTTTTHAYIQTKEHHRSNKPTSDAEQTKQNRTEQNSPAETTSQNAKQNEKTRGAQGRTMNDNTDRVQARDISYAHSRHEKRQTKEHKNKKNNIRKKRQEHSTYNDTTGQTNTTNNNRYYNRRTETHKHMRRQQTASKATTKTINKDNNNTREANKEENTPRDRTDTSSNKSHEQNKKRDRRSEKRDR

SEQ ID NO: 1009208 - protein, 312 aa, Homo sapiens
ETSSVGWRLHVCAGKAEKRQFGTCRAGHCGCRQKKDFPHGIPECGTAALRFTLMLPWSSGGRLATVSHLRSRRCTTLSCNKIWNALRFILNAFGATFCATELAEALISLTPTVDALDPDADIDLMLPRSVSGGIPHPRDHRSITHALYHFLAFTKLCARHNLDGCDDPCCGTAPEPTEGTHIKDPGNPMGLNIRSIQTPGTQLTRPFHGVEGIRHRTHSIETNREPKRPGNPPDHTRETHEKSTTKTNPAHSDNQQTTRTRRQQPGNEQAPNNPPDTKTTNSATQKRQQPQTNTTHTTPPTDRAHKEHCHQK

SEQ ID NO: 1009209 - protein, 155 aa, Homo sapiens
DALQAHVLGGTLTVAVGGVLVAALLVFTVALLVRGRGAGNGRLPLKLSHVQSQTNGGPSTLHTKVPPCSGATLDLVHASAAASSETWEHARVLRFMPVQPEEELWDPTEPPLDMGELARVARDAGRGREARGPTACLEARVWRCRHGHRGKSITS

SEQ ID NO: 1009210 - protein, 118 aa, Homo sapiens
MRVRHVTYIRLRSTGDDILDYIHNLNALIMAEGLNARIPFVRYTRSLNVRRSQSVCKGDAIQPMDPQNARTDAYTYRYACCEEETSSAHLMVRPTDQMSKHCDEGEQRRTNRLSVAIE

SEQ ID NO: 1009211 - protein, 362 aa, Homo sapiens
MMYAQSKGSLLRCTLEDDISGQAQHTSSTIEELCTDSSLHEALVCIHEEILRTLGIQLATDVPSQLRPCSLICSSSFVMLLPGAKTRSTGLLGPLFMWVEQSGKPASKAAERTCEPSSRSTTLRDTGFQKPVTIVHQPSGDVDFLQLRIAHRLRDTLQRDHTALLRTATVACRDTDDIVTPRTDKRVTQRRPRRLYTATFTTGRHSRTLQRVTFILGPFTTDDGRHFITHSSITSQPYYSTGRRVLTSRQMRTHRSNHERHNDSLQRTSSCEGDLTLVDESPSDTDQRERTLTSEGAARRQHPIRVTTSGGTRTGNLPRIRDQYHTKGEVGQHEHEGSDRRTIGHDIKTTLGSIHRNQNAQA

SEQ ID NO: 1009212 - protein, 178 aa, Homo sapiens
VRRGWRIGQVFSLFIRQVSPVLAGQDWAPAAVLLVLHLPPRAPSSPALQPYRAGGVRIRGPSRCPGPTVWMAKPKWTGQLQTKKSSDTVTSPLIKSSRIRGARNLGKKAQLGDSRLSPDVGHLVLTTLCRPPRPWLAGDGLKAFPEGPHHRGSAEQPPGAWLEASVKPGSSTVPGNPV

SEQ ID NO: 1009213 - protein, 422 aa, Homo sapiens
MVPLAQKYTLGDLKFFPKITTSSILIWKHFDHPVHTIQFPRRKFKNKKWPVVPPFVGSFGHSGVVSSFLQRGLTDLVCGEVSGVRQSPRPLWAPLWQGAWEIHIAVATRQLKNYVVLTGTRSITYEKGVSLDHVCVSPHTTNTLGEFWGEPTAKSVQIHDELCSLRTLTLLFLYQRRKKAFHKWGVCVGCQGNSGNFDEGLLRMSYGVSATLDGRTCISKHSTWGRNLRRSVLLLRSGGSLSGEIISIKLWRRWCLKPPLFTTAGALWWVQNKAGGKSWEQHATQGRGIIPPYQLVVGPRSRATNSPQSVVGDDEDGPLHGGTRTTSAKPARMKGTNTAMCISAKEDKRGGRTKTRAAHHNPAGGQKRRRGMKATRQLGRSYTNETHNRWTHAANKHAQSDRQRATHINDSSTCHPPVGTHG

SEQ ID NO: 1009214 - protein, 335 aa, Homo sapiens
GENEVLQNVTCCLAKADKDEHWSLRTYGSSRVTRTEQSSNSCRLTLSKHSSLEGSPCKSNGRRIRNVVEPEGISTIETRPASSGGYVMGSNAQEAESRSPVTLSIDLAMIDVDKETSWSYRADRRMLGVINSGTYTIQDLQETDDREEKLMVPEEPSGGTLGRVHKGTGPINAALHLVRVHQGGESERYVAGCRAMLGRESSYNWLAIHTQFVGTKGDSYRQRGTMGAGAHRTGRGSGPAHGIGIFLRKMVPRGNKIPESLCFGSPPIQKFVGALYTKLGINYYHDSKLCAAKRRDNTTTNHTRNTLTEQEARRRIISTCSDDAQPSSPHGDEQQ

SEQ ID NO: 1009215 - protein, 233 aa, Homo sapiens
MNDIRGQRRRGRIRLRRSWQTLFCALTATVMTLRRSLKQFAFGAHAQKKRRGALTANRSPDTATTPAGLRAAQLVVGRCPPPTMASWNNCGQIGRWCQMSSGLALPPERQATLSASCSFADDSPDENRPIHAKLVEPMGWQHGATYGLTVNGVTSPDTKLWEKSGPPAEEAPYQRRPTRIELRCHPSCLSERRGTLRLKRGWLWETVVYQVEVERKLLTVDSMVAHHSGRCTT

SEQ ID NO: 1009216 - protein, 184 aa, Homo sapiens
GRQRYSEVGSWHSEVRQRHSEVVQRHSEVGSGTAEVGSGSECRQLAQRGRAAVQRRSDSVLRCCASSCGTLTSWLTTATHGDLVARARKAAAHKRNDMTQPVEFETSEEVDVTPTFDTMGLREGPAAVGIYAYGFEKPSRNPSKRGNQADHRKGEMSSHSLSPAQEKQHLQYLSPPSVMAYSGS

SEQ ID NO: 1009217 - protein, 252 aa, Homo sapiens
YFSPVFPADDAVIMKEIVHLHVRGSAGNLNRRQRFGTRDQRCRTASDLQQVTYHGDSDLQLELHQLCTINEATVAVNVRAPSPCSLDLVAQATMDSVSARGTHSGQIFRAVTTFSFRYRVSELGNNCGPTGHYYEKARTWWTRVTGCCDEMDWLKSCDCLLGFPRLTRLPELRRGLRSADGRNPSSSAQILEKERSSLVHADSLEAMCLLMVALRPGSCRTTAGWQSRILALPPKSTNIVARQQTETYCSAP

SEQ ID NO: 1009218 - protein, 243 aa, Homo sapiens
WDHIEVSDDRTTRRTPSIDTASLVPLAGIRARGWNACEQFQKENGGIWTGAAAEVLIRPEVAPVGCPTRDILQMWTLRVLRPDVAGQVARKLVEGGPFAIGAPKGPPKPKGTGQNKKGEGASRRSPRGNRHTAQIAFAALGGMKFARATKENRGKGKDRKCKLPPQFVDSIPRFGENRNGGQFPNGANNMGHPGAVDFDPKRPNRRAKRPTNLRRSQATFLNPPQNGPPPWTREPSATTRKQR

SEQ ID NO: 1009219 - protein, 219 aa, Homo sapiens
GRRPSALWDDHLGTHDCFLPHLRDELFKQTVIQDPMPMEPQGQKPLASAHLTSAAGDTRTPGHPPPQRFHLSWGPVTLRSPESPRAAAAAPQDHQWPQAPSRLSPNPDGPTPWVRPTMILEPWSPHCEVGRATMTLAIILNLAHRGHPHQVPLLEHTPAHRYHSPTLRSTKAGHSGDQDQCFPPGISLNPTFGCLRATKALQAKSELVLLHLDGDPETR

SEQ ID NO: 1009220 - protein, 360 aa, Homo sapiens
SLQQIPPEQPEAPMSTPREPCPHASNQSLAGLPLSALAPHHGSSRHHTESLQLLTGRGSGKRGQEEERGGTYARITGRGQAQPGGRKTATTTRRHTATQQGPLTNVTADNRLGAPTKCAQQSANGLPPNRKNPHKPIATSTNTAQSQDTRHRPVAQTTPTRLPAQNIKRREQPITLNSATQKHTLNATREDGSRPRQPAPAVQQSTREPRPHTIRTRHITPHRQPKPASHSKPRRQQAATNGKPHRGENDKRAAAINTGHTERQQESETTSNGPIHQGGTNTDTTRHQEGKESDQQPNKREERTTSGNNKPKSKPTRKSRGEKKSGGKYNGKTTVETYADRTKHSKDNSLDVQDDEVARE

SEQ ID NO: 1009221 - protein, 121 aa, Homo sapiens
MGPGGLVFIKTPLMPELTKSSVTRKGLGLGVPAITQNSASQFASTSPPLPRSGDRGWLGDMGARGGSTARQWYELPHWRVPRAHQRAYKWLVRPVGVQLDCRILNEALAESRSRLGILCGR

SEQ ID NO: 1009222 - protein, 386 aa, Homo sapiens
HLLHLSSQVEDSYNASAVLFHGYGQSAECTRDHLWNELENSRTRQRKGSRGLLASAVPPAQREVQSLTKKRMSYTAKMTRDKTTAGIEESSSEKYLRDYSHEITELHPSEGSQFSEISHRYDKNAVVTSYAQEELQAGKALLAGMKLTFEPPGYETHRRFPRGTRTQLTTGDTDRNATKPFNSAESFRALRRTSAKRNQNHSQTEDTYIKRRKLEHKGQSPKARTRQTTSRETYHQKRIGDKTSNKKQVGQNPPKQSPATGMNHTRKKRETQRRNSGGSRHRRTTRTRTPHKEETHTGNNKNGRQSNQQKGKKVYQTKKTRADKHRETYTRHTPDSTQETTIHTHSRNKRWSKQRKQRQKHNMDQNNTRRHGEKSPTSNNKTRPGK

SEQ ID NO: 1009223 - protein, 209 aa, Homo sapiens
MLRTDGQLGTQWRLTTDGRPTRHEDQNGGDGHEDGRTDHDTVTGDGHDGLDADDEAAELSYGQSGQLQMMRMTMIDTKKQKTDEDDYDSKKGTSSKLKKKNGRREPIHPPIPVSEIYNVVTLRAREARTRPTRGPDANREMTRDSHNRPNRKTMTQLCNPRSQTNKKKTNTNYPQSPPTYSISFNTYQSYTPTTQLNTTRYYYNISHKL

SEQ ID NO: 1009224 - protein, 130 aa, Homo sapiens
TTYEQPNPDFPNFPPSLISLVDPNKKTLIASIYVKIHGQIHLYNRVIVLRLGRNIQCAFNTEASSLIVRTRHWNHATLDEPEHRPLSFTTQHYVHPIIFIPCGQLFGYDGSSHRNFSSDGYTRHLETQDD

SEQ ID NO: 1009225 - protein, 267 aa, Homo sapiens
GSGAVPGGCALPGGWEAAPAAATHAEPGWLRWGACLVLCRAPWLQLVRGARGCWELLALALWWDALGLYHTGAVALRARTSTQSAPAAQLSLSSRLQLSLYQYKTCPFCSKVRDLPRIPCPCLPGGGGEPCAQGLRSRYSSYRQGAQSLVTQEGRKARKQTEMTPSVIISALKTYLGCRGRPLEGDHSTTYPGPGKACDTTHGQQKVEQSSAHKYLGSVLHTRTEGPSQSGIGAERRPEERTADSKLLHNRKDITWYEYTSVYAQRR

SEQ ID NO: 1009226 - protein, 125 aa, Homo sapiens
GRRRTREMDPVEQIDSLIELSTKLHLPADDVVSIIEEVEEKRERKKNAPPETPGRGAQQKEKKQGRRRRKEQRGGADTTDDDEQEAQKQGKTEKGEQKTGDKHRETTDKTEKTQKDKTKTKKKHK

SEQ ID NO: 1009227 - protein, 229 aa, Homo sapiens
PGSQVTMVQETSWPSPRVPPEAAAEHWEEDASWGPALAWRVLVPFARTASRQLRGLRCPSMRRVPEQEDRSGTTSTCSTQVDHFRFNRAALINRWDFLAEQQQHRTYSVTMHRTFDPCYPLLNHRTRGLLRIIHEAWAHSHVALSTGSVQPVSTTYNDLTVWLRNSLHCVSKDSTYRACANWGMVPTRFRVVPGGREGTDRAFLPGRPEREPCGLHAFLPPPRRNHKLG

SEQ ID NO: 1009228 - protein, 251 aa, Homo sapiens
QECAQPSCRLKAMQLSLSPEADAEGTVCLGDDCLLVPYATGGVSESSPVDYPVDLTPGEIRCSGHPREQTDKPVLGELVSSALETRKVVLGGLRRSRDEALHIGGRQRDQRSTVPERSLHVLTLDAVTNEEPKVVGLGAQRSANFPRSLRAPDIVGTVGTAWRHRREPCKINITVCVQMASFLFWGHSGDYKAYELWPQNMRTFWQTRRERTAALLTTLHGRAHLTTLCGARGAHTEGASHAHHLCAIMAR

SEQ ID NO: 1009229 - protein, 158 aa, Homo sapiens
MAGFLCSYCITGQKMPLIRSGYLEEEPGQVNAAVKYAHSDVGYAHIAVLLSTGNEPEIGEALKEDVGPGKAVTSGGAVSEIQAVEHKNQPEDVEPASGRHRGLTVQTWRYPGTCYPECSDLNALIAAGATNTFPADLLMGLYATDSKPINKGRLGKAL

SEQ ID NO: 1009230 - protein, 186 aa, Homo sapiens
MLYPQLEPESAARETLVWVLHTGVSVELLIRETCVNTVSYPKVGGQVASRYLEMASNGGLAQKLPTGCAVHHPGADQLYAVHRNTKHTTMSQNILQDPRVAENHIAKSAPSGVPAEIQGDTQATKTPKERTLNTIEEKGEQDEGGHKHEIHWEPPQQVKTHQQTSHIGGRNQKRDKERPTRGPREH

SEQ ID NO: 1009231 - protein, 160 aa, Homo sapiens
EQIRATIERDGYAQILKDLVWHCPGHVLVAPCDCASGTGRTSTDRWEKNTIVIVSTTRNVHRCRQTTLDPEDPMPVVTILQVALSSCPCDRFAVDTRLDGSHPSSTGLTLYCEQRHRPMQDSTACEAHGIAQIEAIPEKGVTFRNPGPCDNAYSRQAHAR

SEQ ID NO: 1009232 - protein, 66 aa, Homo sapiens
MCLHEEHPQRMRIGDECSSWGRVASVSAVRGALAGKSSPQASLGRRRESLNLGALIPQSSTRKSRR

SEQ ID NO: 1009233 - protein, 176 aa, Homo sapiens
ERTSLGYIDFYLKTCSATISLLTLYTKGRGGGAAVEARPKPGSQPGTGAALEKRGSDGKSRDQGRIGDAGSDMRLGRSQRFRWRKRSPRDKNEPAHRGRNKTRAKSSRRRQATNEGAQTTATTSKHGDQRHNERAEKNDKPNDDHEHRPTRIRPKAIKPHTTELTRKKETRKRNEI

SEQ ID NO: 1009234 - protein, 144 aa, Homo sapiens
MAEDTQWGESEKPIVLKRIVAMLKRSHCPITSQEPWISFFLEKENRAPWQGALLRRTFQDTQRHWQPQQHSVAEPEDESSSKEGELDAETWTCLTKVRRYLRRLEDHWALAFTPPQAGRYCFGFEGLWGQKTCSGVLASGGAHN

SEQ ID NO: 1009235 - protein, 115 aa, Homo sapiens
ATDLDQRIDKCRVSPTFRRTDASTMASTPSYLKKVISYWRNEFDWIKCRWTILERDTLTFKTETFERAGHPLASNVKPPTAAAQAIPQKPVADRWHGVTRASYLAMLDRDHRRAT

SEQ ID NO: 1009236 - protein, 117 aa, Homo sapiens
VRIFDKAAVSAVFSEFRNAAKDKKKKRTLEMSAKKDKDPVNNIRGQGQKEECLSKGKVRDKLNNLSLVWTKSTYDNSSVEEVPNYKLYNPECGGSLRRTEEFEALPVAEGSPFEELL

SEQ ID NO: 1009237 - protein, 180 aa, Homo sapiens
TGGRLVVATYCIDEERTVYTLSVYDIRHRTVMGRIATYASGLEGGQTPIAAEIETFYATSSRVWHVFLGVSLLHTFLLILEYTWLEAVNLPTSVSSEPIVPEGLLGHKSRYCTDHYTAKRMARKNCLVKNLDSCGDLWVSTSTICSDTTGTLTHNRMTVRPPCGFDNQIHEADTTENQTW

SEQ ID NO: 1009238 - protein, 209 aa, Homo sapiens
MELTPTDRCGWPSSKVLVRIVKEYQGMWTYWVGYAILDLDHNEPRLPIKIKPINEDNQGVGCKVTGNKTYIRLGSVTMDTGQRFNRRTEKVKSERYIQYPLVEKEMHGQAIYVFPSNGDVMAKRYGVGKRSVEHFESPWTTHLNISMDGSIYKTQPILCNSCHHYCANNTTMNKKRKKDIEKEYITETTCIGSGRYTSEYNKEEKCAHT

SEQ ID NO: 1009239 - protein, 96 aa, Homo sapiens
AELSNIMEGNITLVALSCYLLSDTTHLGMHRSTSQSPAALCEPRDVKSIRWSHRKRGLVPCRHGPYRHCQTLSNAWHVYNNQNQCAVVLSEVQYTV

SEQ ID NO: 1009240 - protein, 134 aa, Homo sapiens
LPIRITECYALIVNAVLTHQWNESRDYDCRIALDSSSVEKFLTLQSILTIDSSSDSVSIRRMQRYIHRGRPSARSSPFTESHLNNRQSKVRFNSPLAWKAIRFHVLNGPMWRTHPNNTIHSMASLPTTIEGRGS

SEQ ID NO: 1009241 - protein, 135 aa, Homo sapiens
MYKPSLTPINTSFNKEPLNTLASSTITLYVTRPELYLSSIASSTMNALYQIANSPLCLERHSHRSSIIVFIDSNLVCLMRVIHRMHSDHGMHPNLISYATDAAALGEVSEPENDICTIESQPLSRSVSTINELLK

SEQ ID NO: 1009242 - protein, 224 aa, Homo sapiens
DLAQLPLAPVLLLAARVLRGLQCGGGDVAGCPPAHSPVPDPPLRYGAPTRAAGHPEPRAYQERHIQQSQLIWTNFKHIARFSSNIDLSHQPDLPEMYADQSLMAVLVGRTGASTTLTILAALAETRRERALAWRPFSPNQNPSGPFQLSRDASAEPGYRAREPSNLELHTDETPPRITNTWEKNESAMTPHRQGNVRPTIRRRSETNCETNQPHASTSEMTTVA

SEQ ID NO: 1009243 - protein, 283 aa, Homo sapiens
EGAAALRAGPGLVGLRPVLEPWGPRSPVPEPTVRRLRCLAHLVRLRAPFSKRRAGPASQASGSVAIFLAWLGCLCMAAGWCTCTYSSYSELLSLAYVCHGGLFVTSTGKGIISGSCLPVTCVSCIMVEWRTCLVVMGPGPAGCTEGVWRDKGCNTGSDGTLRRAIESKDPARMRLSGGSVVHDWNKGGNQRIAHIQGIPGRMSDRVPQGESWENFTFTLTGRLGIYGQWVHCVNRGFDLIQQNGNQIREVVTNRARRKVQKYTEMDRTLWTCNEVNRYFHCID

SEQ ID NO: 1009244 - protein, 174 aa, Homo sapiens
MRAPCHPQSGDLRTTPIPQTTAGYISNNSPPQTQPPTYAAISNQLIKITLQIISITHKSYTPDALYNTILWSIRNTKTRKKTPQRPKPNTKNTTTENTQNNQRSTQPHTEQQRRETHRSTNTQNNQPDERPGRGDSGATSHKKEGRGQEKRGWSDAVTIETRERKRHAEANERE

SEQ ID NO: 1009245 - protein, 237 aa, Homo sapiens
GSCHPASRPRCQEVIVFGRSCWSRGTPFPHGSSWVEDCNSCLLPGCACRDCSKVWCGWKPCLAGRASPDGPDAAQCPPGCKVCLDEGPMCHAVLPEPNPCEVPGVADVACCKKTPPSNHPFLHNWLPCGDNTFGEQHVNTHLVWPPWPPFNPIIVPKFFQNPLRWKPPTHGFDRPHIDHPAFYINGPPLCTPPGGTPPFGPFAPQGATSPFELHQWGPGLRHPILVRNFRFVATRTK

SEQ ID NO: 1009246 - protein, 230 aa, Homo sapiens
AGPGPPRSGEVEPRVKESRSPAKEEAAKMPARASPPHSKAAPVRREGQWSELLVEDDGLLMPPGWAGVHPVAPAAQAWAASAWARLGFAVWSLFPARPWKLAHRSTALSPDSARTQHGHREKRTRTHTEVEHNDREASHNINKKHRKSTNEEKIKKNEKAAARTAGRDRHRTSDASQDSHEKAKHATGEKTAQEENEEDDKKTTNHKKKKNRKKTNDDTNKNQTTTADKK

SEQ ID NO: 1009247 - protein, 160 aa, Homo sapiens
GAVALPFYNQDHEKLCELILMEEIRFPRTLGPEAKSLAFRAAQEGPQAEAWRGLRGAPRRSCRRIVSYVARVIGDGQSRVRERTASAHPSSAQVTSETDTRYFDEEFTAQMITITPPGPKDDSMECVDSERRPRLPPVLLLGQRYGLRRRWTALDDSLEG

SEQ ID NO: 1009248 - protein, 188 aa, Homo sapiens
GERTSLEVCFVFFGNFKIPQKRFIIQVSLESQGAYRKDSGYRARAPGPPNFWDSQATRVSYQRGLRSYRDEELIEISFSWESLNPQYSRDNEAHRGLWADSGTVTAYAENSGAHVVPTNALCNGRDQRHVLTPSKKCVSCARRKSPEMGVSQPASGLTWFSAVCGGFPNSHYLPRGGRPRFNLCIGEP

SEQ ID NO: 1009249 - protein, 80 aa, Homo sapiens
MHPVGHAPATKPPNPRGNITRLAGAPRTEERADPYDQPPRETTQGRETTEGDRRHEGDAYRAKRHKAEKRPRQTMCGEQS

SEQ ID NO: 1009250 - protein, 340 aa, Homo sapiens
PHLKRLREAVSSGVSAVMDASAGSAGTGLLARSNEMGVPVVRAGAPESTLGHALCLGPSGADIWGLGSCEHVHSRVGDCRSNDPGEYNRTLSHGGNQDQGPPGIRFGRGYGGMGKPACWNSDAGGGEQRILAHLRTQEDSSEDLELECQYERLRTRLHGKPPGRPLGKTTCHANRRPRLSIGRATGVIRGDRLLASRVHLKGLGVARVDCTWNNETGTEPAIRGECRTKCSKTVARGPGKGANFGQEAVLLTHRKPGVVGKGKLYEPMRDKYSGLKPLIWGIYTTVNLFRMLKHLSVVVSPWVTTPPEVRGRLDSLRNWIGGITKAPFDKPPFPWRWAPG

SEQ ID NO: 1009251 - protein, 212 aa, Homo sapiens
MGVPVAARAPESTLRRLCLGQGADIWAYILQHVHSQRTVKKIRGNLLWYGHQDSPQVRRKLELGKLAGGTRPGGPKIPGNLGPRAVKRVELRAEDIVALRDSGPVDAGSVAHYKTPKRRALLLRAQAGAMRRQQHTLRDPMQRLQNQLRRLQDMERKAKVDVTFGSLTSAALGLEPVVLRDVRTCCTLRAQFLQNLLLPQAKRGRLPNPHDD

SEQ ID NO: 1009252 - protein, 224 aa, Homo sapiens
WAQVRGVWTSLPWRKLLRLSPSLVPRAASGGSGAGRLGSQEMDRSLPHRGEKPAPGPLTFSYPVFCQSQLLQSPLALRPPSPSFPVLFLVLGCLARYGGGCIPRPWRSRCLQVRKLLSIWRRWSETWRSGWTAAWMHQCVVAHGETDCIMDGLEDSLLEAAASHPARFYHGRTRIPSGASPENDLKTRDLSKSYCRPLGTAMSLPGKGSPNRDCIVPEELNPVC

SEQ ID NO: 1009253 - protein, 69 aa, Homo sapiens
VLVRGLLVIVTLTMQIFVDIIVHWLSTTQSIACVEAHVDGALEECQMAHRSERLTEGHSPRMMHAMHAL

SEQ ID NO: 1009254 - protein, 54 aa, Homo sapiens
MPRPRQATAQDNPDHGEVGESGRRKPVSGRVKTGKGGYQGPRVHTDTLNKDRGD

SEQ ID NO: 1009255 - protein, 93 aa, Homo sapiens
ALSLSLSLSLSLSLSLSPECRARAPDIVCVPGAPGAWEEETPGEDAEDDRCSRDDCPSSLHPALLRLRHARRGWSSVDAVSSPSGNVVVLLCC

SEQ ID NO: 1009256 - protein, 221 aa, Homo sapiens
MSLQSLSSTNDPENSHVRGKTHGLQGTIPDVNQDRRRHTEIEARYGRWDGTGCWNSVHETEMVCGGVVTRRLGKRRADLRKAVRPVSRTVGSEADAASSRGLNAGPSGPPTRIPRLAIVYRSDAHSEESPAAKKSQIIIQLEGWTSDVLTGWEPQFEGKLNHTEREDGDGLRKGRASQGLGVACVRRASSGENPIVRERTTKMGFPPKIGLRKNVCVAAQK

SEQ ID NO: 1009257 - protein, 39 aa, Homo sapiens
MFNVICIKAHVRRQLEPSASSREPIIYGLKECVISNGVW

SEQ ID NO: 1009258 - protein, 187 aa, Homo sapiens
AEVTDFLPQEPTEQITGRKMKVRVGCAAWSHSWKDARPMAESMAVADRAGARAAPGDSSGRVGRALAKRVHMGRLLWITCAGCMTLSDQVQEDLLSSQVTQDTEGADWTKTMKGTFDRALAIVERLAGTNLNPRLAGGDCRWQRVVHRVRCTAEDRVHAIACDVHNGTDRVSRAGLVAVAVGRTVAR

SEQ ID NO: 1009259 - protein, 142 aa, Homo sapiens
QSGALGVGQHSASGAMFEGELRTPPCMPVLVARCAGTAATRRARDSGEGRAPGSPRPKRCLGLLGQVLVLDTAPCVLPRVSACPRVVSTLKSQGAISLFPSVRDSWYGGCSPWSFFFLAPSRGCSSPLLISVPLRGLPALLV

SEQ ID NO: 1009260 - protein, 177 aa, Homo sapiens
VSSGSRDRMDRCRVDIPHRTASERREARQEVRVKWSKTQLSLGGKTTSCWLEVIEPDPVHIHGALAAKAIAGPHIAGLLASGADSDVYRSGTRCQDNMSVSQGSQCNLAGPSTPRLVSTHGIKTILVEYLLTSGSDGHPTVLYAMSPDGEASSLVLENLSLTFTNREKIWLVNFTDR

SEQ ID NO: 1009261 - protein, 134 aa, Homo sapiens
SPCQPGDVQQMRTEIIQDVTFHDLYVANARLQGGQDILYMMGQLMKGQKNTDITDIDLRGGDYTKGGEAKYIEPGRYDLEIGSRYVAWYCVIDGPPVTRDLLAVSYNLTIASGSHLGKCLTNASIHPMHVPDSF

SEQ ID NO: 1009262 - protein, 131 aa, Homo sapiens
MAQIPGRALENGSGDGSCEQVGRGGPYAHSGVKGVTLAHSAGCPMKDSRTPPVLSLRTAGCNQGTSTQLKTSTHSPYVSLEGEPQSMKSLIICSQDQNTRTTKLDSCSHEHLTPTMDTFTLGASRGDLSTP

SEQ ID NO: 1009263 - protein, 108 aa, Homo sapiens
MLLDWGAGWSRGILHPLGGHVAPLSGPHHLGVGMCSTKLSCAIPQGKIRSFETNGGSVIEGAKCAISPRRFTQALRREVVGAAQPRVERHPRMKTQQWSCSPGSGHGG

SEQ ID NO: 1009264 - protein, 200 aa, Homo sapiens
DPQRLDTFRGSGSWPSSLCTATSNGQEPSRLGGAEEERPGTPELAPAPCSQRLWQSPWPAPGQPLVDPGDAGPAGQSRKAKLVFAVKPATAQLSVKRIRGDQEELAELGWCHPLKSLPTGVLLCTHRLAGHPRPTRVPESGLQGKPSSERTTLRLSLETTLEVEEADTRSTVNPQLENTRHISTVSKHVPRWSSGEREDH

SEQ ID NO: 1009265 - protein, 110 aa, Homo sapiens
MCIAQLAGHTQGVGIPPPGGNSERPPHIARVVGNVWRGPAARGTTKVGLRVMSVNLSPPRATRICSNDGGFLDIRDETSGAGIVITTLPPVCRTEFWYKQPNFGGHDKTF

SEQ ID NO: 1009266 - protein, 211 aa, Homo sapiens
MHLRNGTTSKCRTKYTGNTIDRDTWIPSVIYSEPRAGTTVMQVPGSDVCKNKAAETSDLTTSSVACWYGPHMLATETEIHERMWAIEQYTDEKLRGAPKERQYMRHPRAVEQGPQSGEADPWEHRALHGRVANTSNGKACRVRTHQKADHANVSPERGEAPKEQGTQTNASMAHNVTQSCHSQHAKKTAKAMPHKKPLESTTLRRSNLWLI

SEQ ID NO: 1009267 - protein, 307 aa, Homo sapiens
MSNPKPLEECVTCLSGTSVPPASDQCLTESPGTMFWDEVKKRVEISCAVPTSSTCVHTGLRPALSRSSLVAAPPVAEPDLRSRARRAQCPSSTPACITSIHDRWPHKTICAGQQSVPKMVCPHRCCWTEFENMSVTRIQDHLLDETALLPACPCPPVTTWDARGAWHHGPEWGTSTTCMASRGTATTGHTRKAGLVRHMVDRSTWAGWPREKRRQGTSRDGPQGRIPHRHVLTGGQKGHPPIILRPLPCSGEARARALTGTLVTRTGVTQRLASWALGPLNRANPHGAQMCNQHQATVVRQGIEPPM

SEQ ID NO: 1009268 - protein, 150 aa, Homo sapiens
MSLHALYMHRLTYNAEGPWLNERHVCEPPGRVMRVAEQRLHYWKGVTGRTVERRTIFVTVDVMDRPIPLDCRTPRWELLEQRSCSGALPERRYGEASQILATVPRVPSHFSRAASCEGGHEDGQSASKATLRPWPEQGSEDELPLKCNKV

SEQ ID NO: 1009269 - protein, 229 aa, Homo sapiens
AEIVCACPTQPDKVPRGQDGHGIVWTPGAEKRPLPADLSEERGSLVQRAGLHFGVLIAHKMPGLAGCTVRYFTSVFVSGANPDISVSSLAWGGTGSPKHLSFYKYPSYNIREGKKNISIRASPADDVHSVPLNGWRAACCWVRLGGEPTQGHGTDDIPRWVHSEESYPAPLWDALTDLTYTYAFALSPDNNTHGDHKFLLRSRGMTPTHLCTLTPLGLRRDQDGFCGKQ

SEQ ID NO: 1009270 - protein, 93 aa, Homo sapiens
MAGSARVASRVVLYQTEMVAKVIEVLDGARPTTRCESLLPRLGEKSQLYLRFQIDEDDAYESRLAARTREAKAPPLFNQDPKGCSSSNLTTRN

SEQ ID NO: 1009271 - protein, 873 aa, Homo sapiens
GRRFPASTSAWTEPGASFPTPARTPTSTSPSEYTIIHTTRRRAPDHPRTTTTRPTLRRAQRHAQHDTADPPPPHPSSISTDTMHRTGRFPPTRTGMTAKNNIPHHQEHHSSNASRPQVYTPGPSSPNPPCRKEHFHYPATFAINRHRVNPVWRYPTLRSLYNSYTNDSGNPRYGQIGKLAGAGHQITLAAQHATKPRSSLASTHHDETTQYKQTDIDDDHTFDTDSPTHNKKSTYILATIRLRPTAQPTPPRGRTQPSTVAAAPTPRDTPTKQQTSGNAPRALTHTAPRAPRHRTAKTAKPTLTAPTPPDHHARHTVLEALSRQPRHSDNAHAVYHMTQHDARHDDARKEKRKTHINSLTTTYETKTPSTPLPRNNAHSSPPIADHTDNKHRSRHNANILGHTPHTNTANTAPHRSSQRQHARRQQPPLVGQPTAKPTEPRPTPTTIVQLEPPHTRPRTHPNPIPHLTPPTKHAAHTKNQPMQCALWTNNSANPPQRPHTPPPTVNRSPVRGDSTNTPRPEAAPHSTTQPPAPHPARHATDHPNIAPHEARHPHVPTPNTQTPSRHTRPDHEPQPKQDHNNCTQTPPNSANNDRPPREQHTQDQPAQPDKETPEECIVEAPPRQRRNQQAWAHSDRHRHGKRMETTQQQSAPTPPASTPTAHNRRKKKHVREPGTNNQSKHTSIKLNQHTRYHNYTHTDHPINVGRPDEPHTETEHYTTAAQRKGKRPPASHATTHRQTTTKTYTLTTHHPDSCMRTTLSERTTTIYQPQRATRHHARRRQSQLDSEARTGPPTHPAPHRGRADTNSRKPQTTAPLSKTYYHKHMKAHQPTTAARTPTTHAQPSRRLTPPTEKTTTMPTTSTTPVEADNEASR

SEQ ID NO: 1009272 - protein, 204 aa, Homo sapiens
MSGMSRADFAPYRRQITTISECGPKTEQDNPYPIGVTPTSSVSPKRQAMPEPWCHPLWHRARPRCLGSAVRCDLPLRDLGLVPNIESTNRRRNSFALRQRSKISSSHKYLRAPLPVGTLGRKVSIQRKHPNPRSELRTALGNLSGPISNSIARDNSANTNSPNRSCDRGLKSRFATNEAPASCTEVLYIPNLAPGPPACGPPVP

SEQ ID NO: 1009273 - protein, 223 aa, Homo sapiens
MRADHRSSPGPCTSDLEKKRRGGTGVSGVSSLARAGEPANPGLQDFTSQDGLCAADWKCCDAYKKAKQDPSALLWGGIGSTACRHSGHVSSASTRNLGSGSSGAWYERRGSWRSRAHFRPTVVRGESCKCQVIWLKGAHIRRNWSPGQFSEPIISGYTECVIRMVSGRFYLSCLLLGSLGIYVHPLHYLLDASTGVVAFAWNGSIYMSNLAPSAYGCWHRWYP

SEQ ID NO: 1009274 - protein, 102 aa, Homo sapiens
ADATASLGAGRWRSRGSAPRPQVPDHVPGSPDYTASAEHGAGARGPPGGLLLLRPLRAASTPPLLGVSSLVPPSVLGHCFQPRIKTADKFRGSLIDQTEPRL

SEQ ID NO: 1009275 - protein, 92 aa, Homo sapiens
RELVSSFLGVFLAGLVILVGLLLLGFDFVFLIIFSCPFARSLTQPSSSSSPSSFLTITFFFLLLFLPTFFLFFVYLIVSLLWLPIFLISISR

SEQ ID NO: 1009276 - protein, 128 aa, Homo sapiens
MSSQVVGIEPLYIKDDAWPALTVQMGSSETETETSCGPGPWSSSHSLPPRPQGRGGWARGLGLVSRGVWKSMDAIRHKLHSNNSPLTMAHSSVTIGFQRYPHTYSMSTTTADGHVHAILQEAHPCRQE

SEQ ID NO: 1009277 - protein, 289 aa, Homo sapiens
VRPVHGLTRHRDPVPRRPSMWRAAPQAGPWPGPGLLLLLLLLLLLLVAAGPWAAQWGCGACVRLLEQEQSYLTARIKHLSPQMRPASHVTAEGTTMRSRLSKYLWPRLNCRDFDAGKWTILRWTTTCGKVMEPETLRQCTSDIDRSTKNMNQQVTRARHSDSTRQHQSTKQLPCMSTGVQSLPGHYLTILVHIEPIGLQPSSQRTKPTMDSNENDKQYMELRDGEQNLDTTHSTDDVHYMTTKIHNDRSQEQTRVPDDRCSRWIDRTTIIDQETMEQYNRPKPRTQAEP

SEQ ID NO: 1009278 - protein, 475 aa, Homo sapiens
SSRVPRRAASPVCMFLMTSVCEPCAPSSCGTVLCCVYCAVPLLHAPVPAAACACPRMTRSTLVANALNTTDVARPGMLQLDLRYQPSLLPGASLVHAYASAPIMHPTPSSLPASPHHTPCAQARSLPWGTPIAPAPSSFPIVVLRFRDTRHCRPRSGVSTPPALSKCPPVDVLAPPQPRTPAPPAPGTRYPAALDRHRPAAPPTCASGAPIGPAAPQHRLGPPRQQRPAQAGTTTWGHTHLSPPVTPVFPPIGPARGSPPATPPPLCTRTTTPFGAPHTRQPIVPAHPAIPLARQPPMYPLSHGVCSTGTPLWANARSHGPLLLAPLPTLLSLADQRPRSAAPVTSPVQPIQSAHCGASATPKKGDRTILPPPPAPPPAHPPLPHHSISPTHSPHHLLPPSSGTPHSGPSLAAPHHLRAPPIAGLAGEPHEPITSAPPHRGSYPPPPRPSSPGPKTHPSPRTVTSARTYYIPPTL

SEQ ID NO: 1009279 - protein, 148 aa, Homo sapiens
MGGVFPESDLINWLPKKSYFGRDPDLKVKARKEESRVSSQLVPGRFSLASFILWAKMFSIFWQPLLNFPGYAASSEQYAAVGGCRTRGVHKTAESGVRLGPGFFTFFNYKGLSYNITGGTIIFFQRVLKMFGGYLAKLLWGAQAARPW

SEQ ID NO: 1009280 - protein, 102 aa, Homo sapiens
MWTVTEIYAYKSRGASVLTQHTLLNTVNRGSVLYPQTKIWLYCLAEKNRGSPGETVVCLSPPSVCSPTGDDKTVGTPLFSQISHSFLKYTYPKNNCGKSPQF

SEQ ID NO: 1009281 - protein, 204 aa, Homo sapiens
VLRSKHLGVRDFSAKCVSVPGAVSEPRRWLGGGPGQYPHLAPTYAAVNALCIIGTEEAYDIINREKLLQYLYSLKQPVRLLSHACREIGPCGGRENRIVDSPVSTEAMPVSNIYPNRHVATLSVGEPREDVNVCQELRTGEAHTVLASGNLDVTKIIVPDLFEGTAEMDSKVSELEKVDIGRGYQGTEAQWMRYTFCGLCVLVD

SEQ ID NO: 1009282 - protein, 236 aa, Homo sapiens
RGVACATLDDQLRVITRACAYIQRLAAASAIKVSGVISVVLNVLRIINEPTACLPSPTAWTELAMVCERNCAHQFDLGLGGTFDVSILTIDDGIFEVKCHVRRHHTGCGRTFDEAGCVNHFVEEFKRITQEVTSRQNKPSREAGMRNQLRRGPNEDPVSPGNPMPDLEIRRPCIEGIGHSTGASAGLRFDGADASDLSRKARVEPVEKALALEAKPGPRSQNSVILDLESGGYTEI

SEQ ID NO: 1009283 - protein, 209 aa, Homo sapiens
MHEREVLHEALEENNNFSAPGGRRSSTTRWMLSNGDPLGTPGLHCAMRLREKELQLAEVRRNKEQREEMSWLSGPGTGLAPILRRNTFGFGFGFVHLCLDATFVPPPPNPSPAASCFSSATQRALPCPRGESLTTASPAGAAGRETRSLGADSRPGAAGSPRGPCERGGGDRGKSRSVAVGSLGPYAGAVWSATCRVRAPVLCTRAALA

SEQ ID NO: 1009284 - protein, 68 aa, Homo sapiens
ATQCNKRPLWLGVVSPCDVCAFEINSPVSSSDACMSGGAGSRVSCIGERWCRYRIPDPNPFRSRRQPS

SEQ ID NO: 1009285 - protein, 202 aa, Homo sapiens
MDRTISDFGLRTPSVHLAWYMIVFRDGDEGSSDSWHGGNELMSRSWRSVVPFYLVMAHWIRRDGIPKEGPEPLDRCDSDPFRMIVLCCETIADTSSPLIARVACVCLEHPDYEHFVIVPSVITPLVHLHGPEISCCLGVLGETPMDVSIDHECRQGLRVCRLDAVCTFVMISTYDKVQSVNLPVIQPGTLGLGWKNHDVRGQ

SEQ ID NO: 1009286 - protein, 237 aa, Homo sapiens
GAAIAGARVGLVGAASICCPCAGACLAASLQVVLELAQRPVPHSESQQRCSSIPVDNGPKCDVSVVHVPILLEWKAKPSFIYTPEVSPILPDPREVTIPSYKHAYNILLVILVPHRWTVNAYRPIVHVNVNNQSPDIILLTFRDITPNPRPTCDSPTDGSCGTRKRMFPLSPTQNRTRIDSGEPGPVPSRVATRTFSGDSWLPQGYRDPGSTLDGRRPGISPGTRERIHLARPAGAA

SEQ ID NO: 1009287 - protein, 74 aa, Homo sapiens
GRNACQWHRTCPGSSNDSSARSQERAGGLGPRDATTSVSESLPTLSDSDPVPLAAVLEINEDTGGFESLAEPFA

SEQ ID NO: 1009288 - protein, 134 aa, Homo sapiens
MARTNVRRALLMSTGVESLPQTAGHGKAAYVKSAPIYAGGGEEAFYRLQARDRERFEKIRRDQYSRNVAALSGSCPSMQVGEGDRAVISRTELRFQQRSHRCCCSEASEAYLVGLFEDTNLCAIHAKRVTIMPK

SEQ ID NO: 1009289 - protein, 282 aa, Homo sapiens
AAREIERHAICVVTGSEEEWGLKRNECPHVGERRVPSRSGGRVSVLCVCGVLHWLLPVPGPGHIIGRYVRFFHDILHTKYRAATDVYALMFLADVCDFIIIIFGFWAFGVSQALGPKPSVQQMLSSHRNIPCAWLPLTCALLATEALGWPQDITSSLQTSRYPRAFLVIAADPVSCTMVVDRAHLPGGKNRAVQGWPSSVALVLAIHLWDVLHPGRRRLRGLFKQNVGGPASGSFVKLLLLSALSGYQIRLWVPDPDSFGTFLTKKVQVIFSLFLLPGVTGC

SEQ ID NO: 1009290 - protein, 123 aa, Homo sapiens
VESSMPCPYAVPYAVGLNKGHKCDQEREQAQAAADVRWASDKHTKFVRDMIRGGVWLCPVLMRSAMELLKVSKGSNAGCPHNLVYGKGCVDRYHRAYRGSVAVSVKLLFLGRREERVLHQGKT

SEQ ID NO: 1009291 - protein, 296 aa, Homo sapiens
WAAGESWTASGPFSCPICLEPLREPVTLPCGTTSVSPAWCALWPHLWREWSLADPVRRGLLPCCASEPFPDVLQLREEPTRCPSCCSSCQGSGPRVPGPARPWPLAPEPSAPSALPRCPGAVGAPEAPEPWPAGEGASALRRVAPRARACPAELVPCRHPWTSTIHYRPPGEDLGPRNESGSTRHPSARTNGLGARTDWAWAKREEAMVTRGRSITGPAPKAAYNSRQRENRQMFVVVAEARLRPTTMESTRGDHRRLGCTGLRSQGKPPQPYKEKCWGTRGVNEFGGLRKCQKVP

SEQ ID NO: 1009292 - protein, 149 aa, Homo sapiens
GGRRRTVNLSRVSSPGPVAAAHIPCSCGRLTFPAVEWPFLGQAGRPSFGPSLECWCSRGLRGPFTAHRRPAQVGRLSPSAKGAQLELEEMLVPKEDVPQAPREAGLTGPRMILAQDLDSGKRRDCGSTRNPTQVYRPGRYGGRGARHGG

SEQ ID NO: 1009293 - protein, 258 aa, Homo sapiens
MSGTSTWERLVSTSHLAWALAIGGPLELGQAVGLPESTAPLLTTLWSFSVERGWETGLFEAFKPPEVSGRSLGECHIVLSRPFPIPVTSSQGPKSLSAPRWCVCPRTSERFGESLPDISERENPKVKVPQRVRDKESLCTREKSQRGAVTRQRHISYKVGVKIKRFSTRFSPAVLSPRMWKNHAFYKRCICGRRYISPRKGAFSTTRSTNTQLLSTRHSTRASSFTGVVVSHTRRPHTVVPTRWAADNKRLGRCPQGN

SEQ ID NO: 1009294 - protein, 347 aa, Homo sapiens
MVLDRKNSNCPQWRQCHSDTRWELIKDFTLLSRVFPSCLKASRPPPPQPPPRIRPPPRLWHSWYCCTRTTRLISCVCLLGQSEKPPICRPVPFAPVYTSVQRRPLHADNHWPVTVPREDCPLNTASVKVAVDLCAQVHSVRRDNSYRRPRRCGTMLTCNSAIFTHCASAENSTLNTKIGCCRVTALCGRAFITHFGFIPHLSLIMWHHLGGPPINTTRVGHTPLKRISACHLARRDSASAAPPPVCPFAPSPTASLWRWPLEALRGPPGLTPPPRYPWRARCPRCLVPSGAAQQAPVAIAQAQVAIRGGTTRVPLCFPQAHSLPAGFRTFDVWPLWNARRCYGLDEP

SEQ ID NO: 1009295 - protein, 307 aa, Homo sapiens
ALFLLASLLGSGSSLALVLGLKECTRARQCGAPNVPTASDCGAVKRCCQNCLDTMPGSEIPYPCEYMQMTVVSGQVVIELEGTIAHLEEETPCEDWRRAVIGLPEEAKPLSEFMHRRYAGTPYPFPVHSSGQSFNTELTLTPVLEGRVSAPASPLRHDLRSRPKQGARLGTQLELTQENVNAVAARKFHELTKYSGEQWIQMSCVRTPLFTEPEATTPPSFVSNPSERTSGPPRAMNNWHHHIRNSAFQLGGDVLLCHDELALSTHGLDLDTIPRNVARYVAPTVPTPMDPRARCGLETIFNGRAFL

SEQ ID NO: 1009296 - protein, 115 aa, Homo sapiens
RGSHGRVAGSEKTRRVKSASSPAWAGSAPPGSGLDAGSSGGHVAAGAEGRAVGAQQPGQERMAARGIPEAQQLGTGRMTTDQAHPRPSSPTSRRPSLVTCQSPAARPPPPPPPWL

SEQ ID NO: 1009297 - protein, 187 aa, Homo sapiens
GRSCNLRSGFPPVPPRARMAAAELDAAPGERRQARGRPLRGSGRAMGRAPPAWAPRVGAGSAMSSWAPLESRVLSVAPSRGPLVASLCRLGSHAVGEERLCHGEPCLDTGSRPGASSVILAPSTGRGFAFAIETFLCSGGGRGSPGLLAPPLAAFGAPDIAAARRYRGHAAGGPGSRGVAPGQGARK

SEQ ID NO: 1009298 - protein, 318 aa, Homo sapiens
MPEKPGRGHGAIRETSEGLEILSLPQWMTRAFSFLYTFREGHDRVRVSGVGQFQSLQQNWSPFWGAEGSPGGRGMSSGAGNPFKPLHVGLQGTPGHWFPASSDPQNCRGSGPPPGELAGTTLSSSRLNAAAGAHLSGGTEPGGTCHDGAGWARRGARTRLRRAWSFAGAITSSRTYRARAVVEPTWANAAVRQSLGQNLGGSKTSAITQAGAAMAGITGPSGLATHKVHPLSKGPDPQWALRTPPWGPPGPRTLPSIGVPIRRQALTEPRWPWDRTLLPAAPTTGGHINPRVALNPPAVSSLIRCPKGTHLVGCGNRR

SEQ ID NO: 1009299 - protein, 155 aa, Homo sapiens
MPGSPVPLRGDPDALLWGLLGRRCLRRLRPWLTSGDFANQLKTRSPVEDDIHCHDPCGEILKGLDYLHLRTARIPPEDIQRPANRAYFSDPGVDCARWRTFWGVDRASFTRPRHDFLDGNYHFAGCTSPFWDVAPLTCPSTGQRLCLHDFHYGHD

SEQ ID NO: 1009300 - protein, 118 aa, Homo sapiens
GKAAKEVVAAWGSGNPFGLGLSAAGRRHSRGGWPIALTFGSACPFSLVTISHLTKDFGLQFLTHFCVPLTEMCGGGQLALSFGPDLNVLRELSQAPEVSPRIFYEFEVTVFEEHVQKV

SEQ ID NO: 1009301 - protein, 353 aa, Homo sapiens
GASPERVRTGCVEELQDRGTECQCAQDRTQPGLDSLGSQEWAHPFLTTLSEALPPHMRPLCPLWPGRCRLLLVRGGAHMEVGTCPVKQDGLMGLALDSPVCTRFRTLPPVWLLRRCPAGDWLLGARSCALFAGDLARVPDGCSTNGAACWRLLGAGTRYPERLLPGRHRKALACAQPGSPHNRGRTAVWTMLEGASWGASQCHSPRIAFAQGHGGAASRDSDLPCAPIGVTNKLLAHRARPCGGTALPYMTRKHRPPMSLKGVVQSCSLSSVIFRHRYWFDVTHTQVIGMFTLYMITSGIGTDHMWSLGPGPIYRYTVPGMIHTVTLSTRVILSGVTKRYPYIYPEHIIVMWI

SEQ ID NO: 1009302 - protein, 224 aa, Homo sapiens
MPTLAPARLTVDHHQSPARGPLSICERWRDNLLEHTVAPPEDDQYVPYVRMTCAYFDPPVSVHGNTSRLLAGVWYKVWQRGARAIRFPAQATIPACYTALSRSNPMVLDPRSRLRCEPSILCGTFSASILQGQSDWLLYPLQWLPGLQNGMHAIDSCHALCHRLPIISRELRITRLPVDEGLSRYGPCLVSLDWQQLKPEPRVLEKPRRYARMSLGAAETVRDF

SEQ ID NO: 1009303 - protein, 238 aa, Homo sapiens
VLSALLGNFSHWQSSPASVFWLHSALSSLGMLQLFRADFIYYEQISITSDTTVMTILRTLCGFPKIIELLLTARYPKDDPSNLTLMRLTACAAWLLRVSPGPASLPHRLLPHHNAAPPSTRVPIPHHLAIWPTARPILLEAYPQLTFIPLNAAPTYLPRARPFSRRRAHLDTPRPIESPSGHGPLCHTTPSPLKLPYHQFRRQQTALQQIPRQQSLASATYAPIRRSVHRHREPSPSD

SEQ ID NO: 1009304 - protein, 240 aa, Homo sapiens
WGLIHPSTEERTKKSSNGAKKRNQARYQDRGRMEWAQGLERTLWCDSASRNSVTTQTPVFYNTTINLLLQGVLVGSVQRTELSSIYPCSVASLCVTRVLVHVRITEYRNAAPRSDRDLAPERLPAAHSFTDLVRQWRFRRPLALSIGPSGVTGASSESLQVAQMVSGCPFVLDTSYASAEKGVPWTSRGDDWRPRHYLYTLKDLHRRQASFRYGICQNIPEGFYGTSVKCLLNVGIVEAN

SEQ ID NO: 1009305 - protein, 266 aa, Homo sapiens
TGQTPSFSQSSVAIRLTGTDSIVAVDRQDEAKVSPSGIDVFDDYIYRCAPIIYIVSSHPYFGPPLVQPDRGPDQPLTWSFTNQHKQPEVTNPVTAQNMRVALPAEPQVGLSCTCSPWGSRPGPTAPFVPFRLFQAPPQIVSPARLCGTLYLVDSRSQPVGTVFPQCTDASPKCLLPTPANTGDQGVNLGPAAWEHCPQWQGTCDCYPLSWHAPRAGAPRRFNGPKCTPAGVCGLTGANNKHLALFNQGNQPQCRLPTRAFLGDDAS

SEQ ID NO: 1009306 - protein, 149 aa, Homo sapiens
MGLHSGATSLGLAFVQPKPGQPLVWSSYKDCAILFSGWRNWRGDHNTRGLPRGAPRRLPLWGATSETTTDDHTLRPERQLPGRLVNAGPAPENYHVDPRGGPREGWTALGTTQGPLCRPSSEKIPSSPAFAFPYHQTPSTREITRGPNR

SEQ ID NO: 1009307 - protein, 199 aa, Homo sapiens
MTKAIGHRLTMWLVTPNITRVLAPKNFAAKNPPLRRLLQLRPFDVAPKLPLWTFSKCGGPSLLGYNAQTQNRTHSTLGPSLLKLDSLIVSLYSAKLTPGTGNFPPLFALAFGTGLSSQALWTQRLGRLCWTLSTDPTSVPGRLPLCARPLSLGPPQTWSSVLAWTPWPLVWHATHKSGCFTLLRPWPWILSAPASLASH

SEQ ID NO: 1009308 - protein, 126 aa, Homo sapiens
GQSSELILKRCLPIPSSKDNICLSPSPYVESEDAPPEKKIKSEASHVQLKKCQSRANRLESLSPPKTSDSEESERRINHEQLLELPVAAMMRSDPSFLRLRDHVPELVQNEKAAKVVTMRDRTATE

SEQ ID NO: 1009309 - protein, 180 aa, Homo sapiens
MATRASGPVACTEYSNKSLGPPVTTTFYTDHGCVIPPENSSPYARKRKHVASTSLGSVISCAAGIKSYSQGARPRLHSVILNTHSAPGFEAQCRTTRLFRHDTTHMTVPEEHLTTRIVHRGTPFGHRAIGPRRSLFGNLKQHNFQPGRSGSRHSKLAPGIAGTQNAGVILTAVRPPVASN

SEQ ID NO: 1009310 - protein, 256 aa, Homo sapiens
MRRRRGGLAATVACVANEFDICFTVSAEKRAISDASGLVLECQLHQMWLPVVRSLSASNERHYGGLRPVSIYSRNLLRRLGEAQGEDSWTALPIDVPSTSDGGPTILSTDNISKDRRYADLTERSAEPSCESLKDTSCQSSDPSGMKKYVPQIKEGETCTDCSHGNSLRGIVKHLEGLSEEAIMELNLSKWYSHQSMNWTRTLKAIKAIADSGGLKRTVRKALEAVGAQGMGTEVEGRGKIIVPRRTLSGRLVLFA

SEQ ID NO: 1009311 - protein, 211 aa, Homo sapiens
MVGPNASCGQRATCPAILSKSLGPCRCQLAAAIWVLFHQFISALQGLGGPGGPHFLEPRLKWLGMKPYSLTSPNKLWAHGANPRATPEVTGCRACEKQPRVVKPVLTRSGSKLLGAVASFDGYPPIRGTSTELPRNFWRKVCQKSLNKLPGGSTPFTSNLRGIVRTKLEHCILLINQMINGSFFHKDPVVTFMRPPDPRTPEPPHHDENVG

SEQ ID NO: 1009312 - protein, 310 aa, Homo sapiens
RAMTLMTTETGSTLAIIAPRRYWKRGCRSWLADDVMQPARFWTAKETVVSGGHSPKYICRAQCAMAVWCSSLEEEVPEERTPYSLSCLDSVNSINRAAMGVGLRDMSFESSYYSSLGLFLSTENATVNAGLAKQALVALVWRLSSGELTWSSQHPSTRSPAASSSWTLSSSPVAHLEDKNHFNANCSFWNYSERSIAGLLVDPRLRLVESNKTHTTCCLQPPHQLRCAHGFTVRSSSGRINELRAVGHHLGGPLGIYPWSRLAICIFNLLGILAGGLQTRTATTIQENLVIKPFPGLSLLILVPINKSQL

SEQ ID NO: 1009313 - protein, 322 aa, Homo sapiens
MTLRRLTFPNYWSNVVRFVYIMNTITDHQSQISTRFGLLSPPLTHEPQNVLWRNGCLCQDKDPTQHKNEPENIRTPQKPMPHPPGRALQASDEQHWPDTAPRLGQRTAEPPSAERIKPSLTLTTYTHLFCGPGCENIPFNPLCLGWSTTTTSRGQLPLPPKQVPEKGFEFQPGHRGYAYTSKLPKFGSPAPPTETRQPTARPHPENGGSEMGHRYEPLTHPSYQTRTREHTSTPQTLSPRLRGKHQRGELRPEYPPTRPPYSHSHPQSPVSSAWRAPTVSPTRVGDKRLSRSRGTAPLGLALTAQCNPGATRRQGPPHTRCA

SEQ ID NO: 1009314 - protein, 269 aa, Homo sapiens
MTPVQRWGPGVPWWPWDGEPRWLPLEVSGSGILVAWWSAGLWTGGRGLRPAELAGVQWPEDNGVDALSPKLGLLWSHDMTDQGLLDGRSTRLRPVAQLTGHHEDSVALVVSLGVPFFFNGIRRVFWNRLIGQVARNRMTPVPVPSCSQGFNWHFWSAYPGDLPTGPTFGLIGRGLMLAYADGHRAGTTLTQFPDSASPQFEFPWGSKWLLPKYSTPLVAWPCNRALTLGRVHNLTRKFLRRKKGHTLAELAYPPIAPHRALEPHGAPGD

SEQ ID NO: 1009315 - protein, 131 aa, Homo sapiens
MSKRGTLIFTRGIHILGAIVIAYSGERSIGDRINRSRYTERDTWWHHTGGSYYRHLAPGNLFNKWPIVGHTTARVYSGGTRPLPKGATARAAHLALTRGAKATVVTPVSPRGANHYAHTTGPWSARKILHV

SEQ ID NO: 1009316 - protein, 181 aa, Homo sapiens
MACWCVCLGCLLRVSELVFRFRSAVALPPCSPQSSPSVSCVLCGRAVRARPHSFWAPVLGCGGRPFFIRSCASTTARGLPPRSRRVHSDLGHLRAGTAARTLQSVDFATVSPMRCQPHGVLDSGPPKCPESTQILRVDRTMSFVAASPHSCSHARPTCGPASPATDGQSSTDRPIRSSASR

SEQ ID NO: 1009317 - protein, 290 aa, Homo sapiens
MLESRAGEQLAIVFDQGHVCHRKVMLQVHSVLHTIHVVHAFVLATLTTCNGFQAKWSNIQSSGRPLRYKAQEEGRMEHVQVSTSIPMSIPCRWGHAQSRLLFARPHTKAGKGETKLVVPTLESTLKGTRKTIPDPLDTGVPPKVLLNGHRWPTLPLKHGGQGTESGRWHRTHEGCLCGIDKHLRICRAPTSAAGRLGHDTDIARSKDHRPHSKSTELGPSPTQKGASNRRDYPWQSAHTWYVTGIHTWQTRYRGGTYKSRERYIGPRQLDVRMEIQVGLSAIELSNEPLK

SEQ ID NO: 1009318 - protein, 635 aa, Homo sapiens
GQLSTLCSSCRLLPSPFSLPGRQLEERRSPALCHLTNCAPGTVQTLCFMPTADAQPHPEPDCSPYPTQISGRPPRTPRGPAHCAWRQLAPHRTGTIHYRCWRRTDAPPEATVPVEHFHGTPCTRYPHSRNAHAPTSASHPNNTGATGNHLRKPNATSWGQPQPSTLCLTGNRTALASTVWAAPRGRHAATPTPPTPGPWAYETPERGPTPPVGNTPPDMGAAPKPTGTRTAHPQLGTRSHSELIQATLYKGRQTPHHSSNPTPPPVAAPNLGNSPHRSPQRFPKWSDPWLWPYRFPPLFPYTLPPFPMGDRPGPTTKTISAPNSYRRSQLWDIPLSVREHAKPDGGGYPTHAEPHNDGATSRPPPLRLHPRKPPGRRLTPRPPPSPRRAPETTWPPQDSAHWPARSHWGRHPPIGPPPGGAPGRRQTRAMHNPPRIPRSNPPHSQHQRHHTAPPIPQLTQSPRAKRPAAKHRPQLHTHRPTTFAPTPRTTGTPPRDRHRANRPRRPRNKHTLAAGRGPGSTGKQPDFPEPRDHSPHTPRATRRPSTPANPRAPRPVGAKNAMPSRQRRTEGHSRSSRGTPQPREPTVQKHHHLSLGYPSRASAWAGPRTTRERTINPRRPALGPPPRQLSGDPRG

SEQ ID NO: 1009319 - protein, 199 aa, Homo sapiens
MVELRLTGNIREREIKRDVAHGGGPPRGLNAEAERQATGAKALNKWGRKRGQRGGRWQTRGPHTNNAVRNHTNTSTRQAHTPTDKHPDISTAPHREQGERSASTPTANRNSPAPPQYNTIRRPNTTGRQTTAQKKKQTQRKSNTPPHTQRDAHRPTEKTHNNNKRPMNTTEQAKDTQYSHDQSQTGPQRKRDTRAKRHP

SEQ ID NO: 1009320 - protein, 157 aa, Homo sapiens
MRTNGANNHQTPHPDTAVHNTAAKKNPPQATPPDTPHDGRLRTLTVAQHPEPAHDAHQRLPPTDTTNADAGASNQMPGHAENNPRAQTSKMDYCHTAIPTPQNTTPHNTPHGTHHRTRRHTDSTRRNPAHRRKPAPPAQKTTAARTPMPTTDCPRSD

SEQ ID NO: 1009321 - protein, 251 aa, Homo sapiens
MGRDLGEPEPSPGASPRTHEPPDRGAPGQQPRQWAEPAARQSKHERDASSVSSRATVMLYDRRQPSDGSLLAPASPGHSARCQIYHNPTANFLSPSWRQEDAARTDRWSYNCAIVLAVSKYQPRPPPNFHQLARTLRTGPGGPRTPAQPSEAHAGPQHMHRPAMLPTLPLKAASERDATGDTHASPTHCTKRTTPHSATQVPREHPRLTHPTRVNRKGLRRHATSTQADTVHEQCAPRISYSIAHRKRSHD

SEQ ID NO: 1009322 - protein, 270 aa, Homo sapiens
LDKLLLYLRIVHSLDYYNTCEYPNEDEMPNRCGIIHVRGPMPPNRISHGEVLEWQKTFEEKLTPLLSVRESLSEEEAQKMGRKDPEQEVEKLRSPPKRPGTGAHGLRWPWCPPTCGQEYPEGLLECVRKPISSTSMQRKSRKRQKEVAFFNNFLTDAKRPALPEIKPAQPPGPAQISPTGLTPGLPYATPDSQVLMTYGQPGPRSWAMELVLSSLQFPQEGLHNPDARMEQAKELRRLPAAREATLGKLGTRCYEKTQGHSGHNGTDAQT

SEQ ID NO: 1009323 - protein, 477 aa, Homo sapiens
EPWGIDALLPRFACALVQEQLCPLGAETRLHLPGAARDLSWCYQEHAAGMVATVLYWGILKAKVDPCAHLSPVPCLAPVELIYWQPASELHSYLEGTDCWRPQALQRAFCRTFAHALYPHLPANLNETVPVPPLQEAGLQRNTQYTVLPEGFWSLRLSTRTVPRPIEATGRGPFQAYPEDPGLLSLPILRNRPSPEGPCRNSFGPHSLLGASQQHHDGVPRTQGAPCTSHPYHGIHQQRGLGLRNLGLQRLQATLAPQVRKAPHNTRYSRRLPADTYTNREYLARERLPLFSATRTVIPRSSPSLEIRQSCRSRPRNCANQKSAARMNRPTYVGHEDCRLFVHNNSPPDEAHSECVPIRTDSRVGAPSHTNLGEVKLRSTREHRSGHVCFVSLLKWRSERIADLVASPRNNSEVKQHYHLGAAPPLTVPSDRVLAPRNHTEDNHVRVTYLKRGTQLATVPSSARPDFGITFVEPARD

SEQ ID NO: 1009324 - protein, 493 aa, Homo sapiens
AFDRQLCVFGGYDAETRKTWRLLLRTFNITGQERSLQTNELPAVHTFISTRHNKAMAAQTPADITQRRRDAGAAAAQSGHGSHGGRMIPCNWLTTGQPLKTPCIWTHTQRGCNAETTHNRRSYQSHPSDNRTAATRRDPDPSRHLQRESQATLPYPPQTERAHTHGLTAEPYVARHYYARSMRPPIPILSQRRAFPNTALPQLHAQTTHTAYLAMAIRLEHSIATPTRQRLRTKRASRLTPMEGNTTQANYNAPQTTIHNPPHTRSDTRPPRPANKTHTENHNTQNWDHKRQHYTQALLAPKHGAPLQNDTHTRNTTPAQNNTTRHYSPRHTQKNGQETQLRNTRKTTLETIREQAHTTRDQEGKPENPSPQGTEPPPRTGTSTRHTGQTHTHTTVKDRTQATTIKRDGADTDSTPKRTTETTHQSTDSNIQALKEAEDIMETDSTQDKTHNEGTTKEERHGRRLTDQQQSVGGQETNRETKTNSTKERTRRK

SEQ ID NO: 1009325 - protein, 172 aa, Homo sapiens
MTSVSTMHCLRKRQMIPMSAFSDAQQGLRTFVMAFLKLQLLPRHDAPLEVPDAWYHSDSCKWVLVLESTFSSLTKDDDKVEGIGRRSLKAVFMTPDDGDADRLWPPLTIKSMCMQTYERVLPSSMNVCNTGHIRNRGALGAQSLEISGTCEHALIPLVLRILKGAESLHRGG

SEQ ID NO: 1009326 - protein, 243 aa, Homo sapiens
GSEGNELFRGGDYGVRPGGLHSGPGSGRDAPGPGRSAPEPGRLPPQAVKITDKCMKHDGGANAIEKDGGDVKALYLAGCQCPKMNAWCLPGPVLSLTCMRCVDAWMPKNKCFRSDGLAGTSGGQIQEKVRYMSCDVMPKWNRCFRYCWTQKSKGTEKKQKASQNLVVLARQDAGAEKIFRSNWGSALAHVYWTMGEHCAHAGRPLGTLGWDLAPEHSVTDSANLSLLRTRHVRSLLGVESQVC

SEQ ID NO: 1009327 - protein, 126 aa, Homo sapiens
ALSVITCIVGTLHQLPPPSECCGSMCICVLVPAVLIACGWKLFYVTCAACLLAVHELVMCLGEGEPSSTMMHMWKVVLKTFSLYNECLLDSFHELATTRWWSCSMMSCDVMRGGGRRSGYFGKGYM

SEQ ID NO: 1009328 - protein, 72 aa, Homo sapiens
RSGAGGGRSVAVVVPRELEVQLGFPRHPSTSQSQKIRKQKKEEKKKRDKTLHTTRSREQHKDIRKDKEHKNI

SEQ ID NO: 1009329 - protein, 164 aa, Homo sapiens
MLKYKSPLCENSEFLHLVFGPPGLQCPTGRRDTPRSLHVAHTSMPSRGIQSHILLVPTSPPRVYLWRHFTGRLFGANNSPRAINRGTIHTTHTYVGALFQPICCCPPAAYAFGTPPLTTENVNSRVACRVHPPNKLLAQFNRGEFDPNCARLVALNMAHTQRTT

SEQ ID NO: 1009330 - protein, 109 aa, Homo sapiens
GSLEFFFSLGFPRNPFVYLQQLSRKKVEWAPLLSAQGDRTEAAPPWPMALLQSSLHPSPGVVHPRVDKKDVLFNHQGLDFGETAELGTTVYGPYQHIAPPVGGSQVSER

SEQ ID NO: 1009331 - protein, 195 aa, Homo sapiens
EQLGSALAEMDRQLSEAGRHPVCSAILHEPGDEESVMLDLAKRSRSGKFRLVTKFKKEKNNKNKEAHMYAWEPRFTSGWTEEVAAWLEITSVSVSISDIFTLVRLSGGSELLHLERRDLMDLGACTKVVPHVRGSCVRIKDAGAGSVPRASRPSLMSSSSSVALHYPPSRLSALAILPSQSLWHSAVLLHTEALG

SEQ ID NO: 1009332 - protein, 49 aa, Homo sapiens
MRVRAQERAIERASKYTPCVLTGVPSCANNLREIVLPKTLKGTCGLGFY

SEQ ID NO: 1009333 - protein, 77 aa, Homo sapiens
GCAGGCGGWQAENNKPRSLEPGEAGRDVDGLTAVRGLPECPDMLLPKSPSPGKSTPPFILTEEQGHNAFIIQTHRPS

SEQ ID NO: 1009334 - protein, 179 aa, Homo sapiens
MALSPAVCLSPPTSSSCPGLPNMAEVAGKRLFNKKQHKNSKATLTPDRAPKAATGHRAHHRAPHARTRMNPKQHPALPQRGPNIQPGHPKIGEARNRTPAINARGYQPLAPLTRDASRPTPPAHRPKTHRHTTMQRYTDSRHTTPTARGKTQTNNTRPKTQQASDDARPAPQTHTSAKH

SEQ ID NO: 1009335 - protein, 65 aa, Homo sapiens
MGKGQRDGSAHDDEVGPDEDRRRHTERKRVEPRGEDDGKQGREKRGQGRMDKRRDKRAGTRGREI

SEQ ID NO: 1009336 - protein, 209 aa, Homo sapiens
MASSPGPAIERGIDPLDLQPWRSSRRTDALTPALAVIFHTFEDESDVLHRFDRGAPWRKTRMERSDQSELAMGAGLRAIPDAGRTMRREGGICIMRHVDDGDGQDQIEEPRGPCCPVDPVRWVGPQDTKRCGDEAAKIADGAAGSDPGATLRPLVQKDGPGVELCVTGMARRNAMNCRDHCIGEIWRKLDAHHPGDLLQLYPRVNAWRE

SEQ ID NO: 1009337 - protein, 276 aa, Homo sapiens
MRGPYGVVRGFPSKLKGEIVQKCPEPLDVLQDEGVRMSVKVRLHAENRTIVVASRDRMTSHVWNRYNRIEKEDSELASLIISNTLKHGPWDEASAWHTRASCCHLKTLLMSVLYPHRNTGHDGRVREVCVLPHVSHVQVAGRFTPGTFSYPVSRQPSGSHGVLVVTDPRADHQPLTGGIVYVNLATIALCNTDSALRYVDIAIPCNNKGAHSDGFDVVDCWLGKVLRMRWQHFPVNTHGMSCLICTSNRDPASRFAPRRARLLAEKAVTKVGIPGE

SEQ ID NO: 1009338 - protein, 123 aa, Homo sapiens
VVLLAWTPQCPSVSLVPKMACFPLASIPSGVRVLSLVAGNQGPLMPCRQVHLAANVALVAAETLCAFQELLTVDCVFRAGGIRNYRISRGTSEHDAAAGLGMFYCVSRNDTRSHTLERKHAYR

SEQ ID NO: 1009339 - protein, 102 aa, Homo sapiens
VKVDSGDSEVVMGLCSSNITLLMCSAYRNQTASSTFCAPILSSSSIADDTRFQERGCLQLLIASYVVFIADEFIFLPGNDTRGRLNEGCYLLCRSEAIQVIY

SEQ ID NO: 1009340 - protein, 196 aa, Homo sapiens
AAAVLSSSAGLACPLLIVFRKHGLTYVAVSDGVINVFTDMKVRKSSTPDEVKNRRQAGVSALSEDSEEHHPGVRAMRSWWSDEGPTVEESLPPTLSRCWQLGTWRYALYDANYEMQWMSMKDGSGVYRSETAPSLRPLNIQVIYARFQWNATQQNEADYGVKHELQAHVLRRRSRTGCTHGRGSLGGKGGLSLEGQ

SEQ ID NO: 1009341 - protein, 255 aa, Homo sapiens
WAESGWLSRDLVVDSRNPEEKRLSGAMAVTLDKDAYYRRVKRLYSEWRKGEDEYANVDAIVVSVGVDEEIVYAKSTALTDDGSLVMNKADTIMVLDVSDMKVTTVWHSREKSGSSLNTELPDTEGQVRMANGAPWHHSCYYGDYELEKLTKELRLLTPMTRKPVYRAQGTALALKDLRRVQATHAPQCPWQATLHSERSLAYTALCPFQYLTYIGLLAPNSVAVFTRPRGQAHSSRTSVPDLASTGNLRSPDARL

SEQ ID NO: 1009342 - protein, 288 aa, Homo sapiens
GLAVVSGCWSAALQCRVCWAPPSPASALSARSPFRQLLQPAPRVCTRPFVAAQGALQDSEAGSGLLRLGTLACVVAAVSLQSDWDKAFCCIDLSYAINGRAKAQDFQKHKTLPKMSGGWELPLNRDRQRQLRADNLCRATANLTVTFTIDHRIPPTIMMRGGGTLASGQRLTEQESLNLTSNYPTSVVSTVINSNDDSATKALMGLEPCHYTTTDSTASDHTTDRIASRSDLSSPLIRETLAPTGPTLRYPTWPRNPYVYPTPGPTAPLCLRAYCDPPQLLRLPDRSC

SEQ ID NO: 1009343 - protein, 409 aa, Homo sapiens
MYVVIRPYVLEIETYVGLRPTAGLRRAANDLRMGNYGPKLGYKRDVGVDGYIETYAKYMTPSDRNKPFNGMRIGEELAGVDKTTHKQFATTGAKGQKWQVPTNITKTPEGAKQCPKKTTKPYEEERKRKHHHKTTAYNKKRKKKKRESRGNNQTRRTREKRREKKTKREKHQKEHTYGKKKRTETMEQNTTAPKQKYTQPVKTQSQQQTGATGTESIAHKKNEVARKRTSKQHNDCTTGKQHIKPMRDKKPRNRHRPKKGNQNPRQQRRTNKKANRGTYTKEHQTGASNPKTHGAKTQLPKYTSKQRKTHRKKTKDTRQQITADGTDSRTTRATQETQQEDTDARNRKTDNRQKKETRQSKKNTNTEERGESQKEQGEPTSRWTDPNKREANQTIAQTSSERNTTPLTP

SEQ ID NO: 1009344 - protein, 57 aa, Homo sapiens
MVPICREVAVNSALHSTCGWRTRKCSSVVVYRDTTWIPSRLVVLLAWPCVVHLGVPY

SEQ ID NO: 1009345 - protein, 162 aa, Homo sapiens
IKKKPRKKVRGERREKKKKGGKGLQNTGTNSAQHRDRPTCSKTGGASKRTPPRRRAEKHQHTRTTRHQTHPRNPHPRTTPSFLLSSPLSSFQLYLTTQYLLPQHYTHPIFAITHPFSHYPLSSPTTLTTHHINIYCCVSSLLSLLISFPTTTPNTSFPPPPT

SEQ ID NO: 1009346 - protein, 287 aa, Homo sapiens
AVRDARRVLVSAAGALWVLDDVQAFRAQKLVVLPCVDSVWTNEEASASIIVNMTDSFTEQADQVLLRFGKLLGDRDRWMQFFAVAGWMAPGAMANPSLSLQNCDLDVERRAYGSSTISRHLATKHLKEGGLLTLAGAKAVLDEELLGIDRVYVHWPRDAVHQSLARDLARARISVMPVQGEDAHRMCSRLPWIPQMNRKSMPEADFSSWTPLEFLVETFHDWITGKKRASSVKPNPGGNHRKEGLELTPAYLKASSQCLLGACRKVTNLSQCGLSSLVLLNPCLVYE

SEQ ID NO: 1009347 - protein, 405 aa, Homo sapiens
AILVRSKVGATVFPERLLRLASISPLTTDMSRDQCSGVRWRWRWWLPQSVEEAGGQWRVIRRTSVSSSLTLAWSPSDVIDREPRIRVLWSRGREQVAEHFTDLRHYLHIAIAENEPSLGEALPKRGQLRAPDRKMSSPERDQDRRVQSVARDRRSRLASRGRRPSAARTLSKARSIASGNRGTPHPGRKACGHHTDASSVEPQTRHVQQAIEGAPARVRGQARTPSTRRLQSPSDPPGDADRQTLHKEAGDPYQYLHQSRKARHAVTPREVPGTRVPGPKQRRRKESGVGIPRRGGNKCLEGGPDKPKVGSPGAIKEYAQFRRRPTAAKATSGDRQAGQGGRPPSVWGQYQDSTTPGTLCTKQRQEFPPRGGPPATPGGGTQGRGTTVVGKTAISPERREGGVYT

SEQ ID NO: 1009348 - protein, 286 aa, Homo sapiens
RKKDGSGPDRVASLAASLRFVSGPRDPERGEADRMTDGARDGQLESLLGSMCSAGRNWTEGEVWMAVADSRLEAAEHSSADSGLEPCARTPAELAGAPGGQEGLGRSTAWDVPWFARGLFLVSHYHGLERNYRKCATRGIERSALRGVLDWTQQFYQADGGLGLRLPRFPCALLLPGSETVVDQLIPVLMKLLVPSPAASPVGHSSPPLDASGDWDWTPRILTFLTFWFPVVHCAPITDTAEPKRPCKHRTPIGRVPLEVEQNCEVQGWESHFSLAAWSPGALPSW

SEQ ID NO: 1009349 - protein, 115 aa, Homo sapiens
MVGDHKARERMTVKEVHGNVAPRYQPEAPPLGTANTPTQRPRYKRQNEATTNNTPPQQGSDHQHKSARRRTHSAPTHTHPPHYAPQQNTYQPRPPRQTPHYPATAAPTLPDLNPQ

SEQ ID NO: 1009350 - protein, 79 aa, Homo sapiens
RYGRIPAGRGGGGAYGALWCLVHDFVVGQQEGPADQVAAGPLQRIQNPELGHEESSCHRCYLPCSCKELHLILSIRSSE

SEQ ID NO: 1009351 - protein, 136 aa, Homo sapiens
MNAFYIWQLPALHKRGVSVVEAVKLLERERGSGTVFLDIELYLVRQSEGSGGSVDVSIESLPSDPMELRGPVTIVCLIYRRPIAEVRRVHVDLMVRSAGSDDDDAGQRGTVNQSPTLALLHGTLHILLLIRPIERK

SEQ ID NO: 1009352 - protein, 131 aa, Homo sapiens
AATVHRAEEGHASPVSKTSETRLSRGRSGPRQQMALKDYALEKEQVDECSLARVNTSDDDTLGRSKVQVVEKPGWFESGVQSSDTECALICVIAGWMVCARSEPRVGLDFNFVRNAQEVLRRLFADARYNE

SEQ ID NO: 1009353 - protein, 46 aa, Homo sapiens
MDHSRCRTTAAPQSANNASKRPTTAADGQRARRTTLGEPGAPTGPH

SEQ ID NO: 1009354 - protein, 219 aa, Homo sapiens
MHVIDHTEGAAVRRRELRNVLTESARIARGKITELANLSAANNDAAIFPGGFGAAKNLSTLAVDGKDGKVNKEVERVLKEYQQAGHGQSGVMLPPRPPGNLIHVGGPRKRGSSCWFTVVRVACRGLARARSRGLCGGVEDRVDGGVGKWGASLPSSVTANKDEGSIGNPVSPAQRHSLKDLRGHCPRKAATVDAQEEVQGAEAPERKVLAGDRAQAGLK

SEQ ID NO: 1009355 - protein, 349 aa, Homo sapiens
GVLEASGGSWNRCVSRRRRPGREAGRAWGVVIAVAAGPGFWLRATGISYSQGATDKPFHSVLLMLVLLDVWGVVSVKANVLDELIEDEATRHYATKLLTDYTALLPELLTRLINGTRPLISEFSYNGLIIQLNDIVLTRIEEPNLVRKLWAHVASELQKTERDSEDILWKRTRPRINPKAQAGKHLPVQRKIGKPNYLHLKLHSATLPRKRGSTWNSGTKICEGIRRFLCPLGPTHTRLPQKTPKRLRSGNFRGYANLVLYPLGPYRHRLLHKAKTPNETLEGVQHKNYYVTTFPFKRKKNSSVHGKFGDSGSLGRNSMERLIAPHLTLHSNVGNTLLHTRIINISADA

SEQ ID NO: 1009356 - protein, 232 aa, Homo sapiens
RALPAVDKLDPTSERPAEQAHAPDAAPEGSVEICHVLLQVSTGPAHASFTRPLGPSPALLPGASLLPLKAGANINAVDKQQRTPLMEAVVNNHLEVARYMVQRGGCVYSKEEDGSTWLQHAAKIGNLEMVSLLPEHTDRWTSNAQGTVRGGRPSSWACKQSQAHLDVIRMLLDTGRLRHPPLTTQENILPALGLLSRAASGHRRQSFCNARCDPPCCQLTMGTPPCTSQSAQ

SEQ ID NO: 1009357 - protein, 100 aa, Homo sapiens
MSFFPIKWTMILTRCRCSVPLLHASAFLPFSLPSTERLSPYFQPLANSPLPALLLQRLFETLALTLANGFQRSDRFSPPFTHFPQNRRGLVDRCKFWDNA

SEQ ID NO: 1009358 - protein, 39 aa, Homo sapiens
MGPHLLRANISPLFVVTSPTGGNILGPQEVAQSRSIFTD

SEQ ID NO: 1009359 - protein, 208 aa, Homo sapiens
MPRTTVSTHSIEPVYIKSRRTKRKESNRLLRAGFSRLETPIGPSYGVLCRIENTLNGILRNLQQTRENNKKDAFGGPIERGEWCLKVMEPSHPYLAHTTGTSILAPTGASIRGLKKGQSKRHNAKSHLGPVVAKRSTNSGPKALADSQTQASMENSQSRVGHTSYNFGPPQTTNHKSPNSRSNFQFRFIRLGQRTLGCTKQTWGSKRV

SEQ ID NO: 1009360 - protein, 222 aa, Homo sapiens
MALMLVSGRRKVIHEFCCLAQKVALYNLSIRHDDVDACSWAPHTGVLPHLGLETGNGGVGYLSLNAFETHSQSKTMTQFLETRGAVPPSHMAANDALDVPRIAPCATHGSEEAFLGVQSHDSDKVGVVWGMNFMVARTCKETESCPVAKENLSVVAGKDIAAAPIVAGLVMTWIRAIREPGGIAFGHTWTLATVEYIRKKEQGTRTIKESDTTSTGLWLADD

SEQ ID NO: 1009361 - protein, 296 aa, Homo sapiens
MPFTVLLLLLLLLLLLLLLLLRQVLLLLLLLLLYGLLRFVLIVLSSFNPSMLALRRFEYRHLKPYFTSLELTNSARSSSYPSVALNKTLARLRAQRPPQYLPSGTGFGSTVIFYKADIDRCRRSGTFWNTSGPAPSGTARSPTTASPEQELYLKSNAGNSLSQVFRRKLPLRLRQKTYFSQPPADNSSRQYRKTSTGPFLGHSVDQKDSSNPVEADSSYWGYQLNVVHATSFTSPDQSLSLQSPDLHAKTDTQPGSTHLQETTTTLFPPQRGTRSNPSRHVTPGDHEPPKNAANPQ

SEQ ID NO: 1009362 - protein, 175 aa, Homo sapiens
VVLVFSKPSSAILVAAATTRLLLSDMTDQMTLRWRPVEGPERLGNPGSDTYPVVSRTVIRRRALFEHKTIIMWKLTRDESNYGIPQTYSAGSLPLMSCDVVIIAQMYSIDALRHPWDVTPDVLWDLTKGQAARGDQVWPYQGCAECGFFLLDKARRIVSGISEIRNIKGYGIPWV

SEQ ID NO: 1009363 - protein, 607 aa, Homo sapiens
IPPLWGGSAGGVGLGPLRKSIRAAAADAATAAASAAEEDSADPGTDKRTPAAESHRHRPRAQRRESCLPRERHGDHTSEHEIRQNKANEAPHGKRKHEHQAPKATTRKEKQDTHTGKDKTSKTPPRRTPQTINDKNQKAETQEQPKQRTNKETQNKEHKKDRPRTRKDHRRKTERNRRGNNTHKQQKPITTTKTDEERRRHGSRETNSTTQKQRTEATDKGERREHEHQSKTTTARAPHRQEGRTNATTADRSTKQTTATGTAQEATRAETADRTTHHVDALEGTTSDAPKRRPARPSKRPKRRTQRTHRASAEITKSKQPDEPDEKATRTERSEERGRRQRPQRTPERNEVTRQTSRRQGATRRERTARARTARDRRGAAKSSTARKARHRDRAEGGERSRRTQEKSRTAGAQQLEDRRQSLNSCHDVTHDRTHRAHSSLHAQPTAASTEHTASPHSQQTESEKQHIPELCVGITAEQLGSQQQRSSDRIVTGSKTSKQRRSMRKSLMRRYRDYARRTSESRRTHGTIESRYRERASRHMTTAHRRRTKQMQEKQRKRIETERRHQRQLTTHTSNGRRSSERTQDAHAADEPHTRTPPVRRERSST

SEQ ID NO: 1009364 - protein, 262 aa, Homo sapiens
MGTTRWTTRCPWGITPKSTPFERNFNTRHRLEHPTTGHGHTTHIPLTLADTMQTASGPHRGLARNQLAASTWASVQRFDGYSTCDNQTSSVRDISQYYPWRNFPTAQIFGQTVPRGAATQNRAPYRSASRHEGDNLKGVTLRESRVTTLEHQGTTCNHTSQTGAIDDFPATLQSRTAPSHSVATTYTCGTAGEDAKRQWNKIPKCDEDNTDKRMQDTPPYVETSPTGTHGIGIYGTTGGDRFHPRTQPSFLSIAPIDDVELM

SEQ ID NO: 1009365 - protein, 78 aa, Homo sapiens
HVGDYVYFEKLLQQIAYLIRRIEELIARRPLGTWSANVVCFYRRRDISSILITPWPDKHCTRELERSEIGAILEHGGT

SEQ ID NO: 1009366 - protein, 183 aa, Homo sapiens
GWRGVAVAWRGLVALAAAPGAVDGDVPPSGLSFLMCSTRRHGPDRAPEIAPCNLTASLGWPQRTVDGTKGLWGSSSLTTVLVCDVTRTHLLLPQDDRTKPRVPGDLYGSVGWQHVVRHAARGDHLAFMRTVLDDGKGFRGSSQFALMEVMIRKDRSEQQCNVVGWYQSACEHFLSVLDRSLGG

SEQ ID NO: 1009367 - protein, 275 aa, Homo sapiens
AHSRSFRAKERACVAEEVSASLCNGGAEPSGPQGPRRRFQVPVRPGPGEPWINEPLSAMRMSEDEMAQGRLPRGREHAVSRSTGASGGGRGTSWRRGREAQEARSQCPTKPILYRRASAIADKKRYQGQPGAWKHMPVVQIELSVPYEGSMGMHNVRRYVTCLDRGSERLTGAVSHVEERNKVGMDNQSERRLDEDGACVRTKWFGCSTCDSVPREHRHTHVANDVRYQSGQRAVENGPVTNCLLAPVQNCRNDKRGPHKRIPYGGNPVISGAPW

SEQ ID NO: 1009368 - protein, 134 aa, Homo sapiens
AVLPRVEGAGIPSGGEAESDPRCVSARTGPCLGVCCWSRAVHRPSLQTAAAQLPDRFGVLLRMAWSDKPWATGLGVSVWLLWACRRRRFAALLACCVISCLRVGPVASRAHEHPSNLAAGCSAALSDEDPSGAL

SEQ ID NO: 1009369 - protein, 122 aa, Homo sapiens
MLPIFNCNFMGICIQPIPSSNQFYVWYFHNSARNSCGPCLQRWLTDLLKVDRCWGLNRSSPWTHITLSKFCSSGGLDHYANAVITAVTASGLEDRETFTTKKRPNTAKKSALKVQPIFPKGT

SEQ ID NO: 1009370 - protein, 289 aa, Homo sapiens
GHILPTPTPIQPSSSLSFGHPHPSSMVTAMGWEQMDVEDRALPGWVDQTLSSPAFPEGRHHSCQPGSAQHPLSWRAPSSLPAVTVNVPHRWEAASAPDRCPGGVSCMDSCWENNKDNFMERQGGDGTDEGNHFLDTDTRLTAKIIYFGSVISNKDLETWWSELSQVLRVLTSRLDGIHQHRASEEQIREGPQPAPIYITLGIASTDISRTPGWASAQQPQWTRTREGELVPCIDGAPGPYTGHDAKPTARPCRRIPQANGLETHRQGTQTINLDTGTHVSPASAPYGTR

SEQ ID NO: 1009371 - protein, 163 aa, Homo sapiens
MRAGVGEREVRSSRSYTARYIAGRKRTNSGEHTNQYRAPLAQSAQTHSRKYNDWDYYICTRRHYSQNRHSTVDTKQTTVAQTRAWHRHKPPQKRGTRPEGTWKSPSTPGHQHNTSEQRLKKAYVATQRNRPQAHTRAQRKQQEQQTKKDEQTGQITKEIEQHE

SEQ ID NO: 1009372 - protein, 126 aa, Homo sapiens
MAEGVHNVRTSNYWPKLYLPILASSPGMRTHRNRRFPQLPPHPKSLSWGGNYTTEFPNAPSGDSAHVGGRMLPGEGPAEGEKKGAAFVAQFGGLYRGTHIADKQLVGPSGSNFFPVNQTLRPFSRR

SEQ ID NO: 1009373 - protein, 277 aa, Homo sapiens
IFVLRLFMTPVAMVHVFLSINLLLASAGAGVKLLLQRWTVSVKMNVLLFGPGLLFLLLTAVRLPWGPPQVWESVLAYRVVLGLPFLLENPSGYLCRVPFELGRQFLFHWTVNWRFLPEALFLHRAVPPGPVDLTTSRCSCCFASAGGTGQGKVSCQLLRDPSKRKVPPQALNPAMIVSSLFSLQVHWHSSFRRSLPLPSSTSWYIHTVPNLCGACLQAGHTPAQVEWCLGLIERLLEHNTLLTFLKSVACTYCHAVIWCSLGLGPDFPKSTQTEEGH

SEQ ID NO: 1009374 - protein, 219 aa, Homo sapiens
MTYVNAGTEDAAAPGRKLENVTYEAGMNMRQGRTVRNERVYMAAFHPELGLCPGHEAQRMEHIVPDVPQGKVGKVRYSTYGYNCPTAHCDVSAQLTCREFDQMHPRMDSAINDVGLLAAITWNLGTYSALYVRNTGVGNTWPLVSMTDRVGKTSTDETIAKLVSPLEANATVSPHVVRHTGQCMPIWIHPKIQTTAQQHQKDIPSGAFFISPAELARPE

SEQ ID NO: 1009375 - protein, 255 aa, Homo sapiens
MGLRATVSVVRPFLTKSLQFAQSPSVSLVSVIGDIHWSVITGSGSRLGCLTSHGLGPTRSPIRPVAFLVSGPSGGASGSLNRHDLYCISLRQAQAHRRPLEGCPGSKALSAQAHTLARAHVFDRVRLSVSSHRANALMAWAAQKRFQQGQLLDGREIAELDANYFRIPTEAPFSSRLRARVRNRFKHPMKIFQLTNARDEENLTVGIEQKKFFREDPLGDSEMPTVTKDPGYKTGKAEVGRKQPGPKRCLTKPGV

SEQ ID NO: 1009376 - protein, 342 aa, Homo sapiens
MSSLRLQWWTSTNGFWRSPPIWVSLLDCSKGEPAGELAQLCGKSIPGLGRALTLRPTCGECFGAHWYRRFPIPIRLLATREIAGSPFLCRDYRFRISGMRDYTPWVTFRTACSPLYQFRKRPESPHLPIAKSPLGFHHLLEAWVATRYRISHKAPPYMVTPVNRAASSIWRRRTPHHKMVARREHFHTHDALIYGVRAPASMDEQQTSAFPQPPRSTRCHRICNTRRYSLRGNIWAVPPRGVTHKRGKQCLAPRAVYEWMCGGHPPGRVIYEEYSSNNPVTLRGDLAGSEGNTLFLNCYSGGEIARPTVAGGHTGHVVYARAPYYAASNDEGTTRCDGWYYK

SEQ ID NO: 1009377 - protein, 701 aa, Homo sapiens
ADSYHPWIADDPLDWRSEKWLQNFLHMTKIWIRPSFNTNDRTATHNGRLSYRTTRLTPARPLHAATRMPTPQTQRAPPHRRPAQARCTTHTRAAPTLATTARPTTTQPANIQLRTHFPPCAHCANTPLHAAHTRERPLTTTQPHTRPRTRPHATASQPHPSRSPALTPARNHRPQRHTPGGQRTEQRKTTPTEKTSLSADIADENWGPYATPATRPLGHTRPKATPPSPRPPRTDAPEGPTPDTPTGGPNRQKTRTTPHLGRKANNQTAPYPGPPPDSHTKTNRAHHTTTTGAKPTKHQSKPPPQETQTRPNTSHPPPKIRPSTTHKRAMEKKEPHPHHKQPATDHPTQPAPTHAHPDTRPHKRSNNTTRGTPHAQTRTPTRHALATLHSPNDPGKTHPLDTHKTQHNRNGTPQPLDTRGTAPHNAAKTTHIANRPPAAPNTTPLGTPEATHSGHTRRPINPQPKRPPPPPAWQPHTHRHKPAATTPAKNARSRTNPPWGHSSRQQNTQSPITATDFTTMDPKWQTTPHITKDTTNRHETKTWHTREKKRPGEQTKNKTSTTQQHTITRAKEKHNHDRKASHARPTKQPSTQQQTEMKTTKRTTQVQNTKRTQNNRNTTTSRDSTTEHNNHPRTRKATPYQPRDNKLPRHEKRRDDKRKQQRSTNSEENRNMEPEAKRRGEHDHTTKKKKERASKTQNTTQ

SEQ ID NO: 1009378 - protein, 234 aa, Homo sapiens
EKQKIAEGNVEENYEQNNSPTLVAKRYRKSEDNHPGDADGSKGPVGRPRLGSYFLLPPSHSWWGQRSVCRETSFSSGPDGCFIRMAWQQSRFKLASPAGDPHCAFPGAWQVIYRGLLPVTHAYVSQGHFFSSRRCVMNSQERGRWEPGQDYGKLCLSLSTKARQARPTSHSVCPTSAKPWLPLSHTATGTDRLTKSAAAPLLQTPAFCSPLTSEALPSHERDCGLRTSSPHPLP

SEQ ID NO: 1009379 - protein, 172 aa, Homo sapiens
GEFGGSTVPNPYGRHTSGTVGIAVVMESGGRPSTVPFQSSCGTHRRVVTCLASCYLRCYRAKKGRPRSSPKEASECELRHRTFTYESEGLSNGGTSIQEQHPCERHCRLPLIACLSCTWRARAGSSLYREPALGASLRICSWDTTLLRRREVTNSQAWDLDELYRWMPPIRN

SEQ ID NO: 1009380 - protein, 154 aa, Homo sapiens
MNDTVEYPHYKVHEQCEHTSEETNGHCSVLTSPWKATVPKTEIREKLAKMYERAHRMSSLYCGFSELIIGGGKTTGFGMIYDSLALCNRTNEPKQIDLHRHGLYDEEKDLIESNERNARTDTDRKSWGTAKAKLVLAKSELEIGSQPKEYKVLQ

SEQ ID NO: 1009381 - protein, 373 aa, Homo sapiens
CIQTSSGCGCYAAHLVALNIQRDCQDLLAAGGGGGGLGLQAARTMSLLSRGKTPRPPDASGPSRDCSPAPRSRLQPSAAEAATRTELSCSPGDRAWAHVDALLDWICAIWPLLGASAGSPWSVLLCSPLGGWSCLSGHLPPVLRLYRSHSISKVFSRESHLIGAPAKKRDAKRKIGGKAGTLTLEPNALFVIACLPPIKVTKALRRPLLTVAFERLEPATATSEEGALALTKVTFNWRDFDPPSCYQIGFELPFGRSAKSLPTFGDATPIAVEQWPKRAVWIGIDKPAVQLRWVLKFNTNRFLYSPVRVESPPDVLGHPTVSSKEYRKIIQADFQSVAAKQPSDGDSGGTPETRTRAWSFYMAPIGLRLRRFQ

SEQ ID NO: 1009382 - protein, 132 aa, Homo sapiens
MYPNGSLCTPGVILVISMWRLFRHALVWDERHYQSFERVSRLDIRNYGCERHLNLGALNSFSVGRFEMTKAQLHTTDLALARFLYRTELIGTGLSSDTWGVSLGPHRVQELLGENFGILWPFARHQKRHVQS

SEQ ID NO: 1009383 - protein, 289 aa, Homo sapiens
MTQPVPRLSVPAALALGSAALWRRLRHWPLPGEAVPPMARPVRAVPCILPQRTALRCVQVSFVKPHPMLGAPGCCSKPGGMLTLEQLAGGFYRCTCCSIALGSWATMCAGISPEGPQKGRLEPGQPFTGYVRPLALALAAVPRTGRVVTCEVDVQPPELGLALWRPGRGREHKIDLRLKPVLGDLCDELAVPAGRGRRPSTWPCVDADKGELLLYYERCLQLLGPGGILAVLRVLVAGKVLNLRNGDVAAECVRKLNERIGGTSGSTSGSCPCGDGLTFALQDLGLAPK

SEQ ID NO: 1009384 - protein, 84 aa, Homo sapiens
MIRMRNLNYFAYTTSTHTPLTINSTTIYTTYSTHRSLYHTQLTTQNKHDLPATPRERTLYTRYRNIAQTITCVDESAPYDHHAL

SEQ ID NO: 1009385 - protein, 109 aa, Homo sapiens
MAHISTRRYQVPAPRQQQRRTPRAQTSGHNDEAQLSAINVTTNKTAPKLPNTPGAPTPPPLHYTTSTDPKGYHLYTHKQRTTTQRQRYTTGSRTNFCDLLTASPPQTTN

SEQ ID NO: 1009386 - protein, 374 aa, Homo sapiens
GLGSVPSHAPAAVSQLSPVCADTMASSDEDGTNGGASEAGEDREAPGKRRRLAVLGHRMAHLLRHRHDRRGALVLAIAMVRSPYGKTRNTQRFYIQSIQQDTSPVSTTLRLAVRIVHCLIGIVPTSVIVHWGPSESTTLHGVAHYVTVLTTQSRTDEECAPPTLLRRDGTCEQQIQLGQQPVLTAFQSPPSEPTFWPTKRLITHTVPSSSYPNTKLISYILPCSAQLTIGEHISSTTLHSRLSLSPPQHVRPQQHATGTLGSAQLTPTRFAVAPPSTTTTTESLTILPRPVYPYFIHSPLSLQPTNHQYAHHFTPNSLTSPITSYPPTRTTSHYIILTSYNHVYTQIPTPTRKTRASHLLPSSNHNAYATRLIK

SEQ ID NO: 1009387 - protein, 348 aa, Homo sapiens
MAPTIVKPNGEKPDEFECGISQALLELEMNSDRQWLYLTRELTYYWLAKEIEGCVVVRDTAISNLCSRSSIVSILSEQNPNGPASYAIFVSKEASGGEGMSVFIRSVGSNSVLTSNLEKAAIHDNYSHIAFPGGRVLLNSLCLRMPSFERLGILPPKRTSWYAAMMNPRVRRANDCAKTQGYSITVSIFAHQKATSQGITIAVNHPRFVTTLSLVGPYPGKASTGAHEIATNFLAIFGQMFLNFRDTPNNIGAVSSNDPLLLSLSPLVQRIHWLSTGHRSCGSASGGSPRPEDSSHGWGRSLPRLAGASPGSGVLPGAARQVIESPLCTGDTLAGGLPGGGPSGPWPP

SEQ ID NO: 1009388 - protein, 292 aa, Homo sapiens
HTSNLDIVFIPLMIMQSEAAYEPYAYPSDYDMHTLEIQSRTLLMNVCMSSKRYQVIPEVIEGFIQYFHKTVSDLIDQNVYELQVSRVSSDVIEQKVVEIQDSLLATAWIAMLTERFFTEYSLGPRVAAIVPQVGNRCCLPDFILRNYSTEHSTMREVMWWDRSLEHEVMKYLLTTTSNSLQRTILNAMVLLPLKVPKTVDLGYYRLTFIYQCQSFSQYRCKTATKSGGRQIDLGFVQIPKSGMSPVSSSVLHSLVDKSKHLATGWQVKQRRRRLTLRVVVGTFWGGASVRTK

SEQ ID NO: 1009389 - protein, 143 aa, Homo sapiens
MHEKRAGHMQHLAKLQGGQKNVKSVDKLYLSVETRRPSWGTFLVGTKSGTYISPLRGPDSIKDKTLSITSDSALTFLEHSVIRSPAKTRTKNCSPLNSEQGRQTNLPFWQYAQIDAAINNAAGAPVELPVAPSMLKAPKLVRG

SEQ ID NO: 1009390 - protein, 112 aa, Homo sapiens
MLVRIHKNRRLTTYGSLSRHNLLSCTTSRGTSCDQYVVPREDCTRIERLLTKTKHMNRESTHQNQQYKKIGGAKGRPDRTEIQHSLQKPENNKKQHPARRKKTQTGTTKANQ

SEQ ID NO: 1009391 - protein, 48 aa, Homo sapiens
MAQCNTEAKQAITVITREPSCKAQYSYIELQVFSLQHGVSDESTVLEK

SEQ ID NO: 1009392 - protein, 123 aa, Homo sapiens
CICTDGWDGELCDRDVRACSSAPCANNGTCMSPIAKELYKAPDAPGYSRKVTEPDKRDGARAVINSESPLPGQEEHHAVGMTDGQQARSREHNQETRRDTKSAPLEGNLTNGNDNQPTPPYNH

SEQ ID NO: 1009393 - protein, 302 aa, Homo sapiens
MAPLKKVDVVFGYHMLEPWIRAQCDYSRGLPHVQLHRNYGHPGGGHTKIAQSHTHSNCKAHCPCRNWHCDTYALVARPIPVSTFSNVVLAPITSQTNWGTQGQPALGTTSRATVGKRQLRGPPRHTRHPTDTPHTPYHRGPGTPKGPPCSLKRYVLGAEDTHWTNTRKVSTTTDTLLMKMAFAEHPPPLHGTLVPISAALNHCAPFTLRAATTSPTTTHGGPPQAQAEYHNLTPTTCVFVAQCVLSPVHKRPFHSSYLPSLGLPTRGATITNRLPITLTSPHSHVDTLYLCGRTTTCKTPSG

SEQ ID NO: 1009394 - protein, 344 aa, Homo sapiens
GSHVPLNKLDAIILKGIKREDWVAPNAGPAMLNGACEVDGKTRPGSGPIISGLISTGLEVSCRCKRPPCWPTISGRIDHCPAGASSPISGHSPGAGPPSGALPQALPRRELLLSAARPRVHACRRLAAASGHTFCYKLARKDYCPAVWRTSVQAAGKVELRRKGPYTNLLAPNFWPFFAGEDARMHQGGGPGAPLGGPLRSGENPRMSSPQERIRTRGQSGEPERHSAPDETAARVAPKAPAGRLQAERPGPRRANQRDDWTFRPRYNPTNVGARTWASKAARLDVIRGFPPGSGAHTPDRLFTPRGSLMNGDRSPTSSHLGFPIYGGGDPPLPKATASTSNTT

SEQ ID NO: 1009395 - protein, 226 aa, Homo sapiens
MRIRRCSGGVALGALVALGLGTAVASAEVLGSGIRWPGSRPCDCVAVGRGRRSSAGVQGTRIRSGLPVTKLEPLGQGHEDQVPGREIFSRRFSPCTYLKGTQDDQLTMCSIGGAIISRTEVYRTIIAQLQGTPGATWPEHKTTPKRFPRGQFWVGDYSGRELSKVGPTDQSLGEWFKGWHSPRGKEVGRKSGRNSQDRGSQLNFPWGPQAFFRIQINTRWRSKNER

SEQ ID NO: 1009396 - protein, 303 aa, Homo sapiens
MPGDTEDQRYHGYNYRARVIDINERYSRRVCKCRRVSWLEARTRNVELALLESNLVSYQPSIICREPLASIYGAFRLVHAVRASVPSYNTGESHMRTVQQEEAKLDSEVRPRKRTGMTLYAPGSDGFSVPLINQSVASFTSHVRNATGTGEALIHRKSGALVHLRRIESALRLQGDLTCTMGWQRKVPTPLGKNTGNGVEPTCQLAWCTRSLLRKLRFPRLLRVRERDNHGRVYTHVTLRAYNGLPKQTCYAALPHGFAQRSPRESKASMLALCIRRDQNRPCAPAKCRGQHSGAFRDPFRTT

SEQ ID NO: 1009397 - protein, 153 aa, Homo sapiens
CGLAGPCTRSSRLDPPRPSNEEYTLRASDCGGCTGYPSSDSPPALRSISRWALAAFPQGRARDLQPCHDLSLPTPPLAPVLPSLPDERRPLLQSAQSHLSTQGLRSAGARQRDWQAAPPDRPRLRDPLGEASWAPESGEDMENLDVQLKLQVR

SEQ ID NO: 1009398 - protein, 286 aa, Homo sapiens
AGEVVVLVALSHPVPVLVCCMQTHCSRQRHDWADDLFVAALNGPQQAWVTPDRLLTPAGSLDMILSASRDKIIIMWKLTRDEINVWNCHSVLCRGSLPNLLRDVVYLAQMASLHLLQATLGMELLTTYWDLDNEASTTEAELMGPYQGMLLSCGPSRSEQPGTMVLWTLRALNDRSELLEYPWAVLRNYNKSKRMMQPLQQLAMSQMSRCLAAYTHGNPSHTYFLVRWDNARSQVTGTLAKPGNASKKANRQFGSTTGVIVDTERVNWDFYQELGLPFCCLNWQGK

SEQ ID NO: 1009399 - protein, 152 aa, Homo sapiens
EGGVCADRGPSCAKARVAAEGSRGRSLIPSQEPGYSERDGGDRAPGSCSAAVSEPLSRTMKGRMCQGSSHIHDDYQSSRRLRWCNSGLATVPASTRYERNYDDLRLVESFATTIFQTSHILELIALIVVKGVPYGWLGPFTHFEWHSQRKVW

SEQ ID NO: 1009400 - protein, 138 aa, Homo sapiens
HGELTVEVAALTGLSTRDSSKMFMKTPLQCLKIMEPERQVPFNEVRLPPHLIIKKEISEGDDVEDIQETNDQETSGVAAANTSLEKGEETVAGICTRKKGVTMTTQQHSDTEHPEDSAKPKNKHRPTNQPPDHTAHTR

SEQ ID NO: 1009401 - protein, 156 aa, Homo sapiens
RAAAAGGRRMAACGVPVATTPAAVRLSAERAQALLADVDTLLYRLRRVLWRRGDRTCHGAAPEALTGRCMSPTDKRHGAFITKQQQHRPALPYAEKLQAPWSIQAGTQQGSPDSQGHRKGHSGTESIHRNQQHLHIDSQATVDLDSHTGRPQKAYR

SEQ ID NO: 1009402 - protein, 81 aa, Homo sapiens
MWTTTIQIRKQPVTVYSRKATTRSNIWRMWAHKDAKKRVRQTNGTMAPQGQVERTQGQALRCDRHTRRKDDPGKAGRCEPT

SEQ ID NO: 1009403 - protein, 269 aa, Homo sapiens
VKSEKVYTRHGVPISVTGIAQVTNPGRTNTGDVGGRLSMFLREARTADIAHIALETFEGHQRAFMAHMTVEADRIRTGYEFSEQVFKVASSDLVNMGISVVSYTLKDILDDQDYFALFEGRLEQLKSKKMHGLEQAEANEQMLGSWESYSHSRKTVSAQYLSEIDDGQGTREITELKKAAYDIDGQPPAVALWLTLAFCFRVAKTKQQIEEQRVQVQVVEPGPAGGQCRSREIARRDKELEGRVRKDQRERSATSLERCRRAQKSHNYA

SEQ ID NO: 1009404 - protein, 291 aa, Homo sapiens
HQIADDAGAAGGALVGPGGPGMGNRWWLPRRFRQLCILVACWSLAVDCVAWWPRPAVTHLLEEQGHEDHVTWTCPVNHSYGRYGQGTEKIKSRVRTIYLFSLDAITGNQGGSIGMSFLGGLVVKGNAALCDGYSAEVQSKRYTAVPGPKSTHPSGYKSGNTAGHRSRGTYHSRTKRLRSPLGACYKDRLRKVTRLAPARLRLRPYSGEADKFQRRLGVPRNARSFRKFSVCPTAGVERSPGTVTHKPLRGGVTPAHRDFSVVERGSARVSATFEILPEFVQQMGIGQPRVD

SEQ ID NO: 1009405 - protein, 251 aa, Homo sapiens
ASLDQKLKYQDDKLIKTAVTGSLSENDPLRFKPHPSNMHAASCSSAGMQAGKHASQPSMHPVCRLPGQRNLCKGSVSSNIMFLHALVPSTIMHETEAAAARKHSVYHTEPKQTGIAASSVHSVNSNTEQYTPECSQEAKSVMASGHPPMVYHRPRKSGRAPNNQGISTSLAGQQPIAIGLQVYGEARSEVKRRQHAQGGTGVPKTGGKQLVPIARPPTKVSIYPIKPAHFSRLAPIAEVASLGHQRSAQLW

SEQ ID NO: 1009406 - protein, 257 aa, Homo sapiens
RKARRPRDRKVAPAPAVVKKQEAKKVVNPLCEHRPQNFGIGQDIQPKRDLNQSFVQIVEPRYSLVCMRHETPPAIERLKSASCDYTVLPTALRVAEPVLQLLTAGPQDTEPETTSKRRSRDMWADGENDRLLAKEGQSPHTRDPPVPSKHGVSTVTHLWMETQAQLTLCGDVHNDVDPNRRWLSIYGLPCVRKHGRSLYMHNPRGQGKTGRRLVHRDRTCNHWSPTHTGETRAEQRQHRVKTGWDSSHKEPKNNSTD

SEQ ID NO: 1009407 - protein, 254 aa, Homo sapiens
TKLRIRRSAGGARWALVALWMGNRGGFRGGFGSGILVDLEVAGLCDVWPVDLMAAVSSAECKCQRIRELDCTVTQSCGTLGSNDNEEIIVTCDGESYLRSPLAPIQRTSGESVEFRSLGSLFSMVLTVFEGLLPGAESRPRAEPGEPVFKCMSLLSGDYIMATVESGLLTCSKAEWAPTYRGAIILGKALHLYTVTAEATGGTQIGQGAQLSLAEVTGRCGSALDTPQSLNQVQTGIVSGTMCPKTLFMMAGIR

SEQ ID NO: 1009408 - protein, 430 aa, Homo sapiens
EAVPRTKAPRVVLNPRPSLVYKEIRKGESRSEALAVDGAGASLWCLQCRLRHPCTGQVAATMELSQPATAGRQAGSMASCVPAKCLFLGVGKQLEEAGSTERRTLALQRTWEDIPKQLDSNAGTIHGPTDADLLLDEAGWAGARDGATERPTREKTELANRQSITEHIHMKPHEDVNRQNYQVERHNGADLQGLCEQNGDEERTKSNKTEGIGNKRHIDKVQGGTNGTTRQQGQHLEEHITDPDIPQTTKKASERNGEQEKEKETDEEDQKKGKAHEKKEDERPQRQRRDTKETAEREAIGETQNRMGHKTAENEKEKKKRGERGREKRKRPGREADNEGQRDRKEGTKPREKKPEERTEQGRARERRKRVTRRQRAKRGKREGKGRGIRTETEERGKRKSRETKEKEEKHDTENKKATERTGEKSEGTK

SEQ ID NO: 1009409 - protein, 342 aa, Homo sapiens
MEELYCHLCILYFTRKKPFRFLLGLLAPFATAFATCFSSARLPSYDEDALKRTSGVDKRISRFILPIRGHREHGRSSTSSSVWPAVLIAQLKQQYELNCRTDFHHSSDCHSVQCWSSRRASWRGPQQLHIIHGRPLGWLDHELTLIHGCGLDCGTDHKVVNVEGDATENARHYTATEYRTAKHRKASRNLLRVKVEDITNAKSEEEDIDPLDDTHRNPLNPVDQDDPRKLAITTGSKEHSEWGTWAIRDIALHRTVYVTQPMESTTQTDESTIGPHTRAASTSKDHHIYKPHTPKSTREYEHHKPRKGTDERIITHKSRHTVLDIREAVTQRTEKSEQHHHA

SEQ ID NO: 1009410 - protein, 30 aa, Homo sapiens
MATGAGIMARIIYTTWHYFQDFNERIVTGP

SEQ ID NO: 1009411 - protein, 128 aa, Homo sapiens
ALRPRKPESATVMKAMPLTLFTDICVCAVTGDRVKDLVPLHRHSLQSGLCIQVTRSSKPLKRFSDFGSMVRTGFLSRQEDYRWFPTLVGSWSSQRALGQAAKIPMCVLIGMTLQIRQGMKRMLSHTIV

SEQ ID NO: 1009412 - protein, 258 aa, Homo sapiens
MESTTLRVVVAKLTAGSHTNEAAQTQASWGLSSGVPLSVRAHQTGKAAEPTYLPLRCFHLVEACVGTRQDLGPRGGHAKTALWVLTSLANGLGKWKRHNSQQDIVRRQNNKGAIIPEETSAWQPLVLPYPRELEHSHQSHGIGQYSERNEATTAAMGAPEGGHIGSMRGNPSHSEQGAQTKPFSTSTHKKWGRSEPIDITDTVAQVDRPKTPLTRDNTRNREHGLAPTQGPAADTHDAQPGANTTGRGDNGSTQGSAT

SEQ ID NO: 1009413 - protein, 164 aa, Homo sapiens
MEPVFELSRLTDSLLTTQQPFLLNPNTAGLLTLRIFHSPSIELHGHHQRYGTRHFLHQLTVTGDTFYPYTDLIPFLYTRLDLPKLLETYEYAPMLTVSSLGRSLFEQGRNTSEETIPCIAGTNRGRRQTTAAPSRGLLRLAELHFDIHLVQSPRCTSMPFLLTA

SEQ ID NO: 1009414 - protein, 309 aa, Homo sapiens
IDPVANDNSYDELKKMQSYVHHLPVSGSCYSTSSMCLWYFRCYNKQHIVKSSFVGRARMTPITEPSSRPMVIFITLFIYSSNNEACQVKRISRWPGFIQYFLDRTKTNCETSIRTYMCFATKALLAESSINSMYSSSLAHMGPRHYWQTTNFIDGQKYAKRKETTLQTKRNQCRGNAMRISGEEEHYAQMSPLQCNEDYVEDTKSRTRIHIGTDGIKGNLWRSRIGWFSVLPQRTHFIHGIVDQQHLGVIGPHTVHHRQFARLRHVWQQEFALQLHFPGKPHINRDEMAAAAPRHDKNDITWQSVYRIV

SEQ ID NO: 1009415 - protein, 248 aa, Homo sapiens
MRTSLELYCVSFRLRGHRILPSDGPCSNGAVPLGPSPLQGVYMATVEEGEIQHVLGETRRVAGTHPDYGEELCFYLRILWLLCCRLAGPGVIDILESPIVGPLRSTQPKVSCYAQKSRMRHITQGQTRPLRQTPWAPLAAGKSATSPQGRSQTARKRRGIVTCDETVNHGKKPSPAGTPPTLDTPPESNCPPLNRGTAPSKDGPMESPSAHYPLDQLYSTTSGHGGLSFTIGHESRVRQPRDPVLPSR

SEQ ID NO: 1009416 - protein, 134 aa, Homo sapiens
GCFRLRLWMLRLSDTQMKVLLAALSSRGPSASCCCRDLLRADEKKKGPKVAVQVYLTYNGDEDVGRVIQVSSEKTVPKQWIIVALGYRREGDLWLLESANSHRVIKDFMMQGGDLSRRDGAGGKKHLKGERFPG

SEQ ID NO: 1009417 - protein, 211 aa, Homo sapiens
MQRPRAGESAGSELTQPDMHAYPLAPAKRTRYRQPPTHRSQRQPLSRSAHTPSSPIHTPNPLSHGPPTAPTVPHTYLHPTAPPSFHASPGHPTHWPTRHPPSAPRRIRPPPTARSVPPTAASTPHTPPRPTLPQAPRRPRPNQDTPHIREQIPHHSAHLSPPPTSPSSKQRDVPTTTQRPHRPRTYAAQPHSTQHPSNRPQPLSRRQRPRR

SEQ ID NO: 1009418 - protein, 197 aa, Homo sapiens
SGAARSQLGPRTARAPKPGSQSGTQLNARLLCIPNQNTCINESAGTLSMHARKQGSPAAPQPAHRTQHRQNQTKKTHKQRNTLGRTREKRKHSRDDKTTNTQGPDKAQDKHNYPRNATKKREQSTERKKERNRTTDNTTENGRTKEHTEKTRKRKKTIKGTHKEKTHTRDKNNTQTRHTRNKDERKEHNKAKKRRQK

SEQ ID NO: 1009419 - protein, 123 aa, Homo sapiens
MGSAPQESTEHFVTIMQTLLTEFSAPHDIPSYKSPLSLKTSRAIVEDPHTFTGPHTHIHMEGTHINAETQITVGSSRQHASEETLNAPPNQHTDPYNHARYPTEIYKKRGLQRLSPPSQLNPY

SEQ ID NO: 1009420 - protein, 233 aa, Homo sapiens
VIAILGSRCSRTVRAPVRVANPFKTPHLQLGARWSQEDLRSNIPSGPRAKPPAAIDNPVQPPAVRKKYQFRAILAPAQGIYATSCGSTSIARVYKASDGILTHNHHAMLHISTLTNLDEENLAQIIATAWHTAPKKVHNGATTIQRQFLQALTPLTTTDGTWVRLPIRGHHGAVKTSRLRRTSSEHIITVLQPYNIAKVDKRGAPPPLQQKIFMNHITRNSKSTSFYNTVPLA

SEQ ID NO: 1009421 - protein, 193 aa, Homo sapiens
MTTRRHHTQKLKEIQNKSAKTRREAYQGGEQDSRKVTRQRSEDRTPGSTELMTTNSHRPHTNGDIGNNHDDTLRGGPTVRRHLHHEGAETRRDKTGPNDNSYLKAEPPDKKRENELTTAERTPDNRQKQRTSRHTKHQPDNEDRRKGETERDVESTGTAEVTEGGDQPSDDNRHCKREKREETNRTKRSNRAK

SEQ ID NO: 1009422 - protein, 153 aa, Homo sapiens
MRVVHLLVQRGQAGVRVSGNGLLGSYYVAWNTGIQPRWPDANVTETIAGEEIDCRSRNLLQYTTEGAEASNVPRGQCWLDSGNPTSQSECHVSATVDLRQAKRRSDRLKPHYIYQGKQDRMAGQINLMAQKGCYFKGYYGAHADESQLNPSDC

SEQ ID NO: 1009423 - protein, 302 aa, Homo sapiens
GPFRKPLLETLSKPVANTEKPVCPPALMESGIKEKKKVQKRARKERQRKTGNKRRKNNRKETEKQQRKNRKRKNKEKRETQREKGAKKSEKKGEREEDKQSREGKNRDKEKKEEQRSKKKKRTGKEEKKREQKKQKRAKKKKKKEKTKERRNKRKKRREKEKKKRKERKQRRTEEEKERRHQDEEGTKRDGKGEKREDTQDNKKRGRKDEEDKGETRKRNEREKRRRKERNRERKREKQERRQRGRKQRARRPGRSKENERKEKKKKKKKEEKGAGKKKRKRGEEERGRKRERRRERKEGEK

SEQ ID NO: 1009424 - protein, 383 aa, Homo sapiens
AISQNGRGKDSYSTLSSYGHVDSGKSTHYWPILIYKCGGLEPDDTILIESLMTWRPAETGKGLLQVCLGLGETDKLDGVETLVINIDMLLVEDTEEPVKLLSDELVIALTPRTSSTYLCIKRTTDLHGSTLRGELVLIRESSAAGCVGEHCEKAGISKNGQTREHALLAYTLGVKQLNCRCEQNGIPHEPPYSQKRYEDLVTGKSDTYIQEQLATNPKTVTHKCQIYCVANGDNNAGNKVLQHCLGSKGLVNRTPRTGTGTRPSGQTKARHGGALENCNTEPTKTRTNRDKRTRRLALPDQGKWQQRKKLGAETTEPGTGDGARNWTNRSGTNHKTRGNTERTHTRLPRRKKVHKQSEAQTNPGGKRHHGTARGCNSIMTRGN

SEQ ID NO: 1009425 - protein, 272 aa, Homo sapiens
MDVNAAIVRTINDQCVPSDVLWDGCPSVGFHMAWAISRTQSSHICWDGLRRMIRAPMVTMETLLVALRVAKNHQATRLSALGFRPWIAQSVGPACDAKQLPVVALVTEARGGMRATGRRSLQETAPGQRHLRLARRRAQGTRIQKPGKGAENQLGNGHGAPGRTSLGRGSRDSNIPRSQHSPDKTSIGSHPSTARANGPTRTDTDERNTTKVRPQRHGGRRQAEQTAQPSPTFPKHHATKQTRRTKTDNHTMEPTNDTITTTPKRTASQAKT

SEQ ID NO: 1009426 - protein, 205 aa, Homo sapiens
ALTRRGVCGMVMSLSDPEKFEHIWRVLNHRYIEWCGGTIAFAIMAIKGRGPNDMLMWMLQDNARPLTFEQERRWENVDLSDEVLNDVIIDVMLVISPPNSKIPDVVLDTDPDRIVYWTGKNLPGAGSLMRRKGHGIHNMLPVERPPGKSDSIQNMTLRGAPLGRDMAVHVFVEGALSGGFPEGTQGHTRPKREPNLWLRRRFVGP

SEQ ID NO: 1009427 - protein, 142 aa, Homo sapiens
GRGFLSSTVPVDGTRRSFPHPVTAAHSQPSVTSSPNPRTSPSAPGAAPPPRKTPTRRTDISLVAAMTDRVTTIAEMRQKLPPGTQRPTIKPNRSTLEALRLLTVYLVQCRYYVMDRDDVAFEDTLPNTFLSTNLHESRGNQC

SEQ ID NO: 1009428 - protein, 325 aa, Homo sapiens
APQALGLCPRGPALLAPSQENELEEDAWCPVPAAVPCGDGTALLLPCLCCHGNGAVCCLLLVPLPGARRRPCRPATGRPPCLLGPRVTLLAPESVALGPGATQRSPVSSEGVLRTRRPCRAMVMSQGTYTFLTCFAGFWLIWGLIVLLCCFCSFLRRRLKRRQEERLREQNLRALELEPLELERQSGRERPGPWRQRSHQHTDSRHGWRLAITRHSPFARCTLHPDACTTGPRKTARARRTPDPEPPGRSRTRRYATVSDDDNGRWSFPAPTLELVHIVPNHTLLTTQAGADWQSPPTPNSRGAHATRRGHLPQDRQAILDCREE

SEQ ID NO: 1009429 - protein, 473 aa, Homo sapiens
AAIVLNSRIPCLDQEYYRKPVEELTEEEKYVRELKKTQLIKAAPSQGKTKFCVCKHPSPSSQDSNQPCMHASGRQNQQSLAQHPSHAFQHSWHSLCKHRHSQFCSKSPMPALCTQATGEHIRHAKPVQRILPIDSTTTTTGSSHNALADWIPDHINGQACIHNQSHLVHPVTRTSDRPDFTSDPLDTAGIAFTLQMARGTEHNKTHHAGTNLYRPGRNRLGRQHTLAGPGLYSPNTHPTGAPDEYETAGHTAMHLSPHKALGQTEDENLASRPLAHRPNPHRTRDSRKILPRRRRRTRRGHLPLARANRKHPRCSHSLPYGPPRLRHTAYTRWDGARFHHGGTGHTLPRLLVNRPGSPPTAAPARSQATRPVVPPLPPYISTPKIQESAKLVTHRERYPDSAYESQQHRTAPHLLCTLTIRSTPYGAKPDKGKAKRRFRTIVRAETLVDLSRGSYTYHAALSHHRNIEHTIKG

SEQ ID NO: 1009430 - protein, 328 aa, Homo sapiens
HRQIELYGVCGECEREAPRLYFYDLPFAWFVAPCDPGPLPAASRKLLLCSCATACGWLAAAAQLAGKMKLSLVAAMLLLLSAARAEEADNDVRTWARCVGIDLGTTYLHASDSVQERTACEIIANRSGQTASQPGPMSTFTPEEGNSLIGDAGKNQTHTPTPEATRSLHAKADSSDEDGIDTVMCSPDTPSSLPGHGRLNTDKITTIPLQGSNIGTRRSTTKDNLPHWQNNFLATGSSLTHDTETRLQAFISAQRQGTPMHHTATLQTQATNTPPNCPKRRERTKPTGRTTHCPAPTHGDMLDRQRNATSDTGRQSETGPRLTTRRAQ

SEQ ID NO: 1009431 - protein, 251 aa, Homo sapiens
MNTHIRGGREQRSNTHGDTRARTRNQRTHTSRRAAEANIHRTSTTLIGRRTAKQHSAKAARARSPQPKSNNDSADRKQSHREKQQEKQQPPRQRRKQKKQKKEEDKRERPGGSEETGGGCRRELTEKREKRVREDEGRERKKKKGGRRTREKTRGRRGGRDTEGGGQRRRRCDVEERQEGERERCNGGSRSSGDGGERQREGEEEEEGGERGERGRKGEEKSAASERERQERDRASESEQREAATRTRRRR

SEQ ID NO: 1009432 - protein, 323 aa, Homo sapiens
HRIEDQQKDARVWKVLMRYYPAVEADSLLVQAGNGWSGAGRSFGPVSTFVDQRALLTALNLARAVPGALGTQSWSDYAVASVVCLLCSVGAFDRCYLCCVCRSTLLIAWMCALVLIVLSPDVPRLHYHCRRAHIGRFAKAFWLTVLLGTASTVAAHQQQILGKWLLARGVHNFSLVPAFLSLGRSVMGLSGASRGRVHLIVVCHGGKAHGRVLGSIGVVRNSRDHFTARERRGCCRPAGTDALPGIGKPRLIDRVDHIHGGNHSPETLHQRDQSLDAQHPLRTLTLVHSSVLIDVHQGATRRTVPSLPKPRGEGESPGFLHNL

SEQ ID NO: 1009433 - protein, 118 aa, Homo sapiens
MEDRDQQSYELWLRVREQFVRGPAKKEAVCYMVSMSFKRNRSDRFVQHPVLRRGCSVQNRDDHPGDHGYMDSKPIDGKFCMTCGSDSSKLHASCQHSRMKSSVITILLREWLIMPDVR

SEQ ID NO: 1009434 - protein, 263 aa, Homo sapiens
DPIHFPRPSPMAVSDQECIETLRGDERILFHSDTSELTEGAPRTRSPRRQGEGTISRRNTAVVKDELSEVLENQSIQADAERGGGRAIIQGCLWRKERIPRRQRKVCEATDVSQAPRVPPGGPCRRSKAEGHTNQATWGGRGAQEERRPDKTNSITPKDTQYCKTITREGTQQVTTWRPKLKEPYYKRGHEMAQSTQAQGGHTGWETRKGEAENTDKKGKEGRTEQEGKRAKAKVRRTNTREKSERKNRTDKAERRQQTKPGR

SEQ ID NO: 1009435 - protein, 326 aa, Homo sapiens
MPQAEPSYRMRIYAALTSWYDQRHSPSCLGNCGDLQLDERCKDMSSRGRVVPVLVWQRSDVRRLVTEWSRNIIGESWNAASLNPTGSQRRSSTQHGNPEGQYLEMLEQLGRTDDLYIRKMVIVGIIVCGHWDKQVSTECAEIRGPMKVIDKGVTTGSNTRWSTRADDRRRAWTRCLAPKDQGERQAGTIPQKAIQQVYLDLEARTTGKIHWGDTVTMSNTRTKRGAFNQRPTTKGDGGPHRTHRQRIFDHSITRIGQKGGPIKTTQGGNEFGTRGKEECTERSQVTTAEPTQIHKLTHKAQTTHNTRKNDSSPTREKANSNTKDRQ

SEQ ID NO: 1009436 - protein, 406 aa, Homo sapiens
MSAKRLLVSGETPASGAGAGAGAWQAAAKGRLCWGDSGQIQRVAARLTLRRLSRRPLTTRRRLDSNGHGLRTDGGRTDAARTHWQQDQRQLRLGRKEPLTPYERHDVPIAAHTTGTGTTRACTGPTEGTYERREDDHQLVTTEEDHIGKGDEHWKAIERQQTIGATVTVDDETQHRRVGPNTRKATSQGDNPTNVDMHKPLGNTVTAQIQHNRGGIDNTKDDRHVSSQANWRARAMRSSRATATGDVETRSHRQPSDWIAMSVATLAPQQQRTLGRKTTVTGIQRVGAKAKHRGQRQACGNSGKRALGQQMERQAYTGPRRSSNRENTESIAPEEEQDTQDTHDGGGRHRRTRDHHRQDGAMRQVSPEVRRIPRDEEAKAGDSPREGARTMRERTTTEHKGPTEQP

SEQ ID NO: 1009437 - protein, 361 aa, Homo sapiens
MVEASSWAAWTGIVAKQVLLGLEGWCSVRCEGITRIFVANFYEKTTVEDTRGISFTSSRSEHQTLYPWGPHTRLSGAPLAVIFWCGPMLTNSLDAHKIAKDEGPRGPCVFGAPIIYRMFDRGDFAISARIRTKGTETLLGKWGLGGFFAVGALSTPFHQGIRGWGRPPFGNNGATINPRKHNTYGVIHGPALISFGRRGPGPQWGAWFKSRRKWAFGGAAEGPEEVDTTRVHKRWANKRGTAAAPFGGKGRTRQEGKAGNTHGTENKTAGRKDRRQFPPPKGGFKAPPGVATQRAQPNGGTQVYRQNVGANYQTGFETQKRAAISTSGRRHTKTAPLGWRAPPGTRLDRTLGTDTLVGVGG

SEQ ID NO: 1009438 - protein, 406 aa, Homo sapiens
GHEYVQASDEARTLVVLRCAKKKVWLDPKLRPDDNLRNSQLPSADPRSVITMMGLDHPQGLVRVHSQWLDCLVIRHSCVPAAEGLWRHGAIGNAEVVHAKVLTEMNHEATCPRPAKLTRRTLDVTLWQTQRIGIMTRNIPVHTRNRNEMRNSVPSTCLSTTPRIPVKQGLDTGRKTMVAHHSNTRTQHGALYASNLCETNEPASQANVRRNRRRKEPKRGAPGDRRNRALPVGGQWKASASRALARGHHGHKRGIHIKGKAPKKVKDGAPGQLTCPAPRDGNTRNGTGRAMHRTAGPPETGQRRNNEQGKASQVAQDGKRQPWARTPPHSGHKGRQQSAMGNTANERDTQHLNTDQRPAYHRRTRQLTKGTQQYGGVEPTDITPTGRTTQSPLSRVTIQQAERLSN

SEQ ID NO: 1009439 - protein, 321 aa, Homo sapiens
MLEEAGEVLENMLKGLVCLSDLHRTFLPAVTAAGVRRTDDMPTTTAHEFTVITSMTAVRHVTGPAPNGNTEMPVLNTRTGRTDGRRTVLMPPHAVDDIAGYMDFLPTEPVPTNGALQGSRRQAQHQMVKIEFALPQGPKLGPARVVPPKEDQVRYPGTNFHIGTELRKAQAGNCVGTQLRRNTRPGTTTDRYLCGPEMRRDTERGHLGMYQYSNQTRPMQPTTGTCALHGPIRTKKGHPPATSFVHRHWKRITIDIWPAYQGDPQRLHQTHGTVSPEIEVTSHMTRGADFPKHLKGPGSSVTLGPRQYCHTGDPKTSSAGY

SEQ ID NO: 1009440 - protein, 379 aa, Homo sapiens
VFGNARQPLAEAHSRGGEDASEGGAEEGRRLCAVVAARCAGEWPGHNVRSLPMTIPDVFPALPLIAITRNPVFPLLFIKIIEVKNKKLVELLSKESSSRPSLMSASFYKRDDSNESDAGREPGLNIYHTGTFAQIHETAGPLGTKPAHDRHGTQKSPYHADELAGGARGAGGPEQQATRPRRQVKRGGNERRRRTELRRLGTRVDAWRTGSPNPLELPPGLRGAHWCDGQTKRFVPPMDSSQASPDGSVTQPLYLAHSIRLKRHPLTGTIPFAPVHTTHPYIAERTCFAFVTQMYCRCAVDPTSGIVVVASNRPKLFPLEVTKIWERTRAEPHIGASPISSPLHGLDTRTSLVTRRRRCNSPKSCHCIHGTYVPRYGKQ

SEQ ID NO: 1009441 - protein, 346 aa, Homo sapiens
RELVSFFLFVGFLLKIYWVLEKGEANSCLPFKVPQTLNVFPWPLIGDGFTVLKGSARKAIELWAGAHNGRPKLFAEQQRGTAFTGTSGDIETISGFTKWTAPRTGLDQYTAKTYQCVLPHQSEEGTVTIPVELRGRQHEGYLQKCALTLMPPETEMPFTKLVTYLWTRDLSKISIGGGEKLKGKETDMIGLSRGRRLHFQRSRGLKNYSQRKLFNYTHTRGVEEVDIHVASGIPVFRYKERPNKRGVVARDHTKGSDKTTRRQVGQIVAEHRAQPTNGRPTDDACTPEKNARWNNNDTRRETKALHPTRTSSSSNGNRELNEELEQAPPTGSATQQLIYHKGSANR

SEQ ID NO: 1009442 - protein, 207 aa, Homo sapiens
MRWSKGSNILERPLWRHEVHHPSALYANIRLSYTEDNMSLHKVVDCRANASPKGSTGAQACGCSLVCKYRRENHRGSPTEDKPTGIAPMREWAPSEATVDYNTHTFLWNRYITSLEGTGLLPIKPRECTSVPTHLRHLFSEMMAGRTHGDTRRRISSHKGVEGYHPEIPLTHMWELAPFWPKKALFAARSAPRYNGARGNRMRTSEN

SEQ ID NO: 1009443 - protein, 180 aa, Homo sapiens
RDLIDNSFNRYTFNEDEGELPEWFCARGKTADTGYDSCLSVRRRWSITVKRWRDTFNARPIKERVAEAKARKKRRMLKRLVQYHGTEGMNAVSEHKCDDSQNEMKVAQLRSLYNEGWAEQGETGHVTYVVAKKGVGRKSAPATLGTSEVISRCVDSRTEDGPIEHSHVQEQTAIETANGK

SEQ ID NO: 1009444 - protein, 438 aa, Homo sapiens
MLQPFSEDVSSSIRTVIDSMAKNEASNFKANVTTVNFALDEIRYGDLTMEWDMHRNMVVLLIESRTKWTVVGVLPEWARHGHDGTPRHWLPVSSARHGQWVVLHGNGELRRATPNVYSANNGVESSDGGLRLRPDSIRTIPLVASDKTSPMCLMYKRRTRTPRWGDPFGRPPVTRRAEIGGPQKRAAPKRVIGNNFWPRGKKDHRRHKEALLLDHTTFYKRAGLATKRNYRPAGGPPKWTQPMEDPAYAREGTQEGRGGVPKWRSTTSWGNRNRSDAISTSREARSPFARSQYHTEGKQHGEQDDWDTSPIDKVLTVWCGHQYRNRCLLKGANRCAKPHKRISEMANSVSTNFIQVGKAQHSGAKHTIGHPLEHIFGGFVVAPTGPLKRNDSAIAKTYTLPEHQEGTTPGPWRYKATRHNGHTGPVQRPSGERDTDVH

SEQ ID NO: 1009445 - protein, 120 aa, Homo sapiens
MSSEPQLTTNRRRANTARENLRQQPPDHEPTRHHRDPPKHALEDPQHRRPQRPGNSTTTTPTPATQPRATTHIPQHHPAPTKTRHPHHTAPPTAAPKHNQDTTSPPPPPTPPTHTKKTPT

SEQ ID NO: 1009446 - protein, 239 aa, Homo sapiens
SQSRDHRRAPLPVRARPACRVCSAARPWYGCDFRICSWPQGAPLSHMSRPGLGLAPRRLVQPRYYPSAAGSAMGSNAGSLPTAALPPVLTVRRDWRGISSLEAVRRKIRSLQEQADAAEERAGHPGQSRAWTTRGSLRETAEASRSFSEQTHQLVRGQSWIVPMERLGNSFAERWSEADQEQQMQSEMRHAQSLRVEPKMDRSTKNGNSGRSNVRKKGTTHSSLNNADRPIIQAGWPGS

SEQ ID NO: 1009447 - protein, 489 aa, Homo sapiens
MLQEMGWALLNLLSRCRASSTCFSAGISLKLTLPWDAFLPTPPDSDGDSCDLYACFMTPLLADGYRRVLKDSRSSHRERGTRAPLVKPGARHRGLRLSTGGYHPIQGSEKRDSKTWAEEESKPGQQSDTNLETSTYGKIPPKTGGQSLANPHAAIPAHKKYTETGTEPLEQKLRLHTGTDSSIGTRDRLTQNTQCEEHKPGKRQSKHNNSKKGNNIHGTITPTHTKNNAVHKRATRRITGKEPTQTHKMTTANPKRHTTKQGNESDKFTPTKTHSATDTGNHPQGNGETEAHGEARTIERTQRTANREGNNGKGKYRHTSSEKDKTQTLDKIETYNTTLEQCNSHGSGYRPASERHTSYMNTNNTNRHNNLQRREAPQTITKGGNSAKTSDKGQHRAPDTETPPRTTRQKTSPSTKETNAATTTGTAHRPDTAQEQATRSTTQPRAQNERQERRRRRQVTQRTRTTPVRTEDQTQTVARQTEHTTDNKA

SEQ ID NO: 1009448 - protein, 137 aa, Homo sapiens
GSQESCERAPVSRAVIYASIWLLATTVVSHPRYLELLERTSRPLKDPDGTRCSTTRDDGGGASDPRSSAKALTWQRRGAHYILRTCMQHLPPRTLNFLPRAMGEDAALREIAPQTTVNSHTSYNREQRYDDMRPKGA

SEQ ID NO: 1009449 - protein, 321 aa, Homo sapiens
ERTSLEFFIFFLGSPGTRAKSAGPGAGRLRPRIPPGAQFTTRTPFLHGAKVLSFSKPVVEGRKGVCTGDEIKRGQISSRGSVIEHPKEAETSVGTREWGSIPLLVFHPKRNVHPGIAYRLLPNHVARGQRNSRGLVDQFRLVFPVNLLARYPLCRDPSPKDRRPWGNSSPVPKGPIELISTKGDVHDGHMKAEYPMGGVSHNPKMPIPLNSGTSKYSQQCWGPNNPVGLHKAPVAPTHTVGSTNIQHVRMQTGPITRGATPPMGWATKREHTYKGRALNKRSCGTISRPNRGPPPHMAKKRYTGLYAQHNPAEAPHNLWRR

SEQ ID NO: 1009450 - protein, 337 aa, Homo sapiens
GPQATRPPEGTLSVDFPEPIPSRDWRYQRPLQPPVSEETSTRPAGPWTYRCPPVQTCNLREALDGCIPVTPTFVHRDWYRRLYMQHLVARCSSKKSHVLYHPCAHFTGERLLTLVPWLLSSRFQLILSKPGPATIVSITSTGRAALPVWGLCAKAYHSKAATLRPAPFVCMHQQVALAGVQECGAALAAVTLTRCFYAPVTNSLHGEISLISVRRVATRFPSCLASGLRVTVHQGSGSRARAPSTRPASPFLVGLLPIPLLNGASSTLQDCRGRLRGSIGHNDRPLARCWGPLVGPRKKGGLTNDSKHGPGHHRKGGPLCHGYDGDPSMNGSPADNG

SEQ ID NO: 1009451 - protein, 259 aa, Homo sapiens
TKGILLQPLWRDKEGISVTLEGANFGLRSTSCCVSNPWYQQVPAAACTCTTIVPYGASTDVWEGLQCSWLSLAYVLKDPETRQLVLQTGALVLSDNGICCYDEFDKMTESTRSVLHEVMAQHYSVHRNRTGIICQLNARTSSPESSHALIPLRSQVEILMRNQALKHIQVPHSFIDQGLIVIFLMLDPQDEAYDRRLAHHLVALYYQSEEHGRGGAPGHWLRAKGQYIAYAHSYHHARGSVQEASQALIEALCRHDDTL

SEQ ID NO: 1009452 - protein, 98 aa, Homo sapiens
AAAGHGFQSAEGEAAVDSGPGTQLPAARKAERPSAAPRARASYLSSPAAAAEDKRAAHDAGPSSVIGAWETEHVGKTCLLISYTSNALSWRLYTLTGL

SEQ ID NO: 1009453 - protein, 102 aa, Homo sapiens
ILDDRRGVESLARIAWSCIHQSETPALDIWMPLILLHGYSIYWCVLHEPLTDQGCYHHDPAKPAYLVKSLCLTTFYGPCQITRGFNAASSRLRVRGQLNYLD

SEQ ID NO: 1009454 - protein, 261 aa, Homo sapiens
DSSSNPRSQIRKLSVSDPAEGEAETELDSFGFPDPFTLTTLACEVLGWEYFTEQYTLLPCAYGAPNVPIYTWWLTTGRTWVMRWRLPCEQLNRRYQPRLRFQKQRLLNGYRRFDPARGMAYHPGTCCLELCDTTVGHRRGPGLARGQSCDGHLKPGCEIHTICPNVTWWSPDLQLVLPLTEWLKLLPAPGYLEAFADNVLESTKNMPELTSDCWSSGPPKTGGRGMLQNTIFFGGSKVQELEFRSDGYPWVLRLAWFGVAK

SEQ ID NO: 1009455 - protein, 116 aa, Homo sapiens
MALLKIGLALVNPLRVNSSFPVGSNVHLEIHISTYHVTSPSFRLGRNAPRPPSDTRGLRGRISALTADSQKRTAPQTADNHFQTVTQRLTATPSTQTRESGTTAPRATRATRTSNK

SEQ ID NO: 1009456 - protein, 255 aa, Homo sapiens
RALRLQDETRTSQVTWRHVLAVWGLGAKVILLSQRKPVIDFGGPGFLADISALEVQLASKSTGDRRDETTPRGIRVYYTAKLRRFNAGIMELGLVVHGQVMAMPPRETAFILTGYCDGQVHASWHCLPPEIHIFASQIHTHLLVRKVVTVLVRDGREWEIVNQDNHYSPHFQEIRMLTRRIVSVIREMCSSVSCTYNPEDRELGTVGGFGILEEMCVNNVAYQAVEADGALKETLWNARVPAEVLQLIKRYQKED

SEQ ID NO: 1009457 - protein, 222 aa, Homo sapiens
MERNEEAKVPRPHGRDDHVTDVRTRDHRENRDDGRRQWECPPTKCRPKQEQDTKNIEGDKWEEREQGPAKAKTSDTEIGRRQRRKPHGRQEVDNRGSTKTNKAKRNRGEPRKRPCERQKRAENRDTRQIKEGERKRDTEKGAGEEAQARKAAGSRRKGSRKRKCEPQKRDQTRKTEDEEKTTEKRTRKTQAQDTGTGGREERTTKRKREQRESRRQKRNKER

SEQ ID NO: 1009458 - protein, 133 aa, Homo sapiens
LEGTFFTRKYLEESVSTNGDHGDPPSCEVAAQRGLGVEIPSTPPESSYPRRAKGSCRADCVAPRFQGTTWDPIFPSVWPGLFETAVRRGRIPTRSPVGHPCGRQTSPVRDSQTLSARTIVSRSDSQSLEIYAI

SEQ ID NO: 1009459 - protein, 73 aa, Homo sapiens
AHVLALEPQDFIHVTWHPIPKTTETVKIITDCDWEHSCVMEQTSCFLPIHLGPEQAVMLGTIICSRLQSSRTG

SEQ ID NO: 1009460 - protein, 283 aa, Homo sapiens
MGVRRRMISCRCVPRWEAKGAVAGCAGNCGWGPVVRDAACALLSGKRPACSGRLCAPGVPCAEGVVGALLQEDDGALRPTTKWPPPGGIPHSPNCCPSEPREMHPSSCDLRDTGSWRPWANMKMEDLRSKASGDLSQGFMQTRGWQASKVHRGIVPSSRGNTYPDPLIRIRIFGPYSTVPFRCGLRIVNPRSGWESPVDTAERYGVEGTLGQRFAGRAVRSDPIGRVVDHQRERGRIYRRACARQRRGATRHHRGLVRTRRGLSTGAAAPEWSPQESRLSAER

SEQ ID NO: 1009461 - protein, 274 aa, Homo sapiens
MPERAGSEGVPLWRLGRPGAVLLADVALAGGVGSGRRGPVFGPVGMSGRWVHRAVEVPVAAGGSMVTAWQLQRQSLDVCHPDGPTYEGTRTIGPRNPHSWRTPYTEPPRRSYLFVALKRNARQGPRTSAISLRRRGNIGLIGGRQDTGATTQQPGGTLALKAYRGQQTICYKAQVGVQRGRMGRIPPINESIYEERYSQGDKGQPSIPVNGRATQKNKIYKRKWGGTIIKGTSKAQRDDSFERYHNEGPNLREEIYRTNAESGTKPWRRPCDER

SEQ ID NO: 1009462 - protein, 84 aa, Homo sapiens
LRRRRGSGAYMPVARMTGFVCTTYVTPRRTLREYSRLDTRAEADLAELWARESRREVWRVNIYRDVPKITAKDRTQVNLIDGFE

SEQ ID NO: 1009463 - protein, 305 aa, Homo sapiens
MGIHWWILSFVLLHVSHDTMFPFYMLLEDWTATTTPGCGSERILADMKKKLATWRRTRVKSQRKTLALVHEADKHCLIDSFEEHCGPGFRHIHLHLQGVPGTLGNQHFLGQCLGANQSRSNGKETVVGRLQRESHAFNGSNWIMLIIKGVMTYDPPAVAHGASARAVLTDSPCTPTHPTGPLQPLSPEDPWHKSPDSLSYTPPSEQWDYASTAPLLQTRQKLYPHATCEALIPACFNTLTHGYLGHPPSDSNGSKMIWYGEGIPLRSAQAPVQARAGPTGDPGRDSWPPTHRPPLASHLAQTPAR

SEQ ID NO: 1009464 - protein, 104 aa, Homo sapiens
MSWDTGVREQILVGTGRDVLIDIRRPGCGIDNVGCNHREFSYKNVPETGDERSGYECVKYIPIGSGCGNEKWNIEETGIGERGKSSDNTERQVGIVQITHRPLS

SEQ ID NO: 1009465 - protein, 142 aa, Homo sapiens
MHANSWPCDIHGDLGPNGASYARTSPPSSCYMAQLKLLLLLITMEQLPESAYMHQLLGLKLLFLLYQNLGGLSSTRHVGAAALPRTYRPNVYINAPKCTLEQYLGWRASYNKVFLGQGYTFPSRRAYSLLSFDIPAPTYSGD

SEQ ID NO: 1009466 - protein, 42 aa, Homo sapiens
MPRPYDGNRNSARSPPDPRLDPVHENTHNPPPPFRRVTPCQR

SEQ ID NO: 1009467 - protein, 389 aa, Homo sapiens
VARRHVSVPEAGEGKLLRSAPGEEEPPWSFRVRARPGPWIQCLSPCPLSSASSLAAAAAAAAAGPELGPSQARQLEENRMGSPAPSKCEVCKYVRCGADSQPLSETGKDQGGDMDTGLMAILEPRRPLAVKYNQVGPCASNRQSTETICTDDPWHYSLTHMQRTGQQSRLSTMRMFTDTFAHIYSNLVPPQAVKGRVHGTSPYEAGAHRRVLAERWLDPSKRRPGGEFDMQRAKRFRPGQLAPQGNGIHTGRPPAPRRTVTAQSTPAPQHATREVKAGPPRRRARTRSPTADEEPARGARRQARKPRQSKERGRTQTRATHNGQTRQGRSERKEQGQERAGKRETQTAPEREAHEKRTTREREGPEDRQIDRHPERRRREQGQDTTEDH

SEQ ID NO: 1009468 - protein, 339 aa, Homo sapiens
GLFENTGLGRAREAPDVLALPSMDVRLCLRSMLSAVIARLVSRPNSLTEKSGSWLERLRSHPCDLYRRRHSLEACPRATTSPFSAFRTWSSQEAPVMGVDIRSITRTERVRRKEPTEPRSSAYRERWLAQGEYSVYWRRRINIPQYRTQDEVATRSVQRRSHANGPTSETLYPGMNPRRMPGIHGGGEKTENWPGWLRGSSNGIECSGAAGEGYPKHMATRNVALGTRGITRGGRAGPESIIGQQGTTESIQREQEPTYGRLGDLNSRWCHVGKVFTLALIPGPSDKGAPNQGWLTGATNGGKEPQGRPAGASPSTPEARTGGELPEGPGHCHRTVCQE

SEQ ID NO: 1009469 - protein, 30 aa, Homo sapiens
MDLALTAQGDAILGCCCHRHLSGVNQPALP

SEQ ID NO: 1009470 - protein, 410 aa, Homo sapiens
MTLTCRNLCADVNVLMALIINGPIKSFCYRRLHVPRPTQAPRRMCYSMTTEGAGRPARQVPHRDNYNIRQVDTHIHASSCMNQKHLLRFIKRAMKRHLEEIVHVEQGREQTLREVSESMNLRPYDLSVDTLDVHADRNHFPSTLTRSNAKYNPIAESVLREIFIKTDNRVSGKYLAHIHQGTVNAPAPWQHEHHTTHAHTATPHTPRPHPRDSPPTNPGPKQNPHTPPRDTPTQQNNPAPAPTEGPRPTQQTTRTTGHQTPPKLTAKDPNTEQNHTKNNKHHNHNSEKKATTPTPPPPTTAPTPPQNPPKNTQQSAKHNRCHHAPQQPNTPRENRNSDPQKAHTAQQQNKEPPTNTNGQHHPHRTENENKITGPCHGTANTQTHHPSTPQTHTEAEHNNHHTRHKYETKA

SEQ ID NO: 1009471 - protein, 225 aa, Homo sapiens
MRWEDLQGTSVPPAEEDLVKRVHDWQRRVMKRGTEWVRAWGTETVSPRVRDPRGVSEPFLVTKHVCIRPQHGGSPLGTFARGLRDSNGAITVTGNTWQREPGIPFSRKCVDRHLARGATGTRPQGDNAPPGPPRYTRRRTSSTGKDDTAHNEGCTWRQNGTSRCSSNQQRGETPQKPITLVAYDESTLNKGGTWTIIVLRHHLRGRKLSTEQLKAITKITWEEIQ

SEQ ID NO: 1009472 - protein, 263 aa, Homo sapiens
MVDWTSDYLSTYKRPSAAFVKMARYVRLHAGSEKPIHRIKRVAKCRPCELTQFSTQGSVVLAQKSAYLMHALKVRWTDYVHDPKEVRQYANWRMRGHEDLVEGPRVRTQWNGLACAPSGDCLRNETRPTVSVSERVRLHKPSEPALVGETQDKAQAEWCISTHRTSVIPRSKLDCRSLPCPLIVRIELRGPRYLRFIQRGNKGQRTWRPVLSTPGKAPSQPLVRRIISKGEPSGRPKGRILRFKPWSGHAIRWDPKFSKMNAE

SEQ ID NO: 1009473 - protein, 138 aa, Homo sapiens
KCADDAGAAGGALWGPGGPGMGNRGGFRGGFGSGIRWPGVAAVERGPGPRPRELAESKAEDTGVDALSPKEEPHMVKDMKNKSLEEIYLYYLPIKESEIIGFLPGESLSQGIEVMRDYAQCARSNTRDRGSGTKVQGI

SEQ ID NO: 1009474 - protein, 431 aa, Homo sapiens
AKHQMADDCRCSLVCGPWGALVALGWGTACGFRGVFLAVASWAGVAAVDGAGAEAAELAECKAEDKEWMPVTKFGPVGQRNIKHQVPWRRSIYSPCTIKESEIIDIFLGGLSHRTGRFRSIIASDRSRPVTASDNQVQGIKYAYRGTTMDTFENWGCKSAPKRGGQPGQSVGEHHTWHQALTIRPRMQTEATVGNKDREKAHSKLSTMHRVDQDRMKIHENGSNDTSNNHSNTEGGNIGKSSTSTKTRCEREGKAVSPIECGMAIYEETIGNKHYKTPGGAKTYAKPHKKKNYTTHTGEPIWKSQQVLKNAVNEANSENPKRESILSNGRQMGISHAKDITTIEYKEESDVTHKPIRIKQTPKRKTELNGGQAGNPRDSQKLSGLTNTKGSNKYTRHQAYTMELSGVKRKSHTRQEKQDDKEKTKKDMSEA

SEQ ID NO: 1009475 - protein, 81 aa, Homo sapiens
GARPASGASNASGGRHDLSATVRGSCMRRHMLTQVERHAACRLGQVHEEFKQNIENVSRGDSYSGSLQRVRAQAGRSLDLW

SEQ ID NO: 1009476 - protein, 485 aa, Homo sapiens
ASFASPAEPHRSDTMEKVKVGVNGLVVLGAWSPAADILTLVKVDIVAINDPFIDLNYMVIHVTNMIPPKDKYHGTVQRLENGKLVHQWKSHNNIFQERDPSKIKWGDRWPLSTVVESTEVFKHPWKKAWGSLCRGEPTKGTIILCTTTADDPMYVHGDDEPIEQEMTHRAHKIQYKHKAYLQQTKVAYKHPKDHREHSMNNKEVYGEKGLIEPQGQGHTLDSQERNEGHRAQHGDNCRKMNETERGNITENNYSHLEKHTRRRLAQETKRGAKRRDPLKACETSTQTNMDKWTKPEDHNTMTQRVNTEWSGKPETPGANTRNNTPEQKHGMHHTTRGGATQSNRKRPTPKRTYTEKKQETHRRTPHDKHQKKKQTRRNRHTKAGEGDHETVHGKTDRTDTQTDTQGTHNVRDKNKREKTKSTKQHQQAISTREHHAKKNTKGKQQTTRRGDRAQRNQRTQNTTRKNVNNRKEGARQRKHKKSRTT

SEQ ID NO: 1009477 - protein, 301 aa, Homo sapiens
GARAAWRAGDPPRQCQRPAPDPRPALSGPSPALGTLRARDSRPVLFCCPSMELRVLRMAPCASAPRVRCRDPAGCCGDQRVLLEPAPPGVSSYVPRASYFQCVHLGRSSRTLRKMLAYWMLEVCEEQRCERAKVFPLGLSYLGIGLPALGVPTPDHAPLVREGSLRCRVCSAGWALPSLVTKNEGPIDPFGKTMLHHSKRTHDVSSFPRRSCRGPCGRRACVPKGDQASKQREPKGPDLVRSDTIEQLPCAPPNTLASPGPHYTINTMNEIPNHWPPSEPPTKINTMPYTKTQYSWTPVSC

SEQ ID NO: 1009478 - protein, 336 aa, Homo sapiens
MLSITLGDRANTPCQAATRIGPLDRNRTGPDTPTGTMTKRRSQANHHESTPHDHSSPHLARPTTCHDTTMIEPAQWPSTPSTTALRHSPPWRHTPMPNPVQHENTIPRWHQQKRTHPIQTHKPRTQYRHNPPPEDNAPHEHHHTTEAPYSQQPSPSADHQPKPHYPPISPHYQKVQHPNTLYTHTTPPPLHTTTDHPSTPPPITPQTYGTIRPPPSTPTCTTQNETAPSNEERNYPRSDGTINNRNPRAPLGATNSQRAAPPIITTQEPWASQHISTTHIRVNYGRPRINTDTSPHDNGRVLTNHTTTARREHRKKATTPNTTATHKTNTNAPHQP

SEQ ID NO: 1009479 - protein, 105 aa, Homo sapiens
LICSPPCCMVQRAGIIEMREEAALGRSAEPSTGRIPDSLNNCVNKDHLTDAIHWASHGPRSSCTLVAQLGPALSGTLPGVVGVVPLVASQLLWKCIGRTMGPVYP

SEQ ID NO: 1009480 - protein, 173 aa, Homo sapiens
MSQTIVQHPHWSNPNAPVESCIQEETAGRHTKKGHPKLTPTFTEVPIQHNGLENANVVQPGYTRTKSLPQTRRPRGHGYTGPRESHTVRFPARNARANLPTRDIDRQPYSTWRHITLEWNRASLEKTNKRHQKVQYLQRQKHNQIKSRATKNNSRLIPFTITSDLTTKMNRPI

SEQ ID NO: 1009481 - protein, 102 aa, Homo sapiens
QMVCLRTAAQHAGGPTARASPELPEGPPFPALAGCWTLAIFTRVCLAGTDLCPLLSPGLWLQPHRTGGPGGRLERGGEEGAVSPQRPWAPDFWQRFPDTASC

SEQ ID NO: 1009482 - protein, 69 aa, Homo sapiens
MGQVQDRRQGVGFRDVVLPWWLSEEGSASSWCSEGDMFVSNGWVVVQWRGDVDRMLPRWDMVIGCGERY

SEQ ID NO: 1009483 - protein, 160 aa, Homo sapiens
KRAKIDFFEGKGNEDNCKLTVTPVEKKNNKGGGFCLGGLVRAQVDFQEQGHFVALSKFLLGIIFWNRVYSHHCFLRDLETTRQTCLETQTLSITSKKDPFSVKLKVNGQQFWELVRGGSSPVFAPTWDELIIRDKNSLSLKQAFAKRGVERVRQEEAGAD

SEQ ID NO: 1009484 - protein, 103 aa, Homo sapiens
RAPPYWLLSCEGSGSGGGGGGGGAVAAEAACAIYQASIKCYGGAAASDNLPDKFEPKMTKTKGKEERIADICSSRPMLRRRWSCAFGHIYAESDEKGDICSTV

SEQ ID NO: 1009485 - protein, 146 aa, Homo sapiens
GQTVPAYVGLPCGRPPAEPSAGPAAMEVPQPEPAPGSDSQVQQACAVCAQEVSRPTSRCLHAWDLMASMVDPRVQRLACIPRRVTTLTPNHARTSPGAQEAESTKGRQVVGHLDSITTGPHRRAEEAQLIPLILRTEGNSEKFHPA

SEQ ID NO: 1009486 - protein, 426 aa, Homo sapiens
EQRQQPDEQRMRSGAMVKIACVRGGGGGGVPLLRVAAVRACRAPKRLKIDNACADQAQECVLCWWLGGGAWGCAGWLACGWGELRMTLNKTPASPVVHIRGLDGRCWCKQTFVEALQEFGPISYVVENALNNEDKHWLEVSNDCVGGGLATRSMKQTAKPEEKAEVLRIWHGSKHQTYNRNEITYITRPGKDSTTGAMGRPTGNRTYHGKALQTTMQQQRHYYHKSLGKPRNYKFTKIATQQGLVYTIQEDLNPLVRFPYRWSTLSPPAKNLGTHQLPRNSEPGEDTTAATIGIGTPYSNHPQIYNISRPQGRTHTALYSTKDVEAQNKIHHFTLGNWQRSALSERKTGKITDQKPTLTTGDLNNVRLYHSKVESREINHCKHTYENKHPRRTIKCETQRLKRHLDRHKTTTKQDHNPTHNNITRY

SEQ ID NO: 1009487 - protein, 198 aa, Homo sapiens
MCGFYRLLLAEHYSALMVPGFAQLSQGWIACAAFARRTPCDPARLLLASTDDKRNSPKIRPSPSHAVPACLALPLSGPCHWPPRPQGLSCWLLGARRAWEPPWKGQRESQVRGQLTVIRRLSQVPHWETTVALVRGVTLGHTRLCPQQPSFLYSSPGTRPSRLRRPRMLHLQRRGGPEGAHIADVLAAPGGAPGVEAD

SEQ ID NO: 1009488 - protein, 192 aa, Homo sapiens
GISDCGGLPEREVSVPTFSWEEIQKHNLQHRNLMVIDRKVYNITKVAIHDTTGGAKTRSSRTTYAGEDCKRSAIPTPLRNTDLEITMRQRSLNIPMTDLGETGTPGEGTPQEPGSHRTTKLHNESRRANIPESALKEKDGHDGNDENPAIKEAKSTDDILSITYPSHMGTHNYRYDTLRTHADFSKIEDYPT

SEQ ID NO: 1009489 - protein, 105 aa, Homo sapiens
MVGDDVIMAMIRGMMDEKGTKIVALFPDLIARRLYERPGQGGTQERGTTGLMHQTALLSDLTKHSARGATNWNVNEQSLHKATPEENQRPSILTEERSRGQLTTQ

SEQ ID NO: 1009490 - protein, 252 aa, Homo sapiens
GCLAVSEAAVSELGGSGGLLFLLVRDLGLMCPTWPGRALPWLACASCLMRAEPARDGCRGQRGGPSSRVRAVGGAQAGRLGSAAQPELFASGIRDLLLNIELENGPSSLTDFYELKSQSTLPHYAQSTPNITCRANTKATPATSSLASSFLQGGAPGTPDMSVILSSIEGVLCMRGNRLNAGPGCRRQGEGVSGQRKQCQLRGSLSHRSANLRIPDDTMWIGSILNGGTNGGRQTPGQGAREVIKVQTHLEN

SEQ ID NO: 1009491 - protein, 161 aa, Homo sapiens
RRSRRAEQFKMCDIHRRPDRRDECEGAVTLSTFCRMLQTVAKNKDQGIYEDYVEGLRDDLTEVKENGHRVMELREDREHVSLVTLGEKMTEEEGRDAVGKGMRTAKRDRLYRNDNAEMTAESMSEDEEEPKGARDIRYSSGHAAMRRGTVPQHLTPKPTPN

SEQ ID NO: 1009492 - protein, 342 aa, Homo sapiens
YPSMLYCNGDGRFELVPNRALHVQTQCFDAVENWHRLPEVVHLGDFQGPTKVDDGLYPLSHQHAGPLLNGGHQLCLPAMATTEHDLGPPVTLPCHNTSPPRPIAVDFPCCQIENSHSIAWMLDPIPPANSCDGPISEPLVYYTIHSAKMLVAFAGLESGHRQPMPRWETNSIPRVTGKHNLPNALRGPCTPEVTTHQYLTIHVRHLAIGHPNNTLRSNTRFLQSITSDLVRQNGSHFTIVTNYYPPFTSGPVPIYYGPVLALKRDFDSNPHRDVRQAIPKSGSQLRFRIPSCHFQRLTPRTTRWWHPSHFTPIGRSGPPSAQGDAHGAPTVRQVGTPMGPSL

SEQ ID NO: 1009493 - protein, 73 aa, Homo sapiens
FVKPSGSESCHEGQEAMVSENELWMRCLLWIPGLMDLRYEDIAYAYDMTIEVGLAIVGSSEAPPYITLGLTGS

SEQ ID NO: 1009494 - protein, 130 aa, Homo sapiens
VSTKPEESWQCVQLCPGQRGQRCICTVVSPTADHVFTGMPAQNSSGSYCEKVQNMFNAIEVLEVRTRETCSTVENDGEPNERTWRSKVQTGGGEVIRQHWTGQILPGLTFKGVYYKCCTRTERSQIQVHM

SEQ ID NO: 1009495 - protein, 66 aa, Homo sapiens
GPDFLKRLGGLAAILRVFEMPPKDNKKKKDPGNSAKKDKAPSEQYPGAGPKRRMWCPRANVRDKSQ

SEQ ID NO: 1009496 - protein, 308 aa, Homo sapiens
ATGLHLPAEGAAMNPLFGPNLFLLQQEQQGLAGPLGDSLGWRPSSPVGGDLPPVPLSAWRACCLLCLPGPGPGPCLPPWPSVMTMGSNINVLKTLNLRFRCFLAKVHELERRNRLLEKLICSKRWRRVMQGRRGLGTSTHRQCRPASSGPSAPVGLQLGAARSGRCLAALRRACWALPARSPVGPSRPRWQPLVVLQLPAPALILVGRFMPGTSGRSRTPAARAGMEPTLVQRPGLSVGCTRMGWASRSETITPEIRALYKCLANVKRERDEYKRRCFDRLNDTKEEEEGFDKICMVREKGSRIGDGV

SEQ ID NO: 1009497 - protein, 533 aa, Homo sapiens
RRLLELLKCRITSVPISGKTKAGMTTDDKPIRALACRGPIALLDKLTGQTHLTSSARLKAKLDRLTLHAHLRHRTYYTEPQLATSQELLTNWPVDPHQSHLGHHWTCTHYTPRALSQEVVTGPFYQRFAHVDVTKTTSFQIGLTFSERGTLRMTLTSFNFQKPIEKMIKRFDANGVYRLAQWSKPLLTPGNFPARFAGQTPLKPLGNPLFRHNDTMVAKLSNDNRLAMPQIGRHFTRTTHFEDTLTLPRDHFRTTKVSSNKTSCTYYSHTYKKQNLVDKHHTKISMHCNRPHTSESCAPRRLVCKNGNASQSRLMSKLRIGRPLCMSHTDSGQHRPPGQTKRTPLAHTHVRNSSPTLHLTRDEHNNQPWRANRDHGLEPICQHQESAHPYPSTRFLRQSPQEENTTGSKEPDNQNTARYCRDTRSRESTYTTLPRPRIGPTGAFTRLEAIAITNKERTMAQQPTEAPMDTRVVVTTRQPDTVSYCVLRDPRVVPQKEYQVPSTERHAGKDLLDRDDGGMSTLIRCSNNNVIYN

SEQ ID NO: 1009498 - protein, 165 aa, Homo sapiens
MGYRLTGISCCRVLMLDRMYDVDRAQREWIATARVTWLWNDGHFVSPRVRIRLGMCLGLGPLIDDEASVHTKEAVSIIAGYGHQQSSDVLVPPHWYIAPKAALLSFRNANNDSPYNRINRSQPGLRLQSEAHGIMPERIATDTDTHVVTHYLPSLPRFTSLTCAE

SEQ ID NO: 1009499 - protein, 271 aa, Homo sapiens
MSNSIVRVDQSELGYLANLTEHGPVPEQRFRMPETVISMPCPQSAETCTYEENQLSRLDGPLVFAGLVSLQELYLKPVIQLYRIAPQGLFLASGNVAAAVTLNSNRPEGHLTCRWFEMLPKLEILMIGGNKVDAILDMKLPAPGNCVALVLAGMNLREISDYALLRGLQSLESLSFYDNQLARVARRALEQVPGSSSRLNKNPLQRVGRGTLPTCLNLTELGLSNVEGAGLHRQVWPVEPPELTKLDITNTQGVFIHPGPSTTGPDETFCQ

SEQ ID NO: 1009500 - protein, 73 aa, Homo sapiens
GDEVSVPSLAEAWLLAMVKRYLTSFPIDERVQSHMLHLEHDLVHVTRKNQPGRREFEVLDIKAEFTGPTVPPI

SEQ ID NO: 1009501 - protein, 101 aa, Homo sapiens
ASICENARRYCEALLLMPYKSLLSQYKEREVVTIKMSWYVYIEHRLMMEQRIRDPGMVRSPQKQYPAELMRRFELYFQGPSSSKPRVIRECAGLTLWATVR

SEQ ID NO: 1009502 - protein, 186 aa, Homo sapiens
GSSAPESLAARRCMARVAWGAAVVAAGHAAGGGSTEKYSFRGFPPGGPDACCACWLYCGTALGAVLRVDELGADELRCYLGVLAAAVLHLAPALDMRVPSVHAKSCSVVPVPCGQALIPERLDCWQTELGLAGGFAGFFVACVPVMSNALPCPCGAACLKRALACPRSFPGLRLTRGPGGPGLACR

SEQ ID NO: 1009503 - protein, 231 aa, Homo sapiens
ELRKVVEFHHARRSSFRETSFVVQWADLIICKTRRNSVFQEGMKNKIVIFGLVEAAGPGCLPGTYCPGDGTMALALIVARHQCRSWMDSVTFAYSFTHLRLLTTNPQSSFLRQEPRAGWDGRRERHTYMILRTHSREVDPIVMYPRCPRLKGRRGEAATNSERDPQRKITEVIHVEKAKGKQPWDTERRRGRPPRLCRWMLHQDTQLRGGRTADPVRNKTHKVKTVRHRTE

SEQ ID NO: 1009504 - protein, 169 aa, Homo sapiens
LRVRSRPVNRRVRGPVRGAANSPPRALLRVLVFSVWRLVRGTWEILVAAPWGMPWLGAVRSLPDRAYVLSLYALHVKCRARCPGTGDYRALCDVGYSRHQPVRRVFSSMVVARGFLGWWMHVLGHVTESSIIPIGLYGCHLSSNSLLGLLVTRWLADHCWAPLIREVLA

SEQ ID NO: 1009505 - protein, 75 aa, Homo sapiens
LRYAFSCDIDEAEHLVPSTMWVQDSVIEVDCLNVEMFEIFLLTNAIMAEQTVACLYQLCALKILEWPYCSFQMVS

SEQ ID NO: 1009506 - protein, 295 aa, Homo sapiens
LSGLVRQPGSRVDVPLWGRPISIAERMRRAGDVRAAAWYLIGAHLSMPSAGHREHEKHNDTWSRRQCAVSVAKRLDSWMPVNVGGKRRGVGAGQRGQKAESPWEVSHGNMRLRAVGQCDSPPRCAASKPGRRRGLNGLTEGPVCPRSSQEHLHVEGRMPSLQFSKHSGRKERKQVFPERNQGMRRFDNPRLRTGLDCHIKGNVRGWGPPQRRQGMPPVDEKRGPSSYVQFHKPLYLGPLLAGTDARQGMCTAFGRGKEKVLGADVLPIQGEGNSLALVLEKRSHQAFGVGPVVRE

SEQ ID NO: 1009507 - protein, 170 aa, Homo sapiens
DAAAHWTPTKTHMTHSSPVSDHEAQPMRCWAPVASTPCVKIYICPGQQGWGGRMTQDYGASVETQAVQGDGTFQKWAAVRGAFCEMEHEIHLPMCSLRVCPKPLTLRWELSSQHQHLPIVGDLLLAWFSIGAVITGAVVAAVMCEEEDAQIRKGGSYHSGCKQVTVPQGY

SEQ ID NO: 1009508 - protein, 271 aa, Homo sapiens
MMAPCWRRRVSAGPEPGPATLEHERLLGASPMDDWAIYMMNDRGSIRALTRQASWTRTTDTPTYSAMCPLGYHCHLPGGPTLLPTLGSRQSDAPKDDLPLTPNGCLSDPCQNTTEPISRVIPIGTDLPTRRPPATPLTDPPSATHDLAHEPKHSFPHEPPMQANGPYPDPPPSPTTNPSAPPPSITTSLHTSHTPPHANSPRHHPSPQSPIPPKAAMHAQMAPSQTSPTRTSFSAADIRPPPAPQSHEAYPRAGVPPPRGAPAWTAPHDEA

SEQ ID NO: 1009509 - protein, 225 aa, Homo sapiens
MTSSALEYPYNENTIVQGVPGANWAFSMALVCGPMVLTLSPDVGNPTYEASGGIPCSPYGGPKGVVPTGVRAKKLVTGLEVILIIETSFDRGLDRDGAMETKPNRNSARSPGPIRIPPPKGVRGKLLGVILGQVTPIGVPPFIRRYLNPGWNSLSPYGHFPNPDGNNLRKGAFPTMELAGGFRNRGRFGQRGHLTVRHLQLVSVGTIRRRLGCGHIALDCKMGSP

SEQ ID NO: 1009510 - protein, 73 aa, Homo sapiens
GELALAEAGAIDTQTCRPRGILHPPSRRGSTLEGHADFLDSRTGYRLHCTVSITEHGGGQNFGNGGRGVACAR

SEQ ID NO: 1009511 - protein, 73 aa, Homo sapiens
GRSGKMQLKLDGDQSRDAVNKVLYRMRVAGQLGFVDVLGLEQESLALVPAPVCALLLLFPLTAQYENFRKRAD

SEQ ID NO: 1009512 - protein, 110 aa, Homo sapiens
MWRWCRGPSLWPPGGMGAAALSELPPRSAVYSGAATERCSSITSDHDTDPERTWWSYKGEIFQGKTFDARASFLGPGECRRGRLCAVGKRQQPRWIVELTQGSFMTPFLP

SEQ ID NO: 1009513 - protein, 144 aa, Homo sapiens
MPSEDSATWKSNYFLKIIQLLDDYPKCFIVCEHDNVGSNAWVQQILHVLFRWECAVCADVAMNTMMLQVPSEVHLENNPALEKLAAPHIPGGATFGLLVFTKGRTSLRIRDMLLANKCASCCRAGAIAPCEVTVPAQNTGLGPE

SEQ ID NO: 1009514 - protein, 250 aa, Homo sapiens
REFLLYQQRLIFAGKQAGSMDCTLSDYNIQKESTLHLVLRLRGGAIEKEEEVLHHSQVRIMHKHESKVQAGCPDKYQYGGMRHGKQLVAFVESALLMNVVAGVSHWQHFAIDTSTQLWASVLALIVTVYQTKPERQVNLYDVHSHTTMNLTPHQQPTKTSKRQFILLRGMPRSTTLDGYNSNNLSRPSRAQHHALDSTVDPQELTLLSTTRLGKRTLARGSPTYISRDQEHELFRTNCQGINPCSTLNSG

SEQ ID NO: 1009515 - protein, 96 aa, Homo sapiens
MAAVTLYRKPENWRAFKDSHQLLQYSGAQVRVLSEQPTSILAKATAAHELSSRKVSCRARSTDDMRGDDWILLVFAEQAAIAYAYREQMSDACGDS

SEQ ID NO: 1009516 - protein, 199 aa, Homo sapiens
GQRSHAKDPTSLEEEIKEIVEAGSSKALDNTPEFELSDIFYFCAARGMETSYGLMRCTREISQRERTGGPGDLLQQNRIIDFQYDQPFGSRILCGVRTADSGTGLPRLCDVRDTSAGLSSPVLALLHGCWQPNWSVSEDITCSKDGERVLEEEVAVDYRHLGHALEGGNIPGQSSDTRVTCPDGSQAPEPNHCLLAYVV

SEQ ID NO: 1009517 - protein, 166 aa, Homo sapiens
MDLYGLNSFPGLQRPKMDSARMTMFACVPAWLGWVPFVTSADLSLVAFTGLLWLNPGAVHFAADWLGDRGCSVIEMFGPAPRPPVANNGTCVSLDDGLYECSCAPGYSGKDCQKKDGPLCDQQAPPASTEAPCVDDEGRASHASCLCPPGFSGNFCEIVDNSCTPK

SEQ ID NO: 1009518 - protein, 238 aa, Homo sapiens
ALVIMRRERRGIAPARSSVADNGDDHSEGGLVENHVDSTMNMLGGGSSAVPESPQCRVWAVAVPLFRQKVTESDTGRWARVASITLAWRSPCKLRNTPLAGSSRSQLGSCDQSSWKLASHDLCRTSRMMLGHLVVATSSLHCYYPRNVCTSHGSSTNSFKLVAYECRVNRGMQMVDDASSDCEAPLNNLRDSLDAQVAKPPNAITLCWGNPPDVVQILRFVSKLEGQGEAHEASDSVG

SEQ ID NO: 1009519 - protein, 179 aa, Homo sapiens
MQEKRQMERILTEGIQKPKQRVEDLQQTPGTKSRSHYDIPQKSAGRSSRHAPRYGSSIEVYAKGHNWGRLCDNHRIYSWKHGINKPIGIYCYRTCVDRTTVYTINTCTLDITRIRSVPLERQKKAPYGKQYKRDTTANRNGTGTRSRTVHSSSVTAPIGMMNHGIMVKQVYQQPGRWDG

SEQ ID NO: 1009520 - protein, 124 aa, Homo sapiens
RASNYNASLRYAQAWGGASLIIPVGITFFKDETTALWIVFNVVSATFFLVDLVLNFRTCINELGTPALLNTASTRNPAQTKPPPTHETPTEHTRTPHQPHTHTHHHTPTRKHNTAPTHPNKPQH

SEQ ID NO: 1009521 - protein, 52 aa, Homo sapiens
MVMQCSRVRKPGSWREPGELALNMGDSGGLMDKWKVSKRTDIGDTGELAEGG

SEQ ID NO: 1009522 - protein, 126 aa, Homo sapiens
MGRSSCCPPPLRPRGTDLRGPSALALLGAPDDLLAVGPGRGEGASGEELNFDDEGFSHSLFNPTGLADEQLDLLDYIRRSANKAFRTFHGDFQRRNFINAVQDLPQRLRFKDFNSANCCRTQRPRA

SEQ ID NO: 1009523 - protein, 150 aa, Homo sapiens
FGLSFVFEDIVSDELRNKSPPSASEVCTLVASSGKRHVGGRSSLPMGELVPCQSEPILLARESSPMGDKAEDGFYGSLPLVECISAALELDTVLYDLLGNCVGVDSITCTRLLSLGHALFSGVASCGSTASMMALHNHRARVTTRMGKTP

SEQ ID NO: 1009524 - protein, 197 aa, Homo sapiens
KDLVPALIAVEWNTDVLMEGVKTEVEDTLTPPPLGCWLTFPETAPMSLAQPGCMLASCVCSVHVTLEPDYAQSFEDSKAKPRASGLSLHSLGALLEPSSQVQWHLCDTGSWSYTSCTCILGKTHAYWAHPLALVRHLGGAFHPRATLQDTTTQTVHNPIKHPLEACKTSLPSGGTPEEKATTDLAHLRPWEPSKDGL

SEQ ID NO: 1009525 - protein, 37 aa, Homo sapiens
VYGHMSTARSDRLCWRRSCNAPLTDRATGRAWRPEWP

SEQ ID NO: 1009526 - protein, 41 aa, Homo sapiens
QAGTPRYGISSTPAVGFGLCGGETRSRLLVVADSLVRSDDS

SEQ ID NO: 1009527 - protein, 157 aa, Homo sapiens
RKINPLIKLISPLIIDLPTPSNISVSDEHFELTSYGCPCHNRSHNHHKDYAIGHALITRTPQPVYLIIAHINLRDVDYGCISPATLHLPIARLILVLLSRLFLHIWGEGATITDHYLYTSESSKCRDYSSCLATIRNSLQEANVLPVRPNIILMGRR

SEQ ID NO: 1009528 - protein, 207 aa, Homo sapiens
MYAVQLVLNLICQKMAYPSVPQSSYLRSHLRLAPVRVYGYTFPPGPCLVMGQVSPVNSWCLTHEVLGGGPRPASVLSRAAEPGPQSPVLPLSAGCSRWPDTYWPPSGPWADTLASYLLTCRYLDSLASQLQGGPIHPTSDSARRARSPAISSRNSTCSYSRLWVTKHSAVPHLTDTVLQGSRKLGEAHGLQGRLPALEVKLGGRLGP

SEQ ID NO: 1009529 - protein, 138 aa, Homo sapiens
RIWGCGSPPYPFPGVWVVDIVTGPYVGSRCHPMRTPQLSRPRHCLTWQAPPLLTYPSDQTIGWLRCTLELHMTSRPDLAFALYSLHPQMARWTPASTIHHSLVRRGAYPRTRSIPVMNISGQNTTQLPRRPHPPNSPT

SEQ ID NO: 1009530 - protein, 97 aa, Homo sapiens
KSTVTVSRFLYYLSRCAQRKRNLLSQLHFSKQLLSAQLAPLACALTTTPAHSPPRSCPLLLYTHLTRTSSAHAPAQTFTPSSSTPRAAILLLSPYPR

SEQ ID NO: 1009531 - protein, 220 aa, Homo sapiens
GDMRRLAAMCWCAGPAPVTPVGAVRTLWSLGPGLLCIPCGKRRRWNCVDSEHVTCVRWPCLSMEVLGAPCTWNPNCCACVCPLSPLGPHSRSDAVSQPAPVIRPIIATQHISSMCPGRLWMARACCCSHSRFLPWWCGPPFVGPVGFGPGDRSHLGQARGSEKPCSSGGQLVAPRGPYPASSASSPTCYRRADSDLFLMHASPGLTAETNNIRNINKTYT

SEQ ID NO: 1009532 - protein, 174 aa, Homo sapiens
MSYTMLIRKNQHIEWPIAVTYTLVIFAVEESFKPVYTLTPIHVYTPGIALRSTGTGEEEENTPGVSLDVVQQCGQITTPFAHDFFKWGDFPMAKSVTLYKLLLRIYTKGLWGETYIRTSKPWGKPLRLIALDSGTKSKTVRSRLRNTKWNGDTKVYQTLTIHSRFLHTRNRANF

SEQ ID NO: 1009533 - protein, 122 aa, Homo sapiens
MSDAAVDTSSEITTKDLKEKKEVVEEAENGRDAPANGNANEENLGTQEADNEVDEDTSERNGGDGTHGRDGHEPTRVTGDWNDGLRPLTRLTEAESATGKRAAEDDEDDDVDTKKQKTDEDD

SEQ ID NO: 1009534 - protein, 240 aa, Homo sapiens
AHRQSGCRKERRPKGEEGGSGPSHVVKKQEADMKVVRFPVWRYRPKNLWLMDEDYLRPQNMKTSPCCVEDGARLILLELLRRPEYVHRSGVNGCAIDIGAHSIAGNIHAMFINPLWVLMRSTAPKNNGINVQACRIKWRESPTTKMYLWNTMVESIEVEGTKWIGISMYLSICVRKRVRASKCEKCVGIIVANTCGNMVHGVHVEMERRKHIVHFFGYAVVGYENESGSIRDSFRDIAAT

SEQ ID NO: 1009535 - protein, 261 aa, Homo sapiens
DDPGHGMTRIRRKRRNEVTIQPFPMRLPLLPHPSLPFCTTLQVDDDSVIMKSIRKALVLYVRLHLILGHFSDQIDWIRQNIVQEFGLHLPGVTPRLPLGESTPNRVDLFGSISGMYDPRCCGLKKVGDRSTGAGSDYQVVPAFLTSKDSTYNSKLDAENCSCDKKHEIAGTVSLSLHLLIRGNSQSTVYTWSWELVSPVEDFCPTPGKKEMFHVGSPICLTYKNLAKRRTKTDSWALVTNTYRIGKEAVIHGWDCLLTAPS

SEQ ID NO: 1009536 - protein, 261 aa, Homo sapiens
TRREEEDEEDMEEEEGAMVPQYQLAVDDSSDEGELFLKKSGGLGDMKYKFPVSQEPVLSHRVKTLPYAAICVLRAPYQDELLERRSREETRVANENEGRNAKNRERCSNAVCKNLKQEGDSGQAGEAAERGRRTRMLGLEEGDLEDDFDPCRQHDQRLCTKCFGDVVLTGACARTEKRYYCDVKNEGLDDYCNWDTWDGPDQERRLEPVRSCTVRTPNFNIGLPTIDPSPGRGRKRMREDPLDLGKKKRKSPFAAAVGLGE

SEQ ID NO: 1009537 - protein, 132 aa, Homo sapiens
MGLDYATMKPKPYSQWRKTNRSQQGYITTTDMTFQKRHKIESTQTPTAVIISSHPPYYVVQPKSRTSYLACVPNLFPPTRANKPRSYILNLADSVTAVNNRWLSASRALDPVTPTIDRKMNSYRPRIANLRV

SEQ ID NO: 1009538 - protein, 294 aa, Homo sapiens
MADDAWCSGVGPGGPWCARVDWGTACGFRVRFRQMASWGRGRGRGLGLWCLECRGSSAECKAEDQEWMPVTKLGLLGKDMKIKSLEEIYLFSLPIKESEIIDFLPGGPLLNGLRYSDQIMTKCNRRQDPVPDTGAHRYQGHYVCYRGTTTGHSLVWVFTLLHRTVATCHPVVAIYSLANNSSIRPRAAEAYWRGTQNLRKTHRTCTLAQVVDTGQACALMLACERLNHLEAHGSTWHQILSDTLVAITKGLPQCMGWILRNDMAQTYSPGELQLANTGRTLGQGHTNDTHNKRQ

SEQ ID NO: 1009539 - protein, 67 aa, Homo sapiens
SSLALLKLKPKRWLYKAKKAAVDKVSTVTNIEEYPLLSSTFRRTKYTATPDDSPNILGMSSSQEKQA

SEQ ID NO: 1009540 - protein, 296 aa, Homo sapiens
VTRWVRVWALASMELVIQFQVLNQSCLLTGMEPPDAVDCPEQQRLAVLATCDCCSLRILQTSTRYWSWSSKMHPPPWWRLTTVAFSTRWYRLYLLLETRMGSLAVSHPCTGDNTSVCLSDHQGLPNLYHLVSRAQECDDLGSGVAQTYGLGLPSGDLTVSLLSVASRTGMREPTCDYYVDLDDVPNAMHTTGGTTIAACDYMVAMWDQGTTITAQNTQAVHGALWKNIRWHTILTPSPSHFAFDPNPDPLEDIMAAASTMQCIQLVTLRSVVLTQRLTVCISISANPSAPRTYSGS

SEQ ID NO: 1009541 - protein, 80 aa, Homo sapiens
SGILLTHAVCACVGLVLCCDYAMSWGELAQLSVDAWLAGRVWILCGEPGVPADWCGWSVEWALCEAAMKPERRGPWLCCL

SEQ ID NO: 1009542 - protein, 80 aa, Homo sapiens
ELAVGGGAALSRRQGGWALLPSKRRCLVGLAARRPAQYCKIDVKGMVFTPLHQRTEVISSFGPLFYAIMYVIESARLETS

SEQ ID NO: 1009543 - protein, 62 aa, Homo sapiens
MTTTVPQCNNITKESVPQMTLNAILVGTTTFHQRTAKVQYPKTSYWVTKPKVCEVGHRTHNY

SEQ ID NO: 1009544 - protein, 131 aa, Homo sapiens
GSARVRNLSRRLRAEAAWGRVRRARAGRRGRRSGQPSLCGSRGRGGAGAPGRGRVWLLLIEFLWCSLACSSVFCISCSVLFKLRNALCGSSESHLWFSRHLTEHMTNSGKLSSNGTSLLDTREDSFVWYMA

SEQ ID NO: 1009545 - protein, 68 aa, Homo sapiens
ERDPHVLGSPCHTKYPHSSTDICPILSSFHVDPVEEGRGLGSQHLVMYHRIRVPLLLNPIKIQEKKMG

SEQ ID NO: 1009546 - protein, 216 aa, Homo sapiens
FRSGSADQARASSWAPRSAAGTHHLPAHAQQSIFEPYVAVRDAAKMNDPTQWASQWTPNMLTARASSPYPCNPAMTTSPLACAPSYCEALPDRPSPWAQGEARSRLRLLYRLQGQKEPGDPRAKSAPLHGADDEPFAVCMFDIIHPKSKLTRPSAVVSWESLVPADLGQRHPSVVVTYSADVAVQTSIVPHSRTMWLSWTNRCHVRCNCRGTEHRG

SEQ ID NO: 1009547 - protein, 57 aa, Homo sapiens
MNETAEPVRVTKESSLKGDSEHRSDESSDEREKEERRKTRIEGGTEEARRDEERQKE

SEQ ID NO: 1009548 - protein, 429 aa, Homo sapiens
MCGVSRTRRNPGGLIKSASRSSNQQGLFLTACAQESELGQHHVLVFSCALTVPGGAPDPCGVHLSFISVHRVGFHTGTWFQLRCMQVWQVNANATAIISANMDAQPMMPTPNIIARAAQKYREKIRQLGSAALARQWQLINGLDNMSSAVPNHYPQRRRTLITFTRNKSQPPDGEAARQMSLASGPQQTKAPDAQRAEGLGNSRSHGRTKQDLGIEHPSSPEKHVNACMQETRLQVSGAQDKKAKAAKIRKTGAGDARRKEGLKGTQARVTQTKQPSEDECSGKGTQRGREHKVSREREGRVRPRLGREVMARGDIATVRTAAGTILALITEKDQRDDSEEKGRKQKNEKRKGQVKEGREDRQVRDRGGDQQRNGERAGREGAKGGRKRSTERGRKERRGGEKRRKGGSGGKGKRRRGGRERSQSGERR

SEQ ID NO: 1009549 - protein, 232 aa, Homo sapiens
MRQRIGNDESRMKVKVLLSSCDETEILTQSPGRSCVDSLLVALSTKTRRSVLDWSVLEPVTSQQISGMREEINVTPTCKSQHNQLDQGWGKGPRRSIENGYTAEQRFGTSSDRDDWKHSKRKCMTQIACDPYKTLMQDESPKRTRSKHRDLRDIHLRTNHEMQGQLPKDAVRIHTLTTRRHVLTQHYDPQNVLTERLFHCTALTIVTRGHIGEIPGRVQRIFRRREKMQHMT

SEQ ID NO: 1009550 - protein, 363 aa, Homo sapiens
MGFLLQQCLDGTRSSFPTPGGSTIDQPSLTSSPHPRDCPKAPDLTSSAAQPPPPSPPLLSRRHDDLVHLARVRKNYHQDSEAGINRQINLEPLRLLPFYLSMILLLCPRMTVATEELLPRIRYFTTLLMRRGNMLSKPDDVLQTTTEAGRNLPFSDIKEHQTVMQLRQSALNATGVCMTLDNTLCTSVTKLATAPTLRHLAPTNGTPRHKVTDSSSCTKTIKPVTLTQGCKNRITKNMADDPKDKRRTMETKESAGDKQTLRIGQGRRNSPPMDQTTHNPMRNHTADSLERGDNGPPGEKKAAAASPAETTHRTKPTQHPANATTRPARYADAQSGLTTRHTERRTATHGNQADMREKDRTKR

SEQ ID NO: 1009551 - protein, 104 aa, Homo sapiens
MPLTLYPITLPRGLRNPWKHPEENPTRCAGTRSSETSASRDPGTAGTWGPPKRGQPGCKTPASTQLRTGLRECRHSRHSPRRPEQKGTQGAQNGPPEAKQTHTT

SEQ ID NO: 1009552 - protein, 332 aa, Homo sapiens
ETIGRKRRGTLAEAAEHPGQEQVQGAKDERDTLDKATDMKDVREPAGLLLPSTHLPAICARRMSPAFSGHGCESPCAKGVLLEPLCPPGRGALMRAPIQLRQPCASPCVTKGTSVLRDPPCVRCANSLTSTEVSLDTRVSPESPHMGGRWGTDFGEDYTQEILAQNCFLVLQEHQKARVTQGAKTKGHLDDAWPIPCRDRKPIDDTMPLVEHRGQMMRHDLTPTARAPIRQPKSKRRTNTTGKMYKPHILNHQRYSTDRQGEGHADSIRQENAWESNKDRAKRKDKGGTSQHTRKEQRDAPRPTAKRQQHPRKTQHQSPNTLANTNTCRPGK

SEQ ID NO: 1009553 - protein, 405 aa, Homo sapiens
LNQVAETRYCVDQNLLKEYLPRAGGHAQVLLGIYQCCSMCGWPFHHAGVAASAWHDGLCWLYTCDGTLASWGVWSVKVLPGPVTRGKEMYRCTLDCLWPASPGMTLQARMSDAARYAHLLAMVGTNISPRPNKDCHAPDACMTEIDGRWQTLHSTGVTDHVTAPMLMLPRTDDIAHCSGRGHHTVRSRDLCWAGAGNGRKCWEDKLGVGRRQAGKTMHSMAGTGTPGQHTQEQGHDAQGTHGESHQWDPNASTQRSPREEGPKTQGALIANPWSTKNSEQTAQRGGPKGPRQQRHAPETPDAPTRRTERERRIMDNERNPSRNPRKPDQRKPNHQTENTITSAILEKSRKNEQAPRTQQRNPRTEDQGQQPNGTAITAATHKTRKEAHETSKGQERDKNNTNTRT

SEQ ID NO: 1009554 - protein, 179 aa, Homo sapiens
EIWMASTSYDYCRAAHEDGDQRCKLLLGIGILVLLIIEILGVPLIYLHHQRPTAEGCRDGPSGQVTGDVSKCHPSPATKSCPKAQKGLQDVEAHGQQLLSSIVMALIGFPGMQEKWPIRYKKNTWRSLTGEITTLNHKLQRRVCRGGATDEENNLGYRRADIRCDNMKYYPSSQDSSSA

SEQ ID NO: 1009555 - protein, 247 aa, Homo sapiens
MTAYKLNKETKRSGRGCEQKERVAGAVTLEDEGIHMSILGKNWNESCSEAVVNKRSNAVLEAASYQYQEPGGYPGGSYRSLKLKNTESLEALVNVICLDFTVVKDDNSRRLICATSHQVYTTENNIATISQDVCGSNDLRGPVLMDFTANKPCMLSDLTIAFQDLPILTLTPRPSATGTSRRTLEWHPTTVDHVGPSCRLRTIVSNKILLLRANRTYRITVLRQTRNTRKCDRRRTDPLTTTLTLQP

SEQ ID NO: 1009556 - protein, 227 aa, Homo sapiens
MAGTIMDMSGKRCAGKLDGQTPASKCFLNGLGLALHLSFQATHLNICHAGCAATEFCGTTKSALHALISVATTLPLELWSHRICREHPHAGYILRENEITTILPASAYRLDTKCLNTWHSIAKGRLSVLVMSALHSYGRRIYFHTSSATTPNAFETQDKQGRTRATIATGHRRQGATHRGGSQYYGLHTFHSNNMGYSPGVFIYDTDTALMRQGTRQKQQDDKLRNV

SEQ ID NO: 1009557 - protein, 326 aa, Homo sapiens
SLKDHQRMPPAPSSGLAPLAKVIQWQLWYRGRTHDQQSSAIDCHPEELWMAPPGKLWRDRPRGSPELSSHASTGRMPKACVAGGHPCSMKRASSLAWALAVSHYCSTCHVVDRDRCRLEKTVPRYDDIKKVVKHGVGRAPSRASWATLSTRWSPSEFNSETHSSTFDAGAGHCPQRAPCQAHFLVMTTNSGTATQVVDLMAHMASKAYEPWTTSPSKSTRGRERPSHAWRVPDTTSVTEQHGISASSQSPCRRLNEGQGLGSRPCHVPAQRYPCDSTHDTPHHWHPDSAPAHRDPTHGAPQRQHDPAGATGRPHRHAKRTGQRPAA

SEQ ID NO: 1009558 - protein, 291 aa, Homo sapiens
PPDSPSKRERHKQLVSPRRPSGKHGAFPTHPQPAPHGTHETGCPERRHAMAWISDCRIPPCSRAGPGPGHTGPHGYGKAWATWSPLGRPRALPRPLVVASPSNTFSGWKEFVYLCKLLRALKYDGRVSSRGGHAWISRRERRGPSGYHQRMKARGISRESPQMLQVPDKERDHRWDTTAIPNIAAGLQGTTEGRGGASRNTLRDCHPSTTVHRNANNWIAKARTAYHHNTGTTRHKLDGSPMGPKALRLNELPNQDVTTGQKPQQQKQTNNKENDEAAPPHQTHKKAAHTN

SEQ ID NO: 1009559 - protein, 181 aa, Homo sapiens
MVILLDMSWVKQPLLIKQILAYRGWQASLRRPYLTMGHNCITRDHGPNDAMVNITGDTHGVSSPWNKDYQSTWESTQSNTRGKHTGRANPKPEFHPIPKGADTLPHRAQTKRSPRGHTKGGPRSEEHQGWRPQDARGHDPTGEKDQRGTGPGRELGTGGNPPVEDRQASNSGTRQMSNSRD

SEQ ID NO: 1009560 - protein, 104 aa, Homo sapiens
MKSFGRHSLAACLIRPKSSHKDVFLGTLHYCTRRTQAAFVINRPTSLETEIEWLNIRYRVTPDGASIFYYLPLTYTSRRGHILADHARLLRNLKHRQLSSCLRL

SEQ ID NO: 1009561 - protein, 89 aa, Homo sapiens
VAPPVRAVCPSSVAELSAQTPVQPLHPFFMHSCLSIIQCLTPFFHCISGPTPMHSGSGIEIVLGRNMATSPYPIGHVGGMTMVPGRFSL

SEQ ID NO: 1009562 - protein, 268 aa, Homo sapiens
MARDVTLKICALIEGLAHMRGRPPPRKSTLETSVVGLLACQDPVIRQWCMTRSPPCQSWTQAERQAPWPRKNPKLRKMAAANWWVSKRGCTLGEGISSSSLSSRWNYSSDEIAAQCRSEGVLSGKAILVSHQRAPAAPYQKGSQKYMARCHRKVCPSWEYWRLNSSKHKGTLGQVTKGVLGLGLSSQRLLNFHPSPPQEQGQAAFFLRPSVQAGGFWLLYPVNPLLFPWVVSLTGWGPLETFKLNVGHLFTRVHFPQRSRNGAGKCRL

SEQ ID NO: 1009563 - protein, 37 aa, Homo sapiens
MGVGEHAHEDFFKGQLGTERRPIESWPLACNVGLMME

SEQ ID NO: 1009564 - protein, 69 aa, Homo sapiens
TVAVGVIRMQWTRRLLESGKVIQGLLGRNAQKAKMNIIPRYLPPHSLNQVVEERISEAWLVSSMAIISV

SEQ ID NO: 1009565 - protein, 252 aa, Homo sapiens
TAAWIERSRYLEKEKDLAENRACVYWRRCDHEFGVSTLAGGGVSGQRRQDLIQCPGPVRGLEPLETCQWDSFRQGESNDSYPHGLMACLQGGGGTCLVKREPGGRRSGKDEHSVELSGKTEAMNYACAYAMERRAVDRNLRRETNRPSCLMPCPELLNYMKALTGKAWPCFPSRLWTRGAGNGLNGPCGEREAGPGSIPGGQSAWRAWQVSKTPGSTGAGAPGVDIPTYVDARREIGQPPKNKPNGEGANEE

SEQ ID NO: 1009566 - protein, 108 aa, Homo sapiens
MLIKSYDEPDMTFSANTLGLVSQSCIGLMFLIFLLEVDSCLTIRSTGMREFALTLRQFAIDCDVVNIPIAVKLFKAATEAAIISVLRCNFSNGCLRSTLYPVEILEYL

SEQ ID NO: 1009567 - protein, 284 aa, Homo sapiens
PTRSDCEAFCHRNCSAAPQSLSPPPVSPRYPELRLFGGLQRLRRSCLEAACEAVAWPAFRQSQRRARGGAGGTYAVPLQPYKFLVSSAYFMANNLPKAYRRLLHDRFYVKASLIDEDDEEELWRYFMRSLPGAEDYRVKRRLECQRRMTSLFDPEPVRGNTSGENWRNNLITRPWSWPFPDFFKAAFDRVSSRACEGSGEIEDFQAFYLSIADHHVEVLECEIQCERESQPSYRRLIRWTTFGGYYVSLTCSKPYDHVNDLNECSPLVQSAICSVISNDQGPAV

SEQ ID NO: 1009568 - protein, 102 aa, Homo sapiens
FSTTRRRVRAAGTGGQDGYDDPSCWQGRGQELRVVLKVLDLVTMTIALASTRQQPHEPGLPQHLASCMGLCARPESSSKLLVIGYGVVGHTYIPKCQNEQYA

SEQ ID NO: 1009569 - protein, 182 aa, Homo sapiens
YQCLVPRQLHMSTETASRRSDGHLSCDNWHKRRKNGGKRKSYHKKRKYELGAPSCQHQDWCPVAFTQSVCGECNKKYLLTLSVGLLGEFLLVAQKCLYSETQGSSMFVYNCHLNYTKLGFCERNEPLVERTFGHLVAPISTQATPRTSTGVLQMSPNIAVRYCPLLGPGRASGDPSSVAPPM

SEQ ID NO: 1009570 - protein, 124 aa, Homo sapiens
MTPRPVSWGLLPQGAKRSGDMQQRQLGKKKHRRRPSKNDAAPGKRTTMLTWEEKKKFDEQTEPSRLSRIQSRDVRQGPAGRSPYNTRADPQWNDQRPGGAGSQETGLILQGGPAAKIRRDQTID

SEQ ID NO: 1009571 - protein, 162 aa, Homo sapiens
MSTHGRRQMHPVVAASGPSLEVAHSLSSCVSALSKHHRTLPDSNLTCSSHDRHFPALPGHCLEYTPGPKGLFRGKEHALGGASRGKSDRVCSTWESHTELSWTQALGEEAQAPDRWGKAAGVPERRAGPDSRQGLACTHQAGLLTGLRASLPQAPTMLVSQD

SEQ ID NO: 1009572 - protein, 210 aa, Homo sapiens
KCLGVPCPPRSNGYVEPRARDCACRILVYRYLSVVTAHEGSVPPPLSSRPRWGPAPHHLPVTPAIPYCFLWPPPQHSLLKRHIVVIRLSVNADPDIPARSGGHETLHPGYEVEMWLHHYSLDMYHKNADPLYANAGRFCTTRLSVSSALYSTPCHTTMSIQEPLPRRTNESVQRLRDGALVYGCIAAMVVENTMGRHISERGVKAGAGPS

SEQ ID NO: 1009573 - protein, 173 aa, Homo sapiens
MHHPDRGPGAHETRSGSGVRLRCAIQLLGPRAGLELGWDPELGMQRSWAGTTCWCPGGSEPRRRPGHHAERQGRDASHPSGCSLRDTLSRKDSGLEMDDNLRYRAIPDTRKRDYEDGPQNQDMNTTCLEDTVKAPDLKCYQDGCKMAVGTLTSQDQGAPNDTSTWKPQRRDEA

SEQ ID NO: 1009574 - protein, 161 aa, Homo sapiens
MNEQKQRRQTTRESIITKSKQHRKETQAKRALNEKQGTRTCKHGETKETNPHGPDINLSTRKETPKRNGHERKTNPEGIAHIIKETGKAVHERTPGPQWYQPKARKKPQEGEKAPKETTRIRTTEGDTLGRRKRIMTRTSDIHHRLHTPDNETNNEHAPRR

SEQ ID NO: 1009575 - protein, 255 aa, Homo sapiens
LLSPLYGYRRPRPLPRVGSRCLLRCSRGATWLLRQALAECLGTLILVMFWLCAPVAQCCAQPGAPTGGFLTINLAFGFAVTLGILIAGQCLWGPPEPCRDLCHVLPGSVSPGSMLPIYTLAQTLGAILGMLEYVHGLYYDAIWHFDDNTDILMYSGPNGTAGIYATYPSGHLDMINGFFEPVHRHSLPYRDVCWTLLSPITNPIPRVPGGTSNSVAWWILVQYGTSHGLQTSGYCRKTLTRRLLAHDLIQDLAAA

SEQ ID NO: 1009576 - protein, 256 aa, Homo sapiens
DIVDQASPQRRALLRIQSLEGAPKMGRRSIGPPDLWDSAQIPSFPTSIEDDLGQLSDLEPEPDAQNWRAYSGAMDDAALVLTQREIDRQEVINELLSVTEASQLRNTPGPGPDTSTSECLTGEPDAPGWSWTRLFPKLPELIRDSQFHGCEAMKKLRGGKAHIYPTDDHVKLNAGHRLIMALPEREYPAQWTGTQDTCAHSQSKRPVRRSLNDRKQPPRARGRIPRVIHSPGQAGEAHPQESGAQQLTETSPFSGR

SEQ ID NO: 1009577 - protein, 352 aa, Homo sapiens
MVRSSWTKMWVQGPHPILPLPGTMCLGLRILEVQARAGTRGFPPTLTCLAHRHTTAHAGNHSSGTLTMLCAHRHAALRTLRTTRTTTLRRVARTAPRLPPPHPRPLSTPSHHGAHGPLCSPLCPPLHARRRPPPLAPLCATAASPLCATDCLPSVRPPTPPCYVPPHHSPRASPLATPPGATSPLPRQSPPLNFSLTSPPPPMHTPPQSPPPPSPYSSTTPSRSQNSPPPRHHPHPTHPPTHLALHTPPTTPPTLSSALVPPPTPLHLPPPSPPPPTTLSPPLPPLSFTTPPPLTTTHLLSYLTQTVAISPTTNFSRSFLLTTTTPPFLSDITLPPPFSQPHLLYYLTTLTP

SEQ ID NO: 1009578 - protein, 190 aa, Homo sapiens
WEPRWRKALRGEETKGSVEIMRPGLELTPWVLCSCLGKSQSAAVCDGTRDVTVGMQALTDYKKLRAFFVAEEEHFLPEAEKEEGLPEDELADPTERFRSLLQAVSELEKKHRNLGLSMLLQCMCANPWQSQIWMAGGCDPHLHGKCQRVAAREAWHVRLALGSIYIVACLNNVHLSFTLRRCPGAANTSR

SEQ ID NO: 1009579 - protein, 118 aa, Homo sapiens
RESTSLEFRGFLFVETGAMSTCRPSLVWKLLGSRNISHLCLPNCWGINRAVFTMPSLGSGGVKSGHRWETWEKPVLGGIPCVCSERGLVGLDWLRLGRTKRTLCRNSLGHPAQPARPA

SEQ ID NO: 1009580 - protein, 139 aa, Homo sapiens
AALLSESRSVSLPLPFPGSRLPLSFLSFLPIFFLLPAPGPGPFSWCLVRTKCAAVPLCGPCSMTLPVHAILLRSPCPIVACGGLLCWLLAHYVPWTMYYAVKLERLPCLCLGAWELTLSGPQFGLGSLAFTKWNNDFLL

SEQ ID NO: 1009581 - protein, 277 aa, Homo sapiens
GCRRTDAGLTTVSVDGRTLDWTCVCDGRTLGALSLSRRRWAGPVPVDGRTLGWTCSLCRRTDGWTDHCPCYHAPDVWYWTLWSGPLTGTGLTLVVPLRIGRPVCVPDHPVRPATNGTRRPAYLTRWSFMLPRAAHVLSVPALTLRCSLASPSTRLSPAPYAPYWFPCALAMRLWAYVRPHPPYACARTSALPRVNARVPAPSTYAAATLTSNRRTAKLRRNTTHNVSNLPHPPARRTGRARRSLTVMDTQSTLQDEIPTAFVHLYSPNGNDPQTLHA

SEQ ID NO: 1009582 - protein, 123 aa, Homo sapiens
GERTSLEFYLYFSCKNGGWGSCCAKAGLELLGSGNPSASVSQIAGITGMIHHAWPEQFVLENYPEPFPEAHLHLAIPTVGEYLHVYLPARRKIWGAEITLFQKQAIYDDSKYGCSRSGRSSPP

SEQ ID NO: 1009583 - protein, 128 aa, Homo sapiens
MSHDRTRYLCLLNIYVLLLNPWGLQCRWSDSPPFMPMMTRVETGNNWMVSLNYEILSDAVPGSLKREDTRTQACTQTQNHASPRAWSSCILAPVKCLYSLGGGLRLDPLGAYRALDGDLESFILFHKS

SEQ ID NO: 1009584 - protein, 115 aa, Homo sapiens
HLCYGKTTWKCLGKPCTGPALGSGDVLGEVLVPRSIPTRLLQLGSPYVAGVAVVAFLSSVFLFPSFQNRGSAGLSRALASVVWPRTWCGVGWLETSAKLLYNSWKRARVLPAALQ

SEQ ID NO: 1009585 - protein, 377 aa, Homo sapiens
EPVLRSSAGTAEPGLFLALARLQRRRSAFAIYLVAREEPRPGCLAAPAMTSRGNARSAHRMARGHEVLSIADHLLLSPCSVREGKMSESRLEVHAWPFVCSKARKTDGVLTKTGARWHRSASSEALRVEGPSGSMLLDRWNVHERRHLQKVAEQAKDELLGELEVEKGYMAEDFETVVTCSKVDRHKSYPTTFHGHGNTQGVDEYLYTDNCAQNGIAEKEEGHLRTEMSPRGRARDCTVEGSIAGSAALGFPFQLVNGSHSVHLFSDDIWAPRELGLHGSLIQTVEPPYGHTIEMDIPTRQEQLRSQTLTFGGAQATLCSVWNKTTSPNPPPHHTCLGNKGEESPVGPLAYLGTQIAPTYSQYPCVITMLMRAEQLG

SEQ ID NO: 1009586 - protein, 283 aa, Homo sapiens
MHPDSATVPFGAWKACWVRDAGYSNSPCMRIGQIARCTLAKDQPQSTERTASIALQYSCARECGASCCISQRDGRVSCKYHGDEGFAGPTETDVPCVTAPWTCVRNLAPYGGSSRDASAHETPVVCEVPGRKTILFLPRLYYVYSPTLRHSPGEHQFGRVREVMLQARVNDLGRTTRWGSHDVTHTHGMNPLSSIQSTRHIVPFGAWVIARTRVVPTKWTRHLNESLEGCFGIFTGREQVLAFLTTSLEGVVRTLLASSLGHADLCYPNWFSISTTISNIKGV

SEQ ID NO: 1009587 - protein, 358 aa, Homo sapiens
PIRLGSGPDGAQEIKRYVFYSSMSWNKLYLCVRSSQAFKPVSGSDLMTPVYFETQSSSVPDIPEDAPGNPHLEQLGAHQRVPEASGFGGHRPDVIDDWQAVVPRRHPCSSVRYKRTPMEDRTWFLYLTADVVDRQQNRVWGVLTLHVPSAVSYTGPSQGMEVMLVDRSIDPGCIHCGFLSGRTTVRDLVASKVQGANATFIKHPSSSFERRETWFIDLTGHSSTVVTLGETDACLIAGGSPWAAALWETYRIAWTQYRIPTGRSRGQDPKRSGVHMGTNGKQRAETLCGQGKSWARRHSGRVGRHKGASPATPTNPTTELGTACMKRHTGNIPGSMHMTLYGTNLAGRAKSQTERMTT

SEQ ID NO: 1009588 - protein, 103 aa, Homo sapiens
MLGETGENAGLREHAGCMETVARGAGVDGYSHWTANKESLCAWKELLEHKAEEKKRIDGLGDALVWTCGTHIGAKGVGSHERWNRGGKKIRPKRGNSRRGLCK

SEQ ID NO: 1009589 - protein, 197 aa, Homo sapiens
MSRPIKEQSKGNTKTKTYEARLTQRESASTNNSIRVNNRKVAAQKRVQQKRSVEEYNNIGYVIIAHPQRKQNIYEQPQGKEQMHESNHEKRQNLIKVAQPQLNAEDTPQKSNQTNNRRATKREKRPTGQGTTVETRATAPHTTNKDRGPTTSQQKAYSAQGTKGTEPKQKNTRVDTNNTIGDRRTRDEKQEPPRDNR

SEQ ID NO: 1009590 - protein, 148 aa, Homo sapiens
MLDIHHKYQTDHRADTTRDAEQTQNHTRTEPRTTNMTTTKQPGHTRTEPNATDAAPTQRDRRSRKRPRHQRRKTPPWPSPTARTTALPSRGTAHRRGRQRPAPALHVSGPPGRCRERRRDSSTTADDAARRAHPESTNTRGHTQHQQQ

SEQ ID NO: 1009591 - protein, 272 aa, Homo sapiens
AHSRSRCLACTEGPVSKVLALYYGPATCFLDGALSDRRFDRARTRRAGLSCDDVSLTGVVRVDGRDVTDRLRDPWVVPSVPSNLHTCPKMKLEISYEMDRCCECCYDCVMEGGAQGDMPRLHGRCVSVNVPLKWGLLTGTPYQVGLLVSCIVLAASRSVNRSLGFRAGSTEGGLNFVRHPVFRDVSAMYPFVFHRSAWVLRRELTRTARRPTGRGLLGSPLGVAGTVGLHEGLRGIAHGHNCGFCHSGDISKASGANDGGGPVYCDDFQGLV

SEQ ID NO: 1009592 - protein, 274 aa, Homo sapiens
NSAVVTMPGRPEDLPSPPVADSESEEDERGLIGGSIRTGREQRGTELEEEALNGVSAVALLVGEKVREETTLVDDPFLDEDRWYGGYEEMKEEGQRFRSVDGTEELHLEDICFLQYRPYRKGIDGIADFDDKVDSRLMLIEEDRDRGSMDGAVESYMRRRMQKELSVMKLRRDIMRDTSAQEDRKEMLSKQMLTGMPEVDPGPSNAINLDDHIISTDGMPRTSPAGQKQSRAENDRQARTSVRWLANMAVNHVAAPTTVIHGGRYKAPIAGSRQ

SEQ ID NO: 1009593 - protein, 277 aa, Homo sapiens
GPMPLSADALRAQLTASSLLLARPVALTAAAAAAAGAMAGVCGCLWCALVHHVLAVLCCAVLCVTVPPVADVRGRTGTCTASTCTRTDMFTALGSMELPRNFVMFFDALVWTLPAAAADLELTWETNTTAWQIAKVYVAKVDFTATSDVCSDQGVRGYPDLTLYQARPRSCDSTRVLGDFQTTAKRLDACRHLNEEPVTPAGRKWKRARCPPKLKQGLYELSGKQLWAARLPQGRRKFYQGSSLRGVAPCNSPGLQTWEQLAHGRLNISEDVKIGKG

SEQ ID NO: 1009594 - protein, 250 aa, Homo sapiens
MPKKVPRVRTADSRADGPRHVSAEVDRRLTDAKKQRVSWSDAILWMDDDEHVIEEGARAWDGDREKRRLDQLERKEGDAAPTGRRMDSYSVNVGKVPRVATSTQGSSSGPDRRTRLRLDHQLREAPDTWRESHRASLEVPLEENVNQRVLEEGSVEARTIEDAIAVLSVAEEAAELDPERRMRAAFTAFEEAQMPRVNKRTPTMRSVAAETAAQRRSESVSWKPMNQRACPSMPPSEPRTWGAKFTHGWS

SEQ ID NO: 1009595 - protein, 114 aa, Homo sapiens
MRADNRLAMRLGKASSHTQSVGYAPVGPAACSYEVLASTTRQDERMLRPARVTLQTELLHVDWRTSNRLNRNPWFTSAAGGRSHEVAPPRELPELGTYVSFRQENIGRTTQHMG

SEQ ID NO: 1009596 - protein, 225 aa, Homo sapiens
AREDKGMTSSMKWGPNGRKARGPRSTSRFMQNDIPRNLAPGSTRTKLTSFEMRWTENAYEGWAHVAEVHVLLHVSGMLPRGRLMHVDLRKTLVRVHRWEHSVRIRDYTLLEEEDPLAFATSQSRFHQCSLPWVFESGLGLHGEYKGGHGISTEAICVLSSRARSQTRSRCLFSNNTVVSSVKAMEPCPEKTGGVPAHYIEPRKPKAGTVRDTPGDTVIPVVPFRI

SEQ ID NO: 1009597 - protein, 131 aa, Homo sapiens
MAQARKETPLRQEKDSLGNNPEETEPRIHEPRGRPLCANTGASQKRPRDGASKRREHKGQRKPEDAGRSQAIETVRKRTDRQRQIDANRRRVSRRERRESTIRKAPRRKGPPASNTAEDTLLPYPRESEAL

SEQ ID NO: 1009598 - protein, 153 aa, Homo sapiens
GGWDLYTYPENWRAFKALIAAQYSGAQVRVLSEPSHIPLWAKANRTPELSPHNFLPARSQHLRVMMDFCVFEMQRQLPYYVSNEELPGKYSRGSEPQVVQWVSLADSDIVPPRQYLGVPPTWASCNQNKQATDAMHKEDSEANFWALLDAYLQ

SEQ ID NO: 1009599 - protein, 193 aa, Homo sapiens
MQHAPEPASDISGISGMYTWRPQYHASGVELRFWCLWVSLRLKCSWEVDKTVDHGTVLSALLARFGCDITMAGLVRLELQSSFTSTVDWSYEACYYYLTNILSRCNTEHTYALSVCPSFSQGMHCAFLSSVVSTPASGKMQGSSDTVRLVTNVTHTRDTRGVSSATFTRTPRRQLLKASDRLDSSRGLSVGPH

SEQ ID NO: 1009600 - protein, 261 aa, Homo sapiens
MKRLWFFLLRGWRARQYGSVSQACEARVRWGSMDVVCKPSVKNLVIALNLAEIVCTGVVLSQMLTYLVAEIRTSPGGQGARSGLEGYSKSRSRERHQMYESRSRSSSDRTYTIIQDMTTVAHRPATIIAVRGLRRRVETARWDNGAVRVFACDETHSVNIRGEASMDDKNWVPGYRLMRNESWRGSEPGIPRGWNAIRPIKRAKLGIRLAHVISPFMYPPHRPDPPIGECKNSPGYGSITVSQDWMGARLGPWRSVDQGTI

SEQ ID NO: 1009601 - protein, 148 aa, Homo sapiens
MSRANFLFINYSEIVYRQGLAGVGQVWVSKLLGSSVSVLDLELPPKYWDYRCEPRVPKDFAINRSFRTGLRTGSFAKSWAKGPKAVPEQEGDSEVEIHVRQRQNRQTTSQGGSFYWSVAQREIEHERVDYATQAQHMRAKRPVGLPRE

SEQ ID NO: 1009602 - protein, 315 aa, Homo sapiens
LQRDQERLGKQLKLRAEREEKEKLKEEAKRAKEEAKKKKEEEKELKEKGEAGEAGTKDEETEQGGRQQRLTEERRKERQEALEAKAKSRLNVICCLTGLNLTDTNRTTEEENTVKTNDEKRITHARDRPTITRFFQKPKDSTRPTSTLDGSCGTVMPPLTHSKSTWSWTLGSRTRLFPYQTSAAQHGPSLLQQHERRGHSFLTRPQQAGSPMSDTGTKARNRPGKCRYYQTVNVDKSTEAWERERPGVSPNRSEVKALGKQKYNTAKQNHRYEKPTNTHDLSRRQHRTPKTHTPQNTYTSRHPTTPTRKATHTHT

SEQ ID NO: 1009603 - protein, 208 aa, Homo sapiens
MRAKDQPSPEVAREIEAGAGHDKTHEVPHFSGLEAKESIMDKREIKAECPHGIEAVKIGPRRSRPERRPWKKHRADQTPVRHVDPVKITVLHTLCTGQFRARNRCAAYPNRATCLTTWSRRSNKGFDIRPPGQDDTSATPIPGELLRWLARHRGRAYRRTNEGVEFELHTKQRRDSSGHPNDCLKTTNTLIGAPASIDMWPKFCPRQD

SEQ ID NO: 1009604 - protein, 259 aa, Homo sapiens
MDHVMDVVVKSVNWICSRGLNHSEFTTLLYELDSQYGSLLYYTEIKWLSRGLVLKRFFESLEEIDSFMSSRGKPLPQLSSIDWIRDLAFLVDMTMHLNALNISLQGHSQIVTQMYDLIRAFLAKLCLWETHLTRNNLAHFPTLKLVSRNESDGLNYIPKIAELKTEFQKRLSDFKLYESELTLFSSPFSTKIDSVHEELQMEVIDLQCNTVLKTKYDKVGIPEFYKYLWGSYPKYKHHCAKILSMFGSTYICEQVVLPL

SEQ ID NO: 1009605 - protein, 181 aa, Homo sapiens
ATVRRIFCASPAEPHRCDTMGNGEGRSRRIGCVLGAWSPGDCFQPLVKMDIVAQSRVTPFDMTSKRTWSYNCSKVMDSTQLDEKLSIGRAAPGLEEREALSGRMENAQSPQSYQGAGDPRPRNQMWWTIAGRLDVTSLEVPLVRSLLTEASGKRGLGAYMCAWVESRNTRDQVILVAPVHV

SEQ ID NO: 1009606 - protein, 127 aa, Homo sapiens
MTCSCWHRGLYPYRIQQKTEEDLTTVQGIADDYMKKNYEGVTKVCCNGTVMSIGIWRSISYGDKQNICHLEDDCRTIMKVMVSACGSLKLSEDSLQGVEFPSLLVTGLKLTLYSTIGSVYLICNSSS

SEQ ID NO: 1009607 - protein, 86 aa, Homo sapiens
MGCGLDRLQSWPHVLCDDRGGMEVRDFKTGLCTLVNADAPILGMWPAVLVVFISNGGRYRARVKLAFRLVPEGKVTWSRECCVDKT

SEQ ID NO: 1009608 - protein, 121 aa, Homo sapiens
ASARAYLQKPAGRVLSVLKVPKGGVVTSRVRCARGSARVLVCGLLFGTCTCAVLHVRTGARDLRPWTSPPAPSRYRRAARGGLEAAGSGALALSRGDVQLQHWTDETPPLEVGTPRSQGVG

SEQ ID NO: 1009609 - protein, 237 aa, Homo sapiens
MNGHVSSISLGAAKIRKPIKCHQEEINDYVLFFLHLSGATRDRSRASTVHAPVRDSPSAIDPSEDSPARSRTRADPCPVVHEVASMSDRPRRVGRARPFTHPPYGAVPAAAVDASWFCQPSSCERSHRRCWPFIIAAPCRGVASCGRKRPACPASFPPAAPLLSRGRQPCAGWKPSVYHVLLILGLFAVLLSCCASRMYTSVEGWDYVDSLYFCFVTFRTHRLRGTWGAASTAAYRN

SEQ ID NO: 1009610 - protein, 239 aa, Homo sapiens
VDVDLLQCGSAGPEASCCPGWLPRCLHPLSLGQLCFLPLCSGPGWLLACRWNCFFNYGKIHFYFFFHAGVGCLSSRTSSSAHIRLLFLEAVARESSSCGHPVSQQAAEWSCIRGAHLLPDQSLTCPKACRAWLPCSGYWSTSSWQGESTMTLHGHRAMLTVLTLPRGVLRLGQSPGDEHTKTPLTNGLTGARMYVAGFDQLVTIVHAWATRNSHSSDPYAHPHPPPTKIQVPTHIYSYI

SEQ ID NO: 1009611 - protein, 203 aa, Homo sapiens
ESDEQKKFLKVDVFLVHKIINEKKDPPEKVTIRLHVSTIKVDERGVQEEAISAGVTWDDSPEVLCCFTPQDVRASYTARSLLGVDLAASVFSPCVPSISVSLCGGVSCTLQRRSSMQSPHLVDLQRGPRRSLFRAFHVGLHGAMWGPVSWSRGNCPIFATLEPTGIWPYENTPSRHATLDFGHTNPQGRTCRTILGFANPDRA

SEQ ID NO: 1009612 - protein, 270 aa, Homo sapiens
HALYQHDAACRVIARLTKEVTSCPKSSGYPETTGWSSIVPPRLLLKFPNRSVSGGGVSLDGIRGCAGGNDPERLFTSFKTIATVLDTSRTHEETVKDCACRELSEARRAQQTTGMVASRTWGCTVPAFLGSWARGPLSLSEDQQDPHWWGAITNVVVLDKSSEQILDYPKGHTKKVTSVVFHPSQDLVSSASPDAIIRIGSVPNASCVQVVRAHESAVTGLQPSCHWRLSPELLLMISTGLFSDIQTGRVLTKVTDETSGCSLTCAQVPP

SEQ ID NO: 1009613 - protein, 327 aa, Homo sapiens
EPQKAVDHTRQLFWEKKLMRAEAAFDIAEELVKTMDLPKGPAGGGTWLHWMRLLLSGTSASCPCTYSTMPINGTALRDAVGEEPLAYGINTTQPLCKAFMVTRRGHSGSRNELVHARCGHPAWQEAAVADMLAHRGGRLARDGERAAWNQGLQLRTTTRKHDAGGGARSPTRHRSMEHVKGTRPSRRRPRAPAWQTRHAEPAEPSEPPTFKPGIKTAEQTNAHEMHKPKDGHVPATHQWHPAPYGHSPPTSPRGCATSVGQQQYSRAPCSHPTPELRIPLPLTSVYLLHHKHTRDTRAKIAPGMITFLAPWPWRLPHSTVSVSTHSD

SEQ ID NO: 1009614 - protein, 96 aa, Homo sapiens
TSFIALACSAWHTKLELHGAGVGRLETLPSLQSPDASSPREPGARHPSPVYLRRHLWPRSRDPGPDGLQKLPYVSVFNGPRWCQNHDVRLSYIRIR

SEQ ID NO: 1009615 - protein, 184 aa, Homo sapiens
VTRGVDGFWRVAGVEGERLVMARCRFCPKNRTESEGTRVACGGAVSLPLYTVVCEERYVRDIFLRNPFRLPFLNASRRAAATRKTRARPANHSPPECAVTTRESAETRGEEGDNREQDEARDQRRQQSAQTPRNQQRPTDEGTNRTQQKEHKDEKPRKKEKERRDKNTKKTTKEQKGSGTHNNK

SEQ ID NO: 1009616 - protein, 179 aa, Homo sapiens
SDEHGIDPTGTYHGDSDLQLDQHLCCTTMKPLGGNTMEPRAILVESRTWDHGLLFASGPLARSLGRMTTLYLVSLGHGNNRGPKATYIKGAELVDSVLDVVRKEAESCDCLLGFQSDCTHWVGGTGSGMGILPESAQIRRRDTLSRTPELPSDVVPSVQSVQTPWSKPYNSHTFSGRIR

SEQ ID NO: 1009617 - protein, 182 aa, Homo sapiens
MSTSVASVAVRHCDDPTSRNYVIAVLNQVCLRGIHALRTTERPADMHAVVLAVCLGVALDGGPEASGCGALAELQKQCRRVRRSPFYQAVRDLLPVWLLEDMRAYVRAFSTGDERVALTVLLLRAFLSDVLVPTTARCHDAYKRCYRAFNLACAHRFPRTGEAAGLRDTSSPWLTRGLFPGF

SEQ ID NO: 1009618 - protein, 69 aa, Homo sapiens
TKVAVMTPVCMLLVGPGWPCVALGWVNLRWLPAEVSAVASGAGVCWPDGLVCLVADGLLELCWSAMAEG

SEQ ID NO: 1009619 - protein, 121 aa, Homo sapiens
AAAAWGSAGALSRGQRAWGAGAGRSEARLDSGLGGAVERDAQLAKCPASKAFGDHSLRGPLCWMPKAGRTSSLRLPFRWLGEEGRRAPKYTPPALLGKLEAERTTRNDKQKCLGRGACRAT

SEQ ID NO: 1009620 - protein, 115 aa, Homo sapiens
MYVVGDFPLPLTERATPPRAAAVSDSHAAGIETDLYPTDSRSYRSDRNHTNSRVTHPVDMIYNCVSLYYIALWTLKHSIYHISYTTHHAIFTAHLLVYSTLTLLIHIANVYDSIR

SEQ ID NO: 1009621 - protein, 348 aa, Homo sapiens
DAWAAFVPLSTGASPLPIPPPVHRLDGQLTTGLSDYLRGGSVCRQRAPCMCKDRALLSWATMRPGPVFPSIWGTLPGHQVVMVGMVVMKDSYVGDEAHDATRGILIPETYPQIEASGYPYTKLGDRIDWDGQDLGYQNLLWMNARVWRSRGCSPYSAGPEAPLGYLIGLNLRMNDDPDLMFEDPSTHCKTMYVMVSKGLCLSLYVLWPVCIGNPWMRRPVTGDQPISVAHLREGNVLRHMLITAVLDVVWPGRLTLSSLMNESVTDPADYMLSNPTQCGPGAGENSVGVKPFIRVDSLNCLPSPPVHFRTATDALRQWPRLSTPRSYGWQYGFDTWPCVAKCHSTLRS

SEQ ID NO: 1009622 - protein, 209 aa, Homo sapiens
MSMPTDKCIVLQRDFSEVMGARDWEEAVKMPVGMQSPCALWATSLACDACEHSYLGDLSQPCGLDLLLNLLTVAVPGMVATSLDLLSVTLASGAPAVSPSCLWPGGFVSDVDIQSERFRALGSARIHTWDTVAGPRHTATPTADGPSPLPSPRNMCETCAHSVPSTWPHERRPFVAKVPGSWPHKPQRHHATPTTRDHTSTPPMQSQQV

SEQ ID NO: 1009623 - protein, 190 aa, Homo sapiens
MSPAIAEQEAIKRGRGGAPVAPDPCQGTGFLPWNTSEAHAQNSVASSEEEEKGAPFSRTGCQYRASEAGTTVGLPTPRNSAVTGPYKAFQGPGARVGETTPYPSPPHTQLNTKLGPLGFPSLYVDGPPISGGPLRMVIHVHLPKGIPQQGPTRGGKRVSGLGGPPKHCPGHHCAHTARVVTQMDTHPGTP

SEQ ID NO: 1009624 - protein, 221 aa, Homo sapiens
LRGYANPLTHLRLPLPCTPTVGPQHRGGPCKVTPAAATAPSLSNSKNQSLGSSPKLPHDRTLTTHLSLSISYPVAHTQPCTGPTHLPSALPGRLFLPSPMAPSNTPPHTSTHTQAYMLTQTHRYTRLCPSLCAQPINRSGPSRAIAPVLLSLRSALPLSDPGREPTPHQSVVCTPWNADRLVDQRGDVARQGYTYCLNDSWRTLTCQPCIPGRQGYLTRSR

SEQ ID NO: 1009625 - protein, 102 aa, Homo sapiens
PTRSATVVRARRYVQQRLRGSGLQMADLNTSCIPRVARRNQGYDVICLSSAIDWPIKCSTSEVSPRDRRHCKALAAKHRCSLRAHRLAWAVRGTEFYLSGHP

SEQ ID NO: 1009626 - protein, 275 aa, Homo sapiens
GNNAPRRRGLKAPGQEKLSRDGEEHHVVLSSPYRLGGISSTEEMDLKDIQFKNRRNWHERLGTSGRLVKMNSEKRIEKLEKRQATDDATFLIVNRYWAQLDDTVEAHSPSAYESHGVMLCFRRPDGTLGPMEGSQHVIVDCLLPEPGTSELERSPVMSAGCRDPSSSETRPYGIERCVALRMQRKAREGGWKHGSMEGRNGKQHKGTNVSRVVDGLRTDYRDRDGLETSDKRRVQHDRAQEPRSEAGQAKTQRMGRENRRMKDWPPTGKNTTNQG

SEQ ID NO: 1009627 - protein, 448 aa, Homo sapiens
MADDAGAAGGPGGLVALWMGNRGGFRGGFGSVHPGAAARGLWHGGPGPEAAELAEARPRIRSGCPLTKLGRLRPKDHCKDSNSPCASDGIYSRIIPMPPLQEIRRSSDFLPLGARPLSKGIDASTGTNSIAQAGTEKLQDTPVDPGTQERPTHGVSPGGNNWYGTNRGGTFTKVRTERLRAATLGGMVNTVGLRTRRGAGFGRPTPGTQFPLVGRGGPEFLITPLWGPNRSFLFPMYRLRRPRNCPAQHERWDIPLWRAGGTSDRGETSEAKTGTALTTTALGTDALHGHTGGMRNENREAHGALRSEDFHSGFSPYEEVHAQPPYAKVTTTLMAKTHPTGASADKPLRRDRAYEVPLHPRDDTAWGSGPPSYSRQRPAVIGTSPTFRTNSGALRAIPLSATAPDQPYRTVNANGHLHDRCPLVRRATMLGTAFVWTTMQHSCCVVAA

SEQ ID NO: 1009628 - protein, 188 aa, Homo sapiens
QRVNAAAVGPARQEADRSPNKQYKGNQWTDIVRTPQWSRAVLSLLDVCAILPIVIRILPHSSTSTLLPFKDKVHSTIFLVGAPGDQGIIASYLRGTICRVHTLAPSGPVVDACDATLPLMPISVPPDLDFLPKKTRPMDHTGPVRHNRSRDNQKTAEVIREEPLRGSNHGPCAWKRIQPQGTTSRANS

SEQ ID NO: 1009629 - protein, 190 aa, Homo sapiens
MPGSHVARISSLAKTDAHGYLDTNSCSSRLSAVASDINWRRDLYSVALFPVVLSPYARRLRRRKGVNGMAEISVEGPQVPGVHVCDVNYTLGHPLLRHVYHGDVMTLHRALCCDSLRRNVTGSKPFAQIISNYALPIVHRVCLDRHFAKVAIDHKYSHASYGDPVIGSTHFAHNLKSFMTRADDNLFTFR

SEQ ID NO: 1009630 - protein, 267 aa, Homo sapiens
MYSSDIYTYCLVSVFMTMERRCHELECHHFYVCKQHAVPQMDDLKSEPEGDQVTDNRPFYDSILVSAVAYPNPSPGVCSLRSSLDALVNAKVLRAILSFESKWSTLQLQLNTVPQRTVMSCVDADITLLEIDMTILCEGGPRERCLIATAGDVTWRAPHSAQAVHRRYYAGADSPFVYLINVIPESSTVCEPCHATDLGPKGFLVCHKIGLMCNVLWEQKDIVRVDDATDGEPVVSRRMTVRWFGVPTPPVRLQGMVLAGHEHARQN

SEQ ID NO: 1009631 - protein, 37 aa, Homo sapiens
MTVPICKPKNAQHDSQGISVTHRGTQGVSRRREDVTK

SEQ ID NO: 1009632 - protein, 71 aa, Homo sapiens
VSRQNTGVVKTTPRSQNGKGEETHINIVDHVDDVDSVQVHTLRGHADHIKCSWASTENEASRENVLVMDGC

SEQ ID NO: 1009633 - protein, 104 aa, Homo sapiens
CADAGAANGRAGSAAMKVKIKVLDGVSTWFWVANDENCGHLQDGIITDAVLTCNVPGRRLPAWLWGQWLPRVFHMLCSPSKWLHAQEVHAALPLCAVRNGSSEE

SEQ ID NO: 1009634 - protein, 137 aa, Homo sapiens
MTLDMDACSVRLMSVPQEQSQGLARDLLDGQDLGCELPPSVILNSVRQSPCWKPTPILIVRGSGWLQDPLKQGLLDRRAYVAPPPSHPSRRQDDNRFKAFRNLQLYTNEDFQTGIHTRETSIEQYMLGCTWEQGQGR

SEQ ID NO: 1009635 - protein, 330 aa, Homo sapiens
MWHSLARQATGSSTRGGNTSIRDEYGLPRDGRLAGELGGRETMGDEKANNSGSHTAETEDGYGTQGAKQDAQRSNTGLRPRVDNALSSGYNVCVPNEVTPRERGTGTAGTTENSVLGGLAEEQNQGQRDKTGGTQQHTMTTEYQWKVGVLERNTDREKPERRQTEMRQHIDDTHRHTIGQPYRWGEKDHTPENGKEKLSDKRNTHEQDDPKQSQPATSTDTDDADTESGSMTADDEDASGTTIEKIARDNEPNDKKETTQKQKLGSHSHRQTTDRDKLAGGEGQTAKDRRDKQSRREEDRKRKGTQQRHTRRHSTTKRGGKESGTEHRTT

SEQ ID NO: 1009636 - protein, 114 aa, Homo sapiens
MRICIDIDNAGYEVTGGPLADEGTTYLSHLAFLLRKKEPGSDNFSKREAFRIPHKNIPIGTIDRHVVRTLNQFGPPMGRFSQASIKTTLCKYFRLRLRILPQAWSKLTSSHTYL

SEQ ID NO: 1009637 - protein, 122 aa, Homo sapiens
MAPGMPLGGTILAVEYQGFWVMIEPFERPLCPVLWKKGAHIPYWESSKGKRTERDEGDGKGREAPKSRQISKKQKRPPRKDTPRGPTVTRHTASTKQRNGAPGPGALSTRGTTHRVRTQLAH

SEQ ID NO: 1009638 - protein, 445 aa, Homo sapiens
MSISSPSGYDSQVVACFVSLLHSRAACRLYAEFCCSDFLRMTLASRKASTLRTCLRTTLIQYLTGYVDYTVTAQHFILLLSETAITNLTPTPRTSCLLYYTSDLITHVSERTSGHDLLGYDYKNMAKIATFDFIDIVRPQSIKALGHNPMARNFSLHTKYAETFFTYIGNAIGPNATGCKPTLTDGWHNIVRTCKLALCETNSGAQPPTPNYTSATIHHTPLCAHHTPGDHGPHATAPRQGAVHTARQYKIPRDTGHTEQSNTMANISTPRKQRGSEADAREMHHPTITDGKRCRYNEHQGATDDHDRDNARATLARHEHNTAHTHGPLTHAHTTQSTEQRPTTRLAEHNINREAQQPMGNRNSRSRQHCRAGIQSQTKSPETVDTTKSRNTHTRPPPHRDMTPPTQRETRHRQHMASPTVRRANTTDRTQAPRVTASQQQTTDQ

SEQ ID NO: 1009639 - protein, 114 aa, Homo sapiens
MSSFLPEGGCHELLTVIGKGFEDLMTVNLARYRATGEVRDCTEEQSLEAGAIEMVTFLAGRGCMSPNSVNHPNIVPYRAAFMADNELWVVTSFMAYGSAKDLICAHFMDGMNEL

SEQ ID NO: 1009640 - protein, 94 aa, Homo sapiens
MGFRRDRLGSQERLGTRGVTRGEEGTEKRVPGGPKEVSVGASNLGRTRETQRELTGTKRNEAGNAGAKERPKCRAHRAECQNGGGLAAAVRREK

SEQ ID NO: 1009641 - protein, 339 aa, Homo sapiens
NTKWRDDAGAAGWARGALVALGWGTCGGFLLEVSVQWHPVGLGSAACGLVAWGRMGLRSSLECNGLRIQDVDALSPMLGLLVKDMKDSMSLAQEIYLFLPAQLRNHEIIRVSFLGGALSSKDRRFSKDYAECKESRNPVPAMRNQVQRHNRLLIGGTNQIVHTQVSRHGMIVTRSGIPKRAEVEHKPRQTHKMRGSPNQVPLEPQSLHPEFLMTPPGLDRPQNGGLNLEAAGDTPERNFWVTKLAPPKQSVCDNQHYGQTWFGTNEVCLMGSLGRWHFPFGFGPLGGLNPWPHVYRNINATDLELTPTQEGGGRAQTHLGRRKRFHGDTDFPTETRAPV

SEQ ID NO: 1009642 - protein, 150 aa, Homo sapiens
SWTGPARVLEQQVNCRANAVCGSDEMIDRSYGVTQGRKAITHEGHQSRLAHLTIRCPVIDPSTACCERLACDMWSMRHPCVSVVLSADSATALGRDNGATMSHQTLDDSMIEPTLVQDFGPRVPYPFISDGTGAKALFPDDTTVGLPILN

SEQ ID NO: 1009643 - protein, 147 aa, Homo sapiens
MRASLIEKVPVHVAEMKRMIDEKAIRDALDNKVIRGTTLLVNASRIPKTHVKHASLNPESFGPCITHRRRWSVNIRHHVWDNTLAFRAVLSSEEQPTKNDTMESHVNYDSQALQDDTLESVTARKPDDYEVVQSSVDELRSYGHSGR

SEQ ID NO: 1009644 - protein, 178 aa, Homo sapiens
MFMICEAFAVEANIVLIVPKNPPINAGVTIWMPPTPITHSKNPVYDKNLEEEEDAKSNRAQRLVFKPSPMDLHELFKRKNNTTKTRTDTTKKQTPTRGQPPPKQHNHHHATWRLHQHGPPPHAAAHDTSVEHAMWLVPTMTWDHYTPRYHPTSVTIRAPAHVRSKTTFTIHITPAYPL

SEQ ID NO: 1009645 - protein, 123 aa, Homo sapiens
ITISTSTEYYYIAHTSISSLVCLEGINYQHVHLYATASITLTITQSLLDSDTCSRYLHITVDLCRASERYAAGSSAVLDLEVLQSSIWPSTTYDKPRATPSARINRANDYISTTEMNFQREAR

SEQ ID NO: 1009646 - protein, 130 aa, Homo sapiens
MQITCMDPSLQVQLFIEILNRYIYLYEKENDAVTIHGFKPALSKRFEKTSRILTSSEEPRSRLTNISITHCDAFALAAGITRIRGAKFINGLILYQTEIAHHTPFHVHPARVLLPLRFPFHRSCLPEMLR

SEQ ID NO: 1009647 - protein, 102 aa, Homo sapiens
MAVRNVSLVGVVGVRWWWWVTLRLLWGPSPRLAAERVGWWRSCRDVLARCLTGPNHCRPAQCHRLCAYPRQYAMATTHEIMGPKETMHPGLLNSVAQNEMTC

SEQ ID NO: 1009648 - protein, 57 aa, Homo sapiens
SRICRPRVALYSYKSLMAQIKLYNKNRMYQKSYGGAGEARCKAECDIGRQIRSVSSG

SEQ ID NO: 1009649 - protein, 226 aa, Homo sapiens
SGLCRPGVGSAWARTDFLLLSGALALIQTWDGLPLHESISTPPCAGPAAGSPVFIAVGYVDDIAVRAVRQRTPAMPEDGCLRDAAGYSRRGRTYWDRNTRNVKAQSQTDRVDLGTLRGYNNQSEAGSHTIQRMYGCDVGPDGRFSSGYHQYAYDGKDYIALKRGPALLDRGGHGKLRPPMHQVGGGPCGGRSGEPYLEGTCVEWLRGYLENGKETLQGTDAPKRTM

SEQ ID NO: 1009650 - protein, 120 aa, Homo sapiens
SLVGPDGAIVDQAPEMIMVYAKAITVITSDACELEDVQCTFTCGKNFVDLSIEEYIRVYNAVWEYIYVMNIQENHYICEKSQECLKVDWRVKDSYMKRIKGTACSRSLLGMENPYLNWYM

SEQ ID NO: 1009651 - protein, 117 aa, Homo sapiens
MGDSASAYIQKPLGSPVPAVQADVQRKEYIQRLKTKGYLAPKVYTQIREHNITPENANQGTTVTTPDKLRLQKLHNYIKGPENPYKKPEIALHEENQCVPRESNRHRYNKEETKHKS

SEQ ID NO: 1009652 - protein, 67 aa, Homo sapiens
VRISSTQRFVVFVRLNHLGKKGADLETVLRRGWARWLTPVIPDFERPRRSRGQEFETSLANMVKPRL

SEQ ID NO: 1009653 - protein, 182 aa, Homo sapiens
MSSALHSARPGCLRELVWAVLILAPDLVKSLVSQHVSLQCKVSWHLTTQIIPGFGAAVTCAEAGRGGGGTLPVFTGGFFLLVLPGMNRFPPCHLLRRVGAHAVFLASFLSSWHDGLHVGARGQLSTLHLGGAEQIGPKLTGRVGADTRLRDQPWTLPRQSAFTKLSLPPWTSLNPLQDKGAC

SEQ ID NO: 1009654 - protein, 104 aa, Homo sapiens
RAPLADGLSADALERLLRQPWAAFVVAVRAGGAAAARTRVLAASPLRLCRAHQGSKAGAACGSGAVHLCRFWSTGLKFPESRRTVGQVQFDKRTQAECAENSWR

SEQ ID NO: 1009655 - protein, 77 aa, Homo sapiens
TAGRPRSISSIHALRWDYRHEPPCLANCCSFLVSFEIRKCETFSLSRLFKHVVSLDMDFSISLENVIGILLGIALNL

SEQ ID NO: 1009656 - protein, 291 aa, Homo sapiens
MVGACYPVLPWNRAHVDHAAGGRSASRVLWSWDRRACGCRDGTGGHSLMFMPDGARTAEHERAVTDLNTTRHRSWRCVRHRDAVCQVRISSPGVYMCSWTPESYPTTDARTVLVPSDLHSRVVRFIEVRCVIAVTSAPEPRYGPEVELCLPCSCRRLRLTRDSDWALILPLRSHVAVSEERWRDIVLTSPLALTVTCVDGTSQLAMKSDRYLAVLAWRTGDRQSVRGVPWEREQFVLSRQRYTRCGNISAQPDRLRTGKAPYHSTVFHTRKHAPWRPQGGFRQCAHNARDP

SEQ ID NO: 1009657 - protein, 150 aa, Homo sapiens
MWPINRYGFHRQSSQRTPTCEYFDPGPMCIDTPPPRRDATKDPRVESQNWSNKAYLGSALPSGLLETALGPLFATLADKTQDVIYHCYVYELQDQRHSLKLLRASIYSLAIYSIYLGRGLFPLLGQLWSRYNHFLHNCFVSLACTHAYVE

SEQ ID NO: 1009658 - protein, 40 aa, Homo sapiens
SADTPSDIVDPRRSCLKRGGRLVEFRTLSCTINKCTLCST

SEQ ID NO: 1009659 - protein, 175 aa, Homo sapiens
EGWRVLRGLQRGAASFGSSTASAALELSNLVGTVLSRPQLRPVYDILSPVQPPSPCSLQDKLLCLECCAVGQQPADLREGVAKAYDTVREGILDTAQTICDCGIAGAMSMNGADWAPWWGVIRQLPPTCWWSRSSLATDGHVQPARGAWRNQICPLKPTMDHCPQSVRSGHVPKD

SEQ ID NO: 1009660 - protein, 109 aa, Homo sapiens
YSELPAFKKITGSEHPYNNLRKRFVGSALQTSDFDLMNKFLTYFPEEEDQLLRTGLKHEYFLETPPPTSDLLHVPHCVPCKQLSSKRVKLWAPARGPLRDGLVLHASMV

SEQ ID NO: 1009661 - protein, 195 aa, Homo sapiens
MFSESGPPADMVSARLVPHSKEELPDTSRTVCDAAEEGSEDPHGGCCQRGSDRSSPSWSPRLHQACEYALQGAGSSWMEKLPILTRSPRRRSWLDTNGAVSSKVSGAQEMVSSAKDTVATQLSEAVDATRGAVQSGVDKTKSVRDRRRQSVMGSRLGQMVLTWGRHGAGDVGGVSGQPPAPYGCRHDPHRHIHWM

SEQ ID NO: 1009662 - protein, 98 aa, Homo sapiens
PIDKIRARDKNSFPVNDSCDHPSTHLLVSGPSDETDAADALRLLGWLGPGGNVLHAHSVRVNSTARQARLVARKTNPTHTQRGLKTNPTRGLSPPSPR

SEQ ID NO: 1009663 - protein, 297 aa, Homo sapiens
AAANAWFRSQRKTTWERASLSEINVQYHRPLPMTTSANLATYSRSQRCRREVPGLASQLTLMDSPVLQIAATLCGRSRIFVEESENAATTLTEPICAVRGLDPNSGGTNGRTNIATITAEILDRFTSQRMLRRTHLWRGLEAQVVWPSSERSAARTCGCEKGTHSERGSCRDRTLLHNALTSANYNVRFQGPVRRTGDPELQGILNSSETKTEAGRNEGARYSRLELMGADCAGDSSYSTPGILVGSTRIRNIVAKYLLSTVLSSDAAGSSETGNPGPVNVIGGSGQIRNTPRKDLI

SEQ ID NO: 1009664 - protein, 205 aa, Homo sapiens
MRCIAEGRGHNAYWRPSATLGILLATACFGSPYARNTHMTSMARQLLEVGIQVPSRETHSYGPVVRKDRRHEIHSIALFPIAPQSSSDPAMTPEPDSNQWNYGRLYVTALLEVTWSLQSQRPDSSVAWESIFSAAEPVVLSCWNPMVAVGIATAEMEENRSQPQGPRSLPHSPSLKPSLFCTVSRTIYKIHVITRTLGTKGILFA

SEQ ID NO: 1009665 - protein, 218 aa, Homo sapiens
MALPQGLLTFRDVAIEFSQEEWKCLDPVSEDSIQGRDAGAIHSEPWSPVDVVTGHVSIGSTCLPECTPRPSTDQCPGSSRCGMSLEGTPPSTLGPVCVLSWLLPGRISLFSCHVTGKWSNLKITREDRNDSGTTVLTAESPRAPESRLTRTLLPFPDVICLGLMLWGSSSSRYASCDRHKAAGPAPFKDQRVPNPPLEVRSYQNILLEQETDKEVPEV

SEQ ID NO: 1009666 - protein, 221 aa, Homo sapiens
LRELPTDGAPPPGAALLARKAPLAFSKRHKALKLRFPAEDEFPELIRPNNHSGPGGCPPSVYAERARPEHAERDYTLDDVIQTGVDNPGQPYISDRGLRGRCRRGDPYDSGFNGLSSTPTRSRDRQRRRTKTQRTEPARHDPRHPKNLQGGDRPWNQNYVLISRGAHGPDSIPVGFVTSSRDCKPDGEPPSPIEKASREEGPAHDMRPGTLSGDRILQRSG

SEQ ID NO: 1009667 - protein, 106 aa, Homo sapiens
GSQFQAKAEILDACPQVARTSEARQGAAVRASCGDGSLERDILQSQQKEDMVKRLLRNEVLHEGMMNIGRGKPCSRGMGNPRSGCGAGLDRGTRLASCDDGSWYRV

SEQ ID NO: 1009668 - protein, 163 aa, Homo sapiens
MLIAYFTDDRAVQMVARGTHKQSKRPMTEGILRLVQCQGVDTKRPNKRELTVRNQVPEVVRVTPIRTSTQDFHRSATDGVPTEGGSKGTTSLLVCFACADYGLDRKPSIAGRPDTIVVSTFGLSYQNETRRELGRSALCVSETPCEREIKGAFEASVETRGPS

SEQ ID NO: 1009669 - protein, 481 aa, Homo sapiens
MRSSMYCGTGAQSFPRRSDPSKPVPPQSLPVDTPAVHDSHSLRSSRQAEYPSVNKKEVDGGLLSSSENTTPWFGIAGHELGVRWTQAHRVPPDAFKNLSLSMQHHQAIEIAGQGRSVYEQWRHQIVPHSTGPSTQGYLQYRTCAGLQPWPLHRQPGIAGTYPAPVIEQPRDCTQVNRVFIGHTTTRSDRLHIPSDARMKGPHLDGKDPAVNQEGPVGPAHTWDWDRAKELRYGRPRHAVTLLRPTRSHATPGMADCTPTQHKSRSCTPAGPKSLTTGGINRETDRPTTHSNSRAHRDRAHQRPGGHGTDLAHMADTVHIPRLPDATTPISTGVLTRRAWWPCKQAIPNPPHATLATTQQPPHLLTIRNWAPTAVALTQPDQSQDRTTHTQQPDPTVTQSHATYRQDDHQTPLRQACPHQQRNRQPRHTTTADHTHATHEATNRPHHPTTTPSAATTPTHGPPNPPTQHNQQATDRPQPAEP

SEQ ID NO: 1009670 - protein, 390 aa, Homo sapiens
MSVLRGYRGRTDVGPIVLGQDDQRSFWRKEPAKCWISTPDFRVSSMSKEGTYGWQLGPGLNVNETKRTSKKQGMPAYVERAEVVDRIRFGPGEWSTTCRGTTTQTRIGSWGTQLAEVAGKTDDEANTGIVGDPLNSSRICEGNGDQGKPFTERKEKLDFARGTPVAYQGTRHLDMGLSREDILESREACPVQKGSRTFVEVGKQFRHSDGIGRLWCEFNEALPENNGFTPRGDCEGKTLKGNMEKEAGKRCGNPMGEQRPRGGQGRNTSSLPTLAARTTGSRNSLLAVDIGREKLGKKPNTAVAQPEVCHQEGGKPRVGEQQPDNSRRRDTTRVTVAPAVEHKRAPKCKTNTDAANPWGGCCLSNHRLRPAMRAPTETTAPPGEVPSQSG

SEQ ID NO: 1009671 - protein, 159 aa, Homo sapiens
MAELMPGAAGGPGALVALGWGIAVATADVFRHVHPGPNVARPCDGGRGLEAAERRRQATARGITEVDCRVDRRVGPAYESNRNVTPIIPSAGRMIVSSFSLVPHERNQRLMDFFRVGDRRRPRMTVWQGFMHKVLSIISRVSGQAANEVQGRFVAYPGH

SEQ ID NO: 1009672 - protein, 498 aa, Homo sapiens
KTVPVRGLNTLGPREADSVPVTQTRVDAQSVQVKALGTERTTLEGLFRPRYQAQARAGVEQELDMNLSCLCPGSSRRAADQLQEGLVQELQQEPRWNLPGTATEGDVNVPNEEGRKAEEGVPRAIEEGRRRVSKCEAHTQNRGPLLTVRENLWAPMRQVLQLHLTAAKDIVHFHGGPQEQTGMSSRGEPRQPHSQGLARAATPLLGKPIPEWLVSSPRGDPRCRRPLHRREELATFPNHALWPSLRLLLPPSLGPWVVGSFVGMPVPSSAAHLSLVDPAGVRSYGKPGPVGANPRWLVVLAAPKGCPPRNCPGPSRSVLRRDLRTRAANFAPKAMVEKSCSPGALPNRLLLDTEPHSVIGICLARASKPAPLEPSALVATRYSATSHRPLSAPQHPAANLAATGVRFPCRLRPGIGSPLARRSLTRRQRQGQATAPAHPPFAGPPTARHHASCPYWCALYGRGLSCVFPRRRAATHRFFCFPHGHVLSSSSPLLRSLS

SEQ ID NO: 1009673 - protein, 285 aa, Homo sapiens
GAQEEVRRAGPVRTDIPEPTGATSVYSLIKVALERANRLLTTSMMRAHGVSMRHQVHLASEEDSFCPQLCPPYLHMRRACHRRPCHSACGTRSMSVRACRGGEPGPVLETPIEDVKVEVFSSQDQFLGFQVAYVVFQKPSGVSVGLGPEGPPWWCPQMSQPVEEWHSQVDQMIYADSVPEPEALRVEVDTFMEAYDQKIAEEEAQATGTEEGVPEEEGWRQGDLTGPGGAVLARTDVSTLRRVAGEGKTEVHGEIVVCSNARTWEHSKRARMEGSIAVGQGVRGW

SEQ ID NO: 1009674 - protein, 174 aa, Homo sapiens
MVASHRYVACTASVIGYGPYRCERVEEEPTIKVLMKSVPRIAEPKADRNCREVVGSSTLDLVCNAYFEGTRDDPHTYSHEKLLYHVVGKVSLSVGVLVQFYTNGLVDIVNHALRANRVEAPKLPPSLRNKGDLEPYGEPSRWRLLGPAIKFEITLGEVNYRFNPCSMGQFPPMK

SEQ ID NO: 1009675 - protein, 117 aa, Homo sapiens
MSSENRERLMDISHKGSPTTPERDHTKGPPPVYTEQPQVGTEMGQTTEEDGPMRTEAKCDKTQRHEPADNHGGTEDQLGTQKGGVTEEKREATTKRNTKGDLLQRGKQNEANTTGDE

SEQ ID NO: 1009676 - protein, 118 aa, Homo sapiens
GIWGLTTDSSPILFCSNLPHWVPAGAMPTKLELALTPTSPTLLEGRDHRGIDVCRKSEPQKSVAADDILVSKLPPTSSIHTNDEPHASEDPETLEEEVPVESHENTILYMSEQTINVP

SEQ ID NO: 1009677 - protein, 259 aa, Homo sapiens
MDRLQVVEKQNLSKEELIAELQDCEGLIVRFCHQGDRCCHLTQTDKRPRWSVHVVGTGLWTMWIWRPVHRKGILVSELNRQMGSASVTAELTLLALIHCAVARSRIPQAERASHCNVTGTPWEADRKVPRGNTKKEVEPANTEPTVGGKIPVRRPEGQWEPLGRRNDRDTEKDHRAITPGPTTLARPVGPKNRVDQARQTDNAHAQMFDYASPAHQEQNLLPEGHVPRYIDRLRIDDNKQNIEGPTEQHDPHCLWRNCD

SEQ ID NO: 1009678 - protein, 113 aa, Homo sapiens
MHPDLHSFVSMSNRHSPRVLNVSITKTRLPHVNVGLLLSLFNLYPITSPGEVEVVTLEPKRRKLRRHNSLSSTPSNVTHHKDELISEFVLYNTLTINHFLNLYTTFIFTPQHK

SEQ ID NO: 1009679 - protein, 82 aa, Homo sapiens
MRQGLPSIHRIHTEQLLDKGTEESSKEAQSRSEQRKKESIGREHYKKERTLRKPGDTKAEASNPITAKTQAQGQQYSKGPET

SEQ ID NO: 1009680 - protein, 311 aa, Homo sapiens
MNNLPEKTFEKEKHPWVLYEETSIEFLIVSWESARGISKCERHFFELHERKRGLRIAPTSVCHNYCTLDRKSIIRHIYMCQISRPLSVGPFQARRDKSRVTHFLRGKPVCSGLWTPHGPAYTSACETRLSGAPVKKVYTYLSVSKPPRLLLEAVHNTHFRTLRRALETSPSVKETPQGGSSKRLPRGRGTNTARGELRTVVVDTTQNANILGGKNRRQTSVGVPKEFFPQRVAPPSGGITPFERTQGSPLGAEEALYWAPAAKPPGEGTKKSRAGYQGAPEKRGNPRSLWGHDNTHDTGRGPNSYITNRGP

SEQ ID NO: 1009681 - protein, 113 aa, Homo sapiens
SWLATRKFLWGVNGVREKGFNPLGVEEKTLPPGILAGSMFSRGWGFRVVETSYDLFWVGAPLVLLPGLLPNMAVDLGHVYSLWGRSPTWSQAVRRLRDTPSQAHSRSTLGEMR

SEQ ID NO: 1009682 - protein, 177 aa, Homo sapiens
EALILGAEALTLSHCQLCPRKPRCPCPPSHRPHSITCDFSHSLSFGGREDEGPPGLPRIPMAPVGQCSPFPRPVQEGSGTLMLLDDSLTTRWPLIHVLSSQCPTEDTPKAEQDRRDSQAFHGNGREGRVVADEPVGLAHPGAQRKPGRRHLRELGDEPKGKHHITSRVQRSAMSVKE

SEQ ID NO: 1009683 - protein, 284 aa, Homo sapiens
DPESPEQSHRRRGLVTHHTPGGAAAAASRPAVTITATMSSEAETQQLVGAARLRPALASSSRPSRPGPTPYWISAQGAGVLVCDSPASRYCALARQAPGLSTNGRVLGDTGFHCCLQWGTREWPLLRPPIHNRVPAAHKAMGFACRRQTIHKGGHDNNETHLESSYLAHHWPSSAWVCSPACRRIASAVPQLGTVFPSGTCDRPKLAVCGHKVSEQPPVGKITAKDPPVDPGFPDALRGGRELGRDFVPARSKRLLSWFHRFNDRLARFPYTPVPILSRSRTPF

SEQ ID NO: 1009684 - protein, 403 aa, Homo sapiens
QRDLLHRAAAKPETLGWLPLHAPCERAMPPRELSEAELHRIRDLDSPPSVGGVYSATPRAVGSQGCGDWLEQKGRLYGANSYDYIGSTLYAVTMRYTHWMPANTERAALDSLGIIQYRPVRGTQYHLGVRHSDGYRRCGKYDGINEETNHVVEQGREYIRTPEQSQVNRIWGVAHGVNTPNCQYHPMRTGCRNQRQTEHGKDAQRRTPNYHKQARQTNGMTNLGCVGAPEGKYQRHSQQQIEPHQEDAQTHMVASGICAGAPTHQGEPEPPYTKEENTEFSTTTRSPVRFTQAVANRTRGSTRTPVGSTLCPPARDGPPIDEPPTRDRSKGGIVVQHAEHTEYPQDRSHYPMALHTFMEVVGYKKTSIRNSQIDRTHTYQHYGTRYTYTGTPPIGPKSPYHSE

SEQ ID NO: 1009685 - protein, 73 aa, Homo sapiens
MPPTHSRRFGEMGGKFMKSQVLSQVYHNQSQGLLSRAVKDSQKDMPTRLPTKGQLKCQSEIGLRPAQIRSYVK

SEQ ID NO: 1009686 - protein, 118 aa, Homo sapiens
MRSEADYDPYAVSQRPMICTQEIQRRDLAYERCSMNEQNLVSGWSHEVIQEKRCIQILSTKNMFLRIWICTSKSGIELRGLGRCASSGCPLDSSETVVLEESDGLIISEEQVWDQSVT

SEQ ID NO: 1009687 - protein, 231 aa, Homo sapiens
MVGVWCRHVGMLGSITLYRSLLTIINSVFTGGHLNTDSKENCCVPYKEGRHQKQGSRRERGGPAKNMSLANRTRFLVVLPKGWPPTTRRATAYSKAYTNEVPSELQTDPDCFLYVEHDCLTFDETHSAESPSDHLLPTGLRERPIPNGTCRAQPRDNASGGYANYPRSERIITLIKQLENRRLIDGRSTHTYRRKLLIRPGTTNENLENAQRTLVSYLTTFITTAANTLRT

SEQ ID NO: 1009688 - protein, 104 aa, Homo sapiens
LRFPSEAMPRPAWARAWCAHPLTCTHCLALPSEMNPVPQMEMLKSPVFFVAHAGSCRQELFIFGHLGSSPHNRWSLTRLPMLILNSWTPVILLPWLPKVLGLET

SEQ ID NO: 1009689 - protein, 152 aa, Homo sapiens
MRPTALGRRKNYVGTPAPAAAAAAAEEEKGKRKGERREAETEPDRGGTTARAPHSPVSGRAAAKSMADCLPVCHSTPAIDTSLNPTWPRLVLACQERFGPAASALLRVSRFLYLPGTDGIFGPLLNFWEVHFAHEVVTHLRGPLFQHLRPWP

SEQ ID NO: 1009690 - protein, 173 aa, Homo sapiens
HLETFASRNGRPVQMVSAAGCLSRIAYPTSSGFEEMSSDGLGSRSHQCKRWSEKENCHLEQSSRLRLRSLRDHQCAGRTLCLSGHPTLTWPMIQFGINSTERKTHDFERHSIRGIEDHIWPTLSTLPSQAGRTPSGHKLSLRRHVCPGDVLPIGKVSVLGPFHPQVPTATWTL

SEQ ID NO: 1009691 - protein, 153 aa, Homo sapiens
MSRCCGSAALSALSAIYGRAELLQFPDQGGILMTYSELERTELAWPAHSFRILMDVISAQDCGREVIRQARRSKVSLVVIKRRSGPSWNPATSYVRTTINKNARATLSSIRHMIRKNKYRPTAHGSHPQGQRHPAQQKPVMVKRKRTRPNKSS

SEQ ID NO: 1009692 - protein, 347 aa, Homo sapiens
MTSVCMRGVPGGPGGPGMGNRGGFRGGFGCGIRVPGVICGQWYVGRGVLSAAGDSGGARKVQKAEWSGLPVTKLGRLVNGHEDQGPWMEIYRLLPAPLKESEIIDFLPGRPLYKDEVCEDYVQLQNADPCPCHGAPGSRHLVAIVGLQLCHVRVWCVNVHPEEVDHPTESQWCADSSHWTKSRPSFPSAQMATVWEQDRQAPDCPLQGDKAACGVCAWYASIPCTLGGHWHSSSATVPKKLLMMAGIDDCYSIKTRGMHMTTLGNFGKAAFDADSKNYSSADPDLLERRTGIQPRSPVFSEVHWSHLRSRTHKQKSPWQRDLKAPRLVGTNIRRFNTRTNKGDLRRY

SEQ ID NO: 1009693 - protein, 121 aa, Homo sapiens
MLAWQIFRGGNRPNTGPLYTEADRIIQRTNSMQQLEQWIKIQKGRGHEEETRGVIYLPKHDQRKYAKSQSPESWPATPERFIEHIPRNSKDKAVNSICRSNPIPLTDKTIRTRRRRRKRKV

SEQ ID NO: 1009694 - protein, 101 aa, Homo sapiens
MVRYWAVRLSWAHVDAGMLGCVAARELELRATLMGAQVYFWLPDVITLQAGYEDFNMAVPGAPAGLRFGGRPAIAVLTGCLCVAWLTSECPRCSGCCGHWC

SEQ ID NO: 1009695 - protein, 152 aa, Homo sapiens
GSRQPGRAAGPVWGCTRRGVGAGAIANQETCTEAKYKELRDGLEVRTTGTAPGCQSSWDMFKTNLGGICTAKHMAGDPEGLHAVPVLQFRGSLCANHLCVAVQLARLETWECLRSGDGWCVGDVLVSELGVSTVTATVCLGAASIGTWTVIE

SEQ ID NO: 1009696 - protein, 286 aa, Homo sapiens
MREIVHLQAGQLRATKVGRQVYGKVSQRMSDGIDPTGTYHGDSDLQLERINVYYKEATRRAKEQMAPRRDSWDLAARGPWNSVRSGTLAGQNLPDRYNLRVLRCRSGSWDSNCGPMVANYIEDRLREAGWQLVCHWHSFDEVQQVGIEEDLAGTLALSMWAFHNALDSYIHTLGVCVGVNLARYLERTVRLAPCPSMCEGTRDRARGKGQRYHAMNTRGTPTLEKAMRDYDNELVLLELATINSGTRNSKGWVPEERTSMLWEHWRKRPTHYRRRCPPTPHRFISK

SEQ ID NO: 1009697 - protein, 86 aa, Homo sapiens
MREAIESPHSRLTAHELARETRGVTCTQTTHRPMSQNRGQRRLKNGKDLEAEVRREPRSAVSGEPGGDPARHEPSHTRKSAGVGSP

SEQ ID NO: 1009698 - protein, 169 aa, Homo sapiens
LAPLGLNGLCRAADAGLGSAGWGVVKVVKNKAYFTRYQCEIYEDDERVKTRLIMLRETHWWIRRINDKVASERARKSNRSEECTCDEIDEMIHLSGLALCRAVMREAEYRVDLAAEIWRAANLPNNTGSGRVGVVTELMLTGMIVTRAWLTEARSAFIELGFGYWHRGC

SEQ ID NO: 1009699 - protein, 104 aa, Homo sapiens
LGPVTRSNGAGSGSETEFGGSGEIDDSYVRFAASADVSELSYIAMSGFEKLNYTDFYQNKLQHSMISTQQLPMIMEEVEDPDSKQYAGYELFARKARVLYLIRD

SEQ ID NO: 1009700 - protein, 289 aa, Homo sapiens
MGVSLCGPGWSQIPGLNDRPVSASQSAGMTGLEPPRSGPFFWNGASLRSRFNAPCYFFGEPQGCTGLDWTPFFLPFLLNLNLKRATCKAPPCGKHAAGVISKQKTEGGVRGPHPGWVCYGPSRASSHSVGGWVTQFGERMGTRGSPVEAQQRVASVTSASRGAHHKSPSWGRMSLSSSVLAKKPGSVGCLKKRWKQSSPPRRWPGKDKSLEGLKALEGGNPGVPGVVTWRQPPRAAQQDSEHPKTHSGTQVYTSLPGGGEDLGAQALGAGNKDSGLRQTLTPVTKIIWA

SEQ ID NO: 1009701 - protein, 78 aa, Homo sapiens
EVDAAVRNNGGRYEGILDSRKLQFAPFSYDALALLGFRHELTHEERLNEDIASGCNAPIVTLTGYYYKGDSVGAVNSL

SEQ ID NO: 1009702 - protein, 253 aa, Homo sapiens
VADGDKRLPGPDRSCYVAWNSVEHRSGASAALVACVSSLDHACSISLPLGKMELLELAGRRFLRVEPRSYIRYLEDVVRWRSLQNRSEGLNISTLSSGMPSLNARTHVDDAPRCLLVSPSRLFGLLDDRGWYAYLGRLELLEKWTRLGLLMVTWCFRGLRRRSPHRMLRRDVLFYSMPQNLPRDDPSDCMGAFYESSTNARDKEGQEGKGEGRKLAHHVGTSVAAGASSRRLVALQSRHANIRCHHQIVTIAS

SEQ ID NO: 1009703 - protein, 101 aa, Homo sapiens
LVFFPSTGRDVYYCAHSCGFSMHSVSRVRPSLYEVQAGFPSSITSRWINTTPAFGRWITTLLLVSFSSRRSAKPVVLSLAPLGDKPAPRLRGGPWTARAVG

SEQ ID NO: 1009704 - protein, 115 aa, Homo sapiens
MRSRGHHVPKHGKRKEIYKYEAPWTVYAMNWSVRPDKRCRLALGSIVEEYENKVQLVGLDDGEFTSLLCRNTFDHAIRPPESSLGDPVTSNKASIQTYWSSKRLTISVCGRVGET

SEQ ID NO: 1009705 - protein, 244 aa, Homo sapiens
SKKEQKETSETNTEGQHRRNYKKKCQAGSDASSRTQSENCYTLMRVLGTEAVREPSRRVEAHVMSSDGEMRSRERRDEEAIVLSVSLTVEQRNGPEELKSLEKTFHEGVHISVYRVRNLSNPAKKVQDLKPNAGQLYLQGVVVLHKDVNVVYVEGGPNGPDDIEASYAASDELWDEQTSNIKGDDDEESDEEAVKKSNKCCTKLGEVQQPKTEALDELEVIQQVFLAEQQWIQETYQKHLGTRS

SEQ ID NO: 1009706 - protein, 69 aa, Homo sapiens
YPSVWASLRAGERWSGLELNRARCYLQEGTLDLLTLNKWKESDLFKKKYHGFNADFWLVPSILSSESQA

SEQ ID NO: 1009707 - protein, 218 aa, Homo sapiens
LEKGVLQIEFSEHGEVPKAMYAACRTKCVLLVCQAWAHHHHRWHVPGSGQCARHSSAGLTLADLLPRSSWRVRVVCAATQRPPADRKFGNSRRGSESERASRKCHVVVRREEGGLLGVIAGASRHVDVLAATVRTIPPVRVGSFPYHSNTLETRGKGNGQFEPETCMAGVLGEYGLVKALTSRQAKAHLLHERSALEIHPRSCRYAGWMCKCWPVVLF

SEQ ID NO: 1009708 - protein, 106 aa, Homo sapiens
MTFLCRFSILCADRGHRVQGLGGLGVTCSAIKSLERSSPWTGVRKAKAWMHVPRSRSLESHRVIRSLIHLRLKSISHIRALDKIMICCTLRLRISRWNLKTTLVYV

SEQ ID NO: 1009709 - protein, 310 aa, Homo sapiens
MNPHDHGGIATSVVLWPMVIGGRTREYDCQNASPGNALILCSCVYGLFYKNGIANRLLERGHEKMGLLYHAPDTQAVSTRTHTAKQRRDRSTIRQPEMTAGEMRRDAHKNLLPRRWRWWATGHEKGRCVQQLPRERVHSVPSRTRSGWVVIACANNTVGRIGETEQLERTKEDTHRPPQPHNAQPQKGDRDRQQEHETRNIISGGGSMGHIYPRGGKRPKRGDLKIINMVPTIGENSVRRHTGRRSRELQANTQKYEDNNRYVRPTEREHASRYRMEQARTECRITITIEDIGQYTTETINTNTQKRHGN

SEQ ID NO: 1009710 - protein, 112 aa, Homo sapiens
MARKVEDPEQRTVDPGLESTKARRRNPTRFGTTDAGNARINWHSRLGMEPHAEHRTVADEAPQPNRDSYPPRDAAMYLGWAKGLGPGAHGPTTGRRCRLNMGTNMSPITVPP

SEQ ID NO: 1009711 - protein, 252 aa, Homo sapiens
GASVTPDSGPRAFSSASACRRLPEPPRALACQARGVPKSAVHTHVLPRTPAAEGEGTPTQPASEKEPEMPGPREESEEDEDEDDEEEEAGGTNEKSLIVEGTRGNTEKKYETVDNASLFLTERAILQFAQRKTGQKLRDNCEDTFFSTLQNENQMNFEIYTNCFTTGQALCPSLPEECGSVQWLSICTPEVSNITTTADHARTHLYQMPMLQEASVKVLNSAETQVYLVNLLTRILTFLNCSKASWQTIAEI

SEQ ID NO: 1009712 - protein, 217 aa, Homo sapiens
VSELRCLLACARVRGHGLKAIIPNNVTQSYGAYPTQCRAGTIPMQSSQPYGQSRVTRGYSQSTDTSGYGQSSYSSYGQSQNSYGTQSNPQGYGSTWLAYEQVAKMLPSRRYEAASPLYPGLWPAVQCSLTVTSGTLPVASSSVADSYWRSPRMSGAYSRRQLYGYLVVHASESVCDHACRRAYSCPPSRRLLDRVEELKLRITQASGLSATDVTVRR

SEQ ID NO: 1009713 - protein, 344 aa, Homo sapiens
MASLTWLSSDARVSHLFSTVRVWPGGKGEDTGVKQCAPNNSLDGRSSHRSSESDYATADAIHGPAALLTLDGELSRGSTELMVETGRKHGSRALTAGDVKTWVCPPLTLRGRMHATLIGKVCKRNSYTWYITLGTFCIYYFTKISRLWTHNTHYAGKYSRVCCPAIIPGGFTCEYEAGTRDPMRIHFRVPIRHWMRKYQSGRRLDQGRAVHIPKRHCPRAWSEALIFLKVPGSLRGLKAETLQRARLEAWLRGAGDHRGDRASSAHSAFHNVADQRGVKDSPGRFHAAPYDRKPADVTPGVPNIPWGRGGTEDSKRRRLIWKNPHNSCGPRGHNRSGGPGRTDA

SEQ ID NO: 1009714 - protein, 348 aa, Homo sapiens
GTRGYFLFLGNIKGLLFIFTIDIMDTCTAHTVDSVAGGPFPPLTARPPSPAPGPRVAPDSRALEPALAAQHGPGGHPAEPEASRSSVQARGEGVPGSLTDGRQARGSLTHPARQPRGRRQHRAWDPRAHETRVQRLPTTRGHRAQAPCHLQMGVVQGGRKPLRGKAVLPQRPAERMGRRGPGQPVSLSRGGKLPWDTAGDACLRPPNGAWGEPPTGQRESEGMSPELRPARKPQTQWGLREGGNTARETTHAKPPRATPRSRASRAAAPLAIQSKQPGEERAPPLWGSPEEKPLPQVGHGAAGPGGPPLGAGAQQRRGTGSREDTGGVALLKEGRHPSQRGTPPSDAK

SEQ ID NO: 1009715 - protein, 289 aa, Homo sapiens
MARELRGAACLWGLPPVGFAVWRRRWRSCREDKANSVYSGGPYSPVGPPVSKPKTVAALSWSRDDWLQPLRETGYVTTGRTHPCIRLISMTEKLCRVHTCPNSSDDSMGRWTKDRRMVDSLVKPVSHATFKETYEGAELPRETDSSQKCRNVLHALEKKRLEVYKHREVGRWTGSPKRRNLSEATYVGHECTPFDKKLEASLDEYTGQPHDKASPKGNTVDTPVEPEEARGKEALCCLHKTHIGRASPIFGRNKHLEGGSDKRAHIPPRGNCAYHRQRKKPKGGIVEGP

SEQ ID NO: 1009716 - protein, 212 aa, Homo sapiens
MRSGAGAGLRIASLLCESRDSAGRESEGAQRSANYLRDLGADLKVIGKYKVCCQDPENHHNVLGRKTDRGETQKKLEQGAKSEGIFQESSEEEHVDSMRLPDLLTIIWMGCQHYLSWELESSFCFLYLKGAVASISESPINYHIGGLGATVQRAPNLFLTMFATHREYAIIVNDYTLPQLGIEPLDECHIVGPLPHVSAANVGCTRHFVVPF

SEQ ID NO: 1009717 - protein, 307 aa, Homo sapiens
MCDWKTGWRPCVCLGRYRRGTSAIARPTLAGPAVDASLAEYGNLRSGAPVRAWIRRLAFWSTACVWPSEAVLSSPLARWDAVVLTVGSSVLSTDEDYWGIAILMRASVLSDGEQQNRVWTVPWHEEIVDEQWRVSLFLSCLHTSRGDITMTLTNITRPVCRKDSSSDKLVGSSLGDIVLELVMSWKTHEIEEWNRDVILWEMHEKLCIYADVVFNYLHATAFQGTPLAQAVEGPSENVRKLSRADLTEYLSTHYKGPFEWCWQQLEELSTSKCETSPRNTSVGFHGLMQKNAVPTFTPCPFNLALKI

SEQ ID NO: 1009718 - protein, 183 aa, Homo sapiens
MRFGNHSLCTRDGFLDPVARSLLLAIDWDEALVHGALKVVGTPGGSQRGHTRHDTIVKYIAKWHFYVPLTHTAYASETHDSIALTIPGNPTGRKQLQKLITVHKVNTQRGGKPTREIHTCRDRAKQDNTTDNPWSTYNGKENTPGQSTPASPNEQAIHTPKTPCKTQEAIMRGTKQTGWETTP

SEQ ID NO: 1009719 - protein, 241 aa, Homo sapiens
LEPGAFAAKMSSKCGEGSSSRDAAFPGHWQTVPRLRHEPLTTPCSPIVAQDAAWSFAVLVALLGMEATHSGTRAPNSLLALSRKTMTRPVRPSRPDDVSVDVTPHDRHPMGPCGHRTCPAAGNRTPINGLLKIPLSIFRSHIDQSTPHSSNAQEHRSMAPNVLQHPGSREITQSTPFQVISGSLPAGCGILPASVSNNVTPLEAPLGSTPTKSYALRLPSPERWLVALRVPPIQLLTAQPA

SEQ ID NO: 1009720 - protein, 92 aa, Homo sapiens
MTTGGALTLLDDGESPVSEPRRASKIATIPHKGNTLTGGDTKRRPLRYEESDTRSTTNETLGGPPPHTHPMRGNAPTGSGDHTKRGALRGEP

SEQ ID NO: 1009721 - protein, 109 aa, Homo sapiens
ERTSLAFFFLVLEGKTKRIYSRPGLKMHTARSPVVISTSKERTCLKGSPTQSRAAVAAVRLPSESTAVFFLTGCSGVRFSTLTAKGSLTINSRYAEKRTESDLLDGASI

SEQ ID NO: 1009722 - protein, 233 aa, Homo sapiens
ATQVCQLRSRGRSPLEKVDRSQELMGTSLMVTCIAYQHQIPMTGISLQNLGDPRGLGCSPQYLTRCCSSLVGQHMLSVQQFNKDQMSHLFNVGTDTAYDGLQKERSLDILKGKVMAVQCSMKVSTQDQLAPLQQPWSGWEVLCSVFSEATSSVQKGESRGMTPMQTMSCYADVGRAPEPPAWSSGAGRQALPEASDQCWGWGGEQPSQALLDIFTIREELGTVNGMTITMVGD

SEQ ID NO: 1009723 - protein, 82 aa, Homo sapiens
VWMLPQQQAGAVVVADPTEKAPSPITWLDWLAGCTYPTLAWLLSFLQGKVVRTWAHSLLTGGYLNPQCKTSKQSKKRLTQTD

SEQ ID NO: 1009724 - protein, 81 aa, Homo sapiens
RDPVTCASDEVAGCLAHLGDEEVFLAIDAAEDVMLSTKSEESSMTGARRSMDGSTGVVSHTYECCTRGCQSLGCLDDSARK

SEQ ID NO: 1009725 - protein, 137 aa, Homo sapiens
MDNWHSDRDNRQHYRQQRTEDEHYHPRIRIHPHETRGEQGTTQRTTRSLLKHKSEGTTVKRDDHLQQALVTTTTEWTHAATRHTSSAPTPPHERRKRRSCNTTDTSAPNTRVEGTNDKMKDKRSKTDPDPKTSEYTN

SEQ ID NO: 1009726 - protein, 100 aa, Homo sapiens
MGRRIEGELACEGERPGTGAVLKHPLSPPSRMGITLGPPSRRRWQCMAAEADWAVALGRGTSRDMRLDMEGSLVLDSFRRPGLTREAIDYGSVAAKLRWK

SEQ ID NO: 1009727 - protein, 119 aa, Homo sapiens
MWHALRLMDDTRCRQTRSCLCCLVYHSEIDGVEDMLLELLPDDCCLGRLAVSSFQPRGRESLAKTINGDVVFLFTFSCTSACVFSHQRWESGEEVDTTEDELVPRALEDPAVCPYRARL

SEQ ID NO: 1009728 - protein, 141 aa, Homo sapiens
MGPKGQLSRGISRIATTRIMDLDHLSQGSAYFTVVTHYQKSNGTNFAPALIPPVGKPLLTLRLAIAGGPNLRRHFLVSWGSTPWGSQEKKLRALKNIPTTSGMCEWRPQVGKVQGTISHIGLWQSTSSIWIHKGTGGKHSR

SEQ ID NO: 1009729 - protein, 134 aa, Homo sapiens
MDVREMRISRTLARVLRLPRVLLTGAQRECREALQDFPELDVSLGGGVDVACVARAAVAQGWVARVFATPRAHRTRTCGRGDVARLWRLGGSHELLLGTSGSVRVLAPSTRRAFCGQAGHALLVRVLLTLWYGF

SEQ ID NO: 1009730 - protein, 226 aa, Homo sapiens
EWARTPVLRTRRANPEVGLRGQAVTWVNVWNIWGARAADLCQMDGTITEALSVVSDDQSLFDQLYGAAAHLPKADMTASGSPDYVAAHKINPSQQQQEWINQPVRVNVKREYCHMNGSRESPVDCRRKQMQQCWWCGGRVPRPIELQQAIVDREELGTASFPNIDHQREEIISPRENPNNMWTTGACDGNWLDVGHTRSTRVAWETLKPSLDDAEETLGLSTGNLV

SEQ ID NO: 1009731 - protein, 324 aa, Homo sapiens
GRGPACVASLSRLGSLGLPYREAGSGAACGGGRPPLSRLLEPGSFPWPVRLCASSSSASCSRRLGGAAQLVYFVPRPGGGGRIVSGLSDVQPRTWTAGSQARSVGSQPGRTPEQTGGAWARALQGPSSSKVASPGRRSPHWGTLFWSPVSADSLRKPVTSKEPPTRRHTLGKHRGRREGPGGLKWQGLHARKDVQHMEGLRTTKNAPREWGIPIGAMHRDAPRRKSGDLTRRSPWTATHTVGEGKPRRRHRGRVQPKHNPSPTWTRRNPATDRGQPKTQSRRKSNGKDPGKKGKTSEGGQIDRSAQGYRRPPFGTAKSAQGANA

SEQ ID NO: 1009732 - protein, 239 aa, Homo sapiens
MSGHRALPGLVMCGNQIGASFCEVISDEHGISPADTYHGDMRPAAETVSSCVLHLERHRWKNMYLDSQSMVDLEQLGTTGRLIDSGPFIGTESLDPRQNFVSKVTSWVQVTTISGHKGHIQHKGSRTLVALLVLGLSRHGQDGRRACDMPCKGLTRHDPLHMVLVNNRSHGHIGARSTLSFQPQNPAEAEYTPESASQWNYTYPRKASHSDPKDVWTHVDPKPITNRHPICGPYKGTQT

SEQ ID NO: 1009733 - protein, 145 aa, Homo sapiens
MTVDRQLERHCTGRGRNGATVKEGAASMGVCDHPIVYEGTIYIIRMRIMKSGHGLINTNRTSIDFGREFGAQTLRGQQATPSRARPRSTRKRTRTPPTLQRRLQSHNDSKQEAGRTREARHRNNKIVRTGSGRHQSTEQREAKTD

SEQ ID NO: 1009734 - protein, 151 aa, Homo sapiens
MDTPPNSGSSFIGSSLDFTPIKGDTDGGHIIGIVNDPGASNRGHRQFGGQDAGNQEVTPYVFDSPLRVPLNWCMGTPRANREGHPPIGSRQRMGIRCGTNQDVPTYHSYKSRLYPLWSFGTTVTVYRWARSHKTGPKWYGIPRAQYLNRPI

SEQ ID NO: 1009735 - protein, 208 aa, Homo sapiens
MRTGTASREEQEIIKRGSGRHQGVRTNRWRVLQNNINERASAQCKPHRQRTLRKRDKMGAIKPGGSECRHAFPRRRRLAHDDNTHRRDKRQKRRHKKNHPGSHQGNTRRSAGNENPSTCGRHARSQKEDPPYGHAREAANRTCEAEFRERGQNNQHTSALKRKLQSGSRQVIPDTRHKKPDNTGDVRRGPGPVNPENQSKANDTATSD

SEQ ID NO: 1009736 - protein, 148 aa, Homo sapiens
MGLTGPWNFRLVGNGFRNAWVDVRHNPFPNRTADVARCPEAGPRHRANDLKARPPRGVVPPVVSGRGGGARVGLSKPTGTRVGPVERKPLEAVSARVPGVCRRLPRKGCKSPTLFHLVCLWGIPKAEVNQPVILACSKLLRGRSPAPS

SEQ ID NO: 1009737 - protein, 188 aa, Homo sapiens
MSIILYLRGQSTFINLDTFIETIRRRALPIHRTYTRRPRLRSDPVRNHEIVPYFFPILSQSLVCWHSHILLTDRNHANHLSFNPAGAGRPHSYNQTPNSDFYSVTLTVNYAYPTRLRNYSPHIANLLTPENTDVTILGLPYGSALSVRYSIGFPKGYPGLTQPYIIQWAIDVEPGKHSSHSVPEVDGM

SEQ ID NO: 1009738 - protein, 346 aa, Homo sapiens
MDEDDDGAGGSAESDSGDEEEAGAHLCVGRRRKNSFGEEPAVAEFQPVDFCYSLMKGRGRNDGSMVPCADVMSRTPRQQSRAAHSQFSHEQRLQKPFGTRHDGTNQQCIQEQCQRSWPRSAEERDEEKGRPAYQGLRGNPMKEDANVDKEPRLHRTHDLHLERVHGGSTGTMTSKRALLVMQPGILTASDACALHLDRRANFAVQTPQCRGQASYQLVPETRLYHRGALRVTRAAGNKGQGDTPTNGGTPRGTGTHAERGNTPSYAGKNKTSATLPLQETASRQRADTSSEANSNQAIHRHADTTAATNAPRVAPLLGADRTSQYTHRGAKSESTQDSNSTADHST

SEQ ID NO: 1009739 - protein, 140 aa, Homo sapiens
DRETRWVLFGCCSRSPRSAWPACHPSLDRADGDGSQAACGESQICLKLKSPQYHPGGWVLLLASAVCCCLSGQWTQSPHPPKSPRWTASPTPLGSAPGAPPGNQYLLHPSVQSWATGLAPVPPGSKCHHPRQAFPDPARN

SEQ ID NO: 1009740 - protein, 310 aa, Homo sapiens
AVTPTDDYHVGTTDDRRRLRRDTGTALCCLQLDTLTGAQHMRDVTYNNLLTMAQAKPYSKKASSTSPPAAAPPAATAAADTTAIAANGQQASSHNCKACTHGTAQHIFSKTQAAASTFTPTTAVFMVGQHLPSPHDPLQAQHNAGNTHLQHKSWHTGQAPQSVPSTITGIHRHNAYTIPTKRTKRRKPSDGQNKHQQKIETAIGGPQTQPSHDQPHGRAQKAQSNPRKLARPPVIATHSPHVTAGTNYPPYTPQNTPEPTHAMPPYHVLEWARNTQPRQPLDNADKATGTEQRAAEGTNETHHRETEKQA

SEQ ID NO: 1009741 - protein, 111 aa, Homo sapiens
MWFQHEQVIDRHHAGHGGAGIYPIDATTLAELVSALVGIEAKMLVNREAVDSVPRDAYAVSHPCGQQGRLCVVAFALRKRSVEETPQSSVVLGASLNGSLLSVRKISERPC

SEQ ID NO: 1009742 - protein, 178 aa, Homo sapiens
GKMKAIVEKLRIHIQNVTAFENLRAAAALQEPGGPWPWILMEPEQAVDLDIAQGGSNAITRLGSLVDEFKELVYPPDYYPDGQVTIDEDTDNCSASVKQKDPRLDVFRETDADRPTVKKGTMGKLTVPRLIEACRALRAEELSEDSRSYWKPITNIFTGLDQRQRVQLPFAQCGTRLP

SEQ ID NO: 1009743 - protein, 126 aa, Homo sapiens
MRANPSFHCKDSVEPRHLDNDTVGWFHDFKVALTPSVFERGDPEEVLTIDLGHSESYPMKDGALWLRNKSRATNKGKQGEVTLKAESERKRSGARTQDLPVDLFTWENPLGPRVRDVGSCTKMMGH

SEQ ID NO: 1009744 - protein, 83 aa, Homo sapiens
GFSPDAETAPQKCNGSKVSFLPKNHRAIWSTSSLASILISGYSFSRYWYCMLPLRVLTTRSFRGNSSRLHTVRSKSKKLNWLM

SEQ ID NO: 1009745 - protein, 204 aa, Homo sapiens
MLRLQYEARVYCSPCGWKKVWLDPIETNEIANVQVPQQIRKLIKDGLIIRMPVMVYSRARCRRNTLGRRKGRRMGIAVSGRVTAWCPNAIEGHMDEENEDCAPALLEKIRESKKIDRQMYHSLCLKVKGNVFNKEADSHGRYARAEGREGPHRSSWLTRVRPRRSKTKDSKASAVNERLQGPRRRMIIKSYIQGVKRARIKSSH

SEQ ID NO: 1009746 - protein, 123 aa, Homo sapiens
LDPGMLSLPLSHTLYLLDKANLLSTTAFNQISCTAKMILSAFWQCPWLRTGSFMMNRCQGSWSETVVVQTRGARMERVFHLPEMFRTGIPQTWTLTMDVKEFERWRGHHEPDSSYRALWIVSQ

SEQ ID NO: 1009747 - protein, 35 aa, Homo sapiens
MESSKTGENAGLRKMAQLAEPGQAIQVNPETVSED

SEQ ID NO: 1009748 - protein, 126 aa, Homo sapiens
MATGRYGYVWSRVSLGCVLRILSIVHDALVITTRVSSLPHPGWHRAGLSPGEPIVSLPSYISRSHVRRSDIRHVCKCKIVYFKAQVELNLLTPLWSWELPLWKRIVERLGVSRRGGNRCPTLQSAS

SEQ ID NO: 1009749 - protein, 251 aa, Homo sapiens
MLDQGWVLNVLDGVDPPHLEGSQRCCGIYSGIRAYLVACGPPFSLNYIKRENKCYHPLGIQRLYKSFHYRGSQGRNLRYFTTKRLLCSHEKVGVSREGKCVDSAMKIVCRREIVANITPGGGEVTSEWGEEDITLKIKSFSLKGIFKQRCGAFRGAYTTRIEKGGETTHISYKQLCATTKFVVPHFRKSGTCVRVQQRIMFVSSPNRCCFGGIVMYAPPHKRESPPPLLTDICGVPTLIMWTHISRAQKDN

SEQ ID NO: 1009750 - protein, 382 aa, Homo sapiens
ASLTLNAINKCLLRESLAALTFSYVTEPCEGHLLLNRAVESRERMENREESADRMAVMSSEALDQTSFFVMSRKVTSPEAGLGRGGCVPTYSSLFQCVVTNDSYLDAECVPESLARKQYIARSQPIAHIPMEGRERTGHRIWRPPMGLGVCRQGGNQFLFTQSVKLMVALVFGGSSLVGTAKRFPVKHFFQDITLIHGLNTPAYDFFDASGTHITMSDLHTFVQPEELTFHDRHVRGAAKALSQNGLSFREPCVTAFAFSDSAAIADELWPVHTLVAVQPLTSTLPDRYPLCLRKRAGGNSSEAEKGLDLMNKVRARSRDCEPESKEAYRPFTRSSLTGSDTPRTKEAAPHRKVKQYNSVSQSQFFPVLTWRIYYNTAYVAC

SEQ ID NO: 1009751 - protein, 162 aa, Homo sapiens
MTDTDNTARRNTTHTGTHTHTKHAAHTTRTHTQNESNANDADPTNYTHRQETETSRPTNDDTQEAKTAETKNTRQTPRRLPNTHTNNPTYKRSRARQNRARHHQERNTRNARPTSNNKTTTEQQTTQRTHNEHQRNVETTEITTEANKDKANEEAENKSDDR

SEQ ID NO: 1009752 - protein, 155 aa, Homo sapiens
STLGDSVLRSAIVWKDDLVTCLPVEMTSVLGPRNYMSREEGEDADCTEASTDFRIDATCIRCFCFPHTCLIFSKRLLCFIMEGPAHTKLTVTPGLWTMSGRSPHKLTVYQLSRPTSVSCAYSTRPSAAVSLAASIEFFAANRQIQHLTNLRAQRP

SEQ ID NO: 1009753 - protein, 223 aa, Homo sapiens
MCSRRLTGPSSPAAGAVVEGPGACMSWVPAVRGSELLRRGVDGPAAVLRQKLYLGSVPCLYALQGLTPALGLLIAAGGGGRRKTGIKNGVHFLAARADYMGCLKLPPCLHSHDTGDTGTTMNLALAGDILAAGQDAHVSASCASRHIKQQGNEGREGRFQRSTGARRRKGASPQQEKEMWSGKARMMGLEVQGRRICGAGGERALGRIRCRKVVCFRRDNTRC

SEQ ID NO: 1009754 - protein, 259 aa, Homo sapiens
PAAPRTVSSWLRSWTEGAWMPPVDAAAPAQQAASAWVDGHALAQLMPSKLYIFESLDEWTLHTLAQVANLYPGFGAGYTRGDELCEYPKILMREMHEPPRPSPGTGKQGLCGAQLAHPSPARHRYRCHSPFVFFNLSSVIFLCLMGWLVFLHGWELIVLPHPLGVPAGKSFALCSRAGGPVGRGPKISAQGGKCRGAFKLTLPEDCLTGGYGVCLVLSSHTHETYFFLENKRLAQSRVLLPDALGQLTLVVVYSKNKKK

SEQ ID NO: 1009755 - protein, 114 aa, Homo sapiens
MTALHGSLLVTSWHWKLGPHRTFRGKLRGSRNYSQTMYLQAKCLHGKSSLLLERNFNGTSSRSLVGLRESEDLCRNSCPSCCISRVPAYVNGENIGMAGYSSIGSRDGVQVGMR

SEQ ID NO: 1009756 - protein, 248 aa, Homo sapiens
FPAQEPAWGVGSHVPAQPEWHGLEAPLPQGLASVLRGHCGSTSLALEDPQTVMCPGNGQLLRLHLLLRPCCLGPILAHLCAAPRFWYHTEVCAACVWLASALEELMWWHGIHRECVCPGPSAFLVDPRRRNKSTDVPCRPTCKRVKEYLSKLILFPRKPSAPRREDILAEELKLATQLTRSGHCPVRNVYVEGEKLGGHRLRKRQDISEAFAEVSCTGPCAQTAPGSYRAITGAKKDAKGKPGRNRDV

SEQ ID NO: 1009757 - protein, 131 aa, Homo sapiens
WGPVTGRRDGRLTDGRHLTTPRTTLTRCDTPLYNTKLYLLYFTLITIYKLILDLTILSDCINYALNGETYLGTRSIRDQHTDEQETVISKTNPRKVTTTRVYQGYIPYGTKRPPAETFQHTDIVVTMRVTL

SEQ ID NO: 1009758 - protein, 219 aa, Homo sapiens
MCLVTHEMKATSDVGPHTQPESDRKVACVQPGHPPVGVEGLQSVGTHLQCTKRESLAIGKITIEHEGPTARGLGTMHSKGYEKTYVVWPTLQRWNHARNDSEQRDEKGTQLERTIEPLKSLVKMLPMESQEEYMGRKVNDEYWHERHVTRGKNSNPMTTPERNEQQKTPKRRIEKEYRQEEKEKRTNKQTQQNTTPKRQENQRKQSRKHEKTYQTEEEK

SEQ ID NO: 1009759 - protein, 150 aa, Homo sapiens
MGPSRRVQMSGTDYGCHHHRNDTKARCISYTQTAIKKNNPRKYLRQMEEMERLWSSIVVVPAQTGAEAAQSLQVLVVFQFTAVNYAVRHVTTYRRFQRRRGPPRNYQQNYQNSESGEKNEGSESAPRRTSTQKTHDPYTKERRVPNLSLH

SEQ ID NO: 1009760 - protein, 236 aa, Homo sapiens
LHTSQLQPHKSSQPSLLTGLSLGALSVDSAQHASRNGVRTRSALRMSEGPPSHALTFLELASAATPIPARYPRYLALLETSNPRPGATTFAGSEGSICQINLATRIVWMPSEPPQELGRVGPRAGRPILILRSEGGMREATSRLQCALPLGRGAQGRFEGDPGLRASRTTILLAEGPQHTNSGVAVPTVQGRESAASLHVVTLMLRGLGHPHVTLGYLSFPILARLTGPKRRELSY

SEQ ID NO: 1009761 - protein, 217 aa, Homo sapiens
ASPLLDYQINRPQTSLSSPTPAQATDGDGPSASPPSSSSSEQQPQVQQPPPPPQPSAPHHTHSSHCDSSSNARDQDSETVKEKAKAHKGKGEALAVSRKKETGEAPTATAATISAPVTTMEYAVDPAQLQALQAAWTSEPNSIAHKPVPSFFVPRLILPDDASHRSLAPLQSGIPCEAMYWHGKALFRLQPCTVAGLMEACPQAPYCSSTSHSSRKT

SEQ ID NO: 1009762 - protein, 149 aa, Homo sapiens
MVSMRLACFDTSTHLHLLWSQDHCDLPIRSPCDPGLEVEKGRDLYFPERYRDMWEEDKTDGRSARGQRAKGMNSCHCDIACMLEGNSNYTLRTTLPYPSAEGERSGKVVRAGGPSYEIGNDQRSLEPKENYQAKAARSTFVYTGDGALG

SEQ ID NO: 1009763 - protein, 296 aa, Homo sapiens
EDLASVNKLLKKHQLLEADISAHEESRVKDLKQPGRLACMTEHAAFDTSKYKDKQGHPIRLVRVPENQELGGPLAGEPMLNESRSSVTSVFRDMDDEESWIEEKKLSWVGLHEDYVLVDPKPLQVQNLRKEGTSGWKYETWTDVMSRSYCRVYLDTLAMKLSDDETTDKLVIEDDPSRRDWPHVGVSTRKELRAGWQLPGVQLLEDVLGISCSLYANCGKRKEALDSGESTDPVLAMRMIYGLDDVCVRPSRGLLKESVKAYEDRLSTVQKDSVLNDVLHQMGRDLIKKQPITMRR

SEQ ID NO: 1009764 - protein, 472 aa, Homo sapiens
GLALQPTREWMGPFLLRRQRSAAARCSRLLACDWPSLEGSGLDVPGGVVLRARGPGLSLAPLSSDAQGREAAMAPSRPGMVLKPTVPQGLAACAWHVDSTRPARKIRQTKDPARPQAQPKYDTDATEIREIPHHGRQIDDGMAPLQGSRDNGNDATRAWTRTRGTERGHNHSTLVKEARHFQEGNGCPGYHNLPTPDGQQRGIEENPHEGKQPESTGEQNTLTYTQSGLGGGTVIRPEQRGAQRDGHCRTTQTTTTVFSRHDSVRGNGEYTSTHIWGHQCEAPPKKNGESVDQQRGQSSRQPHLGKSNELGEQGDYYDDPAMGKRQFVTTNKRTRCTPKISGAHSRNIERDTTSPQTVAGKDSGPHQQLAAETPTTHTTHSREKQRRGGVATKASKPQAEPAREQHTRYHRRRLGDEPHDERTTTDRGETNDAAVCGTLACTTNHATGACVTRPQQTHQSQYETAKYYEHGR

SEQ ID NO: 1009765 - protein, 83 aa, Homo sapiens
SVGMESLWMYFKEHHQLQRIGGVRGSVQESCPVLCSPDASYVNRGSNNGRCVSAISISASESVVGVWLRSLWSQAQEPEGVSR

SEQ ID NO: 1009766 - protein, 167 aa, Homo sapiens
MFLYRWCLLNGALFHKVLPCAVGYLGARNGATERPSGGFRFPIVPHVPRAFHVHDSDCVVTLFPAAIWTEPSSARKLLATCSGEANLGVKDMSRRYRGPTNLCAQKFGLRNTSSLDPGDSRLYRCKTGTPQKINPGHTSRFTRSTRIIASHKVLYTSLPFVPECGVV

SEQ ID NO: 1009767 - protein, 78 aa, Homo sapiens
DVTILYKPRKTIGTTITYIRRMTLESKHSSKPPYTSRAGPKPGNLLGNDHIYNVIVTAHALVIIFFIVLPIIIGGFGN

SEQ ID NO: 1009768 - protein, 197 aa, Homo sapiens
LRKEAWVPPGFCEEMLADSRLSGTIGEDDEVPVEPESDSGDEEEEGPIVLVQTTKSFGENRSADFNPDFVFTDEGWGRYDGSWALADVMSQLKKKRAATTLDENDGESSKEKENRGINEAKSGNLETRRKKQTDGSDTTRSSERPSRELLRKAQNDERLGALTTHQADAEHPHPKPDDTHNVKDRTHDEHDRTGSRR

SEQ ID NO: 1009769 - protein, 112 aa, Homo sapiens
SLLSASLRRWDGPRCICRGGRYYSRYFWCVCVLDHGTARLFRAHCGTFSAPLYVVWVPACSMILSKILPGSILPSSVNERECLVLMPGTIQFCVCFWSGASRPIAACSRFPI

SEQ ID NO: 1009770 - protein, 153 aa, Homo sapiens
IPAQMRKARHGAVPRVESRSHLSSGSYPLLCYISYRGSGKIVRSCDLILPSPWTSPMLVAFSFLRPILKLLLPLTLIAQAQACTTGCSDFPISEKGWRRVTKLSRSSSPDSLWISDPSQEASCLMETIIITSMVCIEHLHQEAFHTPTIPWSS

SEQ ID NO: 1009771 - protein, 201 aa, Homo sapiens
PSRSGVECSAGAIPHPGFPGIRGGGGCALSGCGTVEPGMVLLGVTASAGNCARFHSGALGRATPCFSAVLLPPLPKTLRGHSTADPPETTCAGARSPRNNTWSSDSRSVSVDKIISHFGGRRNLVQKAQIVVDSRLSPDVGQPGAGPPSDLASRHLVADWAEAFPEWTSSPGQRRRQYPCERGCRRSVKPGSRTRVPWNPV

SEQ ID NO: 1009772 - protein, 113 aa, Homo sapiens
TRYTFATALPDTVHIRRVEERLLSLGQKSPPASDYVALVHPELDRETEEMSGRSCSSMEVVRQTVAEPGASEEAYLMSVTQYREEHGRIPRHSIEDQDELSSRLQVPLVAGDM

SEQ ID NO: 1009773 - protein, 147 aa, Homo sapiens
SIHSTRRGGLWRGGRANRGVGRGRFPGWRPAAHTELFRAGEPALWQWRRSEAAWCGARSGRPGPRARQGRQQPLSATVCSVLDSKSPAGEARHHALCRTHVPASTHLPCLTGLLALPCRQLLTWLPNCHQPCALAVGPTVLTTILGA

SEQ ID NO: 1009774 - protein, 185 aa, Homo sapiens
MNCYPRTVWSCTEPRAGHAQVYLIGGRSRHGDGAGTYSLHSDCTMCLTPRGILAGEADSRHTATDTGPASVHEDCYILDQGGLKIDVWKGKKANEQEKKGAMSHALNFINSQRSTHQAHRPERAEGLGAESADRLQQLLPERWTSSPSADSQALGKTHTVGSVGEGQDGGSEGARIQELGTGEHT

SEQ ID NO: 1009775 - protein, 270 aa, Homo sapiens
MVGSTLVPVARGRGGSVPGICNVLVSGRTGIPAAAAVKRRSSAGPLDTDLCLELILALQSLPAESLCVPCGGLLEPLSLSGSQPAARTPCGTCSRGMAAAGFKHCHSCMALDNHSQTPWARDAHITTVTECIGRLENDVDTGLGVDSTPFHQKVCAQSLRFTTSKSDREKHSRRKGPYGGMPSNGLTQMAFGHKTAKQANWLSAVNTFTGKFVNTQQLLETSRRKGPRSLAWGELWPAQIDYYLTPDHIEPTKEGPKEGHKRSDATYTHS

SEQ ID NO: 1009776 - protein, 159 aa, Homo sapiens
PRTPAYYEAGCGGCAPGSQFPSARGPASGVGPALAEPIAPRRDARGESHSRHVPFRPSRRSPRGRSNHELPLLSPPPGGYPPAAPGGGPWEVLLPSSASMPPSGWITWTLCGAVQRKTISREWGQHVWDIWRSNMPSCTLGPWSGNHSDTGREAPTGCY

SEQ ID NO: 1009777 - protein, 100 aa, Homo sapiens
GVEAGFVSGHLGGYRFCLRLQASIIAFRTLGQRDQQFRPGTVKGCLCCHWGRGNPPFMSLDWHASVLVKDGFLRYTSGLNMLVTDPEDKRRTLALAFKTH

SEQ ID NO: 1009778 - protein, 76 aa, Homo sapiens
MMPQPFGLWPACTPEETRSTEPIVVDFEPGSSCRTFSSTALGNLLGLALLRKSRIPDPALVLTLQGPRHRAKDLIN

SEQ ID NO: 1009779 - protein, 179 aa, Homo sapiens
MGADDGEPDPDCYLRRLKQELMSMKEVGDGLQDQMNCMMGALQELKLLQVQTALEQLEISGGGPVPGSPEGPRTQCEHPCWEGGRGPARHHKSCYTHSDSKHLFGQQAPSFHPIGVSVEGYSPLDQDTVTSTAVLSRGQSEWNRMLDSTVMSRGRNPTALVSGDNVLHDLVGHWLDLDR

SEQ ID NO: 1009780 - protein, 187 aa, Homo sapiens
FLLAMLIYCTGGILWRIINANLLIFTVSFNAYVKHVTLLDILEVPKAIGTVGVQPPLEEMNVFLVWGVLHRYITINGFMYNPERLVGNLKSELFTELTLRNGCSLGFHWSKFHLLFVVSGDVWVRLSPPLNARTSMISPSTGQRDDASRSKSVLRGARPGHGPYARAASAGHLRRSPRPPHEQAKNE

SEQ ID NO: 1009781 - protein, 127 aa, Homo sapiens
YRGGGPRARGGRVSGLTWLRPRRETSASPRCMLPPTEPVGPQSVGEMLAAAAAATHVLGREVKRPRGVSLTNITLRESKPHLPGRSANHPILIRSKMTNCDCKDCSDRARHGCLSNWQTSTAPTTGL

SEQ ID NO: 1009782 - protein, 281 aa, Homo sapiens
VALDTHVWFSSCRNWPVRLRPSIGTSTESLSAIPVVVSVTTHMSWTDGSTTVTFRCEVYGSVSFNLFTGSTVGTSPLRSLVAKPFIGLVLAAIDVCMMVLLLFVVALTKESGGFPTSLALPVSSSDLSMARLFGLKEVSCVPSILGVWRCSDRTVGSQWVVSTTKRLCGPMRVPIYDNLIQRQSFASCQEMPSMLAVIIECVACRAAGARGSFKQSSFKYRGPSQSEAAAAAWTLLLVTCQECCFGTTTGNTAFKSTYLYGICCDCGTYTPARTDACDPEA

SEQ ID NO: 1009783 - protein, 102 aa, Homo sapiens
CFILPFTHCSIFKNKAISFTTFFIEGQPCFLYYIAYEIVYKRNTNSYFSLLGCKWHAGTEGEWGAGGGGETFCVFVPVKCCFAEPGYLSKDTARPVGIRTRD

SEQ ID NO: 1009784 - protein, 282 aa, Homo sapiens
MRDKQGHNRENRRHHTQSSQRQRPTNRQHRNKTTGSGRHTRHRRQNREQKTQQTQEDNKAEDKTRKSHKQRKEQRRTEEEATRKDTRRNKQHRGQEQQATQRDAPPEAQTEQQSRTTHDTKAKTNQTRKPQRDKEKAAKKKQPRQRQKANTNNTERTTKEENTQHNKNKRKQNTKHDEEARENSKGHREEEETQTKKKKKREEEKRKKEKRKERKQRMKKRREKNEKTARGRRKIKMRERREKEKQEGKKERKRGEVKREKEKEKGKKRRRHQEEREQEDTD

SEQ ID NO: 1009785 - protein, 309 aa, Homo sapiens
YRAPPSGSRPRRRRENTLVAGWVASPLVWGTTFEPLLMLLQWRDMPIAAICFFGVDVTVPPLIGKAQRTSILFRIVHEPCAGALSFLGGHQVQLVQPRGVTTLNVPESEARVRSPHGSLGTPVVRPLQAYSAPHRYPWRCNPWEFPIELLPGAHTPVMSTRTARKVPPDAREAPERRVSVHYAGVRAKRKRSRNRARQAYPALHNVRHFSSASWAWRKELGIRGTATYGLPQAPLTCPLGTCLLVQLAGPPRTQTHTRPIVQVSLVNYMVKLHSIPQSLLCATTELSAISMLYMDEYDKVVLNNYQGEW

SEQ ID NO: 1009786 - protein, 105 aa, Homo sapiens
MLVFLWCNFKGNVFCPHLTLVLASWGGSAHSWGWHQAAMLSLPAPLRVNRGLWQLCTGAGLWLLQGALAVTRFWAGYTMVSNPNLTEASVWEYQAESCSICYVSV

SEQ ID NO: 1009787 - protein, 256 aa, Homo sapiens
IYTADYVEVSGAKLGSAAEIAYRWRSLQAGGIRVVDPWKREEPGGTPSSSLPCTLIALGSDTNKEANELMEDLFETFQLMTMGFSNMEDDGPEEDGSVWLSLQANFNTTVKLYGLRNYCAQPLPTLNNITTSEGTLTLNSADSLTETLQAQTGTDTEATHTVENARKPAPGRSPSRKPWFPGIPSTATQGTGSNSQATVRHGHKSAHALRRSRGHQYAARTVGPARRTREVLKRTRMAQVNPPTEVMPCNRHLRTR

SEQ ID NO: 1009788 - protein, 143 aa, Homo sapiens
MPSSVFPVRPLSASWVSLSHAHCSVWYLKESKAPVPQTYKRTYKQDLVIMNVLTSALAKQIPLNNINVIITQLTVKLFLQFYTSPFQYDILAHSKDNVLTERKRVEPSPAKPDDKFSSPVRNGLQVLIFSAISMAEGGRAVCC

SEQ ID NO: 1009789 - protein, 209 aa, Homo sapiens
SRSVHPRLMYEAWVAPTLETVEKGCQTEASSERPFSCEVCGRSYKLAGSLINHLAEPPDRPLWLSGLLQGLLKPRCPSKNHRRIHADPRRFRCSECGKAFRLRETAGQPPCGSTLEQAVGCGEHPKRQSSEVTIEAFRCEACAELDRIRPRRAASCTMRSTVTETGHVQRAQLPKNKSNRMALKDHQRLHSENRWRRAGRSRRTGVRCA

SEQ ID NO: 1009790 - protein, 118 aa, Homo sapiens
LFFQLLLESRGFLVGPSPCWASYLYGEPGLLGYYTGLNVVLVETFPELFLGGSLYVQGPSILRFGDLPEKKGQPGQGHTVAPSKAQKLSVFHRSAVCLSRRRPWMPRCPSRASSSGCS

SEQ ID NO: 1009791 - protein, 107 aa, Homo sapiens
MPTNYELVPFGRARGTLSSHEKLYDRAVRATPPSLDDCDAGCCPPRGGLCCYSAVMCGVDAALLYAKNMAKYMKDLISYLEKDELEMELPRPKDVTCKRQRTNGRIT

SEQ ID NO: 1009792 - protein, 158 aa, Homo sapiens
MDTERSGSPQSIGIVTYCETQGWCIVDVLYIVAFRTSGDIIPKQGNMIIHNPVGATPLLRGFFLPTKTPAGTRQQETPVTIPFSWNHNCWAFVERTCCTNLWGPLLPGQEVLSSTPTNHKGVYLLDVGLETSGFLKPRGGHTLLYRNQFPPTCFQSAQ

SEQ ID NO: 1009793 - protein, 124 aa, Homo sapiens
FGARTSLYTHTCTHARTHTHDTHAHTLSCKVEIWGQYLPTHTHTHTHTHTHTAHVCSLYHPIHTRHTAVVSPSHTHTTHTHTHTLNLYRWLLSPHIHTHTHDTTHTTHDTLDYISLYTTHTQPL

SEQ ID NO: 1009794 - protein, 80 aa, Homo sapiens
ETTHDINNAFGPGSANEHTVPWWLKKFCKGDYSLEDEECSGQSSEIDNDHIEKIIEADPLTTIRELPKNSMLTILWSFGI

SEQ ID NO: 1009795 - protein, 104 aa, Homo sapiens
VQYPGYGAKLGCACPPSAEQRPMLSEVQNLDITKKKLATSATDVAGDYGQAVECMCCAGRLLLCSRPDERCVKSIAERRPPDETCGRRSLADGVHAAPPPPAPL

SEQ ID NO: 1009796 - protein, 169 aa, Homo sapiens
STLPGMVARLGGAIISPYPACSKGEKTPGSPATDCPATPSPLAAALLEQKVPLSQPSADCSADAGTGWNEGGVFISLPSPSHATPAPPELHVLLMRWDLIEDKKEGEMTPTPHPPVLKRSKQVSLVEELREGAMVRCQKEGWRGHVWSRGALWLVSSGVSCLAPCSCRK

SEQ ID NO: 1009797 - protein, 65 aa, Homo sapiens
MKATRTLSCLFPKRTVTASHYSQLATRDRSSEWILRTQSINESTHFDPGTPFSGPTPRHSRVNSL

SEQ ID NO: 1009798 - protein, 89 aa, Homo sapiens
MSIAVMGVRPPNRVAASVAPSNGRRARTHPACHSASEPAGDHVLLASCLRASSVWQACPYRASRNAIIRLAFSSTTRSVLRDNDSRKNA

SEQ ID NO: 1009799 - protein, 278 aa, Homo sapiens
RSPGREQAPPATVRAMGERCWTASLACPAVAATAACAGPRGAAATSCPRRTGFTAAAAGSADLRAPCTSTESKFWNGPPGLQPASASWVPPEGWGLRAACPNPGTFEECHRKCNGSCIPITDWRGVNAHKSTKGVELTHYFRSRHTSSQSCTIRGVQATKYRGITICWGTQGTLEFPQKAFPCTGGGDHRNKQVGKVLKTAHGHFNPSLEPPGISRIPKDGPIQDTRKIESLRTCAGMHRQTYSEGSGTFDKGSQVEHLGGNPNDRTIRWGYTGKFRS

SEQ ID NO: 1009800 - protein, 142 aa, Homo sapiens
MGYRRHSQHLEQRKDRCIPSMLPGTRNSVDAAPSASAKHTTAPTKHKVPKARPTNGTRQAGKHPCDLRNPTRTQQHTHGHSSTAKTKRDPVAHLERQESRLDALRGGKFPNQVNPEPMTGTPDPHASAEGGTPRSEPPRQTT

SEQ ID NO: 1009801 - protein, 32 aa, Homo sapiens
FSMEEAVERLQPRNARISHWDGDEGGGRASAG

SEQ ID NO: 1009802 - protein, 162 aa, Homo sapiens
MLLLTWIRGATPSVPIPDGRVQSIPWFPTVFLSIRFLPVCCQAVAYFGRGQTKEIWGQIVTPEDVGSPCANRVGPGALTLSGHPCSLGVPARSIPRVNPHGGAYLGADFGSSWQPLVPLRANGLAPIELEARDNSDWNWRNKASRPPVEALQLGPNPLGAKH

SEQ ID NO: 1009803 - protein, 111 aa, Homo sapiens
SEILNHHPGSHLHQVPGGRWTDSPKDMLAQNFIVSDMHGRYATIIGIEMVIIRRVYVLRSNKVSMIYLVHLLVSIVRLHSCHASILLVHQTIDLSSPKKRNSYICTGNSRS

SEQ ID NO: 1009804 - protein, 106 aa, Homo sapiens
MGDSALIYTFTQEGNQQIDLRSYDMPECHSRQSAVLHTAQEGARKLLVVGSYDCTISVRDARQWHVLLITLEGHSKTILCMKVVNDLSVQMAPVISQIHASQHSHW

SEQ ID NO: 1009805 - protein, 421 aa, Homo sapiens
MTFCWGLMSHLHSKNPKFVVISSKNRKLAYKKTPSYNLRMISLFPGRNMQTVSNSKQVHSPRCTWPSDYRAKKGNLGALPVLDSYPPLDKTRKDQNNLGLLGQPLKKKSPRTLQPLDTVNSPGETPVNLTNTEGANKSLRTTQCFLTLPRLAEDNPKITQAFSEGQTIIPIMQKAAKLPEVSVRRLRIDVCSRNLRHRGDTEFFTNFFTKYKRPQSARGKECGYKQPFWWSCEDSRFIRQGRFMCRGWTPDIATVGPPPTLWIVSSPPDGIMTTTPDTSVGVTTLASCAPQCSSAPVVNEIPHPRSELQNHDEEEYTYDPPLMDRRVRHEQSDNGSRTDHQRRSDLSSAPHTGQGEHTARVVSKLPEFDNKSPAGANQTGQECPPPHNSDPRGWSRHTAVINDAEDDSHTADRHYRIHNER

SEQ ID NO: 1009806 - protein, 195 aa, Homo sapiens
GNAVRSIGTDNVCRDRLEKTIMLETKSALGLLGSASFDIDSSNFRGSLGIFLESVVFLQKIGEGVYIMNDVSSPMYELFIEDDGQRIMLYKPRKNFEDSSPVNSVKPISIKMAFVSHIATLREICRRLVLCIIVPIQLTEELSNCGKKTQEGCTGDETGRRFLETIVRGHAAEVSWDEIYSMNISQTLSSCTSRT

SEQ ID NO: 1009807 - protein, 150 aa, Homo sapiens
PLSLVSIARLTALSDRIILMHYDDLFFVIVRSLCKAMGYKVGESPLWPVDSGVRVRTCPAMSTDSHRHPANALGLFTHVLPRYQFAALLQLVTVVNDHTVICVTRALGTSAQLLSHLVTAYSSNAPDGNVAEIRVDTFLAVAQSVDASRR

SEQ ID NO: 1009808 - protein, 209 aa, Homo sapiens
RGPVSVADYSDADSRSVKDKSTVRGNCEALCCLQSKLRVQKCRRNKTLSLDEARTSTPRKHHQAVTTSQQHHQRAQQQPPSPPIPANGQQASSQNEGLTIDLNQFLENQWDEDLQPNEAVYLCGNIFPPDHHLRTKCRKLFEDNTGKAGDSLSLPYTDSQDYRLLSRIGKTTNRYAGQTLRTTCAGLDQYCPHTDATQQAAMCAFGHAQ

SEQ ID NO: 1009809 - protein, 254 aa, Homo sapiens
PRVRLIATLGFPLKQGPGLQVSLVESQGMRKTAKDGMLAGEACEDPIPFEDPSLQMTGLSDKRHASVASALLPARLASPPHKRVVPHQGSDIILHCREQMERPTVLLLERGLVGGEEATRACVATMPVAYRHLCDKGHASGVARPCMCPGRTGRDLPWVVDAAVLVAGEMRYQPFLDGITEIVIRPHDALQCTLPLSSPSHQVHMKPLSCPVEVKAITQTVTLLSVRVTLPFTLPDGACAKPVDACLDAYEKLQ

SEQ ID NO: 1009810 - protein, 207 aa, Homo sapiens
WETDSHFVAQAGLQGPNLGSLKPQSLGFRQFSRLTLPRLAGHYSVVHHHAQIISGIYLSKTMGVNTNVSPRLALELLKIHSEILHRSMTSYKRCPEYTGASMPTGSPRPQTSIRTQDNKQGRLTHHNQRGKKRHNVDSTSTGPYNPQLKQNSRATTKATPYSTARNPIRTIKKHKHDKRKKEKRQKTRGKPKNPEPIHQTSAIHTDH

SEQ ID NO: 1009811 - protein, 70 aa, Homo sapiens
FQSQLCTVSETLLETCMVVDLVVLGKTTFAEKAVILTGDNYETECYVADRLAVFEVFIALTGSTTQLVGP

SEQ ID NO: 1009812 - protein, 138 aa, Homo sapiens
MRAPKVWGHFGTPFQGLNPFDWYTMAHAGLSSRNSRDQILDVRITPWHKGPILKPTKVREGWAQRGKTDTLYNQLEAEQHRQTRGGLRPPRVGHHKTPREITESVPLGGQPMEQGGSSDTRTDTEKNRKLQATPDGRS

SEQ ID NO: 1009813 - protein, 203 aa, Homo sapiens
RVLFDLGVLLSPLTLPVIVTRYDGHHWTYSVGSMCAGSMDCAFAAGAGATGSEVGSSSGLGQWCFHGRYSRHRLLVTDKRHLRIKHSSSIPGKASASMIEMSFLSREVLVGDLMSPFRAVGLGELNESLGLLDDYLEEANALQTIMGSPCDEAKAGSSEWLAVDGLDQSLQASSKEDAFSGTDWTVDENGFEGVRLGCPVGYR

SEQ ID NO: 1009814 - protein, 254 aa, Homo sapiens
AAPMWRCSRIMHMQRELQPTLLSSLEGIVYQMVWFKKIGMKRFSGSSNRVLAKCYSVALENYVERCPMLKITSLHSHHFVKKLCEQFGVGLETLCPIVSDHVRPERMPLSLWPVRESLAICDKRPVLVMIDSNKCQFTTDVDFRRYPGIHDDFYYFLCLSRKHVDSQHRWRPRSSQLPKRSSSYRGNNVPVSLSNFSAQTVEVELPGGVSDAIVELHYYIKIGRFMPRGRRFVQKTEHRSPADCHPGDSHGKIY

SEQ ID NO: 1009815 - protein, 149 aa, Homo sapiens
MPMENDNENPSFADRQLHHTDHLAQMSFSGTTNEELNALNLMLATAALRNISERRKVTSFVVVRQEAKLTTLLWHINTAYASTPAGSEGEAAIRSHAVASRDGSPRIEASTRTSWRFEWQGIQQLHADERRFIMRDTRPYLSRAVVVAR

SEQ ID NO: 1009816 - protein, 372 aa, Homo sapiens
ARSHVLPGAPAGLPLYSPPGEGSLRPGRHGRGSGTSGAERYKGRRVRDTGRRHGREAERARESKRRRATGTQRKEPRQEREDRRRGEDNNEESATQSQERATNNSERKGAEREQPTQQEENTKKRGGEPATNAADTQRRTRTRQRGEATEKRHRRQKKTTARAPAHTQVRAATRTAGDTARATDDTHREEEKETTPIESGEGRDNTEEWEQNHQREHRAEHTKTRDRQQQEDARPHKQKEKHRRGIQRRRGSQQAKQGRITHETKRRKNSRQQRAADEGRRRKPGDTQRTPHEGDKQHITHQRGKKAERRQEKRQGNNELTKHNTEGNTHSDSEEKDPKRQHQRATRRRRQHRRSRDKPPEQQDRTTPSTGR

SEQ ID NO: 1009817 - protein, 96 aa, Homo sapiens
NKVEKTQTPISSGMRSTNVCRNSSPIWSFIDCAGASVEASGLFTMQELRHAHIIHHCIPTAICAAGRLVVVQAHLQTSLQLCTLSGETISKAREEQ

SEQ ID NO: 1009818 - protein, 389 aa, Homo sapiens
GPEQGAGGRARYLTRAAVLINVPMAGPRSEPASSATVTFSLRDGGGGPSPGGCPGPGPDPGCSASSARPCASLRFPLQEGCVPPRCHRDWIPVPPLSPSGCLGERRLHHWCCHLPVSPPRAWASRGWGLPGDGDPEVQGRHIHGLGATGQVPGTHLVGCLTKSVPFPPDGLDGITWGSLGVEGGQITAEEHGGPEEEKLRQRASAHASKGPPLSRQHAGAQSQAGVPNIWRGWGQGAPTLGTTNTRRQFTTYRGVANNPPIVREFGQGIGSSKLARNALVVYVDAHSDCSGTGCTGEQHNAASRTAGEVGRARGAEGPGRRTFGQRGWAGTRDQTRREARDEGTPQKKVRGRKWETRPQIHKDETHVVNTTWSTRSLEINDGAICRENR

SEQ ID NO: 1009819 - protein, 285 aa, Homo sapiens
TDTFEAAPPAPAPAPASSGQHHDFLSDLFSDDYGGKNCKKPAEYGYVSLGRLGAAKGALRPRLLRAPCNRTRHRAARRLPNELKAGARASEHRCDYEAGKDGGRGRLGGRALGIGGRASLNRRCDDCTSGIPRAGDRSGRGEAEEARTTQRSVPTGPSRRPRDSGAEAPGGNGPREGATKTAHGDRQRRPGSQGQTPYDRGPMKATGASKDPGRRHGNEAAAEVTTGIPGRRSGNKGFGPVAREKARREKGPNDGPHAQEARRNPRVPWEGVTGPEQPSGLGGKK

SEQ ID NO: 1009820 - protein, 255 aa, Homo sapiens
RRLQALLAMFANRTVVARSRGVEPGDGRQDPGSTAASRALVTRTSVPGCSGRAAAPRSAGRGSADSREGGSWECPGRLWTAWGGWCRCSTGAGRSGSWAGRWSLSFLAPWGHCRGRLGVAWAVWVTLLPAVLVGLGSRLALHFPVGPFPLGEFALCRELSLSYGPPARLGPPCGNPSFSCGRWKTPFKPRAPVSNRVSLSVLPVGQFEERKPPGTMGPPRKRRRRFLLSNPLGHAFGSSFGGPCEGSQRVANPKA

SEQ ID NO: 1009821 - protein, 450 aa, Homo sapiens
MCNHDLRESILAVPQLPTPRSRKYFKGYVRGLTTDQWINQPMPSHDRSTGPRRSEVPVGDTKWFDAREWARLMTESAEESRSHPDHSDGTQWTVRVTGLDTSYMEATIVPGEVTSTSEAFEHVGVGRHVVGCRKPLKSETDLYIEGREPARGRIKIHKPRFHMVGEYGLPKRLMLLALQSHREARVANWLTLVQPVGPLWPAYTDSKQAPLTRYVDRNDTHLGRVKRSTRRGKPYKGDCGYVEYGSIVVTGRTGKYNAPTLMGLKPRHRAVKHPTSGNYQWGPPNGIVYRFGPAADRLYGGGLVGVPINPIGCRINVRCLLFTPGLRQLMGTPTVKRAGPTVGCQLPIAKRRWRREYRCATVPAVGEPDTTAARFDICGDVGTNTGDQLAYKEWDQGTTGALKQPTLGANRSPPMGNSPRLGTTLDPTVVYQHSGGGKPGTLVPPVLVMP

SEQ ID NO: 1009822 - protein, 147 aa, Homo sapiens
SVVVRSIPWRMSLTRCFPQGLSRLVPSIARQDLAYFGDSSVGPSDGLDHHRPCSIIQPFSGRMYRLSAPSRCGGAALKKKILELFACPTVASHSRLPTFARREGRGQAAGLHTVIHVRVHTPVGGWVCVCVLVCAHVSALTHTMLAH

SEQ ID NO: 1009823 - protein, 126 aa, Homo sapiens
MASDRAAVAVAAERAVGGKRAVTREREEASEERAEALLFASRLTEPECTAHVHPSTGSRLACSENKCLRCLGGLDEANCRVVNVRQASATYVPKTKKPGHIPPSLATLLGLFELNSPCGNALSPFS

SEQ ID NO: 1009824 - protein, 287 aa, Homo sapiens
GVGPAPTQLGCPPRPRVRPGAGDASVISHALGLRSLRCELVPQLAGLSRGCSVLPLCSSGPLRGGEAQAGWTGALLVACKLHHDCMVALAHGQPPTCVTVTCLPSARGREERAVRQGLHARRPDARSPRPVPRAPDPGTRQPVSPEAGVHPTTPRGPEPYLRGRIVCRKPERKAPKPGADWVAGHGHNTKTRLPGGARDRTHLGRARAVPRPLGTMTRHKGGGEDERPGGGDRGRERHRDAIARRAGAAGGQERGTRGRGEVDEGSTERAKGTRGRKARGQKHRRGG

SEQ ID NO: 1009825 - protein, 367 aa, Homo sapiens
GFVMSSPRHPADSEGHEKATLWATLLSLSGDSVPPFLRQAIKIMASARGPEIYRIPRPKWPAEIRVSITIHVLRPSKRSPALRGQQLYTVFAAACGSLLKPNPSVDRHGPLERACDYACTGGPCPSMCMPRKGDDITKAMATTREAYVREVPMGGKACGTQQVPNVNINLVRVEFALESSRNTKWYATYGRPNSPLGRSPTSNWFHRSEGTFQGLKTPPVKLMGPMALGGAQLFGNGPQLRRRTKRRPRECGPQKRGSSTHTDTPPQDAGCHPHERAQNSRAHRMHKNAEPIGDAAGVGNAGANTPRTTTKEIAPRRQKKGTQAQRVTTPRPESTRRRIQATERGSFPTGVPKAATHQRGKAHNTVR

SEQ ID NO: 1009826 - protein, 158 aa, Homo sapiens
MAEQVVTRARGLEGRTKPTLEATAQLDTAARVWAQLYQDDRWGLPRAIPQFRRDERHTRRLELDNTEHTLRIASAHHRQIGASPEVWRSDRSGTDPNEGGRPLWEQIDLYHDTGESKRAFDHTLSRRKQRPHTNHNSSVELIGEISADAEERTSYGGV

SEQ ID NO: 1009827 - protein, 142 aa, Homo sapiens
MNWGRGKVDFEKSTHDCVYLYNRLQRRERDNTTERQQPHTNQAHIQTHRHTDKDTHSKQTHTTQTQHEDTKARQHTYTITYTHRERDTERGEEKRERGARSGEQTKREEANNCGTREGAQHGTPRAARGARRQRPSGTEEKG

SEQ ID NO: 1009828 - protein, 111 aa, Homo sapiens
SCRQKTGCRENLPRKTSILMLTRTKTHINIVVYLESVDTRAKVHQYVGHLIYKCGCAIVPTERIEKNLDETEREREVDGYTVASFSQDNAREVREAIERRKPEACNVVLTT

SEQ ID NO: 1009829 - protein, 297 aa, Homo sapiens
MDSHFGLASRTKARGQEGTLLCHGIVVPLGLVDIAQVGFGAHILRVALRKLSYDGTILSRKCEVVPRVWPMRHAKGWYGAAIFTKAYVEPGDGANVPHGYQRFLDGTGAQANNEGLLRLTQRASVPTSPVSKAKVAQGLTITTFVWRKPRAIQRLAILTPNSCGRQRARRRPWHSRMRVAPMRSTPTNVWWRRTWETPHGGASRRSTKLLPIRQRENTPGVGTLKRDARGLRKIDPNPPQEVEGVHRHKRGEPEWVEEHGSDGYHKKDVRERQHHNVEGDTTGVNRDYTADVGVYKR

SEQ ID NO: 1009830 - protein, 211 aa, Homo sapiens
MVSWLCVGGNTILLPEFEQMQRQPIPRITHAENPLSSNPLSTLCFTVQSPWDTVNATIGDSGDSIDTQHTEDYLRVRQGTLASETLRALTRVCRIGTVHEGVRACTLRCCSLTRVDNAQIHIAERSPERGGENQFTRGQLDATGEQAIGKVLNVPKNTGIRSNADSSLTLNTQTRTGHRSFADKSQCHGHDQVNWVPCYVLIRALSQAIPQ

SEQ ID NO: 1009831 - protein, 93 aa, Homo sapiens
MVIYQSAKDISSEALLITSGDYNYDATMTSLGGLRDKTRDSCTPIFECGQPIAMQCADIFVLRIVTGATYKYTCPTDNLGRAVLESGTRRADV

SEQ ID NO: 1009832 - protein, 134 aa, Homo sapiens
MGVAPSCKQRVPQIRSVRTEEKFVALSTKSRRQIKVLGCGISIEHRPRYTIVRHNSEFGGWKIPRWKSQSLLRAAFWHTHDWRTRGAGAQDTLSGLYRIFDLPTSGTRKSFLYTPYWRHTISFETPVTGIETPF

SEQ ID NO: 1009833 - protein, 229 aa, Homo sapiens
MVGSSFACTVLSSCGLLTGPLLSPSAPILSSVRLSVVFSLRGSVLPWSSLDFVFPVVVLLMSDLCSLRVQMQTLCSFGPRLVIFLCVIFSVSLGIFLSLYCPSSLRRVWIVSKRGILIRWSLISLKLTLVDPTISSHGAILLGPQTPRRLRDRPTARTTRTRLTCCLPSCGPSTSRCWLCGRVGNGANAADTPSVIHFHVQPPLWVAGCDVCVPCVCARVGAHTHMLAH

SEQ ID NO: 1009834 - protein, 111 aa, Homo sapiens
ISCQHRYNKAGRRRWKEQNLLSLSGLRLPFVLELPALEHQTPSSSGFELLDLHQRLATWSQAFNYRLKDTLLASLLLRFWDSELASLLLSLQLAYRGTSPCDHDISKNFVH

SEQ ID NO: 1009835 - protein, 109 aa, Homo sapiens
MAKNLHLSSGVCRRRRRGGTPKYERMSLTTCELSAKRLLVALPNPFFPKGSIGGRLACTRVSLSRKWESRAPCRCRALQRGVRTICRGSPNPEGLSDHQGVKRSTQLVA

SEQ ID NO: 1009836 - protein, 112 aa, Homo sapiens
GVFALSLKGSCSCVKWNLEGSCLLITLPFLSLLHPPFSLIPCGNQMPSFCLKGPHIECPRQVQSNSCPYANWLFSPIVYFSCLSKVFYSMLNLPYCFPTEFLCGLFHVQHMN

SEQ ID NO: 1009837 - protein, 217 aa, Homo sapiens
MRRSLARSLGSLTRRSALWRVGVQVGRESGLCGRGRWLCRGGSPGLAGRAGSNGTSPAELLPPDTCAARAECRGCLPPILKSPRCAGALTPTCARNLTRSDQPSLDPGLARPDLTQPGRQYLAPSGARSSFPNRHEAIGELELLKPSTSTADCGDLEMPNIIGRIEKLLIVQHGRRRQNTVSKQVLPGRARPELLEGTITSRPDDVQDVEPQADFSK

SEQ ID NO: 1009838 - protein, 109 aa, Homo sapiens
MAQWYHVGTLIEGTLHQSIDSLGLPNVKWPSNVGRSNIPSKGNFHGVRHYEGGDMQTSCKARTILNQGGLSPIIVSTLLHFEQTLGWEDTYKVYITQPHRWRNLHNDTS

SEQ ID NO: 1009839 - protein, 210 aa, Homo sapiens
MHEDPTHDPQSTTDAPEQKIYIAGKNVTAKMWYHNQGITRTESNSSESNQHVNVCRFQMTTRATNDPRHTSAKHRCHDHKENHLTRFDTMLSRQNYCQRTNKPLKGATGTRKDPPYMQTVQTTRRSANNQKAEEPRELRVATKGNNRADKRSTRHTEGDETTRDHRSRDIQTRRNSQGHHTGSTRNRQKQKETRRRRTADSEMQSNNTHT

SEQ ID NO: 1009840 - protein, 86 aa, Homo sapiens
PEQHRKRKIDAGTMAEPSASPSKRRDSGDNSAPSGQEREDHGLETGDPPLPPPPVLPGAWGRSSRAPGSRWGWVATTGRGAQDPRG

SEQ ID NO: 1009841 - protein, 160 aa, Homo sapiens
MVFLIPLYFFFPVSCSLFSIVSLFVVSTRRFLIDDCVVLSSLLSCRRSSLLLFFPSLLSIDPLWLADRILRPYRSCACRSWTLCARCRPFCRLDGLRVRGVLHWTRTARYHTVHELSARECALRVTPTLTRPARRQLPPPRRHTLARPRERLGKPRARQA

SEQ ID NO: 1009842 - protein, 157 aa, Homo sapiens
PTSLTQCRAMMYSGELHCLSKRTSSDPAWQGGVHSLHSYEKPALLKKGSSHTSSVFFFAIKRLETKRTINGEAIEAREPGRPYRMFPAPRGRTPRQLAIPRRSCLVPQWSPLSMRLRISRRRCQETILVTNTFLQVWRHARRPAGTMYAARKDGTHA

SEQ ID NO: 1009843 - protein, 96 aa, Homo sapiens
VSTHSTRLLERDPPSFKSIQYRDIRYDELSSDACATLPRLDHDQFVIYTQDCLRIVRTIMPCVVKQPLLDLKAAPEAITGLLVIAQYIAHGLSSPH

SEQ ID NO: 1009844 - protein, 310 aa, Homo sapiens
MVKIVTVKTQAYQEQKPGTSGLRKRVKVFQEQRPSVRGERSSESIIIHRGAGCSAQGGHAGRWAGTCGSTMKEAITDSSTRIAAAQRDRIADGISDRMESSSSPADIRASLEQNQKAKAGMGTHVLEQAHVTQNRGGAHKWANCEDTRKVQRVPEVGGDLAPRDGQAKRDNESRRQQSRGQQHRSNAEEPSLARAEARGSRGTTVRTMGEREPEARTRAQGKRQYWRGKYHARRGACPTRAGTSEAEMRGNGNPHGQANCDDDRKRRKGQGARCTGRNRRRTQSARATNPETGAPMGMRHSRRRRRRDGH

SEQ ID NO: 1009845 - protein, 107 aa, Homo sapiens
MCCRKFFPLRRGREPFRGCPLAGYPYLLAPYREWTCDHYHGLVQAKCNISEGRRVIRSRGTLGRDRTDTAKTGNVEGAVKVQVATEEVCFFAIDCFNAWSSPDGVVA

SEQ ID NO: 1009846 - protein, 109 aa, Homo sapiens
VIKPCPIRGESITLLGRDGKSPLGRYTRLHLKPLGINFLQSRLQAWAFTPVIQTNRHKGLQNVNNSVIDVKVLSFLVHGANYRLYNSTILEHLLCDDARHGGSLDDQES

SEQ ID NO: 1009847 - protein, 91 aa, Homo sapiens
MGQRKRTIHRYSEGKHTRRARQENDKQKRTKTNPYHRPGSKATQEEGERKREGEERKAETKSNRKGRRTNGGQRDNEEEERAQRNGKKTQE

SEQ ID NO: 1009848 - protein, 81 aa, Homo sapiens
VSVSQRLELESRSNTGCRLDEESSQHHPGLPFAVNAWERQSVEPGTLSVLELGMSNMHANALAVRLCSKIRSSAGVLPFML

SEQ ID NO: 1009849 - protein, 190 aa, Homo sapiens
MAPSRKFFVGGNWKMNGRKQSLVGAHRHSERGQWCRSTPSVGLCSPILPISTSPWQKLDPKIAVACAEHAHEVTNGALLGRSALGMIKDCWSHVMWSWVHLMREGSVLWGSQMKLIVAGKCAHALARGTRSNRHALGEKAQMNMGNAGITAEGWFSMQTKVIADKREGLEQGSSWPMNLCGPYGTGQGLQ

SEQ ID NO: 1009850 - protein, 110 aa, Homo sapiens
MMPLQDLGERRGKNKSLHGYAGHGEDREDYIHVELDLATRECEFILTRCNNLHLADCRMMGQLVALEVENLMVESYYVRCIVASRLILRIDSSMRIGESYAVGDYCLAEQ

SEQ ID NO: 1009851 - protein, 239 aa, Homo sapiens
MISAALVVDNGSGMCKAWLRWATMPPVAVFPSICGAPHGTMGCDCVVHGSRTDSYVGLTRPMINEMASSTLKYPNLMHWSYVTNLVTDMLQKPLGTHTFYNDVCVWLPEVSTPLLPGPDVTLPEIPKWPNLRRNDDSITSLFERILSNHTSCHCTVGYSTGLLLSPVPALLGPGNHHGHSVTCASSLAGTWGFYPNLSLDCPLFLTQARLTGPFSPLLSHFSGGSWAPLRLGPVSTFDL

SEQ ID NO: 1009852 - protein, 170 aa, Homo sapiens
IAISSSTPRADLVAGRVTGVLGAPSWFHSHHSGLGWWHYRDEGGPLWVAQGYGQASLAVFLWPQLCTYRLPCRGLRSRRRLIPEVFPCCGWCFQAEWVGAHRAPPFFLVLLTLRALGVSTSADKGYILQGRVLSLFSVVQLVQLLGIGPAFCLPYVICVSSDTLLVSVEC

SEQ ID NO: 1009853 - protein, 103 aa, Homo sapiens
MPGLIEYFKVRRQGFLQVGSGWVSSSGTSGGSGPPPKVLGITGVSHHGPVKTFNKVSLRAVKLAWVTYSVLCPWVEYSLLRRQEQVAEARLDSTGTKSPYKRI

SEQ ID NO: 1009854 - protein, 161 aa, Homo sapiens
MSTVIRSHKTLPRAQGGFTADPQAIDSTSSQSTCANILRITLMPCHMIAVAGPTGVEGHCWVDVRLGFMPVSAAAAKRWSRSIVTIKKHQVLKDSGNRSVVLRVFNNIQTSRFSEQKPSTGSSPSFTPQATCEGEQHLSADFQTKPVVFGCEGFGGMLVML

SEQ ID NO: 1009855 - protein, 70 aa, Homo sapiens
MRGTSVIRITQYTIQSTIKKSKIHRKPQHGINIQNPVPTKQHAADSVETSTYLHSHTQPQELKQRTRKYT

SEQ ID NO: 1009856 - protein, 326 aa, Homo sapiens
QAGTGYYRRPTRSAEFLVSTQINIMVLTLASVDFQHASEDARKTINQWVKGQTEGKIPELLASGMVDNMTKLVLVNAIYLQGKLEGIQFMKEATTNAPFSIATNDQTAKTCEHMMYSRRTNICTMATSTDLNVPLLLELPYQRRGAQHGHPAAGLTLRTESTGLKETLTEQLTFGTVALSGLNLRLSILIRTYMSALPRFHTAPTRLHLSTSDPRPPTVCPRSLQQTPRLHLAANLRKPRRHIVTIDHTHHKAHQRERAHTTTTTPPLRLTRSASRTPDMPRRKPDLHKTATAPNDVALISIPADKSSRYHSNAREEIEHPQRARC

SEQ ID NO: 1009857 - protein, 107 aa, Homo sapiens
MRSVVRCSVASHKAEPDAWCGTWIMDLAYKSSYVPPNTESRVGSYIIIVLVNSPMLEGKVEAETLTQDYIMLPAQALPMFREPAPNWSTRNTELDDRYMYWYPLIVA

SEQ ID NO: 1009858 - protein, 551 aa, Homo sapiens
MSNHASCLSVRPSVTELQAGVVYKQWHKSKKKAFTKYCKKWQRCTMARSQLARKDYQQHATSTAKLIRGHRPSSQMRLQFLCRQNEGPPDWRLQVNGRTAGPRSVDMAPAEQAGSSTVRVSKPKDAYARKRTTRREYDRDRHGGRTNTRAKSANTTRRETNQRSEADSRKNTSRNCTNPQRTDRYPHKREDTPQKLTDGGNRGNIAMSYELGKRGKSGDMGGGNSARRGRTHEHTGTDNETPTDRTDQTTPKRNKNQTHKEHQVTRRDTKTRKVKPGTRNRKGTDVTTRTQTNADTTDDNHMNERTQPPTCTTPDQAHTTRPPNHEPDGATTRTPPPPTLATCTHHRHPQEQQRRRNRPRTKTHAALANTHAEPPENANTTATHTTLSTTQRRSTNNEDPGTPDRTHTNNLDTRSTRTVTAHTRQHTTDHHTHHPTEPARTTRTQTHVEERDREPPTQHAGTQTRRRSEHTKPTPREARVRTHPQETRGSENTPYEKEDCREESPDQPTLRHNSHQTRTSPSETRSQQETTAESDRTKTMIEQASKRTSAK

SEQ ID NO: 1009859 - protein, 69 aa, Homo sapiens
LGEEARIRQCVDFGTQFRGFITVFAAVADGVRRLANFVMNEPPFQWLPTTAAIRCSPGECRIHVSLTKW

SEQ ID NO: 1009860 - protein, 121 aa, Homo sapiens
MRAQAQPARRVRRSLDASLLNRHHLAQQIDEGRVPTESSCVRVHYLSGPLDSLWNNYLSWVRSLHLDLERKVTITDTKAASFSEAASLATRAPVGIGATKNSPYAWKAVGLRTATLSGIEL

SEQ ID NO: 1009861 - protein, 258 aa, Homo sapiens
MPAPALLRGIQTPSWVLLAGGIVRAAADNGRHLRGICATSTSRDETLRVALQQDSTAFGKVLYGEVYTGIEETRQKEVVCHSETHSDLCEVMGRRIDALRTIPELGMSHRVSSCHVADQALGFDARYVGAPSPKRKHQEATRSQSIGKVPVRQSGTRGTLGTLRYKHEGSALGKETDQYNLADRNSLCREKELLGNGRHWGQFTTASFTEIGQMEFTGRTGTNFHNGFWAKDGLAVNFSAVKGLRGMDRGWKTALGVW

SEQ ID NO: 1009862 - protein, 128 aa, Homo sapiens
MSMCQDKIFGPALNRGNRGELRHKGTCNRAPPYLSQKIQGYDGAVGKGEFPGVHRRNFVPGRLECFGEDVGAHKSARVITEEQGVDARPLVLRGHGTCAQRWLSLGLASTVSIHILAPRVSPPWVGEK

SEQ ID NO: 1009863 - protein, 109 aa, Homo sapiens
MNARLRTLTNEEGVYGPLAELVLLNASVDEVTGKGYCGSAYQWMRKSHENNGFPLTASHGVDLRAMVRVLALPTEIEGGIASLYETTREETVQNPNREHSSCSVGIRSV

SEQ ID NO: 1009864 - protein, 280 aa, Homo sapiens
GEQRQASSKQARAASAVSRSLRLGRKRTRAPQLFAAQRLERRAEAARPRRAGFVMMASYPEPEDAAGALLAPETGRTVKEPEGPPPSPGKGGGGGGGRAPEKPDPAQKPPYSYVALIAMAIRESAEKRLTLSGIYQYIIAKFPFYEKNKKGWQNSIRHNLSLNECFIKVPREGGGERKGNYWTLDPACEDMFEKGNYRRRRRHEEALPAAALEHFQPGKGLFGAGGAAGGCGVAGRRGRRVTGYLAPPKVTWQSWLPQQLVAATASLLNHCPIALPDGGD

SEQ ID NO: 1009865 - protein, 84 aa, Homo sapiens
QVKLYIFDILTDPDSPTKKRSTRYREWHLLSMSVIYSIELRVQMTTEIHVLRRYFFANLWSRASMAFRKVVTRAIRAGVVILVM

SEQ ID NO: 1009866 - protein, 151 aa, Homo sapiens
MLEVSAVYIRGGFGKRHPFPKGCRLGDKKKRAKYTLAHAGAKGAGLQGTAVPPCAGHTESLGATGKLRWARAQVQGAGLYPEVCATGMSVWYRVSHARTHRTPIWGSGERAAVIPRERQLGMTNWPRTRSETRKAAKRGEHESQEVGTEMK

SEQ ID NO: 1009867 - protein, 96 aa, Homo sapiens
GISRIADGFNGIFSDHCYSVCSMRQPDLKYFDNKDDDSDTETSNDLPKFADGIKARNRNQNYLVPSPVLRILDHTAFSTEKSADIVICDEEVVNSP

SEQ ID NO: 1009868 - protein, 461 aa, Homo sapiens
MAPIQATFFDKAGNSDRCTGRKQSSWGQPHQDTPENRRAKGCLVPEDLSVELCCYHPSLDPYLLEHIDPRAQQSHTNHPKQIAMRRPCRPTYTLAYTYTDRHLNLAVTHYFYTIWVRNAHHTPTLRPLRIQKKENHGPEEETHNRIAKNEESPMKEEAQNIPNKTQPQHGAPLGFPILIGEEKTEFPSTNSNTPTWAHTGGGPNTTQTDWRTPHKMPPSHGRPTAHRQAGNPFQKEQPLTTIRDTPPGPETYGEQRPSHHRPLKATQCNPHTVGGTQGNHWGAPKIHTPRGQPPKQEGNNGITANPGTRPNGHPNKTARHTQQSGTPTRTRFNNPDMPNNTGQHPLDEKGTQHTRGTSPGLPTTLAQPPPHKTVAKKTPAALAPTPNEHKGSTQNHSCEEHNPPLGRRHPHPRNNPNQAPQHTPTPPPPPKHTQQGRDTHPERTPTNQRHTPQPPGHTTKQ

SEQ ID NO: 1009869 - protein, 111 aa, Homo sapiens
LCVASRATSLRHHGEGEGRSQRTFGPLNLGARPCGFQPQGGPIGPFFLKTLPIGALQPRAIGGQLLTFSGAFYMWGGPPPQKVFPPKKFWVKRPPLCPNFFGKTPLSEKGL

SEQ ID NO: 1009870 - protein, 181 aa, Homo sapiens
YFYVFGENPLYGAPLVVRHYDTQAFPVAPRGKRSPPFQGKAKPPTQLWAGSLSPRLTGSAPSGDKERGLTHKTKAPQIYRLQGHNGGQHGKERARVQGKMVSESKVHIPGVLPGPKLSSRPEPNNERTKQDTQKDEEEKEEKQTDHKNKRKKKQAKEEKDTGHTDMPKTNNNKQTKDPADT

SEQ ID NO: 1009871 - protein, 171 aa, Homo sapiens
AAKVLGSSEEPLRLRWGEALTSSGDSTRSAVPSHYTLHRCDWPLLSVARPDIILRGTSSSERLKRVMVTKYNGMDNDSECPRFNSSRVLNVCMPVFVRLWLVLAKRSLDAKRTIDLASSTICLLLRGPGCEPCFSMQAELSVSHDRDGTWPAPSQLACLTTSSDGRIEDGK

SEQ ID NO: 1009872 - protein, 105 aa, Homo sapiens
EGGRSRLAESSGLRLPFVLELPALEHQTPSSSGFELLDLHQRLATWSQAFNYRLKDTLLASLLLRFWDSDWLPCSSVCSWPIVGLHLVIMTSPRTSFTEVLNPSQ

SEQ ID NO: 1009873 - protein, 283 aa, Homo sapiens
MTPNWRGWDPQWELIYVCASPMQLAVDPGVSQLVVSSHDRAGQQGPPHQAAHPGYLVVLGVLTVPGDGCCPGPHPASKRDGKRRGSGKPFDSVMARGEPAVSLPGRPGPSSRERSERIEATLDSLGIRDELKDNILEDVLIPEQQFTLGPACWARGELGISAGGPDCKQEDGSFVSTWLWRCCTQRDIDCLEADIEEFLREAACMKEETIHTLAKLVGGKPPEQGLKAVFPSPWVILPFMKHGDLHASCSLPDGENPFNQPSDLIGHGGHCLRDGGTELSELS

SEQ ID NO: 1009874 - protein, 30 aa, Homo sapiens
VNAELPRWATIVHVTELATKLSRLVADGVA

SEQ ID NO: 1009875 - protein, 156 aa, Homo sapiens
MNDLKHSADQSQLCHLIADTCEQRCEVTNVQKCATVNAKLHTYDCAPLSMYQELGISPGTVSCGVMGPKPIDNAASAHLVNQFDLHASQDKPGINFVIHASPFLIERSRKGTESGIPGNVVPKGVFRGGPLLHKPWRVGQGCQTNQRESCGGATLT

SEQ ID NO: 1009876 - protein, 345 aa, Homo sapiens
WKLREDGSSRELTGLDLAGHLDRWIRSVADPVLTRTLNPSPPQRCGGALLCFPPPLAVLPACLRLQISRVSPTSLVNMASEDIANAGRDTVPRLSVAGGQLSFKGKSLKLNTAQIAKDVITRHCRTLTAWQALRLEGNTVGVEAARVNRQGLSTNKLRHVDSAATGSDMSTRHGLRTPEDPTRPLTHHLAPQRPHPHACGATTHACAAWDLNADTQPYEAPTGRCNGLPHDHRSQTPSRPCPHHPMATERSKPSTQTVRQLAPPRVRAAPQNPPAMQRTPRPAHRANPGENPTAVPHRAQAPPGPVKPGTHGGQGRQSPDQAPLAPRRPAPSRHARPPPGPLRPP

SEQ ID NO: 1009877 - protein, 263 aa, Homo sapiens
MPSTNETQNNTDQKYLVISTSWVGTSRPSRRSDDGGKVVAWSPGKFGEPSPRQELVWRKTPYSLNRLYCINDAKGRRGGRSTALVISPRQLPRVRVRCDRGWDSIARGARDGIPKERELRLERVRTNAVEENLSLVDVRQPSHSQKLAQIQDESSGPRETAGGVRALCRLSPSRVKGSSRWPYKHYLVVESVAFGTGGKGGIAYVVRRWLGKNGPRGVHTVGASAYYRPNCVWQGPHGSEILCQPQTIGPRIRRLKESTETFG

SEQ ID NO: 1009878 - protein, 238 aa, Homo sapiens
MACNFARFVADGGPHGCLAEYGKRTDDPTEALYCSPAYLVDEYLRFLTADTNIGNGNEDVCIRGIIPFLMVYRPYGGLAQIKAIPMSPFAPELLISLPWAKDPLVPQSLAHRRSNIRFDPTTAGKQAAYFTARGYNSIHYPGSGNINPVINGPGSTSFPLGQNARISFGEPPYVPRRHQQCASARLFVVSIVGSPWLWCICRETVRTGFEHSVGAKLFLASEALGAARGQQTRPYSPH

SEQ ID NO: 1009879 - protein, 235 aa, Homo sapiens
LTISRSEAATGLEVGGSVDLPDCVGPRLKVLPGGCQPVSEGPIPEVLKNYIDAQYYGEIGIEDAPHQCFTVVVRHGAPSNLWVPYHPLQTAWTSACLDRTQVQQAKKSMRPTVKNGTSFDIHYGSWQTTPGYLSQDSVSGALPSSRVRSGLLAPWAGCSNVEDGHGTYWKNVPPKASPRAHHTYHPASLKYRMGTPWGHWGVSPRGAVVTVETTSAAVSPAAFRTNHVHCTGGKA

SEQ ID NO: 1009880 - protein, 93 aa, Homo sapiens
MQFPGKLQNLEFVLFVKLYSMGIASNISILVLCVLMRASVAPPSLSGVSCLKKQQFKSPLRYSVCHQICVSTIFWSCGAILLSVFEVSIVVEQ

SEQ ID NO: 1009881 - protein, 102 aa, Homo sapiens
SLIPPRSIGYRRPGPSLISGVFATVKNLNRAGPCEVEDPIMEKWEHGLQSGLLQTEPCDGYVMSSPEGMKHPHPFKVTPWEFNTDTHIPSKTFYFVSTVPSS

SEQ ID NO: 1009882 - protein, 243 aa, Homo sapiens
PFGPPSWISVDPRPRVTRGRHSGLKDQGGGGPSHCTMLSTVHTWCCSMLLPVKLTQGAQQGSDPGTPVASACPPPGVPYSQQTPGTHLVALCLLSETSLLHDSMGAISCWPNGHGALGSASRAQPQLAYKDPWNDIQYMVTLTRATVCHTGGNAWVLPMVQNSFIHYDTGPGSTNDPWRQRSHRRVSPPPFYNVRCPVRMTIHGITKGPQKCARRAAGLGGHPRLGLLGDCPTKTWLRAVPEA

SEQ ID NO: 1009883 - protein, 173 aa, Homo sapiens
PSDDMHSSCDSPPETWPRWDGARRRSKSREKESTGMNVTLIYSGSFSGIYAYGLRKRPLVAIQAGEPLPCIKGYDVIAQAQSGTGKTATVWPPKNLIKILASTIDITIYKSRPQCPFFGDPYAPKKTPSKNLRSRAQGYQKCGSLARRRLTIGGRPFLVPKPPGAPGYSRVCP

SEQ ID NO: 1009884 - protein, 211 aa, Homo sapiens
YGNATRAGPAAVRRRGDDGGGWGTSGSESGCGPPAHSRLRLGLPGLGSYREPAALRTSPPYELAAELPRQNQEERSSHPRSSQDELNEINQFLGPVEKFFTEEVDSRKIDQEGKIPDETLEKLKSLGLFGLQVPEEYGGLGFSSKQPMVLTTGEIISMDWVHHCDPGQRTRAIGLKGGSFFVPWQPELSRKAKYLPKLASGEHIAAFCLTG

SEQ ID NO: 1009885 - protein, 98 aa, Homo sapiens
KGWTSAGQAGVWQLLSSSGLRSPSDSCLVLYRELLNPNGHPLLNQGGAAAEVCSEVPQVAPGSARPGQPPLPPSQEPGPQGHTSQQVLIDPRVPGAGP

SEQ ID NO: 1009886 - protein, 131 aa, Homo sapiens
MDIATQASAAGAARRQFESQRASDASRAEPPAVDMGQNDLMGTAEDFADQFLLITKQYLPHVALPLSDQHRSWSDGIRMMVPDGDEQRDYIDTTWNCGYLLDLDPSYFLNIAWDSCLDDVTGCRDRNYTCR

SEQ ID NO: 1009887 - protein, 72 aa, Homo sapiens
NQVEESTLPLAGNWSHRCEPPWILDQYFSLHLAGISSIYRGHQFRSTSELVKYNNLPCPYTQSTKNAPVVSF

SEQ ID NO: 1009888 - protein, 242 aa, Homo sapiens
MFDQRSPRVRREDDPDQCVRTSTPQPCTVAIQDCAIPVRLWAYHWHREWTPVTGSPTTVPIYEGYALPHAILRLDLTGRELTDYLMKILTERGYRFTTTAETGNAVRVTYKEKPVLRASLERFETRDDGHGCISQLRPLREETTRLYCTARVHHPLASGVGSVALRHSSQSFLPGHGVLWDPLKASFNSVMKLDVDIRQQTYYAHTQDGLCWRTTDACTRGHCRGGMQQGDHVSLCTPCLNV

SEQ ID NO: 1009889 - protein, 109 aa, Homo sapiens
DIVDPRLASETEPTCPFCNQRGILDVKMDRARNTGDHLLYRVPRGIPDAHNVSVRTLWMCTVIWIDCLRMRAISSDTERTLPLSSPDVLWIQLFGSGPETFQGIQDVGT

SEQ ID NO: 1009890 - protein, 207 aa, Homo sapiens
MAVILAPKRPADAVRRLHEALDMNKLSGGGCGAGLWCVNVCVPCLGGEWMWTLPLGAYVNKPMRGWLHPNCQSHGDPLVSYLVRYMGCVEVLQSMRALDFNSRTQDHQEAISLVCEAVPGAKGATKDGESPCSLAAQLYPGEEKLKYAGMPNHSHRVHQTGLNVMGGEVPDQNHRQASSMQIYTHSAIRTGDPEQRASMSAYVGKRP

SEQ ID NO: 1009891 - protein, 110 aa, Homo sapiens
ECTPRVDTSTTPAISTDHKDLEHYAIIRRMSWSPRHSSKPPYSEPSWASQANYLGNDHIYNVYRHSPCIVIIFVHSNTHHNRRLMATDKSPNNLCAPDIVLFPRINNISF

SEQ ID NO: 1009892 - protein, 248 aa, Homo sapiens
MRLPIYSIIQPHYSTPYEVNHPSCLHFTLPRIHCTLFDAPRYTYLRTQRPFRQHRYAHGHDPIFRKTPPRYMTRHVVPEQGLEWRPTERDFNGIDPQGPFFQTPGPGTLTRCPDKRVPSPFFQAPRYAYPFTTHKTPGLNIHTYKHHNLQLPTYTLQNTQPHHSHPPLIAETLLTTPFSETQPQRYTLRSHTLTHTLPSTHPLTTTHTAIHTLHNATSTLYYHGLYTLPTNRNAPINRLGLYNIHTSD

SEQ ID NO: 1009893 - protein, 73 aa, Homo sapiens
HVYRIPRVIGIVDQVSGLSGSRSRKIWPVGFYSLAVHLVYPYPCLRRLRTSRLETKRASLAGWPSMPQSSLSR

SEQ ID NO: 1009894 - protein, 261 aa, Homo sapiens
LRLPAFGCVIPGEVSQGGLPGVPLSAHRSPVWPLGLEKLPLRQPGPEKGALDLLRSRPYPSLGPEKLGPCDLGLLSQEGECVHTCSGLWGASGWVRVPLLVQQLTYQTPALCSLRALSGLLLHKKALEHKGTSLVGWGAEAERPCGGTASLNLGAGAGGQLQDNPGYLLFAMRVFLAALHPSLSDSLGTPVAHKGVPNHASQVPSEGWALRSRGLKTVLELKLGGVAGPGTGQPGVHGKATCRIQAAPTLEIVCFSCRFSS

SEQ ID NO: 1009895 - protein, 165 aa, Homo sapiens
IVDPRRRIQMADDAVCSGVGPGVPCVALWMGNRGGFRGGFGSGIRWAGVAAVYGAGADGLWSSRRQGPRIRSGCPVTKLGRLVKDHEDQVPGGRSISSTLPIKESRDHLIFFLGGLSQGGGVLEELCQLQKPDPVPDEEQPGVQGHMVAIRGNYKGATVGTLGDG

SEQ ID NO: 1009896 - protein, 35 aa, Homo sapiens
MISSTTRSPTRRPAPAPSPGTRSPPLTERSRPVAL

SEQ ID NO: 1009897 - protein, 264 aa, Homo sapiens
KAIVDHGVGGPHECGSRNCSRSAWRSSSSEQLQKHAPCTLSTRNSDDHLTRQHEVQLQKHLKHAAGDAGMPMQLAGDAGSQMLCSMELEHQRHLGACYAVWKSWRKQRLEQQLAHSCGKQGEEQMRVAIAQQLRVQPEGSRKFLLSKVNRRPQTQGGPQPILFPEYPKLPGEPHHGFFGARVPHPARACTPWDRHPLRYKLAFCPGALRQVGRRLFPSSVNNMPYETPDFETEPYKRLIQQKGGLMRKEASPTPCARRELRPVS

SEQ ID NO: 1009898 - protein, 114 aa, Homo sapiens
NKFTGTLVVNAGGARNLEASRKPSSFLIWEVGPDAGPPPPPCAPSLSCLSFSWGSRGSGEACIPRGARPESRTRECNQRASEQGPGAQVATSHADLPPGIPWPQYPKDLGTLLY

SEQ ID NO: 1009899 - protein, 88 aa, Homo sapiens
LAFVFLSCLELPALEHQTPSSSGFELLDLHQRLATWSQAFNYRLKDTLLASLLLRFWDSDWLPCLLSLQLAYRGTSPCDHDISKNFVH

SEQ ID NO: 1009900 - protein, 108 aa, Homo sapiens
MSSPKSPYKPATYTHQRLDPPAPHLESLTNRRLSTMNPPSPMICNPVGAYLEYVKPSYCIAYYTVNADTANTVISGHGFQRCGAFSEYHSEKLYGSCVISAVNCPHHS

SEQ ID NO: 1009901 - protein, 97 aa, Homo sapiens
GYVTSVGSSVRDTWLGGSSLPSAAQDVRRLRRTNLPRPSLRKPGASPPSASPGKLSLKRGEEGHMDIDRGGSPGAEEPEPGVSETCLDNGKSYDGKN

SEQ ID NO: 1009902 - protein, 108 aa, Homo sapiens
MGVVHVPCGLRTEEECRRTLQGLRTRERVLMLIRRGALSPAVMLGVSECEWLDAGYGEPEAFMGLCIPFVAGPSSALTSRARTGPHMVSALVPCRALVVGDGAGRKWV

SEQ ID NO: 1009903 - protein, 294 aa, Homo sapiens
FGYLPRVDIVDPGARLVRSWLGAVRCNPWRNAPTETTIILGTYSEGFGMRGSPTCFDQLFDDGIGPLRGAEWQQRTMKKRSRTGGGVGGPGANERSSGLWPRPNSNRWTWQTCLRNGVPEKTAQNPHGPQAYGGGLTRNEETQAARGRLQKEGNTDELEEGPDQQLQGEGTNTSLARPERRPPRERRFRTAHLKAHGLTGRRHVTVDDPHYFDPNLITSARVLVLEKQSEVWPDARGNGAAATHGSFEYLGGQTRALRIGPLVDTWLASFLMPPLPRDHSAHHAHTVGGSGSTT

SEQ ID NO: 1009904 - protein, 106 aa, Homo sapiens
MRQPAQERPERRHILPILQPSKAPFTLLIANKLHSTTNLGSLNILLPHLTAQRTNQTPAAQPLNVVAYHKELYIAKDTVLPDSIMNSLTHTVEARIGWVSSYCGSL

SEQ ID NO: 1009905 - protein, 41 aa, Homo sapiens
ALVPAEGMMGSILPGKVNSRVYPTRANNKFLMCNTIITENM

SEQ ID NO: 1009906 - protein, 247 aa, Homo sapiens
LEDYPGVIDIVEPALRTFPRAAGCVIAILGKQMFSLLWRTWRGRTPFNTPHLTAGARWSRGTSDKQHPQGTHRNQPPTATRQNVADRRPMEEYSCRIRLRRSINALMMDKREGLQKEAETDHTPDCRYRLDTQAHNADKTRRDTTNTYKGNTTTDTSDTAHTEAGERKPLAPNHGEREDHPERYTPYDAKRTTCHRDPSPTAAIMQPSIHSKPPNNKAPYASRPHILTTAEKKKLTQYNRRSNPTPT

SEQ ID NO: 1009907 - protein, 99 aa, Homo sapiens
TRREKKECCGTRQENGRDAPANGNANEENMGSSECVTTEVDEEEEEGGEEEEEEEEGDGEEEDGDEDEEAESSYGQSGQLNDDEDDDVDTKKQNTDEDD

SEQ ID NO: 1009908 - protein, 150 aa, Homo sapiens
MNIPHTERRGGHEHMSVESVDVVAMTMVDRGDGTRQQQNTKTSTEALAQDESGDGWDRSVAYPKHWWYNRENSRFIHAPGCAYIMDATQQAKWDRDLIKGTGPLTGMDLPKNDPILQYTREGCDYPGLAGLNKTGNQNSIPKNGWINHWR

SEQ ID NO: 1009909 - protein, 115 aa, Homo sapiens
GDRASLGRPGWECRGVVSAHCKAPPSGFTPFSCLGLPSGWDYRLLPPRLADFWYLGGDGVSPCGPGGSGSPDLVIHCASVSRGCWDCRLEPPCPATAIVQIDSSRGKFNTPIRNR

SEQ ID NO: 1009910 - protein, 220 aa, Homo sapiens
MGARASGGPLARAGLLLLLLLLLLLGLLAPGAQGARGRGGAEKNSYRRTVNTFSQSVSSLFGEDNVRAAQKFLARLTEETSCWELDYCRARPPDGQRHRTRNLHGIVPTRTSNQSYQTLTPRINNTHRNIQRLQTSTGPRARHTGLEQGRKKHTPETITRQTEDTKNTHENNKKTKTTTREKDGKNRTQPKHTENTKDDKTPEQRTETQKEYTSSIEKLQ

SEQ ID NO: 1009911 - protein, 104 aa, Homo sapiens
EPTHLLKGTPTNDTHTYGWQGGPQEPPKYHSVCGRRPKERDELGPSHLSSPVLLDGSLIACMSLVTCSALTMDQTQSDPVPDQALAATSDRCWLAPSLLIAVTK

SEQ ID NO: 1009912 - protein, 247 aa, Homo sapiens
EEEEWGAVTNPQNATRQQTAGVGGLHPQLLTRAPVPPRFLLSKTLLHIAFSQSQGIHDVQRSLSGQKVVQTHSTAHDQIACDLVVEDPRHNKKQKLVDMRSTASIKITTEEKTEPRSLLRGTRTVAGIRRQGETVTKENKKRHKKIMKEWKVEPAQERKKRNKTETPIAKHHNTREDPTHQAQGNLQKEKTTRSQKQQKDNQNKTRRKQKKKNTTQTNKTKNTKPQKQEPTRTRPKHKTTRKRHTKA

SEQ ID NO: 1009913 - protein, 139 aa, Homo sapiens
KKSKDTVSEDTIRLIEKQISQRPMTQGRTDRHLAGRPENSWMKVHGASNTPEPSFCWIPWGGTLGLLSLPHLQQKTVHQADRSLCLVRPRPSRGNTQTCIILYHCLLTLGPVGWLLRKYLLLAEGLYSGISIDLMLPRD

SEQ ID NO: 1009914 - protein, 446 aa, Homo sapiens
DTGDEQYGDGSRTWIYSIAMETEMRLVLSGAANTQTNDLWTTKGTSDIARIVTRLEAVKEAIMDSCLLSARYKKAISEFRLRHSGVSDDHGCVASSAFPIAGGDITYYRHQRPPEAARKAMASSPLVRIRRSLIGPERTSSSSPLWRTAIRDDGDGKVRFLALRARGGPITPRRINEVERGERCDYSKGGNPSRTDTGCQSSREIHPLKGNADKKKQLCRLDRRGKRLCAKFPYEKRCNFYFAFYALKTIKPVDCVPADVRAKGSRIPAGNRTLYQGNLPSRLRGIDLRGFLIGPNNGGSNNGWENLITPRESGLTKRIGSGRNPTTGTYHGRFGQRKEKHFFPPENNRCVQIYRAQTFVATRGLPLPRRRIPPWKSPNIGRTEPNGVPRALLAKLTLWNPPGCGAGPWQRKLGGTLRGIAPSSCCQGRRNIVAQPQSLPQVGPPN

SEQ ID NO: 1009915 - protein, 108 aa, Homo sapiens
MSKSTSVMAAEVWPPFARLKDADSPNFRPSPMRLAGHRLKHHMELLLFLPSPSKANNINDEHVSALRLTYNYPMERGPNSPKIFTNTNQKTMSFTNLGGITIKGTHPL

SEQ ID NO: 1009916 - protein, 197 aa, Homo sapiens
ALDITTERLTAAGALDSDRVQRRCESVDAKGLRSQERSFGGWQAKGVIRPCPDPGCILQHPAMPSPDVVYGALPPPGCDPSGLGEALPPRAAHLPSDQQTTKPGPQDWCTTRLLTKHKLTSKTTSPPVPDRRKGGGQTCLSGHGWDPRGDQNTSKGSYSWPCRRPLLPLQTPREPTAGELHTYADKEEKQKTTGRGA

SEQ ID NO: 1009917 - protein, 128 aa, Homo sapiens
MSKSRLMYRTKGVHTIEQTCVALRSSTCTKNAEPLEVCTVTTRYKRLNKGHQVAGSDFQGFPLWTLATVTAHGSGDESVGTWGVTPWNRRDRHALCTGQGRGHTRRHNVALTGSAKTNAIGLSHQSNT

SEQ ID NO: 1009918 - protein, 195 aa, Homo sapiens
WQSLKRALKNIVFSLKSCGCPTRGRAGAIKRSTGSPAARARPGAALRGPPSAAGGGHGLQKALGAVAAASERLSVALEPGRGGAGPNAAEDNKAENRGGPGGVQQGEARRDRAAEKEAVDERMVPRAEDKSIAPTQGTGGTAEPAAKEHGRCERQANPKEGGNTRGPANNKTETKAVKTNKPNPTQQPTDEQTEK

SEQ ID NO: 1009919 - protein, 167 aa, Homo sapiens
GVRQAEEARRPPFTRPCPFSLAVLHCSADPPVVADDENEAISFCHIDFCVTMEGLGVASHLTKTGRSAPSRAWSMLHACRSSTPALQYRRTTSCSQGTRGTAVVLSVPPSVCTGQLPCALFVAGGTKPYAQNVSIIDLYIPTSSYSPSNRYDSYTGTKRYPTQDSCT

SEQ ID NO: 1009920 - protein, 313 aa, Homo sapiens
PNDLDLIIGSKLMGTLTIEKIITCQGPLGKLTGDRRGLGGWPPNLDPSEQRLSTVVPGHSGSGKGETLLGPGAIECMPCLAPHSRASIRSPALARSLGHRLFYLWGRLKQMVIQFRSKQKSGRSPIWPGLNKSGSLHRPMGLPYGPVPSWSTKCTLSHHLHPRCLTGSPGVVLGPEGEGNVTTDGSLGPQKVPGNQRVTEGMDLIGPGQQALYGAIGPTPCHGPGDISLVQRLGAHTPIFGGTTPWRHKLEVSRENLWGHTLWPLGNPGKGWESNSEKKSIGIAPPEDNGAPGMGSGISDDSKDFLQILDSTG

SEQ ID NO: 1009921 - protein, 351 aa, Homo sapiens
MLVRPNLTLVSLVVSRSGFESRIDNEHGYECTVTIHSCEDYLLRIVLGSYCACWLEIRPHKDVRKYIEWTNSDGRIEDMRTEWFHIPCMLYVWGIFGASARSDLNELSLIVRLIVHKFESNIMRYTGHLSIMCLHYSDNVWYPSEYINWYVIYPFQIYHKTMEAQDASIGHQTIVCIDIRTLYVLLARDMIIAMEIESSPYLYKLQFTEGKCGDHVTARDGSARIDAFAILLCLCDQAKGCGAWIGIIPKSVYHIRTQFDFFYHHTTCLESPPNYDVRKPAIKRIKGDGKVTMYEGGVPLCVYKQDGATRVIIVGGQMIPCKNEFGGHLDILAMLETTRGIRKFVCLDAEV

SEQ ID NO: 1009922 - protein, 157 aa, Homo sapiens
LSKLLWKKKPSRGVLDPFYKKAVSHTIGVLWTPLTTGAERDCSLSTNLKLPRVHQGSELGSKLWATNGPGHDVVGSQQSAYRRQICEISTLVPWAEENTKKLRGAPNMEIGHKHYSVKITVSEACRKRRIAPAACEEKPHNQENSPRNRGIHMEKRS

SEQ ID NO: 1009923 - protein, 121 aa, Homo sapiens
LVNRTVAMGRVIPCDSRKGAGSVFRTQSDMQPYKGVCVAVRAPRDFGVENGTRGTFTGGIIEVYIIQRSPEPGKESRAIAEGWDLPWKSDIGSKQAVQRRLVQLPARRDNSQRGQVNDVLD

SEQ ID NO: 1009924 - protein, 100 aa, Homo sapiens
GRAPGRVAPARPGLRIARGALRAPLAALPPRGDPWRAEEDMARRPCRVSLAAGPCIEQLGLAWEQTWRTTGVQQQLELERERLQAGNPQKELKLKEGDEN

SEQ ID NO: 1009925 - protein, 220 aa, Homo sapiens
AASGARDGKSRFARFRLVWKNSKKAGKGVGDGTTLYAGVYEDRRETSDDVSERVGHGTDYSVAASEETSCNENSTGIYRTYKSKDMWNVKYAREANPAYCKDFVTKFHSMQTGSIDTVRRVGRWIGNTEREAHILAGLGTQMGDESSQLVSRSNRELFSCISKAIRGGLKSDGRKRQLNNRSRRYSFIAINVHRVPKRGTKSGFSKGQVIKVETHEEEKG

SEQ ID NO: 1009926 - protein, 119 aa, Homo sapiens
WLYGPFIFHVFRYIGIYEITPFTIGNYFTRTLDQTLHRVIRMVIPREFNASNPAKNFGHNLFQLGYLMVLRSFHQPWICGPNKGLGWLGWTDYGRQRTAILQIFGQSWLGLQFIKRYPS

SEQ ID NO: 1009927 - protein, 256 aa, Homo sapiens
GASGCYRPDPQEQENVQYAGLDFDSNPAADWQPSKYKTQVPMVVMPHGGPHSSFESHAWMLFPGHAFAKMVLCRYVRSEAIVASTGFGLDSILSLPGNVGHQDVTDVQSRSGNRLLQEEHCCCKPCGPYGVVPMVAIISVPLDGSGPRDLQGLRGPEARDQKIGSMLGSTDIPELVRGGGWRCLVSSDVPAMTVSVWAEMLDKIAHQIHPSGEDDHVLLMQGQEDRRVPFKAGAMEYYRALKTRNVPVRLLLYSKS

SEQ ID NO: 1009928 - protein, 103 aa, Homo sapiens
MTSQGSRQILPPQPPDVRWGPPVLFATIAQLIGCIGFAQETRASAMCFAPGCGLLNSPWNSQGQLHAVPWGPPKKVRGDLTGCSTHVVSYSLFFTYSLAWVVP

SEQ ID NO: 1009929 - protein, 416 aa, Homo sapiens
GRVGILDDGGRGTPCAYLSGFLDPTSTDMQLSGRQSTPPDRDGIPCLTNVFARRYCAWVGPPVSGIVLLESSSSRDHRLAKDMVGTINTVGRAPVEQHAGAGDSTKDTIACEGGGSLRVVTSRARTPLRSGSSREASQEHLGPNIGVERQGIRVHRILLEAATHHLVPQKEAAITFLDPMGDAGLWKRHVRQLGARTGTEHRSVMVVKYTVKVGHGEVGVPMKVLARPQGTLQRGPLPVDYGAQNGQDHMRRGGYSDVEGRHQRQGGHGDGSVPRSKGVLHTRWANPRARASVAGRGRKNPLAEPKARPRGFRKRGSRKRQTLGAQMALVAPFVYTVAYEWGALAWMEKYWFLLAAGYCVRWGFNSIGRRKRTTPLPKSAGCVPWGDYGFVGPETRRTPYLGAPHHTPSMQAGEPS

SEQ ID NO: 1009930 - protein, 146 aa, Homo sapiens
MSRSAVFFILPGTQMYILNVAILLSTSRDSHVNNRFLETGGPLQDESIFCTLDCASIDRLVVEEIKEGTMTAKYGGYNSSEEKLGPSMKRHVRPRNGSEGTAEAALGRNPDFKMALSELIPLKVASKSHNEPKWGRVKSQSEEEGR

SEQ ID NO: 1009931 - protein, 245 aa, Homo sapiens
KYIPFYYKAGLPNLFTGYTSRVENIQATVDGGWDPLRGYPDEEALGVEIQDAVFRAEGWSHVPCLPLTNVLLTLSKPLNFLVLLLVGKRGQRGGSADKGPNYTLTELSTKPWHTDRLSPGCHSQHKCLVDAYVVAVGRCGAPRGCGPQETRCSKEAVTTEAGDKKPISLTGHSCLTPGKSGEDHESTQTKADPNDGGTHYRATQREDVNIGKWGTPWGYPKMGQKPGKLITTQGEHQANTPKSGH

SEQ ID NO: 1009932 - protein, 104 aa, Homo sapiens
MIYYKHFNERGIIDGKETELYKRNSNQKILKAKKVQYSKNSTDTQKTNKVKPTARRDDYSDKEPDHKGSPHRTQTRTNRASTNRQETSKRPPSISARSVDINRT

SEQ ID NO: 1009933 - protein, 451 aa, Homo sapiens
MRTRRSVKSSLCSVARQLVWTQGKSVMVVRLIGIALDKADPEGPRHLSLILRTTNRSPSNATNLLAAGGARRWRTERSTINDYEPHIRVIGKKRLTISSGSDAPTIHAAWSRCEDAEGVSRVNIPGAHRDRGHMVVRRLRQVGASCIRHIVVVAHMRRLLQAAQVHGWLASGRGALLSRGPMCAIADGRSRSRGGGQGSGRREGHKAVGPPRAPHFGKVKVFNCDRKNDRRLGSLRNGLDTVDAAGYSDTLTEGQPIWNSCSNTPWLYGGNLVRVRDEIGICGITCEERAEGGEKIFGRALVDVNRYIWICSDLGAIMGSNTKEIAQITGGQRYEATRNRGVKGGTYLVEDRQGPLGGPLVGRARSWEWGEEKHRSHREAHHPRQFGLAMATEEGSNQRVAEAFARTRKKGESKDSIGHPEPDEDNLHQKYKTDSLSKASLKNHNEPRSEG

SEQ ID NO: 1009934 - protein, 214 aa, Homo sapiens
MLLFLVMQVQRYRCQCTAVEMYCNGCWDFSRRLLIVGLKSQCSYGQHQVMCTPVTGNKGHWKHYPENALPTPKDYACPHSRMRRSVVCRENGRGCLKLWTWRQHFPHCDVGGEKHVSETERHFPRQVTPCVIVQKGSVYTFGELLCAGPKEVDLSTVKKHVPKAQETTVRSGWIVQETQIETNQGEREITSDGKTRRNLLTSERHFWRHHGTYT

SEQ ID NO: 1009935 - protein, 70 aa, Homo sapiens
KDVGMPIAMLACTTDGAHETSPRGDGRLFSNYLIDYTTQRAVEEDIEFVCYDICHIILHAGIPKSDRQQI

SEQ ID NO: 1009936 - protein, 281 aa, Homo sapiens
MDLEEKKSRVGQKALRVQSRRAILPYSRWGSRGKVGESPERGVTYVQVIQEHTSATRLHLLPSTVVPEVSTAQYTEGPTCVTEHHPEGCPLSGAPPCVGWDIRVLADSAQLVQHNKRPQGRHHSAAQQQTTKYSQQKNTTGQQTKETSGATQTAPRGHITTKKQLQQQSEEAADKNNNRHTHQNIAAPQAHSNNYTNTKATTLLATPAHTHNNTRRHAPTTEHHPKRETEQHHHQTKQHNTHHTIETKTTSKNNNNTHTLRNKAIETRERADNTQEKRQAP

SEQ ID NO: 1009937 - protein, 274 aa, Homo sapiens
MVLLCEQLWKKRIETETPMGPQYNARLELVHMRMEASGVKWHENAWFHSHQPRGGDRQEIDLMLPFDDAHLGGYVLVSQGGTRFDLQARWAEFVGPGYHSKAVTRTNWDNILNPQFRPYVLQGMSRCYVSALFMRDSLDENGVTYAGPQALMRTDSLAPVGNRKGISRNGADVLAFVLDIWGQQISNMKPCGISTKIDGGFLEDSGFSYPIGGYPVVRTVRSKGIGTLQCTTRDLTERIEGKKGEVTRELEKKGGVERRLGGGGANARELDPKN

SEQ ID NO: 1009938 - protein, 123 aa, Homo sapiens
MQSSWSEKLRSTRMLAAHVLRGYYTFAFRVVFNKEWFPWILGFFIKNKKLKTEEGGGATGFSKGILSYLEGVATREVHGGRHELLMRPQGVGPIKEEIDHKDRIREAERRTVAKNVRGARGNT

SEQ ID NO: 1009939 - protein, 162 aa, Homo sapiens
MERSVRRAECVNVLDTYRTGMRTLVEAGMPLTPNCDTTGALSVEQLTSSSAGLRDCRATRSFWQTRNRPTPRKLFKRILRAAHGTCSRRKAFKSLRHTAATGDRTEMEFTEAESNMNDLVSEYQQYQDATARRIKGSCEEEEGEDEALKTSRDQIVHPLVNF

SEQ ID NO: 1009940 - protein, 69 aa, Homo sapiens
SDVGHTVITYIKLLNRESLTGVANFFRALMSGRTENPFAYTEESNSGVNRVHPVKFIYNISNQGFGINL

SEQ ID NO: 1009941 - protein, 149 aa, Homo sapiens
VTYLPCVTWLPRVTRVCKYCVGPRRYTGCCGGRVTAPDKSTRCHMRCAIAHTMCWVLDTITFSRRGPLDTWSTRVATVLGSDAYCEDRDDLTSAASYLASSNSGLMCMDKVTSMLTRAKDGGHNQRICVTRMMREFLSIGDRAIAARES

SEQ ID NO: 1009942 - protein, 111 aa, Homo sapiens
VFPFLPVPSFLSPSSFVFSSIFFSSHLLLFLSLDSHVFHYLFFLNKLLGVLRLLFLYLLISYMRILSLRRFALRALSSLVSRCVWLPVEILPFPVAYLCFYCIIWSVYQLS

SEQ ID NO: 1009943 - protein, 128 aa, Homo sapiens
MSRAYVLPFWSEPDMLHLAVVWGPLLAITISLYIMILVSFDIELQSSVAAHTPWGISDYMGLSGSVKRDGTPNTSSISSEGNSDVQTNFNERIRGLFGYMARSGFAQKGKDTRVDDSSSRITPGHHGH

SEQ ID NO: 1009944 - protein, 104 aa, Homo sapiens
LEDDDITHVEGSVDPIRDDRINTVKSFSVKDEEMIGPIIDETRRGGCEEEEIKNYEPEICYNVLSIILGYDLKKPVRFYHDWNDEEIEVLNKQLFLTCKDQVVY

SEQ ID NO: 1009945 - protein, 372 aa, Homo sapiens
FFCFFVFSLLFFALCLLVFLACLFAFVRLSVLCRGVLCPFFFLPLLFSSSALFFFLVIRLSPSVSSLLSSSSMSVPPVVVLVPFLVVLLFPSLCFLAPLSPFFCLSLSALRSSRLPLAPSCPLWFLLPPAVAPAVLFPLLSWFPLWLILFFLWLASVFFAPLCPCLLAVSLFLPLYFSLRPLSIVGLVSSLVSLDVLLLPVSLVFSYSQSPLLLLCILFLFLFCCPCSWHAFVYSWTFLCVDMSLGHDLYVVLSDEYFWVYLCMLLYRVLSGMVPGSSLSVRRSFVCFSLPAGIHQCLCFSVSPRPATLVWREGSRLCAVGVALCILSQWSDHPVPPLLPLFAPVWLVRRDVREIGPPDLPSCLSLHYTGSS

SEQ ID NO: 1009946 - protein, 351 aa, Homo sapiens
MAEVQVLVLDGRRSSPGARLDETISGLKQCTCWSRECVDEYVQLMNWRSEQLFWRNLSQHDKHTFDTLPCDLVTSAVMRYDTSHSARYSDGPPYSRFLVLHASTANRYCERDPDDRRAIACLATKKSHSADVPRDADIVRTQYLEVCFIELGFATSSNSVTAHNTSAGHLRCAMPLVLTRLLVTPWRVHRRRNQTDDVFGTYILGGGPSVFDGKGFGPGQRLRTCTVDLRARPCGRTNGNTEGRGANEVQGNAENRKNGVRSLKRLREHYWATSNETVWRSKDLDQYHMECRSSNPMGTPWFVEAQIRELSDSVMAIGLALLAFVAPGKWYGDPGGSKASTGCHKAGLGDS

SEQ ID NO: 1009947 - protein, 131 aa, Homo sapiens
MYSGRYSSGVFFGMYGFHDSSASFISVRCLSGFRLFFLPRLIHWFPDSITPVLIVPRSTRMKFLIQVELPELFYLDELSQSHKVPLARSPYVYLIGHGRYAMQAESVTEGVRSPNMHLYIPQGIAFLFYVF

SEQ ID NO: 1009948 - protein, 286 aa, Homo sapiens
RTSPEHSACNSDLGVKLWRCARDVGPHRYLEVEIHPLKNEEQKHRRKIVGTSSQRQMRISAEEARFHSPGISRLPSGGVLLLLHCYLLTNSGVSSSHSIMPCSRPVGVTVNVEGIDYSDDVYLMSIIWTVDDINGDQDRKDVIVALNMNTRRGSKQIVRPNPVVDGYAIKHHTCDTVYGRSADVEGHKRGSESLMGRKTLDGTIRTVDIRWKVDDYGTQHAPKKGQMKSKALCRPCNDLGWVKNEQGNIGVAGTTDRVQREEKKCDGIRKDRKAIQAGKLRIHTVE

SEQ ID NO: 1009949 - protein, 105 aa, Homo sapiens
WFSFSQYPCSSAVFLACFCWALCSRLNQCLGLLCLCGLYIGVLVFLLQFIRPLYLSVSIHNSSDFHMSYEILFLLMPWAIFLVLDFGCHSSKLYCCYLNLYSLLL

SEQ ID NO: 1009950 - protein, 101 aa, Homo sapiens
LYVLALNDAYLTEGQRETIYCYYKLDSPSSISDDITEVIAIRLVRHTSISSLESSQRHTILPSLYACVVDARSYATTNDHYDLQMRISGTADDDMSIHTLV

SEQ ID NO: 1009951 - protein, 112 aa, Homo sapiens
MTILDAPSTPTTHSNESRYSIKSRQEKDGIEPPSKSRYSKPRTPDGPPWTCLQENKNKTRRGADIVEVFALLEGLTMVFTAVPQVFSVVLRNVVVVPYISMVGHCALCIHMR

SEQ ID NO: 1009952 - protein, 67 aa, Homo sapiens
LNTVLNCHLMSGIKNMCGICVYVYELYSTVINRYFSKRQSQYTVLDYLARMVLYTVCMLIFSSLNPN

SEQ ID NO: 1009953 - protein, 164 aa, Homo sapiens
ARCPLSVPSLSSLSRVGSVSGSRVAVTAVCRCSCLLLVVRLSSVCLHLLCLSYSCALVCCLTHSHPFLRCFVFSSLSSFYLCVASALSRVSLSCCARLLSLSITCSLFSASLLGFAGLCSCGVCSCVCAVPASCRAPVAHASDSCSVCVVIVVVSPSLVASVLS

SEQ ID NO: 1009954 - protein, 113 aa, Homo sapiens
MFFLEHNFITPIPEGYTFYQTNKQLPQHLQIILTNKTHSGGRVPNCAGAPRFDNQSIYNYSSIFVLLSTHVKQENKTKLWCWRHNVLVRHVLINNDKIHTRYLIGPYRTVRSY

SEQ ID NO: 1009955 - protein, 76 aa, Homo sapiens
TLLGGLFSASSRSCDLTMRGFSCVPKCVSDTRGEDTMDMVHEPPVRTAEAQSVFGLVKRKGRAKEYSQLVTAGVSE

SEQ ID NO: 1009956 - protein, 345 aa, Homo sapiens
DKTIGGGDDSFKRPSSDETGAGKHVPRAEYVDLVPKQSTCWNDIVTGRPYRQPASTHECIFITETKRKMLTKYTYDPEGTYTRYGEARSLNPLLVGIRDSSKACVMTKVTTGSYTAVIRMEEAQQNVSEMRSADVEFSRDSTPSWREQCTAGNRDLCGSSISESYECERHQTAPKSLVKDIYGNCLAHRCKHHPGDVVPFQRALDKAFWKEAARIGLQSIRNLPPFPWRHVTPNKAAIARRWWHRPRCRGKVRGLGGGVHVWGYIDGRKWYTQAYNCGYGEQSRIFVSGSRVFTENDEATDIRRGYKSSRKRDLGLATKKAHTLKRIGHLKKAPIPGRRAYLDNL

SEQ ID NO: 1009957 - protein, 102 aa, Homo sapiens
MAEGDAKGDKAQVKDETTEKIREVVCYNLLRPKPEPKPKKGPVLKKGEKVTQRAKRDKLMLAKEGNNPAEQWRCQKRPGYRKLKVRGDAKEVCAFLIIVYFW

SEQ ID NO: 1009958 - protein, 246 aa, Homo sapiens
GIGCYSDSKQENVRMLGLTLTHSWCRLAVLQIRPHVPIGGHAPRGAPFILSHCLDAVPSGMLCKMGLSRYVRRGSYRVLQRAFGQDSILSLPGNVGHQDVQGCPALAMGTRCSEAWNTLMQSHVARYGKVPDGALHFRATMIGQYARDTTGPCGGTGTPVIKIGLHVGLHLTSLTGACVEAGLSFQQVYWLTRTSALWADDAGANRPSDTFPQVEDTTVTDVGPGGSACALQARAWSISRALKIRN

SEQ ID NO: 1009959 - protein, 192 aa, Homo sapiens
PTRPIDTPVFELKEALMGKYGEDSKSLIYDLSGPGGELLIPSDYDLTVSLLLGIWQVNKLTKIKRYHIAKVYRRDNPAMTQRSDPGECLTRCDFDIAGNCDPYDALMQSAVKIMCEILEFTFEKATFLVQGKRSTALLDGMFADRDGVYLTASCRYHLLLSRQAGQGVLGKRWKTEIGGRDGPVLPEVARLA

SEQ ID NO: 1009960 - protein, 133 aa, Homo sapiens
MKRKKKLKRKTGVANDTLQLLSVASGLKSQSKRCCVSYTNSPTIQEGAGQVPDKTRKYFRQQRLATNILTGPTCFTCFTNVLGRPADCQLKDTLPELLTLLYDRKLPQGYRSDRSDVLNWDPRVHKHDPSLSK

SEQ ID NO: 1009961 - protein, 196 aa, Homo sapiens
AVGRSDMPLTAGRSMPRHAGPARAAGPCRWHDLAVPPCVYSSSWSCSWELAACVEIRKELKLRELVLRTCVRATTDLGLHALAPEMLAAAVGSSAACLDLLHHAAACELHAHCMCFPDPGWPPTMAPSPLCCGLPHLLGHQPEPLLAGLEKQLAIELKVKQGAENIDPDLQQWQHQGPEAAADSPADVAGPVRPRL

SEQ ID NO: 1009962 - protein, 204 aa, Homo sapiens
ICYPGVRISSTQASHPGARHQTSGGDRRSRKSPSQRATTRLHYHGYHMLPQCTGDPTVATVPATDGHRHPQHPMQHPRFTAYTLLIIRTTWRTEASASPTDHSGYGTGHYPRGRPPPPKHGRNVLGHRGHQQPELVKTQTNITDKEQLTQERTTNPGDHDNHMKREHRCHLGDQLDPWNPQEGGHTTPNSRDLPEHKPDEPESP

SEQ ID NO: 1009963 - protein, 219 aa, Homo sapiens
MAACCVAVYHEGACEGYWPELRQERVMLVSVGQKLWCCGITSSRASCYIWIETQQAFYQVSLLDHGRSCDDCLGWSRPMASASRSKMVMECAIYWCPTVDQRYLVNVLYASELAGVRWPLNPYYGFQAVQGSLLVDLADHLLLGMPFCDSYLISLTSPVCPVQLYDDQEQAKAQTSNGNHGSQLSIARCAVCRPDVATEALGLDHQLRLCARKTSMVVT

SEQ ID NO: 1009964 - protein, 144 aa, Homo sapiens
RHATHGRPREPRGEEHGPGRAGPSCGGWRTTQRTDERRRQEEQQRHRPHPEGLTIHHGDSCPYPVCHRAPEMEPNYGACTLPWWTSVDSCGGIAPAHLLTPWPAAGCDFLCTMQHTGLPALPVPVLLVPGQPLQTQPSLVCALT

SEQ ID NO: 1009965 - protein, 195 aa, Homo sapiens
QAEYRLLGGVYGVSVETHGCSCLLVSRLNAEPKLDYTAAISAHCNLPACFSCLSLRSACNCRRAPPRLTGFRIFVVETGFRVCWPGWSPAPNLRVIRQPRPPEVPGLQSGVVVQLRFAQIGCPMAWTLAVAVESSRGSAVTKPCPQRLPSPALPLWPVPQYVPEICEAPSLVAPGSITPGLGNVSEAGFISLGPM

SEQ ID NO: 1009966 - protein, 155 aa, Homo sapiens
ADLWEHLVRYVQALFQDSYGHVKPHHGSVEGWMHDGHINTVAVSPPWYEHRDGITTTYIPQTVLSDLNACLVLDLLRAGILSLTFGGYAIYIVDCTSVVHYGVGVRRMQQDPARTTLCVEATLNDTVRTQEAGGSQNYRGRRGTVPYYACPLMTC

SEQ ID NO: 1009967 - protein, 106 aa, Homo sapiens
RAGPAAAPAVAAVNDDEVMRNRLIVEEDGAEDDRIIMSDYMQVAFIRVADILSGYPEKKEYIGQLAEKCMDEAALDSRCAVIMSKWAKTFTSIVLMYEFVRRCIWK

SEQ ID NO: 1009968 - protein, 197 aa, Homo sapiens
RAGAGRWAPGGAARSPITRPPEPGARLRASFRPLGEGSGHVPFQSPATLRQVPRAPLEEPELPEEAARVLLRQLWLLRAWLPRGEAGPYKKLEHENPEEHGKKWNDRTDITERPGRKKSSAGTGNPASAQRHDVAQQKGGRKGGAHGRNGAAQPPETTSGQRSPPAPKRKTQEDKKQTAEQPEIRKKKIQGGKDNRT

SEQ ID NO: 1009969 - protein, 79 aa, Homo sapiens
AEWMTRGGGGGDTISKMPDVKGECAPEHSPGDSEGRSCKPETSGPPAGRRRAAYRGAPVPVVFAVTESDREAVNESFQV

SEQ ID NO: 1009970 - protein, 296 aa, Homo sapiens
MRYRSSKVLLLRTEVASCPSGAAHNKHMGEVLTPELYAELRAKSTPSGFTHGQTSSTTGVDKPEATQYNHDQKGCSEAGRPTEYHTEAVAKDSSIRNTSPQTDTDTDRANKAQPDEHRERNVNHRQTVQGRAEQTMEPKLQMLTLAGCARGHSSNPRLNMPSPHDKCKPAGKRTSRSRTHTTEGKHHVTSLGRETQDTEPNTKGRHKGAVQRKSRETQHRQESNDEQKRNCSYKRSKDHRESDHTGLAMETIRGNKEDPDEAGPRNAKEGDFLAATRRNPVKRNRSTGGSRAQTHE

SEQ ID NO: 1009971 - protein, 83 aa, Homo sapiens
MRILGGVIRAIREGGCPVQPGSPGPQAHITPPIGATEHVRRSREVPENSWPQLGLENDLEGQCHKNSMKLLNQGCARNPGSAD

SEQ ID NO: 1009972 - protein, 89 aa, Homo sapiens
MAGRKKRAPGTGRWAVAPIGSPGYFRRRVCRQGPYLSRCKYGSRGGERPWLRGQLSRQQRDMGSHAWLSYYGRGSLVPCSLFGDSAIYA

SEQ ID NO: 1009973 - protein, 289 aa, Homo sapiens
RAHGGGRVYGLGGPDVELHSCVNVHSGAILVDLPRGPRVCDPRRAVCCCFQMADVICLVAQVVQELRHSPVSSSVKGPASRQNDHVAPGLSTCLTCISPSGLYVAGRSCMNAFTCGRSRTGNLLVILSRHYQVLSPAFSSQGTAVHFISAGQWTACGAGLEPLQQCCDGQILSRIPAAPGQSGSHHTLPIRDLLCGFGGPEPGGTSSLDQTVKLWEVSSGGAAASPSSLTCPSWQVTMDLAEHHMFCARAVQGSIFQVGALQRGPDRGERGFHQEQDAVKIFNRAQESR

SEQ ID NO: 1009974 - protein, 35 aa, Homo sapiens
MFALALLTARPSGPYQKYTTRVMLRGYRQAPGSHP

SEQ ID NO: 1009975 - protein, 148 aa, Homo sapiens
MPGVMTAHDKMEYVTHNIVKEERENERRKTILVDYKGLLTKGCSPCDVKQQWVLIAFDPEVVPVTFAVIYKESGGWPSMKHSDQSWLLLPRRYLITGCIGLDIKLNLTSGKAVQRLLDSDNPAPILLTCLMGLEIRLIHANMFRSHPR

SEQ ID NO: 1009976 - protein, 141 aa, Homo sapiens
AGTGASAQQRGKMATAGGGSGADPGSRGRPSAILVFRGVRNSRFVRGETQWRRKIYIPLNKTAPCVRLLNSQVIRLAAESSISGDTGVIHVRRETRRTYSGYRLMAQPPYMVLLESKHFTRDLMEKLNGENQPNCWSCTCP

SEQ ID NO: 1009977 - protein, 45 aa, Homo sapiens
MAQFDAKKSAETQLKKDTPRNREGFTGKRSRKPQAERKEEKQAAA

SEQ ID NO: 1009978 - protein, 142 aa, Homo sapiens
SNVQFPLMTPISLKGQVQAAGDGKKCSLEDLALIEGFAHLLEGPPSQEKYSRTSVWVSSLPGLQFPPVCMTRSPPCQFCGPQRKGKPPVALGRPRLPEMWSCIWWVPKRMTLATGISFPHALFQFAWNTFQVNEELQLSERS

SEQ ID NO: 1009979 - protein, 152 aa, Homo sapiens
MVDRFGPYSHVSQQCCNTGNPRGGPHSTGCTDTKTGIWLKVSRHFPLSWLKEIPGSWHSLTFECQWMGKAHARGAGFCRGLAKLRARYSGTCNDMFVENPRAVVGLPQQAVDSTITKGITPPDVYHQMQVLQKQTVWPPKWLRPPHTGGRES

SEQ ID NO: 1009980 - protein, 118 aa, Homo sapiens
MPVSVFVIDRQRVTLSEEPQFHTMENQARTIGPDRVSYLGLKAVVRNDTAATTEHQQIDLAETRTKKTSRAVHALQRNAIALHMAENTQSCPGVLKASRKSLSSPGAITLRFGLTTCM

SEQ ID NO: 1009981 - protein, 50 aa, Homo sapiens
ELVSVVRLSSREVFVATPRRGGKHEYEGTLETRSRVAPRLVVTSEPRMRR

SEQ ID NO: 1009982 - protein, 147 aa, Homo sapiens
SGVRTAWWPEGSLSAVAGCSVRARTFQSVCPCLLSADGCGPAGRSLGTAPSPLLVPAGHLVPWLIPRLGAFWSPSSSGTLDFWFILRPSSLHSPMSPGSKHVVRVFVIVPFYFFDLKKRGGLGSAGRAQLWVKRIVTSCAGNSQVMQ

SEQ ID NO: 1009983 - protein, 120 aa, Homo sapiens
RVLTWLQILSTSIEMISHREAYSLPTFYGYNIHGVLFSWGSAHRTKSIKSKVPVLDQCVINPRTQFSHIDQSSIDNRGHGFLNVVLVRRESLIRGPQAGKAKIGLTETRGYLEKRQLCVF

SEQ ID NO: 1009984 - protein, 107 aa, Homo sapiens
MILTSTCEITSANRCLRTVVTINSCRDSVRPSERVSGLLTVCCAPGDYTIVASAKCTPCITQKAEGPSSAVRGLAHRLSRGHVSDPEVHWVDVLLEPLVDGSLSLGR

SEQ ID NO: 1009985 - protein, 156 aa, Homo sapiens
SGLSPPAVRGHAQKPLGGDGFPSHARTPAWADCVRSARACAEPEARLPSKRGGAKAGRGPSRAGAGGLSVDSQSRGAGLQCGCGENPKVGGGRRAGPLVGARAAGSLGPEDAGNRGRGPPRGTEGKRCLDRAHPGSKDAGQACLDTSPINNSRGSL

SEQ ID NO: 1009986 - protein, 310 aa, Homo sapiens
MNGHPIVFQSIAIDVREQKSDVITSRRELCIAEFSKTRENNLSTEVIVATMFKDKAGDAEQLRKAIVAIAQKTPRMCPHASIYRAPRLWPNSRTVSTNRRRSLYAWGLRVKRGTGGPGRRGQMVKWKQNPMTGSVRKSEENDRRREKGLAEETRTPQRLGGAVGRGVRRKRSAHRANLCGLGEGSRKEYARWRGGNVARERAPCIAKGGPFNKSVAGNGSTDIAGWEHDKVLWSLEGPRETPGVLSPMEGAPRRVFQGRRGKAHLAMFKTLFIKGILLLAYRENDKGPRNQGQGRMAQRWSSYVNTNLRP

SEQ ID NO: 1009987 - protein, 198 aa, Homo sapiens
MCTAEGDIEPLSEAVTVRNTPERLEAVMKPGPTLTCELQGHYMACRGQESPSLPFYICDVTVRKSPWDLKLTIGGSMTHMVSLGSIAEDQTSCDGHFASWVHNGSKALPVNAEAPTKGSNKSHPCARTSPLRTRRRLTPSVGPNLTCYFFGASIPFKGPFPRWRRSPGIQPPFRHTCQKKVLRQNCLENVKKDYSKGT

SEQ ID NO: 1009988 - protein, 195 aa, Homo sapiens
SGRSRPGGPASGRQWMTRGGGGGDTISQNARRLDGECAPVEYPGGLHEGYGRCHALKCSRSLPMERGNERASDDPPLAVILDRQPVEMKVLPKLRQHTDLRIELADVLTVDTKNGFTVQSTSAKGNRSDGETVALHCLFWDHLQLKQPNHSNSALTFSVVRSLKLRETNALLRGLFANHLRIDHAENRRMMNLSI

SEQ ID NO: 1009989 - protein, 419 aa, Homo sapiens
GTLLAVAVCSSVVSLMASSSCVILKALVTPVSAPGERKMRLSRSSQSSVVGALSSSIGCLENHDAMGCHKLQRIFCLTRMCTCALPGGLMVTTDASAVAIKANMDDVREARCPDAARQYLTSSGPCVFCTRASVTCVGDVSAVVTTTPIPLSVPYLVVSRYPCYIRRETSTHSDWVPLLESRPTERTADTERKSPWAPLYSLVDALPRHVETNSLRGIGTGYLSPRYAPVPSPRGLRQLTGDRGTPKRDFLVSPLVPRALDVLGPLELIALGSGPCEPLWYAFPLNRQFASLARNPQTPKGAHRTSPTTKRNGSPRGFNRKEHSQIRRGFDCGYFVANIVGAKGGLSNAMGARATGMGSLCSRVQQRGTAGPRVLETLSRRGQRGNAVARLHSTLSPFHICRRTQLANRCLQERCLVMS

SEQ ID NO: 1009990 - protein, 107 aa, Homo sapiens
MDPGTDMLPMRIHLGKLLVLCSLTCCTKALSLHCIVGVVTHPSRGATTNHLQGQSLYAQPVPEGATITGPMSHGRATTSCVRTHSHPGIHLLSGETHTPVIQITRRR

SEQ ID NO: 1009991 - protein, 109 aa, Homo sapiens
MSELVSKASHISRGISSRGLGDRGLLTVRDVPPKELQAVVGGAGWANPTLQDDHRNITRKVLSREAGTVHKQEHHPLWLIKERVNGAAFYTVSYCGPAFGSPLFSVLQR

SEQ ID NO: 1009992 - protein, 126 aa, Homo sapiens
MLYLFYHSGFPKVNLHVHTNHYLDMQHFLDRLEISLWMFQGHLKHNMSNRHIDLATEPCSMHLTNGTLGYEHPIHVLNMGKLRGHAGEQLFPNPGHLSSTGLTSKPISSASQLSLPILHCSSNTSM

SEQ ID NO: 1009993 - protein, 302 aa, Homo sapiens
AGRGWRLAAAGGCGAWAVSRPRRRKEPAGCAVVMGLGPVLPVLVWSMLGDGLGQCCVGHVSALGLLGARWVVTGRGLVLLAERRVCACVHWLREDHRWLGLRLAFVNVATVDDHTTLSSETNSLYTNAMGPLNIRRTDLLPSNNSVTLLTPVCTDTWWRFDSEDLSLRLGWQFDADRPWQLQCGIDVRVTLCPQGLATINLLSFQLRFLLSTLAQAFNHKGQAPGVLREFQVSSENTLGTRHANVSHVPHVSPAVRESCHFEKFCLHNYEIFATPSNLGRITAAMDIVWFNTFTSHGRKSLH

SEQ ID NO: 1009994 - protein, 94 aa, Homo sapiens
RDGAAGRRVWSGRDDQAGERSAAPLRCAAAEMGASWSDERSYSDICGGAWRCSAAYYSRVLPGILPQLPSALLLLFAQRLVTCTVWLAAYGSFF

SEQ ID NO: 1009995 - protein, 75 aa, Homo sapiens
NKKNKKKKKKKMAVAQWLMCVIPALWEAEARVLLEARISRLAWATWGDPISPNFIVVLEQPLTVGKGAGCGASCL

SEQ ID NO: 1009996 - protein, 35 aa, Homo sapiens
GIGDSRPPSFHPRVSSSHENLEPETETESVVSLRR

SEQ ID NO: 1009997 - protein, 277 aa, Homo sapiens
MVTVPAMILDGGDGKPVSLGWPGAVVLGYEWSQGQSSGIRAQHDLDDPDMAHGPRFTPSVYPRCQVLETGASESPCMAELLSSTIDLPFYRQRASEFLRTHDAMTAGGCHSEHRQWMFYGGDHCGTLYHSHSGQGPSASSKVRRGHPTVHRSRHRMPTRRVHPKPQRPPMRQSHSTANPHVDRGRAALRLYPGCNRPGKAQRHEAMNQQREETDKHRPLGNSYPNTVTTDTRRETRTHPAAGQCTTRNAAASIHVPPLRSRRTAPATNTRITAKAST

SEQ ID NO: 1009998 - protein, 31 aa, Homo sapiens
MGGYRYTLWIYRSGESTRTEQPPTAQTMVTD

SEQ ID NO: 1009999 - protein, 195 aa, Homo sapiens
MAVWTRATKAGLVELLLRERWVRVVAVLSGESLSLTGDACAAELEPALGPAAAAFNVLPNGGVRGRLCCPGAQATAWGPRSRRRRSGPRGLRPGGVAARCAGCGVGESQEAGRLGAFSAFHGVGRENPDADPQSPKIFPGLAADPSRALRLGRSPFLVGERDRTWPGQPRTRPCRRLKRTGKRPVLEGTSSYPGS

SEQ ID NO: 1010000 - protein, 112 aa, Homo sapiens
MGWKKIWKSAPGTAKCTLALFWWANPNDRKDETLVGRSGALVVSPCYERQVALGGVAVETVYKYTIFPAVVTGDKRAPAIQEKRLGREFRQETQGEKAFKYFLWETSGGDLI

SEQ ID NO: 1010001 - protein, 184 aa, Homo sapiens
MGQPQRDAVQRAKLRVETVTKGMRDMLNSVEAGLYTQGKVLGAVTEQSSQAIHLADTASVATGRAIARPFDSSTPGRTANGPTMGTHPWTAARTKELGNAPVVAKQTGVRQRTDDPKLAGAQKQQYGPQRDSREGVAQAKPKASRGQEKDPVKGDQHAEKDPMREEEGYIMTQKANGPQGPSTH

SEQ ID NO: 1010002 - protein, 163 aa, Homo sapiens
MNTPSSTSKSAQRQGRRVGATRGTRAGSTSTGADKSQSTASKATRPQPTRQERRQSPRRMTQRRKHHQKARPREDKHRDRRERLGRKPPERRAGREKEGTTEAKQTENKTHTTPQQKARRSERNRTKENQQPRAQAREDTIDTARAERRRHRRGQATDKPRQE

SEQ ID NO: 1010003 - protein, 188 aa, Homo sapiens
SGGEACPRVEPPPPPPPPQLQPPRQGLSTLATSVDYQLTVSRYKQSVTARDSLHPVLGAQTLLTALHCWVTLTARCPVAGNVTSPMRAKRRWLALPGGPYLYSLWLHACSMQQLAYHVRCCTPETWRAFPFLTVSARAGVRRTGIGEPVDPSSGPPITRRHNIVGQRPGLPGCNSGRRNSPSCDFPLV

SEQ ID NO: 1010004 - protein, 260 aa, Homo sapiens
RPPWAVDPAFAERYAPDKTSTVLTRHSQPVTPTPLQSRSSIVQAAAGGVPGGGSNNGKTPVCHPVPSKVIRWLATWWRWCHAYQPEEFVCSQCGKVLEEGGFLEEKGAIFCPPCYDVRYAPSCAKCIRRTITARDHCTALNDDPVHVHMLYLCCLQDAHPEQGLLDGGGRARIASETMRTMFRPDNAMGCDFNDRSLVDRFLEALWLQTVHDTCFVCAIVSGSTWNGKTYSAPEKDRPSLQEPCLTLMCEPLLATDCLGG

SEQ ID NO: 1010005 - protein, 145 aa, Homo sapiens
RSGADAPVLAQSPASAGNGRPSTPRVPGSRRHPSAPREPLERSRPHPPGMAEAEEDGAVLILSEQMMSEEKKVLLKQIRRHKLQMCRAQWMFELAPGVNALAILRKSHLAEPATEASRPRGTTRQNTKQDKQEPGKRRKRLENSS

SEQ ID NO: 1010006 - protein, 137 aa, Homo sapiens
MMKNNKKNKNEKDKRETNSKRTTRKKKQKAVRGHPEIRGQDNEYENTSERHEQKEKHEAATSKNNTTTTPNMETKRHENTRRKTKSKAEQKKTPTNKEGKERRKKYIQSDGQDGIKDNHEDKTPEPDDDTTTHKDDT

SEQ ID NO: 1010007 - protein, 360 aa, Homo sapiens
SGRFLGPEENVGRSVVVNVASVSENLAPVFDYRYREKVPPELRHLTSTCYQPMFAHSVVRHHQRCCGRRCASGHGTIIVPRQDQTRAQRKLDQHLAVRVNLTCNWPWHMVVAHVLIAPALSQCNLNGRRHLVFVTRSTNIRIITSLGVESTGGLDVWRCKKTSQETAVQRFLPLTIPRGSTVLPLARHDIVQECTGNDTASGRLRSRTSETSCPAFRKKELKTMRGKALADAPFLPLDRAGEANVQAIDSRQLWEGTGSVESPRPKIRGRHIDLGSGASGGTSQGCFERPVFRLRSLPTGLQEAFAITGSTDPLTLGRVESVRLVPWQDAPIKADFKLPYQWAVKENAIYGQWGFEFRSK

SEQ ID NO: 1010008 - protein, 68 aa, Homo sapiens
RVAGLQGAQESRRDCRAQGGCPRVGGGHERSPRYASLFAAYSVKCSPDPDKYGVLCVPGSVYKKCPGM

SEQ ID NO: 1010009 - protein, 67 aa, Homo sapiens
SGEAFRQSQVSPKPLSLHIAQVPWKIHHELGPRLTPKLQSAQRGPRVIHGAVTLCARKRTSLYVERE

SEQ ID NO: 1010010 - protein, 314 aa, Homo sapiens
MDGRGVGSGRQVWPSESSGSRGIDTGLVWRRTQPLPRLSPIYRSALYPMGHSCVRPSLAKWRGPPIVAAPEPRAARNQGARWHRLWPAKAWQLPPQAHVPTAFQKHPEAVGSQRAQHSRTPRRCEQRYELPAYHIGVIPPIMRAPYHAVTPPTFCDRASRDGPRTSFPERRSPVHRTRTPPCSIRRSHCGHTPLAHTPLEHPQNTRAATHHSLGATTRSPNYYADAPPTPMTPPSLPTATTRGSTNPPRPLTKRAAITPQHHKSHPHHHLAYRHSDSCCFEPTHCDDIGLRDGDKNPSLPYRLSPLHHHDLAHL

SEQ ID NO: 1010011 - protein, 168 aa, Homo sapiens
RALASAPAAGREDWCGLAMDGLQASAGPLRRGRSRRRAKPTATQRVGPGPAPWRSSEDTKKPAAEGVCNPRMCSRLRNARQPVAEQPREGHRRVDVRKRPERTLGVEPAALTPVEGLARRCDRARFPGDGTRPGAEDAHYLGHTPVVCLVTHKVLALVKVPFGTTSHG

SEQ ID NO: 1010012 - protein, 106 aa, Homo sapiens
ASRAASHQNRKKAAGGTIEKDYTRLGNELHTNKRVAEESAIIPSETSVRNKIAGYVTHLMKLNFSRGPVRGISINAAGGGERTERQLCSMTVSACGSGRSVDTLDP

SEQ ID NO: 1010013 - protein, 127 aa, Homo sapiens
MVLGDIRNISCGLDVGQGCKGVGKGYNGSGSAKGGRVSNSVSRHNSTEHKRTEHTYSRRRRPRHARTTGRTGCIATGKRQRAHTLTGEDWDPRIAGTNIRTVNRAAKAGATTRTGTVAPTRAQNNAH

SEQ ID NO: 1010014 - protein, 260 aa, Homo sapiens
PTRQPDPYPGQALMERITGAVAIRCGGTFALGGINAMQLCATSVSERRPTIQGLSPGSTGIAATRILPSRRERRHDARSFMTVLTDFLATHQLLTILIVLASGALLGQIKFGPLRFGAAGALFMGLVVGALDPRFGQNLGMIKGLGVVLFCYTVGLAAGSTFLSDLKRQWGLMLAGVVGLAVMAAAGLGLGRLFGLTPAHVAGLYAGVLTSPAIDAASMATHGAADTLVGYALSYPVGVVVGLIMVAIIAKRCWAAHKDK

SEQ ID NO: 1010015 - protein, 262 aa, Homo sapiens
VRTSHTCISCCFTEVMCSQWAMIMWNEVRNDEGKVIRFHCKLCECSFNDPNAKEMHLKGRRHRLQYKQKSKSRFASRSNSLVFEQERFNEEKMRKQMQKEAVRGARREGKRQRSRRTGPLAARSTDTRTCTWQDDTGREEQHHWRLHRRRMPDGALSSWSSRPIRPSGSPTRHASLSLRGLHPYVVLTHLMTVMNDKNMPPFIQTEEELQAVQKIVLLLNVLYTLAFRTVRLNMRRTRTKKGDDHEQTRGNDRTPSKSEFCR

SEQ ID NO: 1010016 - protein, 245 aa, Homo sapiens
MSGAGHGVGGDLAVIPGEGGQEMCRDRGDEGEGRDGPIGPRATGTRAEVSPGGAISLHGTPWSSRGSPRHPCTAQTYPAHESCWAMASHARNGLHATWPMPMSIRRSTPPNFVRWHRPSQFRRSLLPGNARITGILPFNGGPRGWIQPEMIVRGCAAPACRKGQALTSIQASLLSSSCSDHQVRGHQACKARGAGWSLPGVRRTVQKTACKATWDMTPQAGQKSLLCSRASRRVRRLGPRLRRER

SEQ ID NO: 1010017 - protein, 74 aa, Homo sapiens
GSSSHSSGSICAKEETDEIKELNKKEAVGDLLDAFNGGEPWQYAEVERSSILQVSNPGPESEGSGVPPRPEERR

SEQ ID NO: 1010018 - protein, 280 aa, Homo sapiens
SGGRARRGARRFSAAACRRGAECCGREWRGGEMGCADCGTWVVWLRASSRAGLISCCGCAWCWVGCGPVATAEGLGTGSLGTPQVASDQVCGRTPSHGIEVEIDKRDSILVSARCRKVIMKSDDGRISGEKIGRIGRDWKLLEPIIINDNGSYLEKAMGDSRSLIGSSRMEGLCILLLAIHECRCHMLSSIGAHKGFGMPGEGNLKWSGLYFSEDSRCRVTAVWPEIIQRRGGCGHGKNVNRGPAIESEELQELERVGYKGGRQPVTMGGCGTSATGRMF

SEQ ID NO: 1010019 - protein, 104 aa, Homo sapiens
MVLRFIWRRWFSAWRINVDYRTYFEAYFAYSPSPKGAFMDTAITDETAKRLALSYPFDRALLAFGPEFDVADMEGRLLCCRSELRGVPYQSEVRSTRYLIIQSI

SEQ ID NO: 1010020 - protein, 214 aa, Homo sapiens
RGFRADQEIASILAWMTSGSVPSGPLKPESGPRKRSVRIREQVWAGRPADVDDRDVKTRGNRRIRNVLLHASPEEQVRQGVRLHRVAPDNLGSGVDTCEQVNEDVYHEIRAVVRALMRYTSMASLTYTALIEYEAAWSSQRSEYEAVIVCGSSRGMTRMAFRGTQQSRHGLEDLQTAESSKTRNIGRVLKPTGTPSVALQGASQGLGEHVGRFT

SEQ ID NO: 1010021 - protein, 174 aa, Homo sapiens
SGSPVSEWLPGLHGGIRLASVPGCLSSRRPETPPARSQGHASLARGARSRGGALRGRSLGSGNCGRVSGRDLDGPCVPSVPLHALGCTGRTLEACRPALSWACVIAPGYPCSSWRNPRCIRGLPGGKGLGFPCAQVGAGSRVLHGLSGKPPSGRGQVVRPPVEKVRPPTRTFVI

SEQ ID NO: 1010022 - protein, 218 aa, Homo sapiens
ERRQLRQPKGPGAKGRHGNPKRNRVWRDPRDEPVFVTAIRRSDPMRDIGKDALETARRSEILQSRKSQREEQTGSTHRNQRPKMKNENGRQRKQQTSRKTERQETQEWTQRERGQEDANGTAANGDKRRQEPRKQRCKISKAKRSRTENNHTTEPERARKEKTKRPRDRQREKEDNNNNEKEGKLARTKKRQIKTVPRASTEAPNTEVKRRKTQQHQP

SEQ ID NO: 1010023 - protein, 109 aa, Homo sapiens
SGATGPERLEFSRCPVRALPSGQFGLRSESGPEPRMMTDVSEALSDRLYLVINRERVKWALNLYHSSSFRQSKIMGLRTRQHATGARDTTVNKDMKKLYLLELTFIIRS

SEQ ID NO: 1010024 - protein, 104 aa, Homo sapiens
KPEVSGGLQFRLSRPSHTFACTTTGLEGPGSASRARDKREGKQRNTDRDHIRRKDSNSNERKYTRIPRTWLPTNKKRQAPKKPKNHKESKATQKTHKTHHRRRQ

SEQ ID NO: 1010025 - protein, 102 aa, Homo sapiens
MIEHESYLVAYTRVGIDKQFVEKAGILRGTASERAHLVRGTLADSQLSCGRRHSLVWRYQRVGSKPVWLPKIFAMPLHNRYLGNAKAWKEQRWLKFEGGPQY

SEQ ID NO: 1010026 - protein, 67 aa, Homo sapiens
GDRASSVAQAGVQGCGSVMKLRSGSAILLGSQLVGYRLLPPRGLIFGIWGGTGSHRVGQDGLDLLTS

SEQ ID NO: 1010027 - protein, 158 aa, Homo sapiens
MGRYLAIAWKQIAPSVTSKWVHRGAIEALDRQVAQDGLNKAQLMRDFCRRWRLADWAGEQSIVRSGPVTNAVEIVPITDRHQSLDNGSIASLTIVSNARLEDTPFSATPLTRHVRQATNSTRRIVLYNTSIVWHWHWHWTPRSPTGSNMTADVGHAIL

SEQ ID NO: 1010028 - protein, 249 aa, Homo sapiens
MDDSCIKEADMLKDRNFVAVMPESCIYIMTRPNEHFPPWVGEDSRLMTQCGVTYIKNDVGRYPNPVEVVGTVINKTAKHVYSKRNAHSYISLHSTQTGTIYHTIITTQHPALSAFTNPAGIDYYQSSQKTTHDVSSHGEPLRSRTADATNTGSETTVGPFENDKSNFSATRTHGEEVQLTNKHSVSGKANNPQTPHKKAQRNTPHPHQETQRSHSAVTTGGKTKEPAQTHTLTHDTGDRTPATQSQPPH

SEQ ID NO: 1010029 - protein, 335 aa, Homo sapiens
SGGSAAAQGPRRQGRRGTPNATGSGGIPAPSQPAVTCLRCLPLRGLCMAPWRARTCALARRLPCGPTRELAGPSPASAIATSLSGLRGAEAASPVRAYALPLASARLLPLARLLFASALPGLVPACLCARRDVLPRWLIPYGGVGPFASWPQGSKLPGSSSGRGNSEAPSFGLPRSVAFCLRALRCPCYSPWVASSPRKFGPRVAPRQLYGALSPGACCLVPGLLPLVCANAPVSGRCCALWLCVLGYLALGSALFFRLRLAHYPGVLARLLFVWLLPLGCPPAVRAVDAPIFFPSIWRFCARSNRPVFNPVGPLSQLMPGCRRMCSSTPDGRGS

SEQ ID NO: 1010030 - protein, 38 aa, Homo sapiens
AELGAKQEAFPYPHTSPSPRHQSRVLAVVVLVPGGGVF

SEQ ID NO: 1010031 - protein, 235 aa, Homo sapiens
RHVYKDLRQIELACDPWKTWTAGRPRSSESLRLPREGPGRKLRMGPRRTSFSMDPQLERQVESIRNLVDSYLAHHHTSPSVDLMPKTIMRLDDQQYEGLHPPSELRGLPIAPRKTESSLMEESADQAQRRDDMLRMYHALKEALNESSVTSGSQLTVSTPVAPPVDDTWVQSGQEAQSQSRDAGGGVQAIATTTVCRVPEGRRWGANVHEVHSMIALASRCRARVPQTRTHTNTH

SEQ ID NO: 1010032 - protein, 78 aa, Homo sapiens
MIVYTTLTTLPPQQISGQAQTRTVIHVNATIHKIKPLTLRLYYISPIKISLNLYTITQYSMTLTHSTDIVLSQTQIIS

SEQ ID NO: 1010033 - protein, 135 aa, Homo sapiens
MMRKTSDVHYIEDLTVGSHANVAIPSSYACPRAMPRPCCRTVDDRLMFEDETQKIWLLGELVSYGLHLVNRSIYHGQLSASKVALALPLGIPKKHSAAHYVLVLSKGGDCAGNIQALQTASQLSQQADLRSIVEE

SEQ ID NO: 1010034 - protein, 135 aa, Homo sapiens
MVPAYSQEPLICSDYINMMVSGGTEVTIGAKHAGLRRSPLNDPFLKAWLREYPECEGVNKRDLARWPIMSEWMRKRPLEWQDYVFTTEGSEVTDSEKNDVLPGWGLTNRPKSSAKVLLSPRWNAVGQISGLCNLH

SEQ ID NO: 1010035 - protein, 210 aa, Homo sapiens
RAGRTREERGAAVLSWLRVPASARPARLLRCERPYVQLAAALGGEKRWGTWGACVPAWASQAPEAPSERELSPACLTWSMAKLECSRLPLVRLPSPSPRFRVPLEEPPLSPDVEEELTMTWAMTLGLLSMASGDLDQQASRPGYTRDKPMPAKHTVGSGEALRFSTGQLQFAIENPTQILQFVRERPCTTQTATDAYSTAECQHRDILNP

SEQ ID NO: 1010036 - protein, 69 aa, Homo sapiens
RDRDRIAGQVAAAIQEALEQTMLVLVNSLIRESWIWVVFFFEVSCVCLARLECGGAISAHVQSPPSGFE

SEQ ID NO: 1010037 - protein, 69 aa, Homo sapiens
RNGKIPCELLEKIAPSVTSYIEYIERDMRPWITRSVKRSELKRSYMRDFVADGGSLIGLVKKHSEIWAR

SEQ ID NO: 1010038 - protein, 71 aa, Homo sapiens
SGGDIQRHQPRSSLTELPEFPSPSRNPNTKEIDCHGPQGALGTQCCRYIEVCGRINSHDPGGLPRRGRNTS

SEQ ID NO: 1010039 - protein, 130 aa, Homo sapiens
MLCEAVKRPIRAFDDPGKRRGELLNCYRLTHRLDWKGREPIAQTLDPCGCLVPTGGLCLCPGRKGKLAAAPFPALLLLLAAPWLFRETWWAQAVRRADLGALAAHAEKTTKGLRAFGLTHKEDVSWGVRA

SEQ ID NO: 1010040 - protein, 154 aa, Homo sapiens
GFVEKRPAPWRRRPMLVSVRALVRMVKLFIVKSAPEATEQEIRSLFEQYGKVLELDIIQNYGFVAHIMTETAAEDAILQADAITMLHGVNINVEATHEKSKIVCESCMLGNIESHLQPMKELRAKFEEYGPVIECDIVHRIMPSYTWSGAEDAV

SEQ ID NO: 1010041 - protein, 131 aa, Homo sapiens
ADKRLARWKMILPADQSVHTLTMVISDALVLSGWCSSWLSSAIQVIVCNVTTVLSQLPDVPKQPLEVCSQSGVPMNALSSVTEKLRVTTMYNRRVGHFEALRNFYDRQQTRVEATMSLTYYCCETRTWCNL

SEQ ID NO: 1010042 - protein, 141 aa, Homo sapiens
MYAHATGYKRNYGPKIAARLVAPNCRAFSRSFPQYYAQERLPIVHRLKRNFFHHPVRDLLGRHPFSPPRFVGYRAKNGATAFLRGLPTPRKTPLTRLVAEPSPASFVVKEAFTPFKAMGFKPELRKQSAVCPVVSREFWWE

SEQ ID NO: 1010043 - protein, 122 aa, Homo sapiens
MSVPGENSSTKPSQSYVVKTLSGAEGTMLDDDFLEMEEDNGMLPIKLCGKFFQKGTEVSSAKSRAKLGMLNIVSKILRAGEGPQDTRMTGRLAGGLYAEIRAGELGEDSTFGNALIEAGESM

SEQ ID NO: 1010044 - protein, 316 aa, Homo sapiens
RRTTIAGGGGTPNEAGLRASPSSPLALRTPIAGRGGTPHEAATESQPSSPSGSYDHHRTGARARAHPPLTAPPCHPAPLPPSWPLYAHPPIARPRHAAAGPPPPSAPAPHPARPFLPPPRPSFPPPPSSRPATAHPPYRRARAPRPPPTRPTPPQPPLSLPYATTPTPPPGGNSSTPPVTPTTPDSAPGHAPPPPPPTRALHAKHPTPPPAPAHDNPPNPRPPAPPHPHAPPPPPPGPPHTAPLNSHAPPNRTTPPANDRPPQPTTQHTPRPPHTPPTPTQPQRDPLTAAPPPPPTTTPPTPPPHHGPTTTPSQHR

SEQ ID NO: 1010045 - protein, 329 aa, Homo sapiens
QIPGWQELQEEAARLEEPFPGLSYSEVNDEMTALAEDQLLSSYLRYQEQTGGSPAMNHQYPDGALSVLGPVRRKPSGEDQSVAFMKLQWSCILPAVILGVTRTDIWHLVSLPGDGPLFRTGQWYTESRSGMFIRAPEEDYTTGRSLKESMRAEVAGPRKEPCVDPVECCEDPLVLDLDHYCLSLVRLLTGDNGNGARLITEQGAGNSRETKAVWSKAYIRVTQVPKGEDPSSMRREFPQEYQAHPVGANGEHAESRPQGSRRYGQTARHGAPRIISPMQSVFPEAGEATGSERIDPRHVNAPACTWATPPEGMGHPGLEVKSTTRGGER

SEQ ID NO: 1010046 - protein, 303 aa, Homo sapiens
SGVAGCGADAEPGAAGARMVMAYFVENPGGNTNSGFDVLYHNMKPLDRYQPKELSRFCKGTSYHSRRHTPVSMTKTSKHLQGKLIHQLGEPFLQPVMGTVFQQPFNRGPLRNIGHLGSCSDQFTKTSLNRTVQESNARRNQVHRLINTTRRRTFARNSGTLSKAIQKHNLRPLPETSTAHTYQWPKVVEATMEAVLNKRDRQLYDKRTQLTTNTRAGRFNSFVTGKMAHQELALIKARSLIGWAHNITFAISRHNRRGTFADDQAQHLAPGKHQGLQQSLLPTELFGTDTLPAPSMSTFNARH

SEQ ID NO: 1010047 - protein, 90 aa, Homo sapiens
RGLGAETDLAVEIAVARLQLNGPVKPGKLYSKSHTEGSCAHSRNTIERGYSHASMKVCRVTPKRATRGRVAVTWRSMQRLVVEPYGREAA

SEQ ID NO: 1010048 - protein, 164 aa, Homo sapiens
MECMGGKVNLDTEGGTDIFKGCSRIKSTDGQVVCKIPRRDSWAPEAAYWDVVQWLDEWEYKFGRNKSLRRTYLVRVAFGTRGLAGVRNASLLHSQTQCSRLGSLNACGNGCKFTQTSNTHGSGAFDLGVVGGLVEFSRGSLSRERIDLGVQWVPYTARGTLRRR

SEQ ID NO: 1010049 - protein, 113 aa, Homo sapiens
TTYASRKPLTSGPRRTSWGAGGEGVMEAKPEAYLEILPWGSQDPLSTPLTWNELGTRASTVVAMPDVVRWPLWPHSSLHVHGRRVGFRGLGDWCSWVEHSEGPSSALAAPGRD

SEQ ID NO: 1010050 - protein, 41 aa, Homo sapiens
MVGQFGRTLNVFATHTLEAPFEKFRGTTYVVGELTLRIFWD

SEQ ID NO: 1010051 - protein, 108 aa, Homo sapiens
MRSKTCSRSSSSACPLRQAELHAPRGSSPGSVPVSLSMLSRARTGRVLGLYSCETFYCKDHSFCYMDGLPWARRGPTLSAASLMLVTLFKSKRTLYCRNLKGAKKAYK

SEQ ID NO: 1010052 - protein, 187 aa, Homo sapiens
MPSFLVLGRPRRAEPDGVPRGPPRKPHFRVARRRRDFGHRFLPSELVITKTDASSTRGKTTACDRERHDPHPGADSERPAAHDPETHTPAALGPSDACHYSQTADRSSTRLHTTNANATHPAKREEPGTRPKEASTHSMGRQAQQMNWPYQRYTGKHRDSRDDNHKGTWKWMVGRQTERGEKNTKGK

SEQ ID NO: 1010053 - protein, 268 aa, Homo sapiens
RGRCLPCSLPSRDRAAPSLSGLRALFSAARALASLASRRACPTPALASSSASLACLPHALRRALPPMVSRPEPEGEAMDAELAVAPPGCSHLGTLQGGQLEAETCWAIYQCFVWSGTAEARKRKANVLYLPCLWRPPQPGCIPALYCVSYRAVSTTERIFTEHAEGERGHNLAHRLLDCTASASNRNTRAHGPPSTDQTTCHNNRPKHRPSEQPRHTQPTRTNATTKPQQTLRDTRPTTERAPATRQQRHKHPETRQQHAPPSQRRTQ

SEQ ID NO: 1010054 - protein, 71 aa, Homo sapiens
RFVEYVVDRSVEHDKASKDAKYELVKALANSRDNCRNLWEPKLLEASDTYLSEGPYVCETLFPRLAVEGAE

SEQ ID NO: 1010055 - protein, 171 aa, Homo sapiens
SGAGLGERTEVARWAAEGRGSWREGGPSQVQPRRPRHAASRDFPAALPSTGMLSAHRLTRKPPSCQAAETCRWDNMTGHVHRSERSAAQREKGSTAMHQLERWCTGISRQRPSTTESGVPQEQRRKGRYQTEPRPDGQQNNGDHQDQGQIAVQAPHEGDRQHRAGKPGRRR

SEQ ID NO: 1010056 - protein, 120 aa, Homo sapiens
MRANTSVDSASSTNRAVSVLIASRAAGNAPRARTRAKSEMHIAHEYPKRFSWHTVKFGAPDIDSSPSKWDWWTKRNTVRDVVREYVTVEGANHVDYQQCRTRDLPVLRDHLEYTFTCEER

SEQ ID NO: 1010057 - protein, 217 aa, Homo sapiens
MIFPPDPLCLSSCLPSSCMSKDQDEHEELDFLFDEEMEHAGWAEEHLQLPGPDEESDYEIDDRDVNKILIVTQTATLHVAWARQGGTCYRQPQPRRAKYERRTGHRLDYMMASFYYEHGPVELKQFETCSIPMIKLNEVVELHDHGQSDQPGARFDALTPEPPVDPNQEDSYLGHLGSSIVPTDALDNKLYGAPEPSTIARSLPTTVPESPNYRTPG

SEQ ID NO: 1010058 - protein, 108 aa, Homo sapiens
ARVNADLAASWMPNEIAGRLRLEAADPTVERMANSPDAQGREPPPFIRSGRSVSRRFPFDGCTAERTRLGLGAERGVPAVVVVLVLPVADDDLCVQQRVEAVDVEALV

SEQ ID NO: 1010059 - protein, 210 aa, Homo sapiens
MDTQPAEEEMKLPNAAEHQKEQTPIHAAFKNCKHPGGSGGFMKSQRPWNPPIPDTICTHCTPSLGDRVKPCLRNLASIDDQLWLFQSHSQALKDPCSSLDCLVPAARFHAWEGEYRVSEQFISYWNSSNALRDYKKVNENNEFRHSVGKSDSEQVMEVGLDLVNISLRYSSEMQLRAKGGQQSGNARHGESTFGHHGKTKLTSVWQETQI

SEQ ID NO: 1010060 - protein, 141 aa, Homo sapiens
MSDRDQKFVTISEVSLSAPDWELTIDFASSCTYRCYRPRDWTWKQSLDFEGLRDDMCNSLDLGVATFSPGRPFVGQTANNGRGPLTALGDKGAICHTALRGVRIGQRFTLIEAFKRHTFADLRAKKARNPHAGKKGAKRPM

SEQ ID NO: 1010061 - protein, 142 aa, Homo sapiens
MASRVVADVQLLLEENSLSSEQRLSVLWRTNDLMTELAEGFASSVDDDSEKESSDNDVGSYGKIKPGEVHELSCANVYGPFEVSNSDKEYQCRRQLVDTLWDKDAFLIRTKREFQVLGLKKVMGELPPSLPVGSAFRWLIVC

SEQ ID NO: 1010062 - protein, 105 aa, Homo sapiens
MHYSPEIAFIPAYFIKSPTFTRDVHIMAESVLLTFTANVLPLSILDLPLPYIIWARSYITGSFLYFSETWKPSAIHPSLLDEPDQPYSRVSQGVVSFPLRPRYRF

SEQ ID NO: 1010063 - protein, 185 aa, Homo sapiens
MVAVPRETVTRKLRRQEHADAAFTHGQTSIRDTALDKHTGTHQYINDQWACVGGATERDPYTKLFKASPYEPTSSRTGNGGIQDTSDEHKDRPHNPTKLRGEENELEPKHTMPEHSGVQQGPTESVSFMHSPPGTCNPGGKRPETIRESSEEERPIVNLGAEKLEERYYALKSMTEGGAAAVHET

SEQ ID NO: 1010064 - protein, 132 aa, Homo sapiens
RGRDRTSGWSVGLRGSGLSWLARQGQGNRVAGRYGPGNAASVEKRACEILSESRTTEEPGPDCSRSWSASSLSCQHQIEMVCHLLRMWRVLCYSWNWICLCAILCAGLYNAFSAGVLYASAILLACSQYMLL

SEQ ID NO: 1010065 - protein, 303 aa, Homo sapiens
MCLRNTCGVVRPDSTLVVTPGNFHHIKRGYSPQSKNIYGHMGVLSTDVCICVRTLYLNCQFYYRHILRDSMAVPEYTIFYIRWGDKCKAVLVYYSPFISSCVAQSPNYTPRNEDILPAMCNNKQHQQHNEGGGDAAHIDKKSITPTQERGRPTKVLYTARSNPRKYISKRCGPHKTRVGAPPETNKRDKPNEYITTQDRSNEAPQCDATRCEVLNTNTRGYNWDEHVWVQQQHTRRNTTDRGEQPSCGGTENEENHPRNTYTVRGDEVSVNTQQTGGTTTQQPPTDSREKDSNRQCQQAGRPP

SEQ ID NO: 1010066 - protein, 73 aa, Homo sapiens
RRGPARCALTHAHGLACALTRPLAARAGEEHGEKEEEESQDEHQKKNTSDEDEHSILTKAKEKHKRKREKSNT

SEQ ID NO: 1010067 - protein, 121 aa, Homo sapiens
MVRAIHMWDICKTLKGNVSSKGILDNRFNAFSRKGLGYEYVFHFERIKFHCLRKIKRPSNLGWNFPLYPLKCISDHLVLVVRSRNRQKPFFPERKYLRGYGEAIYRIPGLNGFPDEAPFPN

SEQ ID NO: 1010068 - protein, 76 aa, Homo sapiens
SGIEMQHRDTAMIIAVKRFIRGLAALRMTEAAASDSRLTRKRSSLPDRKTKIYTSDRTLSYHSYVVKTNKHDCFLL

SEQ ID NO: 1010069 - protein, 142 aa, Homo sapiens
MGRGAIRNPSPFSTLSVARRGHRVCLPGGNTLKGGGHTYVVCGAPFVVAHKKQQGGKKFCAARAIEGDTNVAAFPWPVKVCAPSRVPSRNAHSLHIPWPVPEAAPCGPHAVGLLVRRRQIVGPPGDDGRWEGNSPWLGGANT

SEQ ID NO: 1010070 - protein, 70 aa, Homo sapiens
YIIAGGLCGFGLVLAAVADTCVGVQKLVLTSRSGIRTGYQANAVSAVCDVQAMWLYTCACVSTKQHSAHM

SEQ ID NO: 1010071 - protein, 444 aa, Homo sapiens
ERRWALSANERRPHAAGGGETWEAAGLINAIEQPPAGACPRRHLLFLLPQFPPPACRACGAEGPGLSAPATPAPTWLRLPSCCCSGPSVGLACVCPTPSCALWRVAFLICLNDELVDGGPPGGPQGNLHHITGQGPGMKGAEEEGPQSRFMGRTGRTWKRMRIPGRPHEKPRAPSDETALGGTRQPERGSRRIIGIQWEAAERGERPGPERRMPHYTRPAHRGLERRREQRRVHRHNRKRETAHGGRKKGPTTTRPAPLVGRTYTTVVICDKQNKAPTTRATWNRCRRKVYAEKSSQKRTSGTLADEEDTDWGKVDQNMGTAVPRGGTPPIDEKKAQRGVEDKHRGRRHDQHQQGNTWVEDNRQSAMPWGGPNIFQGQLLTNTERARNPGDGLVKAHCGGKPTGVPQAKNGLIKLGRHNTWGWEHPPSRNVIHPRVWPPKKQTT

SEQ ID NO: 1010072 - protein, 348 aa, Homo sapiens
AGCVRRGAAAQAATGSADNAAAANPPPGRLRPSRPCFLGPPPPVAVVRRSFHHRTPRGRPGPVPVAPMPFPELHPIVIHQHSAFSGHWASRRARHSAMGTLRSHVPGGGKTVSIRRLHDKRPASSIPTNEHDMPAALTTRRANGSTGLHIHYTSGAQFPVPVTPYTMVFTRFGVNSRPLAPLPGARTGDDATSVPTYTKAQSNWAQDPGTAAAETGKTGAGKDKRRPQPTKKTPADEHKPEWAKRYRDRAQECDAHNHLCSKGAQTETNSQRPQRNMGSGIYRALRQSGNSDCDQDTRYQGLDDGNQTQGALEPVLGDTTAMQKDELAHPRNGFTAAHWPRQARFERH

SEQ ID NO: 1010073 - protein, 33 aa, Homo sapiens
MFPLKIALWGEQKYYCWRIVWRGPCVRCEKEKY

SEQ ID NO: 1010074 - protein, 102 aa, Homo sapiens
MPQGSPTREKSLVAITGPPSRIGAGAPTGAWPSNRRPGGRQLSNKFLVVTTTGARRPNIGRQGLVATKAAGNTRRGPSGYKAPPQRVGENAEAPTERARYPT

SEQ ID NO: 1010075 - protein, 306 aa, Homo sapiens
RLFPFAAASRRHEYAQASEEGYASSVLPLWHEEGLGETPNETKKKSLNARLAVSQIRKSHHEMELIIRKPVTVHSRARCRKNMLGSACDMGMVIMGIGKRKGISAKCPECPEKGHMDLRRIDVISAVRLAQEDTVNLTKIDRHHVVTGLYLKVELGDMCSKNKRILMEHIHKLKDMTMPCNEVSWLTRLRSRRSKTKEVTQVAVKSASRSRRRMTHQDFIRGGKTIKNYSLHFCLFILSFCDYVDEALNENKLNLGMQRCCVFHAWIAGKGAYMLQGGPRFNLVCLKGGQFQLGTHGKRFRFPWYR

SEQ ID NO: 1010076 - protein, 341 aa, Homo sapiens
RACVWEGGKMAAVDGRRGWWEMGRDISLTALTSATRSPYINPSIRGLLGQAGGSVQPSDHTGPSKWEDKSDVEVNLIRVIQSLDFISKGPLGFHTLSLRIRGLMPLEHIHGNYEPTFTLGRTYWHSLPNFPRTTPVSLRSYRGTYRRDALSFPVRIVKSMWCYVYSDYDGKVNLGQIGGKIKATERLIGHRDPVQIREYLETRLLDTGHDVPIGEKITRANDATRKPYFSPPQMVLRVRKISTGTEQRANRGKRLDNHLFLPGKLAIQFEGGGSPYGEAEKMSDQNQGWAYTEPPGVHSWTAPETVNDRKLRPPRVRYHHTLGAQLPFEMQPISPENESRA

SEQ ID NO: 1010077 - protein, 119 aa, Homo sapiens
RVGARALALTVPLRSPVGLLAAAGGEERAPCPSCARWTPGQPPSCARRDASSLRPETFCQLDGPIGLICRRRARLEPTHYPHDRAFHSSAQKTEGLGTRGMEGTSGSLGFNFIASPDGQ

SEQ ID NO: 1010078 - protein, 130 aa, Homo sapiens
AGGRCGTPAPSRHRFCGQTALWRAVCLACGLVSAVLGRRRCMGGHAGSIYARFGNRGPGMCDHWPAHPVSLVLSPGTLWCYDVSLGPGRKRERCATWRGLRTEAAGRLRCVRTPGNALLPPCHRPSVTSR

SEQ ID NO: 1010079 - protein, 204 aa, Homo sapiens
RRVRRERRTYTEPTRGFPRSRQLPGPKIPIDLTPGAMPRVQRVSWLTLRSIPQQYICSFCPELDRQTHFQWTPCPRGGSDVVYLVGHGDPRSMQGAPNRQRESEATAPTTTLCLTHPDINPADMDEEEDPLQRDYKWIQTLRQDTTDQKLGSRQSATGEKSGIKPPRGVTALQAILSRRILEMHGWIQNRRVRVFPGHYKRSGT

SEQ ID NO: 1010080 - protein, 241 aa, Homo sapiens
MGFHHVGQAGLNSCPCDLLVLASQSAGVSGGYFWCVLRLTDFKNEATDPRVPGQISEVEQEKSSLLHLLQGGIKVPKRILRRLMENAPDPPYCRGEVPGKGVKKYRIWVMPPPRPAPDRAQLLAQVPRRHRSPQRLLPRGLQSHFGLAPRAHSLSSVSPAGRTGRRSANRNLSGKPRQRLSSGYGGAGRARSKPLLSASGHRPSGPSSVPRMLGRRLQWDLHLLLQAEAEEPVRPPIQAAH

SEQ ID NO: 1010081 - protein, 84 aa, Homo sapiens
SGIRELAGSTLIELQRVKVSQHGLECAVTRSGFRSQDLLRNVGDGLNWLTGVCTIEMKAWTYCRRKLLPGDASGMWPESVIRAS

SEQ ID NO: 1010082 - protein, 237 aa, Homo sapiens
MANSLGDLRSLLTVDINLGPSIAHWKLPFTGIRRKPYGQPTSTVLRTKHKGPPGDATWALGPSKGQEKTRLAVVTKRLCRLNKVYNVRTGWLAHPGERWESPESRLQFEEGHNGVGATRQHNFALHQYMTGLTEGNERDKTQSGEYQHFTRPVKRSPWGTPMHRGQRHWWGLDRWIRKRFSNGQEEGHYRVDVMATCPGEWESAKPWERGQGVAVVEDCRVGTAVAKRRHDKPAHVK

SEQ ID NO: 1010083 - protein, 140 aa, Homo sapiens
RVEGPATARRVSRPSRARYSPGDRPSARLAADGSAGWVRVDPGVSSRRGWGAARLWCATVLPTSRTVALGCCVNFALPLCSSVWFAFECSRVTDAQVISPLRERQRQRIHSYQRRDVCSTSATPRPESATIAETTAGAET

SEQ ID NO: 1010084 - protein, 262 aa, Homo sapiens
VQRVAGVMSSSKVTTGPEADLRGAKCMDTVSVQQQRTSFTNQSRSRPTVTNSNDHPSWLWIATVVRPPELSAPDQSHTISGRMLLYSMHISRPTLVYPGSSICSESVFSVLPRSRDVHNKNRDSISPCIRERRKQQFQYNGSENSIVQYWARQWSAAHSSDRILATKTSSFRRPQLDLCHNTTSVRTSTIVTMTVPSHSSHATACDHLKYPSRCDLQWSDGHSCYHLRKTSPAASQGAGWGIKVAKVVPSRSRTFFSDPAEY

SEQ ID NO: 1010085 - protein, 152 aa, Homo sapiens
MKRVEDSRGSALCLLLETSQASDRCYGQRRLLYPVKLILGPVHMPPCDGDPTEALCAKHTVGPAGDWLGTHLESPIVDRKGCGGGVSRGLVTTLREGTRSWGQRLVEMQAGEMHVGLEVRVRGKQSGETPVSKNSVETPQCHLPRLILTPEA

SEQ ID NO: 1010086 - protein, 257 aa, Homo sapiens
MFSGLDQKFLAGPVATSRLVSSFPSGSEEAISRHIRTASLCHGHPTSFNSEDGAQAPVSLDNVGGGDGAHWRVARPETSAPGASASGHRAPSRAEPKAQAVSVRHSMSPHDAEVDVRQAVTVTLLSPPDGRSRSTRRTAEPFFVDQNRRTITWNGPERCPLMAPKGDSILCQWPFPGELKAAACYGRHPVYPLGLNQCYIAPFLVLPMTAAEEAAQCATLFPGFIPKPGDCIRFRKCPAGNSGSLRKSQSTPAGGFH

SEQ ID NO: 1010087 - protein, 324 aa, Homo sapiens
MPQDISDSSASLQRASVEEEVPDGAVKTFTHSSSSHSQELLAKAKYAATTDSDIPADTHYFVSRTKQSSGPHKVRNYEACSDFLSHQTCQAKPPGLDAPTELLLRHTPALTAYPLTPAPQLPSITGKLTASDTRPPSYHTLNTPATTNYVDVTPSPRQRPRHQKLPRRGPPPVRPRNALPSTTFDRNHSRTISLDNVDHPQNGPNRTPHRRSHDTALGHTHHPPITKTLGTHSTDEDPTEYGEGLSTTTQASTHTDLTHGTEQETQQHQPTRGTPTRTTYTPEPTSRHAKAAHTHAHPPHRQNTRTTTTPRRHHTTRPPTEHHT

SEQ ID NO: 1010088 - protein, 351 aa, Homo sapiens
AGWGVGGGGVGADHKDSAECCCPGAGWLRPHWSHSLAAAVAIASLPGSGIRHRGSQLHELCFIRGLCRRAPVWDSANLATILRTREKLAVVAVAPPKASQCSHHHPNRTEQPIVSGSGGIVVALLTAQLNGSRKRKRSKTLAHRGNGNAQGAQRGAPGWTTYFTVLVSPQGPFPKGERTLLWAVDRTTAGTLRSNRCAVKRAATISLQGLESGGANALEDLCHDNIIVPKTVCSLPSRYKFLPTLNTSGIHTTQVPSPLRPLMRKKAVLPPEDGDNPQREGKTPLTALRRARLSKEWLPTNDPLERSPQGRDSNLGAATEAEPDINGQPDKRAICTAGRHPPAQNNPRARP

SEQ ID NO: 1010089 - protein, 122 aa, Homo sapiens
SVGGRGRRAYAYEKNDTACTYLSSNKMTPDDNPDVLDFEEIESVHTAVVAVEPEPSMITKGMRIPAALAAHECSYTHSSETDMRHYLDGVLDTPKMILVMPDVDSYWVQRTPRGQQQSDDRP

SEQ ID NO: 1010090 - protein, 366 aa, Homo sapiens
SGRGGAPGRLTEGNPRPLQAGLCQRWRRGCSDVIPPNSQLRRERAAAGRCAQSPSEGPEKGEGKRSRLETRPFCLSFFLVSLFHPSSQAPVPSALSPSSILFSPSISLAPFRESFLPFPPFTYLPISFTMLTIPFNPRTIPSRYRQMAPFNPSGNKKWRGTHRARTRWARTLTPPFVCGTDLPGVDSSASCRTHRRRYPTAKQAYGHRVEAPPPNFTPLAHRVNQLFAPKETHPQGDATIRRVVTTASSMPSPLRSTFAVPQLVGSYGNHPVVCSFITPHTGSGSTGPKHWAELHRGLVHHDDGYRASLEITHRRCSWTPPFLTMTIGTIVVDRQLFSKTLCSSLQPRPHMLPSVLATTETDAIPA

SEQ ID NO: 1010091 - protein, 108 aa, Homo sapiens
MELFSSALSCSGKVWKRPTKVSDVSVVTPPELETKMNHNQKVVWCRTQHNSNPSCMDAIKRKLHERVGVAMGHSARLYQEPNRETQSTNSRVCEGTHRMSIIQDVRRT

SEQ ID NO: 1010092 - protein, 252 aa, Homo sapiens
SGVRGRPGPWRHSCFVFLLLGGSVLCLRLLPPARSSGPDNRWLEYSVGARLPARRYLLYYVNPAVKASMLLQGCLYPNRPLSVKTLLKTEEWVLVHASSGVRLVPLAVVLTSPSRSGFPGLSFNDLPSSHSKNIPVIEYEQFIAESGGPFIDQDLRPAKLRMRGGNEGTWEEKVDERPCIDQLLYSQDKHEYYRGWLGWYEETRGLNVLLSCPSRAQTSIVAPLGAEKHISRVLIVRQSRRTYVHDHYGGKR

SEQ ID NO: 1010093 - protein, 82 aa, Homo sapiens
AENVFVLQCPALVCVMSRLRYLGPDGPSLCGKYCGYYVKEAQTLEWVKEPLELTSNPLGPLIPGLPSPPIAHGNLPMRLFSQ

SEQ ID NO: 1010094 - protein, 282 aa, Homo sapiens
MLLNVDKWLEKNFPNEFAKITCSKPFAPNNDAGQLSEGPGKQAGGTETRDAQQKQDRPSVRTAAYTHYTPHITQQRPVPTKTRVYLNKAKTFPPRSQTETNISRCKPRRTWWGAFGTVFRDQLGPPFTAAQGIKRNYCGAPTHNYFPWLGGSFPGKHQGRDVVHLTTILTSILQVGRDFIETQGTLDAITLSGHWSQLATGGNTEWVPKPGGTEVGRLDHSVLFERRNLLWGRGEFNKEEVEPLWDNNMWCVDDYTCGALRHWRKDWTSVGAKVVTVKQGYL

SEQ ID NO: 1010095 - protein, 99 aa, Homo sapiens
RIQFLSPAGSGPDQAPGLSPRPQVSATAPSPGPGTRVRPLSVRALAPTPTPVPQISFSGVPRRPVPNEAPVLGPSSAGLRTYSLDVDAASCCSCCFFRI

SEQ ID NO: 1010096 - protein, 104 aa, Homo sapiens
SGLSWSAGYDAISGGQDAPDIAFGGSCGVELLSVYLDVDDSRSSMLVGGGRCDGRESAAWLSWLRMGLRGCPDAGGFAVDGPWLGLVWAPKKIVGMVTQGCGGE

SEQ ID NO: 1010097 - protein, 174 aa, Homo sapiens
MLGAACSAAPPWMTGAVGGQRGEGVRGDSTWRPRGPVYKGLGELQSFAAAEPLSRRSGATGVPPTCTRSRGGLLSKRLTEKKRARMVSRECQEYVTLVLRRVRLNDARSAEERRVAVMRRSEQCVWEHERAQNVTEGDMTLSIASDGSKRQDMREVYKQRCVNSFLCDVLALRA

SEQ ID NO: 1010098 - protein, 307 aa, Homo sapiens
MDGRKRCAARTADDNVGQTGAQVVRRGSQAGLATVGCRQPCWVSQPVPVGERAGRVRVGVGQGRAIIAPHSHLTLSPGNTIQNTTSNAPCVCGCCARQLNPSSHVLHASHYERHRPQNLLRDTQGARELPCPSGGTARLGIAEKPTHHIFPKSKPMCDILQTDTDQQPPNVNTYQTVCLGNGEGTTAERIAWKRECLGRSRTRTNRKAPRRRRNAGKHTQVKSRATAPAGHAHSKRGVPMEDTRHDLTRENAHTHHTPEQANEETRTAAPHHRARSTRRHTSTTQDQAHPTRGPIPSYSDHAVAPQN

SEQ ID NO: 1010099 - protein, 67 aa, Homo sapiens
RGPAVPCSIVPSHRADEWPPSSDLWDLDAALIQMIQNDIRDAIDIHQQDVCNGIIIKIKNHRTIYIP

SEQ ID NO: 1010100 - protein, 234 aa, Homo sapiens
SGVDFLFPGRAGSRHRGARCCFGGPGGGPGCRGPRCGLASGRGSGSHRPGESSQGQKRGRRMLFLERPTSGAARVGGLHVQLLALIHGNLTHVENGGIFVQLMGKEVGGGASALTSGIASSPDYMNSTCGPDQTVLKRNCDEWEQVMVLRSASGEECQENSIKINIMNMNEQSKLYSQGHGALFVRTRCRTPATLVKLYESGPSFEMTETQLCYPLFIVFGGGPWGHHRSSLLI

SEQ ID NO: 1010101 - protein, 235 aa, Homo sapiens
RRCGGAMLASAASRPSSWGSLRAASLGGRSVILWADRQADARSDDRPMSRRRGLGVKGRRAERGTHAPRREEEADKVSATWGYGREAGLGASGGTGHRGSPGMGEGRGAWETQRPEGQKDQRWRKHDQRHRHRQQDYTPATVTHSNGRTSGGQEMYKERVLRALPSPGFIQHRAGPPGKKQKTGKHSGGFKGQEFGDVVTWYHSMINQPSLSLFHNKRYWVFWKSYKLEYVKRRQ

SEQ ID NO: 1010102 - protein, 111 aa, Homo sapiens
MRCGDMVVRMRCGGYAVRAGAQQRDAWTLLRLVSPECWYLDLLVVAVKDRRCRNRGPLVAEPCGDWLVAHFGYRFLAADSWGKLLLVWSWVTARLPGSLGGEQARCANGWK

SEQ ID NO: 1010103 - protein, 141 aa, Homo sapiens
MYTEILTPLRAAGKLACWHLSVLEGTRPFAHGHVWQLTASETRSKHHLLPQTPGNKSERRRDGARKTRSHRKIKAHYHSPFLQRHGVLDLPFDPPRYLYRTPSTVLANTLFEGAPAEEKKENRDEAKLLAHIKSRGEKQNR

SEQ ID NO: 1010104 - protein, 97 aa, Homo sapiens
AALAAAGAPRLVFTALRPVLIKARRCDPVTCKNLEVHSYDARTPGSLEMGPLTFRDDEKEYIYRGMAMTWTHAQRNLYRDDDVETLQTTWLPGTAEL

SEQ ID NO: 1010105 - protein, 33 aa, Homo sapiens
MRGKTHITIEQRYVPSVTAEEHSRRQTRPLTKL

SEQ ID NO: 1010106 - protein, 102 aa, Homo sapiens
SGDVSAASVEGAACVLREDGSRARDRQATTAASAMDASLEKIADPTVSCHGNKLEVIAVNDAGRTVRDRTEEENGKNAHILEDIPGPLPWAGGARYGEPSSS

SEQ ID NO: 1010107 - protein, 145 aa, Homo sapiens
RGLRARGSARAYFCVVAPPPQPCLRRRWGWKFPPGSRAGRERCCPCRLGFEAREVSQTHFALMTAYRAWPDIVHRVLLRVRDLWAPARWPTGRDQHRRRLLLRNRERLATPSVGLNMGNLWTVLQAPGNYIWSFKWVLGTGLFGL

SEQ ID NO: 1010108 - protein, 72 aa, Homo sapiens
AGGAYATEVTWTRARPGEITDYMAIRAGALLKVRGRPFDGHMTNTSYEDDINKIDTHKNDNQQKRNGTHGRW

SEQ ID NO: 1010109 - protein, 199 aa, Homo sapiens
AGAEHGVRSKRRPWKVGSAAADPPVQRDEEEEKEVENEMKTMMTVTRKRMRGRGLTGVNMNELITYQIMIMTEFKKLLQQLFLKAPVNTAELTDLLIQQNHIGSVIQRQRHVSEDSNDDLDDKMRSGFHKPLKFNWEQGYQCVDQNFKSWFYAFCEKNWEKSMVEQLGQVLNDTTKPGGLSYSERFTMSSTDSLPMYQS

SEQ ID NO: 1010110 - protein, 255 aa, Homo sapiens
AGAGVPGPLTQRRHPGPGGQRRRRAAPQSTMVAAAGMQLCVCRLAGRFGVLFGLHGTVDAEIRVLGSTILARAGVSHHLPCIPCARIAQIALPHVPLVRACTVVSARCVKHVQHLCSSVGSVYAGWDRPSRIRSVEHCSPKSAMLRPEGLLVPRVDATEDADRILCGTVNTAGGTRGLFYITVGHMCCLLTYVPVDPDAVRGSALSGPCVPLVCRRCHHRIVTRGAYRMLLMSVAVGPIPRYADLRRCFSPESPS

SEQ ID NO: 1010111 - protein, 83 aa, Homo sapiens
RVGSSLERPNQRGGRGDLSLPTESMDSSTERIKFCCRGPGETNYVIVLNGSGKTYFPCIPSSINEHENSNEGRKNQNNAQQMT

SEQ ID NO: 1010112 - protein, 201 aa, Homo sapiens
RATRGSSHGQATRVNAPGSAKSAGSDSFQVTGLGGEVAHVIVGAEINRDSASGVTYPEVPKQHYPSLKPRAPRQASRPRESSHGQKAVGTNSTGYSRGPRQDSHKFTRTGPRGIAQGCTQKGNTVDLASRGRGWRPSPGAKEYPGSGPSPERAEPTSLFLTDRSAQPAAEATEPVLLHPVLLAPGVLKAARGTVKPLQGEP

SEQ ID NO: 1010113 - protein, 178 aa, Homo sapiens
MALFLTMLLYEERENYESSPMPRPVLGPCAVVRILEVTVNRGTEQLDVNAVEPGGQERAAEVRPSRIELLVGPVGLVSVDARDMVAQAEVHNNRKDDPSAAARTREGERQNKQKGCLTQTNPGQKAAQQTSPGNTDTLHRVVEDPQLTNLGRHADGKKRRGHLRPRKSSASAGQPGHP

SEQ ID NO: 1010114 - protein, 114 aa, Homo sapiens
MLFTHNIYLQDVQMVHPKFYGIGENMWVGLKMNYLPGIAIRSWHAEKTMSNILKMAVALETCLIIFQLCGTTSYKVGCAVLHWSKNWTLLYMQEFSYAILRQEEHEEKDLMNQE

SEQ ID NO: 1010115 - protein, 94 aa, Homo sapiens
MRHRIHKTVCSDRDTNNNGKIESNNERNPDITQIERGADRQKTKAVRGTDQPHQNLEANKSMCGVTTQQLQNETATRRMIDTADKGHNETQRNA

SEQ ID NO: 1010116 - protein, 104 aa, Homo sapiens
MALWRQEMVGFVQRIFPKRKSQEKQEHKSTTMAGAHDSVDVQRMWPIEILPGGRLANGLDLAQPEICTGDVTVAQNYPATLFLHESLTGLVKAKDWIHLHLEGK

SEQ ID NO: 1010117 - protein, 46 aa, Homo sapiens
MLFAINEDAFFALSREATLNCCSLAWCRGYRVATLGNFAKRSLCPT

SEQ ID NO: 1010118 - protein, 78 aa, Homo sapiens
MRVRGGRTREQRGATWAPLTQRAQHHPPPEGGLTQNTDKATYNSENQERVVTNDPGSTDNPTCSAEKKGSKKRNQIKE

SEQ ID NO: 1010119 - protein, 94 aa, Homo sapiens
RVLPFSVPLACLASRPPLPQRYPLRTLTRCSSVLAESAQNVAGPKGLFTTLAGVSICCATTFISGEINPIYLLASPWRTVSSDKSTLNWNLELD

SEQ ID NO: 1010120 - protein, 120 aa, Homo sapiens
AGWSRHACMYISEPFVNVKAVHVLGSSESLWFPFFLQAYFAVSFFFIYYANKVRIQNTKRYVKVLFTQKITTSDYALGHQYHVKIARLHNSRKRTKVRQRAPILESVHVNMIPCWHARAI

SEQ ID NO: 1010121 - protein, 136 aa, Homo sapiens
MLNQAPAICCSQSPLDCLCLIKGADPAEPRSRALMATSNASASISGPTRHFQHPSTWQSQAGNSAHVCSTPPFRHFLKGARDLLAHPILALQADWCACAPQCLFAPYGAHVLLGRWPLHNVPLGGPIRALPPSRGL

SEQ ID NO: 1010122 - protein, 142 aa, Homo sapiens
SGVPNEWRGLLSWWSLHPPWRQGVSRLAHGEPEPWVSATPREDFRVPLHRSKRVVTEMLELCGRFVQKLGDALPEDDSGECPRSAEMLQWTFEVSCATSNIKDYMVQSQWQEGFQTNCVLNWHSDRSKVTFETIKFVIDTFE

SEQ ID NO: 1010123 - protein, 297 aa, Homo sapiens
RRGLRRPAGPKTPEPAAGEDAGGGWGGGWARCVCACASILPVRLLDCLLGLAQLSLSRVCRLLLPPSGRSAGWAGRLGPVWAWLLRAVAQMDPRLVICCAGRELAPIGRERAEKRRVLLPQVPPKRTSKRAKVQLRYRAVQKGIHLDLQAYRIHSPHVVEHFQPQTQLSPKEGLGGTQPSPAGQPHGSGGHHNLSQACNPENEARSERYGTRPNGARNPGSSTDCAGTGTTKGAVVTGENNLQIVPRATRHQKRTLHRFGTHRSRVEVERPRHAPTAPEGPQNEGFARQEGLPHSTG

SEQ ID NO: 1010124 - protein, 129 aa, Homo sapiens
AGLAPKQEGGGGGESARGGERARERPRRAARKERTVKQPRKERHRSKRPGEAQTRTPHKEEIYQVEVGSRELEQREETPQKSRDDNKRRETPPPGRSVKIADTRQQQPDKHEARRTGTKSSSSKQNREQ

SEQ ID NO: 1010125 - protein, 295 aa, Homo sapiens
RVRLHRSLSRTRACAWAGMRRRTELPGGASTLSDAPGFCRRIRHGHLGHGRRMTRVETSITEGAGMARGSWQDAGGAGRTETTVPSSGRTNSHPPNRYLPIPPRSANPEYAHPPTVPRTPRTALHEPYTRDTTRQTTEQQHTPHRHHTNSPQHEATHKHHLNTRRQTLATHRRHNVATGHTHTGSEQTLDSVANPHALETQDQQSRATTPHEKTAHSAKGTHQNGKKPSSEQDNRARRPQPRTSRQRKRTAVNTPDNGTPSDRHTRQADDPRNRRATHTTRDKRPAAHSKPEPHE

SEQ ID NO: 1010126 - protein, 241 aa, Homo sapiens
PGLSLKQSLVPGEASGLGFKGRGVEKFQKCSRDLPAETRRIHSRKHREQHRGVLGPSSWGPAAQPFLPPAVSWWVYVPILGGGAHGQVPVGGAVGHFVQHRGYVKNAHQYTTSFSRGDPRTSGFLPWEGPVEVIVTMGRNIPFLVRARGRQLQEGPLGDRVLRLTSSAITTGHVWNALKWAILKHPVHGGPNLGKHPGGRGPTENPAGIRPGGLPTGDTYTHGPNTPRIRRRLKVPSTFPQ

SEQ ID NO: 1010127 - protein, 71 aa, Homo sapiens
SGTAWESKPRRELEATMADEDWEAEINHSYVFLCTHISRRIGIHGENGDNSNRTRASSISKWMMDLLEEII

SEQ ID NO: 1010128 - protein, 129 aa, Homo sapiens
MAGATQQERRDGNIAAGRECSETKAERCNTHEGRADHRHTNGYCSHPDDKQKLHRASRAQKKAGDGAERIKRDETDTGRAASATRNDEDQPGQNGSHTELQMTGPHDARQAQQQHRDTRDQTDGLAKVA

SEQ ID NO: 1010129 - protein, 227 aa, Homo sapiens
ERSGGSTGSSGRRRSAVLSAGLTGGGRCAAAVAAGKDGGSSLEQKLSRLEAKLKQENREARRRIDLKLDISPQRPSPALQLPLANDGGSPLAILRELPAESPEPTDAEPAKCWGSQSKPCAHPAAWRAWRCDQKRQEIMKQRDYLNIGGQGYQAEIDDLENLGRDGAAATCGQVWTDAPTEKNRATVIGRRSHMPEASGNQGRSTKVQSSMAPGMWCLKEATTGHRK

SEQ ID NO: 1010130 - protein, 345 aa, Homo sapiens
SGVRCNTGPAQKREVASRGPGRRRCNGLGSMWQQPLVTKPTWYRAWKLESRRGRWQAAPGSWARERPSALQRAPRSRGADDPADMADRATPRPRTYIWGLYLERTCMDQPYMTCPVRSTGVRGHDSFAQINHAFDLSWARTHYRVCDPWVIHMPRVTLDEVQLLHSHGARPLSDCAQDHPRAGSKTTKLHGLREPPTRGTEPHLGTSKLLPQPTAGTVGAPNRRLQQRLSERTPEARHTDRCFANNSNGELGGPTHNNQGVATPNNWETWGSNMIHGTGDEDSDWKNPSNNTRPTQLAHYTGHPLVMRKGDTPSITLRKHARWLGTYTTGSSVAQYRAHHTLETA

SEQ ID NO: 1010131 - protein, 83 aa, Homo sapiens
RGSECGAAVMAGVCGAYFPSCCCLLLSGDVQSSEVPGAAAEGSRKGRAGRHRDDRFEIEGPCSCFQGVNVSMDLDLERRRCAW

SEQ ID NO: 1010132 - protein, 136 aa, Homo sapiens
SGVARLLRSWGRGGTGGGASAERRPGGRGVSWSCRQCWACSTSPGLSSASELLLEPLWLRCTLGAPAVGLAVPQLDACLVRTSSLSCMRRGAHALGPRATHRECDDYRRDSTRLGPYETRKLPGGCILCENHLEAG

SEQ ID NO: 1010133 - protein, 175 aa, Homo sapiens
MESNLSGLVPAAGLVPAAATAVTLVADSMPTHTLYALHLLLRHMPRLWLVHSVWAQASQHIRQDVSLCPLSASGADLCEYTTVFSVHTFRRYSPEDKSDMEALCHFLGLLITCMHPILAIARFLSTLAPPSCNLVHFDPGWVIHKDKRCTQIEDRGAMNTTRAIGIQRGPDKGAH

SEQ ID NO: 1010134 - protein, 56 aa, Homo sapiens
MAANPTTVPAKNKSHVENNMGPRDATGDPEMLQCLVSLLAVPTGSGPVLTLVTLGE

SEQ ID NO: 1010135 - protein, 70 aa, Homo sapiens
RGRSVRLWCVRDPNASVMREVEELSSCRIGQGWTLEDLQPGRMRPLMGPDVVTGSLAAVTAEPFGVGSCS

SEQ ID NO: 1010136 - protein, 224 aa, Homo sapiens
AECSASDMAEAMDLGKDPNGPTHSSTLFVRDDGSSMSFYVRSSPAKRRLSEQLILHGGGTVCRVQEPGAVLHGSSPGEALAEASGDFISTQVHPGLRVSSRTRGLELEALSGVGPVLGRGTPCSEAKVPSGRLGSEVRRRSRSRYDENDQVRISAFDGMTDRRSASITATVKDKCHARLSSGHQVTPCVTAMDEELLTQYSWLVPEGPLLKHLRGQEHKYLLGD

SEQ ID NO: 1010137 - protein, 308 aa, Homo sapiens
SGVTAGRPVRSDAPGSPGPRLGGSRRRGGGAPGPGPARVGARPRGCVGPDSARPSRALGQRQGRALFSALDRPQQAPAMTSGQLETLPSEQSPAVPTHKKLVATASCPDWMGETLTDKKDTAPQGRSLGPDEHFPTAIGFTNQPPPGPPGPQWAGNAPKCGHQKIRTHERTLVHPRYTTHTCQSTPVAPEPWELLPLVKVSHGGYTKRRFHGYTKGALATASGQQTGTTTHRKRRLGKTTQPGALERTTTTHTHQRKPGNAHNDLPTTPPQQTTQAPTTRTNAPGTGTDRHQAKQDTHRTWHNPPDKT

SEQ ID NO: 1010138 - protein, 298 aa, Homo sapiens
RKSREGEHRSGRELWLRNARQAQRRSEMVPEREEGVDESARGLESNAVTRPPVHAAEETADSPGNSLIRRFFLLHIHRHRSLSRPQSEMKAITGGLQNLWFKFHRGITVDPSDYLLQCELLPAVLPLEEASGSSFDVAAKCALREWRLRHLLVIGERTSIKHIFWEYWAFISLKFSLLSFNTTTDLYYTSAAVSEETVMEEARGAHSAKMARGLVDNTVGGSSCLYWDTFEHWLAMDNSFRTNCLKLMDQELAGLSDNLACRYPKRIPTTQHKNQTSQEKGSRRQTRRHRRGPDLATE

SEQ ID NO: 1010139 - protein, 118 aa, Homo sapiens
MNEHQYNKGDLASKVVSCKFEASAYEDTNRSPGEALSQLTCVESIQGRKSTEESVRPEVNEAPPKKGRAEPQAGQSLRAVSPTPANWDRVSKKQNLTSGQALAAGHVTSGPKWSDLEK

SEQ ID NO: 1010140 - protein, 199 aa, Homo sapiens
RASSKITIVGRRALVCLPPRIRRAAWDRRDSGSRHGGAVLAGMTSSPTRAEEVHGGRTQIVVEPERRLKKSPRRGVAVSAVASAAVAAPFPGRSLGERPSGGSREVGTLYRTPGLDVHLRPLMTTHVPPMALFRRVPMGTAGGRRHRFDREATLEYPSQNADGFPLSHEPAKVCRCHPQKASSIVTLATVERHLGDCAR

SEQ ID NO: 1010141 - protein, 98 aa, Homo sapiens
RDHPLWLPSVTVQLVEWLGVIGELYECTGTLTQDLRYAEEESRLPLMTRSEGLKSPSRKASSDLGAIDESPGSHGKEELQGKRLENSTELTLEAEQGG

SEQ ID NO: 1010142 - protein, 118 aa, Homo sapiens
AGGARGGARACSVAAVCSSVLAVCWRDWLGIAVDERHVGCLHSLHQSRECDQTKSCACPVPCFHPSVACCPVIQLLGAWLLLPSSVHRAGQPAENYGGALTPGLSDYTTVPHVVSPVH

SEQ ID NO: 1010143 - protein, 185 aa, Homo sapiens
SGAELAGSARWCLGSLMGVLVDGGLRRRFISQSVYPSYQSASPSAVDVIGRGPAYLAIRPWSDQNYSVRSRGRFHCDWSRLRDRSAERTKELVRDRAPPSRTWSLRRSEPDARITRGERAGKEADGGQLNARIQTAIHIDSAKVGVSWTGNFEVMPTAGLVSDDKHMERWRWMDELRGWARPLKV

SEQ ID NO: 1010144 - protein, 245 aa, Homo sapiens
MTYHGGESYTGVLLDRAGIRRARVPVCCRANLERRRARAFFQPTFVDRTKACVPALMASWKKWWNWAPDRGARTRTTRTGWAALNGTALQSANIELHGKFVTRNGLTYKQVAGVACSTILVRGLFTSKNTLEQLTGGKPEFGFSEKAGEVGRYAEERVFRIEPKRLVLDSSNQISAGNDFGEWAGDPRKGSRTVEAGGGLVGRAFVFIETSGKSGALDFFDSKRFSKQGNWPPLYKVFFATKKRN

SEQ ID NO: 1010145 - protein, 79 aa, Homo sapiens
RERTGQTLRFRSSCLLAGRAPSRVPASLSAPERLTAGPGAACSTRAGNYDEESNAPVGDTKPRIRCLRQMVPLVLGITL

SEQ ID NO: 1010146 - protein, 189 aa, Homo sapiens
MAVVRANVLVDVGHARAVIRDPELCEESTEEGDQAGRGGYGLQEVDLPRGTSLIPFCCLKLTVSLLGQIRDMPALGGMSGLYRTGNAGYIDRPVIVLRSTTGPASSIGSLEMIGAWVHTRREIKATEGPSESMEVTRGSLRLEAEGQDGTARLAYRDRFQNHIEADSCGPSERRVKLRTVRKANDIRDP

SEQ ID NO: 1010147 - protein, 227 aa, Homo sapiens
AERPGRISAAARAERGSCLRAGAPALGPARAAPPYPRPASCRLLARLRPVPLSRAQSSTLRAHRQTIGTRSPAPGGLRAEPLGPVAKRRAARAGDVSTMTLEAASMLCDIAETDARHRHLWIRHDTGIDSMLGSILGRPRDSTRKRNNRRQGPWTETLRHIRPDKTPIDSAGQPAAPEAAQGAVSEPRGLGAQAESERLTADSTRYWPGPGGASTTRPTTASPNREQ

SEQ ID NO: 1010148 - protein, 193 aa, Homo sapiens
RTCASGRAEVDPVDLPCSAGGAQARSQESSRRAQSVGWGQAGSGAEQGEACCGPGLLAAVPPGVLGDVACPPQETVPLPRGPKTKGGQWGLRVGGSLRFSTDTTPSHSYPRSTPCRGPCPGDHQHWAPKLRTCFCLGQRGLSPPGVPSCHVLIPRTSGSATHVGNLHHMPGPPGPCRSAAPLPAWARLAPVDQ

SEQ ID NO: 1010149 - protein, 45 aa, Homo sapiens
MYYQSTDDKYCERSYCPSCRQMRELLFGKCNYMTHYGTRKRVYKI

SEQ ID NO: 1010150 - protein, 151 aa, Homo sapiens
MIICITGYTVEGEEDSVMCITFVVTNESSRIEKCLWWWFKSRRRLCEALCGRATNFRFTRAKMPSPFELMNIFGHFNQVVGVDTPFADKKTCFLKGWNIQGVRSAPGLSPFQVGLEKLRHLKNRGLIEFLCGLNPQGTMTFETKGRLTYFY

SEQ ID NO: 1010151 - protein, 136 aa, Homo sapiens
SGGGGQRSRVKPPPGRRLKEQLPPLVGPEQFCCCYGCCHEARLGRTSLPRGVIMLTEARSIHMEDGEAWAMVLFLITLWTLCNYFSWTFNILGVCEVEGYTMSYVILVWEKQTSEKYLRTRGEHVNFFLQASTGGP

SEQ ID NO: 1010152 - protein, 236 aa, Homo sapiens
RGVRRRAEDAGQSEPGGGAWAVTPSPRVASFESSYPSKFQFQQQQAAGSKAEQGQQGQEQSRAEHARPEQERLRVSESTRRDNRLGTFSGQLSPGIAVRESSSPNSDVSYKKLELNAVLASDGQLVCMLLWKNIPELKKCNYVLCVLNAQKKPEPVGKRDDNVERMTKDKSVNKYSGVANLDSRSKHFTRRKHYAASDLIRKDGGTDAWLTMCRNNMHSYTGQHSGQRGRGERIKR

SEQ ID NO: 1010153 - protein, 250 aa, Homo sapiens
MLKYLQKWRGSVCIEVDVKTGTSNKMVNLEVRPNMNRDKCYEQMAFLYVDVSGFGKTVASYYTRMEILRRFQKGEVKWTYSALREVNFSLEDGKIRACNNPQIQKWRGKNTKNGSRLMLKGSKIIAKNLWKAKMTYDLNVCMLEVKLDGKSVIEDSRGTGIIQAVCKITLQDDLTSQGYAKVGNLIGNIIIPSGVEPSSFNRNTRRKNNKCNAEMTEECTAGENYGETSELEEQSEKNEKQRTRNKQNTN

SEQ ID NO: 1010154 - protein, 91 aa, Homo sapiens
SGLEVPSTPCVYGVLEVELLGPQAWGKVPVGEIDSHPSTILSNRDLPGRLGPTAREEQAGGRMPIAYKTQSKLAEHGGADFVYYTDKLVST

SEQ ID NO: 1010155 - protein, 82 aa, Homo sapiens
AEYGPGTAVESERAFPAGTSRALALAGQVTHYKQYAPTQAKLFYFECREKKTENSKLRKVNYEETVFMGCSTILNKVLKQVQ

SEQ ID NO: 1010156 - protein, 105 aa, Homo sapiens
RSRPLGFRASRRSWTIIMVDMMDLPRFIPPEKCLFFQSGRHGNTEWNHRVVMETPVMNDISGNCGKWLEMSNRQGATHLVYSLMSTFTMKIAHRFGLLELYHVKL

SEQ ID NO: 1010157 - protein, 390 aa, Homo sapiens
TGFDECGSNKRTLGAERHLLVQGPRGGPQREHRRDDAFQMNSIPNGAALSTTDFLALLHPSLFSPFYYSTLVALCASSKLSPSGRHATSNSQEEECRHIAPLVGPGPTERLPPWALSAFYGAEPGGIVVGLPYFDLRRGALLRSPIVPPVLLGASGPKPLPLTCLLGFAQAIRCSTSTPGLWSVPCAKKVALEKPAHFSHARGAALWNSLHLGMKRGAELKDKRAGESHRKRPREEFSRSLGRPPASEKAGPRTLPHEAKTPRRLREKRRDERLGNTERGLLNYGAQEGLSRRPFRLRHPTVSNHFGPPTTPKGEDLGGYEGKDRPQDRGHYVCPRGFASPPPPRPTKEKSPEKDNADGEGAPPIRKHTNDHEDRSRVRAYHKHLGGYTL

SEQ ID NO: 1010158 - protein, 90 aa, Homo sapiens
SGVGSSKILRTAMHYRGALSVWARFETDRVMLAIEVVWKRLSLDGHCLVRHELINWSARHDLSKPVRSRRRRSPRDTVLDKKTSYRPSQR

SEQ ID NO: 1010159 - protein, 214 aa, Homo sapiens
MGEDLMRHCSLGGLTPGGLWCTGTPTVTSLWFPNTWFPSVDWILPLGPEHFRVLPGPGQGQVAARFVGPLGVCHGPTRGVPTFAGGLTVFSPCFSLILERDFPSFSAHSIPLRVSIRHLACLLRRYTAPKYGNTPKTSFNDAFALKGLIARYSPETAAPMDTCIEKAVSTGDTHEATLFRVTCYLRLCRVTPTRLSTLCEAGLMSPLIGERDIT

SEQ ID NO: 1010160 - protein, 127 aa, Homo sapiens
MQVSCSLVLLSTEQGLGPSPQLQGWILHCLSPVPVTSNPMDLRPCPWTIGETRCWNRLLSSGNRHGLTLLVTPYFPPQNLHHRGQNPGLSLQTGQTALLYEHLFSLLAPPTRRTAGTLCTLLKAPLY

SEQ ID NO: 1010161 - protein, 280 aa, Homo sapiens
AEKGGGRPPYVVWRVCRALCVCAVSELLVSGVFPELLVSGRFPTVWCLAVFRPLRVWSTLLSLSCFGCAMPMYQTTKTENNDSEDTPSDLQAVNERKQLQTTTEQQRRWHTTISTDATGSHSRVTYLHKPESSAEPPANCILIQVLRTAARTSDTAAPQKSALTCVDPALHNGLLRLARDLTRRAWQPLPLARFTGTGLRFPLGTPVRPPKQYHVVWATLARPCSSNFTFALTYYSLTMVERYTECDRKARDEAQAWFLQGTPLCAPFPRGLHYFTLRIT

SEQ ID NO: 1010162 - protein, 310 aa, Homo sapiens
AARGRAASPGGSGGWARLRQSVRSEMAEQPRTRPVAPESREAVAAPRETAAEPQGDKRGTPGRGPPGYEAKMQAAKKTAALLANPVDLRGPGRFGIAPKATSQNHIARIHLVRWIPLGSHKGNNACNTQRTVPTPISAWGPLMAKPDQQQGQATPTAPQRRTPHTGRASRNPPSAAQTPNFVAHGPTGKATPHQSTNTTGTCHNMSDREHQRGPHESDLDGTQYTMTIPLETVRDTPTHLCTILTASRYTHFTADSTDATNSPNCCPHNRMEDSENYIQVRVRCHLNHLLDRLKSEVADNQPSSHTALRQ

SEQ ID NO: 1010163 - protein, 151 aa, Homo sapiens
MAWSAGRHENVVLHVLFSEELALFAVTQAEGRSQCFWLPNSLLNRYAGAGTRPDLAVQSSTHVGVKCQQLDVELSDDSFPPEDLGIVSGMLNVNMVTGLPLIANVCHYCGPVPSQMLVISTCSSAINYLPGPMSDGPGCDWSLPDAAWTVE

SEQ ID NO: 1010164 - protein, 116 aa, Homo sapiens
MRRPYVLMYLVYWVACCYPECWAQQRSNELCVCANRVLVMSSMTIVFAMNPVNVTDAVPRASMASLQSPFAAATRGRPSAPHGLVTGDAKTLDERRQQGKTPEAFGHEGNDDNENH

SEQ ID NO: 1010165 - protein, 159 aa, Homo sapiens
MSRVVQSVDEDMQSFVGKGNAQFIFCSDHYTIGKLTPGSAKIQTITFLISPPDSLRQWDGNKWNDAISSHKSMISYMPSPKLGPGEKYELHADDRHQLPAWWSMYVRVIKRRRNEEEMAKNDGDLSQKLSRPGGRSTRRSTSAELARDEDAFQIILTGG

SEQ ID NO: 1010166 - protein, 186 aa, Homo sapiens
AEEEVAAGLKAAVSWQLGQALVSGYSSAAARSIPRRVYARFCAHPRIPVPVFPLTHRPRYLPAARALRPGPAGGSDPARSPFWNLLGTIPFTLTAANPRWPSRIRSAPGSAAGRGVKGVSRSGNGGAPNELWSQGEGRNEEAPLNGAERADQDPRACKGPERGAPDAARDCPMVQGGSDVKTRTNK

SEQ ID NO: 1010167 - protein, 320 aa, Homo sapiens
ADYRHISGWGMACLTPPRLIHIGVLVCYHTSGCMGLAHSHIVYPMNHLSHTAGCCHAFFTSGSVPRLCHVLRRACTAQMQAQSVRTVNKPAAAESAYIDVVSAHGVPIIVLIDPLIVTGKVIFPVEHAYSGTSVYIFVYFSMVLAFALYRPQRETTRSTWIWVARLSALVVTRSVCAIEPIVFHYLESKTSEDDTGKSKSHRNAFALESPIGMRASLVAHVYSWSRAPKYVHAWHMSQVRSFYRFSSQGLLCWRKKPIHVRTPWNTLSMCRHADVNQGDRVHGHRIYLCCTEYFYPTVHRFPLSKHSSQSRVNLFTPPPL

SEQ ID NO: 1010168 - protein, 56 aa, Homo sapiens
MTEVVGLRNLGTLGQSMSSVRGFQEDSPFDRMNGSEFSMQEEPLVHWFMSLLKLGS

SEQ ID NO: 1010169 - protein, 301 aa, Homo sapiens
AGFRRRPKCAVERARTDAQAAEPVWARLGPCGAVTDEHRALEPGSEDFKMGDQDPAGHKSPLQQMVASGNRGLWLPLLLHDTLWTVVKGSAMRVSAARPWPSESDAIPSRTCGASPIRKIARPLSNPTGEVPSCIAHGVLEPLYLCPNGARCCHSGFKTLTRFTGTMDAFVKIVEARGDPGPSGSELHRTPCVMTVPVTAIYFTAYDQLKAFLCGRALTSDLYAPMVAGAAGSPGHRDCDQLPGAYAGQRLQAQHVSYPGLGCLCPNCSGSGVVALTVVGWGPLPLDVPYSSPVLVNYKLV

SEQ ID NO: 1010170 - protein, 109 aa, Homo sapiens
MVEIRKVAHDCVEARPSRLQLGVAKILHLARYQPRVLTRREASDEVTVCLRMLRSRLPRDGTESPLASILPLNWYKSTFGLLFDLDPMYRDAKFDHNKDIIRYPYRPYF

SEQ ID NO: 1010171 - protein, 193 aa, Homo sapiens
AERGRVCITPYARLLAGLRDRHRWARETPPWVRGVVGRAYEVTTRYERSIALMSVERVAKRRCERSLSPHGQRCSSLGDIDDLIADRLGASEHARDAECAKALWSPTEVEAIDCSLARFPLATIVEICVRVITCRPSHNARLLYYTVYRWLKGIEHYAILTSWRSFGWRSYIGPYPLVESCSEPSEIFVPKTI

SEQ ID NO: 1010172 - protein, 248 aa, Homo sapiens
MGSAKPRCGNPGANSTRTVTCAMGTLVSKALYLGTGNGGRRGSDQDDNAYSNWEGCVLAQGPHEGKGIHMKPSIGARRDPLGKFRFVPVGPPEVTPLGHAPRFPLVMPEGTSGESRVGLAVGIRSPMIAAQQLGEDGALKRTLNSSGRPLGKHKKGEPTFEGAHQRAYPQQTAQGAITGDRAWCTGKDCSIYSISKVGPNTIYRHYYEKEQLWARRRNYRQRSALVRSAKVAPGGALCIGGGGSLREK

SEQ ID NO: 1010173 - protein, 169 aa, Homo sapiens
RTSPLRLPGESGLSGPRLLGWAVPEIDPAPPYSLIMRKQGVSSKRLQSSGRSQSKGRRGASLAREPEVEEEMEKSALRRRENLPRGLLGASSPGEGFQSSETSEEGFGAKRWLAKDLFFLRPLPSYVLYFHWRSSGEQGARNLQAAEVLQTEPLSASLVFVAHFTFGYI

SEQ ID NO: 1010174 - protein, 102 aa, Homo sapiens
ADYNGSSHGEADMRTLNSRCDEGEVVGSHRGSDYPNSLALLCLYAIIETLLRMGCYVIRALEDRDSRKKGSRANGRYITGSARIRPGYDEFAQGGTGIRSNN

SEQ ID NO: 1010175 - protein, 72 aa, Homo sapiens
SVVVFGVTGRPGRGHGKDAAVRARGRYGAGSAFAAGAGGCEVKRGAGSFSCPNFQIAKSGRENLKNNRSIQI

SEQ ID NO: 1010176 - protein, 110 aa, Homo sapiens
MDRSARPEAEAAALEVLAEVAGILEPASACPKQERENCTGARSWLEVLVVMELSRRTDKLLCMPASGSGFPAEHPGSGETLVCPSRLLVYKLLEMSICHDFLGRTDSMDE

SEQ ID NO: 1010177 - protein, 255 aa, Homo sapiens
MSTKPVYTISVNLCGLHTITKGSPLAEVQQSVGHLWGKPIMGQGGLEEKVNCTHYGEKIALTTRPSVQHNLNVRKLVKAPKRIGKEYTKQNVEGDMTSIDKTNSISNTRFNAAKTRETEQGMASTETSKRRHLLGHNKGYAKTKAHPPGKTWPGNNTLKPEKTGQQKMIVAAKRDLRPQVKQHVTIEHRAQKRTYSESDDKPTRRNKPTEQDTNHKHERGHRRNNEREKTSRQQRTQKFDQHVNITNKRRGHNNR

SEQ ID NO: 1010178 - protein, 113 aa, Homo sapiens
RRYGPGDPQWRVSGAFPDGPARRARPWLGQVTHYKQYPAQHKQSLFHTLNAVNRRLDKSKLRKVKYEENSILWVADTFLIKYLKGQSSKQTSNTLQGTATECRYPKETIFPTD

SEQ ID NO: 1010179 - protein, 113 aa, Homo sapiens
MADEAPRKGSFSALVGRTNGLSKPACLAGVPGKPGGRGGSKKLVIKNFLRQTVWHDRRLHAGHVAEAATRRCRAVQSRHLPSGTSSTELYQAVENLVFSQSVPNVLQATASGL

SEQ ID NO: 1010180 - protein, 217 aa, Homo sapiens
RRGLVRSVAGPLPRPGSLAVPIPRVSTLHFWMKMQTTGDPEDTVTAELGDLGQLLPQISRHNLDCGGARRSVIGSGPQLLTHYYDDARTMYQVFRLGLVISGNGPCLGFRKPKQAYQWLSYQEVGEQAEFLGVRTICSTMVKHALISLLVLLGENRPEWIIVELWYHIFHGAWSRSMTPWDPGANPVHRSIQLDISTVIVDKAQKAVLLLEHVEEDG

SEQ ID NO: 1010181 - protein, 270 aa, Homo sapiens
RTRVGQGALRIHRDAPSAATVTASGHQGRPGALRIHRDAPYSRDSNGLRPPEGGQVALRIHRDAPSAATVTASGHQGAAHGPQTVNGSGLRNPGGERRAVRKSQLVARMPGICPRESAATSGRTTDHAQTVRSFLCMKAICIYVTDYPNLETVFFSSASRGAGGGDPPSRFPGGGDPHPGFPGGAVNPDITGFPGFLLHQTGFLGFPFRGLNSSFGVHTQGPRPGGPWLYQTLPSSLMLKTGFSTEKNLGHSEVLPASGRNSYMHFFSSS

SEQ ID NO: 1010182 - protein, 290 aa, Homo sapiens
RSVASVKSACGNLPHAAVAAVTHTRFQTGTGGGVLHGSRLVGRSWAASKNRDYCLVRRRETYLSPFATNGAEQRHSLGPEPVPRTVVSAVCSASDLEDLVESLRLVACRCFAEVMVTGERAGSDIYLCFGTYKTTEQTKVAEVDIAQVAGFDMDRLHDRGTGQSMGKVVYPSIVVEWVDGGQRDRIVGDSALLPFRIPSFSTSCLIPHKAGLVDSEASVAPVTWSDRVCWEALSGEHKPDVSRCAPARDVCCARMLGLALRGPYMPDCFLLRSALVMACPLRRVGPPVEN

SEQ ID NO: 1010183 - protein, 89 aa, Homo sapiens
RVRRLYRGGLEAAFVLVACCRWVRFCCQCLSRSSRRRTRSTFAVVNTMNEIQTCSTETMVRDYVITMTVCAHPMSVYSGTYFHGERLEV

SEQ ID NO: 1010184 - protein, 107 aa, Homo sapiens
RGVSSFPPEASLGLMLPCSPATAHLQGTLRAAASDRGHALLIGREQSTCVLHRTITYHPSLPQTLLQRFRYSLRLPSHSSVQDSRPVMLMREKNGESTQGAVRYGQG

SEQ ID NO: 1010185 - protein, 130 aa, Homo sapiens
MFIRIIKHSAGIVGVTMPVIVVVTDCRTMVTKVRSNPGLSLLAGYIDMITLAMATTMPVCISVRFAMKEIHFYDLAIMDEDQNIHNHVVETGVHWEQRLDGVVKFATEIASKKPNIRIKQRCSEAPCRIR

SEQ ID NO: 1010186 - protein, 150 aa, Homo sapiens
ERSGNGAQRRTRPSQSGVWPGLPLQPTGAGSLEPEPEPEPEPYAESSEDVYLAQSSRSGDVGPASLWRVAAQCRGASLYALRVLRLRAAPGGRGGKAMALTARKPFLTGNRSEDVAQYIGHRIGPAGIACKTGIIRRIEAKDILNLERNS

SEQ ID NO: 1010187 - protein, 110 aa, Homo sapiens
MDFSQNSLFGYMEDLLELTIIERPAASESSYDYRQEIMKRFDSPMNDLSDYGNGLVYLSQCCVKMSKGTSSHCNISAFCDATRIPLETLRRVLPKGHEHHAMFQMELGPR

SEQ ID NO: 1010188 - protein, 338 aa, Homo sapiens
ERGRRAGREGAGSRTMAACGVAPRGGARPWRRLCGGRFLSWGGGSLRAVLRRPGGHWCLGRMQNTRCAYLLASTKDAGCSASSRYCARVPRRSCCQGWSLGTKLPAFCQRSPSTSCSIEHDTLISTLAGLAHRVYRICTGRLACKQPRLPRGLPQRACHPFQAVIPGTLGAGTICRDGSHTVTRSFPRLGPIACALPSNSFSKHFFQPLVTPRKVASPPRPKGPLGPGTFGICQGLNHPNDRVRHPCGDKHRRPCDGFAGFNRRTPKPWEPPTAFDGLGFERHSLTARLKPARSLVRHSFFRCTTVTGVGTREAVLGNHEQRSGPTPCCSECTFPRGD

SEQ ID NO: 1010189 - protein, 125 aa, Homo sapiens
AGARSGRRHHRLWAVRGLAPGPAAAVLNFSPGLSCLPAGQSLGPAATMPEPPPPPWAPVPPEPPRLVSPPAPRRPVPSTAQGLRSAGARRGTVRQLHLQPRCGIHWVKPAGLLSLVGTWRTFMSS

SEQ ID NO: 1010190 - protein, 354 aa, Homo sapiens
MRGPCIVETWLLPDLARGTKSSSTSLIHQRKASAAAVPKVTGEHWARRGEKAASRRVCLYLCRCCESMRSMKLCKGGGSYVGADNGMWVNKTAMNKRRCNTRKTRQDFCRKSVTDESCRKHTGSHLGTSAVALLKQGTASQGALRHHTRQLTTLEDSPVSKKRATRVGRRYPVKDWSLSPLGALFPGKATTEPIFGGNDLPIWDSYCLVPATGLTERKPLPQCFTQASGDHIEKGARTWGDRAHSGAHHYSTFTSKHFHRFIGHRPPRYMKALTFPANPGISTSFLAATPLPTWPTLRTQKPQDLVHADREQPPSGWIQILLLNTSSAAKSSPDTQEIITNSTVLTRDAWDPNG

SEQ ID NO: 1010191 - protein, 170 aa, Homo sapiens
RAEPLGGHPAAGPAGRTGAGGQSLRPVPAPRPGLPRGGCAAQLGHPGLKGPPPGLGKRPEPPGAFSGPSGLSPQAGPGPFFGPSLGLLGASLTLPRPSPRPPGPSLGLSRLSSPRHGQWASGTRGRANRLHLHSQRLLTSSQEHRPVENPGNSLRLEKKSLARHSVCQKR

SEQ ID NO: 1010192 - protein, 95 aa, Homo sapiens
RGGCVIEGGGDEGWRRRSAPPRGRCAVPAGGGRVLSGDRRGTGGAVGTWGWGGVETASGWSQRSRGKVLVAMGEAMFVHEKSEVVEFAMLYGLYE

SEQ ID NO: 1010193 - protein, 113 aa, Homo sapiens
MGDRYHRKILDHCKRRYRCAGRTSVQHVQVTSRKFGKAIQIKGDYSGYSQLETRVHFDKGENDQKLGVNLGQQQAKGNNTRKGVVGEQHFGKWPLYSQGMETVYLRMNCGEET

SEQ ID NO: 1010194 - protein, 141 aa, Homo sapiens
SGLPGALSRGSGAGVSGACWKMASGGMSGGLAARAVLWLMCLHAAGELGTQGGSHQEGGRRLPRITSAGAEVVEGQFDRYFTSEEEWESALRDGGGLRVVLRSWSRLCEASARSGVNGRAAVGVLSTSPPDLGSHNSLRAT

SEQ ID NO: 1010195 - protein, 101 aa, Homo sapiens
AESSPQRRWERWGRGGVRRQEGEQVLAQEQRLVGSLAACSNSMQQPPPPPPVNADWYPRGLPSLAVPGSRARVPPQSAVGDGQAVGWSRLPRVNRPSGSRS

SEQ ID NO: 1010196 - protein, 152 aa, Homo sapiens
MLSVKAAPQSRKAWSSESRRPAFLALCWPACPCRSSALLGVVLGLCHMPHLRCPSASGLADGARERHSPICSPSTENLQEKPPVIVNACLQALGTVAVALGALGGCYYITESVVNKPLVPHSLAELHQPQELIGDGAGRTMFRISQRQGPEV

SEQ ID NO: 1010197 - protein, 122 aa, Homo sapiens
RVPRLWASSCRVSARAPPGAAHFRFPRTTGAARVWESPQSPGTDMGFRARPQLRIRLPRTEGHTCEPARGRPELRAAPVPLIGTPHSEFDNDSIGHAREKSYREVIAFSSTRQSHDDVAGLR

SEQ ID NO: 1010198 - protein, 94 aa, Homo sapiens
RIESRTGRRRRGGCPKAPRHVPVIAGTIELVPKIEAVKDSRLDIILLGGHCSSEHCRNKRIQNDAYTVERKRMMETEVTRCSRRGLASRFSIAQ

SEQ ID NO: 1010199 - protein, 138 aa, Homo sapiens
AGLVVAQPVAPGRRCEVSGPLPAACGLPGHLPLGPLLPDPVQAAPELACSGRSADGFGFLVPKVRFLDAEQGQACARGRAESWEGKACSVRSTKRLCANRQLNSRGNGLERWDFHHILHLKANAANKLCIAVHQSVGL

SEQ ID NO: 1010200 - protein, 242 aa, Homo sapiens
MNLWEQICKEYEAEQAPFPEGYKVKEEPVITGCASRGRCFFTGVQWQSTYSSRFPIVTIDLTVHPDPRDKLGKRIKPKSMFCQENILEDFHLLLLLLPGSGVACVHRERRTNKCCWEENEADSLPVIFWLSGYTSKIQRGQGSQFTEFVSIPFVEERLKQQATVANTTRSLGQNEGSKPLHSILLESLCGSLGSLRFKNLVSGRRNFGGEHGLQGRSKFLGKEEQKVKWALGDEWELVGQMT

SEQ ID NO: 1010201 - protein, 68 aa, Homo sapiens
AEGAGRSELDGGRSLVGGAWRSRNLRIPWLLAGLRCWLGVRCVCVWVWGCVCVCVCVCVDVDFNKCWV

SEQ ID NO: 1010202 - protein, 315 aa, Homo sapiens
MHKRSHHGLQGKVPQDVRIPQLQMNTERIEEEVDCVIKFMVVSGKKLKWLVFRRYAELDKLYKNLKTNRLSCYGPCKTILATDDNTLRCYILIQMSIYTKDSQRLKTEIAFQQATVRYHRNVCINPIPELLTRHYPVNKWAQGRTESSPRYRNTSPERIARHWSTRNWYPQATGVTTSLKHLDSKHFEPLGGTLFLANSSSSGPNTPPNQSPRRMDIPRNKNDQIREQHRARPSRRKGTPSPLGQTTGHHRRHGTARQTSQGPKKGNAGKHNKIPTNHTRHATNHTITRATERQSGAPTHTNNHNPLPQKVRRPT

SEQ ID NO: 1010203 - protein, 218 aa, Homo sapiens
MSSEYTGGTEPVGPVRELAIDALIIRETLASPLNTRQRHYIPQFALVNPAPGCEHPWGHLGPCGWFPTLSRFTLATGPRTTPNFHVHTISGTASGGLCNPWPSEYCAHIAGVPQPRAPQPSHFVCDPSSPNVRFPRSNKSVQSGTRNYPPLSGANSYKTTIVGTPPTMCVMVFTPSYPPPRWWLVPQFTAPPLSPLVRAHAELNDRQITRARQQTITK

SEQ ID NO: 1010204 - protein, 174 aa, Homo sapiens
RVLAAPPERIGGPVPSPSMGVVVGTDRVPSSRVPADSRMLRRHRSSLYALTDGKHQWTGPGAPAQTVRSSRPSVSSAGRRDAAWARGPARDKGAWGARLCRRRRNRTSLGEGPRVTELTAEGIRRQGHTTAEGRVCGPVTSDRIVDRLVRLKAYWAPIRTTHSTKNDVARAEFQ

SEQ ID NO: 1010205 - protein, 399 aa, Homo sapiens
ADLTARLPWRRHLKPRDALAVVVLTAMPAEHVRRAGPGPDAKTRACEDPARTAQDLNSPAYPNGGLCCWRQPRLTFELTVLAFRGLGCLEGGLLGESAFDEVPRLPGCQLKVHSPAGGPAWRVAPTFEITEHSVLVAQPVRNRSLVVFPPSKKAFGTVLLCFLWNETFTVTPKNFDVIGASLPKGSNTLGGGLTRNYQFRGFNLTRPKWGIKNTLGPGAFKASCFNGSDILSVQWEPRDYEYTTMTKETPKNRFYNNKPGWIRVKLSAHSLEGSHPLDGHEKFSQGKNVHIKEGLLGPLTFWETSQEETERNLPRRHTFMKVPFWKFERGLRESLEGSYVNRTPRQQGGPRAFPNDEKRQNIYNICGRQFDQYDIFPPLWPMLVPQVNKVHSDLCLWRT

SEQ ID NO: 1010206 - protein, 114 aa, Homo sapiens
MLPGKVVLQVCHGSLPRSAADRPRLGVERSRPGMGRECPSWEPSRTLFSRLALAWVQLAVWYSPILLFFISGFSLSRKKNAILPSQEGECPVCLRKSPGPDEDNIRHWQTVSFA

SEQ ID NO: 1010207 - protein, 134 aa, Homo sapiens
RVYTPDQRRQQEEDRESREDGPPLGSHSGQRLAVRRVGAPGLQLSAGAARPGGGDRLRARQPQPPVQRAYRRGAGPKPTRPPKVSRGRAEREKTPKFLSSKKFLFASDNWMSNSTQGLGKGPPVPSSFQATEGF

SEQ ID NO: 1010208 - protein, 168 aa, Homo sapiens
MRAALRSLILVCRVSMTVESAPSNLHAVGRTLANRGVLYSPRTASQPGAIRLSERGRGPDQLAVLVYLAASHYHRCVATPTGARRQTAVCQNFAIVTGLELETHRSYGGRYKCKGPRCAKKDLPYWVREKVNGQNQSVDYYPGFRTSQIKLLRAVSQTGDCEDHGVCT

SEQ ID NO: 1010209 - protein, 140 aa, Homo sapiens
RACQALRRRGRSGGGGAIAKRSASSRTYSRCSARPAVSGWTWAAICAEAPSARPPVRTGAVLETPGSGQRWERGGGKRVRGKAWKAKAEENPTDGDPLQPLKDVRLVYQRLSRQRQRLDFDQDSNQEVIYPVPQPVLEGN

SEQ ID NO: 1010210 - protein, 210 aa, Homo sapiens
MAEAGAHSRSSWLLDCKLENEEDERLGCNYIAPGPRMSIQEIQELDKNDVVAVRIGIKEATDWDRRWPVYPLDPNRSSNARGDWADSWLCMLGSTEPPGDWYYGRAGKLQEAMSFVLKEGVEYRIKISFRSYREIVYGYEVHPAILYQDKASRLTRRDYMESSYGPRAEEYEFLTARGGGNPRVCWPGAATVIKSRFTDDDKTDTCPGSG

SEQ ID NO: 1010211 - protein, 111 aa, Homo sapiens
RSSDSSGVKASAMLTLSIPFSHLFATPSRYIHQCSKRRTKRKYPSVSIVSLIDKPHYGCHKFLSEHLDFNYQQAMQHHALASGVRNCKIQHALRPSFLALRTKIEPTQASL

SEQ ID NO: 1010212 - protein, 140 aa, Homo sapiens
AGGTARGVRRGGARVSAPRRVTRFQIFNRRSPLVCALRLPPPRLGARIRPRKPDLQTRYLYCVEAVSWRKERGVRPVNRPGEAVLTRVPWCDTFLRTQHVGAGRLAMNSGANEDPTSKGHFQGGNPSQKSEKNRPYSENL

SEQ ID NO: 1010213 - protein, 108 aa, Homo sapiens
AEAGADVPCMPLPRASIGPGSFTLAFIWWLLGYFRRALGPARYCEHIAILEAAGRRHRWHAFRTARLRVWSIIEKNRSVCQNEIGNYSVSNAELEITGESSADQTTTT

SEQ ID NO: 1010214 - protein, 313 aa, Homo sapiens
SGFFSPGRLTLRQRRELPTPYTLRNHQWLRVGSRVTSVVQNNLVECLQWSLSTLLRYKTGAQGPDLLFRYPKRQFPFYVSKTQIRNPPGELYSQIKEFFLGSGTGSPGNFAGCECMGIVLLTAFGRGQAAHWALTYLLEGPTAGESLCVAVQKDKSCPEAGPGPKSAPAIWRSAPAGGLARPLFRPGCLPRPIHLMAVTPPTRCPKIDTPRGVSLYPSKRLLWDPIFQLWSIVKPKNGETANGGPQLFGKNTFGRIHGGTERQNRLEMGGTANKLYPRGGSASGRSGKFGVFYTLFDKREPEVWNPYYTALGA

SEQ ID NO: 1010215 - protein, 107 aa, Homo sapiens
MAGRKEVEESAGRGLYEHVKEKQLRPKRLFEGSWESGPGPHRHLGRCVVANRLFPHPPPMAEGPSLRHVYTEDDFYCPVCQEVLKMPVADHGLSATFFCTTMFPDLQ

SEQ ID NO: 1010216 - protein, 66 aa, Homo sapiens
AVLAVGLEKRGACCLRAWACEVGLPRGQCVGRGPKELNHVRSVTGRRGRLSLTGVDVGYYYHDVPP

SEQ ID NO: 1010217 - protein, 104 aa, Homo sapiens
MARQVARRYEQRRSLHARFRRRWRLAAWAGEKCIVRYWAGDYAGNGLTRRHYRLTDGKKEVYIEATVYRKQPLIEPGLTVSTAIWVDVLCTTRETCCCHGPRTG

SEQ ID NO: 1010218 - protein, 245 aa, Homo sapiens
MAGHGNNKCLMGQACNNTAKWSNHHKQQLFVTSVTLENTEDSKTKLIVNYLPQNMTQEELKSLFGSIGELESCKACTETKLSRAELGIWLCELYIDPKDAEKAIKTVKAGGLQSKTIKVSYARPKSSSIRDANLYVRDFQKELTQKEWEQVWHEYGALLFSDPGRPGSVRISRGCQRITRTLRNAQIGGHQQTLIHKPLQGARNPPRVSTADQASGKDWEIEPNDSKAPHAPTRCTECHVCTSNR

SEQ ID NO: 1010219 - protein, 154 aa, Homo sapiens
RTRALAVPTEPVMERPSLRALLLGAGGLLFLLVPLSSSSSSDTVRPCELGSVPGCASPAGTGCLGESRDACGVLRLCAPAAEGEPWGGGGGRVGGIHATPGMECVTDAAKEGGRGKTPGAGQPWGHAVVKARRVAVSPLRPDTQGCRLKTRKQD

SEQ ID NO: 1010220 - protein, 151 aa, Homo sapiens
MGASKGQKRKRYGGPLGTTFNTRETRHTGALYTAKSTEPPPWQHILLRRVTTCGGTLTHFIHLYSHFPGYLLEDRTSGDPFGIYSKLWPFKSNSLKNWYLEFCTRELVVFFDRVKPVLIARVPRVIFLRWDPQSFRKLVLTHGLKAFQGLE

SEQ ID NO: 1010221 - protein, 84 aa, Homo sapiens
SGAGEETVVYSRRNCLLVDSTNGAGLMPSSSFMPCSRRFIDALDVGKHIGKFNTSCNCRKAAKFYRQDRIARIFVKGTGKEKKN

SEQ ID NO: 1010222 - protein, 294 aa, Homo sapiens
RTSDSRREEAGVDLVSPTPLTPPDPGACSATAISPCTLHAARRGEAMAKVSGAERGGPGEPEPFSTAPFRFDDHASSAVKPWLDDLDVEDHLLFGSADTDAPLIRSKTRLLVGPVPDRETHCLIFQADAPKRSLIPETCAVGVTVVLITLHLRMDQEFIRVGYIRQEAEYLNPELRENPPMKPDLLPASSGNIIGLGTPRVTPIRYSTLADIPTNETRDSTRPIRRLQRQPPPLRPDGTSQKFQNSSNIPQMQTGRSDVCITRWSTRTHHLEASRVTRMSNHLAHGDTLRILRT

SEQ ID NO: 1010223 - protein, 300 aa, Homo sapiens
MPRNYQPLKCTCMSVLVPDDTNRHSLSRRIRAEEEEERGRRQFQGSTLREGLGIDQEHWYTTRLESQRTEPPIIEAPKFGPMHPLTAPAYAHRTMVPGHDWTLSRSTQAPVAKFWTRNSKRNNLVQTLVWKFAILSKAATHVSTRNKLATMGWCQPKGSSTYRSEGPFTAYASSQGGWIDAHICQLRPRQHTTEVLPRPPNVIPFHSRYAKQGSYRQCASSILVCRGWRIHNTITQGTMMRKDEGEADALCTNGKTPCVVTTVPLCSNADRGEKTPKRGTSHTKTTRAKGAHTAHHVTRT

SEQ ID NO: 1010224 - protein, 209 aa, Homo sapiens
RVGHVRDLAESDGPAGASCAGLGTVCCRARSGATEGLGCVEALVPRAISALERLLVAVSSSRVSGPDLQAHPCYEDRPCCWQLRLLAAAPQRETCMVCVQSSVRAVGQSGYAGLCQSHCGVSAGSTGHSLDGRRRGTSRRQGIAPNCWWRQAPWALGGFPNSSKGVYKVSRRGFTFLGPLPDQVGGTPELERRNGGRKPILVCNREQAN

SEQ ID NO: 1010225 - protein, 223 aa, Homo sapiens
AERLNAANAPGQLHGRVCASCETMGNQWFSRKLLHQWPLRKGQRLERKPVVLPCILQTNLQRNEQQNFEHVKAEIISFRPQKRPRFPAMAFDVTLRCRLVGYDLVAWSSRSFYLGNEMGTHEITSVEFTWPSRGNRPQYAKVAIHGDELVNHTYHTPENYRNKQVLLRTVAQLNNGVNTKWELGVHVAGYRHRKMVPTKVGGRKQVGTIYRSQYEYYHEGEPA

SEQ ID NO: 1010226 - protein, 256 aa, Homo sapiens
RSSIGSGSGERTPVEPCSSPTGERPGASQHINSPGEEPVSCRRPAPSATIDRQTMSMRGPRLQTGRKPVEMHRRSILTRDKQAQNDDSHGLTPSPRSPSVALAGFVFASSCVYLAIPMASHSASESRSSENEVPPRSEPEYRLLQPTAYPLAQRFSPPTDGTPGNEARSTLSPHLLLALHLAVDLLVNRFELVRRQFCLACMAAASMTVLPPVSTGAGPVLPNYCNERLLTRTAEHSEPVLAKLATSWLREPFDAG

SEQ ID NO: 1010227 - protein, 180 aa, Homo sapiens
RAAAAPQLLGLGPRQPVHGRPVPRALSARAVAPDADVVLMPRSRFARTLVADSPHPSHLRPCAPERQVAGCRSDGRWRGPRGPVLVDASRASRADLGVPRAASLVLKGLPACRDRLERVETAMACLRRNLGMGSQRCRDLGCRGCGPDSYSTLASVCLRALLFDKALYLSWRIPLCPRRP

SEQ ID NO: 1010228 - protein, 107 aa, Homo sapiens
MAAINGRQAPRLKVAAGPVHALSCTDILRRPEGCTDVLLDQLGSKRHHENACYWVQVTSNSPKMRNDACSDRDANSTSNQHSLICKSSNQLMDDCHMESGTTSTCSN

SEQ ID NO: 1010229 - protein, 115 aa, Homo sapiens
SGGARRSVLNAATSPGQLQEGLCSGARVNGYKIIHHGPPKRHSQENHVILILKQRCKEESYTYLSPVDCPRPIGFTYQCSLVYLGFTRCVAYHFYLPRHETGIRDPRFLDLACMV

SEQ ID NO: 1010230 - protein, 93 aa, Homo sapiens
RVYLPMLCRRADAAGTSVSFWSYFTLHFSLSVLFLIVLRFRPTPPPMSRQLSTLLRRKMSLQGLGRPKDTRWCKHARGALGRLLQPLACNTRT

SEQ ID NO: 1010231 - protein, 120 aa, Homo sapiens
RRGGCRKPLCMLYLYPSGSPEGRWSPSVGVEEELRWEPPDEETKMMPNKLCISVTCYALTGVILMRVPVTIASVIATVVIVLASPELLGGDKDDIGAPTRLDRRGVKRLGIAITSVPSWT

SEQ ID NO: 1010232 - protein, 103 aa, Homo sapiens
SGSPSPVLCRERTRLDLCFVLVLFYPPLFAFPVSFANGFRFSSLILATFERILHFCSDGCPQCRGSQQRVERREAGRIVRWNVTVGTLPIKSKCSRNQPMSTD

SEQ ID NO: 1010233 - protein, 146 aa, Homo sapiens
AEKRTDGDGDGREQIQLLLRRRVAAAAAVTDGEICLQDEELPGLDSQWRQIEQRREMGEERTTARPGEELVPCGEALSISSGRHTCREGDQDSSDLSLACDQAMPLLFQDEINWALSREGLVEGEDYVQLPSSCIWHYRGRSCVLV

SEQ ID NO: 1010234 - protein, 80 aa, Homo sapiens
MADDSGRSITHTNPWTAANFSGLKPEVSSRPGMRTSSLSPSFPSGIRGGYVQDISHARVLNGPTVTHLTFNSSRCRRSSR

SEQ ID NO: 1010235 - protein, 86 aa, Homo sapiens
MCFYVGDEMAQEVLYQKVGGQGGTLKVISWRTPVKLWVTSRFTIIGKNQSRGLQAPTYWQVQVLWDFRPRLPCAKMVRVAKSDRMT

SEQ ID NO: 1010236 - protein, 136 aa, Homo sapiens
MRSQCPNSSMSKIIFVQQVYRQRYYKNVVFVLTYQSNVVMNADELEEISEIEKRLLALQVVGLSWASAALEETPWVALAALNRYTGGNVGAQELTNTKKVAPNCRFIRSFYLEDSATKAANPGVPNSQYQVEKHLG

SEQ ID NO: 1010237 - protein, 84 aa, Homo sapiens
MDTGARAESPIQGIPVGGFAPHYGVWPGALPVSVQLADPYALTVCQTNSPERLTPSLPGRTRPFGDPRKPSEECSMFRRTERHI

SEQ ID NO: 1010238 - protein, 112 aa, Homo sapiens
SGGSFSGPASAQRSSAPNVGRPSVRSECNALRLLWRARDDSTAVLVPGTHGGPEHPSHMTSAYSETVRLRVPCVVDCVPAVSLRDCGEFRAYSTRCVQTVSLPRDQGCYFSL

SEQ ID NO: 1010239 - protein, 125 aa, Homo sapiens
AGGCVWEGQNMAADPNKTEIQTLARGFVQANQLGLVRLRRQESELGQHHVTVFSCALTVPGCTDPWCVHLSFIRSTELDSKWNWFQREVYAVSAVNANADGVFVANMDAQPMMTNYRNIIDRVCP

SEQ ID NO: 1010240 - protein, 105 aa, Homo sapiens
MRGRQAAGEEAMGAAGLLLLALLLARAGLSEAGSRKRRQPFQDHAGLTGVITVADIVVWRGTAETRCVWPVGSGEPATCGDSHDMLCVSLLRPPHGTHHRAAHCI

SEQ ID NO: 1010241 - protein, 126 aa, Homo sapiens
SGVRGDSAEGRGQTDLGSVPGEPREESPAPEWRQACAEIRKPSAAQADVPVIPRTIAEDQACGKPCSHQSRGEGAGNADGWVGQIEDIGSASSGKRVTLWIHGEKRACNRSMWNSGLILHGTRKSV

SEQ ID NO: 1010242 - protein, 101 aa, Homo sapiens
AGVRDAVVTGPVADVRLCAGIWYSGGYERCVMRTVAGLLVSPVGRTGSPAYELRMWCGTQCGEYLDGPSVASPAYKVEQRQGGLGTDPPRSPLTADTFQYA

SEQ ID NO: 1010243 - protein, 85 aa, Homo sapiens
SGAGSLKPVNMAVTDSLSRAATVLATVLLLSFGSVARIVHIEESSSRQFFRSGPYETTGAVLVVYIPYSAFRLIGHVCNIPSSVI

SEQ ID NO: 1010244 - protein, 148 aa, Homo sapiens
MFDQAELEEYDGVDAGKYTIGLLARPLMGFCTDREGYYSSLCMTVVQNLMETQIILSYDCIGRLEVGTETIIEQHHESVKTNLMQAVEESGNTDIEGIDTTNACYGGTAAVFELLLTGLSPALGMDGMPWSVAGDIAVYCHRTMLDLQ

SEQ ID NO: 1010245 - protein, 249 aa, Homo sapiens
RNGGHLEAFTALEGLVAPAASTRVPRAPRLSLLPATVTNPRSAYAFLRVLKPRAAARPPPRRLRVLKPRTAARPRPGQASVWDTDWTSLPHFLGGFGQVSQSFACVLLVTGGPSPAGSPRERAVASPLSSEAGGLLRPPMTEPSLSRCCLLSPRASPPRTLGGFSCRAAGDSTEHLHVSVAPLRPSGFCSTACFTRSSSQLHAGPLPASLPSPDQLLRPGHRDPWPCLQTQMPRPLLTFRRGVLGADKD

SEQ ID NO: 1010246 - protein, 97 aa, Homo sapiens
RGEAMAAIKAVNSKAECGAGPGSLCPVNYMRRPRAAGLCLRTNLGPNMAPVKKCLFVVQHDIQDSPKDGNCAARMRCKTSTVQQRSLHSKKYATASG

SEQ ID NO: 1010247 - protein, 167 aa, Homo sapiens
SFARARCTKERRNERCLAHEQQSAMISHSIMLLIAEDQEPRVYGNSQHIAPTALLSSSANRCVSTIEKPQFPRGIPTVSIPQAGRSLSELLSFSSCLRPGDSSSHEKSEEAGTPLPLALVPQSVMYCLPDTEQLGEEELLRTESDLLGQSVTQATSSMEEINGFAKP

SEQ ID NO: 1010248 - protein, 111 aa, Homo sapiens
RGVTGCRLLSAWFFFSCRVKAPVCCFLVNVCECLLSCPRCRRPGSCAKWVRAACLCSHLLPSPVPARPVVRVECNVAVRFSCLLSMAIRVPLPLALGMVRISNARGLNRCT

SEQ ID NO: 1010249 - protein, 136 aa, Homo sapiens
AGCGCAGLRHCSVYAGGPGQGGVDGSHTFVPSHWARRCARIPGRGAGVNALGLSQAWRAEARRTRNPGYGLTQGAYLQSTSTPTMSPDTESLWERLGTQLVTFATLRSCCSCVNHLSLLIEERFSLKSVILLLSTL

SEQ ID NO: 1010250 - protein, 409 aa, Homo sapiens
AGHGWSQTPDLNVIHPPRPPKVLRDYSVEPHAPGHGYALSLSPLSRTASALLNFPPTFLYHINLLYPLTSQLSSSPHTALTYSISSNDSSSYRHTAPTRYTYTLLTYYSSAYNREPRLSTHSTHTHCPPPFAPPVLQHTSYPFLYHRSLLLRPRPILTFKAQLLQALHSSHGLYPYFSFHLRHLHLTPPVAPFPRNLFHTAYCLLTLLPPPTKIDDYSSDNLPLRALTTIPAPTNLISTPTTLYGDTHLSSALIYNHLGHPTVLSPCLTYPLPYQTPPRLLTPRHSHLYLFLATFINIISLRSTFSNHLAALPTPPEFCSIATAPTVSQGVIRPGSYLFPHSPSSSGTSTKRIVNKLIPNIRHDCINHTSDGSGPVGTNAWYPTTAQQETKFESPAAAYAQHVQDTSEC

SEQ ID NO: 1010251 - protein, 241 aa, Homo sapiens
SGGVCAFALCSASGGCSLCLLRSSMEPAALRPASSRGIAGDLHPGLAVVVRSALESSAWWHPVWKWDAPGSHSGTSREDLLHEGHQLVNRTMSLGACVSLPGGLTATALPCWLGVRQGQEAADCREENLDNGIPAHWRDLGEFLQRHLAGTSPEVRTATVLNELAGLSLVRDHFVRTGHAVTGIAEAQYVTGERDLCNVRSRRLSVRGPETKLGEKRMTIFQGMLAIAGLRRSIRGFMYRQ

SEQ ID NO: 1010252 - protein, 417 aa, Homo sapiens
RSRVHANRAGLGADCRVREERWGVFAEVFLSFASHPFVACWFCCFVGPYGGIRQQCRPEDVVKVELVPEISIALQDGVAMSQVSLTSLSEALHRTSPVCTADFLLGRTAGMLEGLRRLGVWTCDSAILRQYDDPLETFQLSLLGKGTCTQVRHGRNALMERNYLILSGLGSIDPRGHAALSLGRATGAPYESCGMMVGKTGAEEHVPIAWCLTYEITDDPDYSFFHRLLLPNTPMGFNLWGQSWLATTCWAWRVHVPFHCTRKRIGHALPFPIRESQDNGDRGPRFVKINVAIAFWDATRALFLGPRRTLLWVPLVDILPWESKPWRVVFPLALGTSRRLFQSPNALLGERQMGIGYGVPNGCLTQGWALRGQPRIVRHSFSVGKTCRGAPLEQGGLFELTYTGKSSFWETKAGHTY

SEQ ID NO: 1010253 - protein, 216 aa, Homo sapiens
MKRPKPGEMGTLWRQPEYPGHGHALEDNLITNLRAVVGLEGTPHEVVACEGSTHWMDGLAGRHWVVAWETAVMVDEARVSSESEYLQRSRWKRKPDVSRINRTMNAIMVMELQSSLGLLVWGAIERATVLGSAHEQALHTFSAVTMRTVTIGERHAPCTPKQVVLQALVVSDTANQEQTCCARIGVNYHKCRGSHTVHHKATRGGRPFTREPSVPA

SEQ ID NO: 1010254 - protein, 113 aa, Homo sapiens
RDVGQAPCHSVGNRAVGDPRGASEHAWREEQVLLVVRASAGQAMHGLTLRSLSGLSLCYHVGAMFVLLHEDDRKQERHAKNVENRQLCIGPMKDWLLDDYAQNRRTVQDRRIE

SEQ ID NO: 1010255 - protein, 337 aa, Homo sapiens
RNRPATVLCHDLWHRRGPSSPQCDSNPSPRLLTRIRRTPASIWETLEHAWLPGKAERAGAGICSSFRDLRRDGLLKVSLRLVEELTRSGDVEAGRCPLVVLAGWDFKAATNILPTMVTMGECLPRGSFAFMQASCGDECFVPPRQVVLSSRQKDAVLWHIAQYYCHTAKTVALLVSPRRGLAVGTPEGQRIPKQKQALARTRSQNARAKRLEWRQFVQTSRRERDTTFMYNRLSIRSITVCGDRWPYLFRRRLLLCDGSRWSPYKGKTRRGSCRLEPSPGLFGNLGMGTLYNASPCEGAERLRNMRGRATACHRLVALLRGKSRLVGHFTLVWDPPL

SEQ ID NO: 1010256 - protein, 56 aa, Homo sapiens
MTPTYEYQSETWDRTRHFRLLTIDRLTVNACVGYYSWTCPKSLENRDVFQPSRPGS

SEQ ID NO: 1010257 - protein, 209 aa, Homo sapiens
SGCPLPRPEPPKRLGALHLPGGWACSAAAARQLDPTRAGAGQPRPWICAVAPPDHCTGLSLRPPIATWACGDWAGGLAPSRLSDHLVPFGLAFWLARGLPKAQYSPPRTFATGVGCAFPPCWKPGLVTVGRPKVGPGGTRQNCEAQRKTHPEAGNRTGPNRRTIRETHTRRPIVLNTIRRTSPDGPRRGQKEKPQTIQPGREPPHTSTE

SEQ ID NO: 1010258 - protein, 262 aa, Homo sapiens
AGGRSQWPQQRAVALCGPSRAQRGSRPDLSLRSTAAWDRSMARHRWPSWRRTGRRLRGCGFPREGHQVPQQDYEALRKRVPGGPGTLFQDPSFPASPSALRLQGVWGPNSSKNLGHLSGKRPTEDLALTPQFIIGGASRTDILPEEALGDWLGGWASHWPSLTFELRKLLGSSRPPLNQELPGKNLCRDLSLPVTGKYGEWGGRWVVDDRLAPPKAGGSLLFGAFQPDGSEVWEPPWLAKASTKNHGCYEAHTGGATIEVRR

SEQ ID NO: 1010259 - protein, 146 aa, Homo sapiens
AGYQKRPLSAARDQAVQRFSHPATVPAADRSQPRSRAQRRGRRPPPRRGRLLSLPHCVALTSCRRLRARPRPGSGPSPARQRAKVNTGNASGTRPEAKGPKTEGKQRNESDADGEIKRNEEDKKNKVIETVMGKEKEKEKNTREKD

SEQ ID NO: 1010260 - protein, 71 aa, Homo sapiens
SGGWGHMAATAAKREPRRRRCRQHIRHIGADTGGSPGDPELSDESEKSRCIRVRWTVAYDCDCGELEPTDH

SEQ ID NO: 1010261 - protein, 214 aa, Homo sapiens
MACSIPCQGRGGPARRCAKSNFRGFRPFTHLVGVVPILPMLVPAVRSSAIACHHWLGPRLVGRPIVVTVPSFNHILPRAPLYLSTLGPGSNPPLFPLGPPLVVPTPFFSSPFAGLILRRQRGTYTPGFENFAMLGSSGERLNPWWRRSRLWDTRGWAPLGHLGLWVPTTNFRKREKPQRQIGTKPPPGRLELSNCAHNGDTTRIPPERANLFPR

SEQ ID NO: 1010262 - protein, 87 aa, Homo sapiens
MALHFKFLVVTHCGELPITPVFPRGDPSERPFTIIHFALVEKPPCGDTGIPKQWHAERSRKPAPEKPTVGTAWRPRLRYSRVDSAAA

SEQ ID NO: 1010263 - protein, 115 aa, Homo sapiens
MQLETSGHLVVQPHIPTAIWYLLCAYLYQSGQSPVYTMPSSGPGGMRSMYHSPLDCTPLMRYCQVRSEDRAPLEFDTPQTLDLNQDLTMAPRSNQYRLGQHAIQIRYQLLRIKCL

SEQ ID NO: 1010264 - protein, 279 aa, Homo sapiens
RRGAPHLPDGECWPGGGADPARVSAPGRWRLAGRGWLITPSSPPGLGRAGRAEWAPHLPCYGASWADGAPSPPGRGAGPAPSTTKQGIELPPPSSQPHDLIHLTRSRPQLGFRTHPRRSPPNRSHTPRRLEHPPPSGQDTSVTSTIEGPRTAPLCTTKAINGLQHDQAGATQSTGARTREKQQSNVGTVDTTRRRPKTSRQHNKTFAAGQARRRARTEAADERVSTTRSGDVDKHMTPPDKYTPDLSLNHSTTRYHFAAVTYSPLMWQPLTKVTIKSNI

SEQ ID NO: 1010265 - protein, 72 aa, Homo sapiens
MGSRFFNNLLPLFGIHGLAPFYIPWGLFHSSVWFVVGMTKGPPSSSLIQLVLLGTILLIPWNESWGKSNGRR

SEQ ID NO: 1010266 - protein, 67 aa, Homo sapiens
RNALPQMLNDRHEDNTFLVKMTFISRTILSCAPTFCHDILSKENLGPSPDVATSIHVTLYPILSRDV

SEQ ID NO: 1010267 - protein, 297 aa, Homo sapiens
AGMQPPPPLPPLPPSLRALLPFPAYYIPKLTDYSATHARILTFITNSPQSTYTLQLLTHERQHKFTLHINIATNTHPTRTNATQQPPQYLENTISDHSQYLRRGMKPHPKHIIIHQRENTQTTSNENRGPHMCGEPTHFSAKHSRKGVSRALNTNEPTYTQPAHRRTSPTVRSRDNAPPTATLLSHTTPQRTSPLTTPPSFTFTTKPTSTRQQRLTLSQHTKRTTTPTDTPPPKHNPHLSNHHYSKHIMTIKLQLSDKKSHTSQTLATYTHQYQFILNHIINNQTSIPTLNYMRTIT

SEQ ID NO: 1010268 - protein, 149 aa, Homo sapiens
RGVCCGASWAGGRGSRARRVQTGGRAREADRSVPGLSSPHSEPHVRANPPGGWLSTRGQPSEASLAVCGERASGSGEARKGGFARLVWGAGRASLWDCLGHFGCGVGPKTFIERKLTHLDGKDTGQVKVFARKRVAHAYSPGCRGGRIA

SEQ ID NO: 1010269 - protein, 74 aa, Homo sapiens
SGLVSRLPGPRLPCARRAGIRSGGKRTIPFCKSEEAKCPGRRTSLRRESVRRMRLQGEAHVSNGVQNDQHEHDR

SEQ ID NO: 1010270 - protein, 215 aa, Homo sapiens
NGGVQSCLRDPQWGASSEARRVRHSAWLGGVAALGESPRAEGAKQRGGEALAAASSLRACLAVRAQGDGNERRAKRGDPARRSVREPRRCPGVREANRRGWARGGEEVLRGLAEASAGFVSEAAAAAGGGGAGGGCGKALLRDARFRPAVGPLVASGEQAPRGSVCGGGLAWAGEADAGRRKPGGGVRAFVDSGPGLSPQLLRGWVTQSKEENRG

SEQ ID NO: 1010271 - protein, 261 aa, Homo sapiens
MLTLPANPPTDASDGLTLLRLPCARTDTLPTLRQTYLPLTHFTNRARKRTEHICTRNSWDSNSTRSNRVLTIFSSKCSPLTPLGPCSALHPAQKTRFTTHLQKLASHLLLYPNAPPVPLNSASTCATELLHPQPNPSRTPFFYHATNPQGNYLLPTSAHHLLPTQANSAAQPTSNLHTTPSGKPPNRHLSRLLRTPPPSPSTPLFKPTQTRFRQTSPLITTPYPRQPPHHWPFSTAGTFSSKLRATLSQSELCQTLTTAKK

SEQ ID NO: 1010272 - protein, 108 aa, Homo sapiens
MCTMAQDGNTAVKFHLYGVSLVHWSYDGSFHDAFVYLHLKTKSLSKDIDYLLVSNEKGEIGAAFMMLYNVYEWTEMSTKDMLKTSRERPMTKDQVDEGSMSDTTKEQC

SEQ ID NO: 1010273 - protein, 125 aa, Homo sapiens
MTRSVGMLHSTCARSLCCTRVHSRLYQTFTEQDPAGVAFGRNKLSDSRSMQKRGLPGARNLGPVTGLMYSRELCMYFWSLECSTVEASGRQFAWSCVSRYFTAWELVLTMLSICRYRSGKVQSYE

SEQ ID NO: 1010274 - protein, 151 aa, Homo sapiens
MNGDKWCPRQHSGAFLLLFLLVLTVTEPLRPELECNPGQFACRSGTIQCIPSPGSVTAGRLARMKSEDCQLSRKLTGEGASSSWERTLWIRGRAGTEATIRTSRGERAHPYVQKFLGKVPRRVAPHYEGTRRLLTGLPDRGELLGCGRLPP

SEQ ID NO: 1010275 - protein, 47 aa, Homo sapiens
MEPQEVIRSNNVIVKILNIMMIQSRDKERENKDVQQESELKVYTKPK

SEQ ID NO: 1010276 - protein, 110 aa, Homo sapiens
RGGAPPGGDDTAPRRPEAPGGQFADRIAATRQRVPRRPRSMGCAPSIQGADAWWPRTRLAPRHRVSSGGPASRRARRRPLAPDPRRRLWESELRDGSGKKVAVADVQFGP

SEQ ID NO: 1010277 - protein, 134 aa, Homo sapiens
MAEEMDRVTLDCRHKKPGTDRILAEENGHGCSSRQQKRNTEKQMAVTPGDGQLLDGLPSSEGWLTNTLTHEQQRPSFAMAQAEDPNRQAKITTEPTSLNEYAATEKHENAEYTGYNTEITETYGPAAHIQLHRI

SEQ ID NO: 1010278 - protein, 68 aa, Homo sapiens
APHPIDSSDHIAISARLDSQTEISSHIMTSGYEYNMSVAVRHIRRKLLLTTDNTSDMSDSKISDRLDS

SEQ ID NO: 1010279 - protein, 181 aa, Homo sapiens
RGVLSDRRNLAGGPGTGWVWSFVPGDDARVQALVRGFASVVVAGLAAGLCEPLSWMYACRGVATLHAGQRDLRSADGASIYLDDLMSRSVEEGNRDKTHYTLRFWNLPIRRASNHRLESHRRELNYYKLIYMIDRSQYLVCVMGNPFRRVSRQSIGDDSREYGILDSDDGYPYPHTRDTIL

SEQ ID NO: 1010280 - protein, 142 aa, Homo sapiens
MAVAAGTAVSACRLLVGVTRCGCCDCVLSVVFIFFVEHILHEGNLISLQHERVGSGTVATDVVALADRRRSENSVAALAKSIVLCSVYSLANSSWQRNGYSSKTGYSYLTVMLATDLSPTMQRCKPYTMALRPAIRVGFQAN

SEQ ID NO: 1010281 - protein, 335 aa, Homo sapiens
RIAVCAPGRAVPSAPRPWTRTIPGPQGLLAGSFLEHLSVGRQGIGVLTSGGACSRYERLRPCPWCALGIYVGAKVSLHLRGLTTGHWVGPERSKHSEDGTRRRKTSGSPSIPCKVEAEDRTHLGQCASEVCQSPFPARREQGPACKGAWVLAHNHGQWQNAAGDNQPNNAVWPHDIPRRRGHQGPRPFHNGGGPKNPIYSRGTSRTSCEHVGSNGLGTADSTAATKRKNGSPEHIPENRDRGPGCTETDHRTTTPNKHERDDGTPIAEGAPTQRRTTIGTYPMAGEHHRNILKPTIGPAGPAHGTHANKEIQSEEPDEQATDTNPNGPQQATPTK

SEQ ID NO: 1010282 - protein, 282 aa, Homo sapiens
VLPSAACGVWREKELDTHRPPYRPSRSEKLVRPALGRGHGRPAPARVMTTEAVGSRCRRSSPGHFVQLPVPVIPSALPLGLWPGLLQDGAAGTCASWTTVSLRESLHDELQLTRSIWTIDLAYADVHRCLGVHGTAFVYPEYPWCCRHEGYKNQSFYMEALCTHDRDPGDITLFAHSKGLQGAGGMNSAQLSCARTSRRTWLSGHVAIVLVNSGVLRCDLCSMPCQCTAASTPVATTASARTPDYQGHVHRAAWLQPGHWLASSTMIPGYCRTQEVVSTRHQ

SEQ ID NO: 1010283 - protein, 334 aa, Homo sapiens
SGLRRGRPGPRHGGRCLEGPSRRPPDPAVGAFFLLREPQHGALGLGSGNWDWALAARLVPAAAFWSMRVALPFILQLPRAFGAPGLKTVDSFCLVCEHEKPRLLPSDEYMFILMNHLVVRVKDTTEVFMGIYVDTFNHLIPTEHLDDALISRIQPGRNEVWGGFQCKSHNGLRGLVEEHCFSDKDPIAEDLAVTSSGLPGWDSNDPNFQDALFNQLLGLDDIMDERTWSQQNTWPMNTHLIAGSNWTIDLKQRTLKDHSYATTPSAEDFSKKKLTLVYRGDHAHPVTKRFGNTSALLGPRFQNAGTIEDTPKKALAKPGSNGKRTVTTTQGSVK

SEQ ID NO: 1010284 - protein, 263 aa, Homo sapiens
RELVSAGAGTRVSASGPALLYSALLCPRLPPASASALRCGALAVLPWPGRPRSPARHQSRCDGDAQPGRPPAAMEPGNRKRRRPTGKALGRPEERRGRQQHRGRQKPARPGRALTNSLEGPLKTRVPKNGCDVGKGGRVEQKRLWTLRGTQQGLPHRGQLAPRALIHNGDKLPFNYHLNIVGTPPRRKHFNSIQGTVSLDFPHREQLLHGSTPWLVPGGCVGTFLGTDTHGFGHMLVPLNPCEGGRNTVAHSQDISTHKCGGH

SEQ ID NO: 1010285 - protein, 246 aa, Homo sapiens
MAEEQEFTQLCKLPVQASHPHCVNNTYRSAQHSQALLRGLLALRRQRIVLFDVGAGGGGQTSIEDPSLSAGLRPVNYFRGMFAGGLKEMEQEEVLIHGVSYNAMLRNILHFIYTSVVLVAQPECNVATTTPGGCLPASDSQKLSISACDFLMSWVDEENILDVYRLAELFDLSPSDYSSCDTYILKNFCGLLSGPDTRTASFQLVRKVYVPPQQATRLEVSCETEVYEGALLYHYELEQVQADQIS

SEQ ID NO: 1010286 - protein, 214 aa, Homo sapiens
MGRGGGAAARDAAPHRFQEDECGAPGEGREQVEAGAGGGAASCISHALKGTARELKKEAAGRATQENGLDEAAREMRSPAGSHVIQDTGFAVKISPLDRALLPEVSPQEMVQEIPGVMDRRTRVTAPVLTDLDWNVLDHFSELLQVEGLQEGSVLRVVQEPYTVREARIHVRHVPRPVQELDHPMPQRGDATPCLLSVFTTGLETRGSGTKVAH

SEQ ID NO: 1010287 - protein, 198 aa, Homo sapiens
HSLRFSVSLPPSLPPAPQSFTTTILIHLVSYLFRKSLVGAKAPTTVYAHGNIHVSTIVTEEETLDCIVPGFPGGLYMGDSILTYIACDARILEIQRGTLEMEMPRLSNTCLTDIIYQREDSTCDIPENAIFGPCVLSHTALYDGIACIALKSTDKRTVPGYTFGYDNLETSKWFLRRSHVAACRSNRAEITEEQNLEA

SEQ ID NO: 1010288 - protein, 119 aa, Homo sapiens
RVAVAMAMRWKNGPLGMSAAGRLVSPPADVDLWTVRADPFRGVDPGGPKVDGVTAVFRPVCPGYFEVWVDLICAPGFYLPQPSSNISMRTIIVERLKTVGEKVDEGDTCDLLWLPHCVT

SEQ ID NO: 1010289 - protein, 245 aa, Homo sapiens
MVAAFDYKPQESSPNMVRGRHELPFRGRGDVIYCDLGPMDDDGFYYGELKWTKGPGSIQLPESGPGPEEQCEPVQGTHGHPRLMMSGLGACNHTKVPRAPMVGHCTPARLWQQHLQDLNVGTPHGPRKRRRSWRLRSPKGNAAPQEAGALGNEETVNAVCHPAGTTEALERPTQITGLLLAAGEGSIAGAQSPRTFSALALVGIPDGHIDQEPLVKGHRLNWLLRLELSRALTLTPKGGEHVSAE

SEQ ID NO: 1010290 - protein, 116 aa, Homo sapiens
SGAEFAPPVVLHARGGIVERLGEAHESNKQEPSLRSRNRTDVGGESRNISAAVLVNTIEQGSEANIIRWLDSDTSRSSLGSKVLLSGFSPGLPKNDGLRWANLGVRQYPTKVTFGP

SEQ ID NO: 1010291 - protein, 371 aa, Homo sapiens
MVLPHGTGAGGLLTPEAMARAEAGVELMAIHRSSSGVSQPGRDYLSRHAISFDLKKQYQLYRCSSAQPLLTRNHQCRLRARARQGVYPVPVSVDVSSPWEPPRYQTPIAALTTPIASRSLQQTQRTASDSPNGNHATPLHSARQHAQGSSEQPQHGSSLASHSPQQSKPFRGNQTGLPPLVHSTPTMHVGKLGLSRRGSFQMGGTCGSARKRGSRRLLDPPFGVRSLLFPKWGPSPGRATKGFPRHTHFAADSYPYHPWRHREQEASGTNVYQGSSYPILRNSQFGMEPHRRNSAPNHTRARSPSSQTTAGLPRSGTRSPNQHRTTTWGPRPTTFEQPYTKPLSIGNLRGPTHSSNPHTASPRGNPSGPLG

SEQ ID NO: 1010292 - protein, 204 aa, Homo sapiens
AGGARGGQLGGEGAVGAARRNQPRLGSSGDAVGPGPGLSGASCEACRGPQSFRRSPEFVVIVAAACNAPCAISSSWACASSSFLLLRGPGLIPFPRCRLLLGLGPGVSQSPRGAVLAGAAAASFIILVHHRRQQAPRCSNRVVCEESQFTREAVHSLRHRQLNASYKGWVSQSTVYKKTLLEPFIGHQCRDIRYVWGLVRANVF

SEQ ID NO: 1010293 - protein, 313 aa, Homo sapiens
AAGAARCASGRRACAGPGAHRLLLVSLLRAWAWCAVAGCCCCGGAASDWAEPLVSRLAPCLTPLDPWPMRCLRGGHRLSILAHSSADAEQRDDDWEACPWSEFQALLMHDWRSLTEKELAGSRFTRLTLTTAKPCGHQGAVLITSGGPHGLTMRHVLASPWRTLNISLSLNGHGAYYPSKRYYERMGGTQWTQVCCPRLRSLNGRTSPNQDSKFGSLEAPGVNEVAAATGHSEEHKSQAMLLNSNPHSKAHATRRRGDQNPWVVGKGPQIHRTISAPKNHNASLGLIAEANGQRSRFNLAHAEGRHNERRVWN

SEQ ID NO: 1010294 - protein, 100 aa, Homo sapiens
PGGLSRPSLRLISKSGPRSASPLGLGPNLGSSSALRWDNPHRKKLSAQDIGQQWFPKRRLSKSEDKRAWKKMPPKQEATLSKKTTEISYCNEVEENDSIL

SEQ ID NO: 1010295 - protein, 86 aa, Homo sapiens
GRRAPSSSALAPAQMFRVLAEHKGDRVIAVSGLGYDVVCSVVAAKRTPVGAYGGLLKDFICVLTCLNGLPRLPVCWQSLTMKQLTV

SEQ ID NO: 1010296 - protein, 305 aa, Homo sapiens
GFHAPFGVALPCLRFSRLSLRGFLSFSPLALCFVPCPAPSSAVCLHGFLFRLLGTLCLLSLAVSCTPVLLYCLSNGPSFSGGSLFAGISTRLLTVSALSVFASLGLCYVIPQLRFPSPWDQVYRINNTLEPFPKVIVSFASIQCLWVQRLNFGPYVLLRSMRYISIWVQGGTFARTLYILSADLRPLFSLRVLAGDPDLDIGLYRPLEDRLAERTHLRTSDLLMRVLGMGRLACISRTLESSLVLNSRLLLRSRRDWGMDLDMRAPLVLTEGCVLLEINRKPLLPQNSDVFDVVIKGPLSMFMLV

SEQ ID NO: 1010297 - protein, 371 aa, Homo sapiens
ASRSTHSPHRFSAPSSSAGVSLEERGPSGRLRDSLLSYGGGSEIAKTFAPHMGQLFQCAVGHPGSRHRSQLGSSWAGPDYQSWGLYRYAKESTSGWSLEECDLRISRNLTSASSHVAFLLGSFAYGGWNVSEFTVTEERCDPYCCSSLEAREGHLPKCVGQCSDVKRLQSQSQPCSSHASPPVLMLVTSRHVQHSSNVRGLHQSTVFYGVTVAGQDSPSHGRSLIIPPCPFQAPVLPGGECGTSRARREAASLWPCERWWSSCGVKKDAMEWPQSPMSWGATVARTRFQRSMALGPTEVPARAGPPLNLTLRWPGAFQAGPFTLGGRSRGRVVGWGLGHHAGHEQATATYHGWLQGHQTTASGSMTSCERA

SEQ ID NO: 1010298 - protein, 358 aa, Homo sapiens
VGVPHNSWGLSAVRGDTCSALLGGARLSCFGLPPGLSASPWGTRVPEAVRLPGVLIVSFRCGSRPAWSGLQLVGAHLVPLIVWPVFSVLARHVQGVPLPWSSAHICRVVACPWGSPFLGVGFRLLPLVPRVSARFPRGSILSRVFLFAIRVASVLALSVACLLVSLDTSLGCAPFRGDLASDVIDDLVTAACAGWVAGAFWVSAVRRTVSPPPLSHARRSASGPGRHPARAGVSLLRPRGSVRGAALGGLVTVSRGILRCDYPRTLAQRIMGVVTLVKGFLGCFHAVGPSSLPWQALSSTDLHSTLWGSVVMQQRREFLWLKNLLHLRSLPGGGLSGPGLEPRTNTLYPGEWIAKGPR

SEQ ID NO: 1010299 - protein, 221 aa, Homo sapiens
RRRGFPRPQAPDPGVAATSPCHAPGGTGRRDGDVSGGRPPRVHHCFLRNFPSASSHAYSVCPRAGPGLGSSASARERVPSAFQRDSSRTRNARAAGPGGGLLTEKLRKEKTRGDGASEELAEAGPQQDAAEAQKGNETGTEGGKAKIARFGQLEQRPGGSNQGNGPCNEHSCPLGEARGPGDTEAPGGGRTGGQESPDNANTRAHMLGEATAKSSDIWDTA

SEQ ID NO: 1010300 - protein, 102 aa, Homo sapiens
STLSLLLPFRVLFCRVTLPTALCSLCSRLSLGRTKLVCSYSLAGSGSVVHPLHRVLCLILRVPVLVPVSGFVSPPCSSRFVWCALLCSPVSHLARFRRHGSK

SEQ ID NO: 1010301 - protein, 233 aa, Homo sapiens
MTGASRRATDAGASSCQAVRRGSEPVRAQTARREGRPVAAGLALDASRFDGGSRVSRTSMLEPRITLLVCPVVLRDQDRGDYDKEEVAATSPRKLRLAMRLPILEVEETFGAQTQGPLLQNSRVAGNMTAGQSGLEGEPRKVCFSVGPFASARVERDTWWRDPFRGLGVNSLDSYSVVGHKPLGTFCDVVQFDTPLVVGGGAFFPMLATGGNMWQAVTTRLAPSPSLLLAAIP

SEQ ID NO: 1010302 - protein, 132 aa, Homo sapiens
ASWKFTRVAPYPPFRDSVPSIYGPTWSNHFLPLIPPLPTSPGQFSTSSTRLSFLQIFSQSTIGENTLRPRLSYRCQLLPHTALNSRMSLMILLLRIISLPGVSITLGIHYLGSLYCSPRTRELCVCVKRVKQ

SEQ ID NO: 1010303 - protein, 195 aa, Homo sapiens
MQQKLPEKQQETMEKQKGPEEEEPNPNYTEVEDPQQESQRRHNSMERVSGGGDGKRARRHRGTEEGAQQEAGAQEDKKIVMEETEEQGWRSPRDRRLQELQERKHSRAPRSHSVHDPSGDNQITDSSQSHQEFSQKAKEVAKSKLSLQLERCRKQMSFHRHLSTQTDFLTSDQIQSEEHADLGPETAASGEVEEK

SEQ ID NO: 1010304 - protein, 320 aa, Homo sapiens
MVKLGCSYLLVEARKNDPWGPGWWHPKYENEPLVMNPLWTTAMAINQHDPDHYMDNYMITNTIYTILKPAPGPYIDSPRAHEIGEMRSQRLTLNDKLLGELSTHHKRDACERHKLQNMNDANEMQETDTQQDSTMKHRGPDIWAKVIFAKTNAPRTQREGRIQRKRAPKHDQTYLRMLQNLTHDNHGAGTYGSGNIQGKEAAFTTNLNDIKGITTQILAMKGESMLTPSRSPTGHMVIKIKHVVTFRGPRIPRFCTFRVGIHSPHNSYLGFATTRTYKTTLGRPVGTPFVEQVLEIHLHRRIPLLPGEQQNYNSVDLLLL

SEQ ID NO: 1010305 - protein, 95 aa, Homo sapiens
LTPRVSLLLLLVSSVQLFYHFSPYGAPCSCLGAFYAVLFGFSLIAHRSFVNTVLLEPVYFSTDACFIGYQSPGATLYTILLPALTWGTCSLLNAV

SEQ ID NO: 1010306 - protein, 213 aa, Homo sapiens
RGDLAGRRDGRSPGGRLGLCSHKSCLGGGGAGSSSRLERPSHRRRGSRAPQNGGTRGSASRQRNMAPWTLWLLLADSVVGWVPVLFITFVVVWSYYAYVVELCVFTICWTMKTTWKDRCCTCVALPSVLGDVCMVLMDDNFHISRFPLQRVLLCPILKRNVMNQNSGKKDNKNIGTKSSKSFTYLYHISFEKPHAVYKIERSSNELDRGSRLA

SEQ ID NO: 1010307 - protein, 78 aa, Homo sapiens
YSAVSEKSRQRSDVYYTHLSRASAYLTYDMRYVWVAVHYAVATSELIVSCCSSVVSYSEPQSPLVLVANDTIVHYTVD

SEQ ID NO: 1010308 - protein, 186 aa, Homo sapiens
ERGLRPVQQQQQQPPQQPPPQPPQQQPPQQQPPPPPQRSSSSSSLRRCTPPPPLPQERNNVGERDDDVPADMVAEESRSWCTTIVHTNVRRKTLFAENNSVSHKEQYGGRLNFNYRKLLGHRGKTCNEVVWATPITKIFSSNLLNRYLQRENWPDDTWFLKNLSLTCLDTRDLARKASWRYVNTLQ

SEQ ID NO: 1010309 - protein, 293 aa, Homo sapiens
CCVWAPAWFSLVFSTWLCPLLWWFSLDPLVFIWLVSLPCSCDRGHFPCLCAHAVTSLDWSLSPRRVTLACQISGPLRDTLDGWAFPTCPLGGGLPWVIVLTLKSPSQLLRVVLGVPYPRARWAQFDGKPFVFLRLCALEPRFPSPFGHWTCTVLDLRNPMGLTLTKVNDLGLHVKHLWASGGSPAMGTRPPVCLEDCALAQLPAPALPTPPKLEATRRNILRADQTALYLRRPTSRSRAPSTTAQRPAQPRKTGRRLHPCPCRPTDPPIYGSKAKGGPPARPGCLGTGGCLYM

SEQ ID NO: 1010310 - protein, 284 aa, Homo sapiens
ASAGISDGSPTRDIGNYSGAGGGARNEEAEVREVGEGNEGKHTMSIDTGRDEIRIRTDERNRQTTDEHKEKDGIIQYRLVLIKIIHSTAESTCTGGDVDELPKQKVAGRNSNKIRLYDLDIGDHGDEMMLYVPMAYGKKRSTCNVRTIMLRKKICRRCKLRAVSKEYSENAETKIDSMEALGAITRLKTARKATAKAGRFGGEGIRRNTEVRKGATKGLKEAEEGTRQTGARARKCERTAWEQMEEGCEPEPESRAEAQPKRQAAQEEDPKPSVKVKSGRLKAV

SEQ ID NO: 1010311 - protein, 88 aa, Homo sapiens
MVMFTHCAELLSLMIFPVNGFPLSTYMLNVWLYRVAGAWSPSQSNGVEIASKKRIIRPFFLKHESHDGSRVDKDLKDQGKLDTARCIK

SEQ ID NO: 1010312 - protein, 76 aa, Homo sapiens
SYEADCLGLQTGQLFPWRGYCSQKAKGELCRNYRRGSEKAVVGGTHMTTSQQERDQKASTGREKTESTKSKADQMH

SEQ ID NO: 1010313 - protein, 141 aa, Homo sapiens
MILCSRDCACIASRKSLDCDCDMASVHHAVVTRSLRTCPYETLISRAWRPFCSVSPICTVLGRHAAQQQAESDGSSLLVKDFELASAQQRPDMVLRHTVIGDFCRPKDRTKDVLTKPRTLTLCEIVSDGADSGTWIRLHWL

SEQ ID NO: 1010314 - protein, 88 aa, Homo sapiens
MVWAVLDNITMACGAGYSVAMRGAAPTIPCHTGSNYTKAPGPYPATDGARRHHSTNGRDKRGYGPRMGRSKPTKTQGARKLPQRISPD

SEQ ID NO: 1010315 - protein, 96 aa, Homo sapiens
QEGGGLTCGLETIAAAPSAVLDPLKASGILGQTCCEAMSLEHLAHNVPMIYGARILELFMSCHGSHARNIDAEAVLHCQRAHMYLGPRPEGLREIA

SEQ ID NO: 1010316 - protein, 77 aa, Homo sapiens
MLKFSAQFLSRCPVTPASHSMFASLEIQAREWNVRCKIQHPARLIKRRSVHKEVRTQPKSSAFDSSSWGDMITLDKA

SEQ ID NO: 1010317 - protein, 148 aa, Homo sapiens
MSAIPRAFLLVIGKSNCWCAPPCVAITPRAGVVESFHNEHNSSGNNAPGVKPSGARAVTDERTCFLSGPCLGTRDPTSTGTGPEFTEGRPTERICCANPCRESGGGVRIIDRPRRRLGSRLGFYTSFFFFARCNPQIRTVCKTKYCWW

SEQ ID NO: 1010318 - protein, 236 aa, Homo sapiens
VHTVCPARVSTSSTLCTQGFLALFFRRHMGSIKSEVREQDQCQGALTRVEEVQGVDHPGSAVHRLTVHMLDIESFSFLNPALESYMAPVLIMATYLVASRVIRGTSYQSLSLAIPIDLLDRLLIVSTYPLLARKTTKQILRNPVRGSEDFEMSEDAYTVLTRIRAGRRQLRYAILLITAASLVCRKRKGTRSAVCDRHQAGLLTLPGSSPAPRKYMKEYQDAFLFNELKGENHDTS

SEQ ID NO: 1010319 - protein, 131 aa, Homo sapiens
MQNSQNYLLAQHGTCGKVHSTPPNCRLGHDTVRKTLVALGEDPLRKSRHTHGQESVERTIPLGHSDTDRQTGDTSTRKYRGDSTAHDTALRTPTATGEKLAPRESGHATRPTRQPSNTGPPKHTPVKRRHH

SEQ ID NO: 1010320 - protein, 221 aa, Homo sapiens
MTKTVSRIVLYFCCLSSFTYVDTPAAEASIGVFLTTTSPTCCRFRGLRLMDPSCARSPLGPQCLLPLSPRASGALIGIQTHAMSLTACITAVRGPGYVILDQCPLNANHCVIGVPNWSGSDPSSTLMREICPDIRCLPCACWSLHPSLQQLLSASLSLGRSCVPIYCCWRDQKVIPRRTLATGYQYSFPELGDASKGNCSLRRSRQGPEACSCTGFQVRHT

SEQ ID NO: 1010321 - protein, 337 aa, Homo sapiens
PNHYNAAETRTPLSDSGSVTATYRSAVLRSPGNICMLTLESTRPVASDAYTIGLVSWRIRLSSLVGSDPSVVRPLGPIGTRRSSPTRTTNQSTARRLDALRESGRSRDGGVCIALVIPGRASETCGDVTHCDMQVRNELCAFSGRARGGQTSTGLNHAHERESSVTVPTLPRVRILRLDPRWKGWDIPYVLLTQSLEVTGPRASTTRTHGSCARTKSAGPSRASLLHLPPLEAAAWLGNAYVMLTICVEKAHAVGGLPIYSISMGLPIGSPLPEVVSPGSARWLPLSAEGCPCRCFCGNRFHMAALGRSERAGRGSAWPHMGVLRCAATGLGGQTVR

SEQ ID NO: 1010322 - protein, 116 aa, Homo sapiens
MLDGLPAKAWMAMDGLMESPSHDSLVFNARPLELIVITYPLGLRCMQASARVLPRANRLLTGPSGAVLSCLRQCSMGPLETVRMVGAMWPVPHPTSVDRGPPTSPPRGPCPPPPSR

SEQ ID NO: 1010323 - protein, 219 aa, Homo sapiens
MQATKESDSELLEDEEDEVPPEPQIIVGICAMSKKSKSNAKDVNIQSDSCRFDYLTVVIRGRTMYSLMNRVEQAGQSCHCLISFQSKGFPLDKAVAYSKLRNPFLINDLAMQYYIQEGAEVYRILQEEGIDLPRYAVLNVDPARAEECNLIDRRRPSRRSMELSFQAFVETPVSAEDTKFTSNNPVQLDGGSQRLYRKIGSETDVTPSENQSEHRGLVL

SEQ ID NO: 1010324 - protein, 227 aa, Homo sapiens
FLAAGRAELSVWESKEIEMATAYAPPMASQVMKSGLVCSKPRGLSGASLTRRPRFVVKAVKSDKGTYQVVQPINGDPFIGSLETPVTSSPLVAWYLSNLPAYRTAVSPLLRGIEVGLAHGYLLVGPFALTGPLRNTPIHGQAGTLGAIGLVSILSVCLTMYGVASFNEGAPSTAPALTLTGRKKEADKLQTAEGWSQFTGGFFFGGVSGAIWAYFLLYVLDLPYFFK

SEQ ID NO: 1010325 - protein, 128 aa, Homo sapiens
MIQLSLDGKRLYITTSLYSAWDKQFYPDLIREGSVMLQVDVDTVKGGLKLNPNFLVDFGIGAHLAQPLHHELRYPGGGLVAFDIWIRTPPLSHPHVPIFGPSLPWGPGFILLSTWHHDHWQHRPHSQS

SEQ ID NO: 1010326 - protein, 205 aa, Homo sapiens
SGSVRPRVPSWRTRPVQVLLGSGLTIRVPAAHVRESAHPAWDMRPLPPTIGRKYFWAASVSASWSLKLCVSTWPVYDGKARVCSQDLTPRLCSGVLGSCGPWVRVLHASYQESDAGGGVRTWKCTEQNVRHLPCDQVYQGDELDEMTARLLLLPCITHPFHVITRRSMVQFIGRESKYCGLRDSIITIYREEGHLGLFAGLVLAF

SEQ ID NO: 1010327 - protein, 268 aa, Homo sapiens
TPARGAMVRPDPAAAAAGAQPPTRPVGTRTSEGPCPGKRLWTTWAPDPEFIPASTPDRPVPNLVSRSGSPYPCPSVSRPGSLSTKSLGSWLVDHCLQRHWLPGGLERSQLHCMRALLIPLCAIPREGPVHRLPDILKEVPILKAEPLVEPYREHIIPCSLGSNTCFQMNGRAKLATRLGPLSSQARTRGNAKLIALGSTTGQTHPGQHVSAPLETGGSYCCAQLAYTAEGKFPSAPRRQRCFHLSRDGHITGARLVDDALALCALGVW

SEQ ID NO: 1010328 - protein, 343 aa, Homo sapiens
GAEVAVGDMCRRGWERCGLGGEAGAARAQELELLAASSLQRYPACACQLPWPLLVGYLTRFCCCLSVLLDPDGLPRNADALAILGALGCWWDKFNACVIGGHTLGQDRTFWSCGETRPLGRAHNERCPNVITEFQGEEFALLVMILALRRLVCWIARQDLYVDCQIRGICLARCGHADWTSTLGQMRPFGMCIVWLRMRNVVTLHSSMDSYNLSRTVARTMLVESHSTLEHRVDTLGFFPMPNHITCVPLDHLGRFGQQMCWNRDLFPRVRRRNRGRLSPGGTPFDPPKHQARENYRSACVAVLLDKGWDDRLVLVVLWCYARNVVVSPLGWIWHMWMAKRSI

SEQ ID NO: 1010329 - protein, 201 aa, Homo sapiens
MRHYKNLENLVAAGGRLKSLGKLSVVALVSDGGLLRLTHDATLLMRIEFMRACAEIVFRLRPFCQSSQCNGSLTAVGKPGGVNSGRIRMPWGGHRHLYWPARRIGGDPLSRKRKRSKWVGGGNLIGPKANRKVCQASLPFRSTAPQGIYQVVTLTKRVRTTPEEPTDPRIPEGQIAATGAQWTTPMMVVNRSRIIRPKDKK

SEQ ID NO: 1010330 - protein, 286 aa, Homo sapiens
MAQKSECCSERTAREAASSEETLTRGRGRGLVRLKGLEALNDAAGDSGTGAIPSQTPMSSESNVSLGPRQIEAHAAGAQLGRRTAVRLLWTVSAPDSQDAGKRSQRQGRDGWEEPVGPERRESAEEPRGHRRGDLHGDLSDGQPERSRREVPGGKDLAASCAAPGDRLTRRGARDWKGGYTVMRTYTCQGARGDRCLGPAVYSRCGKAPPGKRHKGLSDTGSAMRNACPTWRTPRGAPSPGCMVSREVGPVTEVNDGERVVVRHLRLRGPKAKVCMEGAHHGVEWK

SEQ ID NO: 1010331 - protein, 95 aa, Homo sapiens
MYTLGTTTWWPPYSTHPSNPSGTFAVSNMRRSWFPWLGARLLRWNPFHRGNMGTLSCERGAPQGDSQLCALAGRERCVLYGHVRLFDTTITVTAD

SEQ ID NO: 1010332 - protein, 292 aa, Homo sapiens
RLGSHPCVPGPNHSPERAAGGVWLGGPRRVKHLSPPYLKACPLSTSFTLIKTSRMQQDGLGVGTRNGSGKGRSVHPSWPWCAPRPLRYFGRDARARRAQTAAMALLAGGLSRGLGSQPAGRRPGTRAGLPVVGSWLRTWVAQVSGKGQSRVTGVQPYEQVVGSSSSVVTVPVYLYQMTSSPRTNHRHSGSTSLCCRDRIADAFSPGQLDKQLKAQLGQPGTRGTTPYVECQDSVRTVGVVATKTGKAETVGRLLPGPEESQSAGNADLTFGPRGGKDSGVEYGDGVTAKNLR

SEQ ID NO: 1010333 - protein, 86 aa, Homo sapiens
RRRVAVVALGRHVRTKGKEEKRLKRREQAAGRGVEPRGRRGRPSPSRRSLEVASMPQGGKMASGCSGGASDCGGARQLGTRCLLCE

SEQ ID NO: 1010334 - protein, 292 aa, Homo sapiens
RKDKVEREEMEQVSYVDHSDLSSANVSANTWFNCNVLSSVVTVDSEHAALYALNLSQNIMVLKINENFMLLSTACLEGSSSRPGELIPNFTKRFSGASRLEESLSQVANEESKDPHVIVPRGSTHAVLLLEAEGNLDANMRIYEAVWPKSWFTRIETRSRTIEESRQRACRVMTYLYSRSRRSVDDMTVSAFQPMWLNRVGRTVTSEPVYWVARNRGLVRRLMALMDRPRGTIDRKTETLIYQAQWGGQNSREFVGFASMPPTGRRRQDGVCRMAMCPIFFLICAHQNRYDR

SEQ ID NO: 1010335 - protein, 254 aa, Homo sapiens
MTKWKLGVRRPSRKINQLGTSRGHCELARVDDERNADAEGTSSSRPHTMDSHEYEEMLVLPSRCSTKRSQAREVLRLCEEQICLWASSVCSRISSPDRGPTTFGTMTEMCSDANCGRYRAGSQYKAVKPPGDLEKGMRAKDLREDDLVRTGYTDTGGNVKQKGSLPVTNKKVPGPLKLSTDLEEAGAKGIPGEGTTIPVLTIGGPGDRAKQLRRNHPGCKSPKKVRAMEDIDRQQDVKDLRQGLATLNRHPENG

SEQ ID NO: 1010336 - protein, 144 aa, Homo sapiens
RGGPSKERQAVVLFHVVVACFFVLAMYVLLLLVLWVPATFMSCNAHPEGVQLHFSSQQRLLNQGNSGRATFMNCNTHCEDLQLYSCSQRDQEHTWRKKLQTYVKNNSGGAALKNCSTHCEGPWGFFLEVSEAKNPPILDEGGLN

SEQ ID NO: 1010337 - protein, 151 aa, Homo sapiens
SGGCGSAGPGAMRRLPAGWRRFPGEVPSGPPCGGGRESGRSRGRGALFVSWLLTCASASCPAGIHPQLHACARFDSSNPPRRGRNSKSAQGLGWVFETLGTRASMNSNSAVALRQHSGKLTRLLAPEALHAGTLHHGSNAHNSLVEEVCKK

SEQ ID NO: 1010338 - protein, 261 aa, Homo sapiens
MIGNELDNGPVYLKGRLLKDPYIAYLERETSDPDEGYKRIPNCHRKDGLLSEPFFLLLSREISAKEINTENITGPVHMVMVGKENWEQNDGIRLIGGIDKGGVIDDEVKALRRLEGERHYRGQRHLIRVSNNPEDLKGGKKDLEVAMSHKRQAGSSGPPGLVDQREATANNNNGDTKGKGNGSEREKALHKKRHVKAPEADTDKKCGQRIARQVTRTDKQRLSARDNKGGIVHASTLMQARHKQTIKTPDNNTESHSTKQK

SEQ ID NO: 1010339 - protein, 121 aa, Homo sapiens
MATFPKGGATVELAIENGHTHTPRIDKANRGRHDNQMAREIPAGNHRALWQHETTGCEATSCGRQRHGSGRGGERKTQTSGHITMRSTMDRSANKHSDNMCLADPPMRTLGTTRRWRRSKA

SEQ ID NO: 1010340 - protein, 285 aa, Homo sapiens
RSGRRGAVCSKCCLDFTVPRGSARGLMSESASDDRERGGLLLCLNLQFLVRLALKTCGSLLVEPLPLFKPCYMPQIEFPKSDLSLQVPVPHLRTPGALIPAGPRAKGPPLREGVNGTGPLGEAGLRFPRGHTGTDAKELRRIRHVCALQGNDHGKHGGTPLTFLKIGTVITVNRNGDIQKKQASRRRYTTQRDDATAYLGDKSPLCTQEKFLKYKRAQRMGRNMQIGGGMAQEGSNKDWKRLPASPWVQNRAHGTLIETSEEVTIIAPRLSPHNKMEEGKQGDNQ

SEQ ID NO: 1010341 - protein, 228 aa, Homo sapiens
SGRQGPRPSALATTIRPGPHGATGPTADPPGPPVIRQAHRDSARLHRVIRQARPLIRQGAAKPSDLPQKVVGNQATALAGPYKTPNHSKVDGARGPPAKGLRGHCPGTPRQGVAMEPGSRKGSDITDRHSTGAQQPSGIPAEKGPAQAAEVGGHSEEQPQQHLGQDEASGAHGTEQLGHENTRKLRRPRTRDSAYEMGPMHPKKSTGAEADPHKAEDNAPHSRDGTTK

SEQ ID NO: 1010342 - protein, 323 aa, Homo sapiens
MAAAFEASGALRSSGDAMPDEHVCVQVPAQKQQPGPVRILRNRSGSQQDPEDPHRGDVLLAEPGRLRDHCLLTRQVLEGTAGRHGSRRGPSTGASSTDNALGGAEQARHSSSKLDLAPGQHLESTYNTKLWTLVEQDNLKVRQTPEESLRSPNNDSNTCEATQTYITWYITKPKLGVNNMGQRYTNGNEQQQCERRQPKKQTETQHHRTKTGDTTEHRTDPAATKIPHQPPTQTGRHTAEPTRAQEKSSHPQTDAQQHPNAWTQTTRAPEDPPQQSQQHTTHAITANHKQDRNTTHAQTKGGTRRRERHTPDMTTITPPTERQ

SEQ ID NO: 1010343 - protein, 372 aa, Homo sapiens
ERSEVRRADAGCWSAELDQLAARVPVSWARRRPGAATWRGGRDTAAGGAVKNAWLAEENGRLRAKTDWVRKVEAENSEVRGTWAARVNERDASVLDLPNMLLQQCWTRGQDMQQQLQGGPAEGPCVTLHPFLEGGIQALQCLAWSPLLEQPWETRSNAGVPRLNGEQKGPRFHGTGLKNYAGVHSSKQRTYMENTRDSLPLEGRSALFGLWGEVKPSGPPQSFQEHQGALTGQSFVFQQKDAMLPCRNSSSLTRVDMWVQLVHRVHPHLNPCDHGGPASARSTGWDFDPGGVPCTRVSVSPCEPLGKSGDEHSDEVTLGIGPQTTPREYIIMGTRTVTSGPPLLERRTNVMLREERRQIRLHTKLGESYNKS

SEQ ID NO: 1010344 - protein, 133 aa, Homo sapiens
MAQSKEDKARSKNPSRVSGPRVQTARAHITGKYASQSQRLRVPLGGQDGRKDGYLNGSQFSWKSVKTEGMSLPKPGVRRVKATVSGSFPSNTGSLFQDAREPRQAMTEGKAFLESQMLEPFKQQGQGNGIEQC

SEQ ID NO: 1010345 - protein, 152 aa, Homo sapiens
MRLKPSPCEELSINLGLGPCGGKVQPRVLHRANRLRGAPWALLSSLSGQQGPLGDTAEAGAHGPGPVTRSSRDAGAPPPSAAQGGHCRTSHACAVSPDRPRVEYANWGWVGRRPAASCTGGTDCVCRFLRSPRLLLICSSRYSLSIQPLAFP

SEQ ID NO: 1010346 - protein, 82 aa, Homo sapiens
LPRKLWECATTSRETIPSTAGLPSHDVLRRLFSITDTLLAHLMILAMEDTIGQICCFLEGFSDSAFRESTMADHVVRPIDNQ

SEQ ID NO: 1010347 - protein, 183 aa, Homo sapiens
MLFGVVNTIACWATFEMYLGLGCNSWGNLFICAALWQVRECTSLHTTGRRLRQSRGIAIRHALPGENPLVGRADHFTVYHTGPRATNGLDHPLPNRRDSATFNGGLGTLRPRTSSLENRHLNGRATHHFAVAPTPRKSGHPGGQLGTMYRGSYHQTPYTSPRHTLVGPLEANHSPVHLYASDV

SEQ ID NO: 1010348 - protein, 249 aa, Homo sapiens
LIDEGSHMVMLECPETVNTLLHEFLLWEPEPSPKALTGATAVRLQNDNECSRWAGGGIACVSTAADSEEARACSADQLGGPFAPVGGASVRETPPGCLGWGRGIRGEPMRTFRSPLSVPRGPSAVSGAASRDPSRQDDLVHERSSLTFPSQIARGAEGMAPKAPVIIPVVEPVALKSWVDPTEDPNWGNRVEATNPGLSRRNPFAYASEYPSGGWRTPLFLADKESAEIGHALCGTPHTLRLVSTWVLH

SEQ ID NO: 1010349 - protein, 71 aa, Homo sapiens
RRGEHAEERARGPRETAAVAARAEQGLRVIPLCTAAALRVPAQWSLDCCPVWHCSCLCCLDGSVAAWRVPH

SEQ ID NO: 1010350 - protein, 375 aa, Homo sapiens
SSPFCWHPWYRLFSPVGRPLLAGGNILSSVCILSPRISDGVGFCRPPHVLVGVWARLFRSDNTVSLLLVSSACVASSMLILLVCCYIPPSSVGAASVFADETTTPPSRVDETSPCCFCLLVDNMFFVCSSPWSVFLCYEETHRRWFATLMALSFLLQELVSSSSAWYICCGRASFFAVSRARRCVREVGLFGLVVFHTRPPSLLLREHPSCCVAAPSSRVVISSPTQASFVVASEWRLVSLLVSILCGDPRSLLSAPRCCVSSGGHLRGFPHLLFCVGYSLFFLSVIALAGGGVPHPSFLYSPTRCRSVGVFGTSHRHTLFCGALWCTHPLSRRVALAPSLPVIFCAPPVWVHHNLCVLLALRGVYTAEGATIIG

SEQ ID NO: 1010351 - protein, 112 aa, Homo sapiens
MRNDSPWTLKKQKWGAFDERENGPPKEDEVARPSGVAFFALYPKGLEPRLDLTKSLGTNTRRKTSHVVERRGGLINSGVHSPGGRPGEAMGTPKPYINARPKGRPHSLGDRP

SEQ ID NO: 1010352 - protein, 209 aa, Homo sapiens
MTLNIVSVDVPDTDLTPRAGNASRTRSPAAALPHNSPGKFQKTVRDRVLRSMRQEGPPEYSVRLMPKCPPSVTAPSPDEDPQAGAKSPGTSPDRNFAAALERETGCGWAAGPCALWSFCSPAPRWGSLYASTRDCARPPATSCARGRPRKAPAGPSCQIFAPEPRYAHTPVRIKEQVVGLLAWNNCSCESSGGGLPFPSRNKSELLTHQ

SEQ ID NO: 1010353 - protein, 262 aa, Homo sapiens
AGGRGAQGPGALYGDSASPGTDGFLSTLPRWVAALGIHPWGSSAVKPACRAVPLVIEAIMVLVNSLLKASLNSWMGNVVEHHEDHVYLWPLVLWSLLAWSWLLVHLAEHCWASGKEVPLEEEIGKSGSVQLPYMNEGRIRLKNKEEQDMVTPKGTWIRVGRSRCGEQRRDDCTHVVEANEGRGGTVQNRPKERRQNARGKRLPDETTYEGRGGRCLRSPGPHRRGSERRTRYTRPKELGLQKGPGRGGGSDDREPARTQGDA

SEQ ID NO: 1010354 - protein, 125 aa, Homo sapiens
EIREREGVAQPKELPSLGSDSVADVEETSTHAPISANGAVCGPPLPITVLCLFLPLCLLHYTARTGPRFVSSTQLSPYDPAGPRLSQTTRAHSPRFLLTNRSGVSTCTKNCVLSHGRSSHLPCVS

SEQ ID NO: 1010355 - protein, 184 aa, Homo sapiens
GGGGSHIVGPPNSFAPTGREGCVVTTETTQVLFMWGPTRPLWARVLPPPPQFVARFRLPKQRCFCLSQHTVGGVVSLLSPLSQAPNKWSLREIFPDGLHLGCFRRPLAHTSGVFVCFWCRVKGLCGDELLRVHAEISRRVLCGSSGGTRRTHVCPEPPVSHLPSRLLLLMEMSHKPYPLVFFFL

SEQ ID NO: 1010356 - protein, 288 aa, Homo sapiens
MVIRFFLANRSTCYPGHCCGTYGEDGSEWQLHRKGHSDNSPIRTGAVTIHKRGKASFEQDTTLVLEDARAGNSRECDRPLSNNLGELMINRRPQARHRYNEDAPGYNNTTDLKSQDKDPHSRRRRSYIWEKLQNRIMRKGEQRERRNGPQLTEYIAPVMHLAVRKNELVCCHSIRLVGWERQFTLYSRNAQRDIVTSGGINSLTQRVPEKSVTRETQGEPWPPGQTQIQPCARMWRNKFNPRPMEKRAGETAKGHTRGKMAPARPYKLSRHSRVTSGAETIGRERSRH

SEQ ID NO: 1010357 - protein, 234 aa, Homo sapiens
SATGLGTLLGDRWIPHQPPKPCIPRYTKRKSKASLEQRSWATTRRRKSIMKLGFYPIRRVQRPPRTTVRMSPTIIEGDNRPCLETGKIVSAWVTTSCPSASLRTIPSKTWAVMRHIVSGFGVMEEKIAADLRFVRLTLANPQACENLAPGERIGWYVFSHKDVSVAGHPSRKKQIACQGDIGGVYYAEGTRITDRCGDTGIVSRGHRVQQGAKGFYTKVLNNVDWINKEMEEED

SEQ ID NO: 1010358 - protein, 80 aa, Homo sapiens
ISSVPHPGCVSFPRVPAPVILGSSESTRSHAVIRVAFNAMGSFFCTPFAYPYVSWDEVLFFVFTCFDVGTECMICVSYER

SEQ ID NO: 1010359 - protein, 187 aa, Homo sapiens
MDGIVTEVAVGVKRGSDELLSGSVLSSPKSNMSSMVVEGGRVMIVRKFKGEDKMAWCSFSVYFIFENYLGKKQKLKLLFRLTRFGKVTNILMLKGKDSGISGTRQPRKRAITMVNYYSACDTSSFGNQPIYIQYSNLTKNYETDQYIKATCSGRSSKAVTAVQTANTPLSGTTVERECSDSSPESST

SEQ ID NO: 1010360 - protein, 220 aa, Homo sapiens
VLQPRRHARARLIANGPLADSHRGAPLPVPWQGQDARALEDPWNKHTQRRTRSGPERYNIAGALEAADKAKMRNLETQHKVLGAARARGLSGLQKKVGRIASRLSVTHPAEQCIKQLPEPLLAVHPATASAAPERVPRAGRGRDSGERPRPRPRAPRPRPAPAKRLATGALGSAGSPCGNCNMSYLDMIHRQGASKPTAHADGAPARGRYSTRRNVYVYR

SEQ ID NO: 1010361 - protein, 112 aa, Homo sapiens
FDTPLKDTFFRGPLLLGGREVGAPLDAPGGGSTSTTPEERGVGIEATSLLARCSNNTKWAPLITRSCPDILFIRKNTPSLPPLSPPENLLLSPRGVLSGGVYPGTTKIRPLG

SEQ ID NO: 1010362 - protein, 144 aa, Homo sapiens
MWLNTMFPDAVNGSDGDYDVVVCGEQSWRLDLPVGHATRHGLTAEKTFSYPLDLLLKLHDERVLVAFGQRDGHPSGVMHCLAITWHGREWQVHGRRAKRCWSIWVTLLITRCPFDFGGPGLTSNEKLMLAPCSTRLFAIGPSVS

SEQ ID NO: 1010363 - protein, 59 aa, Homo sapiens
MTVCTTNEDLLIQYIIIRARDLDKTVSKEMFHLNRQYEFFRMMLHCDIIKIGSLVRNKE

SEQ ID NO: 1010364 - protein, 109 aa, Homo sapiens
MGGEQDIPLSTLRMALLEATMLQSRMPQDSWPSPLLHLDIKRLRGKEEPLVTRCCREACSWDLPLGLIFAHWGLVAMHHEYRSLYASMSYCTWSLGGLHPNQVSVKMTY

SEQ ID NO: 1010365 - protein, 99 aa, Homo sapiens
PRPATVGLNMAGAPCGEDIFFSSHFFQRTHLLCFPGSRAGFLVRCPHYARGRICSQDPFLFFGSVGAPQFRVPFLLSTGSGAFQGVAPTEEPEIQPGVC

SEQ ID NO: 1010366 - protein, 84 aa, Homo sapiens
AGGAYGLRRDGRMSGLGLVARAMGRAGPQHVLLSADAANMAPAWGHRSFTTIRAMHRRMRVGGLRMDNFHDGRHTGSLGSIPSQ

SEQ ID NO: 1010367 - protein, 433 aa, Homo sapiens
NPRRMVALSALRGAASRETVGANIRAFRRRGRGLPSSRSRTAPGSVRAWARVLYAVTGLRCHCVGHCVMAQRGCLVCLACAGPSPARAWAWVPWLHGCGLAAGRAPLARVACAVVMCRKGRTGGLKLGLATVERGPGQFWGGDVKAWRSLWCCGDRPLPNNFPQVGHPLLPFGGDGNLSEGPGPPEGFGKRTFGGQVIRTVKNGPSFRLAPFFVEGRPIKWPFDLVYSFGLGSPMNTRVFGHGFLFPPTFPEKGPNTNRASDARRAWFVFATHLGEELFPEIDNGPQVCLLEDGLCHQATVWGPLVNTLRGLLPLLANAGGGAPGWGAQFPQFFPKEVGAPGGRATLPFSTAQERGKFLRDPCALFNSNTVAQAAFVDLPLDKGPRCQVRLGKSSHGITLARGGPLRWCLNRREKTTLVAKLWRYRAVLHQEN

SEQ ID NO: 1010368 - protein, 179 aa, Homo sapiens
MSAVHVLCKSMFWIITPKAHSSALDPLNDAVMHPSRSSLVISVSPQDGLQGHASRDGYARFFSHGILIVSHVSCPQNGRVSPRALLLNGECPAFVRPILVCWSMPSLPAPGSEILLISTTLAREAEDGLQATAVSGACIRSVALSYPHLRQCQVHTNMQRGDLALYSISLILPLLLGLV

SEQ ID NO: 1010369 - protein, 228 aa, Homo sapiens
SGVRACGGQPVVAERRLRGAPGRGPHGVRQALGRGLQLGQMRCQRAAFTVQCAGGCYGIEGRPGPGRRAVSSGGASRLGQQDQGAGASAGVQGLERSLNRYSQHLFPTNVRDGTVAIDREGGDDTRDKITEQCREPLGSLHQEHHFADAQETVLTWTTFAGIGSIEPSSAGQNNTGRGRQARAAAVTSAPGSANDIPQAHLCTPQTTANDREGPLTARMGQTPRRTAL

SEQ ID NO: 1010370 - protein, 318 aa, Homo sapiens
LLFSVFFVLGVSLLVAFLVFVYSLFVLSFSVSVLSFFACSLCSSLLGCRFFSVFLLLSGARFVTCLCVFFCCLSVFFIACVFLLVVICASDYASSVVCLLVSLGVCGVALFGLSFALALSAVGVGVWLLCPLRRLLLFLVFCCSLVHCLARSSCFPVFYLRVHFSRVCILAVSCGSSVPFLDVSASRNLLCSQVTSRLSVGNVMCDDGWAQLAWRGNLTLGEYFTSIQSSESTSVQPLSSKRAFPFRRRCQPCKRVKADWEIHFGWAISFIRSRKARLVRGGAQLACQVFRNLKLSSCAIYQVWNMFYCCRDGVRRGE

SEQ ID NO: 1010371 - protein, 180 aa, Homo sapiens
MVIKKTPLSCQKEPFSSEELSCEGHFFHGFLSPRRFSLPRVNTHKGGTLTRGLLSPPHCGPTNTRGEGQNILYLSTHSGGSFFAPLFYAPSKQKGLSSFPQGERWSSYREGGEHIIKTTHRWGEHTHTLCGYRGEHTRGPTPSELCREEGGPLKRLSLRLWVSIHHPAPLPEKHTEGVVT

SEQ ID NO: 1010372 - protein, 278 aa, Homo sapiens
CVPCVRSGLCRPSSVGVSLFSGELFAIRGLAFYPPRICLVFFLLVLAFIRFGFPVLRLLCCVLAAHWCSCNPLSLPYAEFMPSLEPDLGRICSPSRCRGDLSLRRVCPSMSTSSAASPALFDQNCLCILWGLCQLDPGGPQGTTYMEQLLEKQGDGEAGVNYAVEMLKALHALQKENSCGCKMQYPEPERPKKERLLDSQRASSLCPSLPCHACPVPAGTTGPCPVGPMAVHSHQAGSSDSLSTSKSPPGKSSLGLDNLAVTLLREVGANEEWGRKEG

SEQ ID NO: 1010373 - protein, 412 aa, Homo sapiens
VFFVGPTWCCSGVLRVLLWAPNGVVPPRGEVSPPFFCTRLCCAPHFYPRLFAPRGGPPLWSSRAQMSLGLVGVAYACTSSTRWLFRGRASYKPRGVSCAPLIDYHGSAKEILCAHPRVRRPLWGNITERPLSEKGEEISLRVLLWPPGSDFWEHTVYMVSPLDFVPGWWGVPTHCILNGVGCGPLYTAGFYTDARVSASIIHALLWGFLVALVIPPFIFTGHHMNLSRTRLATENMCEKTTHAPERRRHMSVKMCHREGDIPTWGTLGGLSPCLNTRGEPKVIGPKGDPRLEMSQEPQRVCLKGLWSATWGTFIWMSKRNLFLRCDNTEVCLFGAHGRLNLYANAVLKRSHSLRGEALGQNRHTLAFPLGPGAPHITPTSRGATPGEKREALGPFSPIRVFLPGFPQKLLKG

SEQ ID NO: 1010374 - protein, 291 aa, Homo sapiens
GQVHSCARGYIRCPLGPYGHSSPCRAQHIRLQPFGKPRNHDVTKEPFQLQSHGIARERFCRHGHQGTSVTCPVSVLRDGQRAATHGSALTETVRPHVHCAQAKQCIRYCWSLKGPVTNRRQSLMAATVSMLSSDFRPSLPLPHFYKHLLGAEHWGRAAAIGGPHSAPWASTSRALEPKLPRTATEHAARTVLCSNHWTNERARRPGPVCASVDGSWSTMVRNLQQDQSGTCLDFSTRFITRPGQVRHTETPARGRPRPEPPCLTSNKGPRVPPHQPGLTLLSSVSCSGFSS

SEQ ID NO: 1010375 - protein, 116 aa, Homo sapiens
MALNGEKKRSGRTTPGVPRSLFGALAKDTNLCDTSGTSVLVRNASRLGSHLKELPDRLLNDRGRQDWTLALRCVLQTSGSQILFLGHKTDEKGSHETLSQTEMGQSYANFLGDTRS

SEQ ID NO: 1010376 - protein, 180 aa, Homo sapiens
MSTVRSLGRKPLGGTQPPTGSTHEGRGDMTAQRDDRMFPRRSISQGPTDNVVSWVSRTGEPGTTDPGEQQYSRHGESTWVQQHKAWHGFGLSVILPQRHTQRLLQSNGGERSQVSGAQGTLTTTPPGRGATSLEHQRQSLFYKTRNLGTSHESGFGTRDLYQIDEGDPSQDIFSLPSFEL

SEQ ID NO: 1010377 - protein, 121 aa, Homo sapiens
MGVCFWVLAVLVCVSPACWASKPIPVRPDVFPVSNLCLRPNCRDARLRYVRRCNVCLDPWSIRLEGSPRLCFLSMLWGKLEKPPQWEDLCLTHGPMGTHVVLDNQTSCFGETFRQGSNHQC

SEQ ID NO: 1010378 - protein, 297 aa, Homo sapiens
MTEDATRVPGASHGRDPAPGLYIVMEHVSKGNLVNFLRTRARALVNTAQLLQFSLHVAEGMEYLESKKLVHRRPGRPQHPGLRGPGGHRSADFGLAKAETVRRVYTQAGCPSSGRRLEALKHGKFTSNVGLSGDSWGDCSGRSSSYGRAPYPKMSLKRRCRRPVREGGTAVEPPEGCTRPTCTSSVSSCMGGRARPHGQPFTANWPRSMARERTQVQGVTQPPSQGQDADRRPPSPTKPGARDPTRVGPLAQEDRESGEYGVEGTDQAQGGSRRASILHGANSRGWPTEGDNARAVT

SEQ ID NO: 1010379 - protein, 279 aa, Homo sapiens
GGGGEQCVTDAVQAVLSFDKTSTVLGGEEAVGLLRLYDIGVHLMTRTRTVRDVVIAGPQAEPADLIRATTQACGPWMLDPTMASREVAFACTAHGHARTTGREASSLISGRLHRTAGQVVMQAHAATGILRPCADRVRDRSEEDQECPRHCSTEGSPHAIQRRERLATNDRCPEAPVRGHTQLSAAMTKGVRARQTVEHTSRPGSHGMHTRLHAFVQSIHPPTRPPPHRQRPGAGPGTTHPTGPATVWTRTSCLKSRLGNCLNVVWTRPHHIDERKPRH

SEQ ID NO: 1010380 - protein, 291 aa, Homo sapiens
WWRHITERDVRPTRDGFNSLDTANIYVDIDNNRDKRFHRDAWVYNGGVTTSGCNNRAVPPSPPFLSQNMTTKSVYIRVRHGTIVHRIPSSLFNSVNFRSTPRENVNGSSSRLGHCSQHDFFSVVFDPPRALSRRHFRWANVNHSLVNTQVESCQSEVVNGERVLVSPQLPDPHKKPRLRIECSCVARLVVAQLVAVTLVVVTQSATAGPSIARGSNMKTGQRRGMKHASGHPAKDQPSPPSSSLSRGPRRCFLVIQEPGPSVASSFLPEAKLLRYFLELLIDYIRRGGYMQ

SEQ ID NO: 1010381 - protein, 161 aa, Homo sapiens
MNGRTCGTETAVDYIREYEQCLKVLDAGVSSSEPQSWAVVTEALSRSALLPPGGPPPLDLPGSKDLSPAGRTSSMKPHYRGFCSRVRLIWSSAPAPGGRVLEVSPMFTLGHCQDHLWECHPYNTTAARLLPESSPSLGGSRHDSRAVIYLEAAGRCKSGHN

SEQ ID NO: 1010382 - protein, 317 aa, Homo sapiens
FPPCSGGPGPGPRPFGAAAARPGFVRPPALARGRKRAPRPNAQLLQPWAEYWRFLAASGGQCPDAYDGRGTVQELGRGRWRICWRPNVRSGRGRGRRRLRIQQARVRGCRLACSDLGAATPQLMILALGLERRPRRSLTAAASLALVLRARLDPAALAAQRLSPRARTPAAALQTHRRHQVYRRRPPTGHGCLREAGDRDTQTVDPRACGGTCWGRISCGKQQDSCRGWQPPHRSAVPLDHDVGSELPPEGVLGALLRVKRLETPAPQVPARRLFANLSTARIPCTWDPEVPRHPATRTAPRQHVQSNVTTPGALSP

SEQ ID NO: 1010383 - protein, 73 aa, Homo sapiens
GIKSGRWMVLILEEKKGGKNFRFRRKLELTDCKRLEVDREGLLRSISGGTSQDCPVAGVVLCLDFRTDKMTAM

SEQ ID NO: 1010384 - protein, 152 aa, Homo sapiens
MKHESGVTLVIGRLGAHGARSVSKWQPGSAVPEERRLHVGCASDFLGSCVQAGVDQLMFINGGPHPCRDYHTFYIFIISQGEGKERVRSVSFDVHDDVRLLSDAIHGEGYESHAGKLVLRSWYEIEQAHLPRQPLGRPMIPEKKWDKVHPSA

SEQ ID NO: 1010385 - protein, 85 aa, Homo sapiens
EVNPLLSMAPGWTPNDPFANIGERILLPQPTGSAWHRQKRPDQVGPAAYPEEAKRARGPPKEGTMKNQHKWSQNNHKVTELDQYC

SEQ ID NO: 1010386 - protein, 126 aa, Homo sapiens
SSLLFPFVKSHPNCRIFLGDSYLNQVVTCPLRVYALSWSFLLLLPNKHFSLRGKHPSRASCLRAFLRLGFLMRIRVFYSPRLFSDLVLLCPTPWHSCQVEGTMIVLVFSSRRWKYSCFCVISPLPL

SEQ ID NO: 1010387 - protein, 108 aa, Homo sapiens
NSVSVCGFSPLAVFPHPFVVLLLCPSVSSVACHAIALASCFILHTLRSQYYLVLRVLSINRLAIRCLYVFLCCCELLCLYSPALSRCASVLCLVLTFDFTDSRSSVVF

SEQ ID NO: 1010388 - protein, 108 aa, Homo sapiens
VVFGLRVSRPLLVRCGALYTLYCRTLFMVCHWSPIAVSVHVVCSVLCSLVLFVARVYVLPLICVLSLCLAPSSVSFVACVCAFSPHGALPGLVISECLHLVLASRIAV

SEQ ID NO: 1010389 - protein, 391 aa, Homo sapiens
NVPLGSVLCCCGCGGEGPAAGRPPPAAGLFFCLCFGLRNHQLSLFLWFCFVRCAVVIVHRVSRSLLSSRRLCCLCLSFAWLGSRGCACVCPHFAHVFLIARVLGVRVPPGFVSFSWVLCGPCREFCVAHSHVSAAFFVWCPVLCGLPARFRLYCSCSCLLAALVFYRSAGVCGFRPFCTYRSPLSSLAGVRSHSPRPQISLVYCIYVVVTSPLPGALVFSSLAVTLLVRGPTTRHAPRTFVFLPSDRATLLLSRRAVSAPPHHGPRSSAGWSLSFLRPAARLGRDIYGPRRRLRLLVFFFVLAALTPRWLPVCSASPFVGAAGGELRDHVLVPPPSSQLPPPGASSLAEFYFVCVSPPLPPPPPPPPAPPSFFFFVFFPQISCRFFLSATK

SEQ ID NO: 1010390 - protein, 97 aa, Homo sapiens
PSLLINACLNKLLLYRVVDNEGTLQLKRSFPIEQSLTSCAQHLLSPDVLPLKGACVVTGSEDMCVHFFDEETGRAKCLLVNIAAWATVHLCLMSAST

SEQ ID NO: 1010391 - protein, 415 aa, Homo sapiens
CVVLYVLFFFYFFPLLLFLFASLFSLLLSCRFPSSFSSLFFSVFCSPYHVLIPVSSVVLCIVSLVPSLSALSVAPRSCVPLACCAFVISSGLSCSLSLVCLRSLSPFFFLFTPVVCPFSCPFPFRDLPGGVCVARPFLCARPLVSRPAFRYPPVVIAAPFQRVLEPFFHLSFLARWDHTVGLHSGLRILTVRASIHFSISNRIYPLGILTRLPCSQVPCVQRQHNSVIFLHPSLLSLPPVVTLCVPSSASHLSMAPVLQALCMGHREGGPLSSKLSDSGVLSWSKLLHDPTTSPPSESSYTAGGIAVLAWTPSASSQPSSLASLAWVLGENGATGSECMVLCPSLLQPSRPLSGLPCTFPHHLASPPYPAWNPSTSPTRPLLCVSGFSALCKHLISCTQERLGEGPWAGWSRDSE

SEQ ID NO: 1010392 - protein, 164 aa, Homo sapiens
LFFFLFCFAVFFPPFSVVLSVLFLSSFFHFFPSACPPNVASVRPFGSPSSIRLFHSLLLFCRVSPRLPSSLHFSHLLFLNASFCIIPAFRLRTCCYFLLLIINYLSTSLLERGLVSGLAATSSLGTDARQTPTLTSLKPLSIQFILQQVFIIIIIIIIHNRHFP

SEQ ID NO: 1010393 - protein, 170 aa, Homo sapiens
LVFTSAPYCDIVSGGSLSLFLVVSSLRLDSCSYVCQSRSCMPAVSLSWDLFRSSRQLYGALSSLFLGWPIVLYTFLLMGFFTSAAIFLILPIDGGAPCFKDCLNCFPGQLLVESLDKPWGPLFSMSKVVIRRGLDLLPWDTSEKCTTLPDCTMLCSFAFLSLQTFWSTVT

SEQ ID NO: 1010394 - protein, 383 aa, Homo sapiens
MEYVSYAVNPGDSGMILLQLAIYCVFLNTVGSVAICRRRTSGCLVLHACSSGLTLRSLMETSVPMEGLKFNRFKLFLQGPENGLCLPVHSLTCQLPRYTSHYCSHICLTSISYGLPPCVHSALIAVTPVTVSIFLRRGPYCVPLPWVMHNCEMRVPSSNGLRCLQKVSQFLSRLLEYSTFTGAESVHLDSLSGPVHVLGLSFSRGGELISGCHVGSCFTTRVAISTFQKAIQDTVEKFQEVMNSIMLISAPAILGTSNMPDAVPATQPGMLQPPMVLRRFPHPSPVCSQRIFWLAISNDHAPSADPVAMAQDVLGHLEDALAKVTKIIMAFFIALNRLLCQQRGARALCHSSATVFLEDHCSVFKSLSAKSFSPPSSDSTDFN

SEQ ID NO: 1010395 - protein, 111 aa, Homo sapiens
MTLLGPQEGHLAFALDVPSFKWPRRTLARATQHRQGYVARSPAISCLLLGSADLSAGLSSRLMLGPSRRCCTFWLAPYQRLFPVPGSFSLGPTVTALPLGHKDFRETIEAS

SEQ ID NO: 1010396 - protein, 307 aa, Homo sapiens
MFSVSERALRPLFGFSGGPTRGAPLSPGGDPRICRFFLQEIFWGSTAFSGGGFSPLYCGGPHWRRGVIWAPLLALPASFWWDPPMVAARPLITPGGVSGRYYPTRGVFGGFAAPPCVPPWGGSSRGCVPPFSPRAEVCGCPRPPGGSWVGDITPAPTLVERVLLGRHCGILIPRGVFSPGGNYTLRAPPRGWGRPPTCVAPLPPLPLCGEPPGPLGGPLSHVFTPLFPGGVPLSPGYPWLLRGTLLGHPTVPISSVGSPPCRSSLPREEPPPRPPRCPPPPPRGFFVKKCFFFFSQKRVKTPPPLSS

SEQ ID NO: 1010397 - protein, 274 aa, Homo sapiens
GRHFLASGLSFLLCLCWALPPGAFSSNPFSPLVAVLVFGLCFFLPWLTDARSLCPLWDFMWELLSLCMFVPSYLPSMAPCVCFFAAALCGLGRFRLQLGIRRVPVALFLARVPSPFPCGALPYSIIPFDAIPRVLGTFHVVGNYWVGERWSEGFEGTMLSPSLVGCLSMALLGKVSNRGRDVDYCRRLICMHCGLVYARVPRFAKLLRLLPVVDLLGCNVNSSLLLGQIVLPSKWTKIIFQRSPERHVITLHLLLVMVGLFFPGTSRITLSLLL

SEQ ID NO: 1010398 - protein, 76 aa, Homo sapiens
DVVIRMRSPGSLPGPLITLTSDLSLHDPLLHDEANHRKENGSCNPASGDLQLASPVYQISELIVSTSSNVAPFAQL

SEQ ID NO: 1010399 - protein, 67 aa, Homo sapiens
SSRRTTDNPPSTINRAPHTRYVGAPDPPEDTQKPWAPMEEFSYQRFRTRACAARDAYSLIRAVAKRL

SEQ ID NO: 1010400 - protein, 220 aa, Homo sapiens
TLVAGVVWWSAPPLPSSLYCMWGAPLTLHTCGCVRPFLRLSYSLRGGVCVSLSSPPVGVCGGLASLLLFISSYGLLGPIACAYCGAVGEIILPGVRPRSFVAAMRSSRRNELSFSPPGHLPTNSRVCGGCFTTTSSPRYISVPFLWATNINLSLAALDILVSPRWEIRCRHVPHTHIYHAYALCPVSTIYNIYTPPRSFTFYSLPILLSKSITYTPLAYT

SEQ ID NO: 1010401 - protein, 194 aa, Homo sapiens
MGLPTAYALCVPRPVWVCLFLAASLPSRPSTGFRVGPGTFQRLDATPFTTMLGALSHSFLGLRRYTSYGWNEVVFFPRIAPFHLIWAYPIAQGGALMTRSVSIPVSRVACLPVNVWAPPVCLVPAFRPQIGWGQFSCPVTGPGAVCSSSFAAAVVGALRVSSVVAGYGSPGVKKGTVMGTSAQPRCSGQGRGAL

SEQ ID NO: 1010402 - protein, 259 aa, Homo sapiens
APGLLLWRRPPLWPRGPQCTRSPRPSLSYRLSRRILVLGAVLRSSALLWRPLSTLVRTHFLSGPYSCASYACYDPYPPTGHTLGCFFRDHDDARVQCLVVPWIGAMEAVSCLQRISCVVTSRDLEMDGSLGSQGPRALRSGWSRPGPGPCTVLSLECLVLSSGMLVAGTLLSPGCLPACGAPDHAEMIRSTSCCDGGEWSRQTLIGAARCLVGSLIGAVVSPWQGSASTMYVPHTWAPGEQLGAEGSHLAMGLAGRVLA

SEQ ID NO: 1010403 - protein, 414 aa, Homo sapiens
SFLGLHSRIAPPPPGGVLCLYYLVDGCCFLSLLYPAARVGITARVRRAKSKWVGRPPPLFFFIVALYLVVAASSDVCVVFLPSIWRPLCRCGLTSTSPLSFSLCERGEPSPLSHCCGFPTLLFVSSLSRSLPPDAMIPFLRVAIPAGARFSMKKRDTVVPPPLLCRCDAPPPPPPRHALAFSVAVVPHPPADGRVLSPLLFPPPLVALRERVVRGGPTPPSRGRGDTIRSMRDPTLAPPLSFSLLRHRTREGASARSLSILLSSLALDASVLPPLSVSPRERESAPLSPPLACHLPDAHHTTRTRSLVCAPPHTQAPLSYPPTPRVVDGYNLLWSLHPRLLALRASAFSSTNHQGQAGVLSAQPVVFVQPSLRVGICFFRATVKSVAASFFFFSAPPFWGQLRGGEKNIFFFPP

SEQ ID NO: 1010404 - protein, 81 aa, Homo sapiens
MLPTEVLALDGILSAHADGHSSPGGLCLTQHAPRGEQSHASQVGTWGMLFSLRLDCSNPASLAGHVPNPDDSFSNIARYTS

SEQ ID NO: 1010405 - protein, 147 aa, Homo sapiens
MWILYDNWGSTSSVARPSEAPKTLPKAKLGPQKKVMFACFGGLTAGLIHYCFLTPGETITSEKYAQQFKEMNRKSSTPAVSNGQQKGPNSPRQCMIAHYTTKASKVELTGLQKFCLIHHIHLTSRQPTTTSSIISTTFCKENTSTTM

SEQ ID NO: 1010406 - protein, 79 aa, Homo sapiens
VPRYIILVVVSPFLCGFSLSSYRSLCSSASQCSSLLSACCPLPIPQFIRFGVYLCARSTVWADCSNGSWAVEISLADMV

SEQ ID NO: 1010407 - protein, 202 aa, Homo sapiens
MITVWKRSKAQTGRLLVNAGSSPSHRESHQERHEGSNVHQFTEALSGPPSGTSPTVGRVSKTDYPAFIGVGAPKPLTPYRTLAPRTPKEITSERRLLKETVHLPEPPEPGGLGGSALGWHSRLLQWSEKLGPHDWGRAGDATCHSHGPVRDLGHSVLAVGLSSSRVLRRERQFATSLTDLHSPSPALGPAHEGPSDPSCLRV

SEQ ID NO: 1010408 - protein, 222 aa, Homo sapiens
PRLSPRVLPTVLFALASCPLLGSPPALSPFSLSFFLSVLSVSCCLPPRLRLSLLPMPRFVPRSPHTPLSRALCSSSLLRRPASPSLSLPLRPLSVLASSPPSLSRSPSLSVPSRHLRSGRARPHLRALLLFLPPPLRSLGSSVMWLQPASSSCVLVISRVHYTSSTLHHERVLCGSLSAGDQILSEPVFLSHVRPYVVIIVLHFLSAGPGMPTLAFHLIPSC

SEQ ID NO: 1010409 - protein, 222 aa, Homo sapiens
RTTGLRARRTTSYLSQALYGLITQLNNSSKGASHVKYLEMTDRYASDQMTWKTKCCVTTQAERHARMNTAQNSLSPFYLSVLVIQQVVRHMRSIYNPRSAVNISRRKSLHSRFLEGVPQQLPVSVLQIGYPGVASRTPFYHQRVHKEILALSEETDLHLPILLKRSRPSCADPSAFVAAAPVAAATTAAPAACCSPSLRLQPRKTLGGVGRGYGCVSLHTES

SEQ ID NO: 1010410 - protein, 330 aa, Homo sapiens
HFFFSRAGATTLFSLIMGGAVGTHRTVVPYLWSAPLAPPPFPRRVPSALVCAPAELLVWRPPWLFYDARRRASIKGERDMSPASRSGGHPLVGALAGKQILGVIDALLLLGTDRLVVCHTRLAEKVCSFPAPPRAPRKWTSSYSPLVLDRATASRHPSAGPAASALFWTLSEYNNIPPPPAGECTNTSLSLGGLRERKLFAGGGPPSEETPLFSSGPRVVPTPLCGADKSAVSPGVFPPLAARGPSFVEGDPLTTHWGPAGTSSRELPTTGELRVPRGTRCVKPPPAWYSLPRGALPQGPPPGAPRVFLKKFLGKSGGFYAEIKNFCFFP

SEQ ID NO: 1010411 - protein, 362 aa, Homo sapiens
MLILRVFGPPFSACLFLFLVGRFLVSSSGLFSSSAPYSTPSSSPPLSPLSPLSLSCFFLVPLLRLFFTVAPLSIYIFSQPHTRSTLSLRFSLFFCHLYPSLYAVPLHTGCSLLFLRCLASVLPRRPIRCCPPASLFSGSRLRPPFLTAVSALFFCQNRHYGGAFCLVLPRLGKFPPTASLRSCAISAYHTGVFAWVPIPLPPRSLRRPTLWASPPRSLLPFLAGPRVDALLGFVRSFPGTTIPRSLPVPRPSLYGRNPCPRGFPPCPWDVESRDPGHYASSDFASPLSLEPMHVWEHAAFSPASVPVVPTVVSTTPVLAGSRWSCPGSMQRPPHFDTGLGCSLPCLCPLEGTLGPPHQGAEA

SEQ ID NO: 1010412 - protein, 76 aa, Homo sapiens
MLVVDESRDTPVSISSRTSLTLLTLNGAKDPAGTFQSMIPLSLPVFSQCHAPIVSLSSWFFSQVFSSQALTHGCIR

SEQ ID NO: 1010413 - protein, 370 aa, Homo sapiens
MSCLMKPTTNSLLFVVFLRYHYKDTTRASSITTLPSHYILLSSPARGRLDILYIFTHSLAHYCLHLLTLCSSVLCVPISTIQSTFSCVCSSTNQPVRFVIYSAPGDRSRKLDCARIHFHIDCISFLLVSACRWPPPPAVSMIGESPLPCSCIFSCGGATTPLVFCAARGEGHAFFTPLFASSSHVRLLESLSVFPLLRVVGWFLFLSSPLPLAVVIFFARRGEIGTLPPRVWVGITLHCLFLHRNILFFLIYTHALQVYDRTTLSPPPQREKIQKIFFFSPSPPPQHSRCAFDSSHTTKLTPLHSPVRRASHNISNNTLRAGAYNYHRIFFFWTQSTPLFVLFLTPPQTGSSLIYYMFVIGQAPASFLFP

SEQ ID NO: 1010414 - protein, 300 aa, Homo sapiens
AHGPIDYTRTGQILEVNFNFLLVHVASKVIGVEWKRRIVFPQEGNRYKRCLLNLSVNISIGQNHACRVTQTTSRHVLVVYPWMSQCHRGYFRPMHLVVLVAESTLHSGALLRTIQRILPSIIPSLKPIDWPYWSAHPVDHYVDAHTCFHGSTYGWSNVYDIEYPGRNVTRNDSWDIRPLLMRQRSYRLVQYLRSLTFYHWICAYIAWAFVRRFVIFLPAVDSRVRFRLCILDGHPSHYLTSGTEVTGPGATCCPRCGLASVQQIHKSTGTFTPMGVGATFKRSFYLPFHVMRGRIRRECM

SEQ ID NO: 1010415 - protein, 234 aa, Homo sapiens
CVLASFLVRFLLACSSLFLSVFLMGYVPVVLCFSSSLRSLLCFVLCPLLVLSFLFLGVSVAFSSCFLWPPPFPPCFGVPPLQRFCLLFLSRFFFSCFVVSLWVFSFLAFLSCCHSVRAFGLCVIDWVFVCVLRCPLSSFFGSPFSLLISSSPLVPFFLCALLCQYRRFPPLPLFPRLRPTHSAYRASRLRLCSSGVLGSWSDVPWGSHPSGTSRWPSPASISSVLCIAKEIRHQ

SEQ ID NO: 1010416 - protein, 137 aa, Homo sapiens
MAYARPVDLRPIGPPFCGPICSPPDFLPRSEERVVTKRTTPVAQIREAFIGTDPTKELLTLWRLKLARMLKLQSLMEDLGPGTRTAGGEHSHGVCPPFPGRPLAFDLQPRTLKGCKLIGKMENHPLGVLFESQTHGG

SEQ ID NO: 1010417 - protein, 41 aa, Homo sapiens
MRMGNSIGPQIPKPLQLYNRLCAKCLVISKMGGLAQGSVYV

SEQ ID NO: 1010418 - protein, 86 aa, Homo sapiens
RRKKKRGGEEETRKKEKEEEEEKKGKKKEEKREKKRRKGRRKKKKKKRGRKEKKKGKKKRKKKKKEEEERGGKEERKRKEERRRRE

SEQ ID NO: 1010419 - protein, 284 aa, Homo sapiens
MKFGPPRVGVPLGAPPWRPNLSGGRVPWWPLVVRPAVCARVATWGGVFCGGTHSAACFAPHSEWVVRADHRMGGALWLANCCRSVVASLGAKGGPSSVVSLRLSEGPTSFNALAAPLLCGGIFFPPPPVIVFCPPLLRHTHFVVGRVGVCVLVSPTGGERNTPALEGVGEVVAPPGAMVAPPQPAFHRCWCTHGASLYSPPGGGERQRECTPGTSLSLFHAGLMNALCMYASDSPHTAWVQTRGFLPGDGSLLWAPPPHGSVVYVNNSPPRLCFRHSLSLSPAT

SEQ ID NO: 1010420 - protein, 282 aa, Homo sapiens
MCCVIGNSAIVHTMGPLGPFSVYVLPYIPLILSVPLYGGSSIFLRMLEEMVNASYRRLYVNPFGTLKDLFFYGQLESREHLMWFVSRGKKDPEDKMTADRAVFHDVAVIAIQGPPRGRHTFCEPVMVALSNGSLILVGALVAWNTQVVKSGPRCRFNVLSVILVTLVQLLLLFPGKVCTDQGTQRNSKRNGWTKEDASFLLDGPGLDRVVLDVRRSVMRGHKVAMLVFPRDAPTHCKPLTIQVPIAWAPTLSASSAGAHFRTANYWTPWIKRQEGHQLLQSS

SEQ ID NO: 1010421 - protein, 100 aa, Homo sapiens
VTWREPRASDAAGDMSSPDGRSFPYRAALQEAPLPVVTRGYFPFVLERGGLITWEGAQGLRSPRDHSLCRLQRGSEQESCMVETRAASVQDDIRERTNET

SEQ ID NO: 1010422 - protein, 157 aa, Homo sapiens
SIALVSLAGRVPFSFPISHLACLRYSCPYSSAYFFKGPMTYIVSGVWIPHHGWLLFPRCSCNVHCGPCYPCVSGCWCSGMSSLIGFVLTVVSVTIVIRNALSVAFNFVYFAYGLVSLPQRLAFRAIVIVVALPVFPDGVWVCLSRAVLLGPTVARRL

SEQ ID NO: 1010423 - protein, 104 aa, Homo sapiens
MPHPTKLSFSYDTIGRVSGLSVAGRECVPSQPESVGSGHQAMVPSSRPRWYMGTSYTDGREMRVHCLSAPVTIKPLTLLPSTVQGFLPAHPPGPVPFITVNTSL

SEQ ID NO: 1010424 - protein, 306 aa, Homo sapiens
GNINEILVPRGRQTASGHASPTPRLSAVQASPKNWTRVREPVIGSLKYETGVFLRRLTVGKPASNAARPGTLRRGGIGDISNWGANYGTALEIAGKENEFPLVCVPRTPMVNLGSVPCAWSLEPLVGTPPPFYRGPLGASQAPRAKGPVESHAFEYPQAVQQRQIWPVGPSPVSDSRHHQRECLSQALPGASTITWAPSWSMDQAMKERACSLRSPSLALTSRRASISSASGAPAGQPPVKVLPYVEGFTGASPTACTETTAELRVYRPRPATRRRPSTHRPVVRHHVHPVRDQEVTRGAVRRPGR

SEQ ID NO: 1010425 - protein, 170 aa, Homo sapiens
VALLALLVWWSRASARACWFVLVLLSSWVIVCSCGGVGERVRCFTPHHACVFCGGWLVVAGSVAWLCLPPDCACYVVGVSPPLFGSETVWCHTKTVGCVGLAHQIGMFSTPLCVAITYYFVVWARQLGVSPPPRWVLLSSSWVLAQHTRVWWVSPEVSPLPPFVRGRLLV

SEQ ID NO: 1010426 - protein, 204 aa, Homo sapiens
AGRGAGSWSGPVRSPRPRVQEALKRLLHRGAQAAGWGAGGRCLLPPAGGVARLGPLVLARSPSPPLPCCRAEGWWQAAVLPARGSRARAWGRAGGGGSTASRREWGAMAKLRVGLRVHGSRGQEHPARHGILIISGRRVSSTSSGYMLAYEIPTLQGYRKPTGGQIGTRMLEQDAAKNRQKDVPTCNPFTMVAADMPGSHHSDR

SEQ ID NO: 1010427 - protein, 114 aa, Homo sapiens
MSSLLDSERYTLRFEKGGIGRDSVCFILGVCCPLASLLDAARDYMRPYTWIHDPCICHYKTPLVGLGATAETSVLVAPTLITFDLYRQAVRIGDCTKQRGSTGENGALQESGLC

SEQ ID NO: 1010428 - protein, 104 aa, Homo sapiens
MWLYIKGEYTPIGIGCRSPVSKASLGGHFHLVSTKFCHTSSLVFALDVRHRSLSSLPRFMCATICPVCNFSLPYDCEVVDITSGWHPVQACNLCCTLVSLHRNT

SEQ ID NO: 1010429 - protein, 87 aa, Homo sapiens
SSCRPYGAVFSLSRGVRASHAGPGREKSKACRGCREKTEKRLHLGEFEMFKSVQEKRKRNRKKIEKQIATIRAPTEKVELGGQFHKA

SEQ ID NO: 1010430 - protein, 269 aa, Homo sapiens
ARRQGFALTRRPRAYAGSNMARPRKPLAHPIEGTADYRPRTAHHASATGSDPPGRSGTPKQGENRLATPTSSNCRGPLGDASPSPSVTRAHEGLPTLRRFLATDRPSLAICNPGGACRHSCLDKLRDALTKPLEPSSDSVDLYWCLRFIPWPGELYISVKARASPHTWGSTGAPDGRIDNSVRPGHRYARDLRPVIPPVDQCMPRLPSPTCRGSAAGNRGGSLASVVARQQATLPTYTAVPGNWTRALTTISTITAYHWSPAQNERQTA

SEQ ID NO: 1010431 - protein, 113 aa, Homo sapiens
TRVFWWGFVFLLDALLVGWCGIDHALLPRRRSAPWMRTFFFVFVVVCWCCGAEDSALFVCVDYSLCAPAWWDGDRPLRVVGSALLWWGGSSARWTTRLISPLLRMSVCLFVVC

SEQ ID NO: 1010432 - protein, 108 aa, Homo sapiens
MILTEEVKMTNCWVLKTVLKEELHSELDWYQNDERVQQVAVTHVTDVMAELGRAQHKPVHRSPEPSQQARGPWTYEDIEKFQTVTGTVLVGPSAGSMRPALCVHITDL

SEQ ID NO: 1010433 - protein, 119 aa, Homo sapiens
MCAPALWVIVCWCAVRSEYSCLATVVCGVVVWLVATGVVGGGSAYPLTSYPSLPVALFISMTGCGADPIYFFALAYSHRVRWWVSFCGSTRVGDFCCVRSQRVCLLLVVSVYRLDRTQG

SEQ ID NO: 1010434 - protein, 256 aa, Homo sapiens
HRPAAALYLRPQVARSFAMLTVDPGGARAPAPGRAGKRQGPFFFFFGILFLETGVSYWSPMVGSVVGADLGFTGNFRLPGSRHSPASASRVAGDYRRPQPGPGYIRGILSRDGVFTVWARMVSIFRDFGIHPPSASQSAEITGMSHRGPGQAVKGTLSEKPCCGLEVRELGLSRIPVSAISGGQRPEDGWYRNLGRLGSGLRRGSVLAYGPGTGEETNRQGESPGTLGRHHDRGTRWAGQARLTGLGDSGTRRLTG

SEQ ID NO: 1010435 - protein, 255 aa, Homo sapiens
YINPERFLYCETPSGVLPSWVRPPLSHARLCEPPPLNGERLPPGARVFSPFPGAFFIPMGPARGGEYTTLVATPAGDHRFWPLFWAPYILEGGPHYLGHPAVVHPQKARGCGGTPLPPRISPGGLTPQPLSRVGASNHDVRSHFFLAVEIFSTAFFSRRSGNGAAPHMRLSAHPHGGFPPAALAPRLLFHKCQEGRKLHPSLPEELLCLLCSPPWACVTKVCPPARGFAKGSLGGDLPRAWCPEFGDSVFSPRRL

SEQ ID NO: 1010436 - protein, 324 aa, Homo sapiens
DEKQLLVEAIRRARWGHASLVPRLVNITIIKEQARDVVSFEQPEFSVSRGGPGCARIPVHPDGVLEGREVTSVSYTLDRMATAQGNRDYIPVEAELLVPSLVCWPCERSCMVKAPGAGNECLTTLLQGTVSVPAGYSIVQLEQALSLGAQLGPATMSHIIIIREPRMNWDRSFTEVSMWMHRKSYPLHGDAWGAPVMNAQLRRALWIPGKIHVQTWGVPRFWQRQWGGYRGLKGGWDFHGKSIPEISTVRNVAADKHKCCALKLGRTCNPGSSYAGELGEPTDDCTGVGRPLTGGLQEDAGGTGKGATRWVVPWPAGPNRGHRR

SEQ ID NO: 1010437 - protein, 90 aa, Homo sapiens
CAARRGGLFDRPLCLPTDGFGGLCVVVRSRVVVPHAARVCVVISCAPIGGEWGGVRVNRVTVAWLAFADMVAADLFFCDRMRPPRCVVVS

SEQ ID NO: 1010438 - protein, 331 aa, Homo sapiens
HKDPTGLPGVSREMPGQAGVCPCVDTESPLLAGLAGRLCSRGGGEPLHAWLGVREGLLGHDSSIAAVDASRSWECVTRSGAAVHVGRSSNDLRVNDASPVELTLCDEASIREEEARIRRRLDLPAGESIGQPGRDRYAVAAGGDYRGFPIGGSTYSSMPQGHNVLRFGLGMQARSFNCLSLRTHSTAGVGLRCPAFWRKRMRKGFALPPRSGGKAPKFFHPQERIGFRRKGVKANGESRLVTNRYYGKMHDRGLKLELRTVYPGFDSTVEFRNEESQGRSETIIKERKFSRIPDRGRGPLEKAIIAAGDTPRKSNYYLFLVTEKRVWVSPP

SEQ ID NO: 1010439 - protein, 47 aa, Homo sapiens
MPLGEGVASPELGSWMMVGWPDSLDMWVFGLTPGPLGSLLMGQCRES

SEQ ID NO: 1010440 - protein, 226 aa, Homo sapiens
ARALSEPACHCGAGAALALAAELLRERWAGCPRGTPMRSGVRAIDPWSETAWTGCCGCLADGTMPCVLAGLVTPLTVDPSAVPCCRSLQWPRIHQQDGQVSLQIADVAAENLYRATSYQPGERDGRPGGLSYVNSETLQLADSEELEELSGGVDPGRHGSEAVTVPMDPPGALKETKELDWSTPLKELISVHFGEDGASYEAEIRELEALRQVLGSEDRQNGRMKN

SEQ ID NO: 1010441 - protein, 296 aa, Homo sapiens
WVGANYQEGGGPPDHHCRSSVWVGEERGTPSCALGGEDYNDCGLGRRQPALVVGGSCCHCLLWGGMKDDIIHSRSSRRACLYNHNTHLPPSFVWLVIAINTWYQRRFDINMGWWAPHRKTTRGVFVSPLRESSASQQQISRASTRHTTAALWREEQKSRRGVLSTAEKTTLVLHHEEASLVGQQQPDSGGVSLLLVYPGGSLYPGVVWAPRISCQYMVRRGVDDTQHGLQLARPAFLPPHHTPSSWGAHTHTHTLVSAVWRELVVATLDSNNTHTWRNSSGGKHHAATFLVHTLSV

SEQ ID NO: 1010442 - protein, 200 aa, Homo sapiens
MSQAARSQVPPRLQSPRLCPECELDAVALPSSHLMPNKKRPALQLSAKDWTFDSRTPQNGARMRVKNGLAEKHRNWTVLYEILYFLVIYRGRNLRCRPSPPGTQLGQDQRCLQGNLIGIISGHGGRFHQVQRATYPLWKETRHKDGQTDIRIYKGDQSRVRKGMTEHRPIEEDEILDTEQPVTQSWRSNKEEIRMIESDN

SEQ ID NO: 1010443 - protein, 256 aa, Homo sapiens
LFVWFFPPPSALSPLRVCVELGRHRVVLLWWGSSAAVSSYCFCTQPFLFSALRDILDEEYRLCAFVFVLVSILAPMPVFGRVHSLRVAGERERALFAAPARYIIVEDVCEHLLFLSSVRDIIAQHSLSLSRYLLCVWSNLHICIKERGEEIVHPPSLCLCGDGFSTLFHTLWSRAVLSSLCVVRTLLSSLITSLCAHLWCALSVSLSLCCLHTPLLCVSRAQRRDSCLYTHAECSCPIVLATTPSLLWCARVVEKI

SEQ ID NO: 1010444 - protein, 165 aa, Homo sapiens
VVHSFTITALTSSVVRPDFGCTYPYAPYDRPAPGAPGTRCGSPPKSADFYIQDLMTSSGFLGISLEVSTPTLLRYCSAARSNQSYTTRRGQFYSSSSVMLLLLDIRDRNNRLAPPVAPGKPAAGTCSPCIAVKHRLELTNSEIIRVNHALDLYDTEILKQSEPDD

SEQ ID NO: 1010445 - protein, 333 aa, Homo sapiens
DIWYRLGPGTRSSVAAAGQLGRQLGASWDRLPLLLVTSPCPALTLLRSPCLLMPCLCLDFAACVLALHAALSVGPCSVRRAGDLWNALLLNWGNLCDPVPVVWLECQQSSTCPMLPCDVKGMYCRRFLLVLRVNHNNLSLNMHLQVINGDFDAVILALGHGSDGKPSMVQHDTPRDGLTKRPTEVNDSETAAGPKASEDRTLSKTFGSSARTCATFAHGSLQGGQLALFEGPEQHERPFQVQKAGTEGPVKRTDLIIGDSTQRERLPTGHGLNTNTTNRDKTTYPQKVSPLGDPGSRYQQRLRFTLTVLERSLVDRKPNRQRGVQRREEGAQT

SEQ ID NO: 1010446 - protein, 116 aa, Homo sapiens
IFRCDELRQESVYRRLYTIEFRGCSRSCSFQRRPDASQPHDSRSGCMAITIGPVSDVRKAKLLLSEQVAALHPPMLGHPMGAGPAVALTTPWELDCSRYGNEDKSALFPFRSISLA

SEQ ID NO: 1010447 - protein, 104 aa, Homo sapiens
LWAPPVFPFFFLGPLFWGPGLSGPCFRGVGFGPLFPPAPFSPPPGFPPRGPPPRWGPPPGGGAPGAPAVAPGFPLGPGLGGRPPARGGPPPRGPPPPTTPKKNP

SEQ ID NO: 1010448 - protein, 244 aa, Homo sapiens
REAASISERLRSNAAVVLEADGPDAGGLNALVEAVTLGYWLACAWVACGWPVVYGPWSVGPALPRGCYEPWLWPTACACVPGVLCAELMVLILLCMSPWAACDVTTGSAVPICLPSVLCSAVCSCVPCWERRHVVLVTCPALLWSPWTVAERLLCGALLHMHHVTTKDNVTVMDCTVLMCDKTVPTLCDALDVIANRAISKRISSSLSKASLDDDVTIHDQNITPSEPTLLTPCALRCTRVALV

SEQ ID NO: 1010449 - protein, 117 aa, Homo sapiens
KRLFLLSRMINSVCGGAHKTFLAPSVVGFKDTTRNQTPCGGQPSPLTHNIFFSFLKEASLDTLLVRSPLTKHFHHGAPLFGGKYKGRSLSFFLSQEGVENNTWAPDMWVGWLKTHIM

SEQ ID NO: 1010450 - protein, 119 aa, Homo sapiens
MWGVPPLDRSLEPSAALETALGDLYGFGVTPPLAAIKCTPDDICSAKRPPSVSKASTRFLRVALFWRVAPRHLYGGGAFPTHRLRESPWDGTGWLSFPVVDDYLTSVMWSIDDLGKDEL

SEQ ID NO: 1010451 - protein, 120 aa, Homo sapiens
RICFTQQLLFEGKKKKEANDTKNKLIYRRSNQQYVYGLKDTGEMRSENRAKEGLPVLLQKPVSYSETSSSIHLLARFTFPLIPRKEHSGIGNTASVRSGCFYQKKEEDWICCALPERPET

SEQ ID NO: 1010452 - protein, 122 aa, Homo sapiens
GAFAAAPPARPCQHRHLRRCRLGALLGFTAPFTTIYTVLGLLSWRRSYMSFSLVGPGDCSHEADGRTSVRGNWRWWAVLCVNYVHGLCPVWQADLWRYLEAMLVVRVAPIRARALALPSTET

SEQ ID NO: 1010453 - protein, 80 aa, Homo sapiens
PEQKAKQEREKELAKVPIKKEDLELIMTEMEIFRAAAERSLREHMGNVVKALIALTNCWVLFQNKPTGINLWPIKFFFVL

SEQ ID NO: 1010454 - protein, 125 aa, Homo sapiens
GLGTKGASLIVKHNGWALVNIERPPTEGFQEHPGHIPPHTPPLRGEILPLRQLFVPLGNFAPDKRRFSQAVSSAAPTCRIYLERVCALFGWLWGGNNPQVCCAAKCSAPHTGSPIVTPTRTSLCV

SEQ ID NO: 1010455 - protein, 224 aa, Homo sapiens
SWSGHPRLAFVVRPRWLLTLPLTLLPPSFNASLSPFLIRSPSYLTIAPGLCRVLSRGASRALSPAALLKWSSFLLGPIHVVAGLRSSWSLVCRLMASSYYTFAHAILAPGTGSLVHTHEVSLRSQPPVGHVPLPIPPCSFPLVVLLPPRECSPSLYRDQGLDTWAGLYFPLPCGFSPAQRSRFAVCEADGELCALGHIQTDPLGLRLLTGSMCPDLLLSPSLLH

SEQ ID NO: 1010456 - protein, 261 aa, Homo sapiens
MPRDFFFPSQAYLKLVRNQIPQNMDPLSSGFSPTCGQHNIVLDEQERKFTPSAPQRATSFGKIHPIFPKHWFFFPPNMGPQHQSIPEGVFYTRRERAFFETLCAGINSFCARFSRPLMTHGLTEFSGFKKESRCLYLRKFFYVRGVWNPECYILVHHQRELGQHAFFYTTCVDWRKVLRTLGGSLPTSKVNPRDNPLDQCTPVWIHVHNICKPLLSSTPLMRHPACHTPMQAPCVSGLFLKRKIVAPGRGAQPVIPAPQEA

SEQ ID NO: 1010457 - protein, 102 aa, Homo sapiens
MENRDTGSRAQSLNDYLQGYSVRRYLVSGPLEQGSPTARLRTGTVAYEEPGHAAGSERWAGIACTENCTVRSDGSTELDFSQRTHGAKGYQAARSCMTIVNA

SEQ ID NO: 1010458 - protein, 325 aa, Homo sapiens
GSAPSPALLQRAVRIDACAARTREPRCQQPGLRSQPQASPGGAHAPTARIARISAGYRCRLLPAQRRRHDALRAGALGAAATVVNAAAAAVVAVAGRRRRRPSQNATQTSYGLDLTKSSTELQAFQCQPIMAYQIQPKQSTRSPTSTGPNGRSLGLRVHTGEANHWVVFPGGLRRRDTSQAWALHTRSLQGPTSLSRLYAVLSRQDSLRANPVMLPDPTSEEAPQEEAYIASGCSAPPRVTGLGQTLHNDGATEGVKEAGLNEAHHRASGPRKFGTHTDVIYPREKRSLGGGDTKRHGPTQCWVVPHQGDLYAFPTLKGGRKNVS

SEQ ID NO: 1010459 - protein, 178 aa, Homo sapiens
MRSPRVPTQETIQACAQHTSQRTDGDMSRRSTGVPEPGLVKPYPGRRPGGVNALPGRNEAQEARDVKDTPVVNPLTPFDPFPLRDIQRRSFRGITGDRGLESEYLIDVDPRRSATHKKRPLSGHGQTSIRGIKALAKGATNEKCSIYGTNNREWVKVNIVGKTGFEEQEGRIKEKRKG

SEQ ID NO: 1010460 - protein, 160 aa, Homo sapiens
RCSEAGQCVRSGPTDARGGVVRGAMERGLGPGGAGPGWASHWHDMETCGCDGSLVALAWTAMGAGPWPPNCGLRVWWLVAGGGRSPPCPRLGATHIPFPLHWCTRCQGAGANDSGEGATRAGMATRTWGQADPSQGSEACRVEVSILVDVFMTDRHITES

SEQ ID NO: 1010461 - protein, 209 aa, Homo sapiens
LFFLAWPPRGGRIFLTAVLIIPRNRPLVCLYNFSLAALISAVPLNMSSRRGRALQYVCGPRHKIVVEPPSLLWGLFVSRHRSSHTTPSALCGAVVRAPPLEGGSRRRYTNICGRRTYSVVVGPPTVSLPVIAPIVDYIVGTELYLSRWATHTTTGVVIVRERVKNHTWGATFSYSVEPGCVSQHLLCVVSRRNTTQDTMWGSNTLLWGK

SEQ ID NO: 1010462 - protein, 270 aa, Homo sapiens
QVDCAMQRLQVVLGHLRGPGDSGWMPQAAPCPESCAPAVPRVRVTVVGVCTGAGCTGHLAGLVPAAGFNGHHAPTELLSCMSLTCWFSMDCESRGREQLGDICVVTSRRLCLCPLSIDSVRRWATWAVAQHSMGGRPCPWLTEEEPLGNITSRLMEKDNGQEICLIPMGITSETVAERFGISPGRSMDTFALASQAEVMQEAQSNGLFAKLTIVPVTTNGPDDKGTKEGPSTVTQDDGYTAQNSIMEGLAKLEACLQERWFYHSLETLAR

SEQ ID NO: 1010463 - protein, 354 aa, Homo sapiens
FPKFSYGITSPFSVPELLQCTPRVTVIRFSFLDCSENTFGRWICPSPGGERFDVSVTTSPEGVVPTSDGQGMPNRTHVLWVTRVLFVRAVEIVNRMTLRASETGVLYHLGPCDVLPTRASRSIECSMYGSVPILSRLVFLHVDVTQPFRGCELKAPVGSPRSPELDDKAMLNVRFRSIWGPRCRLRGNLAQSMRRSLLDVAGRTRTDGSYTGDLQLENAVVTSKKTLILKRFCRGLQRRVGETVIQELVCLGVHVELMRFGITVFDLLQSEPGAPGLRVTECSIKRAPMLSKDSRVSQEILENLRLAESSGTGRMWTLLAIRRWSLICSNLDRLGKSRGGAGATKVIDGRKLFD

SEQ ID NO: 1010464 - protein, 102 aa, Homo sapiens
MILPCPYLSGDGRVTSGTSNEYGAHCVVGTQLSATAVGNVAAILELVRASPSKDCHLSFECMLPLETSGHRLSIESPWPYYVPCDPASAPAPSYPFWPIAPL

SEQ ID NO: 1010465 - protein, 328 aa, Homo sapiens
RGAMAAGGLSLLRAQMRRDWVGRLREEQQEGTRLRQVSRILSEGGWLELQRRASGLAAGLRAADLVTVSCRAVSRCWLLEGPLKRAARQEVCERPWMELRGERSGRPGTCCPFLDTAKIAWSVYNSAAGNQARCQRSIPDVPVDPNCELLDPGFPENGDERGFSCLPRPDADGPEPIALQPTIEAFTPDLAIDARKGVEIASHCCVVSGNLVDRGLPTLHAQLALGLSATVPIFLKLPTGGNPLVTFGKVRGTLPLAVSPGQGQDTGCRGVVTDVVYREYRQRCPFQPVNTQKPWARRTFVQPQLVAEPKCLAGVPPTWLPHLGRARS

SEQ ID NO: 1010466 - protein, 219 aa, Homo sapiens
FWFCRSAALCFFFPLPLLLPTLLAGVFLFFRGPRVSRLHCCTPPGGVLPFSSLLGEGALHLERGAPSLRMAHLSPQSFFCRGFFPLWLSTHLRPVGTPSCLYRKCCLFVLKKGFFLALRFHTILGPSILPFPLGAGAFLLTPDLADIIMGGSQRVNPTSRSSEIFFSAQKNTFFPQLDEAPILTGKMSENGRHSTAEHHDFPQPLVIHPGGMESQRAPQ

SEQ ID NO: 1010467 - protein, 430 aa, Homo sapiens
ASFASSWRCFCLLFVSVFVSVCFTLGFVSALFFVRALLLLCLSLSDLLYLLLPIRPCLLFGVLSVSICVLFGDAFVRLGYSSCSEGVSCLGCMVFFFVVVSTWVHAFVRFFLRLTVPQFALLVLTLVAMPPLTPSAQSSFYHLVDPFQSVSPGMVSTLGMVSLKSYHLRTSCETNRSIAALPFHLARSLVPWKVFPKPFISRCARIPISRLLADVPLSVPGEGRAMPTRFVNVACCQYSQSSEGPPPLGGLCVCTRLSSGPPIPSCASLLARVLHIIRTKRIRKVIVITWLRLKNIGTFRRWPSVTRDRSGFAPSTGLGTNELSCGMTCFTVTSFSPCCPLEGRPTLHCLLVVPLDTGSGTLDGAHCSHLGLCVKRWQPHLSDENGISGYFSPGLQSGSAQRPFLAHQGPVIRAITVFHTTTLMKKCERV

SEQ ID NO: 1010468 - protein, 110 aa, Homo sapiens
MSHAVCVPPIARVPPLGATCGALVVDCLVTLLCVHKLGPLVRRCVPPFGEEEGAPPGYDPQGGPPFAVSEAHKIRSSGVTSPLRVGSFALRLPRDVCLTVCLPALQTAGF

SEQ ID NO: 1010469 - protein, 114 aa, Homo sapiens
MACCLLRVACRGRGALGAFPGEWPWRCVYGTLLSLSGCVDRGVVGPLCDFVCTVGMSVRVCYGGSVHAGNMCVQLHGAILCRVGGLVGDVFYRWSAVLGSCMLGLRGLISPGGR

SEQ ID NO: 1010470 - protein, 199 aa, Homo sapiens
RLASWSPSCALHSPLLVVAATPPYSVVFSPGGQSRLHTGSLCVGTSHSVVVGVTHNNVFVLVCLLLGGFSPYSPCATLRFPRYSGLRGTPVTFITTVFAYMCSGFLILWGLPRWRAQHTYLLGHVTPWIKPGPRMCQYLAGMVPGMPRKGLATYSHICWDAHRLHITGHTPCRIPEFLLYAARDLHADGIQTQRPTGNK

SEQ ID NO: 1010471 - protein, 115 aa, Homo sapiens
RPPPDVDGMITLKVDNLTWRTSPDSLRRVFEKYGRVVDVYIPAGAPRPMAPLGLRFLSCFHRPGATAQDAEGRHGRGGAGRTRAAWMQSVLLLCACLGPCPDKPPGESHAGRVHK

SEQ ID NO: 1010472 - protein, 176 aa, Homo sapiens
MDVTEEVFGQRLLDINVIGPKTCDDKGQLVPRNGETRSGSKCVISVFTIVSLQSISWLQSFTMSTLQQPRWGLDSKILAYRAGPKEHERVTAKHLELIKTSLQQDALDGQGKRGKHERNPADKKVRGARGLCWHRVFPVSLIDASYITGEYSVGAVEVPRPASEDQGYSPQARVGL

SEQ ID NO: 1010473 - protein, 90 aa, Homo sapiens
MTRGSMTEDASIHTSSPCRNGHQHEDGSRRLAAYPRCSMLRCQSTNPQDGLKGQGSRGKLQVRDHVFQTVGAHWLGPFAVGCLPFTAWGG

SEQ ID NO: 1010474 - protein, 407 aa, Homo sapiens
VSSFFSGLLVVLFLLFFLGCGSRSFAVLSFVCPRLSVCCVSISFFSLFCSSCVYGVSCFLSLASLCLFSHFVVPGWRVLLLSSTLSLLCSRVVSSCVLLFFVLDFFGGVGPPPFIPFVLFVLCVFSIVVILANFISFFVVFLLLGVCVSRVVVFMLFSVDALVRSCSLFLFSLPLSLLFVCSPSPLVGGGVSPWCCLFYLSFFPLRSPSLCCRVCLGADFSGVVPYGVVSLFILSCSRALARTVSHFFSFSRCASAARLCVCRVVCVSGLVTSPPFTCCFADDADPPPTLRCVCVCWFLFVCGVYVVLFSGTFSMCVVRGCVLSLGSMLFLQSVTPPLLWMRLTAPPPRTSRDKQQHMSVIAGMVACRRTHIKSKKSERTQPVPGWGGAPPPPPRRASPPQEPPPPT

SEQ ID NO: 1010475 - protein, 206 aa, Homo sapiens
MSPVRLYVTIGVYCLPHSGLLASLGLFSPPAMFLYYVCLCIHVVVRPFSILFRVRFVLWSLRLPLLCPSVFVSVPHSLYWLRSPGFTSLRYIVVVVMSSSISGGGSPPLVNGVSYGVCISSRFFLIGSFERYVCSVPVSSMPLSFVSALGHRFSLLRGVRRTVLCVAPWPSFIAVVYRRFLLVFPLPVSTSIVGRGFQSVLSFVGF

SEQ ID NO: 1010476 - protein, 108 aa, Homo sapiens
MVYLSTGGYGGNQVLCPCAILSGASRMIDQWRHAELNESTLMSLVILPCLSYMYGSVGKSEGEIYMCDCFFYNMRDLISDLSDHYGLTAVVSRDGSDGCFLRLAGDGL

SEQ ID NO: 1010477 - protein, 111 aa, Homo sapiens
YRHHGPFSFLVAPPPAVVSPPVVHSQIVRPVVVFTPLLHIRESRLGGLMIFSYLLSPWNFLSPLLCPLAGRPVVFPASVFFHTGWDDSCGCVSPSLLAPLYFFVGWATPFI

SEQ ID NO: 1010478 - protein, 245 aa, Homo sapiens
FGPTYMPCDPWPRNDEHFAECVFPLVPKTLFNTSEVVKHKRLRDLPGGTPPGLMFEGAKMYPHRRGFPPWAVYHCVFSREVRPSGLGPDLWSSEHGPSFYEPPVSCAPFGGHPTPWEPPGPPPSPCICCLEVVAPPHLSATPFSMHFPAGPRTPWPHTLVYRSSGVPPLGVLVPLPTSFTGLPPVFQNTPHLMGGHHRFTLLPFTLCTPCPLPAPLSQPFYLCFAEGVGDPPRSISTLPHMCHTL

SEQ ID NO: 1010479 - protein, 92 aa, Homo sapiens
LGKSLLRESTFLSWIYLNSGPKWKAAETAYDFRAVKFSETLERITNRDNFWEECRKICPTPPTKSSLKGDKKMGRTQIARKEPHISTWKHES

SEQ ID NO: 1010480 - protein, 376 aa, Homo sapiens
WGRFRCVACFVGSLGCFLFTFYLSCVFSLFPVSVCVSVLGVQGLGPSFIVASPFEFPCCVLSLLFSIGVRPLVVLLCFLFFGLISAVWWVSSVGGPLRACPSNPSVAFGSVRLVLASALSLHLLLVFHRVALVFVGYFYAFVLGLRPIVSVGFVLGAFSVVDLSGHVFDSKVYEIPRRGSPPPVLFPMIGLSALGGCLGLPAVLLCHLAPVPWSPVSLVGSCSIALGDAFEVMCMVLLDVAQVFPVYSRRVLDLLASHARRKSLRRTYAPGWADKPSSMPSLSPALSVHAYLGSSRDFTFLTSFPCQILPGVRRLRVMVGFSETDCPSSGCLAPPVRCSGFSGLPHSDPQQMRPLVPRPCSCGVTQPPQLCFDVTA

SEQ ID NO: 1010481 - protein, 271 aa, Homo sapiens
MSLLDPWWRKSSGLALCCCSWRSYVAWLQTALLSVALPAAWCSGSQRVRFRPDSEGRRNASCEGPWLTCSSPDLAWAPADRHRARRCTTYQHATADRWLCTGRAHKLSHAQASVDSGTPRDDGRTEELETVTGVQSRPGPGTRSGRNATVRQPLWYQTTSRTCASDPMHGPTAQHAVDMQHDTGGRQTAHLLPQTCEAPTGRGRAWSFPLKTCSDAVCFWLGLGLPGHGIHLDTGRHPEPLCQDSILVPARLLFGIRPPNWRGHVTVGAES

SEQ ID NO: 1010482 - protein, 191 aa, Homo sapiens
PVVSVWVVFVFSSSSASGGRSAARRRRELCVFSVGVYSWRIACAAPPTPLLFPCYGGRSVGQVPAAPRAVFARPLCGVVLFVFWRPVVAPALSPPPLILGFLCLLAPRSANVFLLFCAAPVRLCCIARSLCRADGFVLVLSPGSALFLLVQDGRGSRSLFLARGSSRSAPLAVSRYVVSLSLLSSLARAYA

SEQ ID NO: 1010483 - protein, 113 aa, Homo sapiens
PRVFPFMFPVCILGEIVRENHFPPGTSFALVSPKLKFTPPKRDKKWGPPRGGARLKKRGPPGGKKLGKNPFSPRLWVFRAFVFRLFSFKPLPQRGSPSPGSPQSFSGALGPGV

SEQ ID NO: 1010484 - protein, 98 aa, Homo sapiens
VCQDQQDLLRLPHPLGAPMGLFFWCLTVPPAVCHVSNGREMVVPMSQTPCENVRDDELGRAISPPFDQGSIGLQGDSVFGRHGSCEILHSMLDVDDWP

SEQ ID NO: 1010485 - protein, 269 aa, Homo sapiens
MALRSFLFDLTFISLGGGKVSRNPVVIGYSHVCLIVYIGGCPIRAHLVAPLFQGKGWTFKGCQGRSRHFPVETNTVASEGSLSKVHALLGPYFVVCLDLDCPTEARSPVTFVGCPLKSLNFFGLNFCHVVIGSLLAGIFICMWFCNPFRCLYPAKRQDPGQLVPCCGWRGPFTEASPSASECPLLSDSEVKCIENDAKLPGHWVHWASAWRYWLGARIILPLVHAPTYQPSSRSNIGHLHGDKGCIGTSSQPCHMTLVATPPLSTASTA

SEQ ID NO: 1010486 - protein, 112 aa, Homo sapiens
MAPSRTAGSHLKTLPRAASARVAHAHVVPAGPPPTCTVAALQETGVLRARFPPSRCNAGSSDRCLCVPERSHCLLTGFGRTGDPAFLYLLSAPREAPATGPSLQHPHRRWNG

SEQ ID NO: 1010487 - protein, 33 aa, Homo sapiens
HELDATGAQAPNATYWECYYNSLDCMLQRRDWE

SEQ ID NO: 1010488 - protein, 125 aa, Homo sapiens
VVGGLWIGVPPPLGGGPPFSVVVFAGEAVRGSVQVGLSALVTEPLPAGVVYSFSIAHSLARAVCPPHCYLLVSPPRPLCGVTHSPPLALRHKLIDWVCPPFFLLVRRAPPLLLRRCFSVGSPSPR

SEQ ID NO: 1010489 - protein, 159 aa, Homo sapiens
CPCVSCPPPCSVVAHRATVVLGTGRAFEPSSVDRGTVCTFCCRFRTFPRQMSCSWHASGHLECGVMCDLILEKPLTNIPALVPALLPRPRFYRRNSSQLGAGPSQESLHRCPQSPGAQDPLARTPRKPPVHPAPEEQLRLALELSIHGIRRSGTGAGSR

SEQ ID NO: 1010490 - protein, 189 aa, Homo sapiens
VGGGGGGALCSLRILCPARLGRWWCRLASRGVCAGVGVARASAAPSARARLCVVCCGVFAAARARALDWRAVARRVAPPRLLCVWGLGGSLSGPLRCCVCVLWAVAPCASLSLCGGRWRGAAALSLSLRAQMSFARLSLVYDRWVCVSLSLSLPLSRSRATPSTNSRINSDVCTTSSEHSRLTPLSFFL

SEQ ID NO: 1010491 - protein, 299 aa, Homo sapiens
MPHSFVILLFKAVSYDAYHISYQHPAPLRHCYVYPTSFPTHRCCSVNQSDLISFVNYLIAMFFSSYTTDFGSANNPLQDGPHYLDNGIVHIATARNNVLQISVLGVAITLGYLFVYMRGFALLGNSRPLTREIASQKRFVSVSRLLHYARSVLSKWHAQVHRPNLLFYAGTLSAPRNSSEYTLSVQLVTHDPLPISLSIRCMNSTRFDANAPRLRGICLGERIQAQSLTLDGNYVMPIGLKLIYDTDASWTEIDTFITLCPYMTINGLREAYSNNALGRVNHHNWRTLRVDSNPVSEYI

SEQ ID NO: 1010492 - protein, 254 aa, Homo sapiens
LGPPPMPVALFPPGPVNELAHGNAMGTALGFHRLPESNRRADPVWQPWAAPCSSAIHSTKDGMARMDEPWMCTELFLTLLQSCIVHARTVDAGLLLHALPGSHDVQREGSSEDHGTTRCALRDVFEGPGSLNSTLCAVSSSLNQDAGQQHLDPTRVPRGPWLWPTPHPTSPPKPEPPASLSWDRAGRSRDPKPGPLVRLSGICGSLGSGQAHGGRSRSSSHPHSRVTITASFPAPGRLMIRAVAIHVFMQYSLP

SEQ ID NO: 1010493 - protein, 147 aa, Homo sapiens
GGSFPSGRRVLAPVRFCGLCAAFLRPPCLLCCSGDVLRYSALPVSLLPTIGLSPFRGDGRFFFSFPLRLCAASAPRVPSLSLLRRISARCCPGASRFLCLPVVSCGPLCVYDVLLLISFSALSSVVDVLWAPSLVVASLFLFVNFIF

SEQ ID NO: 1010494 - protein, 171 aa, Homo sapiens
LFPGNIPQPGYPGPPAFPGQPFGDLVTSLFKEVPTAGKKGEKNSRGKCPKSNGEEKNFTKGGSPQAARKKRPRGVNRSLSQNFHHGVFTEEYPEEERGFPTPGASLPGKPANTPHAPLWFPSIGRPEIGVSHVHPPTEGPPSSSVVGHSWQEGLVHGDSPTVGDLAPHPSF

SEQ ID NO: 1010495 - protein, 283 aa, Homo sapiens
VLCPVSCSVSLSSLCTISGRLPPCFSTSRLWLIVHSAAACVLAARRYFPGPHALVGDTSCVHLLVLCFLSPRYSVAAYFASLPRPLSVRSCPCLFRWVLPPVQSLLLQLTFRFPCPSRVVRFLFLIGGWLWLSVIFCVLVAPWLGTVPLGLIGLVPLSSGPYMLCLTFVAFLSVSSCCSFMYHGLSGVVLRAIPGAVHRGVTPSFGSQTILGLLWLTVALSPCSLLLYWYCVLRLSCHCLAGVPRSGLSTLHVSLTRPASHALASVSLVYHGPVFGFHLLVLH

SEQ ID NO: 1010496 - protein, 144 aa, Homo sapiens
PLNPFPPIPPSKCAFNPNSLPTNCGTTTRTCTTAVVHKSFLLHSTLHTDHALIVLTSPLTTLCPPTLYLPSSHVTRFFYSVHETATFPANVFLTGEYSITRTCNPILTRTRASWVAPFALSLFLFRLVSLDHFVILGNVYSTLV

SEQ ID NO: 1010497 - protein, 334 aa, Homo sapiens
WVLIIYNPRGAFPFYIWWNALLQVLSPPRVLIPPSTFLPPPPFCCDTPPPIMVEGMTLPRGARSLFYVLLFRGELFLSPLMLPPPRGYREFLPHSWLFAPTTGVHTAFFWRPLFGSLSFIRGGDPLISEKPTCCCGPPENTHAVLGCSRVLRGNFFPGSVSRKFVTPPQGYVYTLTPFFATEFYTSFPRALCETSVDTHAVLGNTGFLITQTYTLYMTRAVTDGGATNGAARLYNTRGHSRGAIDQTPPPGCKNAPGATESTERGGPAPPVEEDRARWVKTAPSGHVSISTRRMCGQHVCGVYNGKNLLTRVEIKTPDVSATTCGEFSHHLQTP

SEQ ID NO: 1010498 - protein, 286 aa, Homo sapiens
RFRQLSCLGTSSQVPRLSGWSSRALVGCRSPGRLGAGTSALARGLSPSAALGSPQLLLSPRPLRPPSAMSIPCPMLCPAGLMGCTSCLGLLCVAARSTASGRGGGSWRCTTAGHVGNRAAERVSCQGPQVGRASVCALCSSTSASVCGRCSPEHLRGTGSALAEEVTVQRQGHDRNSGSHSSRDTDTGDNTRVGRSTNTHADRALDPNPLPLRPSTHPGVTPGLTYILNIPALLGSSSIVLLLKHLVDDGAPCIAVLVSYPGLHGDHSRRITSYLLITRGVHVRMH

SEQ ID NO: 1010499 - protein, 85 aa, Homo sapiens
PLWAPGAPPPFGPLRLPRGPPGPPPGGGFSPPAPPGGPPLFFPPPWAFPRPPFGGFFPPGGAFGGGFSPPPPPPPPPPGPPPPPP

SEQ ID NO: 1010500 - protein, 309 aa, Homo sapiens
SCLFWVLSVFPLFLLRVSSSCCGYCWVSSPVSPCVVTGLSHCVSCSCAALRCCNSSFRVLHLVRTSYIVWWVVGVLSNVFLPDPVVTAFHTLDVVVSFIGISSLWGFRRSCFSLVRLLLLCCGCVLCSVGALWCAVQSLSLRGMMSASCRLCHALVVSMPMCCDYECLFRCCGGGALSADFMSYRHLWGLLEGDPLGTLFSETPCACFQPTLSCLQLFASDSSFLPGCSTKLSASALRGFSSLPGTLLRCLTVLQTGPSLPSHLSYGLYGSLCLIPRNFSEDSSSYVTYNKHTSILGYNPIMRDLISMP

SEQ ID NO: 1010501 - protein, 121 aa, Homo sapiens
KKTVLRPIPRKPNGFPKGHKHGGHPTGDVNKGATRPSHRGERIPPGVIARPQKITEHFGEPTYESTTRARTQKKKCVLINGPRPLMRTPGGVFSKINTCGLYREISCFYHPRRGTKSRMVV

SEQ ID NO: 1010502 - protein, 241 aa, Homo sapiens
AHHCSSPVTVSLPLAFFFAFFFVAFVSNPRCLSTVPLISARYSRSRSRPVVLPRAVLPLLLCVLSSPFPPLASALVPLLPSFPLGPCVTFNVVSVMLSCRPFLVFRPSVSPVRRCGVCFPCLSGVLRSVFSLSRHFSTLIRAGYLRTPSSQGFYPALSLICRIFPTLISEMPLTVAQVPPGILCTTSTSEPSYFFFVCCPLPYPVDGSSVLIHPVSNVQIVCSRSIFSLLSPWQMTICLLS

SEQ ID NO: 1010503 - protein, 66 aa, Homo sapiens
LHFYLRNMTFPELAYNSYTGYNWFMVSNVGPNFRDEILKQILNFFCVPHEEYECTIIPAFVSYSKM

SEQ ID NO: 1010504 - protein, 194 aa, Homo sapiens
SVLRCRLLFVLRSVTRWLSCATCHSSVPAARLSWSSGGVRPSFSWRDSRRGSSVVVQAATGFSACRRRLHVASSSARSRPLMALVSFLCPIVARRCVSSSPSSCLCVCTAVLLGLSSCPGGPCAGLCPPTIRRVFKHRRLPTGSLRFICLPLSSFYHPRPGPLSHPDPLLHISTESCPLPGAPSFGYYFFQTGF

SEQ ID NO: 1010505 - protein, 186 aa, Homo sapiens
CISLLIILSPRELFAKVGWFSVSFCCLGPPVVATLPHFGGPRILLWGASFLLMMFLGTALFPGATPLFFVGVVSSPPRGWVAKLPPSFSRGRFFFWGSPGPPAPLVAAGVYTSTHFVPFAAIMWGAFSLPPYGVSSSRGGSHSPTGGFIIVGAILVLLREIFLPPLIGVPPIFSRGDTPPWGGYTP

SEQ ID NO: 1010506 - protein, 275 aa, Homo sapiens
MAISSQPGNFRSLGASACIKDVFILRSLKWSSSYQTLVIEVICRPRKDVTFAGHLRSDSLIYKEPRNGPITRRFLTTCLDRVSYAPSVTTSGAGRLCAWRIDVPCQQSLVDRCPTHFFTTVSVAPPSQRNVPTPVASLQLSLLTLTYLARFYQEPRFPVPKATLHNTASCWNLFASQGHGHISSRTSLAAPWGRISVNCGIRVLGQATWIGVVVCKAELKSVPGALNTMQVLLSSCPEHRSREPAGGSRGQQGARQDRAPCCSCPFLPAPPPSLG

SEQ ID NO: 1010507 - protein, 111 aa, Homo sapiens
PGAPGKGDGGGPPRKNGGAPPQKGPPGFFGGGPRKKTPGPHFSPPLFPHFFYGQGPPPRVFFSPGKGFPPPPGERKNPKRGAPPNPGGKGAPGAPAKFWGGIKKMGAGLNP

SEQ ID NO: 1010508 - protein, 266 aa, Homo sapiens
EKIIWWGAPSSPCGGNFSREGFGAATEGVYWGRPREEGSPPSPGLVHTDFVVPPGVPCVPRALAIGSTRGVSSLKKSPFFPRHIFRESVFSLPLFRGTPPLWRALLVKCLLGPIYLFVLYYPLLGVHTPRRGHCVTRAPGVFGFLALGRALSPLPVVGLPSHCHGVWRAELYDHFYKGVLYSAKIPRPNVSSPISRTHVVFSKGCPRGTCPPVDDPSRELLLIPCESPLFFIAATTTEGTVCAHCCPPPHSFHAGAGSNSRGVAVL

SEQ ID NO: 1010509 - protein, 344 aa, Homo sapiens
FQENVESKHRGVPGHQEFSGSLQECGLIWVYIPQVTKPPLGSKVPPTQLATVGQYTRGVIGRAFHRETPGVFPPGVEPPGAPKVGDTSAWTHTWPLLRAPPGRLPPRGILSRDVASPREVLSVGDTRLLREAFRGFNPQSAPRQPPLWWHTPRSWVPLSGVFPHEGFDPAVGCLGVAARASPERVFPRRVLPKTSFPLDPSGPESPPGAAPVLLLVGHPIALRGFQTRFPRVASYGRSQNGCFPPAHFGRLPPGRLLCPKVGEQEAGAPLGVVSRPTTPAVWTPGPGGEYTRPPGNNRGYTYEALGPGANPDSDTQPLPGCIIPPPGSPPQPFFPRFFKKRTPL

SEQ ID NO: 1010510 - protein, 80 aa, Homo sapiens
GFGTRGFPSSSRKSNLTNFPSKSGTANFRKKACSKNKGSFPPGGKKPAKKGSTLPKEVENSAKAQKNPARFFPGIGGKKN

SEQ ID NO: 1010511 - protein, 101 aa, Homo sapiens
MFCQRGYLSWPSVERTFVGAPLCVDVVCPQETPVLVFPLLGDFSPGVRNHRVGGMLCPTHTSPRRGLLTCRSLEDRLLIVATPILLQRAVKWWSTQPGGVL

SEQ ID NO: 1010512 - protein, 31 aa, Homo sapiens
PPPKGTKKGAPPRGGPPKKKGTPRAAGNRPE

SEQ ID NO: 1010513 - protein, 300 aa, Homo sapiens
MSCLVYISKMLFLLHPGCFYVDDPTPLVFLWILSWWGALTYSPECDASPADYFAAPLSCVGTLIWVETLVPIYMWRPPTSRWGTHTLPVRALFGGLFPGGLPPPSYYIAGGPDLSRGVLVHFRARGLFVSIQSVLHVPFLGGLVVGYAKRFFSLAAGLSPHTHLFVCPAGRENCIRYAVVTPHQHLLLRAVYHADPTTRGRRIFPSCKGLSRFYHQGGPPVSHHRVPLLGVLRGPPRCGVSYRAVGDVSALQPGCCHFPLSPYELGSTEKGPPGAPPPDFLIFFSWGTPPLSLFLRVQIC

SEQ ID NO: 1010514 - protein, 150 aa, Homo sapiens
MKCAPPLPQLLSKPTRGVCGAPHHKKRARFVVCVYPLLCGCCGQTHQACSRSGYTLLPAARTLRGWRSPTYVGEISTPPHTRGIHHPRALVTRDTRGLNNTCGLLWGQNFSTAVGAHHNPFTVPAPPLPMGKDVTMAFPVRPPPLPTRLL

SEQ ID NO: 1010515 - protein, 231 aa, Homo sapiens
SLDWGVVGSPRPTVRPPARMLFWLWCSGGWWGGRGNRRRWWCALAQHRLVARVSVVGVVVGSWVDGAIRTVYGVCWRRRVAAWRARSTGTRAVGCSLSRSVGVPRPLTHSARAGVVASLSHRVFSESGERRCGDEDECLLAPCVFLGGRRFCSRHYRVYGSRYFVRVCVDLGGRAAGPRLAFVVTPRGEGAPSSSFCVVSSRLYRRETRSHRARARERESPVRCRLPLRAK

SEQ ID NO: 1010516 - protein, 221 aa, Homo sapiens
VSVLLFGSVLAWFLSVLFIIRFCAQVLDPLGFCALGVVIRCWSLCCLVPSCPFLSALEFRAFSVPLPVSDLPASLLGLPRCPSLELPRRGWALSAWYSLLPVHPSQVTLSTLLRIHALDLLYYFTFKSPTRGKTGTKIQRRSKSIGRSTFQKGVHSRRKLSPGSTDLQTTSRAFRSNAERRLPTRTSPRNRAHPSHIAPSFSQKGLQLHLPGGPPSWCWPC

SEQ ID NO: 1010517 - protein, 112 aa, Homo sapiens
MARLVLLQGLAQVGESPVQFSVVRDSCSPWTLSFPCPVSPTADLLELEAPTFGFSTGRGKLQNARISQPSPRPAGFAKGAPARSGGSGPASSRVAAPARLHVDSRWGGGGHA

SEQ ID NO: 1010518 - protein, 34 aa, Homo sapiens
KITPPKRDKKGGPPPGGAGLKKGGPPGGRNSARG

SEQ ID NO: 1010519 - protein, 191 aa, Homo sapiens
RCYCIEIPMRLVNIPCLSLPRSRASTGSFLGDSGFSGLPGYIAVNQGFPCQDLIRCACCSWDSKYTATIPNPLALNSQPYAVLQRPLWPSMVACKGQLDWEESPLLLTACSQFSDGSNLLYTAATRSRCLVNLPTPDFSMPYNVIIALRALVVGRARYGSFYNLLTRTCPHRGALHRMAEAKRLANLIRRA

SEQ ID NO: 1010520 - protein, 196 aa, Homo sapiens
GTASRQPDRREPTPPARHSPEWTSSSRENRAPQVSSGATGESLKRRQVNTGTKPAAAAASLKISRLAARLKDKRKVRRTSLACPEGRDRSSDGGQAFHVCGHLQRWNKCRYAHQNRPLRSVSSGDIALPPSQLTPRKPHKLRERLPEDVYMALAASGRGSSAFASQDFENDLHNGMCMILSFPGKVKCQIGLLNIS

SEQ ID NO: 1010521 - protein, 273 aa, Homo sapiens
CLDVLCSLNDVLPSMFMLSPAFTGSCSAHELALLVGLNIPYGYRLVILSYHRPLGFPYDLHPPILAVCPFQGLQVQGPSTLVTMYDYFTCCYSHRGAVLVDSCSEFSVGRFPMVSTDLSHRSTLVSKRVLRSNWKQAHCSTEKKEINKRKQLILEGKDPDLEAKRKAELSKIKQKNRRFIRTKRGWRRMKRQKAGRAGHKGASTQDTVWVPLRPSPLPGPWIMSPTRPYCPVLDSSMETEGRRNAYLWRADSPLPRGPTTDASQQNHVGAQCM

SEQ ID NO: 1010522 - protein, 107 aa, Homo sapiens
MKKQRIIILCYNYTDVLKDPLCKRFKVHHAVRQAIEQNLDSIDIALSLRRFQIINLNSMHSVCEEECVKSHCIIELASSERIWIGCLFVIKLSSSTSIHKLLYIKFI

SEQ ID NO: 1010523 - protein, 112 aa, Homo sapiens
LYRTPKSAIVYFTQGLSPTSRSRKLNASYRFAPLSHSPRQPYLVHILVFYAFIEPQYILAPNLADYSLPRQSTFPSTTTRSSSLLISLDIDLGYIGDGKGVIGGYIRDHLKS

SEQ ID NO: 1010524 - protein, 194 aa, Homo sapiens
SSGFSGCLLAFFVFFSVLPCVVVQCFPRVAMPFLRALVVLRFTVALFTYHRELWFFSLIFYAAGLYVRRSLACPDDLSSSCYIWLMLPAVGLLPIDVASGGALVICIFLSFFSSLILSIYLGDLSFTISFFPHISCCSKYGAINPKLHFSLVFAIVYWSHFTLTYSFVYLALFPHIASFSSKGSLVHGCYPSKT

SEQ ID NO: 1010525 - protein, 164 aa, Homo sapiens
SLLSFSPLSSSPLSVPSPLFLPSLFLFSLFSLPSRSVFSSLLSLCSPLSRPSLFSPPISSPCFALSPPAADTLSVSQSRSAGPRLCLFFSLVFLASSLGLFFLSHLLPSCLLFAYLLILFPFLPLPLCCLSVPLFGRPLSFSFRPHLLALHTTLSPAFDSSLCL

SEQ ID NO: 1010526 - protein, 166 aa, Homo sapiens
MPKGSPPPRPSPLDNHQPIGVLAATEERNCCVAAAWYIDIPGKDLRLEVDPTKPKGYHANFVPRATAPTIWSLDREYSKVLALYKPSRTPGASGGRLMRAVRSEATGGRCPSCTTWASKHKVEQLSNMIGASCKMQHEVPPATPSPAGPAPHPAPPRCLDNAGVLR

SEQ ID NO: 1010527 - protein, 51 aa, Homo sapiens
MEHRYNVFNDTPRGNHWMGSSVSGSPRPSYSSRPNVNPPRRFQYSDDEPAE

SEQ ID NO: 1010528 - protein, 117 aa, Homo sapiens
MEVYLSTKSVFNGPFISMLLMHFFAHLNELHGVIVYIVASTIEARGYTSSVRSRDVKQSPFRDEASGEISGSQGVSSPICCTFPRARISKTSIFGQADMDSWVQARSYYTYTVKPLI

SEQ ID NO: 1010529 - protein, 316 aa, Homo sapiens
EPAPEPRSGGQAIQPRRKGGRRPLSHAGADKGAPSQRSSRDNNPVELSTRALTLQRNEKDVPAAKVKGETRREKTREARHRERPRRRSVRRRAGSEEQTLMMSWPETLEALVSKAEEEFFDIIFTELKKKGRQTPQSGRQGLPSPVPAERRRKDIACRGAPPSGPTDKTPIRYERAKEQRWKEKKQRQQPSPEEDQVVEEGEEAAGEEGEEEVEEDLARSQHSMRRYPCVPSFPTCLTVNQTCMAMAGPREDLQELGKGFSSMIDPPRPPTNQDRKSLHYENTFPGSFLTIGHTANDRSLQVCGRDGGRVGLGLHM

SEQ ID NO: 1010530 - protein, 92 aa, Homo sapiens
REHWPQVQPYVELDCNAFFEDIMDRLRRTPTLNIQQLMELVDAVTVHEKPSSWCRSLLLRSLCLDGGTPCGVCALGACDLDWCPYRHEKIDA

SEQ ID NO: 1010531 - protein, 307 aa, Homo sapiens
MPPFEVGLDFGPFCLQTPCPLCAPVGMCKPMFRPVLVDPSCRYGSCSVKPGTPPMNCETGFLVNRSVICRDHGSSLGAHACVSTPWMLGSVMGDGLVYSIEWAHSDVLLPDGYPGSQTNVTDRPFDGRRDRSYLVLRAVNLTIRPEPIHVASPYQRLVSMDGHASTSDSGPLRGPSYTPSTALLHPPHRHRTSGLQTPYKHTGRLDYSSHVTPLTQDRGLACTDNLLQLPASGSKAIGLVLEPGLGWAHRRFTEPCRAAVHPAEDSSLLGAQAMGQKLLTIPGVTGVKGLCWGPSTRHIGTRAHTLP

SEQ ID NO: 1010532 - protein, 109 aa, Homo sapiens
MVPRPIDPEARSLCIPRFNSGRARSRSSTSSEHVVLLHRAPLACILCCVHSIVCCCHRSPVLCQAFSPSPVSSQSQAGSLHPYGLGQAHGSDDTRPIVEWMSGILGSDL

SEQ ID NO: 1010533 - protein, 135 aa, Homo sapiens
GIRHEAKEKLPRYYKTIGLGFKPPKEVIEGPSIAKKSPFTGNVPIRGRILSGVVPKMKMQRPIVIRRDYLHYIRKYTRLEKRHKNMSVPPPPCFRDVQIGDIVTVGECRPLSKTVRFNVLKVTKAAGPKKQFQKF

SEQ ID NO: 1010534 - protein, 135 aa, Homo sapiens
KGGVPPGGGRFKIRGSPGVREFGPGSAFFQGGSCEEGPFPKREGAKIPASPIMKWPRFCFFFFSGVGKFGPGFLWGGLRTGGGGKNGEKNSVFLPVFLKGPRWGVKFVWPNRGKRPCLFSPLLQSPGQGDSPVVF

SEQ ID NO: 1010535 - protein, 74 aa, Homo sapiens
ARGELNGKTFEAVFPQGFGKLASVPVGGGVPVFVAPGFPPPVVGFAPAPPEEKKNEKKGGFKKSNNAMGLALFD

SEQ ID NO: 1010536 - protein, 106 aa, Homo sapiens
APPFRSPVPFLRGNDPFQFFLGPAKIFVFFNFPLGTLFLVLGGVTLEKFGVFPPKKGPPGFFSGVPVKNPKGNIFPPRFSTFFFFGRGPNPCFFFPQEKGFPPPLF

SEQ ID NO: 1010537 - protein, 233 aa, Homo sapiens
ALNKLINDELQKNLISNLHTILKPFLLRRLKKVVLANILPPKREYIINCPMTSAQEKFYKAGLNGKLKKTMFKELIKDFFTLNDEYIGHVSNRSIRDFINYKLSGNETSNTDNKINPTLLQMDKLYKKNLQMEISNKKLQNMMMQLRQIIDSTFLFYFPYLHPEDLTLETLLKTSGKLQILQKLIPPLISEGHKVLIYSQFVNMLDLIEDWCDLNSFATFRIDGSVNNETRKD

SEQ ID NO: 1010538 - protein, 120 aa, Homo sapiens
MIAVVPRHQKAKNCDFDHIYCLSLFIFFCTDKCFPLIYEGLDCFMLEFKPSNFFLFPLVFYRPAKFMMGSKTPIVTNRRGSKVVNSWKFTRKKDTENLEEEAMPSMSTSHNGIARHTIGY

SEQ ID NO: 1010539 - protein, 38 aa, Homo sapiens
HENVIFLEVDVDDCQDVASECEVKCMPTFQFFKKGQKV

SEQ ID NO: 1010540 - protein, 66 aa, Homo sapiens
TSTDDVFSKSNDWSSSSSSPVNCSVSDPLSRYLNGLVYAIEGTYKTKYVPLSTEKTPDNPLTRNNT

SEQ ID NO: 1010541 - protein, 103 aa, Homo sapiens
GVFQNLARGKTGFGVFPKKPQGGGKGPGVPPGVGKGGVPPLVFGKKTPPGGPPPLVVSLGSPWGRPALGGVSLSPGTLKRVWLEKKLGKKGGFLNRFGVRSKY

SEQ ID NO: 1010542 - protein, 216 aa, Homo sapiens
FPTQTFPNHWSMVTGKYPIEHGIVSNIFWDNFSSSEFRPNNLDARIWSNTADPIWQLLQTESQGEYKVATHMWPGSEVVYEDHGDVPRERMPFYFAKFNQWEKLQDKLAQIFRYIDMPQLKDRPELVISYIPNVDSYGHSFGYDLRDKRLQKLIGEVDGFFHDLIEGLQKRNLLKISNVMIVSDHGMSNVNTNDGEHVVVWERVFPADAMTAFISH

SEQ ID NO: 1010543 - protein, 127 aa, Homo sapiens
PPGPPGLGPGWWGAPPGGGMEVSPPPRGAPGNPGAPPGPGLPAPGGGPPGGSPPFRAFLVPGGPGGRGVFVPRGGFLFFFFFFFFFLVFFFFPFFVLFFFFFLFLSFPRVFQGWGGPGFGEVLGRAP

SEQ ID NO: 1010544 - protein, 104 aa, Homo sapiens
KVARDDVDCTTSRNWFDNDVGTAILKIYLTVVEEPDSALRCKPETEPPLRIAFEKEKAPELEEGENVTWPFVDSDRLKEISPLLSKEPGVKEYADGKKQQALQR

SEQ ID NO: 1010545 - protein, 160 aa, Homo sapiens
GGLLVTSFFLGFSPILGKTGFPPFREVKPLPPPQPPRPPSYLGRKGKRAPFANPLFPGGGGFFKKRGPPGFPLGKGAGGAPQLMWGRSLLRPPRVFPFCFRVVFWGEFLGGYHFPQGKGLALISPRLKITPLKGEKKWGSPPGGGGFKKMGPPGGRNLGR

SEQ ID NO: 1010546 - protein, 230 aa, Homo sapiens
GVSVAVAAFEVTSDGCASVTGERPIREISHTLRTRLNYALVKLQNGWTDKTLPELETELAPAVQTPPRRYHNIFPDSADAGTSAHTAFLQALGGHPPREEATAVETLMLLSSPTKKQQHRPVPATSAGEPTDETEPESDTEVETFNVEYEFFLRNLGVNAAAPAAAPFSIYIKCVMCVLKKLTSAYSAYLCVSADQHPRLKWNRTGSRKKRKLVALAGRAHRSRRCVRQI

SEQ ID NO: 1010547 - protein, 231 aa, Homo sapiens
LTAHFENTMNLYEQALTEVLLGKTELFKFYDTLKGLYILLYWFTSEYSTFGNSIAFLDSSLGFAKFDFNFQRLIRIVLYVFDSCELASLEYAEIQLKYISLVVDYVCNRTISTALDAPALVCCEQLKFVLTTMHHFLDNKYGLLDNDPTMAKGILRLYSLCISNDFSKCFVDHFPIDQWADFSQSEHFPFTQLTNKALSIVYFDLKRRSLPVEALKYDNKFNIWVYRSEPD

SEQ ID NO: 1010548 - protein, 68 aa, Homo sapiens
KIRWVFVFLHEFLVRHFVIRNQQVLNVFIVTIFEVNEIRLVERIEDKSFDHLLSLDQLDRVMKSTQYS

SEQ ID NO: 1010549 - protein, 217 aa, Homo sapiens
KEFFKPYFDLRAAYPNRCTTFPFKISMKHMDFSYQLVKVAKSLDKLPHLSDGLIFTPVKAPYTAGGKDSLLLKWKPEQENTVDFKLILDIPMVEDPSLPKDDRNRWYYNYDVKPVFSLYVWQGGADVNSRLKHFDQPFDRKEFEILERTYRKFAELSVSDEEWQNLKNLEQPLNGRIVECAKNQETGAWEMLRFRDDKLNGNHTSVVQKVLESINDS

SEQ ID NO: 1010550 - protein, 218 aa, Homo sapiens
KAKNDAERNKINNKFANQIAMSVKLGNGITDPSMNIRLATSIELANKNNVSKKVIENAIRKASGSSASGKDSNASELCVYEGRGPGGVAIVVEALTDNKNRTIGLIRSAFNKANGSMTPTLFFFDKKGYVTMVPPKMLDTEDKVLESVLEIQGIEDIAPVQEDAEDLECDTETETTGQTYEAVMEPADTNKVAALLKERGFHIRDLGIGYNEKPDRKF

SEQ ID NO: 1010551 - protein, 230 aa, Homo sapiens
ELDGTIHSSTFSSEWLRTKLVSLIPLGCGQIQLARSSLVNGDSCCDLLDLGGTIVSLNLFKNRRFFHEFFQFCMHITMYHMPFTVHLRQFGFQLRPGLSKEASNFCLISATYASIMGFLSWSNSLENAVFLNVYIVIYLVQPIALSTVPGRIQLGPGIQKRLHTARILPLPVRSFTNPLTESSHYLVLLPKHRYYRFWNDNGGLRRYYSSSPNGRFYRYRYYCYLSPFFE

SEQ ID NO: 1010552 - protein, 56 aa, Homo sapiens
ASPFPISAGLSGSPFPPPPGFPGLHVILGPPFLPLCFPPPLVFPFPPPPPSASPPP

SEQ ID NO: 1010553 - protein, 72 aa, Homo sapiens
ARARYVFCIYGSISDYKLLLKKHIDIEDKIHIVRSVFILPGLTVKSAELYGASRVIIYTDPFDDGKVPEENG

SEQ ID NO: 1010554 - protein, 138 aa, Homo sapiens
TSLHNVFNFLVVDSPKGSTAEQYNEACLLKGDIGDLLYHYKDLYKLSAKELSKCLELSPDEVACLTKRHKDYVEHIADSRLAKGYVQRVRYATVGGGKFSLMAFLIIKTLRNMGTTLPVEALIPSGDEGETEFCDKIL

SEQ ID NO: 1010555 - protein, 54 aa, Homo sapiens
CLHWDSHEFPVPVYCDSARTWTYKTKTLWEAGAGGSRGPEIETIPAKTAKPRFY

SEQ ID NO: 1010556 - protein, 191 aa, Homo sapiens
HEVTMGVITGDILVNGIPRDKSFPRSIGYCQQQDLHLKTATVRESLRFSAYLRQPAEVSIEEKNRYVEEVIKILEMEKYADAVVGVAGEGLNVEQRKRLTIGVELTAKPKLLVFLDEPTSGLDSQTAWSICQLMKKLANHGQAILCTIHQPSAILMQEFDRLLFMQRGGKTVYFGDLGEGCKTMIDYFESH

SEQ ID NO: 1010557 - protein, 47 aa, Homo sapiens
GKSVYFVNTNSRLSIVPGDPQGPPRPFRSLTQGLVTRKKPIKPFENL

SEQ ID NO: 1010558 - protein, 122 aa, Homo sapiens
GEGAPIPNPLFPGGGRFLKTRGPPGFPAGKGAGGPPPIKGGGPPHGAPRVFPFMFPVGIWGGIGGGNHFPPGTSFAHVSPRLKFPPPKRDQKGGPPPGGAPFKKRGPPGARDLGPEKKKGEC

SEQ ID NO: 1010559 - protein, 83 aa, Homo sapiens
MKEKKLTPITYPQGRARDKERGAEKERESAALTQRGRKKGETKRPEQPSARLPRKRGRENACGCKCLSPSCVALSLGTFGRSA

SEQ ID NO: 1010560 - protein, 77 aa, Homo sapiens
SMHFLVAEWNEPSLHFYKKKGAFDLSSEKGWRLFKIAKEYLLKMAPKEEECCCKSHPPFYFRINSPLFLLFMLFVVK

SEQ ID NO: 1010561 - protein, 138 aa, Homo sapiens
GGPPQGPPGVFPFSSRPGRGGGRGGGNNFPRGEGWPRIPPARKNPPPKGDKKGGPPRGGALLKKGGPPGAGNWAQKNFLGAPPGFFPPPPGGGPQKTPIWGGGFPPPKKKGGGNKLWEGGGGGGFFFSPPPPPKKIPF

SEQ ID NO: 1010562 - protein, 111 aa, Homo sapiens
GHEVHVPSLEGIAPENQLVFLAGGPLEDEAILGQWGVEALIPLKVPARMFGGKVHGSLARVGKVKGQILKVANQEKKKKKPGGVKRGMQYNRGFVNVVPPFGKKKGPKANF

SEQ ID NO: 1010563 - protein, 142 aa, Homo sapiens
MSNSNSKKPVANYAYRQQQDYNGMNAMVGNPMMYHPVDFVNGAGQYGPSQHPAYYTNSPLPNIPPTPFDTAYGASLLPSHLLMGSPFVSSPNMQSGYNSARSSNLKRKAYSRPVSNHNGYNGNSNSNQNNTNNGMSNTLELL

SEQ ID NO: 1010564 - protein, 39 aa, Homo sapiens
MLSYGNQPYYKSQIGNIFLLNGKVIGGKYDKGFVNMHFN

SEQ ID NO: 1010565 - protein, 197 aa, Homo sapiens
HEDDMILFSKDLNANKKIITTLKKQYDTKIINLGEGDNEIQYDILGLEIKYQRSKYMKLGMEKSLTEKLPKLNVPLNPKGKKLRAPGQPGHYIDQDELEIDEDEYKEKVHEMQKLIGLASYVGYKFRFDLLYYINTLAQHILFPSRQVLDMTYELIQFMWDTRDKQLIWHKNKPTKPDNKLVAISDASYGNQPYYKS

SEQ ID NO: 1010566 - protein, 142 aa, Homo sapiens
MANDNLHWADLRATIISTVRINKLWRCAVVALIAPAELASTSSPLSPLKLAYYHQLMIDRLIRRRKKAGIRNPASTFLAHPKIYPRRHPRSTRKTEVITLNYMPLRKISYEDTVNNPCEKVFPKIIPGQKRFWYISDWETRL

SEQ ID NO: 1010567 - protein, 131 aa, Homo sapiens
LAQGKPPPVPCKVTGPFGFVLVSLIPAPRGTGIVSAPVPKKMVIKGGIEEWYPSGRGCTAPLGKFAKAPFYAIFKTYRYLTPDLWKETVFPKFPYQEFTDPLVKTPPKVSVQRNQGPTVGSTKGFYTKKIK

SEQ ID NO: 1010568 - protein, 89 aa, Homo sapiens
ARGEEDGDEHEEADSATDTRAAEDDEDDYVHTKKHKTGQDDYTAKKEKSKLKKKRPADLFTLHFPYKNLNAVTFKKEARPPTVGSATRI

SEQ ID NO: 1010569 - protein, 101 aa, Homo sapiens
HERHEKVSKKYGIMQNRQRIIGFPEGEEKTKNLENLFEGIIEENFPVLAKNLDIQIKEAQRSPGRLITKRTSPKNIVIRLSKVNVKEIILRTARQKHQVTY

SEQ ID NO: 1010570 - protein, 224 aa, Homo sapiens
GQEIPQHKPVEVKRGSTLSIGKLTSGCRAYLGIRGGIDVPKYLGSYSTFTLGNVGGYNGRVLKLGDVLFLPSNEENKSVECLPQNIPQSLIPQISETKEWRIGVTCGPHGSPDFFKPESIEEFFSEKWKVHYNSNRFGVRLIGPKPKWARSNGGEGGMHPSNTHDYVYSLGAINFTGDEPVIITCDGPSLGGFVCQAVVPEAELGRWTGYTRDSIQFGHFLTKA

SEQ ID NO: 1010571 - protein, 163 aa, Homo sapiens
TRLDLVEWMIRIAANDAPDFDSTKVEVNGVSMEARLYAENPLKNFRPSPGLLVDVKFPDWARVDTWVKKGTNISPEYDPTLAKIIVHGKDRDDAISKLNQALEETKVYGCITNIDYLKPIITSDFFAKAKVSTNILNSYQYEPTAIEITLPGAHTSIQDYPGR

SEQ ID NO: 1010572 - protein, 104 aa, Homo sapiens
NPQPSKGPFSPKIEIRQGDTCVSIIRRLMKMNRGIKALSKVKLMRFDDPLLGPRRVPVLGKESPEKPPIFEHAVFNVALMSKKILLIENGIRVDIGNPKIYWVH

SEQ ID NO: 1010573 - protein, 39 aa, Homo sapiens
ARAEFRFTDYSTKENVLSVLRNLRYMSGGTATGDAISFT

SEQ ID NO: 1010574 - protein, 161 aa, Homo sapiens
GFPPGKGAVRPTQLMWVGSLLRPPRLFPLWFRVVFWGEMLGDNHFPQGTALALISPSLKLTPPKRNKKWGSPPGGAALKKRGPPGGRNLARGFLPWPLETGGWSPPPPGWAKRGRMLILPLGSKKTWGLAVNPGEGVPGETPRCPIPSQVPPKKNKRVLLG

SEQ ID NO: 1010575 - protein, 221 aa, Homo sapiens
STGLREPNRNDPQIKISLGDKYHSTLKFYDPDQPNNDPIEEKYRRLERASKNANLDKQVKPDIKKRDYLNKIINYPPGTKLTAHEKGSIWKYRYYLMNNKKALTKLLQSTNLREESERVEVLELMDSWAEIDIDDALELLGSTFKNLSVRSYAVNRLKKASDKELELYLLQLVEAVCFENLSTFSDKSNSEFTIVDAVSSQKLSGDSMLLSTSHANQKLLK

SEQ ID NO: 1010576 - protein, 152 aa, Homo sapiens
KGAGGPPPIKGGWPPLWAPRVFPFFFPVFFLGGIVGGNHFPPGTSFALFSPKFEFTPPKREKKGGPPPGGAPFKKRGPPGPRNLGPKKISLSFKKGGPLKNGILKKFFLEKTTFFFPPHFGPFGKILERFFSKILGGSQIGKNFKKKKSFPP

SEQ ID NO: 1010577 - protein, 126 aa, Homo sapiens
SAREKLSPLPEKDGVSSELVKHAASRGKKTITGPLSSDFLSYPDEAIDADEDVTVQVPDTPLERTSNGEGKNHNMKYIMTTSINVSTPVVVNPRKYGGGFYNELLKRRDAVYGTDKPIALEIGDCA

SEQ ID NO: 1010578 - protein, 160 aa, Homo sapiens
MNGIFAIEKPSGITSNQFMLKLQHALTKSQVFSKEIQRATAERKQQYEKQTGKKASKRKLRKVSKVKMGHGGTLDPLASGVLVIGIGAGTKKLANYLSGTVKVYESEALFGVSTTSGDVEGEILSQNSVKHLNFDDLKTVEEKFVGQLKQTPPIYAALKM

SEQ ID NO: 1010579 - protein, 223 aa, Homo sapiens
QTWGFWSNLAYWGAVSFTAGTWMSGSAALSVGLSYPETIVSFLLGNVLIIIFTMANSYPGYDWKIGFTLAQRFVFGIYGSAFGIIIRILMSIVNYGSNAWLGGLSINMILDSWSHHYLHLPNTLSPSVAMTTKQLVGFIIFHVLTALCYFMKPYHMNYLLIWSCVATCFAMLGIVIYLTKNAHGVGELFTSTKSTATGSKRAWAWVYMISYWFGSVSPGSTNQ

SEQ ID NO: 1010580 - protein, 200 aa, Homo sapiens
TSSPSRFPSKSERLKRYVRKGIPAEWRGNAWWHFARGQEKLNKNKGVYSQLLRKMKQIKKQNPNEKQVQDLDIIERDLNRTFPDNIHFQSSLHNKEGPPIIKSLRRVLVAFSLYNPKIGYCQSMNFLAGLLLLFLDEERAFWMLVIITSRYLPGVHNINLEGVNIDQGVLMLCVKEYIPEVWSYIKPSIDHHQKNNKTFS

SEQ ID NO: 1010581 - protein, 139 aa, Homo sapiens
LESLHNNEIKSAVGNIIAIQLFENRYHQHVQWYPRVICSENFNVLPNQPNVVTTTPPKSAPKDTPVSAKCFIVEQPYQHRQECRPMRHFRWGNSQRKLIIASAFLDLIHICSSTVMMPAKLQLDVLRTLQSSARQERKR

SEQ ID NO: 1010582 - protein, 100 aa, Homo sapiens
HSRRKRCYNHRNFAYLLRGQRRDLVQTMNKGLFISRIQPCRRKPLYEMLISYNTLFNVIVKFDMPLSWLAHYISPFACLKPASPKKVLQSLIIVHFLVFL

SEQ ID NO: 1010583 - protein, 174 aa, Homo sapiens
TSSVIMLSFTRIAIVRNTVIIIVIFRESVSSSDGGHRHRLMIIVHTNTRIFLILVVVVIHDYVRLRKVIITVIAVVSVIIVFVIFVVLLIMRCLPEIPIHNCVMLFIGVGMIHIEDDSFALNAANIFRIIIIILASITVIIVININITTTFHNILLFRVFVFQILRMQLRIMVL

SEQ ID NO: 1010584 - protein, 101 aa, Homo sapiens
PEQDWRKYYKVGPLDFGGTQKQKQLFIGGEACLWGENVDATNLPPRLRPRARAVGERLWSSQEVRDMDDAYDRLTRPPCRMVERGKAAPPLYAGYWNPENM

SEQ ID NO: 1010585 - protein, 50 aa, Homo sapiens
KQWNQAVLVVLVDEMKYWQYEITSKVQRLDGIVNELSISEKDDTDPSKLG

SEQ ID NO: 1010586 - protein, 40 aa, Homo sapiens
PRAAGIRHEIVVCVLFKNFEVVSILYASSSIICVNSSSIS

SEQ ID NO: 1010587 - protein, 32 aa, Homo sapiens
ARGLGDRSRLECSGTIPAHCAPAWVTDPDFIS

SEQ ID NO: 1010588 - protein, 47 aa, Homo sapiens
MVQNNESVFFVGCDSYKESPSTSPIRLDDLDGNDDVSDQGLAFDGDV

SEQ ID NO: 1010589 - protein, 84 aa, Homo sapiens
GHEGGQRVKSMKFVDGLMIHRGALVNYYVDTVVRQVLFRQGVLGIKVKIMLPWDPIGKIGLKKPLLDQVSIVEPKNEILPPPPI

SEQ ID NO: 1010590 - protein, 206 aa, Homo sapiens
ELRAQKDGYIDRLLQYDQLTQEINKGVVFQGFKEPTLQFRPTYKYDYGTDNYDTSEKARTPSWTDRIIYKGENLHPLAYSDAPLKISDHKPVYAAYRANVKFVDEKEKLNLVEKLYAEYKNTHPEALTTGPDELSHARMEKQKESIPLDATVQSAGIKLIDLDDTSSCVSPLLSGPSPQPSVVGPGGLSNVSPDKSKLNVLPPPPP

SEQ ID NO: 1010591 - protein, 184 aa, Homo sapiens
ARAKTVANAVEVSKESQKELTRSVERKESPEIRDYERAYDPKALKTDVTKLTVDNDNKSYEEPLEKVEGCIFPLPKAETRLWELKNQKRNKIISKQKYLLKQAIRNFSEYPFYAQNKLIHQQATGLILTKIISKIKKEEHLKKINLKHDYFDLQKKYEKECEILTKLSENLRKEEIENKRKEHE

SEQ ID NO: 1010592 - protein, 207 aa, Homo sapiens
HESTLGFLSASLICIVVFLLFYPHVTWCSWVLIPGAALSLLVIPLIFSAYSRSSGSRDDDETEELEEKGMLLNDPYLSSKSGRFDIDADSEANLRGDSRTNLLGDNFKNGTNITVVPDIISHNQDPKLSNITTSTTSDISTFDKEAKDMENSNGSGLNEEEDDGMAYDKRRSTSTYSVIESESGLKNGSVSNNYVRNNGSNTSNNIN

SEQ ID NO: 1010593 - protein, 99 aa, Homo sapiens
ARAPVHFNTTDFEKDLLIPAVNGTKSILEAIKNYAADTVEKVVITSSVAALASPGDMKDTSFVVNEESWNKDTWESCQANVVSAYCGSKKFAEKTAWDF

SEQ ID NO: 1010594 - protein, 113 aa, Homo sapiens
MISIVLELFQNLCCCRGFSDATIRVNDKRYRIQRLLGEGGMSFVYLVRLSKNSLIIDNGIATPELYALKKIICPSVESISNGMREIENYKRFQSPYVIKSIDSQVMQEKDGSK

SEQ ID NO: 1010595 - protein, 186 aa, Homo sapiens
HEVFTDLKNAPPYVPQRSKQPDGMTIKLLPFQLEGLHWLISQEESIYAGGVLADEMGMGKTIQTIALLMNDLTKSPSLVVAPTVALMQWKNEIEQHTKGQLKIYIYHGASRTTDIKDLQGYNVVLTTYAVLESVFRKQNYGFRRKNGLFKQPSVLHNIDFYRVILDEAHNIKDRQSNTARAVNNLK

SEQ ID NO: 1010596 - protein, 296 aa, Homo sapiens
MGICTSTGVIRDFAGPYFVSQDNMAFGKPAKYWYSWTLPQVYAIGPNACDTAVHDASEEYKLRNANLCCDNCHSPRGHWTLTSDAATIKQHTGHMRARSACLLRCTLRVKYAQRSGTYRVMTWHAPSSIVLEHFILHSSGRALFKPSQVTRLDSEGDPISLIHRDPQMEYHARPIAIMWVSHELILYRPYSTQYKRKGLGAIAELLRTERDQAGLVMDVDMDLTEPCIERGRYCPLSSVPLQGSSRWSPSLLQGTVYLRRLAKTHFASCCVKRPWCFPCVAAHAGTHLAGGPALSP

SEQ ID NO: 1010597 - protein, 149 aa, Homo sapiens
AELTVEVRGSNGAFYKGFYQMMYMKDSLTVVSVRISWQPERQVPFNEVRLPALYLIYRKGNLVKDDEVEVYSRANDHRAMWVVAWLNVRSDEEENVMSLEYAACDSYLQMTIVQQFEAYLRSCSNAKYRQACHKELIPSLNAQWMFLRI

SEQ ID NO: 1010598 - protein, 79 aa, Homo sapiens
LYLSIWLAEQLAGSLSLSETQVQVWFQNRRTKYKRQKLEEEGPEYRAEERRATHTHQPVGAYSHEAGQWGRTSMYTSND

SEQ ID NO: 1010599 - protein, 176 aa, Homo sapiens
HYVVCAERKQLVGSLSLSMTQVKVWFQNRRTKYKRQKLEEEGPESEQKKKGSHHIYRWRIATKQANGEDIDVTSNDYAVGNHKPTRDRVLLDCWPGPCVGTKLDSGHSHGQASGEAMEVNGPHRGIEARGHANLKRGDKRMGWLRPGTTLAVLPRRAMLCLGRARPPQQHHQLHLT

SEQ ID NO: 1010600 - protein, 73 aa, Homo sapiens
MNGCMRLCSSVVCTFLHACCLTLAMCACPAQLTAEPWNSYSFAPEGFHPNQCQGPPLFPFQIIDVYGTIGLFL

SEQ ID NO: 1010601 - protein, 134 aa, Homo sapiens
MDMVSLGETVHISVLDSVETIHDTTKDALLHGATEQEAAGKLKNRTRVSFYEYLYYHTGTATLYLARRQGRKAGQTFENLPHNDTKTNHNLYLATTKTVHTLLSQVHVYTHNSIQTCIDSQLDTRLRRSTYMHL

SEQ ID NO: 1010602 - protein, 115 aa, Homo sapiens
MTDRAARATWCGYGSLRVAQKLIYGHCDHYDGVRKLWKLAAEHGLAKLKQNIRDLRPGDKIQSWIAQCLSESEDSLLKKITSFVSPTRGFPQMGDHTEVLKGIRATFPGYQLPSP

SEQ ID NO: 1010603 - protein, 100 aa, Homo sapiens
SALLRLLRTGAPIRCVPAVGDQCRDRVAPCLWTCIHIWRERGAAADSQKLPAVVRVKKCNVGHVHCPPFHDSSIMEGYELVTGGTTGILYEAKSRNCMQY

SEQ ID NO: 1010604 - protein, 258 aa, Homo sapiens
KEVEAAAVRCSGWRAIAGWEPWVRHAARWPIVGPDAVRLGSEPGPGCGCADVPQPAFRDGEAGVSMKWLRAQGGGEVGAWCPGSVREEGGAWMCLDRGFALVPWDADRTLAGADRTSAAGGTRELGGARTVGPWRLCRRPAASGATCCDLPKMPWAMVWDFSEAVCRGCVNFEGADRIELAHRIAAAQLKRSHVAPLMWPVLPWAPGPLMQPGHQGTLACGKPDMGPPSLPGPRKWPAPRPVREPGWRAVVEAKGTGY

SEQ ID NO: 1010605 - protein, 475 aa, Homo sapiens
MKAVKSERERWCAGEDTGTGDVVLPGLGVCSECSERLSPEVSTSLPYLTSWTTPGGSPVSAEQLSLAPVGPLRGTEPEELDGPTNKNEQQGRQWTKEQQSHPRPRFMRKRESSPPTTSHKCRGQERGVIIPVKRTGRIEEAKQGNPSDRQGTTAQSDKGTRRTGDQSHTGDQMRPQTKGKETVYTEKLRKGQLGHTGIQATPAIASTHTCNNGGQGPFHETTEQKRDTHPPYTAQGRNGGTAQYDNSKGNTATAEPARSEKDGSITRERKENNVREPWEARRDATRTQENAGHHDGKGTHRPKGDGRRTEHEAGTTRTTEGAGHNERIHRQRYDRTKKKRVGWRARAETGQENTAEKRKGEGTRTEQKAKKRDKEGDHKEDGETNERARRDGRQDEGGTEKQQKHSDKHETRKENKGKRGAKSQQEGGGRPRTGKSAEGPKKKEPEKNDRGKKQAKKRQEEEKSKRQKGHEQQQK

SEQ ID NO: 1010606 - protein, 266 aa, Homo sapiens
REEYFPPKVFVAVDYSHDKLVGASRGHRPGWSWASCGLYSLLTICYTFILLRTWSRRATRSTNDTQWCVVAVVASIFIFWFALPGDGGIIDVLPGAIVSHLPAAEYKLDSLCVSFAYINCCINPSSNSGGWQGLPGPTCGKSPTNKLLRNVYDEESVVREEQRHSLRSTVDTMAQKTPGSVGDSPHWATVDRVSPYITGQYSLLLLHISRLPGRMGYPIRITYTSPPKVPDDTPGNGPHYIPAGPIDHPVPQYAKGEHSTLREHTP

SEQ ID NO: 1010607 - protein, 196 aa, Homo sapiens
MVGASAPRVVLGPRDTSTLGPMPNSDIDLSNLERCGECTRSFERLPCAEHSTRGARAPDSMGVRTVPMSISGEKDYDPIRRQIDIGAASNQKSSRYLNHVTGNGKTMAIRGATGQLLEGGEAWTASALLAKQTEWSPAGVPDGEGRGWGDGPLWAAYRESQQSWLSTYRASTENCSTVHSFVAPGVPLHVGLRLWG

SEQ ID NO: 1010608 - protein, 244 aa, Homo sapiens
APQEAGTRAHHDPCCRALRAQQPPGKERSRDRALIGALRSAASPRGAGYQELNAEEQIVRVRRRCCFRMASREGASRRVAEADGGAPRPDALRTQRASLTEVAGASTMATLRVSRWRMSRLLGGPSRGSARGSDGRHRGAKRLGMDPGPTDSGASAGPGLGGGGGELGLGGSGGQHATPGLDAHHLSPSATRGSLTSVPTSTLHEPHLDNQICYAFVFVTAAGPFDVLVCMGWKNHRKPPGVLE

SEQ ID NO: 1010609 - protein, 102 aa, Homo sapiens
MIRKEKKHKRVRTKKRERRKKNKNKEDEGAGPKKKYSHRAGGSAQQIARRAHVLLNKRKAPPREGGATIRSTRDGRGGYSTGGGERTKRADGGSGERTPSVR

SEQ ID NO: 1010610 - protein, 282 aa, Homo sapiens
GGRPRLGRRWVVADPNPLRGPPGGRVKAWCSWGETWKWSARPGAGGARLVGLQLAPLWGSGLAASSRLWGGEGAGWAGSWLRCGGGPGAAGSSPRGCLSAARRAEAVLVACARLAAAMRPRLRPCPGPRAPCRSFAPRSPEGPEPAAGSSHGATLARTGGHAFRETQPPCKGPADIHLGKTRNSGAQNPEETKGPEQEAHRKGAQRDQGNVSGRQATSASKGHPRRKDKSHGVMGVEYHGATPMPPKKPCGMENGTGHEERVVSVDRTDEAYGGMGMKYPHD

SEQ ID NO: 1010611 - protein, 69 aa, Homo sapiens
SLGRRVHRRTCLGEAQRAPAAAPAASATAGHAWAPTALPVVWEQARVYVAGVTVCEACPTSRGGRASSA

SEQ ID NO: 1010612 - protein, 107 aa, Homo sapiens
MSETDPLRYTAAQVPVFQDRPSKNFAAGCTSPTLQVANTQTANAAAGAAENAFLGPVTPDWDALDLLLRGSVIFSYQSVKVLLGSLERYHYADGSLRSAPNPMAMIC

SEQ ID NO: 1010613 - protein, 151 aa, Homo sapiens
MLFTGIAVLGIVMLSTDPLRYTASTGASFQKAQLRISAAGCLAPNPAGREHAAANRSQLGLLNMPYPGPVTHDRMPWPCYFEGADLSSKSLKVSWDLETSSLKLMAPPSAPISYRMTAEPDQACGEITCDVVPHTGHTAATSKYPSELPLV

SEQ ID NO: 1010614 - protein, 172 aa, Homo sapiens
DQQVSWEFPCLNLSKPKSRVHTLQDVASIMSHSYAAGTCHVYVRGPRRAAPALTRYCEVARSRHGPAELGESHEPRAHMSCRDMEECSCPELDQLVDICRKCSGLQLHELDWSRMGRLPQYQVVPADKLPSFLANVHKAYYQRSDGSYSTGESNTYLFVYQTCEVGLYRFPL

SEQ ID NO: 1010615 - protein, 153 aa, Homo sapiens
MRHVSSTCIVTNPCHRFLQENHRSHVRESISCSTQDRVYYQWSSTQIARGLAVQGLYRSIRLPEPLVYWDQNVGCTSERIVVGLNRLQTTERAKLQKVHCLMEKSHREAPWAFYFLIVLSEKEQELGEKGDSQVLTICYVLDTSFYTHEIWKH

SEQ ID NO: 1010616 - protein, 117 aa, Homo sapiens
HAADSFEDNIWRDPSEEVSDTTCLRTLHSGQPNSRPMPKPIKQMDKFGPGLKGIASSQKREPCDTVIIFAPRLLSNGGALCALWTRPRGLHNAFLLICFLDREGIGISEVRQTCLSS

SEQ ID NO: 1010617 - protein, 215 aa, Homo sapiens
MGLRLIYDSLEEVDTSIVVPILQEPTAWILHHVCNQRHVQCQSRRHGGKSETASHCHHGTLELTVSSAFNPSGLGDLADSCRVSSDDGQAMGKQPVVQLAIGNILGRRCTGNRYWKDAIHFEGIALGGEGPVMVRVWRHAPTQHDLRPPSGGCTTTHSCRVPTGTRSSWARCQPGAAGAELGSGRGRAMESGLSVDAINSSVAIWLLTNVPTTSV

SEQ ID NO: 1010618 - protein, 191 aa, Homo sapiens
EGLNFPAIASLNWMKQLSPRTITLTMPHTGVCKDRMTVQGPARPGVSCPPSLHNGAERCQNLSNEPHQGEGKMYCTAFIFELEMDEREPTESTQQLNKPGGHRESDPEPPIPVCMGMIKAPLPCTSWAACGQPAEPQHEAQGPQNHSDLARPSCPWPLEDKGQTADNNPGQIETTVSPSSRPATYFLHNEL

SEQ ID NO: 1010619 - protein, 111 aa, Homo sapiens
GRLCAISLILSCRSRRRLHIHASCCPFEHARESPRDSRVAGSCICSLCCLHSDVPRCSVMVVRRQRGYVGVGVRVSRSASSVVVCLWMCGMRVGGSGGVDRCIAEGGYNHL

SEQ ID NO: 1010620 - protein, 181 aa, Homo sapiens
MTQYTGEARKLRTPLLQESYIRHIGTTPWEQELIIVLNKQGIYHGVVTHNLVTHKVYEVIETNIARENYSFSVIIERYVYGRGLSRGPRDFFLRRRLVRFPFSSSQAEVPLPAGTLPKPPQTGAGAPTRTPRPYLARALTRSAQTAPHMTVRAPCVPSLSGPQSEALRSHYLVYRCPRDTR

SEQ ID NO: 1010621 - protein, 136 aa, Homo sapiens
MVGVELLDEESALPGYLGPFPLYCYTMVWGYIGRKKKLCLPGVPPNQGECSTRSRPLPHLLGIGGAWTRGSILTRFSNAPGLSPNQGQSVLPSPIRSEMTRGLIGVKGAILGLQASNFVVINLVGCGHYEESDYEK

SEQ ID NO: 1010622 - protein, 269 aa, Homo sapiens
SVCHTPWAGVLLVELLWHLVLWQLLPVRSSASQNGVSGYRLRLCVNAPLWRPPMRLSVVRSAPEEVWRTPIKCPLCNRFTRCVEHSVAPLAQLPVLIICGRDPVVPPLGYKRAILYPRYPCLDCMPRGHVGPLSLGMAGHMCHRGSTSHLSMWEPLVSHVRFTAGDMRLGRAAHVTRKLVYEGDLSAPSTSTCPIGDMSQEVGDGTAFIRVGGRTNRSRRNTSYSGATESQVTGGQYDGGISVCTKHLVAYTDLSAITRHSSRRAQLES

SEQ ID NO: 1010623 - protein, 73 aa, Homo sapiens
SSAGECFCASSREVSFSRCTEGLPCCSEEPSSHASTSAERVQPRVAYPVNRPLRSRPWVAASSPDQLHMHLLP

SEQ ID NO: 1010624 - protein, 76 aa, Homo sapiens
GVPCSRVSLRKEAPVETAGDPGFSRGCTTDEGEREWTWERGDSIGPQVNCNFLGKDARGPSADSGTETCKIPEPKK

SEQ ID NO: 1010625 - protein, 189 aa, Homo sapiens
MGRLEASGACVWVSIPSTLEVAVEFSMPLAKLLSCPYWTRRVQAREHLARKTADRVGKPCLKDGAHSQSMHSSAAMLTSLLEQHGREQEPASVQLSRGATRLESQAMGLCPTAVYGLSCSWTHEEDSHWIRASVNSLELWKVGTLRGRIPWEMTVSGVSVGPAWVKDPVSSVSNGQWEAGGKYRPGYDV

SEQ ID NO: 1010626 - protein, 176 aa, Homo sapiens
MTGVSLNTRLAQGSGAVDSVPPWDSLRRVRTTSRARQPFPYPGMSATPIQSPVCVTRTERYRSRVVCQHDSTSLVQCVRSKVRQHGRSWSEAITSELSQRSRFTISHVSLNLGETCPEPLSAVASVTEELDPEPSGRQADCSQLPQPSGHLRSISPQFYPSRKAYAAAFAPTSVAD

SEQ ID NO: 1010627 - protein, 106 aa, Homo sapiens
GAKNVVRTCAFWAAYPNNVMQPAHGSGSPVGFPFHPERVFPLPLRRQDRAFILALLARCLRWSSSGPEAPLSLGPTIPAFPGPMTAIQEPLVTLGTVLKTRPRGIT

SEQ ID NO: 1010628 - protein, 141 aa, Homo sapiens
MELGIQLCNPMSMAIMGTSAMYRPSEIELATVRVGVLDDESLTCLVSDVRLMTYPLMGSSKLTVVALSVLSTLYVSSLEAVAGDRAQSHDTAKEAVFHFHQQMIGCGPLPAPQCLQIGTCSKADNYGSLEYKPEIQYRKKG

SEQ ID NO: 1010629 - protein, 111 aa, Homo sapiens
MIPPSAPGREVLTISIGTQSPVKFSSSPTCDVNGGEGIGILVSRDIGVYEHEAEEVVVVVLEPSSRDSPVLVRIFARRRGFRGWGSDSPKLRWLLINPLGLLKGMDAIVNV

SEQ ID NO: 1010630 - protein, 106 aa, Homo sapiens
SHGLALLRPESAHNWWAPPFPVRSFSKGTVARPDGAFQCDMTTYVRTVTFCAANQEILLLNKGRVTPLCSQRPSVLTKATCWGPRSFYPHCGGPLGSQRPALRGLN

SEQ ID NO: 1010631 - protein, 301 aa, Homo sapiens
MKHLTLAKGSCCQRGVSTLPPEDSNFTQDVTAQTPLEATVSLMPRGNSMGKRNTVMSSLMGAYLIACRSATGVPCLVLTHVGKKSVEIITHIGSRTCSQRGLRSATDRARGPFGTRCPTLSPWGIYPMAGTGHCRIGKGLFSSEPLYQAKDKALLGRESLAAKITGIHDCLLIMDPTVTLAIWGPSTATPTPSDEGHFSVQVKGIDEASRLDVPGGPSCERTKGLGVPSQPPGPRPTYRDASAAPLHSGACAARTGLCTPYAALAAWRPHDCGCLACQEQRLFFSSTPFSSISHTRGARTL

SEQ ID NO: 1010632 - protein, 125 aa, Homo sapiens
MRLGNRAQSQAMGFLAQSEVDAGGRGAWTTISAKSSAQQRYPSCPQPTCSLGVSFLVTYYGRESAALCIRSGATACCKVLDHATSTLGSGVPTAGSQSFDQIVIPALAPYVVFWTEDNSGGLQCF

SEQ ID NO: 1010633 - protein, 274 aa, Homo sapiens
MSFFVSLVWTRHSSPLDLSKVGALYSGTSGDLASWQGRFIRRMEMPERPVSGGIRAMFRSSSAHPKQVQEVEVLSSSPIPGQTPASCALVVVKLMRYSGPRRLTPIVPQLSLVHNPPLLTSQINRIKQDYIHEWMDCYQSLPPAQNLWEAPSELASDNGLMLISTLVASSLSPPTPLAQVQIDSLRFETSSVPVMPLSTSIVTGHSWRRDSHAHASKSPRSARAAPQGEWRRAGGGPAPAPRPPPQLPLVLSVLLKSVKYGSPSGSSCLTDGYL

SEQ ID NO: 1010634 - protein, 368 aa, Homo sapiens
MFLSLAKLSTVCTRNTPFCSNHVSDVPSLCGFIWDGVSLARSRVPTMIRHQFEPKALIRLVVHSQVTAEVPGGAPRSRGKSFGAPRGPINGEQGPLLISGKQGWPGGIRLSYHCGLAEHQRLIFPRPLRHVHPFELGRQHAANNPGHSLNLCASPRSSSTLGKIEELLSWREQGPPFMLPYQFQDLEEIEGIPAIAGQEMPCGISELSRPFGGKIEGDTRKSFLHSEKLKTYFEDNPRDLQMLRHDLPLHAAVVKPNLGHVPYYLVPPAVRGLVRPHKKRKKLSSSCRKAKRANSQNPLRSFKHNRNTKFMTHSSDPPEVVGPLLEREHIVEHRLTPFVDRGRVCVLTAQPEQTVLGPAVQDTRAWTF

SEQ ID NO: 1010635 - protein, 144 aa, Homo sapiens
MIGFGAKNGSIDIFPSSHLHAEIRSTLLCRNQIPNSMTSASRIQCSPQRDSPVLLFCPPCWGGTGEVDVGESHWGLQSLALLCSIVALAGRGTVAKGEVAKTRTSSLNALFPPGPSGPSFQGCLSQLLTDMCLKLTRGLPIWND

SEQ ID NO: 1010636 - protein, 61 aa, Homo sapiens
MEQWREDLFLNHWTPEMCMQIQSQLPVKIQINFPVTVLRTLLLINNLLNFCAGSYRSGNFG

SEQ ID NO: 1010637 - protein, 71 aa, Homo sapiens
LCHLNSSTLLCGPVCIDMRTSSLHHVCSFHRYDTSSVQLCGGCFLRGIYLVLRVYRQHSVIPFLFGGINFR

SEQ ID NO: 1010638 - protein, 190 aa, Homo sapiens
LGPSEQGPPNRGRPTWARPNYRSVFPGVWKRETPLCVNSTHAPIWGTWARLFVSALSWKGVLYLERLESKYVDNSWFSQMAIMNVGNIDFSCVRVMGLYMHLFQSGPLLQALCSPFPKLPPTTPAPLASVHSGPSLGQALLCSALHRPPPLLLPTSLTHVPPTWQSGLAHFPVTRSPGAVLSCPIIDQCI

SEQ ID NO: 1010639 - protein, 84 aa, Homo sapiens
MVGDVTGAHGLCLHRSSALNIWVPDFWASSVTILLIVISSADLPGLWIDQEASLRPRALPMTCIHRTPTSIPRLPPSILGGPLL

SEQ ID NO: 1010640 - protein, 146 aa, Homo sapiens
MPYNELLQLPTPWQHRESKMEHLAQLRKKFEEDKQRIELTAGPSANSDRTAAVRAAANGLEVQGQEEARQGLQRSLRGRALANGPQVEGHRVQQPQSESTQARREGPGHPSVLVLQQFLGTKACREEDLSFLLLASTPLTPGPGGS

SEQ ID NO: 1010641 - protein, 179 aa, Homo sapiens
GKRSSVDEDLEGPEEAAGKSSRDGRPASTGPAPVRLTARKPLEAEERGWHRLAFVPQLQVSRPVIRARLPGTWPPLPSSTLVRSAVPASRTRPVRIQEGRYRHPGCYSRVPTVGLNREDCAGTSWVGDELYCEKQCARLAASSGYPANARHDVLLRPRGPRRCRIKHCRLLLERRVMPI

SEQ ID NO: 1010642 - protein, 98 aa, Homo sapiens
WALKKARLHGYNGPRPFSIADKLDRDVLDSCPPKQKVRLLPLPEVLIVPASQLPHHMTSSKAKTFSPFLISVSDIMSREVQEWVSTSFHVFLHIHFQK

SEQ ID NO: 1010643 - protein, 305 aa, Homo sapiens
AHWALWDQFIPKRRFPPIPRNAMPVSTQPLTQRSVATLLRLIRLCKIWRPSNFSLMTELSYQERQPRGSPPADRMMGLRLLGGLPTYQSSLSSSDNLARLWMCGDWRDLRESMAAHLEGCRPCNGLQSDSVLWLPVYPLWDMPGAGGGSCEGPMQHPGQSRPSPAGLRQLDLMDTHVAALTMHGHRHAHGTLSPQLHYPDVTELDAKPGCTLPGHGASHALAYGNVRTEGTQSSLRGLRLVPTPKLVRSAAPTLLRVSGQSVHREHHHDGKVEGFISTCQQTVLVVQVAWPAHWIGTGIRWGDRG

SEQ ID NO: 1010644 - protein, 222 aa, Homo sapiens
MAEVVRYVSCGSKSLAWSSSARPTTRLGPEVFQVCNWSTLPLYGPDAIPQKRSQGFGDTPTSHFLRTPMEVLRDAETSFSLDASRGMNASPSTLGTIMQKMAMSPRSTLLLPEGGSPGNEQEWSFRLRQNLWAAAVPPEWVPYYTSRTFRASVKVKPSAPSEVMLYLSGIACQDDSKLRSDIHKRLQEDPNYSPQRFPNAQRAFADDPKLFALWPNTHEGTV

SEQ ID NO: 1010645 - protein, 149 aa, Homo sapiens
GQGLVDGKISTVTGWGNTQYVVANRPGVLQEARVPHNQQVMSAMATDILTGNSDQGPKTVSVARLRPRVAIDACQGDMLVVPFVCEGQHLSDATLGRHSVGIVRWGTGCALAQKPGVYTKVSDFREWIFQAIKKCTAEASGMVTQLQNR

SEQ ID NO: 1010646 - protein, 121 aa, Homo sapiens
VGFPLTCHWRHLWEVRRQPLLKHPCRTAERSPGRFHAQPWYKSTVIAHDCWRLPAFTVHIYCGHCTTSLPQYGAREQYTLYGILSLLSFAILLSDGWTCMLTLQLTLHSRFVSAGRDLSAW

SEQ ID NO: 1010647 - protein, 219 aa, Homo sapiens
IKEVCVSPCLVSYPRCRRAGKVSDSICIEALCGLSQGEQAPKWAAVSMRLSSLPLVRLALTYLSPIHSESSIKAPQCQLLPPPAHLPSYLSPERLRGTPTSPPEPQDLSSSVCKEEQDAQRRLTGERTASTKEPAKDSALTVAIRRQAAEKYKHRGEGERKDIVSSSMPTAKQRGACGQPDARDRESELTYYGAGMQSKPTRIKAAVVFTPLGVGLVEP

SEQ ID NO: 1010648 - protein, 148 aa, Homo sapiens
MSVVRILRTVSKMRCIVRITGMTASSCSLVDCRGDTCPGESTQPSAGGGSRGERTTGARPQSGHCELESSERGAGHPGQPGYQAALTVSVTRHRSAPAEPSTLEGASESGAFEPSGPVLGETGTFGGTVKRLGKADVTPMGPCAPLAW

SEQ ID NO: 1010649 - protein, 217 aa, Homo sapiens
MHSPRRDIIGFLLLALVLGARDSLLAPVVPTIGFITGDHFVALHPRLLFPAFPGLYVLPLGGLENERLTAPNPLNDSFDIPRYVSIASSGQRHTEVHDQGSKGTSTTGSPIRRSIEHYSRSSVHDGWALVSLIARIQRRHHDSSLETSPALPRYDHWSPSSRSHLRTTSVYLGTSTWTPTDEENSFTHALTANSRPPAVITTLPRSHAFIMRGTQIL

SEQ ID NO: 1010650 - protein, 303 aa, Homo sapiens
VRARTQAYGVANANDPHNGLSMGSLRPKTPVGPVTRPGLSKGAFDRCNQRIRDATRDRSPVAAFGGLQPTREMPTPNALGSPTTAIIVGASSRGQRLHRSKPNEGLFRAKPCDGWDSLAKGLINDMAALKPGESKAKGILAKESPEQPLYHVLHRYCAQGASSPASAGAPGVAKTGPEATQMAARTALAHGSQPGTHELAWSDSHMYWKQRAQGCKIAAMPSVSQRELSEAFASTAQKLGPEKRPGRPVEGQGVSVQKKLGPLACLMIGKMGFNEMAKEKDTDQWSKKAALFHMIQHRVGQQG

SEQ ID NO: 1010651 - protein, 138 aa, Homo sapiens
GLPEKLGKGTQVPFERSILTSDSTYSSDRTKERTTVEWTQTQALMSMRVLGKPEPRSSAVSQRVCQGNRRSFLKHPAKCSSEGSWTEEISLMNDDLLPPAPSRTHRTEDSAPWILNDQVAMGRQWLAIQKCTKHKSYK

SEQ ID NO: 1010652 - protein, 122 aa, Homo sapiens
MRPGSQASSDMMVAEAVSPGVCCGWVRSSLRRQVCVWTIAHLQPLIPTSLVSQRVMVHTDRTLRYNPFQLQHVQGVIQALPPSCSVQVVWTYKLNFEREGLGVEDFVIRDISKIGSYGAGAH

SEQ ID NO: 1010653 - protein, 145 aa, Homo sapiens
VGLDSRILADLAVYGVLRVMEGLDALRGPDASTRTSSPGTCGVERAITEASLSALNVPAQTQSVNGSVNDASCHGPGGHCGQRLAILVRGRRIILAPCPLHPPPSPLASNTGHLLGYRDRLGYEFQLLPHALGAQTPACAMPPCS

SEQ ID NO: 1010654 - protein, 178 aa, Homo sapiens
ESSGLLMHPEVIGGLMKWYIRMKASSRFLRSDAVALLWGQKEEEHQHDLLTIRWVRAMRYYYIREDLWNAFGSAGDSSNIVLAQTQAVWKHGRGSHRVGIRASWNYTLVPNSRTTRGLHTFLGGQAGQMAPPLGNAPASAAGEKLISLAVLSAIAPGTPEIYGLASPPSSWNYNALGY

SEQ ID NO: 1010655 - protein, 43 aa, Homo sapiens
MRTTLGSSIGQPLGSSPNPKVDTWLSSGDLGTGTVVITPRCQR

SEQ ID NO: 1010656 - protein, 221 aa, Homo sapiens
GTTLTPRSTTYLSTDAMPHPSCTVHPNHTGPRTFPFSWRSTPGLGTRALKVDEEVPALSSHCRRSVHAAHRVNEGHPWPVSTSRHKLPRFQWLIRARAYRPRYTPFGYEQAFCEAPYPRPTPGEPKLGDPGEAYESCAMAYRGPHATTQGSRRGPMPREASGGALATWWGQVDAALRGWSRIPQSLGHPGVAPSCPPHLPSLFGPRSVHACWYFVTCGGAL

SEQ ID NO: 1010657 - protein, 101 aa, Homo sapiens
CFAVSYPTLPVSFPPGLERSQVLDAVVIDLQVSDFQQLLACAMRATLSSGVGVFLWRGPMPKWDGPLFIFWPLLVCYVSVNNQQPGYTGKDWRKDELMSID

SEQ ID NO: 1010658 - protein, 72 aa, Homo sapiens
MHAPWPGWNAYIDNLIADGTCHVTRPSVGYKDSPSVCAAVPGKTFVNITVLRGLRGPGHCSGLDPEGGTWVG

SEQ ID NO: 1010659 - protein, 142 aa, Homo sapiens
MAGVPSFGAPVGNRRILSVLGKGVRKQEQPSGVGLPATGAVGETPEGGWGSCLRIPITQRSPYSMFTRSTRVLNIVFTCIYLHFLLIICHLVGSHFISQSLLFPPYLGTGRGGPSAKSSLGNFILTLNIPSDSIRPNFNFNF

SEQ ID NO: 1010660 - protein, 55 aa, Homo sapiens
MTRLCGCSRSSGVCGSASVAGAQVGVPEGRWPGARTSRALSTGPAPALRPWTALG

SEQ ID NO: 1010661 - protein, 71 aa, Homo sapiens
SWLRLWRRRQLWPRRQSPGPDCASSVHWFREGLRFHDIPGVAGGRARGALRIAVVYILDPWLRAPPPHVGI

SEQ ID NO: 1010662 - protein, 241 aa, Homo sapiens
MGTKVGLRSAHRVEQTAKGAEHFRVPPPVVGLCLKGKLCRRRCSPRKGPPRKGFAQPGSFAVALERRTSVAVRKTFVSQPFCAPRFPRNFGTRKPLGVSIAAMAAYRDFAIATPLSGHCGCWCSEAKSWELGHFPIWNHGHRFVPRLSKDATILLSEFSHGGKRIPGSALMAGKENWGLAMVEAKVLVLGYGIAAAGPQLEIIGPRPQKRRRANAVGHTAVTTSNSKHLEARLVAPQCVAY

SEQ ID NO: 1010663 - protein, 56 aa, Homo sapiens
FVHPTGATHSFLPPTSSRDCGPVPPPPHTGARLNPSVPQQAGCAWRAVTPIEPKHR

SEQ ID NO: 1010664 - protein, 118 aa, Homo sapiens
MEGCGFLAESTSELTALDSRNQSSGRRGDPAPLLTMNRAPLKRPVILHMALTGASDPSAEAEANGEKPYTAAGIEIALVVSLYWVTPSPLVFLNKYLLDSPPEAGHPIYDTFYQCLVT

SEQ ID NO: 1010665 - protein, 303 aa, Homo sapiens
RVEHVAAAGGGAPGAGRAGRGSRTRRYGRGGQEGQEVFRSVNVHTYGYLNPSSRTEILHFIRTMQREPTMVPGTLDSMSSDAVLDACLLYERQGWPGGTGRISSSGCPFHDIADVSYVRELTLSHLVVLTDSARTPGISPSPESVCGKFHEASVHGSLSEVQLGPLEAMRAWSVLAAESWVAAEELCCSARPGLPGCLQRSPPSTFWYRAIFDGSLYAPSHHVSLDSDELFYKKWTLEEDLPRLKSQHIIWVPLNSCGIVRLVHWPDEEMTDQVKKPAEPAGPLSMMRDYMLRLATKVYFRDP

SEQ ID NO: 1010666 - protein, 210 aa, Homo sapiens
MGEQADCVVSLRSYKISVDHQRYTAGSDHSSTVLHAGCNDAASPRALLLTSSWWPMSSCVPVPSQPAGPCAGDVRSDSDVHRSACRECFPEWTVELIVRLLHCGLKAVVDFLYGGELELDVLANIDYVLDDGSSCCRSVTVADFCCDVPGSRRVSEDNVIRVACQELGLASTSRQGGLMPFTRVGFILKPLRARCPFTRDFLAERVHAEG

SEQ ID NO: 1010667 - protein, 341 aa, Homo sapiens
RGGKRVLEGVYPRLDLGLSSHCSLIECGDVGHQELSFFFMLSGAAPRGRLSLGRFCPPCAIAYMLLVSVGAVGCVSARVPAGMWFPVVDCGLITVGSPAPCGGPIVHFYVLTPLPLWCAPQGDPSTGVYGVIVSLTVSRASLGVSHQASPVSFLGRESFLPRGAPRCVQLSRKMYEYVLEMFVGFLPLATTQRSVVVPSPVVSVGGATVSPASICSPTIGGTLGLSIDHLLDDREKTTLSPPRGYRNKAEFVRIGAHRQFLWRQAENAVMRHQELEEKSTHTVSRKFTEGFHAEIWFSDKKGFFHSRALFFYTRNVFSEKTITKDHKVLEHPWIAHLSSVK

SEQ ID NO: 1010668 - protein, 188 aa, Homo sapiens
MVTRFNFLVCLGVVDITKLWCGCGWSHHPCTTQTSSESVRSSIVLWASSRGAQRMIFCSTKAWLIDQRRDGAHTCQTTPTPLVGVGGYTTHRLFVVIPPEGVCPPANECWSCCISTHGVRQHIWMGPGTHEPARCGRKLVCGDLSFLCLLGLFSLCRATKEISCFGPSREESPRRLLIFIAGGETLLS

SEQ ID NO: 1010669 - protein, 105 aa, Homo sapiens
MAPPVCFSTPVFCGNTFLLPPQRFVYTHMLEEASKTLFHHDGRPRIGCLFHHEGKGAIFLYRANISYWVILFKEPQDKTWHIFSLSQKYISGRLYMALDLVKSSF

SEQ ID NO: 1010670 - protein, 274 aa, Homo sapiens
KEAGCRIECSPRRLPTLVVVHNLRRNPCKQRQGEHATTEGGRTPTATHNQPHRCGSDRPTLTHSQGRPVHTSPPRAVVRRLHETVDSRQSCQPPTAPGQAPYRNHAWAYRPFSPHHTQGTHNCAPRQVNNVRKLLCRRPPSRAHPPGFFFRPPYSPSPPPLSFYDHALRHHPRLGLAAPPPILGKGRAPRRLLVLPPPMLTARHANVRTLLLLSLPLTERIFLHHPKCALARRRGRTFPPPSPPHPLLSSSPPQERGGGGGIFFPPQTFFFFQT

SEQ ID NO: 1010671 - protein, 186 aa, Homo sapiens
VWGGGVVCGGWVWFVAAVRRIDSLVPLMMGSVPATLEKVAVAAARCLSSCGGVRGMICEEVIESDVRSGVLIRWGAARVGVGSWRSSDSVLVRCSLCCGERVVDEVGACLAWMAFSPRLREGTRGDDFFCGRGGRLEASSPRHRVVALAPVVRCALSFRSRAPEAGVATLLQFSVFAVARSCGDER

SEQ ID NO: 1010672 - protein, 209 aa, Homo sapiens
FLPGDFWVFFPPEILGTQFYTGKPREKVGGPLFPRALEPLNSPEPHKKLVTSLKRNTLNGVGDPSSECCAPSTHATTVSRVGCGICDRLSPPPKMEHELPQGQEKRDSPQRGFTRIKFFLLERVVINYTFTLIAPQGTLVDNPLWDQTVVNKGIVLQRSSASLKARARTGGTRFKICKRRITTTGKKQRVFPKNFGFKSFVFDPFKIIK

SEQ ID NO: 1010673 - protein, 118 aa, Homo sapiens
MRERGETLSASPAHTAREREARESLERRRYRKGNGEHTATRETLVSTESSFAREKHPRVSLSQPPPRETHTAPLSRLLGRTLSSRRAQLSLISHACFMPSSLEFIIRRKYPHKNISPL

SEQ ID NO: 1010674 - protein, 139 aa, Homo sapiens
MYPPRWGGLMKNTGGNWGFFSLLSSGGGNFFGGGGRSNNSTSSFWGWQQQHTEAQVEAPPYWREQQLVALPCGVFTHNTAPTIVVPPPAAGRLQHTSIWGAHPDSCGSPAPPPPFFSEPPLGARGPPLAGSLKKNGPFC

SEQ ID NO: 1010675 - protein, 223 aa, Homo sapiens
LVVVLGADNVFGHTLWGGPTCGCSPHPCVLWCVSLATITAMYCCGNAPAVVCCVVVVASPPSFCSRAWAVVHVGALSWVWWCQVERVVLVVFTPPIARVVAEDAFVVRDHDCCCLFASAPMCRCVVVVCATHIAPHFCVVFVYTLLFGARHRLGVRCAIVVYLRGDLIFCGSVFCFVPFASLLERSRFMCGFVFLSTALALSFGGLGWCLLFCCRVSSDITAG

SEQ ID NO: 1010676 - protein, 55 aa, Homo sapiens
RTVLGAARLERSAEGTAGLKCAGHKPPNSPGCHIAEPKHARRAQLSRLMNRPGAG

SEQ ID NO: 1010677 - protein, 418 aa, Homo sapiens
VGGLGMVYCTHGWVPNNVRRCIIWGGRVYLYMLASYTGCLSPHADAVCRAAGVSAPCVVLPVHTSSVGSSTGSAGGGYPPLLMATMCGCSSCTCSRPAVVVLLARRDGVRPANAYVSTKIKKNREGDHNIFEFDKTSPLLVSFCRQHLIVCSMIITRASRLIASHATQQGCWINATQVNFVECYQQNDQRERRLKDERNTVCVRVVVIHTQLLLSQSDHTDTRSINAVTRPSRGNNIIRGGGAHTTPPGAFCFFIDSQLPPCVFSIRETHEDEQRIGRTRDEWGSTTTSAHIFCLCDSTPGATEECLIHGVDSHASRPHTDSAPLEMCWWEALLDSAHRRFFWRRPPLLGRRPLYISPGKSCGTGCICRAHTRCAPLLSPRKAGFTGHSFYPAEGNSSPTTPLVATPWYTLESQENNL

SEQ ID NO: 1010678 - protein, 148 aa, Homo sapiens
MGINVVEERTTFAPNGGTTFFPTKKILWVELRLPLMAPSLTKQHPRGVYPAGPFSCVVPPRTHVVCTTDPTTLWRIRRKTPLVGDNHYISLSGWCSNSNMAPHNALSHCCVASAAQVFLVGRRVTRREMVFLLWVGDFSPAIRNRPLS

SEQ ID NO: 1010679 - protein, 167 aa, Homo sapiens
MTESTRRWTPPPLRPPRIPLCALPRESFQTPSRHLCGVFFYTDPKFARVATHVDTRGGRITFHPPAHTVSVPPSHRGGRPLSRLFQEWHPKEGLTERTISLFSVDLHEHVTQNIWAIKSKKSAPIPATLRKRISTPISIHGRVPGGRVFPGKHLPRFFFWRKIFFLP

SEQ ID NO: 1010680 - protein, 152 aa, Homo sapiens
MLSRVQRHILGVVIFSPGGLVIVPHQTGRAFSVAILCGEGPTTGFWGGALPSLTHELWERERPPHCVYYGPAYWGKGCVEVSDLWSVLVFWCTSTRFLYHGSRKHSGARVFSPLGEPLGGREQSECSRMDGRVTLGFSFFALRTCTFAHTAL

SEQ ID NO: 1010681 - protein, 106 aa, Homo sapiens
MYGLVRSVVLSPLSRVRVTPTWGDDFLWFGVGRLPQLGVSLHSVSVFCGDPASWRDSFSLYVWSLVEKGDRPQRALGVRCLNSLVVHHNGACLTNSGDKRFSPAVL

SEQ ID NO: 1010682 - protein, 341 aa, Homo sapiens
HTGGCATAPLCVGDGLFGRPGKVCRLEPNIFVASVSNNIARVLRAPCSWVFMPQLVAQVYCGPRAKYLGEVALLLWGSFQGYRQLMVGDRRPFFGIQMRNVFGQSFPARAPRCASQDGGIRDFCPSEREPLGRELPPGGFLPVVGAPLCIVGRHDILTKLLDETGPLGEPYTPGTLKEKEFELCGPPREPTVGITHQGCLPEAGTFLEFPRGEFNWGFEMLGARGILSPKKWEKMWLNFTARFEQNFGKGPRVAHCLPVHDFEETAQLRGEVHGTEGSQWERTRLKDTFYYHHGPSLSQHRGANPRVNPARLVPHQDSLRTPRLLWQTEKCRRTSPKTARA

SEQ ID NO: 1010683 - protein, 116 aa, Homo sapiens
MSWEPPASGAGRASKAQPVTQGSGPPQAGTWLLRGAPRGATHEAQSLHTAGNRHPTTGLLESGPPWGTAQRGWGSRGSRMGAVPFAPDRALFNPGTVRLWGHRGLPGQQPQGPLRV

SEQ ID NO: 1010684 - protein, 117 aa, Homo sapiens
LRSGGGFYYLSPRGVFFCGGDPLLVCCCCGGPPLLLTPLGVLWAPLAIISRTTPGGRASFSCTFSGSILFILLGSPWGARGGYTHKICRQPTGRTQRRDCAPTYGRLYFIEGDTPSI

SEQ ID NO: 1010685 - protein, 117 aa, Homo sapiens
CNAHIVFCLGEGAVPLPLFQGGRYIFLWLGCRLDLASRLGPNQRELGGVLGKSLFNTPCLGNPWHIPFCSRCGCVHPQVLWALKLLGGAFVSSAAMFGNLQPLLFPHTVVSSGEREF

SEQ ID NO: 1010686 - protein, 103 aa, Homo sapiens
MHRGAHDITPNGAPMWSPRGESLPIFKGATPTEFYVCSPTAHQRGPSTLTRRECPSGSPISSQKAIGCPTPGGGTPDKEASLHLPRHVPPLSPARHFSHYCPW

SEQ ID NO: 1010687 - protein, 70 aa, Homo sapiens
MTRPGHRWSATCPSGLRHTSGGHSNLAYTPRFRHPLGGVVPRGRFGKAWHPQTPPYPRFSEPIKGLCYFF

SEQ ID NO: 1010688 - protein, 115 aa, Homo sapiens
MCSCSPPSSPAPPLPLNYWVFFGGVLVIAGVSPRVFPSPAPLSGGWRLPAVLPCVAPPRVVCSPRRSCFLSHRGTHPPLVPSVGNVHHHCREHVFLTMLQRFRPPLFPQGRHTKT

SEQ ID NO: 1010689 - protein, 315 aa, Homo sapiens
PPGWALAPGVVPYSEGRSPFVAPPLCGGGSVCPRLCPVGQRGGSHYLVPHQSFGATQHSPLVPGSQVQCPGSLWPPCPSPRWEGCLSRRSVVTPRGDTFSEAFLCARWVLCGPRGLPVGARVHLPPGPHWLSLVGASRGPPVVLKTPRKERGEPTEEIWIPRCTFCHQIVHGELPLWRDPPAPFLEVAESTDELFRIFSRWGYSGPTVGVLTTGSISWGNGAFLTRCSHALSSIGPKVNPWTTAHHGQEPRGVSGFFSGFTGPPANYGASPMPVEIVIAENNVGLCAPPTKLSTETLCEGPGNSGTWCRHRSPQA

SEQ ID NO: 1010690 - protein, 110 aa, Homo sapiens
MAWGCYIRSCNTNWKHTGQGSPLRGRHISCTKDNKRVTSPVGRKWLCPECDPPGDDGVTVSPWCRKSVGGQRRGPEVGLPGHDGGVGGPTFGVRPGWCGQPTRLRGCFRE

SEQ ID NO: 1010691 - protein, 453 aa, Homo sapiens
MVDFFVENEVESAGFYYRPSSCCIVPPTTVLGCVVHVFFMLGGYHSGGAFLAWVAHRGGSHNKLRLVARTCVCQRVGHRPRGAHRRGPTVHYIGGPPSGVHSVASPVEAHLVVLPPHRVCVRMVLFCNARSAGVGFPLAEDWSPCSSAAFLLGVGSVPPDFVELRLVIVVSPAWLLPPRTLDGRLVKLPGELFCRSQPTGLFIFPARNFFLALRCSGLGAHTRGAHSPACHGGACVYNSGAPSCDSQGQHTCAHDIASAVTPPFVPSHAPTRGARSSLGLFARSPTLVGGYIKGFRSHELPAPHGVLLSPVERCVGCLGRPCGGGPPPTLPSLHCGHHDPQHPARGIVLHRPPVATSTTTTPPHSGAWGHPFTCLASQFRPLWAPDVAVVLVTPPSVLAWHLLPAFPRGVETRRPVHEMDPRPDRVGPPPIFAAYNPPFSPIFSFPLKPFDNT

SEQ ID NO: 1010692 - protein, 258 aa, Homo sapiens
MNASITSLIAKSGDELLLATGGSRGHGVKMTHTPAADKKGQTGIIGAQDHRQLAHAPPARQPHLTGAPSMSIAVVGDANWALMHGSRIQSQSVILPASGRSRDVSHSSWHRGTRSEAEKGQLHEHLPAIGSKLTHTHLPRSHPPEKNSSSMSAMYLSCEELMCCAWGRHPTLPPPWGTDPTQGGDAPTPACTHTRPTCGWGAPSRAWPQCRPDWARTWLSSSSPSWFRWHSSSSLGVDQEPVRDGPGQMSDTPQVSVS

SEQ ID NO: 1010693 - protein, 185 aa, Homo sapiens
MLFSTPSLVHTHWGPPFHAALPSLRVVGEHFSLSAKLFARRDWFAPPPRVLSGRPPGWLLFVSLLREGPTHPHRMLFRTPRRPSFLPAALSTTSGCCVSPATPALVVWCCTPRCSSVGPTRVLPRARIGPPFGAESSSRWGDRLFPRGSQAFSPLMTRAPPLGCDVPLSSPTLLAAAARSSCVAA

SEQ ID NO: 1010694 - protein, 152 aa, Homo sapiens
SPGTSRVPPGFPSEKDFYGLYGAAEGPVEFPRGAMTGPLALEGTLGTEGVFGHIGGSNLVGQDVAHNTEKFRRSRVPGAPVSITKARNSPIHGAQNTLSAPSKSLCDRNLVRHFLMKPCLQNWGCLREIICRTAANHSPGKRMGAPWKGASP

SEQ ID NO: 1010695 - protein, 243 aa, Homo sapiens
FEGFSAQEEVRVSKEPHKRCMSLSEPKQGGLCSVCKKAWLWYKGGIVRPTTFWGLWHDAISAMFLIFGAQNLSVPVGSPQRNGGAPVPKKKVTKGPAHMPREAQSQNGRHTPGGHTLGKEDLFGVKPSGGGALDKAVSCKAGVPSHYPSSAEIALSPENPTPGLRPPWRAIRPTPRHRLGTDSRPATRLGEQTQGPPRPWSSRSTEGIPFGQDLQTPQMARSNNSWEEESPLGNPLRHRSEYS

SEQ ID NO: 1010696 - protein, 383 aa, Homo sapiens
MGHPPGARSIIPLSGIFLILLAPPGGRGFTQVCDGRPGGTMPLVRPLRVALFLCRGNPLLERTGVCCPRKCLRSCGVYTRVSREIFPPGVLWVFCAHTHKSLGDFFRRFLAHDFIVYGTHHVVNACFPGGRVIYGFYMGGVPVGPNRPLVGARHRQCTTLLVWETLGPFGPPEVGHKAPWRSFVRWNGPGYVLRVILAVQGMCYHARKWAHKRSGTYPAGSVDTHTCGRDSVSLVHLVSGVSPHPRGPHLYGDTCAVCGLKLVQQRGICVAPTQTFFVGGFTPRSRRCFLRGGDLPKIWGYPQAQPHHFPMTRPHIAIRRPFSQDVYHVWPWDTPRGPEAYMASPASDVWGGGPSWKYHTACKASERTSTLDRVMTPPGEPSI

SEQ ID NO: 1010697 - protein, 290 aa, Homo sapiens
MGGPYYLTLGRAPLLSGEYYFFHGYTNGYTWVVSNTHQTALCVWAPLWIVVAPPGGVCCPLWPRFSRPGQVCHWGRFFYRHPASFFGDCFCRGGSLLLRLRVVFPPGVLNKCSHTFVAGKKTFSRSPHTVYPLPTLGIFPERSSWERIFGWQKYIPCRVGSFFYTRAVVHNAHALVVIKTMGALQWAHKGPTYFFPHRSKCAFFCRTCGVLKCVEKESNILTRGEILQRDLSCERKMAPSPALVTHTGGRFFQRLSVRKSKDEKKAPPKVGRQTPETFGATSPDTPTVGC

SEQ ID NO: 1010698 - protein, 254 aa, Homo sapiens
VWLWVVLCEMPNQVFVWGPPRMGPVFCCGIPPGGDPNDFVWVIVLVVLSLSLPSVPLCGVNLPGWLPPFWFSHPPALRGGSMRRVPAMSIASLSLRRTRFVLSPPTGVSLPTIFPRVDAHPPPSRVRGAHTTAFGSSHHAGRLRPPLCLTLLSLRERERVCLPHGLSPPGGVSLHTIPGPACPPSVSPARLELVGGYHICAPPPPPALTEGPTYCCLSAASALALFVPPSPPLSAPFKHPLFFLFFFSPQLFPP

SEQ ID NO: 1010699 - protein, 120 aa, Homo sapiens
MVIFHPLLLTTPGWTFQWSVALTVSSGCHSRISVCIVFRGSTLHFHYVCVFIGVSYFPLETGSRFVAQAGVEWRDHWHVLSAFAYPEHRAVLTSASGDSSADHRLHARPMAQSNALHDIL

SEQ ID NO: 1010700 - protein, 240 aa, Homo sapiens
EQLTSRPPGQREARAVRRAPGPLGPINRPSKTAGFWGAPPGGHPEGYAPGISTLPRVSENPPSRFSHQSFTLETVLSLQELKAPLPDVNLRGFGSRGSWRPPALVFLVLLRQSSLVSEGPPRRRKSGHRPQHDGLWEKLSGTIEGDATRCHRGSTSPEDNLIRPNSLCHLNQLFSPTPSNTRLEPEAPPILSCQGPDRNIFSASMGPTHSHPLQLLKFAVVAQKEAIYPGLTNEIWLCAH

SEQ ID NO: 1010701 - protein, 192 aa, Homo sapiens
MGGATGRDEMFRPAFLGGGASRCFPAPPVLSPTRAGPPRLAPPGQREVMLPNTRATGVGRPHLVVSHPAEGRLFPSFFSERGRPPPLSGSVARTGFPQRGGASRAGGFLNTPPPVTAPPRHFFAGLASAAGPRAPSFFPLSRGRTRVRVPPTRGGSLLFVVNTARAGGAAGLPFFFPRDDWFCRPLFLSRGD

SEQ ID NO: 1010702 - protein, 201 aa, Homo sapiens
MTTRGTKPPTCLRSLPRSLFPNDVMWRYIVYLPCEGMMYLTGNATMARTYQSMNRANQSAGKYATEVCLWPLHHDTDSSPALDLLTCCQSRSRLHSMGPLAPPGESLPLYHPCPLRSKVSFMSALCIHGPPATPCIAICSTYDESLPSHADRPSSRIGQEVTQGGPQGVLKPHLDHPPCQVLSKAPDPSLWRKREAQGSCL

SEQ ID NO: 1010703 - protein, 153 aa, Homo sapiens
MSLAQRDAQELYDGRGETAWEQTSPRFNAVLCSRSRAHLVAVLSMTYPREEKDRDIEKTHHDRGRCSVREPSDVSGHVWAVGDNGSPETLSPAFTCRESAQLRTTRRGVTEHKAPGTLMSSHGVFAADDTTILDIRSEYKRMYGKSLYHEHLG

SEQ ID NO: 1010704 - protein, 267 aa, Homo sapiens
GSFIYTPFILCFLLYWAVFFLERGHSGRIPTHKGRTPLYFFFFFLSLIGPHHTTTLWGKGVEREVLHKRLSPQCLFAPLGAPFFKCFRTKRPSFGGPPHSNYKSVSGETLSLAHQSFPLRVVSAPIKSGAPSPTRSTVFVGAKRERPTMGGAHTTGLDAPRDTLGAPHIHRGRKHTLWAYTEGPTLWGPSPHVVEEGPPVFWPLFRVQGRQRRLVPRRVARVESLPEDFFGPGASLSCPVFGVSSCALPRFTCSPFLGFWGNLPPLI

SEQ ID NO: 1010705 - protein, 139 aa, Homo sapiens
MFNDPRDRYIWRSLYDIAKIRERDMPHPKYLPPVCEIKGEIYKPFSTLFLLGVFFELCSEKREGRKIYALQKLRYWFTINAHISLLHATEYTREKYRTPHEENSHGVFPEGTGTYTPTGTHESHGSPHKPLSRGPRTTP

SEQ ID NO: 1010706 - protein, 157 aa, Homo sapiens
QFQRAHRGPNRGPRCVRAAQRPTTLGAKTRGGHMRQLRASGPAGEKSPGGSHDSTRPWGNHPRDLWLRFHGPFKETKHSLAEGGLQASGDISSPISLLVWDPPSAKPKQGFRTHRLCWGQPPVWLTCADDTETPNHLVVESCHHQRSSEKPGSGCST

SEQ ID NO: 1010707 - protein, 102 aa, Homo sapiens
MGYTKAFGRLTPASPERCFTEHLPLLGPKGPPGPTRPDWEGHTTALHTLGTGNSYGPQVPRMEFPQTEERTTVATPPETTRASGWKALLTPLQNTTLAPPGT

SEQ ID NO: 1010708 - protein, 74 aa, Homo sapiens
LFGPSDTITTRGPFMTAKITTLCEFAVWASQVVRHNLLRQGSTPHPYDTLPEGHRGRPKQMCCTTTDFAMGPPH

SEQ ID NO: 1010709 - protein, 137 aa, Homo sapiens
NSNIGEKESGDKTPESNVGCVGRTGPGGVVARTQNGWNQHHRVWERTPKGLSPVWFSPHSGDHNDKLYGPAEQEKNGATNRVPAKFAREKGEEFGINHPTRRGFSPRENFCLGLKPPECGPTDPGRKFSCAGGFPGV

SEQ ID NO: 1010710 - protein, 299 aa, Homo sapiens
CGAWGGSAGHGGWVLSAAGSGLGEGGGVGAVARVSCDRHEGGGRRGGGGEGGGVLQRLGGGRILRGAREAVLWGAYCVARGGYSWSWSFWGGARVMSGGPGTGGVCCCGVGVATPECGGGGGVGAWGPGGLCREERAGVAAPVGRRCGCVALAIGVLVLVECWFRSGGVLCGAGQGPRCWGGAVALGRVSRGRPRGGVVVCIGRLIEIGERGGWSTRATRCGWAATLRSKQLFRHPRPGCHATTSAGGQDRKEVFVCTRRRASRRHAPREGITHIVRASSLSPPHGLFHKQDTRGGRLA

SEQ ID NO: 1010711 - protein, 144 aa, Homo sapiens
MFFGRRYLAGGEIVPTVVGARRRERSDSKTRGLCCSLCGAHNRRVSDKRERVCFLCGKDREEGEVRSLVGAHPPLWWWVEGHSTRAPTTGGAHATPLCFDSRAGGGYGGNPRGGSRRFTFVLSPGGVFVLADTCWLYVWCAQDM

SEQ ID NO: 1010712 - protein, 121 aa, Homo sapiens
MWLWVKGVGFEDAARPFTAPVEAVLLGIDELGAGCVGVRDRRRPSERLRAEQVSSSDALGTPLLCSCMRPVFQTVVPFEETSAWSLQPGEVKTVATPKCGPQSQQLYIMFEAFYKMQLCIA

SEQ ID NO: 1010713 - protein, 324 aa, Homo sapiens
RRATPKASRQASGKDRQDEPRCAQDHHRWTPRPSLWPTQKITGEDHPRPDRALGGRAKTAIAARGPLPTRANITQSCIQQTRQPCASPPFTKLGIDTIIQKALLAARHGNACKEGTGKQPRAISYTSASLTRKSSYAVLRRLASWTRMECYQVWTKRLETKPGEPPSLRQELGVDPDDIPVTSRHALTQALYRIQTSHHSVLPQASRIPPSCTVPSKLRGRILMNPAPDPRKGVLVDHSSAAAGSSHEDNERLPHSSLGSLGTPSEVHNLSPDLLPFKTFAWSFSAGSKKALQLPPKCGPGDQQLNIIFEASVKECTVIPTESD

SEQ ID NO: 1010714 - protein, 78 aa, Homo sapiens
RKVRVVEGVYVVLQRAVYSRIPPRSMKDRHYYEYVCDNGPQSESCVEESVMTGEWMLKIVCDRSAYHNYLSHAIVVCA

SEQ ID NO: 1010715 - protein, 192 aa, Homo sapiens
VPLKAEPQRWGTYIHSLTALHHSLPSVLRWLASEPPVPTSQPAALVGQGARQHDSSSSSVVLAVQGSSQGKLFDPCRWPGHSAESPSAKLGGIGKAKLRSMKERKLGRKKKQKEQEQAESHEPRWALRCRISVNKLGHRGGKGMLWAKDLRGCVRGPEEPLAERVETSHARRSCAHTASKPQAEEDEDDRES

SEQ ID NO: 1010716 - protein, 361 aa, Homo sapiens
GLVRAFSRERLSSLSFALRFVFVAFFRVLGVQLVGVLHAQCCLLSLAVVILMLCYLSAHSSALMLSVSSLLLFLLLVLYQINLLTLRWSMSCIVAYDVVSALTSCVFCVLSYSGLYHLRTQCFLMLSMKYCWLSCALLQCDVTVACSVVAGLRYCVVVRASRSLKCSSVVRFVVSLRWQAGLAELSLQRVRLLVLRLVVGGVGRCLVVECQPPFVSGGLSYINFLYRIGGAAFRALVIGGWKLRRCADRVCRAPFGGDDVRAYAFVHTALVCLLYGAPLLIIVCEGSPPPGGGAPDGFATVPFSPRRSFVFIPHIVDPPAGVTAGIYTPQRGCLTSHNGGRYSRGLLWWTPHLIGRPSYSV

SEQ ID NO: 1010717 - protein, 172 aa, Homo sapiens
MGAHTGCFSLHHKSAVATDTVGGHTEDALRGPTICVRSRLRMASCSPRVTSPRATSVYFLESQPKGFSHDFVRRWSLLARDTLQHPVVVQNNRGFPPGHWDKGDRGGRPRSWGSRDGRTKALLAAYGGLNSLSAHLTAILDHLTTKGKRTPRKPGNFPFWFQGFPINFLTHP

SEQ ID NO: 1010718 - protein, 281 aa, Homo sapiens
GRFQAPGPKLAPCRESVGTGQSYVTKGEAKDIPEGQVQARYPGLYEDWAGASPAQEPRAAVLSGLGGRTGAPELYRGVEAGEAEDTVAQACGRRRLETERKTTSGLGCPGSRPKATPSQVAGLRGPVLRLAGAAGVCRAVMCPDERPRLALVSLLAPALAYGNTVVIGAPVRPVLMLALEVCQDMATVFPAGTGQRGDRRPGPYLTRCLALHQDVQANVGTFGLSQGLHQFVRVGLGRKPQTGVGEQGLPSGHWDEEAEGAGPELGLRVARTKALWLPMGD

SEQ ID NO: 1010719 - protein, 140 aa, Homo sapiens
MWGADTACDTTPQGGALLWVVRVCPQQQLLGASLSPPWEGNHIRRVVCVRETHTHTPGDSCCPAQNTHAGAKHVVSHRKDAFPRDTDLCGFFGVRRAPPLIFRGDISRGRFTLGANTRFLFSSAIFLRRSFSWRIEVLLR

SEQ ID NO: 1010720 - protein, 153 aa, Homo sapiens
GLAVPQSRKLYDCRVDEPYVLTYGGAKPVPPSTLQRGNRIDLGLPRTYGSRRGITGKHTMPLTQGQTQSLSHSCVCTGSSSESSGKPSAVHRDACASGCEERSLTTCHRALTTYASVTGLMEASPLWSNSTSNEALLQLVFRKEGLGFGDGGQ

SEQ ID NO: 1010721 - protein, 268 aa, Homo sapiens
KAHIGGETVIMRYSVHALDVPGLFPQYWELTQGKQLLNVVIKCYIGSEGTWGLVFRKDGYRAVKYVWSGFARATSRRMNKLHWKMHSYVCRNGPIGSIRFLRKFFSIFTKDESAFVMNSYTQVTAQGYHLVSGMARAYYSNRRLVEPSGWNIATHMWNVSSISAYYSCARRNAMVTPFWWNNAQSKTLSLNQRVSIPSEGIPTKTSDGIQHALASGHQSRKGDYHRLEKAYLGPSGTCTIVHTHLPFRPGPGLALENFVPNTLHFINR

SEQ ID NO: 1010722 - protein, 345 aa, Homo sapiens
LLVFASSLFVFFPFSFFPCSFYVFILLCLFVCLSLCCISIVPSSVSAHFCCLPVFFAYFFTPLGFLFPASRLALAIFLSLSPFPFLVVYIGPSGPFSIFPSSRLKLETKSTVSWTWSEGHQPQKVARRVFYQQPGVLRQQNVNGCLRPTLRNAACRRTSPVAGYAEQSNEVLRLAMKYIGFLVRLLRDQSAALAAGLTPTRASANGRCTGSQIDGARRGSGRRAEAAARFAAPAPPADPDRQPRMELARPIKNGANRLLSPEVQGDQHAGSNLLSQEGTRDSAEGRQEYRAVDVRRNAWERTSPREKDACCQTDQAGQGLGGPEGDQSTPQGPADPVKKSPTTLC

SEQ ID NO: 1010723 - protein, 286 aa, Homo sapiens
MSLIPPWCHPNHSLGHQFSYLPRMLPPVPIPGPQSQLHASDEEEGDRQSPPLELLYGETYGLEPRAMGSCLAETGSKKKIRLYQFLLDLLRTLADMNGTASGVRWTRINGHLLSSLSKHKEALALRWGIQKGIRKKMTYQKIGRARCATYGNARAEVKKVEVKKLTYQFSGEVLEPPGDLAERLPPAPHEPAAPAGPRQGLHRLANSTLSPSATARNTGRTTPGAQMAGPVAGRGLSSHSATPRAPLQAPSTSRFASLQESPPRLTDASWASDPTGATLAEDDPGY

SEQ ID NO: 1010724 - protein, 107 aa, Homo sapiens
RVFLNHAYQLYTMWSRSEVSPNCFPNSLRGLLQTWSCWYCRTALTKYPATNQPLVRALMLTSSRRTLIEICLMSYGRAMAMSHCHDESSITTSIFAASFGARLFTRV

SEQ ID NO: 1010725 - protein, 65 aa, Homo sapiens
MLPERASRMQIQARPQRSGYQLAEERAKDHLGMTRDHSVDRGHARRLRQEEAPNGRNPVAPLATP

SEQ ID NO: 1010726 - protein, 125 aa, Homo sapiens
YTSYGDHLSKAPKKQTMWDSQARPDRPPPVPLPPAPETRLQLLRSSTEGAWMPPVDSAAPAQQAASAWVDGPPPLPSLDAIQVRYSCLISRLNGLEHTFGPGWPHLYPGFWYRGTQEEDDLREYP

SEQ ID NO: 1010727 - protein, 239 aa, Homo sapiens
TNPYCLMSGSHKESPEWRPPCGIKPPLEVRASWCSRSVKQSSKVVCDLLPKDETSKRRLPHPTVYYGTPETLVRKCSQDAWAELCYCTRVYGVPKRVVSLDAFAWTHYEERHAAEHVSVAVYKGEPSPHSVALVSRVPWHRRKVHWKTPQGSLPKLNVMTQLAENHLSLALTSAPLPSTHTAPSHCASALEPTVDNSSPYDHSETHHNHTSCTLDPRPTAQAIPCAWISPHHYCNHDVE

SEQ ID NO: 1010728 - protein, 169 aa, Homo sapiens
MGSDLIRSTSLGPVLSGRFSVDPFGGKGTRQRTNLDMTVAAYLMSAGSAAQADGGPIVKVVTPIRGKDGSVCGIDWRPDDICHHFCMSAVSRSACLLRKTRWLWPTEAQPQGSRECTEPRLEGWRPSYGCRTSPHCQWSHQKPRCCNQGRVSTVPTMRTEGILYRMYAG

SEQ ID NO: 1010729 - protein, 234 aa, Homo sapiens
MRVMTEEVVWPNTAGFGMAPGLLELSHGAMCPQRLTVAPLLHCQLNVSHGIPRCPIRRVQACTHHVSSATWSYRVHFHGTTFLAHTQAPRPWQLGLDALPPQRPSTSALLHTDFAPASSAWHAPPVTTYAAPHFFHLNTKLYGQSQWSACEHCWTSTGAIQQAGYCCQGARELVQCYHMDTRATSLGWAAMAQVKKKAVGKMGLSQGSSQSPGAEDPVVKRRWERWQLTPESEL

SEQ ID NO: 1010730 - protein, 71 aa, Homo sapiens
HLPFFPKVLKYEVGYPSNLLESTEVIDVSGSASVTLAAAGTVLKHSTEEESMVLTGYRGSHHLVERAGTGF

SEQ ID NO: 1010731 - protein, 235 aa, Homo sapiens
MLTSETREGSKGRGNSQRSWWVSSSSARMPRRQQKEQNYAAGEEEITAYSQVTSPTDLTVQQRLLQEHSELKTQSELDRINAQYLEVKVTASYDAIKLRMEELKIVVTTRYTVEKVEVHRLIRDRLEGSHSPNRRQHMENSRQVLNSYEVPWEGVRQAGEKSNTCTTSRQQTNKSVGPSHVTIDDNGLPSRALNRDHERHGFYIRLLPPNLHCNVGTTFTWGCLQYKRDVEMLAH

SEQ ID NO: 1010732 - protein, 344 aa, Homo sapiens
QFDRPSIPVTGLKTAGIPRASYHNGLLVWFLRSRVKPTCNSMLTSQPGILTGKTLHGRFTISGLTLRLPRVPSHLQVDVYSELPRAASAPSILIHFINMFLFSHSPSNRLLVPPAGGGPRHTLLVLGVGHRCPSCCLDTPLHLLHRHPLVRLREDGHADRQEENKAGLAGPCHDASVNWLESPMRKKGRGLWMMKRRPKLVPSRGAHDTRPSHTIRVLHWDASPTPPSYLAPCGAQEPGQQPQTVQRFCGTMFDAAVGHRAMAPGKAGRGGCGAGHPSLPPYCRGDRALILDCGDGGHHQPSLDDPAEHALGGIPEQVLIRHGLQAESLTFAAQILGQPRALQA

SEQ ID NO: 1010733 - protein, 69 aa, Homo sapiens
RHDMGAIRLSNLPGDEGRNPAIHPASGLKVGHETERHVIGSQRSLLLSTAQMELRDSFATCAVSGSMTA

SEQ ID NO: 1010734 - protein, 71 aa, Homo sapiens
ATLRFCQKTKCSIVDSAVEMAHRSNSQKRQLPWHRHCYEEWTRKVKRDSAPPAFPCKTGRFMDNDAGPHGI

SEQ ID NO: 1010735 - protein, 181 aa, Homo sapiens
MEWTRIYGRPSSLLSGHAYSPLDKAFPFTSSSLSEFQNEAKRLSAAPGRYSCLFGDPDHSSLLAGLIEEGSITYGHSVRCDEGLAGPGRCLAQRSSYVPSPIHAGNRAPPYTSTLSPAKTVGAQPPHVTCSPGGQPPLSMYAWEPSPCKAFAIFSHWAELQALEEGEGRDCVVMGSPANTT

SEQ ID NO: 1010736 - protein, 345 aa, Homo sapiens
LCRFSSLFSSRPIYPHAPVRQTPLARRAHVLWSIPADFPEWELGSACLSGVPPGVDDAHQGGTLGLCFEDHRLVIIHLHDQSASDVHCRIRLRGGCLPVSGGLEFGLTLRRSVSGDALPLAFWPGHIAPGGDPSTLASSLDLLPEPWHALAGAPSCRNVHPVDGYETSAALLLGTGKSPRSVSLSSTRPTQTTVRGVFACAEWKVQGSLRSPQGSAHSDTTCRPCRATPPALWLLMSPRYLYDLSKDHGENLSTLHVGDVRCRGHPRGDCNAVKQLTAAQGTSETQRVDLRPPARWPRGEDPSHCRSSMSYLACTPTPSMAAIAQIPMPEGPSGLAWACDGSSRG

SEQ ID NO: 1010737 - protein, 121 aa, Homo sapiens
MTRAPAQDIVLAHRILLLLLQSPLISSRRQSSVSGPEQRSMRMVALREVTHDTFPENGGKHAQSKHHQDTLSSIVIWTLTEAYNTAVRDSQELFCASGFLPYREITPALIEILYCLHEIQD

SEQ ID NO: 1010738 - protein, 102 aa, Homo sapiens
PLPFHSTWLLSLLFANTRRLTHAHRIRITIRPPIYNDLLAAAASSAPRMYGPLPFHFPECFFFAMTFSPLGRFITPGLCTFFSDHRNRCTANTSAPNCYAPA

SEQ ID NO: 1010739 - protein, 176 aa, Homo sapiens
MCTLQRPYILTEAHGASPFHVHIPTMLERYTVCGDHHRAQAFHVSHTYRIQRHVSRTTHPRLFDIAIGNRDSQSEHRTMIRPAQLHRACALGFPSCLRIGASKGLMLISRRALISWIVSTHSSASRVTCGHPPVQSSCLSATYGRSSSCLPVASFRHQLIPHVGHSGPVFPFRQPL

SEQ ID NO: 1010740 - protein, 87 aa, Homo sapiens
MKTAKAQNLRSIEGPFSLRTVFLFNGQFASMIISVLEIEVLYELSVHCHAMFFFFHSFFAVILEFLVLGRIKQNLKFYEIPLGNIFC

SEQ ID NO: 1010741 - protein, 196 aa, Homo sapiens
PSVFVARLSGDLRVPCRAVICSCSTVLSAAWLLAASAAAAPSSASHLAWLSRHGGTFCPSGLAGTRSVTSCHQRCKSAPSTSKVVVMLSCPAVPQPCLLSAVAAFDWPQLYSGHSASYRGSGPVLRLLHRSTPLLAHQLPSSHLPVLGFLDTRTRNGETLLAEAHIEGLAGSGMYDVTGLLDRGGGALSGSRIEWD

SEQ ID NO: 1010742 - protein, 67 aa, Homo sapiens
CVWVDGYRMISYPHLQPEGIIQTVEGEKGEDVARDEGSGSPEDAAGLAEGFNAGNGKHCMNFKQQMN

SEQ ID NO: 1010743 - protein, 182 aa, Homo sapiens
GQIISGKEDTPNGVDSSQGGIVSDPEERDQEAEGEATVSEALQAPPNRHHGGRGGDKYHSFNGEEPKPHDPQTRHPDARDTWSDGSIKEASPPGETTRSPEGLRGSDLGWLPSSCQWRDEIGAPSWGRAEGRHVPFPWASEGPGLCSAVAAAPQSHEEERQLPLGSLDHTHSPPGPAHEGPF

SEQ ID NO: 1010744 - protein, 197 aa, Homo sapiens
MLKGDSVYMTSPPWELANGGLLSRRFFETKVLNSGQPLTEFSDKGPHECVRLGLPLLIPTAIFHKGGKNRLGSFVAGLTMESTQGMIQTPNEDSVHAIGVTQFRLEKNVGGGIPPATCGARRAPTKRCGPRLDFHFCSRVRFSRASANQYAGNRLPFDSPEESIYTCLSQQLRGKVSIRQGRHVLFDLSLCQIGANT

SEQ ID NO: 1010745 - protein, 325 aa, Homo sapiens
GTTAAARKVQALPGGPGAPGGHPGDSVTTGTAEQREVPGTSIMPLRTREAEARGEDHGTNTAVLGACAPAPDQRRADWLADKGPLPRHPCAGPRAPSCLRDETLAGEAAGGNSAQGSRWDEAYEITSGLGTHPRQRFRQRHPGHLGAPVSQQQEDMVWDGRTSRLRTMQRTAKPDANREGPEVQEPEKLSHSPHPSASDTVGTAGFGSAAFSGTGVSAEAHRQPKSSGSQGNPKGSHLDKEAMGPESPTTDQRPEARRWKLGRVVCTGGMAGPHEQLQAGVLVIQQVAPVEAAGLLEGSPMLQEAGRNWQENPVPCPGGKLSPRL

SEQ ID NO: 1010746 - protein, 208 aa, Homo sapiens
MSVNPGRCFVLVVDHPYEQEVSFPESNLSNWEPKDFVKSMHQLRRNECGQAMWCHKTLNCSAHLEATFNKNSSMPSHPAYTSRPGNTLPRSVPRPLTPASSCCNVLATRLSSRTGPAASYYGELATTESRLRTVEGTHSTSIRRRFVSSHLPNHTPFLEAPRSVPLSHTQGAPPPRVDRTVTCCLIGIMSLEPGYSCAGILVYQHDMF

SEQ ID NO: 1010747 - protein, 82 aa, Homo sapiens
RRCALDRYVSWYNGWLTDSIPLLIIPSTALGALHHVPFSGRSRGLSSVPEVKKFESTPSHSIIPLKAYRFKTGGYKCFFSLG

SEQ ID NO: 1010748 - protein, 208 aa, Homo sapiens
FHIYHMGQAWLPRSAGPSSTPHEILLWPRRTCHSGAHQCNRDLKPENILLDDHGHISISDTGTKLCMVPRGPDQSKGRVGTVGYMAPEVVKNETVTRSALTGGRSAASVYEMSRRTSRPVQQRKKKIKTGGGGAAGEGGPRGVVRALLSPQAALTLLHSCLMQGPCSNATGVFVGAVPARCKEHPLFKKLNFKRLGAGMLEPPYQALT

SEQ ID NO: 1010749 - protein, 108 aa, Homo sapiens
MGRQHSIGDTEFLGPKNSPLYDTQKYRQIFPMGDVIYPMQSFSVQLLPCELCRTSKQAHDKQLESVIREKSHIVEMIKSLCSRTEAQWLTQCNPSTFGRHDGQVDHLR

SEQ ID NO: 1010750 - protein, 363 aa, Homo sapiens
PYTLDHTPALGTLHGPFQPSDTPPQETPLDLNSQKLTRKAASPTTPEDHPSRLPPYELAYTLRCAAALIYPEPYTPSPERRGTLEPSVMVNHIAPCTTRVSYPLHDVATASVSNVTVLPYTRTHKMDETVYATTKKFPRINEGSTRPQLLQPQWIVKLVTTNHMSGVAIKRTSSADVFGPPVSTSISSNTFTHMTGPFGKGRLYQSIVRQVSYKSDYENVPKSPGLFETPPVGPCALEERRLIRRPGKQRSQVLAKKAKDHANHTSGTEAHTPWNQASADTARHTLTTDKAHSLACWPSSRVAIVSQARDRVLKDEARDLMTGLIRLTSTMPRRLSILAVVSDRSLSPLHDPKTGRQQMAFIT

SEQ ID NO: 1010751 - protein, 81 aa, Homo sapiens
LSRFLFPYPPEISISVYLINLQCLCLCYDEQETHSQIVDTGYGALIAYVPLCANDCSMSPSPFDISRQVQQPLLTQQNGPV

SEQ ID NO: 1010752 - protein, 361 aa, Homo sapiens
VFTPLKSWLRYAVFRGLTGGNWTRRETFLPRCQSSTYTKCIFTNLLAAWDGPVLQCLSRSLQVTGSKSSRGSVVTNALTVEVLCFPYMGPPWCPSAPKVCWTKLFYPLRLLWVVATPCVAHRHVLLAKVTIHQPGFLLSNNLYPMSSPVLYVMGQAPPFWGRPRRTSGKYTGAHWVLGACFLAILRVFYVPQPLSTVGLGPLPSPNNLSQLLPGCPAPISDHNDLISLRRGGKGAIYRAERLRKHYRLGSRCSLPFAETGHVAVPVVAHQRQGKGATTYARAPMVKVDPLPLYHARPGHVPCSHRNRMGGSVQKLSIPKAVSVVEARLDILPLSALTPLSLFEGGELCKDIQPAGTRVACA

SEQ ID NO: 1010753 - protein, 147 aa, Homo sapiens
MCIRNSGCQIFTCILLCLYHIPANLPYQPSGKSSMLPGGLGGLAFLGSTSALNIVPGRILSPVTNLEAWLSLLRQRSPPGCSMTDRTRPLMTDTRVPDRTALVDAINGLITRPPLPRTLATSGTGPLAVVHAVGAVPLVSGPPPSAP

SEQ ID NO: 1010754 - protein, 131 aa, Homo sapiens
MAMEHNECKNKAQDVKLPWRNSDGEVSSMHLGEGDIQPIMNGKRPSSSLGLTIGQTQQQTRGATGATVGTVLRNHAQTDRFCGAQKRVEKAEGWRVNLGHIRHPHRAQHRDGLAANQARMRSFLTLACCGS

SEQ ID NO: 1010755 - protein, 230 aa, Homo sapiens
VDGGYCLDGRFQREADIVKLWLVAEEYLDPSYVIREDCSESRHVLFIVLQATSTQPQPSRQDGPRLPGERASYASHNASRYLAATLPFRTRYCRGVQPLTKYDGLLWHRLLAMVTMNCVPHALETTSDPSASSSRQGWCGGSLGRCMTFEVPGEDDESGGSYTLGRCVEVLDSSNPILVDRPPAATSWASSLPTTWHPMIPIKLFRGQKLFVWSCPLRKEGQGKKDVDVP

SEQ ID NO: 1010756 - protein, 124 aa, Homo sapiens
MLFDSTTDVHDAFRSKDRCTYIRDLPGCLERNSTYSHFYSNLTIWKPYTMLTDNICYWRFYYSSCSQIETTLLRDFKSKLEVSVIYFRVMWVRRSQSGQIKIKREDYESASNKRLPCARTPKYC

SEQ ID NO: 1010757 - protein, 289 aa, Homo sapiens
TFTTRRARDIDRNNGGLRQAISPVNPGFIQSTYTVLCCGPLTVIRLNTKCSAIANVPGTNQGVERYVAIEPGHQQRGGDLLRHALQEPVRQRIRNEPFKIPEHDGNDAEPTLFFNPDSAIGLAPEKLVGRAKTCKRRWFILTDNCLYYFEYIHGQGVPEESSPWRILSIQKLDDPRKPFCCELYIPNNKGQLIKLHNEADGRGGGKPHGDRISAHTQEEKDEGIKSIQRLEVDPFYEMTGSEKKRISVKKKQEQSDRLPPDSINYTELPRVGGQTLAWGCDPVPCLESH

SEQ ID NO: 1010758 - protein, 104 aa, Homo sapiens
MAPPTTFVQNSSSSTAHTFQLGSIRSPSLTFFHVPSSFPGFSVQYMTSCVLAPSHMPDTPPGLHLEHRSDDKTSPLVKDFLTERSALYILLISLDSCKRYHLGY

SEQ ID NO: 1010759 - protein, 143 aa, Homo sapiens
VCRRMSLLFTYVMTTCICSCPLSLVLICFGQPRFLAANLSPQDFLAGIPYHYRAASQNLIGVNPSRVVPYTLKKNPTSGGDPSAGLSHEYKVRDLRSRHNRPYGLSTMTPCRMHDVLICTRLRSHHVIDTKPLPCPHYLLKNS

SEQ ID NO: 1010760 - protein, 58 aa, Homo sapiens
MRVLESRVVVSTCGHQGAVRCLVSRHLEPFDGGGSSLLPASCVAIHLHPGLKAGCCGW

SEQ ID NO: 1010761 - protein, 272 aa, Homo sapiens
LSCPARAPCASSGVFPRCPGLTVGAGRGSAGICAASGGDRSPSGSAAGPFAPGGCGLRVPLPCAGCPALPHLLCPVSLGLPWAQRLGAFLGQPSAFMAGPEGEDLGRDLLSDLRSEKLSEQTKVSLLALSMEYPAQLWPDASAAEVADTSLLDTLVLLPPRTSALRTALLLAAPLPWRRAARWAPARAPPAGSCPYCSAWPRVAIWGEALSPARNKAPCRPRAASAARARELQPGLLRGSLRLLRGLLGQEGPVQPLQPVAGPRIAPKPMGS

SEQ ID NO: 1010762 - protein, 80 aa, Homo sapiens
MSERTLFARWAVGHRHASSPGISSPDRNQEPLANFFDSDSEMIKHEETSIHWKSAIGVYFKEIMSFSKGLRLQRYFLQYA

SEQ ID NO: 1010763 - protein, 296 aa, Homo sapiens
WVIWHPVLVGWYIGVFIRCALLFFPLLFPFHLRSVSRKFASNEIHWCLGHSCLSSSTRVSPSSLCVLFAQACVFLVGPLCPLLAVTLWWPSFIGRDSIAILFCYPIVLAAFVFSALNARLKFLWAIHKTALLTLDYCTHHLCLSMCLRFLSLPLGANLRDACPPATLFVWRFLAMARFVATVSCLAPRLAMVLRRETFLSDSARSCSAMTFCRGLIMPGTATTSYNVMPAPHLRFHLYTKHVGHAPLVISVHLWTSTEEPYNTAGIAAPGGSYEHSALHPRKPGTMHPALGSGGNK

SEQ ID NO: 1010764 - protein, 80 aa, Homo sapiens
MFVEARDAHVDMLLEYFPPALAICNSHLWTHRAQAQLTGSTGTGRLGESADLQHDTECLQLGTQAARDSNFQEYDVGTQG

SEQ ID NO: 1010765 - protein, 101 aa, Homo sapiens
MAHTTVAYVRCPRAPVALHICATEGRRRSARLGPLRMAIVGTIFVLVVTALRSGRRRGSVAYVSWYMSVAAGDPSCHAPLTTASQAGLLLACIVVGWGYIV

SEQ ID NO: 1010766 - protein, 82 aa, Homo sapiens
CFQTPRAIVNPILEGKGSIAIYRSRRMDIVNDLALFSGRDFIISPCVILQNSFSSSPFLHGTLSCYITLQRRHQSASSSSSC

SEQ ID NO: 1010767 - protein, 214 aa, Homo sapiens
MEREVRATDYAPSHQSVSGRALPCNERRVVPQRSTETSGLPSEEGLFVLCYSSYSGTKGRLQPPSDTRQVPLMDTEPSWSKYPRSYSLNSIRCDSATSGVRTRSSVLTRHHQDQPEDAAGVVCGMRTFGRFGLQQVQVDCNFLQLYLWRFVADEELGHLLLDEVVASAEPCACPEPVPMEPSVDEVICERGYAQPLQGTGLSCTPCTITRGGSF

SEQ ID NO: 1010768 - protein, 130 aa, Homo sapiens
LPEGGLQVFQSLTPSPCRASPRSCLEMNAPEFQGLKRLSARRCLASSLNPFRVQGLLLANGQVSVVPMKISRMLLARAHSTLGKRTCTEVSSRVFDPSRLGLPLSSGLTQRMVAAGQWCVLRWLERNILG

SEQ ID NO: 1010769 - protein, 300 aa, Homo sapiens
GKPFSLGESNIRASLDVSSPGPFMLERTFLNREDRFACFGASYPRRETNGALLLLGYQSPLHLHSDPGEPLQRKNALGGYGWDRVTMLARGLRMVTGGRRANRLYAKTRHGRKSLNDENALKARWRESLELGQDCSEALGTSPSGLARQGTEETGPREGASHRKTPEARARRTTCAASVSGVSRPPVNHTCDKNVQCSATLLGPAVDPGLSSAIGTSDMVSTGIGPAVIVQATTCQVGLCYNGSAWSARSAERSQKATPQVPVLRGPPASCTQGRSHRTVKPEPVTGTEGCRGQTGTGAN

SEQ ID NO: 1010770 - protein, 66 aa, Homo sapiens
MSNGSFVPGGACKRQLVAVARQLLRTFRSKRLMGMTPWEQDAGPVLEALRFDGTEPGTEARERHRA

SEQ ID NO: 1010771 - protein, 341 aa, Homo sapiens
FVPRGVRRRGLWCHGYAVFRDALWHGSRHSVVVGIVVRSQRGTGRRQGLFCPGWFPGGRSVGPRDGRCLNGDGAVKRGGGMAAPGSRRPGGCYRAAPGGAASARGQARGAPVLPGTGLPVYTDRLCVGPEHLRPGTCPAHRGGAGDLARVPGRYPSGPHPWTAELEGRTPGYPSGACPSAAGLRLKAPTLCSWLVGTGCMSLRVLTRAHGCGPSVAQDGVQPWRRSTTWTPRRPGEEVSLEPTLEPLPGTLRTLTRVQTTKQLIPLVPRKGSQDLVMAQPRDWDLEHDLLTSLGRTLPPLGSGPHASKWHLEYEQRSWLQAGLACGSGIGPAEHLVPLMLL

SEQ ID NO: 1010772 - protein, 263 aa, Homo sapiens
GPVPAIKTITITAMGKVDGNVPRAGVLHTWGPKLTWTSMSWLLCWAPLLRVPVYRHVLSGWPALSSLFGIRTIMKHDRHQDRDELEKLMVRIGVFSVLYTVPATIVIACYFYSKAFRDQWERSSGRPRACKEHTRIPCRSPPGGGGAQPHPPMSPDFTVFMIKYRYELIVGITSGFWIWVRQDPQLLEEVLHEAHQQQTRGDYSLRPGAQRHAQASAGAQRSHKASAVEFVPILDISRFPQLDNSVSTGSFEQTQLTAKASRA

SEQ ID NO: 1010773 - protein, 144 aa, Homo sapiens
MSDAATLPHAHLPITSVENAPMVGRRLFFRYSSQLLHTNFAIRRNFLVCQPTLCWTERNGHLTRDEHVLFEISDHASDGLLTSYSASEWHRDRTGLGTQGTWLSQLVSDENDAKILNDEQDRFEVNNSELPDEKDISSYIEQTR

SEQ ID NO: 1010774 - protein, 259 aa, Homo sapiens
HFQIPRRGKPIKSASLVIPNNPDLCSVYFPLRNRKISPVRCVELLRVLVMHLIFGPSVGIHAMSLQSLLVKPANRVPFLGGYNFRLQPRISTDEVLSLLVCRPKMETRVSEVLHACSVPGPYLGHTTKSICAQVPAVFGLSGAHKASTIWDWHSWQSQCDGVCVALPREKTCQNVCHYEDTQNTPFPTVLYALVVPVLSSLSDRGGEACQTLSLVLVQTAHCSIHSARVIAGFGNLNRTFLPWFRLHVTNKENGPSCDH

SEQ ID NO: 1010775 - protein, 109 aa, Homo sapiens
MTFLPSMPCATAGTSRVDSRPSGARRTTASWSLPDKQVLTRRGTRRGKLPRMDPGDLTDANLNLTVDEGVTGGQSTSCGRWHSPSTREDQLGLYLLSLEQQNQRRYAQR

SEQ ID NO: 1010776 - protein, 188 aa, Homo sapiens
MSGGHARSAALLSAVVVGAHAVTALPSRFHAAAQPRLGSAQVRCPAGIVVSFCASPRRHRSPRTVRRTLSAPVRATFPAHVEEPTRPAQGLDISQGWRWRRAADPGEKRSGQIWEHRASEGMGGYSQDQPALLTQGVLKKRGEGYSSSGLALRRAVVAEAAKAATFRGKVIPGAVGGRIPEAHRGLTG

SEQ ID NO: 1010777 - protein, 70 aa, Homo sapiens
MSEVQLCHGSAEPQSPEHKLSVSQGHHPHHLGLTPPSSMDSVATGPCILLSVASGVGAEPLELKTAKDSD

SEQ ID NO: 1010778 - protein, 151 aa, Homo sapiens
PGLRSCTVKPGTRNAAGTTRRQFSYGRADPGRGPRRSLLTKRVAAPQDGSPQSPRIRDFSWVSPKWGLQSPSSKAPRSPPVDNVVRAFLWVEAPQVFPVGVLRLRFDLNGCCLKTLVRTRCLLGQNLPVVQQHGDTPGYCRLDILTRSALG

SEQ ID NO: 1010779 - protein, 364 aa, Homo sapiens
MIRRSKRCQLIWSETEEKDNLHKEYLNLFMNFRGCRLKMVIYQLTDLIDYFEAGTLGGAPCAPCPPCTARADATLKAPPQTCTPHVHNHTQPSIYPYPFTNPSHPPLRTRGDRRHRQTLYRRTSFTFYRTHLTGRRDTLAAGAPRPRLWNLANKQHDSRAGTSALAPACTATCSETQTDVPFWTTPTRTHTCSHPPSPYTSISLPSFPTRPTPTHARPLPCRPPLVIPRHHAPQSVSTQPVSGCVMLTQSARPSRLQGVPQPPRPSSPASSPPSPLRRLHRLPSATSLSPRHASLSPLPPPSRSPPLRDLLPSLPRLSSQPAPACPLLLSLLSACPPGVFSRLVGVGRGCAPSSSPALVRSRVW

SEQ ID NO: 1010780 - protein, 279 aa, Homo sapiens
MKRWGEEEKRNTERIEVERSWKDTNSDGERYRGTTRTEEQGECAKKPKTRERGTGTEQEEQRRRAGEDTREDERKKRRTAKQRERRAEPAGAEERRGRSGEAERTRRAAREREKSTPRGEKGQRQKTGGKRRGKRREHREQGRRQGQKNNAQAREQRGNRQEKAKKRKRRRREDKKSARAKENTEETKAGRERESRGRGRRRERGEKEEKSREREADGREEKKREKEEDKQESEKREREKTEKEEGKGRGEKQAREEAEGTREEARETDGRTKRERGKR

SEQ ID NO: 1010781 - protein, 130 aa, Homo sapiens
MGQPGKAGGAFFDGTPNGKPLRLDHDVTAAKWDEVVELDGPLGIVNVSQSVLAQSMYGIVLVITRPIAKFEASCRRVTQLTSVHSLGLCVICVSVPKQWLPFEGRPYSYDNVDVGHFLWRYGHSAGVEGD

SEQ ID NO: 1010782 - protein, 618 aa, Homo sapiens
RGAARGGAAGRQEAAARHAWQLRLKLPLTGTNRTTLWTCLNDLNLLCKPTANCDFPSRWAKPLLLLKPNSCCALHTAERTLTHTLLSAHTGAALCSNSHAARELSTPQTASALHLHCKPQPAPLTLSLSNCNTNPDIFSHTATLTYTPYTPLTLPKTSITPCTTANKTNPSSPTLAHHAKALPSTKTPNIFQHFQTPIVDLDANLSSHNPPKLSRAIPLKHFVPNPNSPAFPPPCFPLYWRAKITGPTPLCGSPLLITQGRPLSVNAADPLSKQAKGGQNTPFTWHDTNPPTPRAPHQGQRPHPKKAPGQNDNRFINAPTGRYTPGARPPPPTVGAQNTPPPWCAVPTDRARVQDEPNMHDGDGHPLQQHNPPQNPSRARLSIHHQHPPTLPHPTPPLWRRNHTRPPPTPVEQATKPPFRRRRAQQQPPPDPPPVGHPPPQCGAQNPHNCPSKTRRPPLSTTHFFSPPHTSPPNNSLFFTLHTHKTPKQDVLLYRHTPPHPGRPLNHCPITPRRCSKTNSSIAHHTRPPSTRIKRTTIYTYPPLIHVTTLKPHKTTLLPPPTTTYYEAAIDPHTSLFSQMLNTHLTTPRNMDDTPHTPTNPTAQKYTLIFQYPTNESN

SEQ ID NO: 1010783 - protein, 179 aa, Homo sapiens
MWVDEKHSVEDTRGRRPLCEECVGSKRGKSGKKFIQRRSSRKLLWTVLRGLGRQTSTVVDKTRGAGGRNKNKRGAERYTMWKRLPCGYNGDKDFGGRPFRNSYIKQRKVYPQGGQTSDVGDQPILLDRQQGRALFGSHTAQCPKQCVVAHFTRQPVGGGDLRWTSWRAGVNAARVGNIP

SEQ ID NO: 1010784 - protein, 59 aa, Homo sapiens
MQSAANASLYDPRAFTLEEIRPEAQLGSQADSKPLQPCQTQPTPFQTAFLRRKYAWGFQ

SEQ ID NO: 1010785 - protein, 392 aa, Homo sapiens
GTVMSVRRHERVRLRCISARELRARCAPSKPWSGPLELRPGGALVVWRCRCPRPLNTLEWLFRGHTVFGMTCIDVQGTCCRPTSKQPSDDVNRDVTVVKRLVAQELVKACLTRKPVTPEYGRYHAGLEWDFGLRAYYRRTMLMWDRAGVGNIGELLQYNRKYNGRISSANYLGDGPRKEPVRTLDGNLPYLTGRAPSKRYVTTRRVPCVRGNHAITGAQSSEGDMESRRGRETRHIKKVGHCGGNRYRVPKLLDPDNLGQALQQTIGFSHRKYKCGSPGFHFPEVVCSISEWTQRNFIAPLFRSSSPFGKSPRRPTIGYLVKVLEEGRQSKVVGPSRNTTEPGNGYFATVWPKDRKIGPRGWPTLWVRNHQEPQVPLGRIFGAPPAAVGGRP

SEQ ID NO: 1010786 - protein, 177 aa, Homo sapiens
MPGLGSPPRFPSAAPGNGLLQPLVTEEEAGGWRRRDGGGCRPFGKLPDPAASDEEPIGGFLARLSLRNGGPPGAGPSAPLARRRGIALPGSESGGSAELVVVTPGPRNQRTPARYGERHCQLLRAARWGRGRPSKHAQCGAPGPVRAEPRCRASGSSKGCHIGHRITRGKKLFPRDG

SEQ ID NO: 1010787 - protein, 107 aa, Homo sapiens
MSRRQRLTRSRWLVKRGQDPEELPVVQEDAVCPVVLALASRATSCEERLKEMEAEMALFEQEVLRAPVPGIPIAVPAGAHVSPTVPTVGSESRSAAGSLMNRVLIYR

SEQ ID NO: 1010788 - protein, 286 aa, Homo sapiens
IFPSRRFGVKLPSASTPGISRSAVSPMTRLRAKSGPDNFYSNSSTTDCTAVKDPVEEALPCSYTNKDGKVIHEAYGFPVWVTGTNGSALKRRDSVLQHVSSSCHRLPCKKDSVQRMAVGGGGAGSSPRPRRLGPNVCAVNGRPGCKGHASDGNSQKMSLGRAPAFAGGSVNPRTMGPLGFRLIRRAGRKLRLRTDVYFLRLQHSGSEKFSASGDALVGYLLSVTLGDLKALSIKTMLQKRLLGGVTGLCERLRKGLTLSPILGVQWAFLAHFSLEHPGDRAPANFP

SEQ ID NO: 1010789 - protein, 395 aa, Homo sapiens
RGLRYGPGDDNLFERPKHRVSNDLTDGGQPTARIQRGTRGNLKRRGRTLHGGQNHEISHVPTEPTKRPPTQVPPGQGFTESPYHRGVTPGVVPSPEPGQAYGTKSLRQVASSVAGPCSGSPSPGCTSMFRHGLSDGKGTYLTLARTESLGDAKRVPAPRNLFGSHIAQKSFHEAILGSWKDQMTTVNSNTATQKTVGRDHQRKARQRWTGCPPEQCIPASTGACRKLVTKVIPELKGKLDYGIGSSWVPNPLDVSVVDHDLAASPEPALLSFTPYKEAVKAAAKGTHGLASLRYTRGLRYVSYWTCRTVIHDIRPSLRCLRPACALNDNLSEDSCVMVRQANIGLSVSRDGRPRCRYMYQPKQVKREGPFFPSKGTGAGKVPPVPASGCYGRDTQ

SEQ ID NO: 1010790 - protein, 37 aa, Homo sapiens
KASYPITSLITCENTADIRRGPASPDQLRDNTPGRVA

SEQ ID NO: 1010791 - protein, 37 aa, Homo sapiens
SSARERRGGVDRSNLAKSRAKSVPGLRPRRLYGRVRL

SEQ ID NO: 1010792 - protein, 255 aa, Homo sapiens
FGPGGTVMETVREHQGQDYTRLQAFVGSRKKQQYSRGPATPSPNPEQRLNRQRGLCAGLHAAGEDPSDKADKTGPSRPHQAHGFARRTWISFRRPRGTLVLHSIPVLAGGLSGKTPYPCGHIRVVTQRRPLAQGGTLRVPGEFLQWNSMPRLPTDLDVEGLWFRHYDFSRAAGSVPYPQEDRRGPLLAGCTPCGAGEIGFRCTQHLIPTRAPPSEPRDEQQCAPILRALHSCGDPLGKFSVPCQASRSIWARAHG

SEQ ID NO: 1010793 - protein, 105 aa, Homo sapiens
MGCLPYSTTISTEGGRLSITWILAADYNDGVNTYDVLRQIQVCLCQPCRFQRVRRSFWNSVNARCQNDDPVFTRKAESPHMSEMIGEYSTLSCSGDKSQYNWSSL

SEQ ID NO: 1010794 - protein, 258 aa, Homo sapiens
ARKANCLEKLGERREAARTALADPAQTAATIHQRSGVPNANSTQSRCCWTVVEPRLAATEHVDIQNFSSKPGVNGSGSSVPLVAELSSLEALRAMGSLALMNRASRTLRGWPVLIHAVTPWRTARSSVDNEDSGRELRELSDWKCVYTYMPGIATACHGPDEGLVTKPDKVAKPLLRGPTDAGGLCDTVEEVDDMMIMGKKADPKWSVTYVQSLYNHLDATNCACAARMFSLPARIGQRSGKLPPPLSGHRLLPVVRP

SEQ ID NO: 1010795 - protein, 102 aa, Homo sapiens
EPVNARNLPPTGWSQRDIQGARTPTRWPARATRGRSIPWVSQHGGGLPRPQRSPSQLPETGEKQPIAVTCYPKDRFGAHRKLSEPLASYVTSLHLATMMEPK

SEQ ID NO: 1010796 - protein, 147 aa, Homo sapiens
MKNQNRSRMPWGKCKISRFLFVCSQHYNEGTVMKFQKITGDARIPLRIVDCLYPGAPRCRTSTTGFRNIPSNNVGVPATEQRQESFEGFIARMCSPVSQMRASGTGSQRKEEEWSRNSRSSSENKTKTGDIPTDTLISNSLERTCIL

SEQ ID NO: 1010797 - protein, 271 aa, Homo sapiens
GPFEGPGPEAGTEDAAATSQSDNATEKNAGPQGDISQRPESYEETRQRQTATETPPRPTTTAPAGGHKARSQQPGFPQMKNEETVRTDGNQCPHSITRLSGYSTYDDRQLGQPVLPSRDVTRPSGSQGTGGPYLPSGGTRPIGHPMLLQPGSAVLVAHQRHEQDHVLQKVQRVLEQRKGPQSPAHAPEHILGDCVLSYRAHTSPFLPDRSCFCCNGAYGLTHLLGENLAPEGSVQKGYCPLGLSWGKGSSGAVEDLVQKVGLFFPKYFSAG

SEQ ID NO: 1010798 - protein, 257 aa, Homo sapiens
IQWQRGATGRRSWAPGLGRYAPMAWSWTIVFLDADIGGRAQYHTCPRDAVATSREVARSPATAAEAREGSSATWGSVNVAFKVTPVCDCVPAPVGDKKLMRDLLLFHERTRIASYKQPAGRQGAAPTLPTAEATLQKVTGGEQAQPPGDQEPEAVLAMLRSLDLEGMRSTLAESSDHVEKSPPVPPAGHAGHTGGFHAGGNEARQRTEQKPESVHWGVRTKGGSTMSFLWDTASHQGSSPDPVDASGEAKDKERSKV

SEQ ID NO: 1010799 - protein, 174 aa, Homo sapiens
SCGSVPPLYARLSRGETTYPAVPTVWRHTRLAINGDPMPTVTVSSLLNLAKATGVSHTRPPFQTVSLGENSHNSRASLRKSKPVPARGAFSRKSQTALQVLDTKAVQGLLATSATLARSSPSTTALDDLMRHNAQYYSMKIASTHSDCNMTWCPGAKLWRTGQSLPSATSSMED

SEQ ID NO: 1010800 - protein, 102 aa, Homo sapiens
MGVCMVLCSYASAPGVAMRWVMHCFKLPRGQDCPTDDPSYSTSRTPPACQPPLVLPPYLRSCGAHGSITTATRPHMSLGLTGSSHGPASCLAKARGLGWERL

SEQ ID NO: 1010801 - protein, 102 aa, Homo sapiens
IDVFHRLVAESEGEAFIELVQIGVWGSWLHGINAAEKQNRVSVPDACQASIVVASRVTYVKSDEQAPLTRTVTPHIVTPRHFNGTERVLESLCSKAEAICNT

SEQ ID NO: 1010802 - protein, 241 aa, Homo sapiens
MRVSTCVDSMISSIASPCADVAHMVVYVLYGCARSLGLSCMDGRTVIDMSNQGVLVSHGALNVARTPVRRYLPIELTFVLRMNLSCNVSPNIEDITRLLALAILSGTHFDKDGWSLWYLTMYRFPEEAHSDLCMSGNLITGMFHALDKLRNECLRQCHPVSEPDNSRSISGVLGHSEARSIALSAEIQSWQVDYESYTCAETGSWQRGDPDAGFESTFPGRGPSSMGAKAFNQGKILIVNI

SEQ ID NO: 1010803 - protein, 484 aa, Homo sapiens
RPVVGGSGLRACVRRRVRLLVCAPIAVLLVVRRFSCVCVLLLFVSLRCCSICLCLLAFAVRFSRLVSRRPRCSCVSGCCAAPLLLGSPVFPSVVRCSCLRYLPRVFVALALAVPGVVSAWRLAVLVVRLVFLTFFRVCGGASRSRGPSLALLRALVCVLISVPTVAGASRGSLLIAVLVSWSFVFALFVLPPPFSFLLLWPRSVRSSMSLCPVLFWPPCTLVLYCVSSHLFVGSSVAPSYGSSLLLSLCVPFVLVWVYSIALGPSCYFDCSPNCLDFYSRGSCLVPRSFWVVICRRSLLGGVPVVPAVFHCVCSATPAPCFLLLVVHVIIMDRPRDASALSFLGRCWTNSQYSRGPPHVYGTLNVDRAFWACRGVCSNRSTGALPSGRYRSGWFCIAACKFPDRALGTDVLPCWLLPHRCPREESSPDRDPSAIWHCVITDQLWDCIPCRNLPAVRQGGPLLSHICCILGLRDPDQMDLQGAGH

SEQ ID NO: 1010804 - protein, 285 aa, Homo sapiens
LFFLLCLFSCLPSVSYFLCLFFVSPSFSLCHCTRSGSVGVVCPPLSFLVLWTLLLFVSSLVSLCNCVCFVSCSLLYVLSPLGVSPVGLFWLLVTVLVSFFLVICLCPPPRCFRVSVFVVFLSPVSLVPSVPASFPPLVLAYDLYTVSLIPVDAALVLWFLVLFFVLSSRSVVLWLPVVVLRVALSLAFVRAAACRFRPGLHVNVSLAVRLWSGIGLKAHHSVMKISGIVSDGSGSLVVAISMPDYMSCMHGLNGPSIPRCGDSSGCSLLCIVELREDFQQWSEEK

SEQ ID NO: 1010805 - protein, 265 aa, Homo sapiens
LFPAWLIAVFRDSCIAVGLGGRLLPVSAAGLPSAFVGGSYPRLLGHWAGALFVDIVTLADCLSSVDCLLRYGVGCLYVPTCYVLLCVFSEPLGVVGFVRHCRPCDTFCSIVFMVVVWCPVMCAVDMVTGVVLFAKFVLSCFLSVTFFPNFSDSCTYSTALQHLSTCTWRYTTGSVPCVGSTENEGLEVSWASLICVHCVRTVRRMSSSVLAASEPLRPMCCADAGVILRVLDRIGGLLSASTSDEHATSTCTGQQEEAHMFAHEG

SEQ ID NO: 1010806 - protein, 111 aa, Homo sapiens
MVSPGCYLRNIVRNCSPSIALVIYRTKVFVLFGLSTADSDGTYMSCTECSVKCIVFIQIIMSRYLNSETAMTPGAWHYRQVHESSIRNLQWPSYRPYLKSLSRRLLRCLPN

SEQ ID NO: 1010807 - protein, 146 aa, Homo sapiens
RAPAPARHLAPRPPKSPGHPSPIHRAGCASPGTFSAPEPPRTLQGPAVVARPPPPAVVWGGPPVSGLQLRRIPTRTGALTRRRHCRRRRRLRCTRRPRRTAREPGSAVVAPRPTGFSPHSSGAIHSTLTANRSRLLLSLIITASVP

SEQ ID NO: 1010808 - protein, 133 aa, Homo sapiens
PGRAIYAPRPPKYPGHPSPIPQGWGAASPWNCFLCYREPPLNSPVAQLVRGSAQYAHAVCVTVPASSHVQYQTFADDAQTSDHYVPSHIQSQGLTANYVWTATVRTAHITVHTTTDTDTHWLRQPVHSNPLLP

SEQ ID NO: 1010809 - protein, 243 aa, Homo sapiens
RVEKRFKIQPEEVVRTEVKGPMQPSGGDPSHHPTPKLKTKSYRRESILSSSPNAGLQSGPSRMLLVSAREPGHCFHAESVKRVFDKDKSRNARYERGTAFRTTWSPSSGLKWPVKPFQLKEEELGARQSASLQWGLPWQQVRMGPPVSAPPPIRPLPGRLGHPSASPPPSLSPVGQPACKHGGHLATDRQEELSCRTAMQSLSGGAGGLALSLGVISLSPLLYPYHLLEPGRLWRRGKILASG

SEQ ID NO: 1010810 - protein, 109 aa, Homo sapiens
GPAGHCPMVFRISPGGVPLGEKCVSMQGAPLEFLTEFTLLGFVFRATPFAYTLFGTSPPPTFYDTKLLIYRWLSLLYYKGYPPLQYFLLAPQICLKYWVSPWGELTRGT

SEQ ID NO: 1010811 - protein, 316 aa, Homo sapiens
GTFHIVYAVVRDQLVPATLGLKPTCSGALPKLKANALTYRELLGLTADCTDVHQEGTLGSPYIGSYGEKLKPELMGLIRQQRLAPSSVEGIDSSRKITQADGDQDKLSVHAALSTLTTTLLLVTETMVREGAARPRPYPGRVLRLSKLPSSAVQVSGTSLTRLSDSLLHSHGKKGIREAEQGTFYELAIHQSAMTVGRRKRTSNFIAPLTSGEFIPVDRLGSTCTLVWSAHEGSRADTVVTWSSVSDHNGDPSCDLLESGERAHPPSRRTPCAPTLSTNFNFCYDCSIAGLDSVAGHGLQLRPLQQSMKLRRGGGV

SEQ ID NO: 1010812 - protein, 71 aa, Homo sapiens
VDTVDVLPGPVGPRQRVLCNIEADTYWCMSKLLDGISGMKKEKRRSLVVRLENWYTFIPTLRPGVPRTYRR

SEQ ID NO: 1010813 - protein, 254 aa, Homo sapiens
SLEKHKPHSHENCMAAEASIGGRRPDEESGFPGMRGTYKCGEPPHKLLRPLGTVLLHTLSSQRAIHSCDTAASYLRVVEELSRTIDLKLNIHLAPGSPGHQGQPLDAMLATRAQAYHSSVVKHIETILASPDPALSTQEAGVTSSTSLPVPNMKEGERDATFGLSLELIGQWLSLTEWVQVWEGGTRGRKGASTHVRESACGLARQPQCHLTFLVTSNISSPWMSPVPPTSALHGHLSATRRQPSLLIRQGDAA

SEQ ID NO: 1010814 - protein, 288 aa, Homo sapiens
WELGKGIISVVNVPFWVGKFLTWIAPEVSSCLNPPVYWMNPYVTSQEQVGRNPEECPTIERCSNPSGLYPKGGRAVASWVGARRRVGHGMLVRCLVSPFNPQDVKPTFLDASQTAVIATLGSHLCRNDAFHASLSMSCLDQSRKPTDKIMMRASPRPRGVPSEDMIRYPHQLLQCTPWPPGLHGTQLAALSGMWTVNDLDGFLGVGSPKQTKLSHRTPLWTGGSVTRLRKGEYAGGPEVGIYHGTLDLPCVWTFCCWIDMMNTLDPITQIIVPVQQQQSGWSMEVHES

SEQ ID NO: 1010815 - protein, 228 aa, Homo sapiens
MQAAPLTATADEPRRFTEVVCLQANLESAGLRATGSPSMDLHGSDYVKGTVVQVMECRWPMAEPSTILHTLNGCPTWEQGQDRGIPPRITHSSGTAAQTRTGCPVKLYLALVVITRMTQERPRKESFKRHGQPARSLQEKSVAPPSDKGGEVSSGCPAALMDVEDEFDNGKRSSCRQSHQCSSRRQHRKPIDLSVSKGHIKTLLYGSRFRCFNEEWKLQSFSFSNTAS

SEQ ID NO: 1010816 - protein, 194 aa, Homo sapiens
RRNWPQSGANLIRFRTESLPGPFAPMRAHKHPVSSLQVCVGDTRESCQPRGGTSVFGRPDANRLHSPTADSATHVEPRTKAYPIPGRLSVRSTYVHHSHVHGGLESHKCRKSRGCANPLGMPQSEPLGSHLKLALAVCSCSQGAAFQRKSLVSLGHRAIAQHTECFLFLSQCTSYLRVYVRGRECVSCVTPKAD

SEQ ID NO: 1010817 - protein, 110 aa, Homo sapiens
GENAPHKGGKNHGNPNKALTKSHNASIERTFKDHVHPNNYGMGAIQERGNPDDHKIEEYSSSIYTAGNHREEEHDAKAQDGHGAEGGIDRAPYSAVNRYVRVVRQDKKWE

SEQ ID NO: 1010818 - protein, 106 aa, Homo sapiens
WERRNLRYLQDRESKGPGDPMGLTASLFGASNGASRCPSHCCVHLLGTVEIPGDKVLIQFGCTEIGSVDGERGFLILSRCTCAAPIQDRPYVLLVKVTPSIPVLHT

SEQ ID NO: 1010819 - protein, 208 aa, Homo sapiens
GEYNPEVFDYTYQFSNDIRSSKEKELVKKQLKKHLSGEEHRRYLHAYCFSVMEQPRNRHSRNRKQQQELHLALKLRTSGSGPAGPSADTVRGKESEQRQLGTSCTKLQGRSKLQQEILENFIESKEADEMTGKVQEIIVPLTQESNKELSSALPLPQGDMDAVTDQSLVHGMVSSSKGQGSQLPVNRAIAYRDRLEGSVDYPSGLQQE

SEQ ID NO: 1010820 - protein, 184 aa, Homo sapiens
MAQKYCTMVFVTLWPFLWGPILFAFADVLPFGRPAPLGPIKFRSDQYPVGALSNSASWHLALPSIGDFPSTSQAVHGGPFVEAPSPAAALVPPPVFPFRRFACRPPYYPGLGSPLPGNGVQLLVPCFRGPSTPGSFSRPHVNAQAIAHGNAATWTRCAKRVDSNPNSVSDRGDWAAATDVSYGA

SEQ ID NO: 1010821 - protein, 131 aa, Homo sapiens
MLHFTCPVKIRIHLSPGVPNLCKSRYLHRSFREFGSLVSTSRFPQPQQHNNAYQLTRFSVPRSQGLSDSYIPPYRTRYTALAQTRLIRSVKLTRDNLTFGGYLVLLIFKSQKYTVFTNTDPKPRNSFLKIL

SEQ ID NO: 1010822 - protein, 66 aa, Homo sapiens
SRIEIERKQDSSSSTDSWKMAPSNSQYCNNDRVRIRTITRIDILVVNCPRGDVLAVIKSALPDLNR

SEQ ID NO: 1010823 - protein, 270 aa, Homo sapiens
MDRTSGPGARMVRLMASSVRRSPSYEGYPLPSITEGMDYAGSDLTAYLLGLAEQSRGTNSTQDQMGIVEDIKEEMLAFRWPWIPLRRRKSLSVMHTIRYVLPDGKGDYSCAQEQVPPTSEMFFKPSAHQQSMQLGLHTQTSVRALTSETSPSNWDLMGNIHALLGAALIAQVAFRYPSAEGAKQHVSPSDTHAGKRAALKETCVRVERWLHPGLTLRVSNVIVGHTAVEYEEHRGLSFLYQKVLLNGDEDGHCTWQVPTLRQGDTLRDTG

SEQ ID NO: 1010824 - protein, 246 aa, Homo sapiens
MRQTQQIGPGFLLCPFYAFLAWYEEVVQNLACSLDFANDPLVTICVPLCPALVVECKFSMPFYVWLVLFVTMSFALYYLERVPVLTRLDHRQIVERVNLVCHDRKHVLAWRSSIGNSLSVSTAEGANEEHMPSMVMWPSQSTVATLTVCPLMSLWRPGSQQRGLSLSLLASMMNAEWAITYAGYTLLFTSLSANGNPWAQRRRSLPSGPRLTLSLVSTGAIRTTLTQGSMILFESSAQPRRYKSHV

SEQ ID NO: 1010825 - protein, 424 aa, Homo sapiens
QPLTRVVVSTPYTPYTHTSFTRRLHMSVYDDGLYSAGATKLLMFAGCSPHRQCTDPLARRAILNIRREHVVKSASGYDPAHVVCPHSTHGNKTAWQARALRESQKPPEEVFVPQRHLAPLGLLVVNLSIACTGVHKSRLRVVPNLCSQPRPKCGAHIDLLPRAIIVFDYGHCYPPRFVTHKLRDHDLSALSRYYRPVVGKLLSALLRVGALVGVFSTNTEQATLLSGLRQEAYFKHLLFALVSSCWANVGGRALNPPGIFSSNMPGSPYMCTPNRCSYSGACCFAAQIFGLSPPLLGPFPFAEIILQAGYYYFRGHTKSFPKFAPNGTSPAVVRRSSVPLLFPPTGGTFLLVTHRYGGNDNGGNANEIVGVPTPPLALNPLWGNPLQGPGNKSSQRATRAHPLVGHLYGGNKVRLRVDISRRYI

SEQ ID NO: 1010826 - protein, 218 aa, Homo sapiens
MRDVIGKRLNHKSQNHMSEANKLCTQIVGSESETEEHRNGDQWSYCPVAELYWRSSSHTIALPIAPAGLWPSPRSTGYSTWPPETVLNIGNMRSSFLGIPEQALSLLHMAIEPMLWLDGAILDKGRSHVLEWPSARWLQQLPNDQPKKAEALEAAIENLYMKPRSYFAKGDCKERIRERRLLPRPDSTIPGEDSRRGTGVRCSSGSCHQEHALLMGYP

SEQ ID NO: 1010827 - protein, 218 aa, Homo sapiens
TALRLRDLVLECLDCQETAEQLRLGYMFGFLALPSSWPFDFATVKRVQRKTVEERIRLGKYEYAKDSSIRWVPRSPLPMGQPFLSVSPCTGTSSSEGRSRPPPAAAVGSSTSPSTKPQGTDRMLGTACYHNASGNACVTFSDRAQIAPIPTVLRRPVGTRNRRDKDRCGPAKGYQTATTKPSHIQMPRGPGNWLVTAWTRAPRGGRGTAQRPSRHASF

SEQ ID NO: 1010828 - protein, 78 aa, Homo sapiens
GITMLNDAQTFVRNGFLYESTWRLNLKGVKFLIFVKILYELEEFDRNLLTLSGYENGAMTTKCRLVKLTCFINVGFEI

SEQ ID NO: 1010829 - protein, 376 aa, Homo sapiens
KRRTVTPGRDHGPVLETPIKDGISLPDSMSQYGKKCWREGVVLLHVVQEAQSVRGSAWRAVEVRVMVGWEHAGDMVVSGLVGEGSDGSSALADCVSVRAGYGESCPPGRRLPFLLTTTERKPLYWPVSGTARPGWGPNLRTLALPGVHGGGTSLTGSRREWCTRRPHRKGVWVRPIGVKKLRICSLPGQDGAAEVSPDGVSCTKRYGGPDEPGSLPWMGAPLGTMTCGCHECARESVLLPEACKGQASQRGTSAQGTPYVNTLLGLPYHDFTRVQTEDLRVFRTLGVASRIPSRILEGPGPGSHLATASVGWGGGRDFDGRFLGEPLAIVLHPYATYGCTGAFGGERSGGPIQGLVRAWYSGRSPYYILDRPRVGA

SEQ ID NO: 1010830 - protein, 143 aa, Homo sapiens
GSDPRWWFQEPKAVFREGIPGAGLFIPPGGGQFREVQWLFALLRRLFLEMSSTSSTIKSGSFRQLGTYLVDVVSPGTAVGNTWTKNDLPDTPVNLTDDWDYQAPGAGHVKFAIMFANLWSVPDVGMESGVGASTLVDWVTRQT

SEQ ID NO: 1010831 - protein, 169 aa, Homo sapiens
VGGRRLQRGVSWGRCEVCEAEPGTCALGALILNGDAPEVALGSPVAAAAIPWEPGGWVPCDGYLVYGLSHVAPGAPPCVARCLQRDVELLCELRAGSVRQAVISPCNVFPLGAARLAKLVKPVRPCQAWHAVPHPAGGLATTCRPLAQALAGQWEAPIVFVGLDTFFDP

SEQ ID NO: 1010832 - protein, 131 aa, Homo sapiens
MGHRALLCYTLLPFPHSGGPEVMGKQAGQYSFVAEELNIYIQYVGSSFGQGPACELVWVHRGSTASCPLLLLVVTPLLSAHVILPFSEPTQVLIVTEDRKVSNGGQCIDLSCSPVHTADQRERLSAEEAPC

SEQ ID NO: 1010833 - protein, 189 aa, Homo sapiens
MQRKLLGAGPIGLQEAHSRTNWRETRCVGILKEIRGLQRYKRWWKGEKKHLAYLTYVKNGGSAMDNKLLTNQDKTFTEDYHPIETQISKKEVQAMYCVQQIETKTARSPPRRKASKKGTPPRSPCNLVQETLFHDPWKLLIATIVLNRTSGKMASTCAFGSFNGEVSIQLRLASNSTSTAQKTVVTNCL

SEQ ID NO: 1010834 - protein, 163 aa, Homo sapiens
EGCLWKKGAALDGGPCRVNTGTGQPGGEPGRLTGQAATTCWLQNERQSLASPGNAGGTPQGFVKALAAPAPKDYHPSPRRRHLGDPSAFPTGGREVDIVEDSRDKAPPTVRLTPDSGGRERPTPGPKPASQLYPAVDLGPFHPWKIVTADHWTQDLDSKQIPT

SEQ ID NO: 1010835 - protein, 59 aa, Homo sapiens
GRRPTPTRDPRKSSTVLTDDNTYSRGACLREMRWDPGVYSVACGAWMERHAIRGPLRIQ

SEQ ID NO: 1010836 - protein, 110 aa, Homo sapiens
LTCVLRVRLARRGVAWAGACELSIAGRAEQARPLRRVYHLSRRETSGETKRCCPVLRVVTTTCTYGMSTFAHNKTKGKPLYAEPKNKQGNGIYFTRTTNAWSSMDFYLPK

SEQ ID NO: 1010837 - protein, 233 aa, Homo sapiens
GRKRTRAKTQDIRRPKGGSGESSCSRAEGKHRLQEESPQPPITSIPSDSMPRKRHGADKSNTETRRQLGQQKAYCPDDTRRSGRVDSPETVPTSWRKGPTEGEQQGAVGVARKSPREWTYAGLPTDYKCSDQLVRDTRPYLQEPEIVGRLSWTLDEDKADSQAGRTNCSVNTLPPSFSFHCPPRPAGTGRPPTPPIKAHSSPHVPRRPPRRAQQGRRSVGSLRVHGQDSVPPR

SEQ ID NO: 1010838 - protein, 123 aa, Homo sapiens
MHDATTATGTAKRRRSVRGRWRSRNRWEQAETRLQTIGASRRLRSPLSLAAAARRQLIQRRSVPAQRPDILRRRSVRRLRIQRCTMDDGAKVVATDPRGPQGSRLFLLLRGPTLSTPDPTVLP

SEQ ID NO: 1010839 - protein, 99 aa, Homo sapiens
GRIRLIRETWETGGSVEEDDRYTCCVRAMLCVCKFVFVSIQDYFLALSRKFHHVLSARAIKRLGAQDRDFPLPAAWRRKRLKGIAPAEFRHSLIRGGRD

SEQ ID NO: 1010840 - protein, 156 aa, Homo sapiens
MPAPMTYRRPDTYRNHMPGQSALTCAAPRGMIRARRPGPCTLARSHPGARPPQQHYGQDRCPACPALIHENATRRVTSVFLHQPAQEETKRAHAMSIALSISSLVFKEAVWYPGGIDIAFVEFETMRVQDRGSIAMPCRAFKITQNNAMKISFAKK

SEQ ID NO: 1010841 - protein, 103 aa, Homo sapiens
MPEERELLGNCVAISLDHLYAVGRYCDVTYPVERDVPTRCGAPEGWRERLETRIVDSAVMPLDSCVGGHGLEMYLAFLSGSSPEGGVTGAAPKSQQKTLLDGM

SEQ ID NO: 1010842 - protein, 235 aa, Homo sapiens
FLFQKGQQRGPQRRTLAERLEQGGATVKRNVKRGVREDSRKPSSGEADLLDATVNKALAERGPHAHEFPNGERIVKKGGRNTASACAQDKERSFSSGLAKAHEAPPPPQSPKWEEQQTSVLAPWWGYNLPGDPARRRNTLLVMFIQPLGSPHCKKVIPHFTATADAFKDDRKIACAAVDCVKDKNQDLCQQEAVKGYHQLSNYYASYGKFAEKYDSDRTELGSTNNIRALTGGRP

SEQ ID NO: 1010843 - protein, 41 aa, Homo sapiens
MGSWVHNLCIICTFMYLGAGSSSGLQVEPAYRLKIPDGDAW

SEQ ID NO: 1010844 - protein, 66 aa, Homo sapiens
AHHEFSCEGPMLALELDPALTSPAELTWESLKGHRATVSQGKKGRACRGDDHDLEMATRNRDHVTR

SEQ ID NO: 1010845 - protein, 117 aa, Homo sapiens
MESGPFQREYTHAQFGKQLAVMLHAEGLGSGMSVLSMRDVWRWTLPHQLTRNALVRATNMALYSLLSCHHPCVSPSFVSQRLPHSPYMLGVIRSIKATASLIHCPSLLSSVEAEHRQ

SEQ ID NO: 1010846 - protein, 275 aa, Homo sapiens
LDPRRRWTRSVSWSWGCAGSGAHPLPLPLLLPHTHMCIRSCKDECLTKTVDPQRRHRPHQAPARQRSRRRIPTRQTLPHTRRPTNKTTPQQPHTHPHPQHTHATHTPPTPRKPEGNDSTHNPASKHRRIHQSHARHDAHASAPTDERRSTTRIRSVATPRNVTRKRKPYTPTPPIRRRHNPTQTIHYAHEENGKKHEPNGRKTDRPDTRAYRRSERRRRLVAEAQEREKQGPDGRLGLRPSATITTRTAPQRKTARNNSNKTAYTTTETRLPKLH

SEQ ID NO: 1010847 - protein, 67 aa, Homo sapiens
MPLQPMGEEMGKWSQPCTLQGKAGPATVGLGTISNHQRGEAEAKALARLQPQALEGLVRPTYVPGPL

SEQ ID NO: 1010848 - protein, 113 aa, Homo sapiens
DLSPRNCSIRDSASVSAADGETRAAAGVITKTSSTVIPARCQDALSLHVRKLHEMTEVMADCSGWRAEHVRPCRRLAMGRATHSPSRRLSVGSRHIPHLIPGCTYNPEYRIAD

SEQ ID NO: 1010849 - protein, 76 aa, Homo sapiens
ERMALTLCIRFFRGPLAGNPGALFVTETLGTILLELMVTITLLPWKMQTSALVVAISFLRSCGTAGQTVYPLRGDC

SEQ ID NO: 1010850 - protein, 254 aa, Homo sapiens
DGAPDGGIEQMGLVHGALEGPTLGRGAALGAAGITCASSSSWSPSCKYLIILEARALHGLVASVHVRHRVATVQATERRAEGLYSQLLGLTASQSNLDPRTLNIHQRAPRMPSCRCGWDARRDLDSHQLSGFRASARVTGVIYTILIRGHMAAIILSEKQFRDQFTGTMNKSCDAWVFMLNQKVKTLECGDSQGEDHWHYGYRHSVLLKKRVAEEQVVECVKTRELQQQERQLAKEHCGRCKPLLALDKDKFEM

SEQ ID NO: 1010851 - protein, 83 aa, Homo sapiens
ATVSVLCTFSKVCPAILDAVCSTGSLSGPNFGSETVDISKTKFSGTAPEDDAEDARVGSLQGTGLHGRAKGIPGQRCEIDPRV

SEQ ID NO: 1010852 - protein, 262 aa, Homo sapiens
GGPGAEARPGQAQIRMLEAVCREPGLVRVHCEAARVATIRQISLELCGGSWSRSAVSRRARFVMKNSLKDCCGSGWAPRGSMTTFLILSKGETNVYFKLMRLPGGPTVTFQVKKYSLVRDVVSSTAPARECEEQACCSIISSWYSHQLWPTEWYACDRLMATYVPEICAPPIDVQRGEPLNTHQGACLLIDYGPDSQERGASGMYRQSKLCLCGAESRDERKLRPRQNVLPDMSRHAEDMREACMAHGRGAVGEARKSLTGN

SEQ ID NO: 1010853 - protein, 141 aa, Homo sapiens
MGALRPLVEAQDRQSRECKKFILGSSQSDMSIIKRNWRKPRGIGTNRVTRRFKGPGSVMPNIGYGEQLEEKQKHMLPSGFRKFLVHNVTGAVNAADVLTNSLLCLRSLTRVCSSKNRKKPSGKELPNWPSESRKPKCQAAQ

SEQ ID NO: 1010854 - protein, 226 aa, Homo sapiens
YSQDYPWHSSTDFLRDSKMSLRGRQRPSVKDVPGPVVTCDTERPGTLQRHLHEDGIANPEWLQDTAAVQTVFGVRRHQDLRETWPRCYSKVPLLTSQHQGRHLRLHPISVNRCRDICVNDLVLRDDMIPAKTLVQVAIYALGREPTFFFDPEIFDPTRWLSKDKNITLLPGTWALAWACAAVVWDRRIAELEMTIFLINMLENFTVVETPKQPAADVGHQQFNAHS

SEQ ID NO: 1010855 - protein, 172 aa, Homo sapiens
MSRTRTWAPSSRILPRRSPHGSSPTRSVILSPRSRSGSQNRSIHGAVRRTKLALTPRMRSSNSGLGLLPGPPRVSYKPHEPTPARSPPVPERPPHPFPRSIVIVLEICNQFAIPYLLILLLVLLRPFLSPPLPIWTSNRRPVTDSKLVKSNNRTRRHYPVKSLSLVATQERY

SEQ ID NO: 1010856 - protein, 250 aa, Homo sapiens
MGRVPWDCAQIFCADPGSLLRMEAAKARFQDRAGRSLRQNGNGGITAEVMMGILRDKESGICMDSGGFRTTASMVSVLPQDPTAAHACTFISRTRPEPQSRSSCFKPLHTSGVRGRPRPSEVHVPPLLEQDPCIGLLPPIPDSGRSSAYPLPWTPGSLGLMERDQDRGQQLQQKQQDLEQEGLEATTGAAGRRVGPTPLGAGQPRPGLREEGEPGLCVSFIASAGMGWTQDPWGLGVLSGGKVENNFTVM

SEQ ID NO: 1010857 - protein, 292 aa, Homo sapiens
HAGLEHPQALMQPAPDEARRTVAGDSQWSMARVPGMDGELLLGIVPFMYMSVSVIQASAPILTPVIQESRDVQRWKQRMEAGIVLSKLRSGCYCHDTGCELAARDRIGGEKVILLSASAWGSITAVTPLLSHLGGSALLVFMTFSRILMGLLQGVYFPDLTQPAVAEGAGELSGAFTYRIVGAWVPDLGRCCTVGGVAPLSWHGTGGTSIFVCLRRPHLAWVWYVYRSLLMCIQDLILALGVLGPKAGRCPWHERRGPHGDGLFPESLLSGQPLNPRSLHACSVLHPSLLRA

SEQ ID NO: 1010858 - protein, 156 aa, Homo sapiens
MKRTSKLCIYLDKSIMTLKTPFIEKYLRRQLTKSRPVILDPAEPTGRTWVVETQRVGGSWHTEAEALAELPTALSNRDGVPQMRLHGFCWSESKSDATYGVITLTYPKDGYQETKVGYIGKHMRYPHFSHRPRRIPGSIQTHKAKKEGLCPCSNRV

SEQ ID NO: 1010859 - protein, 111 aa, Homo sapiens
GPSSCYGPPLNEDLSVLAILLVGPIWALLSREVECSTCWGEVERVCTSASIWHDRKGNVVHGAAPDLERDGRHGHEMPSGNHSDETYRPEQASSQECINVLLQYGCPDECV

SEQ ID NO: 1010860 - protein, 172 aa, Homo sapiens
MRLPATRTPYYWGTARPLYVLSVNTGVCNIAEIHDARSLDSGSRRHISFRSLSHLLGLPLHWSTQLPCVETRPIGLHLRPREHRRHSEKRCKTCPKVEDESYYVVMRCLGPSMFLFSSVDTQRTSGLMTSGLHFVPPMGRMMPEGNGSEYGVQDRNSGPDSTFPSPGGLNRR

SEQ ID NO: 1010861 - protein, 283 aa, Homo sapiens
RSVADEQQRESRGNPGKPGLGVAATYDGKQYVGSPWQAPCASAARSAFFPVERIVNSNGELYHEHVLRVCPVLPWPSPRGVFYEFEGRKYCVTRLPKMLFAPCCGSCGESIIGLWSSRPVNEQVAPGLLPAASVCDVELADLGFVNECRAGNLCPDLATTVTNVPEACAKVHHAMLVATVVIGRVSPSVSGSQRLPTLTQFNWHPPVGRKLDTRMPGELERVQLYCLPVANVTKNWGSPPFVRGHCRAGQFDGPDSGQMRLELSTLAQLDAFWSVQSCDNAIL

SEQ ID NO: 1010862 - protein, 172 aa, Homo sapiens
FTGYTFTVCSMNSYPLAYTLLDLPANSSLASLTSSKRKGPVIEGFGNMAFGSASFGVFNHRATFRQEAPGLLTGRRSPELTFRTGTLARYLGVPKVSHKVACVYRPCQGPHRPPSILSHGKSTCSSCLPQPPATGCSTPGRRWSRPRMVVLALAMVPMPAAMAHPCTYMHRT

SEQ ID NO: 1010863 - protein, 374 aa, Homo sapiens
SSSCAGLQCTDHGAGRLQAQWASEEMKPPATRALRGGAECEPEPQIPTQAWVLVALERGLCEALAQLRRLSPRGVTGTDLRAPNHMAADQRPKADTLALRQRVISSSCRLFFPEDPVKDLSVPRAQVPLLPMNRGARIPFDLPISNCGRNGWAQLGNPFSVVPRPGTMTPEPACSNNQNSRVPCIDKPFVATYCARRPVQQNLAGASFSVVVTYFPLKFLGSKNAQLTVGPCRPWLRHLTPGTTRTGWVGIKINAYHGPTFELPLIWTLRVRFQFPANLWIGPRQDGGVQGWDPSSQRAYGGPLKRGGTNPSTRIMGLCQTEGETVVVRKLPRTQGSEVWQRFSDKFFGHVGKGGYNPRCWKFSKGTRIRKGGG

SEQ ID NO: 1010864 - protein, 239 aa, Homo sapiens
MIAEVHSVDADQTSSVRKPSGGFCLFRGHPSRRPSGRAPDAMVVPPQVVTRADDQLLKRRLAFQEPLDRDPQGLFRAVKERGTWLTVQPPAPRTAEEGAEAITYPGHRAVPGALLKSAQRGPVCAHTQHGGVAAPAITAMPGTSVQIKSLGSQLATEARLIGAQEGEGVGREEAKAHGGLGTLTDTRGWPPVLTVWALSPSLCSQRTTEHELTGCHGAALIGGLRPVAGRVELLIFLRS

SEQ ID NO: 1010865 - protein, 161 aa, Homo sapiens
GLDVRTLLKAVVRTLAPHSGRPCALCTGRLYARMRLCLRDKRFPGYIKLCYSRMHATDEWCHDVGKAQGERCPMPPGASRRKMTRKLAALPEALHISGTPYEDNADNSTRTRDQQPHPGSRSAHRIAPPADKVSGSPEEAGTEHAEPRLPPPPSPSGTLGI

SEQ ID NO: 1010866 - protein, 366 aa, Homo sapiens
GTFPAFGVRGPWPLLAIQVTKGFLTALRVLGYLMPGAKHWETRMGTGRVDCGSGSLILGEHEIDEMLDGTALKNGFLRKIRSGGGIVERSVTTLDGYCVKANRRSCAIRTARFESLPLRTAILGGSSQTSASSVKAEQSMWETLSQVDQFEDGTCTEKENSPEKFSPESCATDACGLWAERSSVTTIGIQHTRGTAGRMACKNDASAVHSENRSASQWRFAILEPRAMLDHVVPNMLETLTDRLMMEKKNPRPGQEHEADEGSLANSGPGLVTSRSRTRLPRSMRQETWADALSPSSRQGQRRGDNPAQSVRIRAGVESAVFQVDPPPAQQFHLKSPNPAPHPTLHTPPQSAGVRKKPYFKVVFCL

SEQ ID NO: 1010867 - protein, 102 aa, Homo sapiens
MGQPCGACAKTAREGLALLLLLFSVLVCRSAGHEPVCEPGRRAMGPSSARQQGIASALSAEAVVYASPCLPAGHGALAPLFVPCRWLPEETPLTQPAWAADH

SEQ ID NO: 1010868 - protein, 265 aa, Homo sapiens
QDAGQELLGWSGGGGMSDSEKLNLDSIIVRLLEVQGSRPGKNVTCCQRNEIRVSVPEIPGDFSEPAILLELDGTPQDLLVTYTASIDLLRLFEYGGFPPESNYLFLGDYVDRGKQSLENICLLLAYKIKYPENFFLLRGEHECASGQQIYGCYDECKRRYKSNVEKPSLTVQLPAHRGIVDEEDLLLHGGLSPVTAVYGADSADHAATVCDWTQGLLCDCCGLTLSKGRAGWGRKQTGRLFLPFGAEVVGQVPPQGTTWNLIWRR

SEQ ID NO: 1010869 - protein, 78 aa, Homo sapiens
RVPGRYPGNAPGIGSTVETFEKTKPGAKRTPWVRDLQEKSKGADEKPDNSRKVNTAFNGIQGTSLLGDHFVRWAESEF

SEQ ID NO: 1010870 - protein, 233 aa, Homo sapiens
MAVVRCLRVIYPVRVGSWAIKLLHACSSCPMSCSRFALLAHRAWAPGRADGTWGLSRLVAVADQKLAVLIRQIEALNTVLEHQCFASFVWACSRCVPLARMPLLQGLPRTPSRMTALDIQEYASRTGAHCVRARFRRPGMSTCPLRDSRAAKHSATHQSMARTLPRALVALATQSSCHGPGMSWCQWPRNLTFPSTGDACLGMCPSAAAPAVLDFPSFPYPRVAGQPWFGQGV

SEQ ID NO: 1010871 - protein, 205 aa, Homo sapiens
GTGGQRSLYGRRYTVMQEITDGPRAIKSGKDTAGGPASQSKAVLTGVPGPGQMSPPCLLSSWGPTMLGTLRVEGEWLVRARSPERREMQTVRPPSPEQASGAPVTQDGKKPVHSLSTVTGLLVSRRIPLVMGGSYSPMVNWVSLSDIPWLRAWVEGALGRRIVRSWVLVLQCCWLAYSVYATSDLSREALVATPCSCGVPTAHVV

SEQ ID NO: 1010872 - protein, 195 aa, Homo sapiens
KLLRRANSGREQVAMTACNGCRTSYIVPHGVPEKARHDPGQPGSSTKDQRLVATRPLPVPSNCPEAMISVIANPDNATIPITAEAVFKKHGVYNPNEIFGVTTLDIVRANTFVSQSCRVWIRARVNVPVIGGHAGKTSHPPESLSAPLKVDFPPGPADSTHWVGSRRAGTEVVKAETPEQALATALQWRMRGDPL

SEQ ID NO: 1010873 - protein, 182 aa, Homo sapiens
MTPQSPRHGNRVTARTQTGVTPGVDHSLVAPGKRGVDVPGRISRPRKAQGPGLRRGRPLIARVSVRVMSVETNWPVRGQLHVRVLTVEKLLHRITTHRVRAVHVLAPASCSGPLMPQAGAALLGHMPAGLGRVAQGGGRTMLLWYASLPFMPMLDCPCTSAAEGTQRPVIRRHPIVQVSVQR

SEQ ID NO: 1010874 - protein, 155 aa, Homo sapiens
MHRIRGREVFLTTGHLTGAPDPSAFRCTGARANWKYRSLEPDLQVQSVENMAVQFVMGAQATQESAQGTLEDEARYNASSDQETIRVTKPCTRQDQRAKAQSARNGKANRSKIAKPVGLTEGGPHRDVTTGAMAHALPALRPRVCDTASAFLSAR

SEQ ID NO: 1010875 - protein, 152 aa, Homo sapiens
MARVWSLMSVPHHMGSVAGGAVYLSVRTGAAGVLAKRARQPYMKAGEVVPHRHVPVQAVLVSADRPARYPSSQTPPTIYFPIRDSWNAGIMTVMSALSVVPSMAREYSKDGLVKYVKARPSSQSQLGAVAASGQNGQGMSTDLKTPDVGPHS

SEQ ID NO: 1010876 - protein, 105 aa, Homo sapiens
CVSVKYTEVPWPQKIPFLRARITAYRTLYSLIVLSSAHLCLTSLMAAYWENIFSPNVPRSQEHNTRSTPKNFAPLCMSHLGIPYTYAVVSYLCLTGQNITGTFIG

SEQ ID NO: 1010877 - protein, 233 aa, Homo sapiens
MSDLQLDCALDLMRRLLPSRSRKISVTDRLVPSLCEDLLSSVEQPLTNWQRQGDGNWISFCVIQRDGDSYRSPWRNKYDPPLAGWWPCRQRRLRKLEVEAKDAFDQYRDLYFEGGDLICLPLGSGSWLCWSDPHKEGWRWFKEDRKAAGDSIHVVEVQEKLQLGGPPITQLTSTVMLWLRTKANLALAPMNLGGGLPDRWRKDETCAVTLSPNIVNIGRWLQDHGNSNTQTYG

SEQ ID NO: 1010878 - protein, 198 aa, Homo sapiens
DLSQQVERTSSPVRTAEYDEDSPGGYFHFFSNLEPNGKLQPRLPGDSYTSSMLVRSGVVLGPWGMITMGPTCCCPVRLGLGGPIGSGPPDSSPGYTSGDLAGILTHALEVKTTVHGVLNGVAHILRHIMTEFAPDLRCCPGPPSRSSLSPASVVQAVFGRQRAIMLLEGQKVIPRRTLATGYQYSFPESGAALKEIVA

SEQ ID NO: 1010879 - protein, 288 aa, Homo sapiens
IITIAFQEKLLIPVSIRNGCFGDIEGGSFLAPTNRGSARSEEERLMLAIVCSGDVHPARVLVIGEESRDRHFPCDPLRVGTSARGAKGGEHRHASSCARTLAESRCQASSRGPPGALSLRHHARQRPDMAPPAQKGRAPVIPSPVAATDPVRSALPLPTFPSTGQPQGPKPHPLASASSRSCPAGYGSRECLVTNGEAGSQMHPGRYSLSTTTSESPCKVQWACKHESVALQGRTKMRVIRSNTAYTKRMPFVCQMRGNASQAQAATCSGSRRRKKTTFDIDLYFVYC

SEQ ID NO: 1010880 - protein, 235 aa, Homo sapiens
MKIWVETHSNERIPGMSSDREAICVTVAEGISSLCMRVNVWKRLDDNQEIDSALKKGYRQRLDCTCPRVFRKQLVVAPEEVSMEIECHNRTTREENKSYKTASEVTYSENSEIGDDPSAICVSAEPKKKKSYDAKEELDEVAIRSRVERAWQQPGCADETERESTPKEETAPMTAEEAGPQKWLQGKEVILRRRSRSDSGPEEAGWQEQLQEEENSSIKHPRKSRMQMTVLVGYG

SEQ ID NO: 1010881 - protein, 317 aa, Homo sapiens
RAYGSIGNHFPLAEGPPRGDPPALVKIRAQHPGRGPQSREPTLRTQSAGEKGTLGPREPVGLTARKRVLPVGRSFRHGVPRKARARTPGPTCFDTKCQRLVANPGPACLRPEHWPGSHDTACNANPVNSTIPITAEVYQEAWRGTDPNNSCFGRDDPGHRQSQHLCLQTLKGSGLLARVERSHRCIWLAIDWEGPSVPPSDLLSSTPIGGLSPGPADSTSLGGSMEAGTEVDQGYKPEQALATLSMAYAGDPRLSSALVDDNEWKGRCLMAMFTVLKYTGNGMYLAFCTAPLLLGKKGIEESNLGIGKRRPLVERGR

SEQ ID NO: 1010882 - protein, 248 aa, Homo sapiens
MFHDLFPARSCFWRSCGPPARGASVMLSTEVFAPPTRGDTQHLFCPATFWGPLSFFRGGHTLCGRTPRGFGAHTTRYSHEPGVYPRFPGVFFSGGVTPLWSQDLSSLRAHPLVAPSPWLAPLSRVMPQRSFLWGPQGGFFPAHRYGFLVTGGPPHGRSSFPHWADIFAAPPGFATKEWEAWSPGGANCVSGANDNTCVHTSKPWGCTAPVVHQSYNLGGKRFWVPHWAPGLYSSPVSHQSLSYNPWDT

SEQ ID NO: 1010883 - protein, 115 aa, Homo sapiens
ACLPPLPSVRFFPSHACEVLNLSQHEAHYCPVATHLSDNDAVIKCSFTWERWPSSNLVSVRSLLPEGIPVLENAMNRANPEKCACTPLQIGDFLGQDTFSGTCMPLTKPLSICRR

SEQ ID NO: 1010884 - protein, 350 aa, Homo sapiens
LSVSRRENTERDTLGWSSFRCDKTDQLRESDRVLPSAVDPRTRECRKRRTRSRQGDLPLPAMGSQGQDPPHGPILANACLIGGRCQGSASEQWRFQCTNGCSAMIIRAEHRPNPRCPGQTAYAQAPDWTKGGIGLSDRDLSGHRQMHTFLSRLAYCEVTLLTQLSLFATFRYVATQSHVCTREASREMVDVCKRRNTQAPELRQPRGRTCPYLDMVSCRDAEEVPASLSDSHRERSSGLARCSGQRMPRRRCARDGRGCPAIHEPLSTGHKPGDHVNHVERFTGEARQQHRPITYLPYRGRPNGAASGLRLGLLEAQVRHCSTCCTSIAVSQACPETQVYRKQVESKSGR

SEQ ID NO: 1010885 - protein, 137 aa, Homo sapiens
MVVVCSRGGAPPTDSGGSPPSSCWSMVVVLRPLLTPPLLCVGTAAVFCGGALPRVAPPEEKIGLSPQHGGFMAARADYFGPPQGHLCGPPPFRSLPPLLCCGVAPPPRGASSPRLLYTSRAVFFLRRIFFVPPGGFF

SEQ ID NO: 1010886 - protein, 107 aa, Homo sapiens
EAGVIAKEEIVRFGFEVLYMDSCARHRIYTLLSRNCWVRACTTTSSTMSYSVTSLAWAMCLLLDATASEGLYRFHVFEKHLYNAAAFKSPEPRLEAVCRDQAGQTCL

SEQ ID NO: 1010887 - protein, 99 aa, Homo sapiens
PNSDNCTNVTVSISSTACLEKQGHSMDKRYTSSAFSRVCLHTLQIRFTYLSNFSRRRIPYRPLRDAFGSVSHRVVLPNACDLRRSQTSICHEDVTPSRI

SEQ ID NO: 1010888 - protein, 132 aa, Homo sapiens
EGHEGDEEEERKKRLGPGGLDPVEVYESLPEELQKCFDVKDVARCLQDAISKMDPTRRKATTCSACTDSGLEGPQVKASEGQGGRGGRSWGPHYWKLFHKTDDEKDRQVVTCPSYHRHQLPGTDEPLGQKTD

SEQ ID NO: 1010889 - protein, 133 aa, Homo sapiens
MAPWSTWEPGGLGKLSSTGTYTERENTSIGARLHTQPESGASWCTATAPPRPLPPNAHSSCYVDDHGTLWEQSRTVPGVILGILSVTWDWLDRGSWHWGSGASKPVEDPGGLRQIPPSDSVLLVSDRKPRQEQ

SEQ ID NO: 1010890 - protein, 77 aa, Homo sapiens
PFLSYSFFLAFSLGVFFIRGFCLGIRILISGFFGFCLSCYGYIGTGLVSLVNTFLCLTLQGASYCPLCLLYGGHPLS

SEQ ID NO: 1010891 - protein, 148 aa, Homo sapiens
TSYHPEQTPTSWRPTVDITPLDVQDRAFPSPTLREQEVKPSKGKPTVTYPITSWAYPKTLISLMLKWKGVAPKHMRMGGYGTNPLALSPIQWFNGCTRLRCVCFFEWQAEYFSCREACPYFCFLYLHHHINVRSNGSDMSALRALDPP

SEQ ID NO: 1010892 - protein, 76 aa, Homo sapiens
SLRSVLLSSWRVFRSLFSLLSFLLSPCLVFVWSLFLFRPFLSSSSVLLFLRSLLLSLPSSSSSSVFLVFLSFCSLR

SEQ ID NO: 1010893 - protein, 298 aa, Homo sapiens
EGSGYSGGPKLERACLTGSARIRQLSPVLHGPLRGQWRPGLGSTRRGESPSNPRRKNPHSRWLFPDGVVPALKLTTLSKSEGLLLRPLLDLGTWGPHGGGTRPVGWERLGEGNCFEPPCTASNWEDGDRGLSAVVAGEALVTRMGFRRIHAAAVLLEYGVPIPEPQKRRGGREVARLSPGQPQHGLRDSPRSLAAPAHRWGSWIGIAIMTQCRPGGAEPPSLRRGPAPPGRQPLLTPVLSLQWTCSAMVGFTQMTIWAKGKHRSYLKEFRDYPPMRCQYHLLLLAYLLGYLNPYILGD

SEQ ID NO: 1010894 - protein, 227 aa, Homo sapiens
GSPHCADGGSRNSNDGPSISGGIIHVGPTLRALYCTSQTLFRYKEPRCSLHWVSYRTTLLDEYTQTPHQEICHFLSYGQQLPSRGTMRDVLTLTLKQGASRLSSIEQEVVRPDSGACQMQLRVSRWKHDHTASNSGHVALRSTYLGYLSVPPKIPCAIQESMSHQKHSRGAMVALTLKLMYAKATEIELMESCAPQQGAPRDHLYYGITVSSWNTNSSVAYWSARIY

SEQ ID NO: 1010895 - protein, 238 aa, Homo sapiens
FFCYFFLLSVVVFSVVSPSLCLALPGLPCVFLSSSFLCLALDSPLIWRLFAWLLASSGFVLYFFFSRLAPSAIIDPLRWPVGSSVFCPRRPVLTPAAPLRPPYTPGLTTDTVPAGPDMTDGRPRRPRPPDVDPELLRYLPGTEFLDGKRGLRRVWARPAPASAVPADTRVWAAEPARPEGVLGALTACETPRDPRRPRCLHAASCQPEHCPDPVHHGTQKCPPPSRHKDCSPPDVRAT

SEQ ID NO: 1010896 - protein, 93 aa, Homo sapiens
EGDDIIIVACEGSRISCHVTLCCLLVEDSTVRSEQREYLHLPLTSSLSTAACFPLQLPACEQKKSTVRAPSQHNTCCRRSGVQSLRDFGVKIL

SEQ ID NO: 1010897 - protein, 174 aa, Homo sapiens
GIMGELRGHHLVLVGGCFSVGGENTSVIGARTTPLGWGPPPRFVSLRFYSHPTNCCATVTVTTKVVSPLGGPPRRFSKTTRGAPFSRLYHKIFEKNLGLLPRGREEEKIGPAACYCVDNTTSGRQSCLLCGGVGPPHFWAPTTEELCVWRRFIKTHLGAPLTTTTVVLVFTSGE

SEQ ID NO: 1010898 - protein, 289 aa, Homo sapiens
GASPTGPSEPQLQEEKLIGLMGHSQTSSSNSANGELLPVVGDPAAVAGGRIKVPNDSDNALLRATILWEQCPAEPSTLIDSHILKLEQRVMAPPRCTIKPSGTTISVTASVTIAMVPPDQPEVQHESSMTYGQPVLSAQDGSTGGRTMRTQLDLRRFRIYSNHFCTGVAGSDPITGPSEDLLQIGVMPMLNERTWRGVQIPLPEGNQTLQCIEVGDETIAGFLTDRGVICRPFDQMGSTTSVISKNLAMHDVGVHCPHTVHSSCNEPSIPKLAAVIQDPNPSQPLFSTL

SEQ ID NO: 1010899 - protein, 83 aa, Homo sapiens
MPSCCVTPISVLGSDKPKSFLMPPLLHTREIARDSSCDFVTTLIPFKQQRRNYCFIGLYSNLVMYWPEINVVQNVKCFYLNIR

SEQ ID NO: 1010900 - protein, 150 aa, Homo sapiens
MGAIWGASQSSKSCPRGCPGVHALEAREPSGNGISARRLLQLPSWRTNMKKIILSTAKLFLGGPWLRNPRALEDTDLSRLYTAHIPDADFDRQSLTEEDFTAITSLKGILLRKKVAWRYLHRDLYVPLTAGVMAADESVGAMKRLRNHVQ

SEQ ID NO: 1010901 - protein, 164 aa, Homo sapiens
MANCLPCCFSPFHRIPISFPGSSYDNPCSIPPGTFGVPNQDYEFQAKKLAHTGHHLYPPAPLPCRLLHRNARLRGRLTRALLLLVRCGWTSLIRGWSVKSEFVFSEGSDGISDGELRWAGICELEDIVASKGIRPWAPICLWSLEADVRGPGQPRSTDGSGGPG

SEQ ID NO: 1010902 - protein, 174 aa, Homo sapiens
LSFPPLGVFFSPPHIFGGETLWSKRGAPPQYFFLSPHYFILPQGCPTKGTERYSSLREEIIRAGYNCVSPPRRSPSVGVNTRPSLLARHTGAFSLRAPHPPPLGGAQTSAHTGAPQYRVYTHTPQFVCSREYGTPRWREPSACVLATALFWCSKCLVNKGYMCSSLSLLERTLL

SEQ ID NO: 1010903 - protein, 210 aa, Homo sapiens
MTFISMVLPYESSRVTGPNVCQQARTSALASHYFDVILSSNTQHGKYCGYTVLLMTTAGSLNFSSGIRSQAARHDIALPILAAFGSISTRPSPLGGVTACARAIETHVLYSAQQHSVDATMRRELVMATAWWLWLLGEHVVARCSEVRQASALPGIDLYTICDSCADTCHVFQHRRPDLYGNLGHSLSIRRDFCRVIDSCHAPHPHTVPL

SEQ ID NO: 1010904 - protein, 66 aa, Homo sapiens
FPMRGLQTLWTNPEEETSVSYCVRKYGEDCVQEDYVRHSYVSVGTGNRNVSMPSAHLCLRKHGILN

SEQ ID NO: 1010905 - protein, 80 aa, Homo sapiens
GKVAALQVRGRRGGSSGGRCLRRGGRGAGVLVRRTHTPAAAPLRKKTPLLRDEVCDGGRHRVVRRKEIKLAAGETPLGGY

SEQ ID NO: 1010906 - protein, 271 aa, Homo sapiens
SVSRFLCLVLHLGCVFVLTYSWGVIYTVFGLVLGFPLCPVSVLDGFGLVTGLLDFSSCGQHLAHSPTRVSCRFPCISFLRIQLILVPSGVSLTQLSTPFNFGSQCSIGFQPASLVEYLSSCLIEQSSYEVLFLAGVDFGPLQVSRWSTQDVQHITRYLSSLVLCLAVLDLSFTGLSDELLHLLAAQPVGLLAPPSTQLLLNGNRLTRATARMLTDAIKDTYQDSTALAWVDLGNNVDVASVPQPLLVGLRRLLSQQHLHSPAIYEGLDLRA

SEQ ID NO: 1010907 - protein, 110 aa, Homo sapiens
CLPRVWALPDASQVAPAISPHPPVLPSAAAPMARQYANTYGLVSVLIRSYSLSTRETPHTSRPNLGSIDSAYSLFILHNKTGQLSALSRQSAHACNISMNKLLSREQNLF

SEQ ID NO: 1010908 - protein, 96 aa, Homo sapiens
RKRNEDGYQSCLMQYLKDTPSSKKQFFGGSWDEYDWYEDYNVTSPRPLRGPRSGLVGTAGCQKSEMSCTGYLCFWLAFVCCSCYFHLVSRAVRRQA

SEQ ID NO: 1010909 - protein, 93 aa, Homo sapiens
MLILTGGHTTHGATIVVVERPPRRGVVWVTTCWGATPAAQEFSRCRHCGAHTRAPVVEPLGWGAPPPRLPSFWAPFWLFPPPPPPFYYPGALV

SEQ ID NO: 1010910 - protein, 116 aa, Homo sapiens
LDTLVEFPIRDLDFSEMCIQPQNELISGSLYKYDLIHWYANMGEHARWTLHNILPAKGTVALSRSLAIDDNSVSSCSMRIQTGVQVSNSRRDLRLTAERLVSRQLVSATAELPGHD

SEQ ID NO: 1010911 - protein, 183 aa, Homo sapiens
GGVFFSPPPVCPLSLWFVSSLARARARARARPHSPPPPSLTQDALSLSVRHALTLTPHPTHAVCATHSARHTPRSAVLSLFCFTPPLSCPSLWGPPPSGLCFSPALFFVAPPPSKVFPFPPPARAHHVGLPSPTSLLREPSFLCPPPPPPPLFFLFVPPAAADEEGPPPFFFFPGKKTPQEGH

SEQ ID NO: 1010912 - protein, 236 aa, Homo sapiens
MVSHNGPISSVSAVLDNLRAKEEFGAMRRAVHASLDHGLPARCSPLMTGRVFNDGWASSSRRFCGYKDRDDFPVSVGREQGRSGVTAHRSPESEAIMPFRRRPTTLAHTVVRPRHKLRHQRGRGYLSSWCGQSGNTRNKSSHRALPVPPGRRDGGCPMGPHCKPRQERSNHHKLYGSYAAFDTLHSVTLRPSLSLKFPHLGLPGHIHTNPNGPGLFWATSHCVPSANASVSPPKPG

SEQ ID NO: 1010913 - protein, 333 aa, Homo sapiens
LCVCVLPFCRTFRFSFSTAFFSSSFCCSSLFTSSLSLSRLSLFGSRRRSSGLCPWALSGLPVPLPFTSRSVLVWSPCPRLSVWYPFAFYPLLLRLISRLSVSTFSSPYVSSAFTCSILLPMSSCYLLCMSLALCYLWCPPKFHPVDSPCCRLHLYYRPAFVACLCLLPPCPIFVCLVPVCVPLSSVIMWCCLDVLASRSAFVWNMPLFANYLIVTSVTMSCEGCGYCPASALSVSVGAVPYSSIPPLKYALRWTASPISHLGPAQEPRLAISIYCLRPCRHWAIWPGVLFPPGSQCHNPSGRPYLTQARNKKGPSAHIAESRLLCLPALSPVF

SEQ ID NO: 1010914 - protein, 273 aa, Homo sapiens
FWCGLWVMRSPQCPGIALWGSKPRDKPIIVLCGTLGHHPWTSAIWQGASPGKSSSWEVPQTLVDPWSMHPKVLWAPLLAPRSRSNEQSDWTIVLCALLNQPRALVGGLSLPRKRYPLFASLTLQSQGRKLLELTHEALTLPTSRTAINSQPRTHPSSALPVIRVPVHMLWLLKDTRLNRRSRARLRVGKVGPIRLGSTWTLSGRTRRSFTVPVLSQRCICAIRSQVLHKNVYLCQLPICDRVGPFLQIVSSLLDGNLLTERLFDVYLDICDDV

SEQ ID NO: 1010915 - protein, 231 aa, Homo sapiens
GKQKSEKIGSDICENQTTGQPYAAGQDHATIQNLTKPEAKGPEELPEKLKLYSEFLGKRPWFAGYKITICRCFSSMSVGGPPHVYVEPNCLERLPKSEGPSSPAFEGLEKIICLHEVQPLPPKTCCSQRWLSGATSRALEGTGGGSEEPILSLLPRLCSAAGLCIPAPASSFRFSCLLPICKLAKILRCVPLSAAPYTPLYPCRTRYEALQHTPLSVREHPVTISYRFHCS

SEQ ID NO: 1010916 - protein, 128 aa, Homo sapiens
MGSASPTCQGPLDTVPPFFNKSPANPGYLYQRTRTHPARVALGEDLVVLTLSFLTLAARAAEESTSGHRRQRVPKHTGSPWGSMLHSSGDLRRSFTHLACPLRNWWPSFHTPTSQSLASPSVYIGGST

SEQ ID NO: 1010917 - protein, 114 aa, Homo sapiens
WSKDPWALLSQYTLFPSRRPHKEAEMDVERVEYAEIGMRLSRCAHAHGIGKSRPCTTPAMDEHALRRPHQDSMGAVRQFMSYGGNGEAWERNALRCVEWHPAYLRKRHIAATCT

SEQ ID NO: 1010918 - protein, 286 aa, Homo sapiens
GLHLLRLPGMVKANLINQLWNGLPLSRLVISSCVGFPHFYLADATSMHVPWPLICGPWCFISGYTGYEPLMDTMDVPSFDPASHCLLLDPVDHPCSRGAPWFIEGSRSSEMHGPSRSKNISYFVEWIPNYVKVSLCDIPPTAALKMASHLHRHTARPLSGAVQALSLSKFSAMFRRKAFLHWFTGEGMDWNGRSTESESNMNDHGIRVPAVPGCHTPMTGTEAFEDEERGESMDSRKDAALNSDPTTRKFLLEPWCLDPYGPWMVHLVLIRCWCQAALHNMQRKLM

SEQ ID NO: 1010919 - protein, 130 aa, Homo sapiens
MALKDGGARSSCIARGAMNSLRCPWRCLLDAAALELRAALTWKQCNRAVGTGSCRLNREPDFSMPACHLSAPRQDRLPGSSTCSLVLSATTDCFTLIARKAIWSHHDPAGAQIPLRYRVHLQSCQETGHF

SEQ ID NO: 1010920 - protein, 59 aa, Homo sapiens
MTSGVTVPGGTSPGTRAGGSRLPMEACPLRRFASERAGIRASSLSWSTAAVRRQLREYP

SEQ ID NO: 1010921 - protein, 254 aa, Homo sapiens
MTGGPIPCARFGYHHSIAGVRIELYSCNQHLTSKYWGAFTAMKNVHVDVRQICTAITSCLEVVILQERTVFGTRDALLPPETSPCRSTSRPAIGTTLRLRFIGTVLSADQALQSTEVILAEYYTTKFPCRVCYVLKLFDRYSEAHKIKQVESLELCERICRCRGAAAPRNIGSKGPSPKLDVPRLSYNMYRYQKLELSTLTTDGDFDLEDTMEQERGVEEELTGPDQWTVSRIPTHNRDPANLSIFSFFIFTES

SEQ ID NO: 1010922 - protein, 287 aa, Homo sapiens
GLFPSPPDHVAYVHVLLAVINARTAKSLTNPQLFQGQARALERFVGHETVGIYIEGGDLPEESAQEPVTTAIRKEPFKIPEDDGNDLTHSLRSTLDREELATWMLGRAADEDVEAATCFILTDNCLLLLRVHHGTRSPEECIRTGESEHPRGGRAPGKREHALNSDIPYNKGQLIKALQNRERTAEDGGAESHNGVPDLGPHARSEKDEVGSSPSQVALVDEWSPYDMRVAGSRDKKRISVQEEAGAVLTTVPSTPLFITEVPRMGGRTHGHRGCGSWLPVNNWHLS

SEQ ID NO: 1010923 - protein, 256 aa, Homo sapiens
ATMREKPGTPRDTAEQERGPGCRHSVGSASFRYLGRVQWRVNPSRTPGRQAPRIQRSSGLTPRGPYPHGMPKASGFAAVSVCCADSFLKVAKPGTTVSPIRGCTLLGCKCTDEEVLAPTQCVKLVLVPPIYPLDRCCYGKFLLTVAQAGPLEDAWKPGKLVGGSDGEMELLPFCSWFQGVLGICGVSNSLASELRVPGATGKAGTGPYLCKAQRRGPYWLQQIDLFPYTRSSVLTKDSDMGDTRAWPASTKMSSER

SEQ ID NO: 1010924 - protein, 76 aa, Homo sapiens
GTPQFLMAAHASDKVSRPFQLDHANMRPLLVRHSMYAIKSAFRRLSIDANSAEKSLDSHAYRRRSNDSCRYAVLDL

SEQ ID NO: 1010925 - protein, 119 aa, Homo sapiens
MRVVVVPDHLRSSVGGRKYNRGEDLTYGGSLLLKREEEAAPSLVSIIIMWVEDLVLLEERNNNIFSSGSAYWDTAGGKHVLSAEAEHNNFMCSPLLKEGCFTHDTLCCHTSAHSRERGV

SEQ ID NO: 1010926 - protein, 83 aa, Homo sapiens
VIDLWLSTPRDMVVLLLGCVSRFAVQVDSPRPNSRHGSSHGRRNVNTSRMASHSALHVAHWSQSKAHLICSSLGQTKFFRQVP

SEQ ID NO: 1010927 - protein, 105 aa, Homo sapiens
IHTTPLSSRCDSRAPRRTPVFPPARSTEGVSLSRASPLVVREHSFSLSRRDISTHFCCCSLSDARAGAPPSEREREATTLCVGTTLVRGVGGGPPVSYIPSRRER

SEQ ID NO: 1010928 - protein, 321 aa, Homo sapiens
CDPLASCMYCRRMTCGARGFSIASTEGSGWGPVANCPGKDRWPPKVRAYCACEVSPTVGWYYSACIITNVCLNPLLCRRPGIYTTSRRNWWTPFGRLCISNAPTGVTHHIPGVGVSGSPLPVWSNSLWRLSTGVCLPAETLDIRGPLGSFAGIGPEPLTYLCSEVPLLIVDIPLWFLLGLEPAFWAGFYSLSYSRYQSRSLRSLVLRKLWAAGSLLLEQYASLMRGPSTTMREANHTSPWHPGALERYCHAFTSNCFACDHTTERNRASRTVLAQIRSAHPLSSMSFTPTYIGPERSLEQRCLRTLGFIPMLRIVHAGARC

SEQ ID NO: 1010929 - protein, 262 aa, Homo sapiens
GVLSGKLVSPFLTRVYFSSSHMYLLSSKFLLGRKKTGGSPVRASLATLFTYSGGGGRSPPHMVLSHTSRSYLLRSYAIAHSHTPVFLGKSPFSLPNESPLFLVWRQHRCLPLFFVRHTRISPPLGDGPGDCPRVASSERHPLYGREESRAYRRHHGVLYPRTPAGVPPWCEGRQRSLSLYSTPASSREWLPHPEIHGVLFASLRGLGAQFPRLRFLALYSPPGPKKIFYNKPAGFETPGGTTPTPPFQGGFPPPPKKLFGGG

SEQ ID NO: 1010930 - protein, 112 aa, Homo sapiens
VEKKQEYCYSGRTSPYCRLNMSRSVFNTCNVQSTVQICSRKRTARMSDYALYSVKYCWKIFNIDRVSVASIKNRIFIYRQSACVWILSEEVLIVSIIMRLKDLIKRSKSTLW

SEQ ID NO: 1010931 - protein, 307 aa, Homo sapiens
ICLAIPRAPRPSPVRVVAAVQLWASMAVDGCAWPYAETPEALALRRARSCGLRLVLINTPPGDHRERAETGGGCLSPVMTGWPSERDLEQAVRYAKALWLSQGTPFQPFPSLVTPVDPDCACTRAARGAPGLVEHGLSDSFVKAPLGIILHGHRGVSWFPYDRLQKYSAETREVMRSRFVIGNIGTSVNRKLAEASYIPLCVQSPSIAVGKFPNIAFRERPSTSTLPDNGAPQVQVEASRSRPDYIAEGVAQPMSVIGGSEGAPLLYANVELAFEVGRTSRRGLGEPLTSPPCAYREVHIDATPAMP

SEQ ID NO: 1010932 - protein, 111 aa, Homo sapiens
MEPLACNLTGRSGDHIGGSIRSLVNFPPGIDGLKRRKGPQDPGYDSNTSATAKEGIVLSLSVDQSHRGHQVGPYLPREWCSDAYTCEHSSPGRLTVAETSVVSAYPPWLAV

SEQ ID NO: 1010933 - protein, 394 aa, Homo sapiens
LVCDRSLPLEAPIAVRVLSVRITLSGGLFLAFWSVFPCGPVVSRLLALAHPGYPVLAGPFAGPYWSLGPDLILSRRASFESHWSCVCLALLRELSRVLRTLCAYCVPRAVLRCSSASIVPPLVVGYFNIHCLSPGLCSPAALLSSPLYPLSGRYVMKVYYPGRMEIYLWLTHSLPSSIISLFRFNVPGDCSRVNAIESVSYAYPHSAICLLGLSVSEGLPIGGYTRRCSHIVASSGLRDHLVDVVCELAKELCALSIGGLMHGEIAMLSRLLTPSSHTCLWFPPGPPSFRTPPPKAPLLNAYLPRALAVHMRGLSAHRKGSQGSPGKASRSVSPHFCRYTSAWDPSLGSVGPLVSQKYGGIGPRPSRTEKGRGGLRQSGKEGRPDPTFWRDSFT

SEQ ID NO: 1010934 - protein, 334 aa, Homo sapiens
ERQRVLPGTGAAWAKPAPVEGRAEGTGRLGAWRRTHQHCVTCREATVSDKLRGKLKQDVGPELGRRQCPKLSQFSLAAGVTLIQLGEVCMRYLKNKGRSRYRISVGAPVYIERQLIEYLAAEILELAGNAARDNKKARIAPRHILLAELPNDEELNQLLHTGVTIASGGVLRQIHPELLAKKRGTKGKSETILSPTPEKRGRKATVMATKGGQEIQGCQTTDVHRSPNQKDSDKEGTSNSTSEDGPRRWIHHSGLLRALVLGTEAVLNPKSDIRPYLVHEKWRGIVPPQQQGDIDLQEDIGKALGKGGGKRVLETVKEFGNPEALESRRRRVSN

SEQ ID NO: 1010935 - protein, 103 aa, Homo sapiens
LIDCLLSFISHSLPLFTLVVPMIYVFSNILKLKFVSLSLACIARGCIISTEMCPPWPLTVVVPWDLFHYPDSYRHLASRLVMASLGEFLSRYFECVLLTLTTV

SEQ ID NO: 1010936 - protein, 116 aa, Homo sapiens
MERVIYRIMLWHITYSMSMNQYNRCLFERKKISYHIIRCPNLGLLREIGDAINYTSILNGIKTYDLSQADAWKYVLSSCGYPDLAWFVIVHYLTAYVSVCVDVGSFVKWGSWIRRL

SEQ ID NO: 1010937 - protein, 255 aa, Homo sapiens
MLMGPSLLHLSDKATQTPLCWQELEGERARFLCNKRSVILGQHRPPKRDFQVEATTAEDEAEPAVGKRRMRGSPLLGDALQCGEQLSGVPSHLPLRVPCLATSSPLPAQEPGRAHSARAGGGICEGAGRRRSIAGGSLISLMGSRVLPASSPEMAADDHSPISPRVESLAERLPRLSVPVSLAVSPALCGLCQVYEETSGCRSRKLCIEPLNDEASSPGHPGAFLNDGMPDLQSLPLLASPRRYIIATIFKREPP

SEQ ID NO: 1010938 - protein, 166 aa, Homo sapiens
LFVLLSPLHTYSALCVSSFLSLVYVFVSCSPRSLVNSPLARARARALSSLYFLFSLTQEKHTHTLLFFSLSLLSTRNEHPPPRCVCCFCYSPLFPRARGSPPCFGLFLFPPLPRARAGGTPIHTPPPPPPSPPPLSLWGVRGHPPPPPPSSFYNIYIIYLCCVFFL

SEQ ID NO: 1010939 - protein, 329 aa, Homo sapiens
GEIPLTGSFQRVLRCELADRRLLCGEVRAGEVTGPGSGSMKVSSSQLLCNSGPTCESHRFPPACNLPPAPRLNCDGRTNSLDDFPSPLPLPALPLLCNWDRGLRHGSRFILKVLDVTWLSKSQATLIVMVCYSPRCLDGAVSCLVLTELMQPRARRLSWQRVALRWDLPQGDRTALNSQAVFLDGQSQGPQDLPAMGSPPRPLLWGWALPVSSFELPRHTCSGLQVRFLRLAFRPCGNANPHKWVRHLSHSDAYVILDLRLPKRGHDGPRWQFVPREDSRFFSSHPGLRTLNLGRKSPQSQRPGGGNGPSLSVVSDAGRTAVDITHGPT

SEQ ID NO: 1010940 - protein, 139 aa, Homo sapiens
MWSCLDGIITDFVQYRTSVSLRFDAGDSRIWSPQLVLELQIIRMWSEDFVPIGKHWTVKAIVHCPRRPACKMAWAPWNHERAVSSVTVRSGLLAPFTPRKEGSWTGNGGDVVERALIPLKSLGALPKGPATGKDFPNSQ

SEQ ID NO: 1010941 - protein, 78 aa, Homo sapiens
MRPCTRTKLRVDPVYFIAPKPLACLVTLASPPPRRVHPCGARLHWTKIPGFCDRTVTDLQIPLSMEPRWTMLLAPWIT

SEQ ID NO: 1010942 - protein, 109 aa, Homo sapiens
YVVVPPPGGADCEYTLVAAFLRSSDMVWGLFPPPSVLWGEGVPPLCVVVGGAAHRPPTPQGASCVVFLLHTTPPLLPPPVNVLPSWVFATLCVLYEARSRARLRRRLSV

SEQ ID NO: 1010943 - protein, 202 aa, Homo sapiens
MPPEASIPCLACTRAMWLLMYLSGGKHGTGSQDNGACSFSWDVKHLVSSTLAPAAFQPRYSCDSPVLKSQILTLRLLSYRPHRGELPKSIINQVSVSRLQLDFANHLRQAHWSPTLPLKPGVCKTSLLFPHCAHAALVHTLLITENPYLEACKSKISYLVTVGWFDVRALEYDTMDSDLVKVPLVPMDNRDEALGLKGNFIH

SEQ ID NO: 1010944 - protein, 182 aa, Homo sapiens
MCQEIPPSPCVTPNTICGLPKERLACPLPTGLHGNTQGGRISWRDPDTMVAHGERVITCGALFSPQSNAVCGHTPTVAPAGFRENLVRLGVATAHLLSQETPEEHPVRDPFAADSLETTGVFSAAGGDHSVFLTTGTLWVREIPRAGSIVLPCESSFTREKKFLHVGAIFPPLRPRGPTFVS

SEQ ID NO: 1010945 - protein, 234 aa, Homo sapiens
MDLELVAQKQRERVVMSMDTVRHWNWVTAAPGYHRASSCQQLRQSAIMEYEMRPGLLRRARREEWSEVLAARHNELVVKDREGQSRESQEVLVCSSGLLSASPMWHQSPGPDSLFSQPGALPPSVEYDQCRISGQAASMGPLLYPRRSGPGNMLSVCEAHMLSSSRGEELRGGQEPCAIAQWLPQSGPSAEADMDADLLQELRLVPSAVLNVSQEMSPAEGLCPDDTAGTSHRP

SEQ ID NO: 1010946 - protein, 196 aa, Homo sapiens
SLVPLPVVFSFLFSSVLTGSSLRGLLFLRFPDFLGSFALHNGTCFHVLNHSGRPWPCSATGDGHCATFHVLVPRPPVHRVDRHGLRCPLSRGRSTRYGMSFSLLLVDARDLLCCFFGYLLAYGVFYPVSLLACTLVVAVRIGRPPVFQFVVPYYVTDGMTILRPLPRSRDSSLQLSGLLVCVRQLVGFSGLITFRI

SEQ ID NO: 1010947 - protein, 184 aa, Homo sapiens
RGHFTIVFVKICSSNERGASYAQSLLQCDSRITSAKVFCLIYWYHGISTNRVYYTVRRSDSSPTSLGLTFWWALLMEALLHMVIFTISCGDTGSHAKYDLHFLYPTTLTIVFLCTLMVVENLFLANKFPPHSTSKDPTFFQLQVVCCDSLVMNDPCPFLSNECGEHISCARHGYTSAAILALLL

SEQ ID NO: 1010948 - protein, 114 aa, Homo sapiens
MAFSLPCFELYGPASLVGGLPMSCNLAPILPSVASPYGRIRSCTRLNSIKSLHAHQKIQVLNLCKRSTQLMRFNVLPLWGSFTRSYIRTLRGPRTYNYCDANITSLRTYFWRGD

SEQ ID NO: 1010949 - protein, 176 aa, Homo sapiens
FFSCVEYRYTRRETSYTLLSCCAGGTVFFVCCVVVYKERKKKGEGWEVALGAPHTAQLSLLLVLYEKTTRDTTLPSPRPAPLLSARGESFSCVRERARRASLLPRRDILSLALLVVCCVLLLCVELRGARAPALIVSLLVSVSPPLRGRAAHALRFRNDIYVWVRVEQNDTSLSSL

SEQ ID NO: 1010950 - protein, 158 aa, Homo sapiens
MSALSVGRTFSDISLLWSTTSGPTEGEKPYRCTVCGKHFSRSSNLIRHQKTHLGEQAGKEFQLKESPIESEGERVYETTNLLEEDASASFACLPWTVKPFIATLENGFDIAVMKQDLRNVLRRDSGIENPCLFPGQFLVLESQKTQSLACTFIGVKEK

SEQ ID NO: 1010951 - protein, 366 aa, Homo sapiens
MRSPRVGPLAQGVLLRVVCLAGIAPVILAMRLGIRAFRGCALSPGRVPVRALLLWPAGSAHRMRCPCPGRTPGRSVFGMVRATLSPGCNPVSGPVPLVCDWRRAEMCSYGQACPMRRACPGGTMAKRRSRFKAFDAMAEGALAAYATSRAKLERCNAPDRPRLATRWARVPCTQRRHLRDQLYTCKQGTADQRTLLENPADSEEDAPSGCTTTSETLSETSPQLSSLLSRCTMYGHASPQSPYERVLGFRLARANRATPWDQRRLVRVERYAGPRARKGPRDPECMVNARTDAEKRCAAEKCGRAAIAAYRNHCDPRCSPVLIPVPRMFSSCHPMAPNPLVDAALPTHPGPQLRVIISSVRCGCFA

SEQ ID NO: 1010952 - protein, 175 aa, Homo sapiens
SLVCSSFSSAFPIWPLFWASSLGPPFRKAPSGGSFLDGGPPRSCLAPPGGVRFPVDGCCVAFEGLTYRRHAQGAAVCWNGTEDNGAERLIKEALLDARTGTDMITTLQRTCRATCLQGGRPSLAPRGHVTRASPEEPRKDRDSRPQGQPRRTGCALLRPRTISKLEFPSQTPPTR

SEQ ID NO: 1010953 - protein, 118 aa, Homo sapiens
AQDRWSPTCPTAVDAWPVRLYTNSLNHRSSLREKGGKVPYRPYEILPGSDDKSHPASVCGFNGGKELTRGSSRGIHSIPVTVWWHEGKLSLNGLHDSPRSKIPGNNLARAVYRLYPLK

SEQ ID NO: 1010954 - protein, 106 aa, Homo sapiens
MWCTRFLYYAGAIGPSDGIANYPVVMRDQPVFGPPELRFQVEATVGKIQLRSLLGGDRCQKCMTQSNLQCDYLYCGSAIALRRRRFLADTGPVPTKETAFPLGIAW

SEQ ID NO: 1010955 - protein, 86 aa, Homo sapiens
HVPTPPRAGGLNSPYVYSRTRAHENSFSTMGVFSLVFSCGGHHAGGRPPPYSRDGGPPPPTWAPPYTEGCLAHLSSLSREHTPPFF

SEQ ID NO: 1010956 - protein, 380 aa, Homo sapiens
GFWSLHIASLFVVTLTRVGAPATLVLLISFVLPSCTTVCFVFRGRAGTVRRGLFCTVRAVLVGGVPRSLPLALLAFMDGCDLVCVVCFSYASARAVGCRPHPPLVIDWIASPRHYCALHRPRRRRRSVLAAHAVHVTRLPLLSGVCMAASLSSHFFVAGVGARFSARSARWRGGRAHSPPASWEDGHPLAPHARRSVSSSSRARCGCDASLLLDSTTRRPLSFVSSCLVFASLSLSWAPLFSLLSTALLSVVARRRPLALAAGPSSTSTPSGDPCCLRSRFVAACLPLSLSLSPLRLLLSEFARSGCRASLAVSLFFSLRARAFFYLIMCWWGAPPLFSCSPLRQMGRVSLPRLPSPPPPLRSALPPTPPPRGGGGSREG

SEQ ID NO: 1010957 - protein, 247 aa, Homo sapiens
RLCGWLACGSRAASWGGAQVVVASPRFALWIIASVALVLGSCDVGWGVRVLLWTGVATAIGGGPRFLRVLVLPTVLATFGWRGGFPGWSRRASCSIRPPWGCPQRSSSRCAREFTIETRRRKGLSEDVSSQANSSMDPIRSLELAITRMLCSTYPMWVRGPPGSSCVPTVVLQLLYLKTETSYDRGLRVVRECLEAACCHLVLLTNLQPRASVREEHMASCIPSVASAGLHSRGKSEELGLTEREGR

SEQ ID NO: 1010958 - protein, 102 aa, Homo sapiens
MSALGREFFCDTGRGGATLQGHARNYPARASICALERGAPKQRWNPPLVLDTRPRENKRVYAASLCVKKAESSLGFAALCQLPRGRQKRCLHIPPYQIATPR

SEQ ID NO: 1010959 - protein, 126 aa, Homo sapiens
MTLPHSNMQSPQSYSYPWVGGMPSASLPSWALLVHSYTDPCLILSTSPAPLTPGLWYTLHRRSSLGPTRCSPVLSNSVEGAVCGGGGLRFLPPWAEGPFPLVLCPHPPPLQLLLGLSSAQGQPRFC

SEQ ID NO: 1010960 - protein, 195 aa, Homo sapiens
MVVRWEANLRCTPTGVLSLSQGVVKEIFLSRRHYIGDGGPSWLFGETLRTDDLATRWSTPLSKALLNEDPSRGEFTEGTRRATGGFTSLSNIPLAEPPTPGFPHTAWGRTHTEGGIYRRDALSHTLLGGDTPTGPRCAHTWRESTTRMGKKFFVYTGLFATHPKSSTPTSVYSAPGREPCDCFFSSSLLCRRHQP

SEQ ID NO: 1010961 - protein, 102 aa, Homo sapiens
MSLDLYGTSSLLESYACLYEPGWTNLPKGACALLMNLCGSSIAHLCMACGGLMCSLYQVYRLKPLWVQENSKLHLRCVRVDLKGQHGQKWQHEYLVGHLVCS

SEQ ID NO: 1010962 - protein, 150 aa, Homo sapiens
MCGDPPSLAGFLLAWKTRPHPTRLVCVTPPPLVEEDPPAGPPDFPSLSRGRFFLPSSRAPPRGARMYTPCRIITRSRNTQLVLRHDLIGPLYLEVDTHYYRETQHMCVTTQIRDSERSGVIRALRGNILPADRRGWWRGPAEMYHPVGEI

SEQ ID NO: 1010963 - protein, 102 aa, Homo sapiens
MLGQDRPACALQAGHVVLPCPKDPECPLFGSCSIPKAPTHYKKVEVESDSFMNAVLTATHTLAQTEPLPFSMIMISLCHTSLLRSSTVWQGSRRLYNSSTVC

SEQ ID NO: 1010964 - protein, 334 aa, Homo sapiens
MHSFGGDEKCALSIRLVTLLCSIVPPYFIHVFAHVCYYRRSASLIAAPSTTVPLQTVGVLHPGVQALNSCGGIQRVFSPLRHHTECLLNPPLFSLFISGVHLTASCRLPFCDIRVTSAQYSVLLWAHNVSRPVWVFPWPELRRGPANMNVAFLTRLEAFPGNLGKHSKCASEKPQSREKEPLVSKTVNSGSQEVTVRTDPFYYSDSSWFLAAKILYGQEDGAVFACPLALTVSHGAPFCYHAPSGATCMMHSSLSLQPMAFRSLPPDPCRNSRWNSSCHHPLGRTLGPTGTSLGCMLTRSSALMPAKGPTAPCPLPCSFNRVNMCIYRPSCHCT

SEQ ID NO: 1010965 - protein, 174 aa, Homo sapiens
TVVVSLLMIVFPSPNMCFPLVGVGGEPTSQLHTQLWVFSVLFELLYLASCMIHLSCLVRHYPVWMVFFCLGLPSWLMGWVGECPAFCSTSTLRLGWPNYPPFLGIALLVPPPFVTVVDASLVFLGGCTPLFGPHVSSQMSPPPDLGGCRHSQCSESDPPNDVVLCKITASCSSR

SEQ ID NO: 1010966 - protein, 86 aa, Homo sapiens
MESSGIMAWTNSPYGVNNCQATLRIRRFDIYGYKRYEQCIKKELQLERDSEMEHTRPQITNANNPPAPPSTPSPTTIVLNSDDTVS

SEQ ID NO: 1010967 - protein, 261 aa, Homo sapiens
MLLGTILSRVFWYPMKGSRKSRSNFEKFLLCVLDRIPIHALAPPDQRSAILYMIILSYMRRQSALGIQEEVTEGPSHPMSTMEEEGLCSRIEIRVSYTTLSTITDPFPITQGPSLAQMDAYSSVYSTRHCAVCGACGSFTHMPTGMRDLCVCAWVYSHVSTYVSFWELCTIMCACSCVVLDSDNPFSPRSPLQMIIVHITPKSRKEKPGSRLAIVLLSSDTINLGASISHCLQIVSNYDLTSTRRFWVYHTPQPPAPSEDV

SEQ ID NO: 1010968 - protein, 146 aa, Homo sapiens
ISPTPGSLSFGFCLSGRYSLRGVDVNVPTVCLVFVFFCVFPGLSLLQRRLLRMGCCICVGFGPWLSSFVSLKGSMVTPRPCHCGGGSPTAIDYHSLMWSPCRGTVFSVTSSALCNRGAFFPPSVNEVLLFDDHFVNVPCVNPFMVK

SEQ ID NO: 1010969 - protein, 126 aa, Homo sapiens
MLVCNSRGEIHAYMGLTLMGPLYFMGGTPYLCEWNQTCWVSQTQHIATRLWGEATAFRCESFSPRENWLQTHYLRSFFRALSQWRAPVQEDPRLLGEEAPTERGSSQTEGRIHTYMCLYTASHHAH

SEQ ID NO: 1010970 - protein, 122 aa, Homo sapiens
LSLSALGCVCFCARSVVQGVIFGARYRIGYGRPVLLSGTFVRVSLTLVLLFDHLTCERCPPPGSGVLNSSSTGLVSLLTVWLSLGYSSYRFSPFWLIPSCLLCCVSLLLVGLYAIAPTLVCD

SEQ ID NO: 1010971 - protein, 107 aa, Homo sapiens
MVVKQCVLVGSHLRPTRGGVLVRPLRPNMAQQQLGGGEIPYINAWSDTRAMAANPNHDRRCRHKSVRHLFAPSAGWRYPTRDDTTVLGVYVVTHSWVEYTLAYLVIL

SEQ ID NO: 1010972 - protein, 263 aa, Homo sapiens
VVLGLMFSTSVDVSSEHVCPRYMICVLNPLLVYMRSPCVLRGFLVPVDAFCKGSCYNVNPFWLGVRVCNAWFLCWFSILWTRSLRNCDFCSDVCGLAMVNSPSLAVCTYPREVLVFTRLLHLCGGLHGVEFCTRYLVSAYVYLRPFLVLSWFSIGSSTDNSAGLNHMASQLGVTRSNWCPVEAPATSKSLTGMTSSFHDASGCRLVKSEVTCSRDCRTSQSPADDGASLRTSEPLGVSHRKLRAQIYMAPLCERMHQDFIRMH

SEQ ID NO: 1010973 - protein, 141 aa, Homo sapiens
VNTPGSFVVDPWILPVSPSSPLFLPRYCMNPRGPSSALLCFFLLVPPVAGLYSFCHHEELLDCHSFCPLFFVPYLWRQTCFFHMSVLVSSFPAIFPGGVSIFFGFPLGWPPCCELFVFCAHLLFLSFFVAHYCGFPVTLSV

SEQ ID NO: 1010974 - protein, 167 aa, Homo sapiens
SKCHQPGSVLVHWARLRAGPTRWPNECHGLLAVQALILIQPGATRGHKLGEIHPVVHLVPTPLVAGVFVCLLEYPPEEKTRRSGSTMDAAARTEAHDIAVVKLFGPFTRNYYSSGTSCISSLSVPAGFLLPTILGTACLAIASGIEPTGVCAWTEQMTPIEPKPHRG

SEQ ID NO: 1010975 - protein, 36 aa, Homo sapiens
MDLRAGPDVLVDLTVKFLSNKHHFSMVRYSLRTESL

SEQ ID NO: 1010976 - protein, 229 aa, Homo sapiens
GRSGPSRAGPAVATVLRPWGSFFLPRAGRHRCSLPSVCLLRVIPSSSVRVPWSWASIMALSGLLGRDLMSVPAPAPRTLGPSEPSCSLVSCCSAVRPSSAFLMHYVCLLGDQCAMLLSRRCSRDRGVCVAGLALLSGMPPHYPLVTTSRLACHSLNPASSERPLSNPGRDGLAHTEMVVKKIRELTDVGKCQGCPEVYRGTYTPAICRRVSEGQSPSLPPSLLHLHSLP

SEQ ID NO: 1010977 - protein, 141 aa, Homo sapiens
MLYGQVNSVIASHSSLLLQQPPWMWLFGVGLVPRSPEAAVRGPGYSWYRPPRPSPYVRVGSLWLILSGAEVGGCPILCSYVSYATASDDRGFLSCILGLVLPLAYGFQPDLVLVALGPGHGLQGPHAALLAAYASGAGRGP

SEQ ID NO: 1010978 - protein, 243 aa, Homo sapiens
GGAPPPSPSPPRSVRFLTCGDAAPRLLLPTLVRGGRSSLRFTRWVPPLSLSALALCRIPLLGARLARRRPLAVAHTHLSLALGCSLASHTLSVSAAVTLSLAGLSLSSTVAARAGVYTLTRARATRVFATRSDMLAPHTHTRARSHNTHTHTRSCTNDTHTLVCYTPSTRTQTVEMSVYMYATHSNDNNNTINMLVCCLEVLWWTTPLVGCGLLIPVLSGRTLYYLRLLLRVCGGPLLLAVDD

SEQ ID NO: 1010979 - protein, 420 aa, Homo sapiens
RLYRELDRSCVSSDLLPRLARLSDPLRSAGPWSRAPDCPVRRALCARRWAATECGAGGCGALRCNEDMRGLQRWRGCGEWQSAMRLAWPPGAHGGRTCSWDNHAAAVLQLCCCRDAPVLDVRLWLCAMLWTCPLCCPVHFPVNRANGAPHALLPLGGIAYICLLPREHGAKTQQTIGAGHTDQHVSIELIPGRPDPRSIGEIERMESAGWSRARIEGKEAYKNITLASTLGAAANWVSYPRNPGRHQWIAKGGPARWGPPPIGTIIKCKPKKDTYTIQEQKRQELHTPPPRGTLYGKPPWIRKEPRYMYDSLYSRRDIRNMSPKTQRVSNVDTTAEVTEYFETQPVKKFYSYGTTRVIQYLWRGVTKSPIQETIGTTDDHHKDHKPAKFGYYWPMDRYDAQWMKRGRDTLRKERAKRGRR

SEQ ID NO: 1010980 - protein, 216 aa, Homo sapiens
IARSWSPQAGTTAIRVFHCSDECTPIWTVLAFHSAAVPSCCWPVRPAYVLFVDCAWPPQRSSRPGIQSPRGSTSYLHCVDACPQTLSFLGEDLGSADEGWCGYRGRFRSLRPVEKPRTGLSVEGPGLRSDGTQRHLMKVTADVTLVDGSALELSVPLCLLCSCALSRERKRVRTVLREASQKRKKAPIEHCTLKELFDYASNQFRGYGVPLCFGTS

SEQ ID NO: 1010981 - protein, 120 aa, Homo sapiens
GRTTPPVGWCFTHTRRGGVLSFDEEVESKQKGGCFLTRKGFLSACGRGRKSRCWWCFRRRVISLVRREDDPSTIISRCVRPGLRLLSTRMLTTFSPPSLWGVFREEHTPRGDTIFESSFG

SEQ ID NO: 1010982 - protein, 115 aa, Homo sapiens
RQVGPHCWLSSPMDEGVPGWNTTVACILTLPPYYRRGYGKFLIAFSYELSKLESTVMLPGEAAVMTWASSATAANGPGCCLEILRDFRGTVSIKDLSQMTSITRNDDHQYHAIPR

SEQ ID NO: 1010983 - protein, 31 aa, Homo sapiens
MIASRDPQGLLCHTLLEKTGQRLSSASVSPH

SEQ ID NO: 1010984 - protein, 130 aa, Homo sapiens
MPLPNCSCTLWHLLFASLPLSRSPLRSVSTSVFCLLVSIPSELSASFHGVVLGARASSHLSGLPASLSPVVSVPSPMCSVFSVCIFLLPDMGHTPSGDTILSLVLAHGALYKELGGRSRKWEPRDVKSEV

SEQ ID NO: 1010985 - protein, 111 aa, Homo sapiens
VSPSGSRLRLTSSCVQVANDAYRSGENPRSVPLFTAPYANLDVRLPQPSFLTSRGDIYPSYYADSRPESSMSASSTGLAAPGSLSSPSLGSVTIQHQSTTEHVHALRLTCA

SEQ ID NO: 1010986 - protein, 134 aa, Homo sapiens
ARGAYADQLQAQAVVYRKLVCLGSNRSGPQGCLALNVVLVWAPLHLRDCAPSQPSELGSTTELGEESGFKGFRPKDQTSGGHAVFLASVAISGTLGCTLRDFVPFDVAKDPTPARSGRRVEAVRVNPRACGLHL

SEQ ID NO: 1010987 - protein, 110 aa, Homo sapiens
MDLRLNRRSCLALVSLGLVLGVPSVWTRIGLLRMLDAASCPPVTVGGRTASALYTVLEAWNRSHTGMPQSGRFEQSFYLGARRALAQNIWNAYTTLCAVFLILGYNPGSR

SEQ ID NO: 1010988 - protein, 133 aa, Homo sapiens
NRPNILQEGTDRRSAQEDHTSRIGRPSQATAIAPMGGPGEHSSLTKQRREDEGHHQRPDQKTSCVPPSGVCLSAAVVHTKGGLQREDEDPWDFAPGQTLRLSQICQLCMAEAAYQYKPLYPAFCARRINFCWD

SEQ ID NO: 1010989 - protein, 540 aa, Homo sapiens
SSSGVGAVAWLFLVVCGCGGAGRAVRLVGVGCGCVVAGGGGGVSVASVGWAGLLLGCVVLVLCGGWCPCVVVGVVACVVGVCFVCVRFCLSLAGLRCVLVSGLFARWCVCAAVCVVLSVVASVSVFWLQVFGGGVCSRLSLGCVGRVVSVFVVGLCVGVLSSVLLFVVGCGRCWWCVGVLVVDGSLCVRVVFCCASVRAVVVVCVVLSGGAPGWWSVFVLWVRGRWWWWLSGGREWCVCGRVGRSRCCVVVWWGVVGAVGGGVVCWWGLLCVCVVVSLCGGVGGWGCWWWVCVVGGGAGRVCLFVVLVAVGRVGCGRWWPVCAVWLRGGRCCSRVSGAGCVWCLGRPGCVRCVRARGPVCVALWVLCAVCWWSCVFWCGCWRGCVWSCVVRGVVCVWASSVVVGARWWGLVWWFLLGLCVCGAFVVGLCVVVGWVCGVLGGGVVVVGVVGVVVVVVGGAARVVFCFVCAGGACRVVCLCVCCVGCLVLAVGAVVCWCCCGGRGVCFVLCGVVGCVLVGVVAVGGWCWWLCGGGARCVWGW

SEQ ID NO: 1010990 - protein, 107 aa, Homo sapiens
MDKSEVIVTVKVVWVKAGARSLDSCVGYHDRPFGISDCIYVAFLYRSVMFAHKITRHYVIPWQFACTFAEYASRSFSWQGMVIIQYLAGTERLHGSDTHRDFRTRHQ

SEQ ID NO: 1010991 - protein, 309 aa, Homo sapiens
EPPTAGGCPLTPQNIGLQRLDLQTQMRSAPYPHLKTTMAPSQTGSYSCYPGAGRRRRPVRGREKAESGSCLSQIAMPGNEGSWSAARAKLGLSPWESLSPVLGTVEAGPPRPGMTSACPFWRPIWASAPRTDSVQAGAAASSQQATNNGSEELQYAERKPGPLEARDAETQPWGDAGSEPPRAESRENERLSPRETTRRGGCGIGGAQELSLRPSGGSGTGRQSPAKRGRQELPTVSSACNMRRLSPAESVQELDALTTSTSRPSSNSPRTNTRLATVHVSPRGTLPYREVGALTEGPLLDNLTPETPG

SEQ ID NO: 1010992 - protein, 426 aa, Homo sapiens
GCRLVLLAQTSICVAPVCYHTTDSPGGRRPHCFDRRGGAVPNSGRWCCATNKTFEERVVVVSRHRRGLSAPPSCVWCLCLWSRRLLLRRQRTRPPVLCAPRPALTEVGRQRGETQPPPHYSVECTPPAGGNDAGAHRRGGKKDGGAQHTAGDLFTHGSFFLTRGGQQPAHNCRPIVDTRWWVCRHRRFPPTRGPLLPLCRAHKRGDISRLSSFVSSRKQRGCPPSRSRSCLSSPNRESGLSFSKRDTLFFSGGASPAWRGHTPSRTICAQNMVFGCRECVSLSLSPALAPPRTGGHTRGLCVKRGRHPVRDTLVKTAVCFPFFSLNYFSNKQTTPRLSEGAIIEGPRRVPLFSCKREVENLVAPVDPRPCDTAPSTPPTRPRVSAFCGNLNLCGRGNGFKRNKKRPKPIVNRNPFSPFLFFNTPTN

SEQ ID NO: 1010993 - protein, 72 aa, Homo sapiens
MGDPRSLESTLSRRDTKKSTISIYGLSSHTKGAMGCTPPVDPFWYIPSCGNPDDTLPGPFQRAQELKSFWFF

SEQ ID NO: 1010994 - protein, 309 aa, Homo sapiens
MGPYAQQEGERLSSAAKVGGGEEIYHCGGGRNQKERGHLVNHAEDYRASSALCLPEKRGGAAILEERTNEGSLFGGEEAAKQPHKTSGWVSPPRPRGQHYVGYACRRQHHEVVPTGDESITTHDRVVSMMFLRPLGHIIVTLGGRYSPLTPHSVESALHPSPLASSILRAATPRRPPLFWANKKGGAVTHVEKTTSGGENTGSTGTQRHCETIRAGHTRYAYARDTSVIIREKNIEERVGTHTEWRFGKKEVAGEKYGATREESVSRTPLGEAKAVRNGARSTRRNKSAFKGTTGPRTSTPQGATGTQK

SEQ ID NO: 1010995 - protein, 101 aa, Homo sapiens
MRAAEHSAQASTPERCTNRSPPDSGETSPASVFHHGCWRGPSDGGGNILPRGDTRATWARRPPREKKGGGGTPEAPRGERTPPPPERGFFREKKNTLLGPG

SEQ ID NO: 1010996 - protein, 207 aa, Homo sapiens
VPPTQTGGEPPGGRNQMGAANRGAENRLGAPTPEGRGRRRVLGAAPLPAPSGGTKGEKAAPTRAREIPGGLFGEHPPRPPSRGGQRGPHGCHTHERGATGGAPAVKTNGGCKLQLALGGQQGDTPPSAEAPAAPPYGDRPPPPLGASLGTTHALSPNRGGSTGPQRAGGPHTPREPLGGPRRKANTGGFRAPPYTPGPTSRANLGRG

SEQ ID NO: 1010997 - protein, 123 aa, Homo sapiens
TSARQVVCLGGRYGVKLSMVRIEVMARWDGDVLFEAVLFGRLGGEEFVAHLRFSLVQAGGEKTTLPERSPPPRSKSPGELWPHLLCPRDSPGWIYADRRVGTSRRVVHKRLFFGRERAADLEN

SEQ ID NO: 1010998 - protein, 125 aa, Homo sapiens
GVREVLGHNARPRPPCTCVQHAALKSAEEDLKVPVFPANGGPSSKDVKVASQIGPAKMALIQMGSSGGGGPGPHLTCTTTTSRENHHLRVSFVQGPPSRGTGPHGRAPWRQLSIIPEKSHVVKTA

SEQ ID NO: 1010999 - protein, 103 aa, Homo sapiens
VSYYWWWLVIYRVRSGCSFGGVRLNMIISLSYLRWGVFFFLGGPPRLFYIMMGGPSRTQFCCVFFPPSSSRLFWWAPPLLFFTPCFLERVCVGYTFFASRSVC

SEQ ID NO: 1011000 - protein, 236 aa, Homo sapiens
VLSSLFGSVSSRTWRAGVCLVVVLFALLTTYLGWRGVVAGAAGRSYQDGVVWCRRRTGCVPWGGGVESVGGLAICAWGEVGCVLFVSFFLFFVGARGEDLGLVCVLMRLILICCCCVRPRSVCFSVGSGCVEFYYAPPLFVVFVLLATVRWFVLVGIVCLWSGLCSWGGVVICVGVGVGVGVCCALVVYSRSAVVLCGPVGSVVGGDRCWCVVVVGFLRRVWWFMVFFPRRGVFVC

SEQ ID NO: 1011001 - protein, 109 aa, Homo sapiens
PAGAGSSLCVTSLIACVAPVVCCYPNSWVGVESCWGRFVVQSLGCVSLFWVGGDVFPLCIFWGLLVEGLAVCGCLYKVVCSISDVSSPLFWCGLRAPAVSFFLLCGSST

SEQ ID NO: 1011002 - protein, 236 aa, Homo sapiens
RSVDGDSCSWMCCLGVFVVERRLRCGVVSGHVCVVVLARIDVFVFVGVSVRSPLLRVRINRDSAVVCVVCGCALRSSPPSSFVRGCVCEVFFSPRLWLLFVVGVCPVNSCVVWVFPVMVSTARRRLCLCVFDLPLEVVRCLAALRWVLSRRPARWLCGVATHAARVCCSGLRFISSAVRSGALLLVIDQVVRRSSSEVGLSFRHCWGGDVCLVLAVGSILFVVACSLRVSGRDSVH

SEQ ID NO: 1011003 - protein, 115 aa, Homo sapiens
MATDTVWLGTLHRRPPLSWFRKWISSLPQMKDNYYYDCALRAAVYSYRGGGCFFKEREQPFPSLRREPTSTVLFVTSHSASAHGGGGYSHTPLILSGGTTHSVSLPSERVLLLKH

SEQ ID NO: 1011004 - protein, 232 aa, Homo sapiens
MFTLPPTCSALWPGVGDYISSPHRGLVYDTCCLLAGRIPAGGRCSPQQGGALSSGETPLLCSRRGCPLSLGRALLVEGEMCRFLLYTRARAPFVAPTVVCPHATRGETSLAPRMVRGVSLPHHRARGPSVRPQHIFAARSICAALCPLCHTRGRPRHRHTARDPGARGTPPHTERPHPCLCALPTHACQDFSREGRRDGSPWWHRGAPPVVGWRRVLFIFRSCCRNKNGLNL

SEQ ID NO: 1011005 - protein, 77 aa, Homo sapiens
MRGLLDPAFGLGKSPLFTAGGVGPLTKGAKLVDQGLEGIPTGMTRAHCVGGPAGDGPRCGCRRLGGAKILLFLLHQT

SEQ ID NO: 1011006 - protein, 216 aa, Homo sapiens
MGVHWFGSFEYGAETEKLQKQLASEKEIQMQLQEEVSLAAGFCPHPGEPLAQSGDPRPLELPDSGEDKQELSLVRFHPLHAWHSPAGDSSIKVLSGVECRYLPCGPPHDTRSPEPGPLALSLRADRQGVLDWGVPGSQQSVWVGSQLQDLREKYMHLWAALLIEMQEEVEDPPGNKPRCPLGLPPLPYSVPLVEDPPLVATFYVCACVSPWWLTGI

SEQ ID NO: 1011007 - protein, 348 aa, Homo sapiens
VGATALCRGERCRRMPETRSRRRLPRRIPRAGVDRAAGSHDPCITSVNLLRSLPSFPLLHHHTQLAAVTVVVCVEGALGRRRRGSPGPTRTPPRLHPGPQLLIGHSGKCVQVVEFSLLSIAPRLLTTVDGPPWEWPPVFLGPLRVSCQDHTGPQSAKRSYHEATRGQPRSEAEPEDAPPMYGPNTPVVTSAIMRPCIAHPAPVSLPHPPPRHQPPSRPYRAHTPTGPVVTPSYLPNPAQPFPVPCTLVGADRLRRAAPLSSRVAPPRPSISRVTPSSSALRHAWSLQPSSGLDDGCMARRRLFARAPAVLAGNYVLEMGLAPWGDPITGRSASSPWLPALRHSYSRFP

SEQ ID NO: 1011008 - protein, 297 aa, Homo sapiens
QLLPPGGLCRPKSFSSRLPQAQLRPLGGLSGCKSSSSQPLQAQLLLPPSGLFRPSPAHASRRPSQAPLLTFGGLCRPRQGPASCLQKACTRPMSLRSAADSPSPMPSSRRHCRPPESNSSCLLGRFGRPSSRLPVASCRPYGAALPAQTAVSRPSFFPVSWRTVSGAQITSLEVWRSPDRIYAAVPVISLRSPDSVPPVLRLPGPTFGLPNKRLWTQLLPSLPAALVGPTASRSQAPQAQLRPHGGLSRPAPCPLMASAGPRRPPVGGLLKARLWASWRPLQANTVLKVGSPGQLRP

SEQ ID NO: 1011009 - protein, 224 aa, Homo sapiens
MSLLLLHSAWLLILLERSSLYHVPSFRAILSTLLQCSNVIPQVQALRILGSSIDEQVVPSPGHHSSGTLGGLSVVHKVPRCHALSRPSSSCLPVDFIQPPAQLMALSGLTQVPLLTFGGLLSGPELDLQSDHSAGPASCLLKGLHRAPASASASQRTLHAQLALASLWPPPVTKLLPYAATSAGPAPACQRHSLGPAHSSPTAFPGPVFPFRQILRRGWTFVVL

SEQ ID NO: 1011010 - protein, 255 aa, Homo sapiens
MTVHKLTLFDLEVECVCTYSNGTDNESKHGIPKVGGDIMLMYGMLFSIRSFVMQDVAALDSEGWLPWPSKRMPVTNSITTDVAHHGDQIVVMTVLTLGVGPIQKDVLAATVYSALYCGAGGEEIPCARMGQSCAHVTLFRSRLDSYVRSLPFFSVPVLAEASYLKSPGEFMSAWGPIRNLCLTKGPPFVPQNQPNDLLTSVGYDDRFWLSVARNNLWSPCSRLPPTSSAPILLPGFYGLCVPESLLRVMVTAPRC

SEQ ID NO: 1011011 - protein, 81 aa, Homo sapiens
RTSINTHGRGICRSVEMLKNQGDHEEECLSTSIAQLKVVQTKYVEAKDFLNGAEQEQLRVWGRRVRVTLQWRTCFSRPHAS

SEQ ID NO: 1011012 - protein, 334 aa, Homo sapiens
RRPQQTCRGSGACRWLREQLGCLDAGQGVANSVAKHGTRGFHFTVDGNKRASAKVSDSISAQYPVVDHEFDAVLVGAGGAGLLSCYLDRYREAEGLITAVCYQAVFLPVSHTVAGTREESMLLWGTWRRTTWQVAFRTTLVKGSVLCLVGPVMPSTTLTDAGAPRDDGSSYNNYGMPFRENVKDGKIFISVHLVDRASSLEEGGQAQIGAAVLGDRTGHSRIAHHYMEGSLRYDTSLCVEYSALDLLMENGGVPVVVNVTVHKTKGVTVQSTYRSKSTTGEVADREGQRGRHPTLTGMQRSGPQPQALGDRARPVSHQGQGSYMARNRRWTGPA

SEQ ID NO: 1011013 - protein, 110 aa, Homo sapiens
GSSEKARGCPVLAMADYLISCGARPTCRTTESQHSSSSTAETASPYKCVAYGAHLGEERGGTLVNKARWGLPESRLGLGVGDRSRELYTHAPGSHFETSGAVLWGTEKHL

SEQ ID NO: 1011014 - protein, 361 aa, Homo sapiens
RAGLMSRTVEPILSNAMQASRVRTPCQQTFRANWLSCTAESGLQHGARDASSSVTPFHYEKAYSLTVRKSLEARHSQRPGREQWTVQVCRGRCNEPGECQLWTALREQVPSPESRLASLSRRSMGLYDVAVPESLGLHGWVKTHGRQKGCIDGGFVDGACILTCRCPAEDPFMRISPRIKSAHARDEGWVHGRLGIYPAVDRLRPWQMASIVERASERFVKRLECSSAHRAPSSSPILMFLAAASPEAKRDTVHALVVSPCNRGGLGDLKGEVSLPFVKEPVRSQLRRGIGDTVRSGVIIPPQRHCWGPPSVWGPSRNSPCVGLSGSLKPHQGKLVRMAQEKWLLRQILGGKVERQLESTF

SEQ ID NO: 1011015 - protein, 145 aa, Homo sapiens
MHTARSPICNILGPTVNHFSSVKFRGICLRALTVSCQLGRHYCGYTNCDTCLTLFTVDLKSRSSPKIYMVLHEVKLSGLTMGASRPIGPVGKVPVVVYTTVYEELRGFPPIGLGPGAGILLNFLGPPRVLNPAPAFRVVPKALEN

SEQ ID NO: 1011016 - protein, 109 aa, Homo sapiens
MWVSRHIVVHTGWGFSELSWPLQVVVPAASRASHSGLGLSRCEAPVPTAPQYGFKGVSQPSSLLGADPRYFCVPFSPALMPPPRFHRGHPHPGALFREKKWNTNLGPKP

SEQ ID NO: 1011017 - protein, 106 aa, Homo sapiens
MVPSMSPGGTGAPLKLVRPRDCRHVGPLSPRVPSRTSGYLPGFTGLTGELLAMTQFWATHEVWRTLRKGSPFKGRREISKGPSFVVLKQFGHGTHPGLPLQVGFPL

SEQ ID NO: 1011018 - protein, 184 aa, Homo sapiens
MTVPIRRKIESHSVSFWDGVCFQNRRPFSIFLWRKIGGWCSLSRPQTLGQRGGFSEPEALPCSPGALTARRQWAEHLHGCGPCGDAGSMRCCGLAQRQHAGVSMADRVSELAWPEYHAWCHAVAPVATKEFEASRASSATGHRKRILRLLQTGTEEGSLDPKSDSAMETIHQARPRQGTGHLET

SEQ ID NO: 1011019 - protein, 105 aa, Homo sapiens
MEGVDCVNGVGNKSACRGKRATKEAGSVLAEPSRAWMSRESSRFERSADSPLLSSPLAFVTPWEFRFLYRGFPSSAWVHFYQLTFYYSAGVTLRVVWGYGGLFAL

SEQ ID NO: 1011020 - protein, 212 aa, Homo sapiens
MGTSSTDSQQAGHRRCSTSNTSAENLTCLSLPGSPGKTAPLPGPAQAGAGQPLPKGCAAVKAEVGIPAPHTSQEVRIHIRRLLSWAAPGACGLRSTPCALLSWAAPGACGLRSTPCALPQALPQARPCPGRWFFPGCSLPTGGAQTILSLWTWRHFLNWALQQREENSGRARRVPPVPRTAPVSKGEGSLPPRTQMERKSRQSPLTWGCTNP

SEQ ID NO: 1011021 - protein, 183 aa, Homo sapiens
LGRRPLLCTRNARRCLSVSFSVALLPPTAPSPLLVRVCFLSLLLRRRQQQRLFSNDRSTLFTRASLSSDSTTPRGGRHDVFLSTPLVVFFITRLALTHVFSHHSWVSGGRRTPRLMILLPPSLLLFCPLTSAAVMSLVFLSHPLLRHSAVMYRLLLLLPPHAWCISSSATTPRAQRTLVCVFK

SEQ ID NO: 1011022 - protein, 189 aa, Homo sapiens
MSTVFTRRCSPTPTQWFFTPPSYRESRGTQRGGGRQHSLVVCSHNERDLGGAHTHTQGPPALWRAHLGVLGKRRTHGEHTSGGLVRGVHTRSSALTRLFIAQLSPVWEKKRAHSAQTWGGSRMDCVRCRHARRYSRDGRMHLRPISPTHGGEWVTPAWRPEDHVHWGHPSPRPGGNLSPAFPGPKIFSL

SEQ ID NO: 1011023 - protein, 145 aa, Homo sapiens
HATTILSSLTHTLLNNNARRERNMIFSLLMQGGVCVYRHHTLLPSLSLALSVSHTHAGARALSLSSTHTRTHISLSSRKRYFCSPPPAGRSTPRGAPHITKEGGIKGGVFPPHTRCPHSGYPPAGRPVFSPRVSLFSRGHTHITL

SEQ ID NO: 1011024 - protein, 141 aa, Homo sapiens
RGVLSLLINIKSYTSCLMKPALLLLRGFVVVQHAGLCVAHKSGCPRQILLSYCAQRCLDTTVTRGARGGRHKIASSSCRKTIDLFIITRGGAGILSFLSPDAAEVCFGAADNKYYPTEQPCLFSSTRGVIIVEAPRGDDII

SEQ ID NO: 1011025 - protein, 144 aa, Homo sapiens
MCVPLLGHRDTPTHSRNFFSPEREKPPSAFSTYNRARESSPHTAVCHIEGQQLVWRTHARELISSHAPRECLTKEKRLTQRRGPLFSRRGSQRSHDTTEIKHFLYTQPLPKPRHTHSLSGVSLLAGRKHSRETLVPTLPSLSSL

SEQ ID NO: 1011026 - protein, 149 aa, Homo sapiens
AKCHPPGEWTRNRSIPLPRKDAGDTKHLPGRAARFVLRPPRFVSRRTNICPERARKTLSLLSVVRPAAPHTICGGDTPLLCRGAQIPPNSSQRSARAPHIPLWDTKRGLHSGGRTHPRETKDGAHVAPQPKRATGGPPLGGRCLVPGAQ

SEQ ID NO: 1011027 - protein, 154 aa, Homo sapiens
VLCPGDKLHCCGLALPTLVVILRLVAVLLSIVEVTSFSYHGASWRRGFFAPPVVLCCRHFLGGALLLCWGAGDSLCSAGVQLGFCTRPIVVVRFVALCGIRPLHCVVFRLCSVSLSFSIHGPLFKGRCCVVYMPLIEYRVVISHTLNGRLVPLV

SEQ ID NO: 1011028 - protein, 87 aa, Homo sapiens
LGPPLGFFAPRGEPPLIGSDPCRVVFDSLPPPRGNPGLFPRPGYLRRFSSHRVAAPVGVHTRSLLRTTIVGRYFYITRGGEPPRVYG

SEQ ID NO: 1011029 - protein, 170 aa, Homo sapiens
MFLPPAERTPLYSGVLFYRDHFLCSPQARPRGGVIHTRPPLAWGCTSPSGVSPGGHLSVGGFFRARSIELTTPHRECLTTQRGIRLPLVPHTAHAPLLNLFSCFASTERWETAGPSSTVFFQTFIPEECELSLLVLHGASPLCGPPLQCPPLDPLALHWVPSPGRGDPPL

SEQ ID NO: 1011030 - protein, 397 aa, Homo sapiens
MCFRVHMSHWSVFLASLVFFRSASTKLCVLSSASFCWCGGLISFLFLAAASLQGFPISLCWLFVHSLRSAVCWPGWRILPTLASLFLLPFLVGGMGQLLHQHYSSHFLALRHTPLVLSLSSCFLLSVLHCEYLTVFIERLRPLVLYNQESVSLPRLLATSLPLVPFPHPPCFCCSVLPSPLMRGWWLSLSLPLSPSVAEDTNSMCVPAPLLSRWVVDQNWWRVPPLALALSLSLSASLLWRPCPVLPLLFYPFSGACMRFPPRVLSLRGRARHRYRSPPLCCYRRSTPHSPRALSVGSSATVRLLSLLPTLMFVSSCFCLFLSLAIYPRRSSSLTPTLQVCRLVPPLPLFHGTATLGGSVFFIVVICSCPRPPFFFFFAPRFWGTFGGGGKIFFFPH

SEQ ID NO: 1011031 - protein, 192 aa, Homo sapiens
MGSYALVIWPIIYSQLYGVLPCSTGPRPPMGFLRLFVAPTKTYAQDVSQSLLAICYCRNGLFLGATTFVLGPGLEISSDHECFCLMQGSNWNAALLYQCLRRELMVRTRGTKTLPHVNAPRYFTSRWQLTSCLCEGTLGTHACLTYGRPHPPGLKWENRDFVRWMPSVVHWRFAPSTIYDPVPRQMAGYGPH

SEQ ID NO: 1011032 - protein, 114 aa, Homo sapiens
LSGCGLSLFFLLSVLVGPANFVVFEKWGFLRCFSFLGPVGTGCHKSFCVRRCLRTLGPSSGCSLSLSRDVLPHLPRAPSLWVVRDRDTLSDVGSREQTALCVRPHLSLGHCGAL

SEQ ID NO: 1011033 - protein, 82 aa, Homo sapiens
PPASLSVVVVLFWVRLRSRGSLLLFLCVAPSHCVVSPLDAVFFLRGGPPSNGRPPLLFSTVHFPRGIPAVMEPTGGPWPSMG

SEQ ID NO: 1011034 - protein, 435 aa, Homo sapiens
LCVCLLWVAQPLFLLTHYRGAPRWISMFSLGGGAAQSSVRFVLAFASIFVGCWLRLLAPSDVMVCNLTDHRVVIIVPAGPHSLCATLHALWRIHRLLDASHMEVGQNSPQLGSDRLWADNACAAVADKIFRSQLRRYDDTHHMVVVHSGRRDKSLLVGEKKMTPPQVRIDIDDRRLSTTDCWSLWHNNVGGDIFVVPPPTCRTIVSVCGATTPPPVLERSKTTLLCSTQEWSRKMSTSSREVNSTHHLWATKSHVMILVRAPHLVGRPLGRQGANRKSVSEGAPQVRRAHHCALILQHVCPRWYSFCMCGARSPPVSHVSRFSPRENAQQNLWGTHTTTAHGGCPRISRCRAPLVMARLPSPCNLVFATTTGCLAPPGWALLFSCQDKSWVHPILPVSLLNTPKEQRPQQNQRVFATNLRGNQGGPPIKPLVIIC

SEQ ID NO: 1011035 - protein, 127 aa, Homo sapiens
SPGPGRPFAWGCTFALQKSYVASDGAHQLLGAAHSKQHDVTHERRPLLNTRLGEHCKVTSCSRSKRKDNKRREQRTTSIPLTAHYSQVNFVKLSGLWSYLTQIFPVQTVLIFSRFAIAAGKSALGQR

SEQ ID NO: 1011036 - protein, 136 aa, Homo sapiens
SGNNSLCYGFLSGFSTGSTRDYFFGGYSSPVISGIAVQRYQFSQGSMGPHEGYAFHFGHTWSLFSAMCDYPSPSYTGPLKLDALCAPASSYFPRCVLHGCPTPSYLVSQSVKVYLDPGGVHGCLTPDLPGEHGGRF

SEQ ID NO: 1011037 - protein, 310 aa, Homo sapiens
VHCPHTFTRWCPEKERDNVPPEKAEAPGSAAGRGPRKPEEVRRGRRKRTTTTNGDRSMKRGENEEEGRKTAEAGSEKDGRGPAGSPGRAVAMDGEEVPEVMAGTSKLEDKQRLAQEEEVTAKRLAIIDDRRRREKYLYQKIMFGKRRKIRDGQQAARRSGKPTMSAARGLRRRTKKVKAGVELALMAPHRARGQPARQLDVARGRPRGHKCDGSRVNFSLSPFSSQPLTPNALWHGPEGSPSLPHWIGAAMLVPGQRRGLCAELDIICSKRASDMRRRGQRSTLLLASIHHGYNSHLQHSGPGLRRVMSG

SEQ ID NO: 1011038 - protein, 80 aa, Homo sapiens
VLTVCCRPLPHTTAGPGFIPEFVTLTRGPVSNNLCSGNRDPFEPPALMAVYSQANARPLVSAPGFRRFPRLLRLLPGVPC

SEQ ID NO: 1011039 - protein, 175 aa, Homo sapiens
MMRRHAQCVDIDRGFVGTSRYAEVPFLPGYRSGLVPVCSIHRCLAHVQLYDHQTEEPCMRPDVRSCSLTWETPKVVHGWQSGYQHKRMPSAGCLRRDRDPPCRLTLQSLGVLDCLGTIAIHASPLLVTHGSPLARVARVMPVSPYHRTLSMHLASDGAITIDFDCPLRRSARCGC

SEQ ID NO: 1011040 - protein, 342 aa, Homo sapiens
LGALAGVWPGSSCAVCPRGVRRCSSTRLPSPCSVSFAFVPFWFPLWSYVSYSSGGAIVAVSGLPCLRAGSYPFVLPLGCSGLSLSLSRRCPLLFVIIAAAPSQAYGGDHRSKLSATIETLKALSVWDMDTLGHPSDSGKHYEASSVVISTCRVLGSRIEVEGSLVNVTVMSSVGPHCLGSTRGWSCPGPLVGTSWGVSLESSLMCTSLLCISYIAVSSNSQIFRVFHPLKLRHQGVFQRPAYGVIDKRKADETQGPVSGSLSRLRAWSIAELTVTGGVCSGQTRSSFMNTQQPEQSPRALPLMRAPDMAVPRDSSVLEGTPRTTARVWGLHVIVYDSVKTGP

SEQ ID NO: 1011041 - protein, 106 aa, Homo sapiens
GRCTLFFCFFTGALWCFFYGLFFLLYVTILKCIVVMSYQLSTSSVFRGFQRSRYLFLRNVWYSCMYISRITTLASSTADSGQMLTDISFNQFVSVLLLYITLLAKL

SEQ ID NO: 1011042 - protein, 202 aa, Homo sapiens
SPAVCGSRGCSSGPGSPGVSGVREVRRGARLSLPVRWVVRCFAVAPVAPVAGAGDAQGCPGSLSSCGLAAVASCLGLPVSALGSRTVLRARRLGDTWCLQGPRLLALPGAGMAPVFSGSAGRLWLLRPTPRGYLVRLGSGRGWVLSPPWARWVHLCWTWRQSESRASLLAIQPLSPQEQLQSRDLPTLMLRVTNAWDPWCWI

SEQ ID NO: 1011043 - protein, 148 aa, Homo sapiens
MVPSLLDIPTLALWNIVDYAIRTGPTEELEWNDFMVSSDLLRRHSGLEYSCIETELTEHKEKDPYLLSQERQVLKVRYGTGHGGLCGELLMAPVVLKTPPPRQCGDLFPAPLSACPSAWEAFYATNPLSTLSSRHPPRKTSTLGPLSC

SEQ ID NO: 1011044 - protein, 164 aa, Homo sapiens
TDLREFPIHCVSRHLCSDKTLSVKAALGVSVGVHRMASYGAEALERTVPGPSPPSKTYFPHFDLSHGSAQVKGHGKKVRCDALTNRQWAQQWTDMQPTRCPPVSDAAQRTSYQGGSRSTSSSKPLPCLVTLARPLSPHEYPLQVHAYLDKFLASVSTVLTSKYR

SEQ ID NO: 1011045 - protein, 104 aa, Homo sapiens
MDQSLWPLTHPWTSPSWPSSWGATWDTLAMKMSLWLPPVSRRELQTSRPRLMSTYICLYTSLVIGAGDTLMSKIRGQRKASNTCTLAGEAHRDLLMNSRTEQIR

SEQ ID NO: 1011046 - protein, 129 aa, Homo sapiens
MSSLGNPTCGTLWGALLYTYNWTPALSYQCAQIRPPRRLRSPPLPHFPCMVCLLMLHGELDVDSYCNIIYCVYCNREGREGAYRGGVGLLPPGTQARGDIGTGTPATWPSPLCTVLWKRYTHVVSKEFI

SEQ ID NO: 1011047 - protein, 181 aa, Homo sapiens
FWFVYCVCFSSFVLFVAPFCVGAFCFCLVFFWSVRIVLVSSWLTCVVCFLLFLVGVSFLFFLVPLPSISMSRSAFWSFCSSIPLSSWVSLSSLSCLSFFELWSFLCSILFLLFDIPLSPSVCLLHLCLFVLYVLPILLGPLTVLGVSSLFLCLFRASSHWLSLISLLLSVLSSRCPFFSLS

SEQ ID NO: 1011048 - protein, 139 aa, Homo sapiens
MTSKIWSPLEESRIFNRILADEVITRKNSCLEETRSHHYSSSLFHVEDVGFTYIISELTGWRVTDQKALVKRMKMRMRNNKLFFGKHLQCSSNLYKTFIIFVFVYRAASAIYNGYGVFGVFPFFWDNANSVVVDMIDVS

SEQ ID NO: 1011049 - protein, 151 aa, Homo sapiens
MTGSDCQIFHSRGRAGVYLATVKSHHAECQVGGFEGKGRWGMTSVRHCAESCESGAGHRSSACYPCCATSSCYRHPSAPSQPSTLQVPPKLVLRALAPCWVKQVLRWSVKGLESRCEHPGPCSPLLGIRCRPCPLVAGPHSYTELEVLCSE

SEQ ID NO: 1011050 - protein, 112 aa, Homo sapiens
GENWRGTPMTGCWLDVPCTTDRHSLHEEENNMLYAVKEEGATDTCLSLQDAALLADWTPGPPNQEATVGLLLPCVTSAQRYRNEVLMADKADHLSCLANSTTALQGTGLEDS

SEQ ID NO: 1011051 - protein, 239 aa, Homo sapiens
STGPESWVLPGHLLLRCMLLSEPQASVWPSCWRSLGRASEDRSAEPGVPTWDCEDGSSRRRGRGDGTPRDAGLCEPPASALTTRGSCYLTVHLINFKQLKDPPFIWVFGVVFPGRQRCVVETAEAFQETDLGFRCRATGRGPGSAGACFCLLLTGLTHLLLKLSTPGAFRYPGARPHCLHGALVPAPGPVQGTCVADKPGSYLQPGLPAHPASPRPVKDGADVAVGDLIYRVTSKSHSA

SEQ ID NO: 1011052 - protein, 106 aa, Homo sapiens
MFDLLRPSSLCHLIEHSFEGMAGTFKCPVCFTVFVHGQQVVSSTSFAVQVMEDKIYDLLTVPQKFFFQTELQNLHDEPSTHSEGSLNRYTSPQIGLLGDRRGVGPI

SEQ ID NO: 1011053 - protein, 331 aa, Homo sapiens
DLKRNEFTWCQRHSQAIMAIPLVRWSLKGTIDTLPSPAYCESTILATIILSHQRGPSYCRSVIPTVRGLSRRVDPGNKDIEHPHCPGEHRWREYSSLEHESVAGLVESLIDSVTRPSPCAFAGCTAFQAWLQDDSGSNESDGPGGTMANIMIIWADGLFLQCCMGVLTSLATPQITFENMIVDDTTMHVCVSRPQQFDCSWWMPNRHIGNIVNNVCSRDWSGGPGLVCWGQLWPLCTRCLKQLRGTPCKSIANKNIGQPYLATLLASCMIAGPPHELHSYATSIRIGCPWQSMDNENTAHSGHRGPGHNILKPSTDVIRHIRVINGRAVEA

SEQ ID NO: 1011054 - protein, 170 aa, Homo sapiens
VLFWFCGCCAMSGWRLARSPLCTLLPLLWLKAPVWMHAFLVECLAAFECPVKSSSRVCPMSTAMSPVGELAAPDAAHPHPESCTLLAQDAREAYLPGSLGPSSSTSPRDPSLMPALPPSGLWGGRSPSSLQRGLPGALGGLLTPLFLRGVLAYLIWWTAACQLLASLFGL

SEQ ID NO: 1011055 - protein, 234 aa, Homo sapiens
ESHLPNKVGPFLYKIRASSLGLSRVLSDIGTVVRYHTVGGISAPESDPLTALMYLLPSEASSHHLQRLECGVCPDLGAELPRHPGTRDWTCTQARLHRTHGACWVRAEASLHARPQRHALTAASWLRGPGWARKRLNIRRHFRGSSCLKSTRIRIQFVDPKVISGDPWRETWTLASRQTAVITEQWFQPHGGTQEFAFEASMCHDLCPHPLLGGRLLMRILQDMTCIGQSTIAP

SEQ ID NO: 1011056 - protein, 127 aa, Homo sapiens
MQLYSLIATFPQVPLCGIGDPSPRLYELGTRGVGNPSLGPPLVASAPSVICLSINTQVASLPPLSGTPQSLFEPGHVNVQCLPMVFFRGPRSPIASFRQFPTGAVKGLLSASCLCGTCFSLLTLNAE

SEQ ID NO: 1011057 - protein, 327 aa, Homo sapiens
DTLSDVPYALTKCNVSLTGIDDKVELVTLDLDLSRLLAASHEFLPPTMFYPASLISRSLLWASPDDFICPRMGKVFGSPFDRLSVELKLTLGVTWPCTLILASRTSTKQGTALLVTYVLTKDRSYRALSSPTLVLVCLVRHRTGPFMVGARSPNLADLASCIGVLDMMEGLDAFDDLMQHTHIHALVPAGGEGHHRGLPSALNVPAQSMREGSGRRQHARAWGHWASAWRYWLGAGSFCRLCPRTRHQPSQLLITGHLLGLRRCYGIELQRHAQCQWGRPLACPLPSCSAAPLPGPLSGCLMANPVGGGPRRTAGRFVLSGIHTWFL

SEQ ID NO: 1011058 - protein, 276 aa, Homo sapiens
LERVRVSVKCQATSIWDGMLAGHAYSSVFPVRKPRQGPVVPEIGPLRTTFGQPVAPSVRVMLQFFVHVPEPCLPVPVRPRPGAREKQEQFVDLYKEFEPSTGQQHRLHHGHGNADGHLRHQLQRPALHGEPAREQAPGVGVWQFQLLAIIGLLLGSSPDFNSQFGLVDIPVEFKTWSLRQVLLHGLHALALIGRTRVLQLFMGTPKHDKCYFLRWLVLVLHMLIMCVTRWAGTALTGPREGTLPSNPPTSKASTVIALGRLSWDPHSHPCTGQQNK

SEQ ID NO: 1011059 - protein, 183 aa, Homo sapiens
GRRRFNMFCRACGGSCHSAGSPTLSSRRSFPTRFGAHVRRSTRWSAAPVKPAWRPTCAAHGSAACLLLLRRLGTAPAVPRPSAFPVKYSSAAGGPKATGDYDKKELRLRALGTAGPLLPANACEALDKPGDPRMDRGFRRVERASRLLGTSGHLRPDGGIQESAPACARSMTFVLPTSPAHAA

SEQ ID NO: 1011060 - protein, 75 aa, Homo sapiens
FFPDSERDFPYVQPVVMSFLAPGAPQVACKVPRWIHSFCGNSNIDVGSTGEFVKRWHVSCELCLMALTLIIAVSD

SEQ ID NO: 1011061 - protein, 217 aa, Homo sapiens
MRKRGLDQERPRLLEDAEKDVTPVGSRTDPRYEGGPMTSGSVKGALGTSARSASLLTALAAEIRVRLSLLTQVSYKGTRLDEEQDGPQALELYGLLSRAAMWSLTASDPTRLEMFSCILNSSGLLGTVVHVIGKPVAVSQIFNELQAAILLAQVSLGEACQCNRWTTIRPAYRGYARPGHRWQAAGHSGLKAAWGHNCSLATHRDLAPTGWSVPRGL

SEQ ID NO: 1011062 - protein, 37 aa, Homo sapiens
GQGKRVCGGGPDGPGAQREEAPGQRRSGVGVRGSTER

SEQ ID NO: 1011063 - protein, 109 aa, Homo sapiens
MRRLMWVPAISGRQVLLRWSGAARRRIPGIGQEAHSSWTSLNAWKRTVESWDTQHASSRLRNALHRPAGDIPCTYVASGTRHGAQRALDHGAVALRVEIPPLMTDRIAV

SEQ ID NO: 1011064 - protein, 314 aa, Homo sapiens
MSLGWPCVLIWCLLASPNVPQGAPKLQASPAALHLTNWPTSRFSFQRSNAAHVVAFTGSSPGLLSDQPGQVPGDHEWSSLRILPRRDQTKHALCRIMGPSPSLARHPQQSQSTFLQLFVIVPLIANRQGGTVVISRHQRLRTQPGQPSSRTPMHTLTLGAIMAADMTERTKAHKGLPRCSGNVTSAHGWHRPPPLLETQHAHVVSLMLWTMMGAPRTVLHCCELKVMRSLATSLAFSANLLLNREELGLITRVTFLLALSAHSYTSPPHPVWIQMKPPGPQALALPDLHPPRQKYMRGAEMSTQLYTRSGGKTE

SEQ ID NO: 1011065 - protein, 109 aa, Homo sapiens
MAHGLSELVLPSWTWVYLSDISRMIRLLGLRYTVDYYAVCVWNKYHGVYSRSVHVWGTVPSVCTLNGAVRYGCQHVPCEHHGALLTPHPENNKDESDSCGDGYGNPRAS

SEQ ID NO: 1011066 - protein, 158 aa, Homo sapiens
MGRPWPRGVSPRIRDVHTMFLDLGHQALCISSCLRPRVSSSRASLVEPCPSFGGHVVLSVPLHPASFSRLPSLPNSSSSQLDTSLVLVSTVGSRIAPPRHVLMAQAPVVGGSLCWIPSAMESWCRDVGPDHFRSASPSSSLRGPPCGPRHSTLTASQD

SEQ ID NO: 1011067 - protein, 209 aa, Homo sapiens
SQGDGLRDDCGAPVRWIVRLSCDLYSWAAWVFRTGSATGIAASQRRFRGVHGTCFKSQTLTAACPPPLPLLHSLSTGYSQAQSKSPERPPSHGREKPLLWLKGPCDIFCHPERRQHDTCSRSSIGPVPIPRSTPQLAPNSRLGSAPNSTLSEMSSTPQQLPSPDESTPQQHPLHMRVHPNPHPLQMQPHLLSTPGPEYPQLRLSSWVQP

SEQ ID NO: 1011068 - protein, 64 aa, Homo sapiens
KSKSPKAEELGLLDLHQWFARGSRAFGHRLKAALSGFPTFEVLGLGLIHHYLPCPSALTPPIVD

SEQ ID NO: 1011069 - protein, 99 aa, Homo sapiens
MGVATRRAEDVWSCAVELRLGNGHHAGALCVVGLGNVMCMLQAAAALYGFLRPLTLLPILSNITDELPLLLLAWGAQWPGRGVVEPVAVTLSLRYPERW

SEQ ID NO: 1011070 - protein, 169 aa, Homo sapiens
ILIFFRLLKGIFPGDSKAILNPWDQLSSSPQEDDLPHGMPFIAGPWVDGNPPYCVENYDCSFPQVSKLAGFLVTSLEPGGSILGYAVISHRCTPVEHCSKRRGDHLDDKSMSSSVEELFPGNPFGREGAMPRYRCVATCCVQTKYPQSLHLVRRGLNRVPIDGVCAMES

SEQ ID NO: 1011071 - protein, 182 aa, Homo sapiens
ARAPSLEFRSLKRLTLVVAVPSAVPPVPPPLPFPLPPLVIRDFLVQMPEPLSDGPVQFFSAQDLVIGHYRKVQGPLGTTGEVPRAIWEDVERIGLPLRSPIAHGTDAVPKSPGQDHGALAQARSGACCSLLRSPRRLRVDSSSLQNWLMGQEVQAWALGPSYDGPLELAAQTPIFELLPYIK

SEQ ID NO: 1011072 - protein, 171 aa, Homo sapiens
MVLDKYALSMGQFLARRCVGRSLEVTALVTYVLGLHVRRRWRNDGFPPFGGGICCGKSLSAWRRFFATLRVGGDRHRIWGYGHRSRSSDTCASRRRLKAAHTRWTGACSGAMHTRQGGWTQPRNRRDDAQRHRLEAPRKECVIPGEAAAGTHRQESANLELVAEGHVTHLS

SEQ ID NO: 1011073 - protein, 199 aa, Homo sapiens
RNCRGRVAGRTGRQAAAQRLNPLRAAGRPSHPRLCVSPASAFSDFPAPLLPSSLVLGVSPPAQRSPRPSRVKPLSAGRSPPRLRHSFSLWLVSQTALLAPGKTRLRPLNGTILSQEPVTSARGPSPGTNPGGLGPSAPALRRTQSAPRPRAGRTRTALLACRRSEPEPDRMDPDAMTARTARVTCLRSPSLGVRGAPTD

SEQ ID NO: 1011074 - protein, 222 aa, Homo sapiens
SGAGNGFYAAGSSRIRCPCPGSAWQIAEAAGRAVGACCCNQWPWDVTVYSAPGWRAPQGEPCCCGCRALGILLRGLLLWLIDYDDTASDRLCTFAMQVSLRCDKALPPVECLSSLWAMVPVGSPTCAMDTSTVLIDDTVLLCGRACNDADRGPAMCSMPLTSIRTIGSNPDVSGTCSWGPGDGTIHGCVLGEDHVHFWWATSRQVGLYCPDDYCDEARYQHP

SEQ ID NO: 1011075 - protein, 140 aa, Homo sapiens
MRLCLGFHREYKAGRLRGWRKETDVACNLIGPIATAEMGLQFAKNAGKKARRHMRPVHVRRVRRLVRKSQHLNSLYVFHSICGVDKNSAGGNSGSHPFNQNRYTDESIYAFAKPGILIWCRKKRIALDTIVPWDGNWNDR

SEQ ID NO: 1011076 - protein, 245 aa, Homo sapiens
RAVGARAVAGPAPWARSAVRTVVPEGRGLGRRERVGVARAVGRGMVGADAQLQLATLEGTIACSGATRGLLCLEQRRRQDPRDRERYGRDSVYDDVWHGIALRYETKDIIRTLRRHYKSVGDLGSRDYRTAGDRPGGTTGWGRVATTRQAPGGRALKGGAVEVSTRYVNDRLRPKRERSEAPYGGPTRKGTGRLPRAFKLTIGDGAAGRNGRSRRFARSPPAAYSGNHGPRFGGRLEPKIGPEED

SEQ ID NO: 1011077 - protein, 48 aa, Homo sapiens
MGARVEATSFLPWAWYVDVSRRLGHSAPGVAIRNPFGPPVRATAKFDG

SEQ ID NO: 1011078 - protein, 112 aa, Homo sapiens
MRNLGKLHHINIACGISQGLADNAPLTCLRGTLTVRAEDPWEQTVWEQTGNWYRWETFFKTLTGMSDKLQSRCSLQGTSNIAFSIHGLKANERRSPNGWHCLNDYGTRRNNK

SEQ ID NO: 1011079 - protein, 253 aa, Homo sapiens
AGWRLEEGERTCCTWVPPGVIDITSRGSLPKNGFLFSFSSTAYMGASIQSTEAQIEVTNELPLLRDPGDPYSDLKALLPLSLAHGTRRPWDSGPAIVTYPGQGGKGSTGDRTPGRSGTYRDVTFRPGLAKVTRLRMARGGRYGGYGSIVGRRRDVGRPEELKATEAIPQQFPGTDGNLEHLAEYPGKLKPGQDRDQREAQNTRHTGLRRPPSGKLNNQGMYPAYHERTVEALERFPCTLIGLPYRLYIRSSNI

SEQ ID NO: 1011080 - protein, 56 aa, Homo sapiens
MKRPCGVDNLVEEEKTIVPNKGDKNLESKTEESTYKFMKKTITPLGEAKPPIDEFI

SEQ ID NO: 1011081 - protein, 109 aa, Homo sapiens
RASVRRLVPRLEDAAGSRVLWRGRWARWATHMRGLSAVRRSSLANMLVAPESAKAEVSSTTVCAGSQRCLSLMKNEHKLGFSLVIYSSGCSYLILSLQTEGICRKSCDY

SEQ ID NO: 1011082 - protein, 140 aa, Homo sapiens
MLPRSKAVLGPHWNDHRGAKVLSPFQLRWPNVELDRSLHVQQRVKIDELWNNGQGPVFERITRHDRATFAPFPHVVKVRVKDVKGEAAEINEVAERPGGISGRPCAFKYSMKQRTGLAYHPENSADPQELPNCFRKVLPP

SEQ ID NO: 1011083 - protein, 133 aa, Homo sapiens
REQTPTGEEEWRAAVVDIAVGGGSRRRPAELGRVRPGRRCSDACVPPFVRAGTLVLPDRPQPASAQTGLQVTECLAVYAAIRPEMLAEAGGAHAPIVSYGTPPRTTSTFHETHDPSSVIPETSLQGPSGRTVV

SEQ ID NO: 1011084 - protein, 233 aa, Homo sapiens
MGGLFRSEEDDTGPAFSTVQRLLIVCVSELGELGKVHVLVTEYPDVNVVPSGKFGEMKLRRCEGNWIDRASTLLRKREENAKHSDYGQPVIEPCRFPSPRDMHLLRGRILSKIDKVNCKEDLNDKTRKALKRRLPGTEQNLEFILRRTQQSWMRWRIRDLLEESSIPLGANVDGKRLAPLRLGFVAGVINRERILLLSACFGGYAGEHVFLRQAEIGETRGGSCGIGTTVPKS

SEQ ID NO: 1011085 - protein, 419 aa, Homo sapiens
MSWSRRALTRRAGAGRGGRGAEKSGRAAERPGRGPGLCFAHRRPDGAQRALRPERPAALSPGGAWGLQREAQPESPRCVRPGRNTCTGRREGGKKTAAPHRYRPPEGQALKSDGGGGAVEGGRGHQEGTGRLGETCTIGTRRPGTYQWLQRITQMMPQGDPFTWRYHSGTMEKEGDIIGTHTNFQSTGNQGEEVPFSSSKGDHRLSKDTRRVGPCGGGAYFKGGKVSPKGCAQFTTDCRSEKSARSISQSRKVAALAEGAISTTKNAKRVGARPPVTESNGQEAPKLGEYQYTDQEGNRWKREKEGGSKGSPRREEYAEYRQRGGYPRYRKEALYRKAHRQKSKSKTADITEKEGHRLTPKEIVIAGRHRGRQKKTPRREWHHERAIRPDVAEIDRTSQSKQYSRSRSTKRTERPRADP

SEQ ID NO: 1011086 - protein, 116 aa, Homo sapiens
MGIFPQCGSRPDALAMGGICDLRRLGLRIPSMHTSVNKWHHFEETIPWGMRPYRMSPLRVFHYGVYQPCRLYGHRVLVCAAGTTVPFVWHLNSVADTPSTLGVSHFTIVPGSAQLF

SEQ ID NO: 1011087 - protein, 84 aa, Homo sapiens
RKVVQCDYKLPGIESGCRLRFRSLYQSLSLSVNEISVVGSRNLPEISDNSSSRQDLARPKERYVSSRELLDPVLGRWKRRAKRW

SEQ ID NO: 1011088 - protein, 133 aa, Homo sapiens
MLTYARDKVMVIQPNISEDAAFKVLSWNAETVPSTRVQNLLSNLIFHFNLHSRNCFRIRMKLASYNEVRDSAMKIWCRDSDRRTSLKEIKSPVYVLDVRSSAEEIQLADLRSSGATSPKKRSHRVIEIRNSFI

SEQ ID NO: 1011089 - protein, 189 aa, Homo sapiens
MVATAVAGTAGAAVRCQRGASEYTGSTRGVESIIMQVCPSYAWPMRQSESTSGVKMNRRQFRLCRVKDHYDSVVSGNTIVVWSSSEMIEEPSAPPYYCDEKYVNTYKTNYCAFIRRDHSLLLYLVDLESYAPANAWMVAEDQASHEKMQTESRANSVNNTCVVQDNASVVLLDEGGKSYSEVTLLITEC

SEQ ID NO: 1011090 - protein, 162 aa, Homo sapiens
SGFLGPRSGDGVNGGGTTVGDVRLSSRDCEHASRAAVPRAAVNGSRGRRAQSGGLYSFPMYQGFQLAIAYGGTQGHCSHRRKIRGDSIRDTYLQRYEAGTGRSNEQRDRGERHTRDALKSAKPEEKREGPKSPSDADELSAGHDDPFTRKGTEARKQCHHHT

SEQ ID NO: 1011091 - protein, 109 aa, Homo sapiens
RIFIQAPWPQPAGRGAAGYCLLLGLHLFLLTAGPDLGWKHPGQNVACADVKALYPPTSDRLYHLSARLDPIPAVESVVGGTTLVVMLIPQKSYVCHNKGWDGYDVAVGM

SEQ ID NO: 1011092 - protein, 271 aa, Homo sapiens
SAGVVSARRASARGARLASWPDAHPGSAGCARAAAPDAHWPRAGRRALHAPRPTLACILHCTRTPAGGNSQRHPGQTHCAGPRSGLPGPPTPRPLRHDAWHRDRAPLSPRSSPCPHLHTLRTASPRRLCPHVGPPWPHGPGQALGRAGPSDALLVLLALAPSKPIQPVGCNVRRRHTRGPHLLGPVCPRPTPPPVSAFRYHPSRCHTLPLPPWLPCLRNCNPLRPHTRHRPLRAGRPSPCSQVHKPRSPLRHLCTSQHGQPTLAGTALSPL

SEQ ID NO: 1011093 - protein, 72 aa, Homo sapiens
RGGVWSAVARERPVVTPSLLTAATAARRSCGGLVRRVVSVMLCSVVMVQVVTKSACLSVKVPCASIGGQSML

SEQ ID NO: 1011094 - protein, 250 aa, Homo sapiens
SGLACEPGGDDGNMALNGSCKSDRLLRGRPPIEAETKVLQARRERQDRISRAHGADYLRAQVSPTCRGRDSDADLQGRSYLLKSNQSEESTSVCSVSEPRSQYVDIRYIPVAECASAAHHPTARDCSTDGLMPQMLPPGTLDPAPQAPKYLRPRALVRGACSIDSQAAPGATCYLHVPPIYKIVMACTQNSPHLQNADLVPLRELGSSTLPWRLDIQLCGLIRAYAEALRRPAAGYSTKSKPLRTKPSRK

SEQ ID NO: 1011095 - protein, 121 aa, Homo sapiens
MAGPLRATSDSLLVILAGGPWNVAADGLASSPGRSRARRGGDVSHWMPGVEDAQCLCGMHLDFCRQDGYNESQANRHVTNSSALLKGWCVDPASRVVAGGELDLGPVELVPKHSVPRTSPN

SEQ ID NO: 1011096 - protein, 184 aa, Homo sapiens
MASLHYFYFGIHFEVAGPVWCWWIAGVQAVWRLTFCSPGSSVPQSWLPCAWGFTTSRVLLLLRKRCEGTAYPGGTEAGLGWVRRTCKTQSGGSKPGDRSVDPFPCPESRTYSVIAINLGSKWCWFILSVQREIIHHSERKARGGEKVYLGKPKNSLVTTDSPNSTMVKVVNIEVEPISKDQFAG

SEQ ID NO: 1011097 - protein, 189 aa, Homo sapiens
SGEAEGALRRRRRRRGWPWELSTGEDSLSREAGSRAGQDGSPPAGDWALPGASSVKRITQNHRRIVAATYFKTQSPQIVQAASSAPALDTDSSPPPYSSITVEVPTTSDQKFTGEFVVPCQLPIGDATSLPTYDEAEKAKAAAMAAAAGETSQRIQEEECPPSRCTSVTADQLRLAECWLFVLAFVMAF

SEQ ID NO: 1011098 - protein, 103 aa, Homo sapiens
MEDFPKRHQTIILRASLGGKLKLLIQTIVPKGAIGRQPFTERKINCSEAARDKENGMQWGNIEFPVEQKIVNTGINSGQEGAVPPDGSTEREPEAYRHYPVEG

SEQ ID NO: 1011099 - protein, 158 aa, Homo sapiens
SGGGREVLGPLKRPPSRPSAGLAPTLSRLADWTTPTLAGRRVPLDTQADSGAAKPNEGRAPGRTVLTRRKLHGHTTRSRRIKSGIKESIQEEYKLKHTSTSSKSKMGPDYKRPHTMTNGTMPCTKLIKNHNLQFPISRTPEPSPRGSDEPYTYQYGTE

SEQ ID NO: 1011100 - protein, 142 aa, Homo sapiens
MNVPLDGAAVVQSSTLSNCMALITCPSILGLKMRGGTRKQSGRQLEVAVVVNKLALNHLAWGSLCTRGPPLINPTRGHGLQRELHNGDSGGRKLGGTTWLTAMCSNALLAFYWQKMNQGEFLKLLIGPLVREGYRRPLKVAP

SEQ ID NO: 1011101 - protein, 276 aa, Homo sapiens
RVSWVSGGAHEGGSAGFRWVRRLRDPGCENSLCGSCRPAQGLVTQDTCLVGDVTCADVRLCERTVRVGPVRAAQMWRLAAWCPRGSWLRLQRAIRCKTLPGWSHSCRGRQTITLKHGSWHYQLVLARLIRERIAMMYVEVNNRRVMYCIGEGLHNDRLSVVFRGSVWQVVYSGYQDAIGTQMGTELATVPPGIGQSNVHLDACMENNLLVVWERTGHPISGRELLVMHVQCCVTVERIPRWRVGIQHVGGKEDRVCAIMDRAMAIITGIPVVSCGG

SEQ ID NO: 1011102 - protein, 218 aa, Homo sapiens
MKCRKADSRSESPTCKFRVSLSFPLQPLVAVGVYTALPEEELRCRALPERGEPEGPGVRRWWTQSGRRERLREHMRRISARLLGWSTGDSPVLFPSSQSAVGQGKNLTANSSALFECADENIGRTWAFTASHAGISERSLRIHTDREGSTLKEITRSSLLGTEHVPLKLNVKAHEGKDSGIWADDNEEQPYSFFLVILRGVPFMENAYDRSRRTEKGE

SEQ ID NO: 1011103 - protein, 138 aa, Homo sapiens
MGHDLRSFIAYPTSCGRTVELEEACLYDGVEREGGKLSWLVDLAGKHYVSRLAWGPGLPWVGWAGGRMARWHPSAQCKQVRGEPFKYQNMKHHWIGACTTDWGRCVCVEPLRGATDEWRGMWPLKRGPPSYHYRADDY

SEQ ID NO: 1011104 - protein, 112 aa, Homo sapiens
MGRAVKVLQLFKTLHRTRQQRFLNNDASSHYEAAQTLKHNMQELSNKYINHADNLLSYTNTQQAALTAHNYGSPALLGTPLLYPPNAHPFPGSKYPHAQITFQPPNGNPTDN

SEQ ID NO: 1011105 - protein, 229 aa, Homo sapiens
MSTLRICDIPYLNKGYIVVMRLPSSPDTTGCTVITEGDKITERLWAFYGTLKNDFLQNDKRQVGPVVLRSDSYFLGKESHCIIVIMNYIIGTSWACTHRSCNHPINLLRDLTSSQWPRATDDAELHLSQPPTWPSEEWLNICYQSWSETREIACFSDELIDSSEPAASKTYDASDRTPVSTRRQLSLLPKELALYVLSFLEPKRPATSSSDMSLLEKFGCRQASLEQRH

SEQ ID NO: 1011106 - protein, 73 aa, Homo sapiens
AACVMAQGFNAYFKEFIIKSVIVYRYVSSKATQGALHLIPTVLYHWEYFYIIPLDQRTPEVTIYETTTKSIDV

SEQ ID NO: 1011107 - protein, 312 aa, Homo sapiens
MTRAMRLLRRWCVRGSVCCRCSPGPGLEEPTGPAWYARAMRGAVRPQLSEALASPVRSRKPQPPLGELVGELPRGKEVRRARERGTQGSARSQQVARLLQSWATERVLRSVATRVMSYNFNTGSCERETTSVPSSIAILWSAHVQPIEGSKHKTTAPGALEKTHTCERMPWGDMRTCGVHTRRIVPLLLRITSSQHLSHGMTSQLGGASSRLEKHLDLTFCWTRPNVRMWLGAPFVGWMTLVPWGRPVSGATNRSISYAVNPRCIHIPARNSSSILGTLQRGKPQVALSYGSRISCLASRFSGSTYPRYPGA

SEQ ID NO: 1011108 - protein, 102 aa, Homo sapiens
ERGREVMAAAPARGGGGWSAEADGGCSGSGSSASRGYYINDRSCRLRPASPGRLLGAENPYGRRSREASLACVRVALSMGIFPGIDERRRAMRVICQLEHFS

SEQ ID NO: 1011109 - protein, 282 aa, Homo sapiens
SGFLEKLQCGDALDRVLPPVSFHLSSCSSGSVHAAVSSGNYEACTPEASPAGMERQPEKEGYGSPDRGSVYRMEGEPDWEPDCMGPGEYTIPNELDPYMRTNSAAYIDQYGDKIGRRFSMTLDASSDDEGVLELVEPTSDPWFQQRECSRTVRPDPDDSLGTHHMREGTRCAGLLYRTGRTDKEDRETSCVRDREHGAGCDDKDHGAYAVLERERERGRRSHPCRRVPQDENSADGEPRDMKSEAHRKQGTEGRGDGEQAQRQTPATRGDTRLEPCSASAPP

SEQ ID NO: 1011110 - protein, 42 aa, Homo sapiens
MRSGAVDNGRHQRRASRATLGWSDAPGIRRPRGFRRQGQSKR

SEQ ID NO: 1011111 - protein, 222 aa, Homo sapiens
ADWGLRRHGEEEGAGSLLVRMDACHRRMPAAAGGQTPIHKTHRDRWQPWREAAAVGRGAREGRLGQVDPGSSSAGVTLQAFLQALPALGRIYPPCLLTSAGTHSWAAQSCCSLLMSTVGGFEMHTSGRSAFLPRLPFPHWQTSALGVRSEVHIAPYILMGGSRSLTAADEYLTPSSICVAVGAGTEALDASTWTTRAVLPGWQEGSRWEAGGGACSTGTPGF

SEQ ID NO: 1011112 - protein, 117 aa, Homo sapiens
SGLSPPDPSMTMRIPTAGEDPGGGRCGHERVDMSPSPPAQSPRVLGCDQCSLLTCGRSCTLPCNFPTAAERWMFGCLTRLEALLRHAGHIGRNGSSAVSGSSCAAKREGSAGISLLY

SEQ ID NO: 1011113 - protein, 88 aa, Homo sapiens
SGSAACESSAVSHRLGLPAGVKKKMTLQWAACGNRLLYAEIGLILSLSAYLIDYLHRRDGKDKIIVMTGVKLQLVGTRHILDQLSSYG

SEQ ID NO: 1011114 - protein, 107 aa, Homo sapiens
SGRSSVAPPCALGLARLLRQAGRWAGRSAGCAERLVPSVIVWAGVRLWQSGGLRPGAVQADCSRPVARERNSVVATTHATFRQLTRMTERYAYCRVRSYTLQPTEQC

SEQ ID NO: 1011115 - protein, 230 aa, Homo sapiens
MRILLRLCSRSPPAQAGRLEERRESGAKPSRVHVRSSDARGGSREEAREADGRGRFPGKVLGLEENEARGTWARVGSCWPGVPPSGLYVFSQCHPGLRSPLIGPSGDQPKVGLVRAWTDWEIDRRTCKGKLSGIALPPWTWRNRDADGHCRKKCSTVRLQWKRDSYEHEGTQTPDLGEHPRLRDVGYTGGAQIAGPGTAKSVGVGIYEGYQGQVHLTPLVPHLFNGHKPE

SEQ ID NO: 1011116 - protein, 166 aa, Homo sapiens
MVSSDIQVKKKLVEALRSEPRLFDADVSDSSAEEMKSVAHDISPRWPAPEGEQVIVAPGSEYLSVQGTLENAVQRAGRRKVPDEELRGLVTSELACRTPSTHADIRRCLLGEASRRGEAESHFMVQTLAERGRLTTSRILEMLRVNMMNSDGGQKIGVPEVGERLG

SEQ ID NO: 1011117 - protein, 120 aa, Homo sapiens
MRVSVNTVVKAINRLLLMRYQGSNFQQKTCNACRGKTLAVHLTASRRPTCAVSYMTHTYIRFTSKSQDTVTDYVRCASDRRNIIIVSESALYARCIRRRAYRIGSLRRADNATTETMPIK

SEQ ID NO: 1011118 - protein, 161 aa, Homo sapiens
MTFVLAQIVAARVVAAPRRQKVTPCRLRREHVQERRLSDRLPGEKRTRKAQMRAEGSCEGERGRDDNEEPRRNSNVPSAEAQIMRDERRTFERRHGEQCRNVEPTISGELGRMTNRGGEQYGCATLGTFGERKVYATLEMNVLVENRHESEENPACTRRER

SEQ ID NO: 1011119 - protein, 142 aa, Homo sapiens
AEGQALVPILAGRCPPALPVPTERPAALTVASRSSTLRHHSCPVQVHQTICGCMGNEGDTIPTRYKPGQTGHNPHVYPGRRSPCTEVVSGKLQSLTCDGWKRRISHVVHVLSVVLCTVRMIRTESTVIVEMFDVSEMGSNGT

SEQ ID NO: 1011120 - protein, 83 aa, Homo sapiens
MESQAQTILQKRRDCEFWPSLPQGISTAFVALLGKEGNKETPVVQRIFRNLSVTGSCPKGASWLLMKACALVALIQGFYNSPT

SEQ ID NO: 1011121 - protein, 222 aa, Homo sapiens
AERADEQRAGRHLEIRTVPGPARAGGRGHQVCPHRRLGPRQTDLPPMIWRLIHSTNQQGVEVLIFPKSTDDDDSASERYVGMLIVEVQSLIQDPGQSACDSALIYKHRLDDTAFFHSLDAVLHQFGLDTSRAPKTDTAQTGVATGSFDIHSINDLCVYLCIRAALSFGQRITLMELTVNDTEFCSLQYYSSPAWDVTYFLRSSVGFTPKQANFALMEREPPA

SEQ ID NO: 1011122 - protein, 223 aa, Homo sapiens
SGFGSGVEMYVLRRFFRYVFSTERRDIYGSSFPRVTALYASFHDEVAAVEKTGRRLEEQGEAEPRCVARARKRVRALVVLAFRLPGQLRLDVILAWLTKIRTYWSLLVQEYVEYTRAPQQWGTSLLDYRYLLMMGKCVPPESITLRASWHLVQTFRDYIKTCVTMHWVTVGIMLSMTEPARHIAIYRGKPIWVTIKVYLFVLRGLPSVALDTVPVVLSFTVRD

SEQ ID NO: 1011123 - protein, 108 aa, Homo sapiens
MSKLVKSTPSRPEDKRSSHCHNHIAPLTASGQVARRDSLDCIRRCSSDRGANGVVTALTQDDRKFVIGGHWDCSATLAISSSEESHKTYNWFHRNLRIVVERASSRGR

SEQ ID NO: 1011124 - protein, 176 aa, Homo sapiens
AESEEGGWERPRYPSTLNQQSATKQTIQPATIGVRVPPDLGLSRVLCKHVWLSGPPFASLVSTWIVFLLGWRLYCGCGHVSPSLAQKERNLRPYYSNQRTKTYGVSHQMLIHALSRYVIYGTCLFLLPLWVPSMLAEGVLRSPAQVQARSFVRRTQTTDRAGIGPLSVNRVNRGEP

SEQ ID NO: 1011125 - protein, 224 aa, Homo sapiens
MESTGPLTASEARVRLWARTGDGDGTPGPARRLRPLRSDMSSGPCGRPGPMSGRGRVRASLTPVLRCGSFPQFSGSGLSALRCPARARGCRLPQTRRTGLAQLRARGSRGADYLRPALRPPAPSAVCPRGARPLAGGGMTFDVHAQRGSRWDHGGLRACVFRRVHGHPCQDQTLTLGTRTPTFQPHVYYHFTNHGNPWFDSKLSTPITLGCWANKGNSVTTYFF

SEQ ID NO: 1011126 - protein, 190 aa, Homo sapiens
MLLPLLLLLSMWLLSVRMCQDVARGVCPSATSVMFYRLKFLTYSPVWIGSVPTYIDFRCTITIANWLSTGLVMEPVLRRCAVPSHWPASCVHASCVGLIMPRVDTPLSRSGVQTKWVLLEQLTWLQWNTMELNILDSRLAVRSLLNRLLMTREHVTWTRLREEPRNSLAERAWIGMINRAKVGSVHEGKI

SEQ ID NO: 1011127 - protein, 170 aa, Homo sapiens
MHIHAGPTIRTGGSSPHDQVTSADDNTLVRIAQKRQDARTPGTQSKGRTIGQTDGMERSRIKTAGEHNAHNITYQNDHMRKMTKDKRKAPEDHGIHGAADGTHTTIGEWRRPPRITGTSLAVLSTGSPAQGTRNSRRDPRQDTWELLGWHTSQNITCIEIREDLRRQTVM

SEQ ID NO: 1011128 - protein, 259 aa, Homo sapiens
RVEGWKVPTSRCRSLLARVLGYLVVMAGGIDRNELDEEEQLPENGIAKRMKEFALPDIHGHDMNAVPKNDKKRKDSSLTERLWPQLDKTNTGHTTITIETRTWQQLDTSDYLPEELTHYDFDSLLNTFTTSGRSDDTHASLGILPHATSPHDADPTTTHALGNNRQRRNEPNYACTTCTLARNFTTRDARHAYCATRRRQPVRLHNLLWRHGVTTQALQTSLHTKELHNPRTGPNLVIVPQPAHLVHELRPGHSTIRDY

SEQ ID NO: 1011129 - protein, 175 aa, Homo sapiens
MPKRRAAESSNACRTSAFPKSSPDATKGWRRDWSALTHVLRCFGMWPCVAMRSVSDPETGRPSSKSLNNDSHFLATFLYSPVGTRDDAVHSAPLIDDTYQCLLAVAGTPRGPQDLIAGGTVSAPMPGIPGGTAMALTKALALLVVLLAAAETQCLERKAEPDLLGRVAGLSEDSR

SEQ ID NO: 1011130 - protein, 74 aa, Homo sapiens
RAARGLASGFRELWCMSPSVDARPLAPWMPRPRSQLCVACNSPTILRGEALAQHLPPRMSLASESALGHLSHRS

SEQ ID NO: 1011131 - protein, 135 aa, Homo sapiens
THRRKCIDSYGRTGPLDAGVYNSDYPNGLLQVHRELETHVSGSRQYNTCCNRHNQTLMLDPRAVGPHGLKHTEHMPHEARYSLRSAWAKVALVGTWSGFYRVIHASLLFPESMPECGFPFNMVAVHQENAMGQPP

SEQ ID NO: 1011132 - protein, 190 aa, Homo sapiens
MPKKKPEDHRQSEKQREYSTRDRETKQRKDQRKEQTSTQKEGNQETKTKKTETRGRESPGNQDREQAEEDTRHTQTTTAKQNRQNGTDSSDDQEETPAHTEARHARRNGTSKTKQATKTKHAEPTTPNRPTEQRNRSTDRKRTPHTTEATASRQEQEQTNTRTYKRRHNTRRATKDTETRHTERQERKTT

SEQ ID NO: 1011133 - protein, 151 aa, Homo sapiens
AGSRQRLGAGGGGAEGGAAAASAIPGPGGPHSEELEHERTATPQQITTTNTARTTNSTKNNHIHTNHHKQPPNNKKPTPTQTHRKRHKTTTQKKHRYESRERTTGEKQKESGETQKRRQGKKSNREAERRKDNATHDTNQKEKDTKDTTKK

SEQ ID NO: 1011134 - protein, 305 aa, Homo sapiens
RAASCQAGPGRCRAPGAAGDAWILPPPSAGCLVPRGGCMSPRPWVPSRRTWNLGATPSRVVGPCGEWAGLPRCPDAGDGSPRRPALLAMTVPDRPFPAHQARGRLRNMRRGTDIPSLQGCRVELRAGQLEVAKRSPQALYASSCPKASFRELGALRLVTSCEGPPIGGYLLENHLTRVRKHLTGERTDSYFKGPSGPKDIVNVAELQKSCTLARVGDRDLGTERSTRVEPLACSWRLGSNWAADLEEPEQDDLPAALVEEPRNTYAIEPIAGHQKCPEQWFPMGPIWFGARTHAHGERKRPRFPG

SEQ ID NO: 1011135 - protein, 194 aa, Homo sapiens
MLGMMDVVRGMIFQFLVSNPGVLPDSASVASVALAPRAQMYSAFDFNCPCAVGLLVRAYSAGILLAPPLVLFLLGLVMELDNVSYAVIESSANAAYSVPACVPNVDPSVVLDAYHLFLHPNGPQLLPLDALPVSSGLAFTATLMAECFLCGLAATAVPCESHWANGSLCTLAFLAPGARSACLALGALPLRIYG

SEQ ID NO: 1011136 - protein, 68 aa, Homo sapiens
SGRYARGMKDNGNQDNSKSGLAQYQMPTSFIICKRTVGVNVLGSGKTGMGWAAWNFLATHCVKDLVTC

SEQ ID NO: 1011137 - protein, 97 aa, Homo sapiens
MEGVVAMISPSSRSSGVGGPPGDPRAVFVVPARVGGVRGGFILSPERPLGRVYRSQVGVPYARCGPPRAWVQHPVMQPRRCSPIMGRPAADDICRAP

SEQ ID NO: 1011138 - protein, 151 aa, Homo sapiens
MKTKEDVPQRSTRNKQNDRRRRKKTKDGKQQHRDTPKKKHNKRRAKDTEDEKKNQEEKKYDAISESSEDKDDKAENAEGTDERGKQRRRNTRETQRTMQKRTDERKKGEDEKQSERGQKEKNQEKKKGEEKKRTQQTPAGEPGYKDRPEKY

SEQ ID NO: 1011139 - protein, 91 aa, Homo sapiens
RAGGARCRLWHRRSRLRLLAARSWRASRADSCPERDMRCREAMRFLSDQIGHVRGLQEIVQVIRHVSRDGQDERVDKSQYAGHVMAQLFSG

SEQ ID NO: 1011140 - protein, 76 aa, Homo sapiens
RVPASRGGGGVVMSLRRRRGVAPRAVVSGCKITWQPRRITQETFDAVLQEQMPKDITWMPVVRLEAKLFSLKLKIS

SEQ ID NO: 1011141 - protein, 174 aa, Homo sapiens
SGLAWALLAPAAHRWSHTECSQARSSVASFSLPWLPPAVSCATCPVASDLRDSFEIDQGPCGWCACGCACRGVVLLPAASRSLDVQMFMSLPLMASRAPVFDAKGPSLAESSFWLCNQIPKTVINLWMTAICSRSELCRVTEPTTEEEVLFFDNTVSPEETAKFTLFKSYIEYV

SEQ ID NO: 1011142 - protein, 111 aa, Homo sapiens
MTGVDDLDFFIGDEAIEKPYICKKVANPPWYTLKIADLVERFMEHVIFKIFKGQNLKTHYLFRLKPPIEYSRRTGEYTCEIMFESFNVPGLVALLVPGLVLCLRLHLGSLQ

SEQ ID NO: 1011143 - protein, 82 aa, Homo sapiens
SGLALPAAAAATAVLGPPPPPPTSTRQEEQREDDKKIEEAELQKDKQDLSGARHRLLLLVVLENLVGRHHGERKMRIDLTFD

SEQ ID NO: 1011144 - protein, 176 aa, Homo sapiens
MLLALAFQANRQQGMQEYACPMKQSLTYVWSRTPWRKPPRWRTQTRLLGQTEKPLGVFDGANSVHKLTSRGGGKCRKASRLVCLGVLKFRVIFRTKNFHEKARLANVTCVRYPLRRRRGFLQGGRKRLHTQPGNSRVGDGETKIVAPRLGQAIKCRERLRVRLQPGNKRYLGAHFD

SEQ ID NO: 1011145 - protein, 129 aa, Homo sapiens
SGGVRAALPVPIHRAATGGGAHCVRRQRPAARNESECLLQKNDRRLSSCVACIEYSRDVLKLDVLYEELGTGRTGYCLISKHTETSLVWLYQPSNLVCAMLRNMAQETNHSQVPMLWFQLAVEFHWKPS

SEQ ID NO: 1011146 - protein, 131 aa, Homo sapiens
IGVAGGAALKPTYCSVADVLAPVIYAGDDKRLTFGISIEDLGVTGRSTSNTPVYLIEKSEPLLADKLEETVHIMISPAHLQCNNSDNFEIAAELKLGMVVNAASCSMSPSPRSPRRKLAIRIVLDLALALN

SEQ ID NO: 1011147 - protein, 230 aa, Homo sapiens
MIRKAWKAPMPSLCWWNMLSTRVIAIDKSRAHGKYEQGFNMDEVLQDEKLNDLQTLLPINDQYEATLRDKTLRLSAYHNFGPTHMRQVGLPCWKQTGGNPNWEKGVTIGRPNDRLPNTLTTLEGLEAIEEDAKIIISLTVDQEDRFKKIKIIAQIKNTPKQGKSFGKNRLKSIVEIPVLKPDITRGTYITVQRKFRRAMDCKRPIETSRNSFGAQYLKTKLIGRRNQITR

SEQ ID NO: 1011148 - protein, 259 aa, Homo sapiens
MTSRLRSCRRAPVGRERVRGAGAGAGAGAGACGLQPGGGGGDGDGGGMAESEAWTPSTPGEYESKYFEFHGVRLPPFCRGKDGGDRQLPGAASDVWIVTYPLRHQLAARKVVYLVKPGLLDPDEIGLMKHRRAAPGPGSTPQPGLDIIKGAEPSPTAHHDANLPLTAFVPSDLQTMENSKGHLYGSQTPRIWWCLIIRFQRFSADHEATEGHLHWNFCRRFMNDKLGLGSWLSTCRSSGSTRMDSQRSYLQRIEDMPSG

SEQ ID NO: 1011149 - protein, 200 aa, Homo sapiens
SGCFPGRTWVVWGLLGPGARRHLRTRGDSMGELGSGADEALGCFRLAVVVVLRVLAGQMSLGPGRGSDSLVGVPPTPRAAGGVACPSPTDGQDMRVLPWSVKVCSFSDDYMHDGTSAAMFHDQRSLAVGWRTGLIGSSLKETVRTLNKPLVQESRRSSAASHISKVVGLFTRHIPIFLLHWKLIMTKVLKKVSKIHSRAE

SEQ ID NO: 1011150 - protein, 121 aa, Homo sapiens
MAAVAVAAAGARLRRGDASPVRPRVRPTRSVRSSRSRLPPRARPWRTPSSCPDVPVPLIESDAVASLIARYLSAGPVSESGPVCWCRSLERVDRVVCRNEMWTVDVAIEHNRSYEESVSSN

SEQ ID NO: 1011151 - protein, 39 aa, Homo sapiens
MHSAHLVDPGGMRRYPTYLRTLKITTHKFVYVKEFGTNP

SEQ ID NO: 1011152 - protein, 312 aa, Homo sapiens
SGGATGVASVTLPRSGRLPERWYTICFILHRAYGPILEPACRAWRPRVGERAVRESDEGLWEMRACCLYTRVFLAFLSIASMRVACLHQYAGPLAVLLLARRGLRQGSSEASWSLVLTGTITLARFGRTQEAHVPSLCTRGQPASQLVVVVTEMHAGVPSVGCPPLEGEELTGGYAYAIVGPECLLMERASIRLVGSKGARVDKGHDEELPGLCVDVAPSNLLWSEPNAPSVAPRPRLPGTGCLRVRGMERSCGCLWIVPFALVSVDELKGIERIAKKTPGTNLGKHYGTDFYENPLEHLVKTSLRMFEPPL

SEQ ID NO: 1011153 - protein, 207 aa, Homo sapiens
MPAPPSPAGSPAPAAQAGRDVPDVAGSGSQPSPLLPVLCEISPDQISTARTRGLAHGPYHGPGVLMPPNAPSPEKPTSMQPRTCGRKRASVRTWASAEPQKGPRKAGGPNNGPKPTAMEILLWMGTGNSCHDPQEPMKRQSELDPCAAKPGGATPPGGMRDDPEGEPEENEGPRMGKAPVSDNTGQSFLVRNQIGSTQSLQSVANFR

SEQ ID NO: 1011154 - protein, 520 aa, Homo sapiens
AETLPPEREHSLVGSGVYGLGARGTFAPPRPVLRSRAAASMPRGPGDRRGALPYGTPAGHAASRLAAPPCLDTGVERLLTHVTPINATLAYTATLLPPPSTRRHHTRSPTCATLNHPSGNIERTPRHRSATQLAHPPTPPPATTPPLHTDLPGPRTHHLPTTPYARLPHPPSLDHATPCLLPPTPSPLLHCLTTPSRRLPLAPPTISTTLQRTAPAPRTLLPTHTRSDTPTLNTTHLHPAPPKPPPTLETRTRPTHLHFATATAGPRPHARTHQPQGPKPTHTPATIPRDTHDRPRTPHLTPDPPTEPPAHRDPERRPTHINARRTPTRPTRPRREHQQADTYGTEHAHTTTTRADPPALSPQTTNSAHTARYNSRDHNNCARHCAPYRLAPIRTLNASGTRTATPTHDARSTTTRPRSPHDIPRTPHVNQRREAPDRNSAETHHGEPADGTTTETVQPNRRGHFAGPRDSEHAGAAARPVRDTRGQTRGNDSMKHTGHQTTYEHVAGAHRSLTDCSDAP

SEQ ID NO: 1011155 - protein, 183 aa, Homo sapiens
SGGDLGRMDLEERRASGQRVLLIALLCLVGRTMCEIRRGGYRHVVLLRTPAPATPGCKPKSHSSTVMKAFDLRGPDPLTLVERNLLERQPRKRTGITTTTGRYRRVPDITECKGGGPSCCMYEAEMQWKRDYKCQTKNIINIMQDRLKACQQREGQNYQQNCIKEVEQFTQVAKAYQGPLSGP

SEQ ID NO: 1011156 - protein, 145 aa, Homo sapiens
MTVKTVSRKAYDAGEYNAGKRNLEQEGTFDRPTFERANRLVKSVQRILEITGVRRQLGERIRGASLGSPVAVFNTTACLGPVLNLQVVLRCKPGEIGNQRENLGIAPGISNEAIPPHKGVPRSPFTYTGEPRNRPETRIPVGVEL

SEQ ID NO: 1011157 - protein, 103 aa, Homo sapiens
MWPLVAALLLGSLVLRISSATIEVKQNLKNSRCCNDTVVIPCFVTTYGVHKTLLNVYVTCGTFKGRDIYTFDGRSKQVQLCPLTFRYCKEIEVSQVTNRRCLF

SEQ ID NO: 1011158 - protein, 101 aa, Homo sapiens
AGGRLWRIGGLRSAGAGRGVGGGDVWSVRDPLLLEERSGRTSSTTGFSSVWQIWNTGMMETVFSYKVAQQKNLEGYVGLCQSPKSGIQKIGEERLCIHAYG

SEQ ID NO: 1011159 - protein, 78 aa, Homo sapiens
RDSFTSRVTELLWPSPGRNHEVEGHKIKDKACQLLCANFRHKGIKVVGKWKEVKIDPNMLADGQMDDLVCLEELTDYQ

SEQ ID NO: 1011160 - protein, 177 aa, Homo sapiens
AGAQAQAGKMAGGWELASEAGGIVLCCVRTLPTCPPGEVVSGLRTSDFLSLRQVDDHYMTRSLETWRSSLTRTVLNHMLGTWYLVVGSDAVVAWHCRVKHVPGISRRCESKHKGGAQDYDREWPQGFINTTSLESLWLCFTAILFVPFPRTFHYTSPNVDNHGAFATQVAKRNRGVT

SEQ ID NO: 1011161 - protein, 114 aa, Homo sapiens
MASTAELFEEPFRGQDELILKRLVVDEPQGGVLYEVDLKTFAPTKIDSEGSLKTQYSGTSQIDGLNMAFSMNVEKLEQQLSDEAKEFAKKVQELLEEAIRLPSNDFQELDEHIS

SEQ ID NO: 1011162 - protein, 255 aa, Homo sapiens
MPNEDKWSIHFLRNMVYVCDIGTRALWFYTSKERLYGYRTSVGRPGSPKEAMKCASGVVCMGRVSVTVRSLACIVREMYEACTIEETCLSWMYVKDGSGLRKNACTNLSMAVWESSSASDDGQCASIGSTENCARAKCTYDRLPSVCLGPSNLSPEVVDVGRIGSWVTLWVPGLFELRNRDRRNYFRGVSAQVHVLYGVLGKRKSGVAAQRIAGGNGKRNCSRGNICQLEPPVRRSWRMFGTVDRWTNCKGWRSK

SEQ ID NO: 1011163 - protein, 220 aa, Homo sapiens
RRGSEWQSELYPYETVERPGVLRSRGAGSAKLDKQRLPHPGPRARRRGGGIGGEEAEEAGVQVPVMEGRGRRPWTPEADAEKSELRMGLAPDREDVFVSDVASRTAAVFTDSNHCREEAALSVLGAFDLTGNRTKRRLDDEVPLMSRPYEDGSKSIEVWPVLVFLLLERDVMHKENGEVDYASVHGSSYDKIHWQGFLDSSWVERTCDFQGVMYLGYVRG

SEQ ID NO: 1011164 - protein, 70 aa, Homo sapiens
RISLAQQKSMHGATLHFQRPSTCNSFYPASPTGLRPGAYLPSCVAWSIMHAIKLYPIVIEKEYIRSNATL

SEQ ID NO: 1011165 - protein, 204 aa, Homo sapiens
MELHRGNPSGGWHVAIGSRKTIRGWYGIQSYSNLQIVGDTSGSPRQLDSGSIPLSLMRTVTVECVPRVESINPLDCYVNDSSLYLRKVPYRLENRVTAVGSCHRCKIWTRLSGRSLINRFNQKTSRCVGATSNVWRQPSHTQGNGCVGTKPILTSPYGKVLATELPHEGVIPRYLLGIELTAGSIGKHDPTSNTGIVGHGRFPS

SEQ ID NO: 1011166 - protein, 81 aa, Homo sapiens
AAVELYEYGFRLSSFYPMAAVGSSGSEPKSLGKSYSSTKYYDVDNLFKMCMRRADGGYLRRSKVTFQTVMAYVQRSLCRTA

SEQ ID NO: 1011167 - protein, 210 aa, Homo sapiens
SAVAGRAERPQKGPDFRRRRILMAGTLISGGHGVQVTMRAIVPDVGASNMTFVNVILHRSLWSGAVHLHSLRYRWNPSYGAWSSLTLGNWQAATWSSEPLDAVPTSGDGTATRDEQSRAPVITSLPKIYVRARARCSEAPGHCSTSLPLETTLPNCGPFCQSDFLGTWRGLNRRPLQPHGQVIARVIASMRRFLGPCSPWVSWANMAETN

SEQ ID NO: 1011168 - protein, 89 aa, Homo sapiens
SGGEHATLRPLRDAPPTYWSCEKSIFGNHNSCQRNLVQTLYDNYEWFESSLFLNVGYYREDADKSMVMMHRGPYYFVNRILPLHEVHNT

SEQ ID NO: 1011169 - protein, 271 aa, Homo sapiens
RGPERCEGGRAAGRAGPGRARGVGRQEDVRTWGCCSRRARWDSDPHVAGPCCVLVDICNNCSACPGSTVRGNACYPRVTEELCAVLSLSTHQAQAPRDSVSPRRTRGIYRPPVAARCSCMVLSRWHYTGRSIGARHNRSFNRGAWVQCTRALARSSGDATPHAICGVGSLQKLGPGRGRFSVSRPMCPHVPLWPFHALFNHHPGFKVALFGAGLWKDRMTGSTPLGKLFFSLGVVVTKRNKLGAPGLRRVVPEFDKFGLMREIAHRRTVAL

SEQ ID NO: 1011170 - protein, 273 aa, Homo sapiens
RAQPGLRWRGPGSRPLPAGPPSGRRDGSRLHVCPSAPRGGRVAKRACDPASGRAGEDARSHEAPACEGGGAAARAALGVHRSPKSMRVFDGLYPTYYICRSYEDLLWLPGACVAGPSSILMAVDFWFLLMMGVLSAAEPEFFIRSAHVPPVADRGGQPSMCPYTMAAPEISGQEPQQAGAARITPTQEDRDEPCREYHGNWFQVPPKSPQGSVACQRLSLVQQPRPRRIVCDGPVTGVLPTFDMEKTFSRAVSPCGFQARDEVGLTGTGARGC

SEQ ID NO: 1011171 - protein, 51 aa, Homo sapiens
MYEFGAHCEKAHSREYACWEVPDAPVQIAEVPVLVTTLRNDGPFGRSPSET

SEQ ID NO: 1011172 - protein, 216 aa, Homo sapiens
RGDEACCCVTAEGYENGAVGPGAVTPDSTAASDSPGDVRLQEPPQWSAAALLLVQHACELQISVAVEGERGVLEGSVVLQWCTVPTDCMLETETMYSRSWSRYLGQWQPYGYRHSSAIAQWRTWLMNKFARSTNACATKCACGDDVPSRRPVPCPGRLKCSVRTLEGQLRYCGYTLTVLVFPNTDGELCGCAFARSLLYGILAGGLVLPIAPDWPT

SEQ ID NO: 1011173 - protein, 180 aa, Homo sapiens
AETLQRHEALVDQFRMVLWTVYRVPPRSPPYPPFLLLPPLPESEPSGRETAGNAAKEEECRQYVQMEPKIPTFVYMISEHTDSSDSEWHIPTICSSHPAPSVLRLGPRVLKDSSPVRNLQSFGTEESCLLYLEDVTPYQQHAYPSDSEINTLFGRLVHLVQKLSKWLIFHDRDTNNTADH

SEQ ID NO: 1011174 - protein, 214 aa, Homo sapiens
RSRAFVAKARGRGAAVLERGCDRTLRAGRRMETVASVVHTGWWLLREKVCGVRHHALLAEGWAVVDESWLGDSPRSLGSLKSQGSRDPWDQVDAGLCACSLAQRACSIAQAGGRGCHVAWGALLVAGYGSGPRVEYRIACSGHIGIPVNFVTGACQPEAVNAEKHMGASLRDVPDHPLNSVMTGSEGMTGRDGGEPKQSGRPTVQTDTPSRGTA

SEQ ID NO: 1011175 - protein, 66 aa, Homo sapiens
RCFREEPRRNGLRVEAGKDVPGLVEKEELGVWLRLEIRIRAWTRAFPEDAEGKKSWLTSAAEGECL

SEQ ID NO: 1011176 - protein, 35 aa, Homo sapiens
MGSWGAVCELAIIGTYQIYYALPAHTLKPEYSSSF

SEQ ID NO: 1011177 - protein, 136 aa, Homo sapiens
RRSRRPSLQGLSALSPPVLRPPLYPRSLSGPQEFHTLDNLLTEDRSTVGGPVLPGLLPARSSGGALDESLKIYAPLYLILGDSSTHATPGFGAWSAKDAYVAPSPLQRKKREERAARHIYMADLADRRHYSRMGCS

SEQ ID NO: 1011178 - protein, 174 aa, Homo sapiens
RDAGGCTLTAPSSGVIRHPRVSPSARHASGAEGGKLRRGPDKSPPPTACPPSDRDARRGQSLSAGGWGGRRRMLAVPVHELAAVVGAAAQTAIPIPVLRCPVLSRRGRIGVYMVVRFPSLLVLLVFPSSCLAFRSSLSVFKRFKETTRPFSNECLGTTRPVVPIDSSDLHWIFV

SEQ ID NO: 1011179 - protein, 148 aa, Homo sapiens
MIMIYFRFLLRLWGKKWGVLNLRVVHPPRGFGELCAMWARARAPRGSHAVGGTPPLGGALHPGDVSKGATEFSTSGGPLLTKAQPRPPAKKDVGGHIVATNLRGPMARWWTLPPRGIFTPQITPPHIGGPDKNSFVPKQAGRAQCFFL

SEQ ID NO: 1011180 - protein, 285 aa, Homo sapiens
SGGRRRGSLVAGAAYPSPLAPARAPSARTLWCSHPMLSVEVCARLAPDECPDVVLPGRIGDLACGYSTRFPGSHTSWLRNRGPRTGPLGSRKVFDRSPTNIAAPGLARVHRTCNMTSFKYRAKVATKLVEQYPTVCLAYEIVRQSIKPGGKFAPVEVEETVEIVKGLTTELTGYRYGDEKKNVSIPEELAERFAKRHSLEKGEHRWNPGWVYNAARVQIPGKCDHTIEETIPGGLPGEPPRKQKPCIGNRIVPIRKVNLKSLNRKRGVREKAQKLTELAPNIPEV

SEQ ID NO: 1011181 - protein, 304 aa, Homo sapiens
SGLPVLLRTRARRVITRVWAARKPGLRAVFDSMSRPIGAWKCSHEKREAARRGRLAAVLKAQLDVAVPEMLPQDPGATDFEPQVLNNRVTAWRPAGTNLVFQANTVSGALIQHVNAMIENDNWNHLITGLKTSTRTMTQSRSATYHTAPFFLGYTVQMLISSGIRETIRYLVAAQHGGRSWVITAERTWTEDLIKCLARIILGRDLASGGRSSGSNGINSDRKSGGLPNDELRASCEDWLMRNSGARWLMAAGTPEGGKAVTPSKMNARLGQRIRNPKSAYYWAPKKHIPVFESALYPKVSVPN

SEQ ID NO: 1011182 - protein, 200 aa, Homo sapiens
MHATEPYRVRHLIRTAVGYIHTAPPETLSTESQLSTHPVLHTLFTHDDPVGTTATTIWLHSTLHFTFTYPPVKIKLNYTYLNTNPHKSDQPTNVAAQHNTSRFTRITQLHSQTIPTDHHQHMSVSPSATTALHHIVIVHTGQQSTIMLTQQASIGAETHYNSRTRLIGAIMPLTSSHINAVTKLLLYPTYSRLSSAQRPR

SEQ ID NO: 1011183 - protein, 312 aa, Homo sapiens
AKRVHFIKWNESDQAVTFAGNDFLFIRKSERGKRKLNSYPIFGSQLPEKRCRNSLCVNCWRVRTNTHAVSYYACDEDQIARRSGPDASLSQQGQISIVLLTRGAVLTRDLRNDESFGALERYSEMGEMVRICGKSVHVGFTTEFEETRVEGSNPWRKRLLSEGRPWGTWFPPTALVNGLGPQYSPQSYNYPDCGHPQSCGRVDSAHKAVGLPTEVVENSPRHSGNTYESAIEGLPERFACAANFPKVSGNTGRTRYWQMGSPAINPGRSVSANRSGQNPNFFLRKTILQEGYGPGVIPRKVDVCRPTTIRQM

SEQ ID NO: 1011184 - protein, 213 aa, Homo sapiens
AGQTRCDGCLKLLSLGAPALVVVVSGGAAWIGLLSTCRRLPVGGFHGWPGAEVELACVSARSFMGSFARAQQNGSLLRPPLANLDRGLIPSVPWALTADVESDAPGRNGSFSEEVQTLDITTPMEKGPVTVPLCGKTETVGEKKEETHPKCTCFSMTRNLQSASSLLAHRIGFSTTYVVKCFVQSKRGRDTRIMLVVWWKHDVELNVDRNTGK

SEQ ID NO: 1011185 - protein, 214 aa, Homo sapiens
MRSDGCSACWHTPSSVRKPSRYPGKRQTWLDASCWPSNEYFPYRSTGDRGRVRLPGWHATLAARTCLACEVHLSDDVLEDYLSDLTLYTAMQTIACHSGWPMSSLVLTPELERHGLYTVPKLGMVRRYPRNECVEWTTHNIEDLATNGKGAHKRPGSSAIIQFIPRKGELVSLRCGDMRLNHMKVAQLVKIPMCQGMVGIYYGVNEIQKVAVLN

SEQ ID NO: 1011186 - protein, 278 aa, Homo sapiens
SGGGAARGVAEEQVGDARRGAGGCRWDRHQEPGVLPAFGGISDLFALRVTVGHLPAERGNGAEKPGSTHKCSPHLGGQEEVKEGGARVDTNLELQKTLGRRSRHPSPKRGAEQSGHDPTLQLRGVDSDGDERKPVQYRRWESWKRPSESKKKGQDRETKHRDKTRINTRNPKRSAQLGDKGGKKGGNKRRKRKEYGPNIEKNGQNNKVNITKEEDARPYPQRSTKGDRQTYHYHSENAPSRQSRTTQAREKTRKDGKDKEKQRGKTKKKRENKDKERE

SEQ ID NO: 1011187 - protein, 336 aa, Homo sapiens
RSSRRAAGWWAQRRRRHWEMTLPGGPNGHCCGLGWLAVGLVQTSGLELGPCCLECLVEACALRLRVRACAGGSLTRLCADGGASRESPSPACRSCVCWGHDGSTRRGLSPSLASTADLAGVSASKHALWWIHVSGGRTRSCASPFIQKPLGGPGSVDVCGEARGSVVRFAQGHRQRVSLCCNPFGGVMSLVWPGALYSRPFRSVSSLAGVGRSPPFRPGLAEGEPFPAHGELAPPLTFEAPAFAGLQWNRRNGNAPCWAMRSLARQQALAHKAMSRRRRQTRSVWIHGYAEMSPPSCPKYRGIRRRNPHFGSNRYLLTTRSNLIARPSLRNDTAVP

SEQ ID NO: 1011188 - protein, 130 aa, Homo sapiens
MRTARESRALSPVLLPRAAVALRPLEKTLPLFPSASSFVAPCPHAAGLWPARPRSLNPISARAVRMQLPGLGLGIEREEEEERRRLGGMRWGTAAGRSASDCFARKRGGCSEEAAAEDPSILEHAQEVST

SEQ ID NO: 1011189 - protein, 107 aa, Homo sapiens
MAWIWVRTPWICCLLFSNAGTPNTPKDEAHTERRRDTMNPKRELQNIWLTFANGLACQKQSRALGLRSIQIRKGLLSQIELDPPNHYVCRKTQRSEEVGLHKNYSGM

SEQ ID NO: 1011190 - protein, 71 aa, Homo sapiens
MSLRSFVVALCVGPTLCPLTLLNFYKLAAGAFVPVADPLVVGNQWWVPPFSGSPAEGPCGVHRRSLPVVSP

SEQ ID NO: 1011191 - protein, 126 aa, Homo sapiens
SGDSTSPRVVGVSCFNSACDGIPGVSFPTPVRPSIASPPYSLFDRTRRYMSHRPPSTAPVAGQSPTLGADVVRYLAAIDDRVHPRQVRRELTTRIVRGAQSNSHRNQTWSIVRPSYVYLIHVCYLL

SEQ ID NO: 1011192 - protein, 94 aa, Homo sapiens
RVLVTGGGGGERLLDGLEESCKKCLSDPSLEDLNGDKGRFDGLNTVALCICKPGRIARHIEYRSFCSVSLTSGNLYPKLYPKTLSIYWRHEDLE

SEQ ID NO: 1011193 - protein, 339 aa, Homo sapiens
MQCDASVCQTLHAMPLESLRHELSMILWTLLSSSPRNLSRAPVTLTYKRQVRNPRTRTHGTERRNLSVKREVKPSENLENRPSAQGHWLVSFIDQELSSSLHTARPQGTGTWFRTKKTMAQTQALSTIPLEFWRGNWAHISLELGGRGTPQIGYKKRPPSQAPVNCNLGPRGPGIGGVGNPPFYHTRTPAFNVGSALTPTGKANEISMGEVQGTAKNLSLGLHAWHNDCAQPTPLLTLPLNIRNENSQSPLGGNASASTRHMPKRGYHTLWSPDTLRRTCDFPSERTVKSHTPSGPCGHTRAGHELPFNRHRPNAALGTRLEPVNLTPLALGKLQGVIS

SEQ ID NO: 1011194 - protein, 178 aa, Homo sapiens
SGKGRSKWWDSLSLAAGDVKLSRLLPRAGRRSPSLSYDPPTRPRPWPPAPDHRHKTELYPRKAKLCRSTCVALRSDMATVSLTGSDRMQRATGACPPEGGAHLRRRGSPVRKKRLRLVGCRAVSLPIANRVIILRSIHERTKRYPEEAFRSSEKLLVAGRCIDVDLYFRDANWLGGTQ

SEQ ID NO: 1011195 - protein, 112 aa, Homo sapiens
SGRRGGAMCDYHGEESLSGVPGFRKPYYLQRSLLICADEISIASLPELVVFRSEARIIYCAVYSTYTEFNARRYIGTVEGNTRVCEQRYEGLCSYYDVACCVIIAFDASKLV

SEQ ID NO: 1011196 - protein, 95 aa, Homo sapiens
RGRDSVSDLRCGEHQDVRELNAFTVLGLLRLLHGREMQTVDCTGMLIGRDESPCEIVQSALARGDGDGTNIQIVMALQVLGANGACPIDNVANMV

SEQ ID NO: 1011197 - protein, 222 aa, Homo sapiens
RLSGPGRRHDGAIMGVDIRHNKDRKVRCKEPKIQDIYLRLLDQAYTGYLVQKNHTPHSSQGCVEEEIYESHTTRGRTTVPFPDDPGKMKLPGRENKTDRWISGDPITDDVRVHRRYPMLKVCALSVTSRAPLARYARGLGGNDSSSFRSDWLLDPTEGSVGTCPVVSGSSLKRPKRVYRAIIERRPPGSPATAITKALRPFQGPEVRACQRSDGTSPSATKS

SEQ ID NO: 1011198 - protein, 326 aa, Homo sapiens
MKKGRRRDEMPDGITSIGAFCTFPFGATQAQRPVELIRVENRDSVNHHLAPYSASTNGFFCRRQKAKSIPGARITNWTGPGKPPGARHIAQDEQALYAVTHPEYDACKLIACPGRLGKAGNAHIHPTAAPPFRGHSCGLPREPQQAHHSAQATLTARAHYTQNRNPPHAGPTRNTHTGGDALRTCHLTPPIHQSPAANTAPHPDPTIPSRSTHTANPIHSRPPTTHTRLHPVWPHSATAGHPKEPLSQRSLSPNHTNQQLQPCSNRPLPSPQRTQRPHPQYTKCLGPPTITPRWAQHKQGRTRRAEATSDCPLPAMARHITQHNLT

SEQ ID NO: 1011199 - protein, 81 aa, Homo sapiens
MEPGPEGNVFAKRIAFWAPALRKGLGLRKQHAQQTLKTALINRFVHRGLANHFGDKVPGGTTKAKGGQPPFDGLSLCDTVT

SEQ ID NO: 1011200 - protein, 119 aa, Homo sapiens
MELGTPVYVTTAGKQLDRATLKRLEVRPVPRVSASGQGPYDPDLQESQSSRSRSIANDPIVEADIGNAPGGEPNIKHITDGLSAHYFKTDSPGVHKDEEYSGEGSIVRDGRMPAWWHMT

SEQ ID NO: 1011201 - protein, 285 aa, Homo sapiens
RGGRSRRGWRRWLRLRDRWPSARPAPCTQLVVLSYTAGAACAQPAACQARAQCCQGERLPTMLFTGGLSMDQRMTVVLATSWVLHSGPFPACFTFPCKNADKGVVPTRGSQLPFLASDRDLGQRGGKPCRGFDKFTWRAHGLGSPGAVPQVNASREGTWREGTRAQQCEEPTSISGAKEETRTLENGRYTGGDYDNEADEDTYETPAVEDTANRESEDYNTSGVRGIRRQTQWANHQWGGQQVREKDKAASNGYEATLFEKPRAKEPRNKEYPNRERNNAKWLDS

SEQ ID NO: 1011202 - protein, 181 aa, Homo sapiens
MAQRDLGQRRESRRSEAGTRWWMPQPGRLDDQNTDDTSGPTWEKVESQRRPDVDEKAWHRKAYIVAENEPGGVRRFPPRGNNTSLYREADERPYIRGHEIGASKPQGTCGLEAHNFGRAQISRRTRGAEPKDHRRYLHGKRGKGRPVWRHRDPIEGDSGAPNIPGGRPRGAAQKQKEGGAK

SEQ ID NO: 1011203 - protein, 43 aa, Homo sapiens
MALSLIPPSWYVDREHRWVHGYELGNCNFMKAIDGDNDRQYSP

SEQ ID NO: 1011204 - protein, 173 aa, Homo sapiens
RALTVTAALCVGGPRRPERHRAPSSPVGPRGPQKPGRTEPDGAGTMNNVTGKSLRRRKPRLIVPEGGRARTSGRADEDAVAEGHVQATRSGYLGHVEVEGVAGELQNVCERMRVNREAERADWGARTGARESRVCLLRGCSVHDLGGVRRWVEPTGNPEEVSREVEPGNPGRQ

SEQ ID NO: 1011205 - protein, 70 aa, Homo sapiens
SGYVCFLVAAVSEPVSGRSLCSMAGRVCGRVEVLGLGTDPDWPSFLCAHRSKVVQLDEMDCYESYRLVQY

SEQ ID NO: 1011206 - protein, 208 aa, Homo sapiens
MSEADVNPIGLCPLPMRTRLTKKPSGLSIHATNCNIVSSFWTTGSLSDGHREIVSSTEAPLGEVSLGRWLHDVAQAHWGVIHFVCERVYLRALAVWRVMRGSNGGSVIGCYAGWRASQSSSVSLVVLTKASLLASWCVLQGVVLLWSKLLVAMALSCGLPYTSYVVEDIGIRGAIAGPQYAPWVRCITHLDLARIRLPLQLTFLPRVA

SEQ ID NO: 1011207 - protein, 104 aa, Homo sapiens
SGCYQRAGTGRRGHGAGKNQSAENPGEVNWVHKDQVEEYVGAVRMLEGRVRMQAPGLRNWGALAWEQEQVGRGLEQEQGRGPGELGETQVQYPKAPWGRTPELK

SEQ ID NO: 1011208 - protein, 108 aa, Homo sapiens
SGRVPVVSGDGGCSGGCRLATRLWAAGADGALAVGFLARWLCAVALLQHLPKYCPRMLRLAGGQVWLHFYLSMRRSGEHRRIDTEARYSMDKSRHSIFRRSCYTNCRA

SEQ ID NO: 1011209 - protein, 76 aa, Homo sapiens
MNVDKGNSSGEASDTDVSRTTWHFIQWFTKFYDANYDGNWSMILYRHDNGPDAIPPPDPGEQIFNCQKKSHHATRP

SEQ ID NO: 1011210 - protein, 92 aa, Homo sapiens
MQLRITRTTQHHTGILLNWLVENSAFTNVHCDKGQFGAQRIFVTFRAGHIFNITTKASSHKAGFPRTTRIIYDRGHDIADPGNLQVEPPLRP

SEQ ID NO: 1011211 - protein, 75 aa, Homo sapiens
SGGSKNESKQELLRGTAFAEYPESVLQAQKLLDRREHFITRELCPSVITTEHKVLPFCRKAVCDLESGAEIYADA

SEQ ID NO: 1011212 - protein, 186 aa, Homo sapiens
SGGALVLAEDASFLYAPIFPILPLERARLLALVCSIGLHSPLPAELHIELSLTVCTSSSSESSRSVRGASVMRLRPSLGVRCSSAYGAKRMNDKNHATYVAEYAEEVVRLLDARVSIAERNKMPTPIAPMAPSIPLPPPRREVCGAQRLGSLSVSRSAAGSCWAIAAESVPRLCCRSLVTVCLVFL

SEQ ID NO: 1011213 - protein, 584 aa, Homo sapiens
SGGERCGSGACADRGQSRTNGAGAPPQGPATHLPGARAAASRSTATHDRQRHSPTAAARLHALGPSTHTWRAKHTLAVDRAPHGQALLRGSPTRRLHSCQVSGPRSTRPCHTALRTRPRNSLRHCPAHGLRSPPSYRARGLSATATPVLLLLSSSSPVLIASIPLVASLALSPRRPRTRIIRDSSVTAAATHARSPPQGLAPDDSAPTPVSPASLPPSYFPPGLGPTATRLPVPPLYGDSGSCRQVFPLSAVTAPLLRVATARFNRSLRTDSADTSLREGWTAPRPVVLAVVLFFLSWSEWRTRVVLCPSRGTTSEPCAGHNVINNEVHLSTDTVTHGNMCRNRPDRLHRTLPIVWYLNPPPPIIYTAGRFQMESREPIAVLIPDRGTLEDLPNNPLPPRVLLTITGAAGAAMYSSGSPGVPKFPPALGIRARPGSLATRVWARSRERPPPRGPTLAVYYPRLNASPRTTARDHVVRQHAPHGRRRGYKPPGPLGPPPSSHLERRCGRVPRRCIFPRITNLPVFPATTTSSSRSVPANPAALYPRTRHPHLFTPRSKARTTTLLPTNGRLVVCPRIQANSRSCA

SEQ ID NO: 1011214 - protein, 144 aa, Homo sapiens
SGCLRGCGSVVSGAVSAPSGRPAQRLPRADPGLIPVGAPALPCACGVRLRASSSRSLCFSCLPVCAMCVGCWRSLSWRSSRPAAAGTSSCRMQEQSGEPEQAAELMLHPPYSSISAESAAYFDYKDESGFSKAPILQCSYNTAQ

SEQ ID NO: 1011215 - protein, 125 aa, Homo sapiens
MGYPLVYGTFAFVYIAALVSRPRGPLPVAYASMTAARRGILDTSVVSLRHIRQFRIQCPLEGSTVRIRRSILEPLNGPHSDVSADTILPPIHPVPQPLEMNCGIDWQPRLVLLGISQGGATGLPA

SEQ ID NO: 1011216 - protein, 308 aa, Homo sapiens
SGVGSLGGAADRACDSVSPDAERRPDVLVAAAMAEQESARNGCRNMSGGSPGVWRWHSCAPSGLAMAITYDAHHMYLDPVSFIVHVLSSKATRESPGDASLYVGVTPLPRSFKLMARQYHRCSQDLCSSAWSVDVPLEMNGGKVDRGMTEAWLDTIWSYTGVPDLSWIAPSFSVILREPLWWSRTSPGPVFPYGALREACGPSPGVASMTAGTLTTLWKRSKTIGESRVSLCMQLKADWGGRLCLTLAGWTLFPAFRAASRTRPVGHWFRGPVPVAYSFLWFPGDPTLRHSVVLPDVRPRKPPSIEDG

SEQ ID NO: 1011217 - protein, 279 aa, Homo sapiens
AGTRGCGVSLLRGLGSGSWLARLSPSAPLATLCAQCPQAACPALWPAPDAVPGACWPAAPVARVSRLTCSLALPPMGPRLDGAPARPPARERPPMLAPDGKPVLAGASPIKPYTSLAEGPITTSQQRAAIPRTKPWVGPARTESPGQEACDSRMTEAASTQNRGMRTALSSNPRKQPKGSGHNHTRGPKCTDRTRDSSGRPWSGRGPNGAGEDGGNEHKNSPKNKKTHPLRRDQTNQVRTPAEKPRHTEPTSERTKRPRNIHDEAPRIKSAADQMQEPR

SEQ ID NO: 1011218 - protein, 256 aa, Homo sapiens
RGAGRGRALCELDVQAAGAAGPPGCWFAGSRLPRVSKRHDHRLVDSWTHLAALDRQSAEPRGGPRGHSERHGVARVVEDTLTQLSEAQGRGTDESHLHRILSMFRAAGTQAYCESGPGLMLCYYAHSANVVSISRQRSIGPWSTPLPVPGQSCAPARQLEWDERIVAWIIVAQIYHSREAFLMSIIGTAHIPIHYCGLPYKMVAKTNAPRFFSPELIQGRRPKMLEANNCERSPFIPMCVTHGPGQEGRMDRLWHR

SEQ ID NO: 1011219 - protein, 217 aa, Homo sapiens
RGRRRWLRGQSKDTVDPTRTAAHSCAPCRVAMLPGLALLLSGRLDGSCAGVYPLMVMLACWLNPRLPCSVAALKHAHDCPEWEVGFRSIRDQKPALIPEEGILQYLPRKSTLNCVISNCGRMPSNHGDHPRTGAIRWPQGSARAISHFVDSLPAAYVGEIVSDALLIPDKVQHFLHPGLGWHVVRIVIFIWHTVAKETCSEKSTNLLDYGHVLTCRN

SEQ ID NO: 1011220 - protein, 112 aa, Homo sapiens
MQRLMRALARSALDLIGLRLYIKVEHTNSPSTLMYMILEISPEPAVQVVDAMMELNAIYRCHRMLRHSSANREIIPVSYLPDLSRYTMRRILSGLTALLEGGILPHSHVCGP

SEQ ID NO: 1011221 - protein, 213 aa, Homo sapiens
IGARGRRGLLVASACILWGTDFTAGLVLEVDLRQGIVRALLLDLLVCGWSLCSEWMGFNLSSTLPQGISSVRPRISTGCLAISAGVPRDSYGLSRGPRAGVGLRRPPGPRLLVVLLLARVRLLGGHAPLACCKTPVGVGRCMAVPNRSVRGHGQCLGAVNLPMHKVFRGHEETPSLQGGLRFLIWRHYHCLVHGPLSLPVWKFMLHNIKRAHQ

SEQ ID NO: 1011222 - protein, 122 aa, Homo sapiens
MGANRNAFNSSSCLWVPHSNVLAKTEQRQMAIYNTTGVPIEKSGDKRWLHHTQPTVVNASNPSLLITTVGWVRPQMTHSSLVQLLTVLQTGACPNHTQLQRDTKLGGKIPPRSNVHYPMCPK

SEQ ID NO: 1011223 - protein, 132 aa, Homo sapiens
RRRRRSRSGSRALGRRRPGRNTCVWLHFQGCYHELKAVTWVLPINEPVLQQAVTLMNVLSLLTGSRFCYELAIATLRYRFDVSPITNILPFCRQTFTSARHVETCRGKHLCVFFHLPYHCAFSQSLRRFGVI

SEQ ID NO: 1011224 - protein, 369 aa, Homo sapiens
MARSEAIEAFAGHSFVAHRLNATKRNQGPLWFGPQIPPNKPLDPSDAEIMNGYLPTFFPIGTRRSSPEVAWKPRDKEAPILWEHQRLRSQPWESSVSSWGATILFPGAPEYKAKLGHSLLAITNILAPVFRHRVQKVRWSKLAHTYGGEMFVSAPTVIIAKRLYGLVWSGNRVDLISPAFGVALHRDVEYNAFFHNRVGKPVSLSTPWKLYYSLSDYQRPYVPNFPSRTPWVSQRIARYNMIGHEGHMPHSQDDDTLFDTRNTGLTKGCHSNSSGLVQGKVPLTSRLGAPPIFESKFTKHISQGRLKKFPSYESIPPDSEHSLRRESSDEPPLLSSTRVQNVTLPIAPGEKFPAKLILYRENSAKAQHV

SEQ ID NO: 1011225 - protein, 62 aa, Homo sapiens
MIPVGSYANVLEALNGEDGGGSKVRGSTYVLKGLEAVNVRTISKEKAGAQGIRILTVCALKQ

SEQ ID NO: 1011226 - protein, 242 aa, Homo sapiens
MLPRARSGSTELTPPWFASICCQPCVGRHLTLSLLLGSHCTTLSTDGRSIPLSAGEASDPRSRRWISRRLGAQEFRRFDPCKAVGRALCLVTEGMHSTQVAFPPALRHWAPGPNGGIPNPRAPQEPLTVVLHTGTPETAFPANANTAHRMSSFYIAQEPQRRQPSKQSLKPGSITVLCLSPLIEGNYLPFVMDCLKHRTSSPVNLLLDQVSSGELVDGLVRIEWEAPWGFDCIVDRGHASGP

SEQ ID NO: 1011227 - protein, 239 aa, Homo sapiens
MEAVKAEAWEGAAVAQDLLALGYGGVPGGGVTGRLYAQDFTWLCVRLAAELATLVRPLARSYDGVAAVTVLSAGEGPGAEEELSAAVGQPAAGAVLAGSCALRAGDGASALREAGAGLRLLRFLCSELQATRAPVPPLSAEIRVLSHPLVKGYVEGAGMVQELDLSLQALGLSRAAPGTTDRQLLQEICMLKISELQPSLPPGSLKAPPQLLRRCTQMGKRGRLCPKSLRDQYRCCADF

SEQ ID NO: 1011228 - protein, 66 aa, Homo sapiens
AGWRRSLLLRLRFRCCPRNQDLGVAYGVMVTNAVMRAEMATAQCRASSILEQKDSPGPVMVCVKHY

SEQ ID NO: 1011229 - protein, 215 aa, Homo sapiens
MGQAEAPKHPLRTSSTCHHTTINPHPGVPPTGHTHTRLNHKEATLSHNTHQYRQLKDKNPPIAVAKTQNDPQTEYTLMSHSTYGKVENNTVPINNEQKAYKTSTMWGFASHTDNTPFQPHMTCETRQRDTTPKIRTTTGKNTEDTTERCAVKPDNNQHDAVKIIKGTKQRTIQHSYPNDRQQKKQPSVERTKSSRTRNTIQHKPSPHVEQNTRSL

SEQ ID NO: 1011230 - protein, 306 aa, Homo sapiens
SGSGTGAVQTSRCLNTPEVLVIQHYHVCGPLRRAHPGRRALLYMSREDLSPCLMHAARVVKIPSRHARLVQGQERTEPQELHGDVMQCPDIDMRGPRPVWVRKEGLAGDGLRIDLGRREREVSRTRMFSGSMYPTWTCSSVLLLARDMELARWEDPTLALFADQRLCPVGNTPVRDGLNLAFGFWNVRCCPAGETLPCIPSEATPVVPSETCHVPADEHGASRQTRSVLALGCCVALVRGLGLCRSWPIELSRRVHHRFVARVENEYFKGRKLTVRREKTRWYFAKNRNGCLGANGLAYVRGGIRL

SEQ ID NO: 1011231 - protein, 104 aa, Homo sapiens
MPMLVPGHGPMLRGAKVSHCAETCEELRKSDEERTVPCGRVRNELLELYSSDTDALTEETGCLALGGESNSLQSISWAEKLLTTLILKELLALRWRLQLERPIC

SEQ ID NO: 1011232 - protein, 152 aa, Homo sapiens
SGVSRGAAGGAGCGRSPGDVLGPGDGQAVHRGPLPGNRRSPESRPRGLQPGDGPGKPPSKLPEGGEGHSRWRHGIGTSRPMGLALDSRAPIGVLPVSGPGAGVGPVLVQMRTRRGRPGPEETLRFAAASCTCACLMGPPWDLLIAPMVAPNM

SEQ ID NO: 1011233 - protein, 153 aa, Homo sapiens
MPRYPGRYRVMGPLRACERDRQLTRAARRPGTWRVVAWLVTHAIDRCLFIECCCIVLSNGSEFVCSAEIASSTHASGLQLPRAKTHTFLVKLLDSLFRDCCQSEAPLIPSPLRVFKLLPHKDHSKKGDNVNCIKELPGEHLEGKTGTRRYAPD

SEQ ID NO: 1011234 - protein, 263 aa, Homo sapiens
RTDAGSGRGDVISSDLRPAVCCERSTTRLSQLWSPGTQLVADSQNTEFLPPGWGNQSSNACARRSCRTCWKAQTLQSMRVQDNGYYTRLLEQTAPVDTLFKWKSLEKIYGQLLPLWGCFQHLQRHVFRTFDAYGDGTIDFREFSHLSLSVTSRGKLEQKLNWAFSMYDLDGNGYISKAEMLEIVQAIYKMVAVCNEEWLKMSLPQRNEQYKIFRQMDSNRDGKLSMEKSPSEEPKAIRPLCASCECEPSSAGQFWSPEANHRM

SEQ ID NO: 1011235 - protein, 236 aa, Homo sapiens
SGRKRKMAAAAWEACEESGGCEGGRWRPGGALVTLAGSVRCCDCWRGMSGALWMPCSSWGPVPNRLAAGWPWPHAARAFAPHKSQTPNPHHRTCSDLAHSTALVLQRWRVTIFAGSSRPDLPHVSSRFFVLRQGTMFVLFVLAYIHIVFSRSPINCLELCVTSGRSEGILRVEVRHNSSRAPVFLQFCDSGGRGSFPGLAVEPGSNLDMEDEEEEELTMEMYGNSSIKIELDIEPK

SEQ ID NO: 1011236 - protein, 172 aa, Homo sapiens
RIGGETSESSVRLAVARCQTAGAFVRPVQAMGESPVWTEKRSMPDTGSVDAFAMSTGFRHTQSLVASGGIFGYVKRRQCCQSLGCRAALVDSLAGLGAYHACLMDPRNVRVFLGYIWYLGWPSGNEVLTTLDSSCLQVYLQGAMLLLDGLPKSGAKYVQQNPIRRSHGSSLD

SEQ ID NO: 1011237 - protein, 124 aa, Homo sapiens
MPGGVPSLPMAYLTRAWTVASSETREPISQCSRHVESEIKHGSTWNLHLSPLGNLDVRYVMRSISRDVTILVVREELLGIMRDLPPGAVKWSEGTLCQRCSDMTTISCLRDQHRFLRTGKRALE

SEQ ID NO: 1011238 - protein, 470 aa, Homo sapiens
RVAAPMMQGLDDGPDFLSEEDLRERDSMLCRYALEVHVVRTIALYVANSLASTSLRMHSRLCLMTRPPSYGTYRVHGLPLPQLIFSLQRLDGRSCQPSVWAQGWVLESPVTYTVNRTSSRQRVPHHGAWGVDQGLVRPNKFDRMAYQTFTEATKMIRNAYQQLELTCLPCQDVRTGSPETALRYVVNAGVLNYAYTKSHLAFIQLTRNGFHFVPTKLFSQTREQAEGLLPRILLVLGPNNPFGNARKLFGFFCAPVPHWQFLRFMLFRHILVATVTPFLVPRGLNVRFHFSPRPKARTLDHKKRPPGNLALELAFPTGADIGKPLIERNTCAFAMLDPADTQQRGGSQYWNSQNADSGTLFHLGRGECDRRPIAERPFGEKKPRQGLREHINQPTENNLLWGRFYNFSFNTTGFKTISQFPFSLAHFPYSLVLRNYELLFSHLLDDFAYLNRLVNARDTDISPTTLFFSH

SEQ ID NO: 1011239 - protein, 33 aa, Homo sapiens
MTPVDYRLTSQKYHTGEWPTTCEVSKKPVTAKK

SEQ ID NO: 1011240 - protein, 116 aa, Homo sapiens
RGFRVVLLHGVRLRRFGSGVFRTPWRTETVASSPVRACWRSDNDGPCAEPVGLASRVASPDVGGLCVTTDTSHSEDQVLVKCRLHPKLHEAQCKKGKLDLSMNLIHNIRAIDCYRH

SEQ ID NO: 1011241 - protein, 86 aa, Homo sapiens
MACGPSTWSGHCMPRPSALAAVLHCRHAHASGRSLRKKRPEDFKFGKSLGKALFATVVLARELATSREYAIKILEKRHIITREQGP

SEQ ID NO: 1011242 - protein, 85 aa, Homo sapiens
MTSRRGLDPGSCVLPLSACRGVWGFSLRTGPGGRRAGQSMRSLLGDHVWHTADTRRGTCVFLRSADVLQLELCGTLGPGRRSGDG

SEQ ID NO: 1011243 - protein, 301 aa, Homo sapiens
RRGGAGGERGRERCVPGIEGHSQCACHGSTGSDLTPFVALNEVCAGDTLAIQPYRLAQDWLNSSILHCVFTYDHVTCHPTVFGLSCDTLRQLRCPAGPAGKRVVLDLGPVWGPGLLLVWPARDRGEPRNHRWRAASWSVSTAAGLGIMCDVAPPGSVARPMPVPSCRSFLGVSWPTEDSRPVPSCAQVSLLVSLQRGSGARPRLFRPPDYWALPQIPPRGFSHSWSQAVLAYPHIDAFAKPAPCLVDPPVLSPGCSAPCPGAGKPGSDLREGPGVLHQQAGDEFLCRKNWPGRAAPVASLP

SEQ ID NO: 1011244 - protein, 204 aa, Homo sapiens
MEPPHRPQSGPHSVNLSPLLCGPYFPLVLAALGLQPVRALFVSPSFLWRRLGVGAIVGASREGCPLGPDGSRSRQGPSVLLHKNFFIRCDESFCGPSPIWGPRFERGSNPSATVCVSQEPFPKVGFRHAHWGVERYALCTYLVGRAAWGAPLVPSTPCVDFCHLARVCFFPLVVPPGLGRLCGVPPLSPFFRAGLEARPVGPPL

SEQ ID NO: 1011245 - protein, 138 aa, Homo sapiens
MDRNPSPPPPGRDKEDEEEVAGGDCIGSTVYSYNTGLFGVLSGLIQDESALTNTKSSSDDEEQTDGGLMNDNARTEDYARSYGSSVKWHEDVRCYFVQEVYMLREYVVSVGRYWPKGSQDVPRIEGIFPCQTVDPDID

SEQ ID NO: 1011246 - protein, 108 aa, Homo sapiens
SGGASGVTDVLSEGFWVCELESRALDSDPDDGLAGTVDRRPPTLHGLSAPDLLLTGWWSHRRRDSVDAWAWTLITLWGLLSRPGWPGDLRSFIAWIAWKRLQIVLHSG

SEQ ID NO: 1011247 - protein, 251 aa, Homo sapiens
AGLVARVDSSDGGGRTGLEQLPECDGAAAPSRCAGGRRPSRITGPSVVLTHGSWTFLSRKSPSHSVQCLSAEVNVTGQKHGAIVCSIANDLAKGAQGLDAMSYITDQRDLERDRLRCCIRCCRRKPAGTMCPYCVRRRWTEQLEAFDLHNLSELSQQAVWALCGQHDVLELNLDWKSPEKSVPHDYTRSGLNKKLERSDTPLIVGRPVALPRVNEALVQVASQGFDFTVNRAGHPSGQGPQVPIARNPAGM

SEQ ID NO: 1011248 - protein, 243 aa, Homo sapiens
MRRRRDAEPGAGVLPSRAGGGATATDAGGQVVRVGGGRGAQGARAGGRGANGQPGMEELIPLSTTAGAFSSIGQSWHLDHGADRCSGRQSAARARCWRTSVGPGLPSPAVSGIVSRGPLILQLIFSKREHAEGFALKSRSSDFELSPGWRLKPDDRQGHGDQQRHYAKCPFKLRVTRPDVLTLTPHELPVLARCLWATGSRHRVTRSGHILQVIRRKGSLIVVAGPANLTWQLRRLQLGQEVD

SEQ ID NO: 1011249 - protein, 81 aa, Homo sapiens
AAFLVKMAGHTHVPFSASGNVRVASYYKMAITMLQDSTPLGFLRDDTLVQRMQDVETIAIRRLPENLYNDRMFRIEEGTGS

SEQ ID NO: 1011250 - protein, 109 aa, Homo sapiens
MQPAPRGRTTLMLRERTRSVTRNDFECRLSDSVSVLYGMRVQLEKLRDERGALLYSFVRITPVDRNIQTTDYAQNLAEGRSQLNLGSGIGTKALKPAFSGDLMGTTYEQ

SEQ ID NO: 1011251 - protein, 76 aa, Homo sapiens
MPVIFEHEYDGYISRESECEQNYMYMHMLGYPWLTFWNKLAVPQAYCLSRIYKTNALGYLGAMLLLDEDKMSISHD

SEQ ID NO: 1011252 - protein, 93 aa, Homo sapiens
RRRAGGGGERWRSARATAAGEWRGHRCGATEKWRPRMSGKLLFLCGRPVECATLAVHRVMCQRLRLCQVRAAEDASIVHDIGLPKAMGRRVSI

SEQ ID NO: 1011253 - protein, 105 aa, Homo sapiens [sequence omitted]

SEQ ID NO: 1011254 - protein, 221 aa, Homo sapiens
AERRGGVETGGAAWAPMWTEWTLRESEGRYELWPTMNTRLTHIHTTIPGNRTERGRLISTDIEMEGKNEISMQQKDHACVMITNNRKWKAYLGHKKAMDHEEEGETDNSDRTQGRTRTDGHAADDQSLVESMAKYRDKGKLGRVNPVEKRTEFTPGLHNNEDTRYEGEQSAVEIGHNKGELHDIVTKERQIKNSKVKQKSTCNVRNPQYETIVNDTCETEH

SEQ ID NO: 1011255 - protein, 83 aa, Homo sapiens
AGRRRSGIMALWWAYQLVPWARHRVRKYTVLTDWVPAWAWVTSYLTASWWRGVGSARNIREEALVLVYQWCSRGLSGFVDLCW

SEQ ID NO: 1011256 - protein, 102 aa, Homo sapiens
RAARRLRTVCADGNVNAPAMRLQRGREEHASGRRRLSRVSMLGRAGTGAEHLHGLLVRVPIMAIRNEKHQVAPQLLSHEFVLQNHADIVSCVAMVFLLGLHV

SEQ ID NO: 1011257 - protein, 107 aa, Homo sapiens
MFSMTDYDGVTWSNINSCESACKAQMCLTTEDVENAHLNARTARASAYRSGSRPHERCMGDIKRNVKIVRIVIERSYNGFLGHGICQLKDQEGEESEDSVGKKLLSL

SEQ ID NO: 1011258 - protein, 273 aa, Homo sapiens
RGGAYGTSIIPCSIIVIYVTKIIKGGAAHKDGRLQIGDIDPGGQQCGAESDVMHEDSVAALNNTYDVVYLKVGNAQQVPYLMDSVLSPLADESSTFVIPKHAWTSEESVTWSYLGTDYAIAMDPTSPRRYSPVAKVPARGGMTFPENRGDIVIHRGSTGLGFNIVGGEEVQGIFISFILAGGPADLSGELRKGDQILRVTGVDLRNASHEQAAIALEECGSDGHTIHSLSINPERVTADRRAKNPQTFRGTSSIEPCQPWASRGTWRPLRDAT

SEQ ID NO: 1011259 - protein, 283 aa, Homo sapiens
AGGGAGGARARAWALLGCERRRRQGGYYRRESGREPPPSSPLFVLLLARQRLVSGGPLGGSMASACVLCTSVPPGQLHVVETDGACIGFHFQIWMGWTHHVRTLLSPKWSWSLPGKPFYCLSSEDLRKNHSACYTDYCQQGSTGGCPSGSPFNGSPEAPRSMLREPWVNILVKGNFNLPLPRLFHPMVSHHSIHSFGYTFGSMSPKSIPRRLVLVTQSRSRIATWGTFWYKYVPFQCVDALVVPSSPMRNHSTRHTKGNFVGFRTGPLLPNARKGSLAFRVLT

SEQ ID NO: 1011260 - protein, 222 aa, Homo sapiens
MRTWNPSFGNWQCLWPDPYETMIVIHPLPSTHPLRLSWYRSGKGLGWSRRSSRVGVYWRVAHGSDGVNCNAQTVGSQTLEEEGVECFQRSGNSSVVRSRDLVCCTGHPAGIEMPRPLTGVERSKRLKAASWDGPSWGPNKASVHSPEPEDEGEPGRSGLELEPEEPPGWRELVPPDTLQQLPKSQVKRQEVISELLVTEAATLRMLRVLHELFFQPWQNACS

SEQ ID NO: 1011261 - protein, 120 aa, Homo sapiens
AECGSGLDEWLALRSRRSETRLWCGSSSSPRSGRALTRIDLEADCLCRAWCLCALILLFGARLLQLPDGLTGEPDATMGRVSADYAQHCDADCIVVRCEREHGRLQWTLGEELDLPRCLN

SEQ ID NO: 1011262 - protein, 172 aa, Homo sapiens
MGLSWRFLYDWDLCMGYGIHDYSESTCALNKMKTSLWDERNDHRGISVVALRRARDSQKVIGGSVAAKNVCQASVLSYIHTVFDATIEEFGTATVGLNADSAQESTLAQGSMSRTRKETVPYREKLAILCARPCTPEDLRGNALLSEALPFFPFSNRNSKKAPPQKYFPWWG

SEQ ID NO: 1011263 - protein, 234 aa, Homo sapiens
AEFRARARNRRRQPWQTCQAEPGTHCWDAGCMGRPKPSPLCLLFRLALYLCAPLPEDLTGPNPRAALERQQLRLRERQKFFEDILQPETELSFLCPICISSRRDPTIGSISSMEVNVDTLERSRTDRPWGPGCSRCVLALAKILQTNPPDLSGVDKHLEELSLPVAYIRQDPHLGPPPPSSSEFLQSNLHKPNIQVMMEANTPLAQLGGQKEDKRLMRRGQSLDDLQHTHGALD

SEQ ID NO: 1011264 - protein, 146 aa, Homo sapiens
MACALGSACCSYEAGRWGPAVALSRLSPPPVGPGDGRRREMGAGARAVAGGVDGDRGSGVLAALLRCSRNPQSGSGLPNGNDTCAFSLKDAGTHAGSDARVTRGVTHALRRMIPNGADSSCRGTRLKEDFEIRIGIARSVATHGPV

SEQ ID NO: 1011265 - protein, 110 aa, Homo sapiens
SGGAETSGVRAAASMILVLHHILDSTVVSHLPCRSGGHYRSFFNGAGAEARTASDRRRQCRPDHLCGGNWLRLPIWMGVVPYLGVVFEPHSMIDLGPRSGKSRGKAIYLP

SEQ ID NO: 1011266 - protein, 114 aa, Homo sapiens
SGLRAREPSWSWFDPSVSYNARACVLGLLIDFRRRGSLCRDESADRWRLGRRILLELRNRTPSDVDKELVLDNSRSQMTVHNSKASQMNLKNWNSYGIKSTVESSPQSQDLPKC

SEQ ID NO: 1011267 - protein, 98 aa, Homo sapiens
SGPEEEVVRLLLLQRLSLALGAQRGAAVSAAASSSLAVPSMFPGATTPLPKGALTPGSMEVWKDPSTGHQQSRRAERLLAARNTKRLFLVPKSCGISF

SEQ ID NO: 1011268 - protein, 245 aa, Homo sapiens
SGRKRKMAAAAVEAVRRAAAARAADGGREAPSDTCWVVSGSDAGSACLEHCGALHSPGALGPYVRRRRARPPRRGPRTPNLKPQTPHRDVRDRLFHALVLQEWLSPYSRALPARLPAALVRSFFVLLKAPVCALRPGLHPASSSPGSPINCLEHVRDIVARVSGILRAGQCGTTRVLRARTSYMILCHAAAAGSFPGLAVEPGSNLDMEDEEAEELTMEMCGNSSIKLTLDIEPRCQSRQVAQRP

SEQ ID NO: 1011269 - protein, 155 aa, Homo sapiens
RKGQYPMRAILTWREVCFLIGPEPAWLCGWWDAYPTDEAIVAQKLDRILTRSRRSARNCFECQVQVGGPRRGGGGGGGRWAVVGPMDEAVSCRAWMLHFLWLSLLPSFAWDGRFRGRSRMDPDICADGSYSVGLIRVLGSVARFAESIYHVIRIL

SEQ ID NO: 1011270 - protein, 91 aa, Homo sapiens
MSWIQKAQSWWPEAGASAYDDMCTWIKAVSATGAQTVPREERTVLCVPNRAWSGGRCAGWRVISYIEQKNDTSDKKSAVIKTIGRKWSRVR

SEQ ID NO: 1011271 - protein, 71 aa, Homo sapiens
SGHGERAGACCSAEGCGNAVTLRAVRTDSHRLTPASLLSRHTIVAVTAPGHGLQVKLSSFFCTSVVLIRDF

SEQ ID NO: 1011272 - protein, 304 aa, Homo sapiens
MAIADDWTSEKRKDEIRRARPWTGHKQIVDQKGDGTSVSNRALSESYSMDHKDPDTAGTRLSSILRSGCQHGRHQLGAADSSHCLEPRRENRVTASETIYRNRAVGPQKAQSKLICIHCENFIQVGGTASRRDKKANGMAWKPVRSMSRIVALTECKCRHSLIERKVCALRTYAYAQTSGWYVIRKSKGFAYASLCVGHWERPLSEKGVVSTPDDYVPLLEAFISCVNPIEGAPWDRRRLRQAFIGENCPAVNGKLLRRNLHVKLQCKRNKVHNLGLGASRFNTGTGPGLDPWDLVGFARVLPL

SEQ ID NO: 1011273 - protein, 77 aa, Homo sapiens
SGGLAGERLGRDGILLTAHVLWAEWAELPGSVGPSVPALRLSGAGNPLFSPRASKAERHYSPYEVIVCLRNANTVYV

SEQ ID NO: 1011274 - protein, 123 aa, Homo sapiens
RWKSVWRFLRDLELEIPFDPAIPLLGIYRKDYKSCCCKDTCTRMFIAALFTKAKTWNQAKCPTMIDWINKMWHIYTMEYYAAIKNDEFMSFVGTWMKLETIILGKLSQGQKNKHHMFSLIGGN

SEQ ID NO: 1011275 - protein, 69 aa, Homo sapiens
MREIVHLLAGQRETKVGSQGLREVISDEHGIDPTGTYHGDEQTCSMVTHSACTTTEATGGQRYVPRAVL

SEQ ID NO: 1011276 - protein, 67 aa, Homo sapiens
MRLRLPLCPIPGAHMSCFVEIQCGFPAGRTDSNCGDWVGACVGLPLRSLITPTFQFIEQTAGRMGDS

SEQ ID NO: 1011277 - protein, 158 aa, Homo sapiens
AGFSRAAVRAPASPPQRRSPRRCQSRSGEPGCVRPAAEQKSGPGPGAGKRHEGSLARAGSMPARDYCCNGASSVEPPRPGLRTARGIAWSRALPCVPGWLRHVPFAQECGCFKQKLVLFVKKNPPGMFTGHTEKEPQSVLGFGHGLTAESSYLRRTLG

SEQ ID NO: 1011278 - protein, 42 aa, Homo sapiens
MAMQLKSVKKDEVRSEQREWDLAVRQNLMIDEMNGVDWVCIT

SEQ ID NO: 1011279 - protein, 61 aa, Homo sapiens
MCSIAPFVLACANSSCAHELVSQPSSTCGHGSLDFHVRSCRRCRQFQPCCFTQCGPLVQRG

SEQ ID NO: 1011280 - protein, 145 aa, Homo sapiens
MRPPRSSLTPVASPDRRRRMTGNMPEHREKPATKAPNDQGGGTTIRGVTTNRQSRQHCQGPPGDPVGIEQKPRDKERDQGEWQNEENSTKGDGRPQGNSNNVQEEKQEKPKEEHLVGLEMMHPGPECGTHTKQLGARRHEYQYWA

SEQ ID NO: 1011281 - protein, 304 aa, Homo sapiens
SGSRGRRRGAWLSPVQRSPESPRPELLPSLDSSLGFSCRQPYCCCCCSLSLAQGLRPSSSTSTVPEEHIPGVCWEPHHLHRGPRGETLWGPPVPRTTSVELCDFRVPGGDPPCVIIIPPVISHFPTGTHACCPWGCFSTCSTSRRVSTGAKPRPLGDSFNRLASAPLPVGTGVFVRGATLLPGATAHNLWSQGAPGVSVYVILSSSRELSCAARVRGRLLCVVPGRASEQNLFPHNRVSPVHRVFVPSFTYTGFSTAGVCGGAGGVSALGPCHCGLRPQSPNPVQLKALWLWRCSGCQLELALS

SEQ ID NO: 1011282 - protein, 249 aa, Homo sapiens
RGRLAPGPAGRSSSRLLRGGLRLKVLCLCAGRSVVRRLWACQSAPLRRPVSGPPQCPPPFSGQTQRPRKMAGPGSKLVQRSPALAEQAERYDDDGRGQCKNVTELNEPLSKEERNLLSVAYKNVVGGIADSSWRVISSIRAEDICYGNEKTIEMVRAYREQDRPRSEEAVCQDVLSLLDNYLIKELQSETQYESKVSTVKHARGTRYRYLAEVATGEKRATAVESSEKGLQRKPTRYSKEHMQPHHPCD

SEQ ID NO: 1011283 - protein, 154 aa, Homo sapiens
MAALPRAAACPGPVPGLALLLSSCAVGPQVGIKWKYNPADASKTRKHPVSQTYRHNKVWPWSREIKGHKENFPLCETCRSGPEKRGERCVGPGHLRPRGCDARLGDPTRRCFLFITCGASLEAQKGEILERVVAILPYIGRLNQEEVCKNGDHL

SEQ ID NO: 1011284 - protein, 326 aa, Homo sapiens
SGSCPRPHSNAHSCRIRKISLVPARVQGLCVEPFLDHLRASPLYMADSEKDQGPARAYARSVRMGPDASGPQEVSGREGQVAAGGGMSCDQTAARKVGHREPRRQCHGLEEMGIAVDDHTKDPRVPGSKSAAEEASALTIRSSLVPEVRPIVPLQLREDRKHYAREVRIGGHPCEKKRPCAKRNGRNWREEEGITEKAQIECIEVHGDIWFHGTYVGERDKHRKFKLVTLRKKKVPPLEHTAAYRKVHQKLSVVASTAVRNSKVWHAGGVGMDTLWESHLGERGGGGKRQAERRTSVHRQRENGIPGTEGTLESRNGALGNGRGGN

SEQ ID NO: 1011285 - protein, 104 aa, Homo sapiens
RKEVASSAALEHRQSAPPGVGGVALAFPASLEKPGGERGLRAGAALPHTPRRDFSVGPTWRVAAGALIRAPGRWIAAGGGRQAPRRPAPPETAAGSSPIDRLQM

SEQ ID NO: 1011286 - protein, 176 aa, Homo sapiens
AEESGGDALRQGNLVGSPDLETWAELTAFKPEGRDPSQPESAGYNALHYARRMGTYACGGRYAAVEKRETQMLSGQKPRGVPLVWRPKPGYMRGTQKFRRGPEYHTVVHTPKGGWDDDRAEPRLAIKLTEKRGPPRGHLARILPGNTDQSLKEEDYRGDGKGSGVDTVTLRALPKK

SEQ ID NO: 1011287 - protein, 302 aa, Homo sapiens
MTKKTRDLFYTLRKAVMDHVSDSFLETKCTTLGTDEKLQRMELTKEVKEYAQVYREHANKWIEVANLGLYQSQITEEGVTACPNVCKPVRKPSVPRGYINAALAFSQQSTTRVNWPKENMDAIDTGTMGQTSSESHTDELTMTLTLPMTDFLGWPHENHMAGRCDTKWCPMGYSQENQKLRWASDPRQPWRALRRPGDMTRGTLPRYSTLRTTGTIYEPKERFLTTTRSEQSVEKKKAPTIALATYKTREPMTTHNHLGDERAKATSDGNDPTKAHSKRLTQRPLGITNKGYTEELTARAVI

SEQ ID NO: 1011288 - protein, 146 aa, Homo sapiens
MQRDEKSEARTSYCRRNDNFSVQCHMRVTRKANRTWSLHIYTTAVLKTVCVLRSCMLVEARTRKPAESLVAMLTYLHQLEQAILPIGVHIDRVRLGPKGNKLTRKGLNSCKSVFVAVHEYTRDRRLRTRRLVGIMDIAQLDAMPRT

SEQ ID NO: 1011289 - protein, 316 aa, Homo sapiens
RAKGPGGGSRGNGGWWLWAECKALRQEDCWMPIGLPVEKMSVLRLCDLQRPRQEQKLASTHWGQHTGVTGQARPREEANGAQGLKRGNRVYVARSPNKVGYTGVSEEKTIPCKSKIQRKKRATTSRLVAYYRPEETSQGRKPLSETSNRHQDVAESKEKDKPTGEKRVPKRGTTWEGKTQEKGRNDNPRGEAGNECRHHRTYHQDPKAAHIEKNAKGETGKMHKDQSGVIDSIVISTRKGQLGPEDRREKENDGKGNSELGGGLALVVQTHTSNIIFRLARSRTEPEIKAHNQNAKQEDRTKPANTNDSERSTMKA

SEQ ID NO: 1011290 - protein, 114 aa, Homo sapiens
MHPFSDLAKDQKDKTGRKENPKVPFRGQLSLRPLHSLRLLANKLVVPEEQQDVRVCMCCNQQNMSQHDDTGAGTIDGFIKRIAVTEPQCAIREMESNKLRGKYIGRDKSSKLGC

SEQ ID NO: 1011291 - protein, 254 aa, Homo sapiens
REEEGLGGRMGLLSMWRKLKSAPDQEVRILLLGLDNAGKTTSSEAAASEDISHITSYTRVSTSTVYNHKVCKLNVWDIGGQRKNQTDTGRIYLENTDILIYVIDELQTRKKIVNETGQELAVIDLEEEKLSSVPVLIFANKQELAHSQALGSEIGRRTEAWHTIRDRVWQIQILAQSLTGEGVTGWHERGSGRICQCKRMTLTSRRMEMQELPESPTFGPAKTLIGLLSDPNCYSICVQLQLFEETGPTRLHTE

SEQ ID NO: 1011292 - protein, 112 aa, Homo sapiens
SGSHRVDIPVFVRGSVRPLAPGGQNITMILCGSKEDQCMAGRKNLRKDLPRNKRLIMIMHYDRYGSRDSDEAPGTWDGMSIQIIQDETEEDENIEYFRAEKVRSPRVTSTLG

SEQ ID NO: 1011293 - protein, 31 aa, Homo sapiens
RRQICLLRVETHERRPPAVFRTANRTLWLTA

SEQ ID NO: 1011294 - protein, 102 aa, Homo sapiens
MGHSFSFVPFLLLTVHKYKTQYKDLPSGQYTHGVFGLFPKFALTLIWRSTGWHPFLHSLGGRIFQHQILVCCLALNRGPASFIPHSAGAAGRILLILGMNHG

SEQ ID NO: 1011295 - protein, 286 aa, Homo sapiens
RSRLRQPASQACSRVARLGYSAGRRRARGGGGSGRHPRAEDAEMCCTAGRARGLRRPAGPSRRVMGPSRFDAGHSRAPCARWLFRAGPRDWQAPVRRRLQCRVGSALAVGRCRVLAGPGLDCGLGGQMSELRRRARSPRIRRCSSGLLVFRTHCYVDLRSVVALERCGTGAKMVDSKKLTYGRDLSSNWHTNISNEMRGHVAGSYKEDSPRETEPYPWVLETHAPLKAAPRQAVSLEDTHEWGASMCHLGLTCAVTTRVEDRKSRLFASCTPRWNMERASNSHLEA

SEQ ID NO: 1011296 - protein, 168 aa, Homo sapiens
MKDRHLSILSQGAWGHVKVSGCTKKMRPLEGDEAPTERPVETREHGADVSPTGKTPVVGLYHRGAQSPHGGTARERRNNHWPCRECYTGRSGACGVHISTEPHGANFQRPTPRSEHVGRPGAHVTVQLFCGPNLNPFPVRGRGGDPRRTTGAVGACVCAQEEGSPTVY

SEQ ID NO: 1011297 - protein, 227 aa, Homo sapiens
ASGKGTQRPVARSLVIALAAAANITDTASLPDCGRDGWSSNGRRYRRRGEAGGSQLGIQVMSEYPRRSGGSMRRKKAAHEHRNKRINRIMGLSQSPGIGADSKTQSHQRSEAGRTGDRLNSLSVPSDSKRVVAEVIQSGPREQLTSSGGDGRGKRGPNRETNGTRSLNQLSAEVMYNLEAPASGHRGDLTAGPSGPKKGGTPGPHGGLRKPDNHFPEIPKDRQVDRR

SEQ ID NO: 1011298 - protein, 229 aa, Homo sapiens
MGRRSSLVLGAGSGTFAEEPGKGSSFATPEKPPLGSFSRCRGARRPGGFPGGVSRVMPRQSQSSLVGSVIPKHQVCRRGGPPQPTTVLLLEKSPLSRRAKTTGRVLPNKNKTCRHCLPHGLGLEAPWASSDDSLALGVLHSAWGVTTELCKSSPCRRAGRSFHATTVKFGCRRYLRGGWGGHMVVHIYLITPFLNKKFYRETCGALNYWVWGSGRYTPSYRAGDPRTYS

SEQ ID NO: 1011299 - protein, 131 aa, Homo sapiens
MSCGCLIRIAQIGSLLSLNSIDGQLCAPCHWRIGSHWEAVLYHGAREVGVPAVPTMIFKDPVTRRITGAHGLMHCATLPHIYLHCAYVPELNGLPCCGRSPDLLTLYAPMVAGALVRLGTVTVIRPLGAYA

SEQ ID NO: 1011300 - protein, 32 aa, Homo sapiens
MGCQASRAACELTSCVRGAIRQIALGGVGYQS

SEQ ID NO: 1011301 - protein, 102 aa, Homo sapiens
MQLPVGVTRPGAGELQGRGSAAESVKLCLSFTPILYSDATGRRGMGLNIGEQLYKAYETLSGKHAWVEILQYKNFSRKTVNYEHENTVYNTGQAVDFLQTIF

SEQ ID NO: 1011302 - protein, 208 aa, Homo sapiens
MTYCCFLDRAAARRRSGCWPSLLPCCAVTVCVELALASQSVLGVAGRSHRSGEALEPGRLEIEKSTLRPIEGADRFVVILTHVTGKRKIPMNEEAERHKAPEDAWDCRSSLGFHSTLASPPGHARLHVHWSQVASEQNGNVTIDPEIMYIPKCHACLATYRAYVGFPPMRRENHSIQRIMEPEKKMIGSIKTGLRQRWIMTYKGGKQT

SEQ ID NO: 1011303 - protein, 151 aa, Homo sapiens
MIIYREPHQPRMQMFSAHLQRSGEIAAGIVPGGGSGKTGQYGTRTVNIDLLVVSWVEDACPLRGSRGLNWYLTWHDVHQLECSILVSETISLHGNVSSKREPIKKLQSLRITSESQIIRELLNEQDDQEDDVKTFYEQGACRTSVHSIILA

SEQ ID NO: 1011304 - protein, 38 aa, Homo sapiens
MTGEIKHAGATGWALVGAPGAVSGTVPDGYYRCKGDTP

SEQ ID NO: 1011305 - protein, 249 aa, Homo sapiens
MGAPRIEATEIDYQTSQKDFCVILSRWLPIELKKYLALLHSCDSCLRKSVVVYYALGMEGMAMLMQKTSAHGLYGLYGKSNIVWIILLVQPYTPGVIGTVWDNLKDQGMTFGASAAMAPSSGGLHSRSSGLSVHPGVGPPGRLYNLPKKSCEEVLGHWRIAICCLDPCIVVVGSGVQPNRSLPRVPWGPRSSLMEGVLYPHETSPGLGEAIVTRLSFWGLEGKQGKLAGENWKGKPKQARPNKVHERLG

SEQ ID NO: 1011306 - protein, 254 aa, Homo sapiens
SGLAEPVRPGCRSLPGALRTWRCLAPLLPTRRNFPVAPWILSESPRLLLRFLALCPPRERLRILGPLLRFLGAYGWSGPLAVRAHSERGSPEPHVDCDVEGELVECRKGGRYESQEPTMFNLSLLSFKCEDLNSFLAKVATCYTALTIIGGYFREVEGATCHSDPKVLRYALYRSGIQSSELIARKETCGLNTFAIGSPKGVDSPLTVETPQERFSGCRAPLRSRPRQAPSTDSPLEVARCSPLVKFVKFLRVP

SEQ ID NO: 1011307 - protein, 334 aa, Homo sapiens
SGGGDGAPAQHLGELPPRPCFALASPPGEGARGPWHRGAKARWMALEGLRGPRRTEGPSRDPRDGVLGLPRRGWGGHRAGGRSGRASGCERSFVQSHPWVWGRCSQESVLSRTWVWGVMKLYLPCARFSVKTLLGKYTAEPIDDSLGGVCRFLRALLEQYLSTAFKVPRELGFTLTTGTRGVWDYIRRWAVSEKCPTTVCSTHLRTLENISTGRGKGRGMGYPGWVNGEKRMSEYIHPRGLRDTREHQTGSMTLEAIMLRDEATIPHRNADSGLEARIGTSGFLVVRGKMPGTGKNPRGAIGLNRPTKSYAEVQYLTTEEEAESQETSEGNRRD

SEQ ID NO: 1011308 - protein, 41 aa, Homo sapiens
MSLRQAWRGSYTRHMCEVGMAYRCAETETPRHDLVDMKVTT

SEQ ID NO: 1011309 - protein, 159 aa, Homo sapiens
MHGGTWSLLWVEFVRAEQAELTDNLREVKASACHSVRKAVTWNVLEAVRYGCMQQVDLDCDRALTRGDTSTGEARAASYSVSWASFKCVLLSQLECTQNKDLAKCKSLCCTGRDWVQCDPYRPEDSNCRCSWKLDDNVTLRQTSHHIMASRRKPDSEFL

SEQ ID NO: 1011310 - protein, 32 aa, Homo sapiens
MSVASLGTNEFHSGEDVKSAQGSDEMDKMLCN

SEQ ID NO: 1011311 - protein, 157 aa, Homo sapiens
MVLHSDEFHPFIEALLPHVRAIAYTWFNLQARKRKYFKKHGEANVQGGRKSQSKMSFSVEKPGNQTEGGHPRLLVQTGAKDIRPGSIEQLWCSTGGLCKKGTRCWCSYPPEPERVTIRRHRLGCRQGRHKSWRLSKSWLILVPKASRLDKYPMESGS

SEQ ID NO: 1011312 - protein, 108 aa, Homo sapiens
AELTLLKGWEAHPVGSWARSGNGVRMDEDVLTTLKILSLLGESGVGKSSSELEVTHDDYVLSAQTCSEHIVCRRFSVMDYFHVGCWHLWVKLCPTGEYVGGGDKRRVV

SEQ ID NO: 1011313 - protein, 149 aa, Homo sapiens
RLFPSQVAAAKGAVVHVCVICNGWSCGRCSSFLIRMEVTQTYSTEPNNLKARNSFRYNGLIHRKTVGVEPGADGQGVLVVINAEILASGSAANVLLLRTIHATENCSSQAQEGLEHIDPVRTKYRPELQHVSQSARAQRRIACADHEGL

SEQ ID NO: 1011314 - protein, 328 aa, Homo sapiens
RAELLVLPVVAWFEVAVILISAEFDLPGFCRSYTSLALFEDRRMSARVGRNIVDRPGHHLFVASRGSYHSNEPEDGGSSVQLDRRASRIHAPSLTVVPFDGTVRRQPYVVRNDSAESNPVFEAIETLDLTIYHFGTAQEVPEFGYRQIYVMVMLIKLEHFSNYCKSKLRYPSCRVDVEWQCREEEAAHTVTSNEDVLTNTCKKLLTYKGASTIPQKEIPYYLYSLEKGRENTLPIPNVGIPVKPAFRANFKHGYRISDGSQCLITTCVGGALKSGMPAKGRSESPNSTREFLYVDPGNSLQYRTSFDVSPNPGEPDAQYCNRQGGNRS

SEQ ID NO: 1011315 - protein, 143 aa, Homo sapiens
ADYVRGGFPPTGTHTCGQEAGRPAPCLGSCRGRRGWLDRACPVEVVGHGGWAWCGTLRMGGPGGRARICGGRPDHFPPRFLGDWGRGTSGNVGRLGKRREPCVRSPRFPRYYSSPAGLLHRGVPRRTGDNLFFEVEKFSPWGF

SEQ ID NO: 1011316 - protein, 77 aa, Homo sapiens
MSMPCGTWNRCLCGRRDEGTYQPLANYQWDWKEWDELGCRASASPALPANKVSNGPPYRTRIPIYGTPKFLQVPVAP

SEQ ID NO: 1011317 - protein, 55 aa, Homo sapiens
MCERHWFDTGSGRPPMGWVRNAFESWYNFGSTSGVHPKFTPTLPKFEIIGGGWET

SEQ ID NO: 1011318 - protein, 156 aa, Homo sapiens
MRTVRKVDSTSSVLQTLSSKPQDLRRAARWPKRCLQVDGRGTSRRNPGSAHCWTYGPLAVENRAPVINAVSNRHGGQCLCSNRDNHTYGQSLSHGGYCGAPRDRSSHCCSALRAKSSTTDSIGPPDEALERTVVELYESCLRTRRKKISFDVGRDG

SEQ ID NO: 1011319 - protein, 105 aa, Homo sapiens
MNCLAGANCEKRHLPFRYVDLLINEDCGKKVGEYAKFPTEMEQGGAAKANRTEEEVDQTFGYPPDKFQIKKMLPGKTRGRGTNHRVIQGLTTGVHNIGYRNRGKI

SEQ ID NO: 1011320 - protein, 248 aa, Homo sapiens
AVNIAKAYGIKETKSRIQIFPMEKRKKKKSQVKLVPTMITKKERHNCPGSMLTASREEDDSQSDDILEESGSSKFQLGQMAGRMEFDAGLTREPGRLLQVQQMEEGNAIRTFHKHIQETEWQRSRRVKKLGKKADQANHHKTTEEKTVSEGSASWEPTDDGDTTAQKSMELMMHGDDDGDDGGTDGPRHSASDDYFIPSQAFLEAERAQSIGYHLLKLRSQEKKYMTDESIGTTEPGEHQEAKKAENS

SEQ ID NO: 1011321 - protein, 314 aa, Homo sapiens
RIIGWGIPWKVNAGEEGRCPPGGVGVRYQIQPIGAPMPLFSESGCCGLRSRFLNRVGSGCPRDDILAFPRGFEWDRCPLAMRFSGFLWGLRDSSPNYPNLCWIGRNPVPERAHKGLNGHALGKTVSVLSHPGASFPGLQRLDGRREPSEALIQDGPIYLVVLNGAWGHAQCRVTFVSGFLRIRKLPPTLPSDISAEPNSFPYYLPHLHGPVPSSNRLHSGLPQTCLALRCTFWGGPAQLEPDGSLSLSAGPDVQTAQHGWETPETQEPAQCEGPSENTWARTHTQARNTGKTHPRGAKPEDTAAAHSELATQQP

SEQ ID NO: 1011322 - protein, 445 aa, Homo sapiens
MPGCARVTREGPCYSEVSNPGRETQPRATEKTIERETQNEKSIRLNDTAQRTMVEHNTPHVVRKGSDRARHNRGRNGTRTTEYLRRGKGMATNMPEHGATVTHQDNTGRDPGCDAPAAHHRDPPPHKNARETKTTTQHNDATIQGQAENSITRAEPHTQTRACKQPGDRPNRPKHRQTDRAPNQQSAARATRQATVSEDNTHPNPPANPTTPSHHTRNVRVRSHASTGQPQANTAKGPTHDAQHGDAPRQLKTHPAVAVNSTPPAIHQIRARQAQMNNIETEETPRPQNAAPQRINHNTRNTVTPAAQQAVNTPGRPRRTDNSQLNSARGNQHNNCKQAHMTHHIARRTDTTYQDPRPQHTLGPKHRTPQRLGTRKHHEPSVPPSAQERNLRGTPPPTRSLHQLRPHQQRHCTYYSPIATDHVLRQNRKLLTESDPQPPPPRPHR

SEQ ID NO: 1011323 - protein, 93 aa, Homo sapiens
MPVSLAMSLEFRSPSNPRGSAAVGVEPWHLHCARWRRLESHVTYRASSTLMRPRRWAADRRHGDGLRNTPPDREVHGEGHSGASVRVDKRTAR

SEQ ID NO: 1011324 - protein, 248 aa, Homo sapiens
MRAAVATHASLRGLRWLHVFALTRDNDLETRKTTSVIMTPYGSDHAVRHAEIYMGHTAWPDRRSGRCGAVRRDAAGLGTPENTRGDCIGSALTNGSRFAGEEINYSDRSFPSAGVPDRRSRALTYSQVSPRDTSRNRLKEPEMNRCQVEEIQIIFRADGAEEPGPHLHMEVLGQRFQRMGSPVVPILGFHLGTFEGGPGGNQIEIQTLGALPCTVVPRMSSACDWLTPGHSRKEGPERILRCQPRSDF

SEQ ID NO: 1011325 - protein, 88 aa, Homo sapiens
RSLRSGCRRRWRVSIGVKVPRPCRLSEELVRRTGTRSTRLHGTRYRWGLVEMMKEVDTIQGWTMADEYHSVPSPRHEHYEKTSNDTKP

SEQ ID NO: 1011326 - protein, 177 aa, Homo sapiens
SGAVAEKAAGRLVRLCGCCVLWRPQSGSWLRPQPHHGDACLNCWCSWPALLATVSGYFVSIDAHAEECFFELGHLGHQDGPHLREWQEGSRFLDIRPWRCEARLHQQLRAWSTMATRGIGGNLGPRRGGLDDEGVWLGEKILLVAEDHLGKKGHEGPGTEAEVKDWNAPRGAKETDA

SEQ ID NO: 1011327 - protein, 73 aa, Homo sapiens
MKHEHNTPLTHAETTGEETAEAHATKLRGAAEAARHQEVSTRQPTPGKHHNKNRRPETQNTRNTHTHSKETNQ

SEQ ID NO: 1011328 - protein, 200 aa, Homo sapiens
RRSKKESMRRAPDRVRAVFSGTERRCCHAIYTLRHARPEARMVQLEARVWTRVSDRDEKEGEYITQSLGPDSSEIHFKVKNDNTSQETQRIILSKTRVFRMNSLRFLSERVSRIADNSYSNKNLGMAEEDVIEVYQEQPGGSFNSSDNSVLKSGAFSLKSVVAIVLNKVGRSRTVVLSKQEIEPDLATPIVSRNTSGSTS

SEQ ID NO: 1011329 - protein, 35 aa, Homo sapiens
MEIDFREQQSVIFRKKLAARVKVRGKEGREESEET

SEQ ID NO: 1011330 - protein, 423 aa, Homo sapiens
AASLPEEPRGRHTRPPTPARAHSHSHPGRRRQGGTGPHREHTNERTQDTGERMRTHADLACPKNQNNRGQPQDKKRNHHATRRHSTSGKAKAASRQHRGQGERDQNHQTWHHTRKRKDTEQEREGEKRTNKRGRNPAENKSPNPHGHPTKPRHNSRVTTTRAPREPRDHATRGAPKPERAQRTEAPATPQRHTAPQGHSEGQTPSAKHPEAQTGTRTRRPATEHAPAATPPSPPPQPPQTGAHHPRTTTHTTADTAPRTPEPPRLAPPPRHQPHPPRTPSRHTNQQAAPRSATATHRTATQGTTSAQNEEDTHTQASKPIPHAKTESSRAHGRPDRKRRRRRSDQHVNDKEGRRDQPRKRTRDTTRHRRHKSDDDDQRTRRDDRQPQDERDRAPHDRPTQQSTQTLAATTTSERATRRYHQTR

SEQ ID NO: 1011331 - protein, 215 aa, Homo sapiens
SGGRALQARREPAGASESRRSAELAGVPAWARSRLPGGLPGFSSARLRPPSHTRRHRVAWDERQRYCALARSDARPPDSRAPKSSRRGSAVPMLPRLLMEKGARMTSPGPWSITRGHLGERVNFALQSVAVSVLHASSSYYLLARKERVRRRTGGGTRIRRTLANCPSLESKREELVLTKQGTELVTDQTASKLLTARKSPGKDRRPLGRRMLPH

SEQ ID NO: 1011332 - protein, 72 aa, Homo sapiens
SGGAEARPEREPCACAQDRARAFVRASVPPSTCPRDKLDVCWTASTRMDDIMCQRSHLNEQALSIEVRPTDY

SEQ ID NO: 1011333 - protein, 126 aa, Homo sapiens
MGIRKMGGMRMRYRTQQSMVEQIKERVGAETHGHRHQKANNTRMSLNKLADKENSNTQSIPRPQAELTRYDANQIETPAVWGPITVCKTHTRTKIISQKHTKRHGHRKTDNSANHNDEATTSKTNP

SEQ ID NO: 1011334 - protein, 213 aa, Homo sapiens
MACARQLISDVLRKRGSHLAEMSLLPACSHRLLFDQIIVKLVNAQLRKNDQTARMLISWNYQDSVTTSDLSLGEYWQMRVELQFPEFEGGGTTCICARVLFWKHVSLEARNVGNQANKLAADCHFERGETSRLQIIHDNDPFLFSYSLGARSFKLRVSHPRWGRIVLKCAHSASLKKKGYPLEKVSLFGNNGRKDFTPMTDRYNEEIQVDSSL

SEQ ID NO: 1011335 - protein, 280 aa, Homo sapiens
RSVDLDSNPVADSRSRLLLRGFFPALPGALTCGFFPGLICQPGGLPYEGAMRAAWVRCWAAGGVAWSCVRQCGLWTCSAAVLPWRCMLTLVMPGHVKVQDPASLVPRRKRDNVPLGLHAQGAHPGAAALIVPVPDGRHSCYSVLRYVGIMTRPVLPLPRPTWTVLEQPFPGAVPSPAALLRRCLAGPALRHACSCSPLTSSRWRPVREDSFLRPARLLRPASFYMIPPIFFACPTCAFYGGLGFARRSAELHLSDRALSAYHRGPPNARGRKAGPGVHCP

SEQ ID NO: 1011336 - protein, 46 aa, Homo sapiens
MFGITPRHYLGGCLFLCVTQVQSIKGTQYRSHQATPSWLVIHEERI

SEQ ID NO: 1011337 - protein, 105 aa, Homo sapiens
MTIACAPCIGEQVPRDPVVHLAIVSSSYLYNAFERPDENRVFTLQFFLSCLLKMDPWCYKNLVMGVHTLHEFSHCFQCDENRNDERDHRRNYPLTYLRICLDKQA

SEQ ID NO: 1011338 - protein, 315 aa, Homo sapiens
ERGHTVTGCLKLVSRGCRALVVGSVPRADSARYLDAALVAFRLDGGRVSPWFAGFLGSFEQPLMSDLHPRTNQDPAYTNCAPVVRTEGCAGGKRFRKSGLLTKDKVVVAGLPAGRCHAQGAFEVETLHGSIRTSSVYVSQCFSEQGLQVCPKTYGREFVHSSCVYCRHQGQFAPRTTVRQTSVDNVRGTYFGIGYSVCTHTAPHAAFFHGEFEKATNCYASIANYDFVSAQRSVFTAVCTPICAPELIFGVGGKCNQYQCARLQYSALGNPPYTRQANAMLANPPVRELSRFIICGAGNGICPYIGERCVQQHSA

SEQ ID NO: 1011339 - protein, 116 aa, Homo sapiens
AGWSELELGEGSERAGGSTVRAEHGDATREDAATFLTSQPTAVCSPFSGVRQVPGSDPKPCPQSGENEQSTSSRITNGYHHSFPEAAHVRGERSYSWRNGGQCVFYLDNPRDYEQT

SEQ ID NO: 1011340 - protein, 192 aa, Homo sapiens
MAPCMCKAGFCWVTYCSPEPCFLPSLAVVPITTRVVMVGDGPEGLLRWATRPSSKRVHPDPEVPRLMHGRSSPTGTHMVEVSGIQQPSTSELRRGPGGAPSAADPESPLEPRMDQQTRQMTHDSVLDLHSILRPLYVAIQGRAVPSIASAVALTGIVHGSLEDLGSPTQVSHLRMGYALPHAILQSGPGMAV

SEQ ID NO: 1011341 - protein, 120 aa, Homo sapiens
MSAVLLQAYRREQLVRLVVSTASSACVLMEQLVGFSYSAVVKEILDETEDHLVLRSLPHAWCGMQPWHCETHAPVHLAVCPAFHSLLCLPASSCGRGTVVAEVVHGLCSRLGALDCGSDQ

SEQ ID NO: 1011342 - protein, 160 aa, Homo sapiens
MTTSLGKKVAQWGVFFCLSVVAGSLKTVQLSRRTLTVRETYTLQGPVVHGLVIDRQRMIPRYTTHAMPQARRSLWGLNPGEALSVGIPAANRHAKLSNRSVTRFRNRATSYGSERSLSSPTRCLQTVHRNVELPSGSDANRQWINRLGLVSYEEDENVDP

SEQ ID NO: 1011343 - protein, 106 aa, Homo sapiens
MEAWAACGARSRNARTADGADRREPVRRRNWYPGVCVWSPDSWETIADEHGAVRCANYTVSAFRRLTLLIGGASPSGMLQFEPPGLQETTDASRLRDLRRSRGIIA

SEQ ID NO: 1011344 - protein, 100 aa, Homo sapiens
SGVLVQYVPAWGVVSDPSFSRRLKRKTLSLKRSRSSEGPSESGSPTDECNADRLACSLMLKNQRGQLGRKKQDLLIKCLECPYTSTVKILSANDVGLLLT

SEQ ID NO: 1011345 - protein, 102 aa, Homo sapiens
AERRGVFMAELQLLSVVAGRLVESMVKESEREQNIRTMQDLMFRCQAPAVVRTSQASMKQVHHCINGCHVPLASSPGFGQPDDAVITVPGAGMGPDAPCSVR

SEQ ID NO: 1011346 - protein, 152 aa, Homo sapiens
MQRVIHPNAMWYPSRNLNENGDVYYYFVDAVLGIPLLKRAQLYFSRVNPHYVFPRCTEEVAYSDDVFPNLMGHYDQSIAAVEMEQFVFLSQNLECSPIHCKLSSAHRICTNPAVEQIQCGSNLVVNFVRKYILIATTLVDTFGIRWPEELDL

SEQ ID NO: 1011347 - protein, 277 aa, Homo sapiens
KRTWPVRLTLRAVRSICPPNVINSKVLSRLICEVLMSSGTAYTGVLSIEIEREVVAHAMVRSGFKQTFSAQCHTCAIESSVLDAKGVASRSPCYCSRARIIALCIAAHCCAMCRVVQRVPWTWARQSLKSVFIGARHLERDAFHEELAYIVVFGPGGLMRPIITFPVKNHEYSPRSAAVRAFLQKLLAVMDWCVYPYLREVRGDFTPQCPLLLEPGESSNARYGVCVLKQYFTTTLIGSGAGAAIYLSFSAINTRRKTYPSTFMTGAQRASSFEEWV

SEQ ID NO: 1011348 - protein, 182 aa, Homo sapiens
MGNFPFFAVFPPVSPPVFFFLPPPPQPPPQLFGAVTACFFICPPKVVFRPPRLFIFNAVSGGRGCVVLPLPSRIFYRGGLCDLLRERGGGASPPPVVVSFLPTIVFYILLPLFSPPSVRAFLLFVGPLSYSSRGVILCCRPPLSAAQDHLWRITRWCICVPHPPHFLFWCVSYAALVPLDLA

SEQ ID NO: 1011349 - protein, 277 aa, Homo sapiens
RSERADMMQLNVPLSHVYFEKVLLPVTGETKALAAELNQLRAMVAHSIWHVRLPALELRELRAAAQIKLTANERPGWRFDRDYLADRTWSTVSAERSRIDPDLEAAEPMNYPVLPIIQCYADDMPSTGPVCSLGEDEIDVAVRTEIRVPCCEDLRNGRRFRETLSEQVGPRGVCVPCGRLDVGPYAMMLVAQTPENHGSVTASYRVRHWRYHRISCMHSSEDVAYRFARLGETMTDGLPSNAEHVPARPSTKPTTTRRQLLVLTCDLAVSVADTNRV

SEQ ID NO: 1011350 - protein, 286 aa, Homo sapiens
MGARSRRYGRVTNISLLVDTRGCGKAASKWRDKSNYTRNQFIRGSIIAPQMWAGTQKAFTTPAKKTRGRRQGRSYKEEGPSWGTTWQWHMLAVPRSTERRRSKHRDGYIVYKAWPDKTKLTGKTGTRPPAAHVHHHPRGVDRQSGVYHTKGGPQKRGKHMREDRTLGTDFPTRKGDTKPAGRQKQDKTIVYDKRTIQYRTTEEQRSRTTQWRSDPTRYKHVARRTENTRRARNAREAKRVYTAEEKDNEHTGRAHKRARWTPRRGDTTKGDGTVASGKIAIVGDIT

SEQ ID NO: 1011351 - protein, 115 aa, Homo sapiens
SGQDAGDLRHKKEKLSSRDPGIASLRFYFSKTGMSDFVQLIEREVAGSYRVSLTTTDIFGCNFPPSSSDSPTICHVRTREKWRMAEGGMPAPSDDRCLRSLDASDPRTEAHSRQA

SEQ ID NO: 1011352 - protein, 142 aa, Homo sapiens
MARATLQQRRLLEQALGEPCDLDAALLTDIEGEVARWVQGLRANGLVRPKGGRMIAGCHWHCTFERHASALSINQGLVTSLRLFEPTRMLRSWGRWASRSLPVRRYRAPSGTLVSTSCHRLSSSLCSLPERAAGSALSRVPF

SEQ ID NO: 1011353 - protein, 108 aa, Homo sapiens
MAAPILKDVVAYCVKCGHPSGTERLFNDIYNTACGYGGTGFQRLLTNKNSRSSSKMATQSTWDKAPEERRKARFGAPGLKECQDSCEHTIDESLSLAAEYEWTHLSSL

SEQ ID NO: 1011354 - protein, 323 aa, Homo sapiens
QRRPSTDPSPSFTIARHRHPISRNLQTFDLFPLLSVRSPPTTYDASGAEDESTALAALSAPLSPIRGKLRAPGKRVPDECQAPVTWLQLSSVLFIARQCSPAKEYAVDPLRRNGHLGTKAFAEAWCLRNPSGTDIETKHNTTHSLIPDKAPHAFLTHATCKGAFQSWYLHRGCEEHWPPMGTLIHQCRWPDPPTCRSCKSALRLHGDNSYWNTQSKRIPQVSHKPKTVIATMHTIINCTPKQGPHKGLQLGHTSKDRKDMKRMLEMATTTKGDEGPRRYSHTLTHTTPHDATVRSTDWTLNKERRRQTQRKQATRRTSPRNTD

SEQ ID NO: 1011355 - protein, 214 aa, Homo sapiens
VAHSNSPSLLRKAKGKQQEVAIRRHVVPENGRTGEEDAGDGPTVWTHRGSEVRLLEMAVTCDNSSRGREKPSGVLRKREGGPGPSADERTLAVSITVAGLGRQKSMDFTFHVYRDFLTLGTAPRYAQANRRVSEELRAKGAELAEGLGNGPSRTGDFEAFCNVPGKVDRTFLRIVAKPRMSWNVTPDKVGIFSQNEQASDGVRKDLGAAGLFYL

SEQ ID NO: 1011356 - protein, 246 aa, Homo sapiens
MSARTRNPNERTKQRGQPPVPRAQIGDKVNRNELRLLRAQNGRPKKGRGRKKRRSAERYNQYRHTGTARNRRVGLAKGPNENRLDGIHKKYGAQSKESKAPEHGYRDVRNSMSQRRGNRSERAHVDETSRHKLRVASTSTLQRHEDAQLRCGDNHETSYRLDRRTQTEVLNRHQRDMGTHGMAIKPYTSLRLVGKNEGQKNRRKSTIRRELWATWVRAWRHEKREGERRLARTMRTGDNGQYPTKA

SEQ ID NO: 1011357 - protein, 139 aa, Homo sapiens
RTVPITSHPSKCQAVRAFYPIFHYLPPRAAFAPRARLLLHAARLIARASAAFAAFYPRCRCFCGFCQRHRCFCPRAPAFCPRAAAFCSQPSRLFAAAAFCVFSPPTLRLFAAATFSTAAAASSPAASFCPPRDLFPRVC

SEQ ID NO: 1011358 - protein, 147 aa, Homo sapiens
AEGSGVGRGAHAEVSYRALCQSDCEDLDSDPRWRYGKRTAGGRSQHSCVITPESRRRLIRTRSITSRITSLYTHGCLAIVADRGDSPWRQPDVRPGGWISKPLRFGEWSLPSIISHRLVGYSITDETWHEREIGILTTNKNTSRTSQ

SEQ ID NO: 1011359 - protein, 342 aa, Homo sapiens
RRRIPSPEGRGPAVVAGGGRFWRAEVHFDRRKAPGHRRNLVREPRSARHIEETRADWTGGERATRGEATVRDLTRNSRITLRRSPTCERVRRQHPASWKPSVSSMVAPHPWQAWTRLHRTERPDWHVCGMQPRAGVARGFRVRENIASGTVQQNITAGRALQAKRSKHSVVSVGPGDGTPVEEALMPRVRAVVTGHVQRQALVLDYIAVARWVVDGSLLNGADQGIIAWVAAKHGKLTLGSKRDALRENFPKSMLIGGTTMWRDSCGHKDRLEKLLPFRNRARLTGEKPAQYLSPRSKCSRPLWVPRGCPVGAHVEIAAQGRTVDNLAEDSESQQGTSRPGS

SEQ ID NO: 1011360 - protein, 111 aa, Homo sapiens
RGSDHNPRRGCAVSYFSSLVGLSCICLCSLPAITRLEAKGIVETLNHCFLHWERPNEHPDNHWLGSVIFHSNSLFVSSSRRLSSCLFGSSVISPCLRYTISSGPARPLVDC

SEQ ID NO: 1011361 - protein, 257 aa, Homo sapiens
MAQCRWTFYSNVHPVLFPSPDFFFFFFGARGLALSAQAGAAVVRLSAHCKALPPGSHAVPPASASRVTWDMRAPTTRPGYLLPAAPGYNMGVPPCLRRRWLLDLRNLVNLPASASPGLLRHSHALTHHPWALPIPPEIPLHTRLTRITQELTQRAAHTASANKRHQLPPPSSEKHSAQEATTHYHTTLESYTRSPDHPMRTAQQRHNYTYTDIVPHNLTSHRAHTEMPHQLALHPHAALQQRDLSRTRPPPLGRGPS

SEQ ID NO: 1011362 - protein, 494 aa, Homo sapiens
MAEGVPVSLDGTSCHVLLLWRSVRAALPELKSVTMYAEIVGLEVEAASWKMTEEHGQMGSCPASNMLPTRARCAAYLLGDAPLDRVSFVRRHAPQVACWDRFVPFGRVLRLDLASRRSPRDVPHPWWAAVCLGRNRASVYAHGRIAPGPGTNDDRIRVRTGPSRRYWSAPGNNDSPPGDPIASIKAALVPVRRHTDHGAWVHLEKGLVSPSNQAIGGKARLQSTKPKAFWITERRMYQVQIVALGHTQITTQQPFGSAPLGARQVPYSPASEKHPFIATALTATREGGPPTIWGPLGRNLLAIWKFLTQQRTFRAFQYSSGFCGTQHHRGEDSAPQHNAEGDHGKTNSGTAKSNFPKEVAQIHHPQNPGFPHADIHKLCRRQNATQALGASAPGEPTPAAVYPPCSWCVPPGAYCDPIDRSGPCRVICDATGMCRRLHHLEAPLVANAAQPVCLPHGQTVGVSALSCVPALIRCALPGPGTHRPCPPRVTGRQN

SEQ ID NO: 1011363 - protein, 82 aa, Homo sapiens
MAKNIQNSYRTTLALRTIIPTFDAGEIPTQVYFCAFYSKPLVVRFPTQRLLKRLGNPTTPLCRGSRTKSVDIGATLGELSCV

SEQ ID NO: 1011364 - protein, 134 aa, Homo sapiens
MAAAPPSYCTRCLPSKMLQDGLDGISGKIQPGPEMKVQEVVYIHRGADQRTGEQGGGSTYMSSRSKFRRTYAINDNAEPVWLWEKKKWEPMNMDLCSSHMKAINNERSQLARNRMPCWGMASGQAWDKKEGEQS

SEQ ID NO: 1011365 - protein, 77 aa, Homo sapiens
MQEQKHFDENPKTSKRQVAQQNHKTSGNEQVERAKRPDAKTWQQDEGHREYSDRRIVSATDHETTEHDKKEHEKINK

SEQ ID NO: 1011366 - protein, 72 aa, Homo sapiens
SGLSLPETMAGEAGTRCSHLLSHESREAPLCRVGGGRQYHNYHLAGTTEKATDQDIKDNWGDSDDVKRKKEK

SEQ ID NO: 1011367 - protein, 242 aa, Homo sapiens
SGGPPGPREAARARRRRRRARGPAFGNRVRNAKEPTATERKKRPPGRGQATQERNSRRAELAEEDTEPRSHTGTRQRLAGEPWGVGWERIFWCKKRIPYVWKAQIEGYLGHLVGYGWLHRGRKGGALKREDPPGKGVRKGEDANKPDMGVKDKGAKTQPRGLSTGSTNLQREPKPLVERGKEARNWRSPHIGCAARHIETTIPLVGGAPPPGGIALGGKTPPGGEKPQGSTEHVVDLLPFSR

SEQ ID NO: 1011368 - protein, 275 aa, Homo sapiens
RIQSGGGGRDHCLVAPRDYNREPWRTMGMDPDGVIEIGRWNDDGRLNFDDIEEFNTDGSAACVGNLVLVRVWMNAFSVFRPGDATDPTCYETRILDRDFWLRKRSAITSSIERKEHCTTTMSYSHRDFALHPTARDRFGGLSRRDEHHECPKDKLRPHQIKTEPWAATSDSPQTRRLPFPRAAYEEKLTKLVKAQALLLQVDPLAIKAVAKSQRNWSYQHTIGEIASTRHMCNGDLNKQRATMNMGKGIERTYPQAAGQEGYAVHLAKKLDRNGN

SEQ ID NO: 1011369 - protein, 68 aa, Homo sapiens
MDVLSLWAKVLDPQCFQAREQSLLFERVKGDYYRYLAEVAAGDDNERDCQISHSKHTKKLVKISEKRT

SEQ ID NO: 1011370 - protein, 253 aa, Homo sapiens
SEVAPWDAGSERSCVMPLCLRVGHRSDACVVLSFRTHIFRSSREGGMVKRAQTWLELEEMLPTKFAILVNPKASGQEDEWRGTGPSCARTARLADRNMSVTWDRMWTVVFSKRQRGSHALGHQLMREFKEGPWKKLDEQQIQGRRRKEEAYRMPICQLDGMAQEPSQAVGVTKCKKQWGAGRTGLTDHQQNTPGSHKEALRLRAAMVKGISRERHGQSWDEQVCYTLSALARTCQGTLPMAKGDRTVEGLGKN

SEQ ID NO: 1011371 - protein, 327 aa, Homo sapiens
RICHGGGRRVLLRLPPGPSRIHRPAAAALILLRVGALKEAHVAGCSVRSPWCVLVLMSLELILGNQCPDAMSYTINRELAGCCRELGLVNRHGAPLGVEVRCRRTSVHWAVSPTISRNGRANEKRCIARVECVKSDLLDHTWLYPVMHFDSSRPYTRIRGKPNAVFAGSHLRVQRWSHCVRTLRAASLVHSPGVVTTRVFANDTGRSPCWDWDCCRMALRLLSDNGDFVAEGIQHMRGPRLDEDMFPPSSSRPGVARDTPEQVVYSGINGPPKGPGGMRYAAKRKVRNGLSQVPQLGGPCERLGYTVGLAPVSSGGRKPIRGRHKTF

SEQ ID NO: 1011372 - protein, 320 aa, Homo sapiens
MATRSLLLTLWVDELRQGLMSRPKSVAVANERKQVLSPCNAWMLVEPMASVPSVPTRCQGSASSLLLHAPRRYETGEQRGPRIRELNLCWISQFDGLQILDAVRQPLVTRGPQGRRTEYSRRNRDLDCISGCLRPVALKPHETIKHKACIVLVDPFLSFSSSKRNGLMFRRSYWCVQEGAPFPRNPTGVKKIPEGKQIKARPMADVPLLVTFALPPIAVSPCQGHRESGTGPVLFVFVETAHDRAVHPTRTSRVTRHNAGWRVAVTIIGCTRHILGAISEGQLTREGPKWVMKRLLEMYTETLSERQERQRTLSPLVGKL

SEQ ID NO: 1011373 - protein, 79 aa, Homo sapiens
AEGPLCLPVIPRFSHLRQAEQEEKLPPEPKDSSFFDKFFMLDNGTGLKVPGDSQQEAKMGRASMTMVDEVPGLITGTSD

SEQ ID NO: 1011374 - protein, 95 aa, Homo sapiens
SGGAWRKLCLKRSFMRDARLSVLGKLRDITKLPGLSDELRKNGVESHQFFDVKAAYLESKEFQSNAASKASWMQEQEHALSLCVMLNVSPCDNLA

SEQ ID NO: 1011375 - protein, 68 aa, Homo sapiens
DPSLSELDEFFFRNNQTSSPWQDLVHEFDEKLNVCLRNYNAKTENLAPVKNQDRSKRRRENRVYRYEE

SEQ ID NO: 1011376 - protein, 143 aa, Homo sapiens
RGGGRRGLLAAPLSRRSPPRGSRRSLFALVSPLSRSCDLNVTGQEKPRRRPPPPLPGDTRPLAAGSSSTPAKRQEAAGRRGRTCTGPRLPKRRLLTQPPRRRRHRQTVSVSLETTDIQPDIFSYLLHLMYTGKMAPQLIDPVR

SEQ ID NO: 1011377 - protein, 215 aa, Homo sapiens
AGFTARPVARRGCGASVSTPSSAILARCSETRSRTTSTLNLSMMTLIGVHPSMGPTNRVLEISPVIAVSNSRSCPRETGSVFRPSSMIKGAQSSSIVVNTSLDAGGVDDRKRSGKFRQDCASCERVASHTYVLVMLRYLLKSASRLCASQGSSGVRKPVRSLVIVTYVVIATTSAMLWGRYRTWTVAVVVALLHRGPTRTDLVILESCEHEDYQS

SEQ ID NO: 1011378 - protein, 70 aa, Homo sapiens
RGGAVPGAIMDEDYYGSAAEWGDEADGGQQEDRFWRRRRMMLEVQRRTACINFLTSGSISMEPHPIFNDI

SEQ ID NO: 1011379 - protein, 49 aa, Homo sapiens
MSVGHDAARKQISSTGIESVEHTPGDRLWLRIDRTTHEDHSHLNGEISI

SEQ ID NO: 1011380 - protein, 129 aa, Homo sapiens
SGRIDPAIPPSRSVTVRHSRERTDQCYLSLVPAVAKCVCWSEASEIGHCMHAVNVALLIPGSLQSPVQLCMQPHVVLGWLVHMPPRAPSEDTKPETRPIKPSERKITGDAVRCRAGVHCRGRGGKLREQ

SEQ ID NO: 1011381 - protein, 227 aa, Homo sapiens
MHWLLQQMKLFTRCAHCSLFLLLSTLFPLSYPSSHGTPSSLAALLLRARFSALTHVFPPSQARPVLCPSVSPLMPRWSWPNPATTFWLGNPNRKLHWLVSWSSAFPSWGHPSSLLQQPQPHLLAPVALQACPWSRPLICGRIASLIYGLASAVLSHGRSTRPPPLRPARPSLGPLLPSFSQSCLAVGDLPLSLPSPLLPLCVLSPSPLGFLPVFFCSRLFPVPLCGL

SEQ ID NO: 1011382 - protein, 286 aa, Homo sapiens
SEEALEKDQERLEYEIQQLKQKIYEVMVFKQDHHGTLEGKVASSSLPVSAEKLHLVPLMDARINAYIEEEVQRRLQDLHRVISEELQYTLQTRCKDNEKLHNGTIQRKQTYERMAFLAPLGANPDDLKDPINNYVSHATSSAGKETDAHFESEVKLAALAISSKETISDTYRTEPCDLLSRRSSLTANYLRALLHACMLQSATSPLHINQSGTDSLETITIREFHPFFKTGVLDYSSHGTGAEPAVMAEPPTAVPSSSKRAPMQGQLPPARIRVCFLLPEDTTCSS

SEQ ID NO: 1011383 - protein, 100 aa, Homo sapiens
ADRSESDCARLLRRRTRQDEALDRWAATVGLRLSWGQCLAVPDTTVMMVCRCREHDGHLSARVSRDHMKQRHSIRLVPSAALVVNESLPYHCNCDSSGPM

SEQ ID NO: 1011384 - protein, 278 aa, Homo sapiens
REVRAEGRRCVPAMKGAAGPAAAACVAVAREPPASMQRQGRGATAMVAPVMPSGVRTYANDCVAVRRAPGRYMVGNMLHTRGARREGSHGSRERSRQEALASAVTHETPRTSGTSSPLRRTRADRLAGFAPWFRSAAATSPLCCECGPEEDGPAYSGVPLCQVGWKANGLRHWIPRDTSVFHLQYTSLSRVLRRFPSSLCVRNNVYFRSGRKRHLALITVKDVIREPCLSWFHKIPATPLGISPLALSTAIQTLEPWPGTAKQHIRHVSGTPKATYSL

SEQ ID NO: 1011385 - protein, 96 aa, Homo sapiens
RRRGDVWLTSSDGGFAEICVPGWQLVRGVQLRAERWVWGTVCEPVSTDGGQVPKLVVPHGKRAPVVVLQPDAHVNGFGCRWRPSVERHYMGGICEH

SEQ ID NO: 1011386 - protein, 227 aa, Homo sapiens
RFEELLLLGGGNCIEVVAALPAPGRSSLVGVAFQTSALSPPGAQRRTRASATMRCVTWSSVLQNGEHRRNNIAHVPRTASACQQPRARGKCLSEEIKQDDTLSLTRVALMSRTASHQGEKVAEAIHQASSGRREHDQDVIHGDHEGAKGAEWKPSKRNNGCARHRERSARNGASHDHVRPTRNVKGIQHGQRTLPYDRRAPREYLRCPKNKALPETTNCHIVARGGN

SEQ ID NO: 1011387 - protein, 111 aa, Homo sapiens
MFEPEYVRERGFIRERGLPVISGLRLKSWKRPCTDLHKTWASVHRDDLNARKFVLYSQSTDEEVQNKLDAVTLDCQKWTGKGDVMSYVPCGKLQDYVAPEVLAQKPYSKDR

SEQ ID NO: 1011388 - protein, 193 aa, Homo sapiens
MADSWSHGGLTAGKEMKGLKDGVKDGKRVEDLVRSRRVVRIVKMWPLTLERRKSKGGSATEGCSARIQCMKSCAGGAGDDEGDWSCEREQSDMGELTTKIPEKQPAGFMASYQGLRGRSERTGPDGPSRGNGSGKTPRKNPGTAKGAVIDQCSHKTMAGNVILGSHAASGEFPERKGNNLAQGGGNRYTKSGT

SEQ ID NO: 1011389 - protein, 296 aa, Homo sapiens
SGTAAVAAEGTGIASACRRYLQLASPPSYRPPPSRPSAVSELHRHRLRASPQERRSGCGLLPGFRSLAISPRAEKREQAGGRDTRAPRARAGQSGHRIIPGSGALRVSAGGSKDHQVEEYSKHEHPGTHKGKGREITGPRGRQPRSRRIVQGQVVHYRDKAGKEHARMGGASGSGLETPVSGGEDHHASFAPRRWGHHRREHEGAKDGGNYGHRPHFRRPVQGTKRRQTDGEKPNPRTSSVTARTVTSDHRCDRPAMQTAKEDGDKVAQGGTGGNDGRRKEPKATRTAPPMRRPSS

SEQ ID NO: 1011390 - protein, 170 aa, Homo sapiens
SGAGRRKMEPNAPRAGLGHLSRGCCMHIELSARLRQVDPAPLAAEWTTPQACLGDSIRCFFRIPEGPGAFDASQFTDRSDDTQARDRPQSNVMEVTLRSSGPHPHFSSASSFRAGMHGRHANHQNAGAPIKVSSYLHGRERQIDAEVDMAQGFPELVCDRTRVRIRTRMA

SEQ ID NO: 1011391 - protein, 159 aa, Homo sapiens
MATPAAVNPPEMASDIPWICDSCPLAPMAGAPDEVTDGGGHAMPVEESGVPEWTFDDEDDEGPSKCSRENHSEIERLQDGTQMTQYITELSDMVPYMQQQLSSEAETSSPVLRMASLAHEVHEGYREQVHRLVRTSLPFPHRAGTESISSLKQLMDFCT

SEQ ID NO: 1011392 - protein, 142 aa, Homo sapiens
AGGGISPRSSLPPTIPASLYPLCYLPSFPLRPSSYSLPKHISHPSSQSSPLCHLRIPAQSAPLSKMTIIKQKYHRERGSTRDVSTVRSVGPKVHADVPRDHREAWRPHAGERTEGKAQSSSRTSSRKRPSATNRGGGRRKDS

SEQ ID NO: 1011393 - protein, 94 aa, Homo sapiens
RGVCLWRLGPRALETSVLAPASLLALALALRTLPQRRAWVSPRVRSGWVCERACMLRSAGCLLRAFTWRDPGSAAGRPASSGIRIRSKVQQKDV

SEQ ID NO: 1011394 - protein, 94 aa, Homo sapiens
RGPDPFVACRNRPRSVPWPDTSIQLPSCGAVRSVPFKHETRSFDLETSDVLVQPPTVITDLIQHVRSIKVHGSWVPGVMRHCRDLLICALGHAE

SEQ ID NO: 1011395 - protein, 98 aa, Homo sapiens
SGRGSQDSDNIFDRRRGKVLLNSRQPQSPPACISFLTCRIPSCEYKMLQQGLATVCRLSCLQECELDMKHRLGYLLQKSDTCEHNSSHNKKDIVDYLP

SEQ ID NO: 1011396 - protein, 80 aa, Homo sapiens
SGPSPGSVPAVPGEEVPRHRRSPPPAALECRAGSSCDALGLHLIGSALDLRPWNRSKFALLCENLSMIFSPGGVDTLTSI

SEQ ID NO: 1011397 - protein, 99 aa, Homo sapiens
RLGPSVGKEGPPCSPAAPRLALVAAGEDEETVRGAKPPVEKVTVASDGLCALHATKHRTPCTARYRPVCGRPGPPELEGKHTTDAQYMGCYNNKHRWRK

SEQ ID NO: 1011398 - protein, 216 aa, Homo sapiens
MPSDRSLSSQRDVMLQRVPAVREVLVSILRTEHPSKIPVIIERYKGEKQLPVLDKTTFLVPDHVNMSELCQDHPAPPAAEPHAGLLPAGEPAQHGECVHAHRGHLSSRMKVLMTGFLYMVYASLGKPSASEPAVMGARPGSRGAPVRPCPEMLLVPELSCLYRGGLGRHVAPLGQRVPNPSTLPMGGSWAGRVRVCPSGCWLVGMAEGWGSSSPNP

SEQ ID NO: 1011399 - protein, 194 aa, Homo sapiens
MPASACAGPARVPGMPTRLCSSLLLTVLSCADRAGIRSASLRSVPRTSRSISEAEFLYQPGFSSPLTHTITLCSLMDPCRLHTLYVWRPGHHLRFIPVPSQGEQTREDCIGMVPEGSQNRTVRKYTARKEDELSAECVQILAIASASHLLTCGTFAVDPKCGVIECVQVPRRLKDLRSGRCDMSLRASSAVSQL

SEQ ID NO: 1011400 - protein, 126 aa, Homo sapiens
SVGLCYLELRVLLMGSAARWEGSSRESSAPFFSVAASATRGSTWTLSRTTFVPFFNLGAYTPPSDGSGVRGGPGMLAGEGPDVLGVQHWTIGGHLLDDKGEVQEGLIGQLSYPWLTGYGQEPNGRP

SEQ ID NO: 1011401 - protein, 147 aa, Homo sapiens
MVHPLWPLRQRRNAATLAAWCSPARLTLEKEDESLKGCELYVPGARDPAGSQRLYRAPLAFSKALNAAMKFLREHFEKLENGRKQADFGAGSKVNSSQSRLPMNAEVVAQAPHERLGRRTRPRERKRVTAGARTPTEEAVSYVQKGN

SEQ ID NO: 1011402 - protein, 106 aa, Homo sapiens
MSCGRYYPWMDVVAIPGLMHIAYTFDASMRLETVPEVEICTCELSAAVDQASDAIVSDIITWFHFGAGNSTSHSIVGDWGIPQNRGRVQQASLLTTTSPVLVEVSI

SEQ ID NO: 1011403 - protein, 186 aa, Homo sapiens
AGLSAWSPYCPRRCCCGLGILLVTISRLRSLSHSSRQDVAVRLAVIPTCATTARMGSANEPHGRRRNCDELTEASGGYGWTTELSLDELGLEYTKWTCPDVLTKQRVSVTVLRIEMGPMPVRRLAIPTNTPWSVGQSSDRASLIRAGSSIPCCWSWWSTPSCIAGTNGSSLTANGTDEPISRTIYI

SEQ ID NO: 1011404 - protein, 137 aa, Homo sapiens
SGALPRLCYPWLGASCDSGSFGQAPRSLEPAEEGVHVLLLALAKAVTTKQGSRTPIRRGSERRVKPLCMLLAYDVSHKDRVIEQLASVTLELASVEPELHESWYPASCDPLWYRRLTVPSEHGAFSLEVNWLARGWK

SEQ ID NO: 1011405 - protein, 159 aa, Homo sapiens
GVQSGSKEDDGGVPGSLCCWLRVVLLLLVSVSDRTPRGADHPCEKQQEEEDEILRREQIYEEFGVMIAVSSDPLAGMLWRPWISKKGGRSEAVEVAVRGVEAIVELCHWAVSVFPFGGTLEAAAQIVTPNVTGTAEVVPQGASRERVECRPKNRLILSL

SEQ ID NO: 1011406 - protein, 158 aa, Homo sapiens
RSGRSAVARERPGDPALLTGGDRGRRRARVSEAAPQQRPHGRAPGRERQHVADRQAVMPRGHGRSELSNRTRGTVIDRHGSGTLRSTGPGALVDQGRLAAQGKNAKRSRKPTIAHRLWDNITACDNLEYFVIKNVHWTQQQKSRKSPAADELAQYLGT

SEQ ID NO: 1011407 - protein, 139 aa, Homo sapiens
SGHGARPAGDPAAGARIIVELSKCCQSNQVIFLEKVDADGDLIAPIKIVNDLIKLARLLESGDYETRRRFWCWERPKYQFLSLTLGDVLIEDQCASPVVVESDFVKIQRAKFANRREWNPGRLHWAATVNLNLGGSKPV

SEQ ID NO: 1011408 - protein, 34 aa, Homo sapiens
MRQLCLSHTVCREQKGLLWISVTRFLDYFPCMAN

SEQ ID NO: 1011409 - protein, 75 aa, Homo sapiens
MKRKKIQSQEAGKGKNLTREILLSVRKSSAMTREVKVFRIQESIHLHAFQFLPGLQEEDRTLGEMTLRRRKQNPD

SEQ ID NO: 1011410 - protein, 121 aa, Homo sapiens
AALFLLELSEDRSLIMNDTVIIRGDKVDDQPDLLQIGNTWSLMSFMPRGKPQCLTTEIAGKIKTQNCTIPHRDVICCIVGFRTHYLVVARQVGFVHDLLTSHGVNALDTLVNLGLAYDFAR

SEQ ID NO: 1011411 - protein, 143 aa, Homo sapiens
MAKHDLFQELELTSLNRLAVGNQAKILRGPFHMSSWTKLHEPFRIHAKIGNWHSEQWGIGILVKTSCRASYFFNLHSSGEKITVRTFTQEGWGHWNHISKKGNPLKEAPLLKGNPTLGHHFRLEKAQFTSFLLPYIGVVENKG

SEQ ID NO: 1011412 - protein, 236 aa, Homo sapiens
MPTPVTMVLTTKSPTQAKKTSETCRRRRVRDCRLSAAFRKHVLKPLECSICDVRKGTSRQKTSDQFSAGGHSYVAQAVCHPNTPVKTDDEGRKALKQRDQKRTPEKDGDSSPSVALERIATRKRQGRKSDSSEEILLVKQDSSTALQSATDEDQRNKITPQGPRLKPRGPEHLHSQGGSKLWATSTVMITDFNEEKLRSFIDILIHSDLQCMVQNGRTRASRGSERTNHGFLPFLT

SEQ ID NO: 1011413 - protein, 159 aa, Homo sapiens
AGGLHGSRARRRFGGQGPSEERRLAGRRTPSLGCSLLCAARPGARGAPIRVCSMRGPRDQPLLPAPGRCGAEAVAAALPPLREAGGPGRLREGTMEVNAGGCDMAYQFFQLSLKAMPLVTVRVLRIVSMSSSVFCSIFSKVALNADTNGNPKNGDLAKY

SEQ ID NO: 1011414 - protein, 105 aa, Homo sapiens
MEFLIERRGGSGKTPEKARYSPVKRTLGAGHVQHLAIDPQWAPVMREGDSSPSKHRAYLAHVLASYCHCFGQVHSRRTLSGERLARSRCVALAAEGGSHPKEGPG

SEQ ID NO: 1011415 - protein, 223 aa, Homo sapiens
SGGGGCTRGAPGAAMRGSGPIPSADPEAQSAMPEPRDERPESRARAAELPVRLAATAGGGGGRGARSEAQGDAPGDIDLGAAAIQEEGAEERGDVLGGGLKCRPSREDEYLSQQFAPVRMRELVQDQAAWRDSYFLGTLTRGAPRRLHGRAHTQKSKRRRVPVTLRLLQNRHGVLDVGKRVVENGRLKEVKAHDPRDGPDGPHARPLRRLGYHTFVPGACKAP

SEQ ID NO: 1011416 - protein, 132 aa, Homo sapiens
MAHDFNPSTFGEYPYDGRTHFEDREFDDQTWSKRNAHLYLRQHKHEPGVVANMTVIPSLIRSADGTEQVDLRHNTGAESKRSRGHEISRIRGSRRPGLTVRRALASASAQQNSFACITLTLHWWDGLEYGVS

SEQ ID NO: 1011417 - protein, 169 aa, Homo sapiens
MARGRLCAAACSVLASPGRGPGRVAPAVGSQYPVERPCPGADGPVDASVEGGGCACVHCDFDVGDVSRTRPATICNLEYSDATAGGSCARDADTYPWGELLLVTVELGHIPSVLPRDPRVQTWINVPQFHDLAYDLAPQGERFMLVSRDLRCCRCGMGHQMTCGRKVAP

SEQ ID NO: 1011418 - protein, 255 aa, Homo sapiens
RGRGSPPLSTGAMDDCGTVDCSSEARGGMLCHGMCRAEAELVSVRGPADILKRKFHVCEGTQARLSKITQFDVRLVPGAEQSYILTDIRKGIVLLEELLPKGSNGGTTRDYVFYLAVGNYRLNGIREGLNSTVRVVCCMTRRPTNQASAYTVTGSVLIDYGHEERWTRGHGHRGRHGPVVWRDWPDSSDLLCPSPTPEWRRGSPLENAPGGPCPSSLSFPCSPLPPVSILCGLQLISAPLRFVLSAHHVLWDECT

SEQ ID NO: 1011419 - protein, 103 aa, Homo sapiens
MSSRRTGRPPSPFGSARSSALARGSLYGTQQSPRCTTARLVLLLGSCVNEYTETFATMTVIPLDFTVCSPGTLVGSALTIPMQEHARKNVTLRVSGELHRCEE

SEQ ID NO: 1011420 - protein, 239 aa, Homo sapiens
MLGFPAGIIGQGPISLDSYITTRRRLYSRLALCEKATRGYKVHELKHEQAIGIKRLAAHVRVEGNKALYLATAERRCMALQYTPRLLQLPPNGSIVGSANGHNAHTWKFPARYSSNGTASPHRNVERLLGPLIDPQCNIPLNKRYSPPLTDRYTTNGGERTPPIGVIFLLLKKRYYRANFIRLTAWFNPIYRTRKDTLVNNKNFGLTAYEALQLIGYEGDITSTFKFYRHRHYSYKQYE

SEQ ID NO: 1011421 - protein, 116 aa, Homo sapiens
MELESDGHCFLGRAHGSFRRCSRFPGATKREQQRWGMPYREDANSRELAIRGEAGVCGAQEKYHLVKNFMIELVLQMAPRRSTPCGNTAVVERDRHRLDPRIRVQILWGNLTSKFL

SEQ ID NO: 1011422 - protein, 96 aa, Homo sapiens
SGQEPGRGQDGGRGGAARDLDHWAGTHDPTTTPGGRVSVRLGLGTGSFPARAPPFPAREAPRGGVTVPGGPAFRPNSAGAPRRPCPWVHEAGSPGS

SEQ ID NO: 1011423 - protein, 249 aa, Homo sapiens
MRAGGEPGDGGAGLPVLGPFSSPGILVACLSNTTSAPGAPDFPAVDGPFLGQAAVRLGPSLEVLGIRASAEPHLASHRSALAGPSVGRTLSTRKGASELELEEIAGPQEDVRQLTWRAGSRRRCFLPRPGYLVPQGLWLHRKSYQCPASQIGEGAEHGDEGVAMRLKFSAQNVLRIRGEDEAQKHRKLGEERRGSCGSESPRRTALRRKADQVRERPEAHLAEGGAKGSPEGWENPKDLTCGANESGAA

SEQ ID NO: 1011424 - protein, 358 aa, Homo sapiens
MGGPTEPNKNRPKTGRKPRNHRKTRPKTQEREHTQHPKRRAPKYRHALPPKNHTPAQGTPPRTKQRTQKGERDSENRGDNPRAKARIKKNTQRKHPKRRTPQENQRHRIPRERHTRTQEGKQEQQRPNQRKKQSTRTHKTGKSTARTDEQGNGKRNNKENNTAPRWQPGKSEKNTGDKRADDTHKQNRRAKTQPRDEAHETTKRHKENERNTNQKNTQKQAEGKQGKKSKQAQQEQKHPRTHKKRRRGAPAEWREYQRTNKTHPGETQTNQGGPRQEDHRARHKYTRRRPNNQATRATHKTNKRHHSKQRPHKGHPPPTSGDTQPDKRGNKRAKQRHGTTWETQTQWASAQPQPTNTP

SEQ ID NO: 1011425 - protein, 110 aa, Homo sapiens
AGSPSRLSQRLAPFPATSLRARAAGWACARVKDAASLSLLRRNGGGGGSRSGTAGGGGSSGVPDEKMLKVTVPSCSAIVLIFDQRQCGPRETQASSGLLIEGSNRDALRR

SEQ ID NO: 1011426 - protein, 97 aa, Homo sapiens
ADCESSPTPRKHPGAYAVRPLIQVGGLQETCVGSVAVTPSWAVYSQTPAEVGHMSSDFQDWVTIQDTVQRNAAYHVSGMSEHPSMWPWTTPRKSGDS

SEQ ID NO: 1011427 - protein, 80 aa, Homo sapiens
ERTLNEGEGRGAARKRGLREGGAAPQASGSVLELPPRASVYSRLIPRLAVLGSSVTSCSLAVSVILAVGGARELLVLRTL

SEQ ID NO: 1011428 - protein, 66 aa, Homo sapiens
MESHGSEIEQRSLLSPEGRCGTFYLGLHVHLEKGHRERPSIMVRGMDVSEGLFEVESDGEGRENYI

SEQ ID NO: 1011429 - protein, 196 aa, Homo sapiens
SGGWDGRRPGGLEPPANCIFSRRLDQQRERLCLRNDPRGSHPRMSMKETGRYTVTQSREQHEECDTLQARYPHLWTNSLVGSGSSLEDKRCAEKGENDICDVMADVLDMVKSKISEEHEAKVLYMSRVRYEDWRVTGVANISRTVTTKEDITHQNLKCSVPSDEGYANAWAWVGISERLDTGGEFWLKDCIIASVN

SEQ ID NO: 1011430 - protein, 122 aa, Homo sapiens
RTLRCGCWTDGRTGAAVLTASAVRGLGARGVFPRVARHGRGGGHARAVSPELRGSSTPQGLRVTSNVACCLVIIIVKLVCSVTLRKVLAITLSLNIWLSCDLQVTDGAELDKTYDVCSRQKT

SEQ ID NO: 1011431 - protein, 298 aa, Homo sapiens
ADGPLAPELRARQLELGAEHALLAGRCLARCSPGAGARLVDSWASGTLAGRAGATAVGGVAGPRSWLRWPREGWHSVCVSETGDIYIWGWNESGAAGTCPPGNLAEDGETVAQGRHMNWMNDGSQVKRTGGAEDGAPCPLHSCPALPGSYWISAMWLTMQSRQAVDPGRHSCGDTEQGELYIWGVGYYMDKLGHAGRRTSLDRSRRVELLVDSNSKYKAVTCGPWNTYVYAVAEREELDMWKMGITGFQENLLKLAFHRYPECWDHSPSGPEFIAGRNSTDTKGGYSVTVTIGGTQAS

SEQ ID NO: 1011432 - protein, 135 aa, Homo sapiens
MGPDPVGPETVGSWELPPRYFDHGTEVDHTLRVRGVGGYMIDRKVYYTVKLMFIRLRIRGVHPGLSQAHYRTGAWIGHGIPYCGHFHMEAIGAFVNEDISESALRALDECGALRCHDFSPIDRTSAKETYNEGLS

SEQ ID NO: 1011433 - protein, 137 aa, Homo sapiens
MFIEECHRCREDILDLARSMWEPDQAGITQQLRSRTRLPEAASSATARLYCALGYMRPINPLNYAKAKLERRRSSTISMNITGGPEFILGKNHKISKWWSYRYNKVGVPVKFEEIYKAQLLRRNADIPPKNDTPWKA

SEQ ID NO: 1011434 - protein, 205 aa, Homo sapiens
MGSGPRNCHGLDPRVPRLGGNRIFALPCVLEWVSMEGLGLALWVHSRQVVPWAARLQHGVFVNQPEEDGVVRLPECFSWTNPAVDRKDLVDDQGAYPSGCFARCSHLLSCHARVPSTLGTRTFHVLDMDTFVQGSNCYVPDRRKENGVCPDLIFGLRITFYFKYHVTTLEIIFLGNAQSGVGVRHDSRLKAEPLGEHPPSAYGEG

SEQ ID NO: 1011435 - protein, 357 aa, Homo sapiens
MLRILTLILGQGSIFCISRRESLYGRASYRRFTCETGLFRRLAVPTGASTGIYVGPSSSEWLMTGDLDYYGCHVVFSRGVSEHINENKLRLPWLAYEADRHQNIEDRLHKTDLIDDGWYREEDRDLKLSDANAHFWGVAPLAVLAKAEMSDSNKGGYPPVTDRHRCTMLSGNVLKVKSWSMSPGRFTLSTRTWSGLLIAEVNTGIGRMSVEFRMNPIPHVGWPGHNLRGQRPMAAIGGEKLVLTHHNPWNEIVQSSRSKVLGEKEWAPYNRGRDSELRECWLPRSIRLRTELNERGALGNLRLEELGVMWGKRPRAYSMELSGGSNPALGPRSPGIPKLLPRVPGKSTDPEHSSLPE

SEQ ID NO: 1011436 - protein, 131 aa, Homo sapiens
MPSVFIQVKPSRSCNLRLGLLVAIASIRLPQENSAPGISDHGFPWHYSRVMFPKQIKANTIRLEGLKLNGCELPELPGDTWVIRLVPNPVFILPKCLVGRNELGFLHCLGSMEYYTYVRAGTIINTTSGPP

SEQ ID NO: 1011437 - protein, 222 aa, Homo sapiens
RAASRFWQDGEGPMTLTMSLVHEMRDIHENTMETKNNSRKLVSNIVVELCEECTYLIYASMLGDDIWTHHMNRCMIAATYDVWIVRMTRAIGLSSELRKTGSLGQITESSRLTVHAVFEAIERSVWCCTILYVWDFTQNDPTNTAAEEQRIALTSSKNAQWDIYCVMAIFGETEMTLSANQIGLRSTNSKALAVELCRRSSPSMTSDYAKAALYVSTGTNDD

SEQ ID NO: 1011438 - protein, 280 aa, Homo sapiens
SGEEEEVRVKIADSRGRDLHHGGVLVARRKAVSNPIAEETVTSQTDLLTLHLLIATLGVHPTRHALLAHGIRWLRYPSNLHCKRPLLSIDSGHTIVSQVLTGASRHGSVHTGGKLLAIAFVTNRLVGAPKERVGALTRGVYSGWITQLLPSFILSELMAAMHRIIGAQATVSTQQWVEPVNLRRTGCEDGRELTDRCGKGWDSLVILRRVRMVLTCLSSYEVRLLHDSVSRMSLGIPWTERHRMALSLLQKRGHCCSVTGHLMTRPVYEDYIVSTGWENV

SEQ ID NO: 1011439 - protein, 177 aa, Homo sapiens
MLGERFSMLPIAPIQWEERNVIAIQGPGGYMCECIPSEAKESMWITNIDWRLTRPFEDPNSSRSPIYDIYWLRITFELYANVRRIVSLSTRPIIEPYSDVNSGDAIRGDSTEKDEYMCAIEACDESMEIVQSIKLITEGASYRIADFAFEVLPGTNHRSNVHGGATKPDMMLDVRWG

SEQ ID NO: 1011440 - protein, 256 aa, Homo sapiens
MAVLLLLLRALRRGPGPCPRALCGPSALAWESRVPRQARGGGVRTCASQASGGDRRSRLEASSAERYDGDCVTPTFEGINGLMLKRHFFRTPGHDSGDFEVVLSTFELPQWLKHEDKGRKGLVSTGERLPDQDEEERRRRERDEQMYQMSGCAPLLVIGGCVMSLRESARQHQRRQHFLERLGPEEMLAKGEVQAAVQVVPESGVDEKSYCSLGAGGVRGGPRIALMYEVQVDNVGSFAEQLRATEDGWIWGHARI

SEQ ID NO: 1011441 - protein, 260 aa, Homo sapiens
MDLDDREECFQILHAYELVEHGIRYCWLRDDMGWSLGYRLPLRRTSDYVHETSRGSLFCVGSIIQGSMTGDQMGYVMGELLANWWVPVWSMQGAIGRVMGDIQGEGSRQRIALDTLRTMQGGKAESVVPTSKGKRVPKRVAKSWSSRDENVKLPVGPTSEVYTEMAAIVDALFWGTGCVGQGTVKNPSRAPFGSYFVAQVIRCKTGGKQRRVNKPRDTTVRTPSTGHSSRGALNPVMKLGDRTTSALVVPHTVQPRKTGV

SEQ ID NO: 1011442 - protein, 207 aa, Homo sapiens
AECAKPGLLRCPGPWRLPCNMCQSLGDQPLGPKAAIPWKRCTEEELGTEYPMTSRLLVHCGPTSDVNEAGHLLCPTIYIVIFGPSVALPPERPAVFSHEAVASAWTVEASSAWSSSSMRILFMESGEVALPGSLKGKVSGVLGCLPPPGSLSRCSHAILTIRDHGLAQFWINKHVLSIHSATDGRVNQVNSVSGVSQFGKAHFLLIT

SEQ ID NO: 1011443 - protein, 126 aa, Homo sapiens
SGLESLRVRREPEQGQGREVLRLPTVASTVRSTHLSARDVRALTPDPCSPFAFAKPGSRGMGSEARPCGSSRWRACGGRLRAGGPGSCMLRRRLGATNSPPSWRGQRNPHACIEFSSRNRRRQAPM

SEQ ID NO: 1011444 - protein, 412 aa, Homo sapiens
SGVWGTGRGRGNRRPDSELLLSDQCPGPPIITAPRFLAPENLAFPVIAMMTWPRRLRLGSGPSTPRPVLRANSRSRATGRQEASVRRAAGLQAESAHAWQNAEPVGEITSGIRMIVLPQGCELEVTSQYGRSLLHESVILTGCLGTTDEIDVCVNALNECRTNVLAWLTNGLPTMRSRVVERIGLTHDPLPRGECMANFIQDQFFEDAGTCTSSRPNVLYPLDSCELSVRVSTPTSWGMDPLGTGLMEHRLTCPRWTAFQARGSNAPSPVMEPFVRPAGWADFRKTWECPLATMSEVARKKIKALYGSLTKESLGGKKPHVHFTSLRQMHHLGRHVWGYRLGKAGQRCGIRGGNLLSLSVHQPVLTGALSFTPGRVLQAVNSHTPGGGLCGPQVCGVLVLCAPGAYCAHLVP

SEQ ID NO: 1011445 - protein, 40 aa, Homo sapiens
MCPRNPYNDLDSLDILLGRSRASLTVATITCGIHLSWDST

SEQ ID NO: 1011446 - protein, 66 aa, Homo sapiens
RLWLEEGYGDPYGGGGGGGGGGGGGGGYRRYYRSINRLGYEVACVLYSRTSSETDRCFQNKPSSLR

SEQ ID NO: 1011447 - protein, 140 aa, Homo sapiens
MESLGKRQYSSEPLPQKNHEANVERRPRAQNNQETKEHKHRREQQRASERSNRKDTIDKQREEEKTTNQKSTREQTQDNQTTSRTGGRTNEETEKPAHNEPTGEECRTAETTQERNRKGNQKQNTHRRKNQPRTQIENRR

SEQ ID NO: 1011448 - protein, 135 aa, Homo sapiens
MGRARSSGGMQGTAPWSDLRGPGAAPMCSFQFRAGLRVASLRGQYASCRSFVLELAKRPACPSCEEGPGEDAAPVPRVRAPRPREGKEAMNEPKGHREAHGGPPRQYPGQATHSGGGSELNSAQRPNPSRRQKKP

SEQ ID NO: 1011449 - protein, 351 aa, Homo sapiens
AGCGAPGRGLREPAPHGPAAVRPSPGPPSSLRPRFQCAENLFASPGMLRDDLAFVLLVGGVRSLPAPLPPLSRIAVRVVHWRMEASSPAGLVLAAMPTAVIDADPGHSGAAVRRKSFSRTSVDLTVDRSIGTSRLLPELSYELSFHGNNEEYTCVMALKDVKELFRPRLTRLGVTLGLNYCDVVDLTWDEAIVHFPDLAGKSIGGFKHAISKHLDLQVFTKKVLSVVFHFLNAPQLLARHWTDELLALDTPRLDGLHVRKMETPSAFGPSSAERGVFETPWEFPLPRRPSGRTRFGHLLIGPTRLRKNRSQVKPGSTSGEIWVPLGTRKSVNYVGQLFASNRNYPFFMDLK

SEQ ID NO: 1011450 - protein, 333 aa, Homo sapiens
RGRLVLWLRKLRSFTLLVWCPVTMALAVLLGPAEPFPDLRSPPVRGMCCLPPGGALWPAAELGLVLVLRPCMVMSPAWAGAAGGMTMEGPDCVAPKSRVPGTCLQATWISRCSCMRHPGTGCSWGAGVRWLAGGAVRAPVRLALGTLLVHLVLAGLGLVTCEVGLIAWIDGLLEVDRSRVSRDSPVVLGLTRAALLGGCLVPRGDIGLACGLGVVTLGGAQNVLIREALVGPVESGPPSPQTQYVVSSILAGYWPQCVRTPGGSSKWKADFGKNSTLEEGRSQEALYSGSAPLRHPFPAVADMGPNVCFDPACPEEVSVRSTAYSSEQCKHLS

SEQ ID NO: 1011451 - protein, 89 aa, Homo sapiens
RGGRKQSPHAVSKRKEATSSQETVSVFAREEQFISEQPGRKPEYSVQVVGHGGQIVSINLPSMNPTEDYAARTMYYPWTWDLMTIMVIL

SEQ ID NO: 1011452 - protein, 216 aa, Homo sapiens
MACYFDEPRVPSHRTLQETLTNMLLELVRSLVNRMDFEDLGVGSEIGTYHLSPPAVMTVVENLPRTVIRGSQAELKCPVCLLGTYEERCETCLVDDVLVLSPFPFSMLHCCLWSVSNRVKFPVHLLPAIRLPLARMSDYVIRGKRHDGLVMAQKIKLRLGEHLNLEDSLQCEPVYYREVTVGGEVRGPSCVITLLARWGSLSLIRCSCIREQQDKN

SEQ ID NO: 1011453 - protein, 277 aa, Homo sapiens
GSRVAVKEEDGGVQEVSVLLLQCGAAAAVEREARTPEELTILGETQEEEDEIFHRNPTMRVWIMIAVSMTLTWQVLETMDNKKGRSILRRCSGMAGVVPVGVCTGLAGLSLWTFLCDSSPNSSSEWYRHRWRSAAQKGCLALSLLELLGFEPHLMSSWQSLLVLIETEWQPGSGIPEVNCYLNGVQVPGIVRLRTLLCKVLERCCTSVARRRSNEREGTCQLIPQVDPAAWTAMPYTSAPRSISDYAKNPVYPVAHISRKRQHEEEEMPPPGNGAAS

SEQ ID NO: 1011454 - protein, 103 aa, Homo sapiens
MIVIRFCREVHKDDKSYWKMIQMTARAHFFSKGDHLGPTYSGTLEYAITVKPCFRIEVDEVIDVYATKIFHRYIAVERRETYHELAGHHQNSSSANATSFQPT

SEQ ID NO: 1011455 - protein, 293 aa, Homo sapiens
SGVKLPREGSRSQRHRHKQSLLHHVCTMVVENFPDSSDLYSEIGAITRSAKVDFDQLQDNLCQMERRCKASWDHLKAIAKREMKPVLKQRMSEFLKDCAERIIILKIVHRRIINRFHSFLLFMGHPPYSNAGKWNIKQKTAEMIRSRTEHQEEYAQTEGKKRGIIEKQKRGQPSERLNKEPKESEHRIAEAEFSGSSPAPPSQPQGLGAMRRTPAEHENRWGLKRENRLRRTEEDGHPGQGVRTRRRSKPEGTTKFRDYGNWMIRPCPTRVPLMRHGRLARPHQVASRDLGGA

SEQ ID NO: 1011456 - protein, 124 aa, Homo sapiens
AASSKPRGRVLGLARSAARAAAVGVFLSSPPFCESRVPRLSLIRRSRCYYTVSYGERASWLTSCISSLYILIVRGSNFLIANLTRYLVLTPESCRPSFNNPYIDSGQETTTRASEILKPSYHKY

SEQ ID NO: 1011457 - protein, 85 aa, Homo sapiens
AGGAWKSETSRCDVTEIQQKLLSSLPKDSGRENLRMLSSEDSYEGTRAVLFEGLSVPGSRSLTGDVGLIRIRIYFPEHACCDLRS

SEQ ID NO: 1011458 - protein, 114 aa, Homo sapiens
MQSVEPSGDGNPRIPPACLAIESCDMPDIGDNAANGRTRLIVRWYGPQTEPDGGGLPIDLQAYQCNKSTSRIKPLTARVDATGGSYAGIKAGGLISSTRAGIGFGGSLSDFNDG

SEQ ID NO: 1011459 - protein, 171 aa, Homo sapiens
AGGAGGGSASWARVSAAAIGRERPRESSMSRRAAIQGSIHADQTKQGGDSGKSKNAARTRCSRRSKGAIYVGTKRHMHRQLRSDKGKALENEGGSRGERDQFSANLGTKFNEPTEQSQGEMASERMQRRRPISWIDELGKTAVEKDKKLAWFFAFAQSCLRIALGNRVKRS

SEQ ID NO: 1011460 - protein, 76 aa, Homo sapiens
RGRGLRGCHGGGGPAPELRAHRHLHYLQQVRAANVRRSKGIPSVMQQRKRARAEALVESPMIREMIAEADGTWDLQ

SEQ ID NO: 1011461 - protein, 99 aa, Homo sapiens
RACDIRGRTEWSETSTIARRRPSKKAGNTENCTLDNNKQTKSGNQDLENTKTDRSENKRTDNKQYTYQESIIKTKNPEQHKTMKKSKKKNTAKSNEIHN

SEQ ID NO: 1011462 - protein, 69 aa, Homo sapiens
MRSLESSPELTENEVRDPCMSAECIDAPRRGNGPLSESHLPECRVTGPMPPSTKEETRGNPPETPGLDP

SEQ ID NO: 1011463 - protein, 70 aa, Homo sapiens
AEKYRLRSNQQIYIPSARLIIRYHTRSYNKAMLLHLGNIIKIEQSIQYDKSNQSARRLATFESRKNEYTN

SEQ ID NO: 1011464 - protein, 114 aa, Homo sapiens
MKRRPSRQRRPETEKGDRTQDGIREEEEAGPPKYEAVNAGRKEPKLRMKEETEPGWNESVVQFECNHEESEKMPDEKRRVPRMQKITRNQGERNWRGKYHRADTSPPEWKAVQD

SEQ ID NO: 1011465 - protein, 162 aa, Homo sapiens
MTRLLDTKYLHTRVNEIWNRIESETMNAKGIINIEQQQLKQKIKPMKENQAKEADERSRKNKAMQEERREEQQYQLGKLIMSEIIFDYGLTIKFFINKMLKHYYGMLMIDAGTAHYNNRGFDMKRNLYEQHRLGKYTARLRLRANIFCIAGLYIAKGINSEW

SEQ ID NO: 1011466 - protein, 110 aa, Homo sapiens
MGAQLSTLGHMVLLSSIWVPSIKACYIKSLYPFASVACRSPYDYPTNNLAPSTECLSEPGIRSDFRIWPRTLTYQDPLIAVNPPDCICDITDPLIPILSDLNLSIIVRDI

SEQ ID NO: 1011467 - protein, 126 aa, Homo sapiens
SGFFFGTGPGGRSATKQATVLTERAPPCDRLMRRYTRALSPARDQGRKVVRAATERVKERILWLKARTKYWHEDWLKCAGCDCRWERLLWCNGKAALTCSKLIPAFEMVMRAMDNVYHLDCFGMSA

SEQ ID NO: 1011468 - protein, 91 aa, Homo sapiens
RGTRSAAGPAAICPCCAVCPGGPGGRASTAASAYADRWRRRGFCLDEDSQDDQPKNLFPRTVRSEVEYRPSITCMAMTTEVKSLRNWTDNY

SEQ ID NO: 1011469 - protein, 278 aa, Homo sapiens
SGGRISELLLLVLLWPPSLSRSALCPAGSETEAVGHSILSRADAGSDISGPVHAYAVRRSACQERRRAGRLRLVSHTGERRVGCAVTPAVSVPALLDIVDCSDRLIAGLSPCGRGTGADRERLWQIRSDRLMKFSFLAAVLQGGLTERLHIPLFDMTEHAWSFTNISTIKEWPEGSIVSLESHQFRPTCTYSQQVSMRAIPYSMTSLLDCMHGLRPPEENAVINQTSKATRRVRLSRGDWTFSEQRQESRDAGEIEHCRSEDLVCSWFHSGNVLRGKK

SEQ ID NO: 1011470 - protein, 110 aa, Homo sapiens
MATQSTKRRELVSQSWRIETTFRGVLEQENICTRLEEEIFHTEFVELPTLTCVQYRQRLRKDDYILDSIQAFYVYQSVQHMNDLEAKEGKIADTYNYALSGNMPDWQILS

SEQ ID NO: 1011471 - protein, 180 aa, Homo sapiens
MQTVLNQKVTLPPIRVDPPILPYCNHLIWPHMLCECALDSEGVEVSLLGDIIIAYAAPLFKTYWPTLRKCVPFRSLRARLPCLLESQGPRFFSRVPLCIVRALSMCLRRLVLAYPGREWPAPGLGVARCELYRGTPILCRGPAVVLEPPCNVAFVSFQARVVHCLLFGLALNTSSCAVPS

SEQ ID NO: 1011472 - protein, 279 aa, Homo sapiens
SGMDRSILTAEQSQPQMQTTSRLQLESESLNDMGLLSAVLGMSGTGPALLSLVATWIVVLLRVALFCGCVDIDEALSVAHDTYASLTTLVSRKTSPRLLSTPSFNCDPVSFEVCHLVELASFFCPFTGALAAGLERRSSRQPAPGLAGHALFASHFTDDLTQSLPGPNGGPEPVKLSYTGAGPEKPANGAVPKKAHILITLNFLIGKPRLLLDLLDGRKLGFRNIPGSKFRRGIALVCPDAVVRGLLGCLACLWMCPCVRFSFRGTLGAPCQSIWLSPV

SEQ ID NO: 1011473 - protein, 218 aa, Homo sapiens
MSLSGEKKYSTHHERSSSDQQDGQTCYMMYQSFYADIYMEDGLIKQIGEQSELCQDGSEDHARPTPGWCSPEEVDVHTRFQMPDQGLTSADWISSKVTKVGPELAGTHYDHWTTLFLSLGHACSLPLTSGAEWADSKSLLWLLFCLVASAEWHKGHPKKETGKRLVLKDHGVNFRFIVLHGLSKNRFQLDGLPDFMTYWRWNSGNLGAIAKSRQNATP

SEQ ID NO: 1011474 - protein, 288 aa, Homo sapiens
RVSRSLPGRQAAGVHRGKAGLGLAVRPPPETAREERAQKLLDAVGSKPAGVLLLGPPSRIVCARKMLLAVLGASLLSREARAEWVGQPSSRPNILWKSCARPSRCACSSGQEGWVLPKEGLLGAYLSSLAEEHLERIRRDVEKLASGTLLLSLTTCGPSALRSLETNLRVSVTTCGPSLALRPIGAGGDLGGLSKTVSRLCRVVCHNQVVELHVPQTIKSRRRVKYAEFAFVTVLRVGGRRNLEITPGCGIVAPRNFGGPRITRQVPQAEEELVSGPCPTCVGDSHNA

SEQ ID NO: 1011475 - protein, 400 aa, Homo sapiens
RSVPEELCSLSADASGPGRGNCEAEGDRGTDAFQTLLGYTWLHHHPCWLQGWCVSGHYPSRAPHPAFTQGLPLLLTESHHRKDIHMGPSKPPPSQGPIMPPAHPRHSATPALAQQLPTKLQQTASPANPSHAPTHYPTHFALRHRPSMGPAQRARRARLAWASAHQLLPHLIGPWAPRFNWTTLDALIRTTGLLHFGPSSNLSHSELPHFHLQTAHSLSTFQPARSSITVCKPTPLQPLPIHPHSQPRHPAIGPSHRTLSHCTPSSGSLCAVKHTLGRRTLRHAHWPRPARQLPSATRSNIPTIAPRTPQGPNTPSWPEAAQQFLRLRNGRRTEEHYSDNATYAAPTSQHSRDTDEEQTPWNLHGEAHLTRRATSTRPQTHSLPTRQKPTTRHHTRPPDP

SEQ ID NO: 1011476 - protein, 395 aa, Homo sapiens
SAAAQDPAAETDRLQSMETTEGVRQGRGCLSWRRPMVALIDVFHQYSAKGGRHSIKLKKSGILKELINNELSHFLEEIKEQRGLCDKVMETPGHNGDVRSVTSTEFHGLLVSHLVTTRLPPDSLDTLTVKTLTHTHAKTLSLLHQDDASMSSQKTRTSHRASDWALSSGRMISHSPLVHVASHLRQASASRPSARIAPTLQQHRPLPTHAPASNRACPPLLSAYYSQACVWIQACTLGPPGNSFFEPGKTFTARPGSSSSHLAVVPPAAKPRPPRPDWLRTPLKPPGAETRLPLPGNVTPRRGNPLKNLAQPNPPTHETTTTPAGYRPDQKGRAPRPATPGAHTGGARTVNKSEEPPRRRVAHPPITAGANTGAADTNRQTWGSRAKPVSRAPTN

SEQ ID NO: 1011477 - protein, 243 aa, Homo sapiens
MLLHAQNTSPLLTSHTTWPRRHQDKPPPSPAQQHRPLTQPRLIYNLASDPWIAHHIYPIINRYTLFGALEPFLVSLATWRNLPPYYSSHFKTHHNHTHLTHRHNRTRRTKPPLLLTTRTPPTPDNYPHRGSPAHPHDTQTHPPHTNNGPITHHFTHRPPPPRPPRPKRTPTLEPTRRLHPQHPGPTTQTTSARTRPATTTTKPRPEPSHIGRTVEPTPHAHRTRHNPTNPASHTRATRRARPP

SEQ ID NO: 1011478 - protein, 165 aa, Homo sapiens
MAEEFSEIPLGQPPLSLGYPERDFNNSNWASSAQVPELLWTTPKALETLGVTQVPTPRGAKEKAPPVLDQTQENSHCASGAIETCLPTANLPRGVPFTPARNLDDDPPRREELLAGTNAQRELPPSHRRGACKIRAPVPQEAHRRNPRTTWTPPNKRRHIPPNRQ

SEQ ID NO: 1011479 - protein, 245 aa, Homo sapiens
AESCYTSRGAHSGNPGVRGRAAGQEGPAEARGPRKRLPGRQGGNAGSGGGLGDGGGVLAINVRNAQVGGCLTRAAGMAEQRVGAAAGTGPAGPPLPPLRPLWGPCFPLPAGTLYSLAGATSASVGQARFPFPLHLLPGLDLNRAIPILPQRGRRHPARTFAWHSDRYSSTYDIQYIGVPGEPVHIGRQWLQAPHLTRMFRRQTCTLRKYEAQSPTGSRIRILHSPIDGHMGTTRQGIDHPYPQPE

SEQ ID NO: 1011480 - protein, 343 aa, Homo sapiens
SGESAAAAEAAAAVAAGSQRRRFRTRALGTGDSGRALRPEPLSSRGRSWLTYRDPSLARNLNQANRFTPLNRILANQGSNARPLPTATDDSTEADPSKLHATNPPLSLRQLGPWRLSGLSLRTEGPTSIPPRSLHAPNPFLRLTTSAKPTQSHSCKALVPPTPAPPCNPFTFHPYCRSGLCTHMPRQTAHPVGLAPLRTPPFRSLATRHPGTLTPLPATPIPQRSFTTPPRLYFPILITTTHPPYTHTIFPQHPLNLHLAFPLPTHTHPHPVLQPRTPPRKFHTSNPPPSRGPLSPAPPYSPGLSLTSPAPPLQSPPIMLLRHRRHKSPTATRKHPGLQADPP

SEQ ID NO: 1011481 - protein, 460 aa, Homo sapiens
RTVHLPAISPAPEPGSLCAAWRVVAACSVVVRRACVGRRALLVLRACSVRVSRTPLRSSAASLPRGQEPPLVLSAAISVPWLHTAAPRRFRRVRCPEVEAGAGGAVHVSLAREAAWSALLGLECARAVPSNAVVACVADEPLGRLDAIQAARRVQWMTGIAWQPSRGAAQRGIILSIAVLLGALARTEAPDGALGHAAMHSASGGFLDFRPPPALWHTRMAGTFLAKRSKAAWSPPRRAPCITPGPCRCTDFPVTRLCAPSVTTPTLESCPRAASAPTHALQAMAPVVATKRLRNEQFGDHATKIRAHRRRYTYRAKKGNSETKTAGQKNKHRRDNSPKGEERGNTQPHRYTRDCPTTPTDNNDTGSQTTDDRPERPPKDTDSTPPNERATDKTKRKRTATGESKNITAQTNTTLVDTPRQRDYEKTPTLATNPPPETTTNARDYPSEPDTDRPTTHTHN

SEQ ID NO: 1011482 - protein, 250 aa, Homo sapiens
AGGEAVAAFGGLSFIEGRGPARGTDWMAEAPRRMVGRPLLVLGCPRLCGCADLGLLRGLTSIACDHPLSARGACVPGVDLVHFDQAACGLSVAESGYYKEPCEAFNTIYHRILISGPFNGGTPQYLNSPSNGGRCSIPTACSPVGEPVSCAALTRRVVRGLLCTCWFFAGLTLVCLNGVTPCVVRWAPTCAPCNRNPSCGLTFASYLRWLACVGCLHEMDLGPVVPGGLGVVHLAPLRGFRAGFLPFPSF

SEQ ID NO: 1011483 - protein, 96 aa, Homo sapiens
RSWSKCPWPEVSGRIPPSPGASSGRPTPLRISYPKARNKFVEATYDRDACTMAATLDRVNNHSGNLAENTRAEDFHVKLLATPKQRHLTRISSCNR

SEQ ID NO: 1011484 - protein, 123 aa, Homo sapiens
MASSPCGGGGRQRAPRNGFGGQHGMQEVRVSVLTPLKLVGLLCIFLALCLDLWAGAEPGLGSHADHQYYLSFVGVLPDTRIAEDILALQIPRIQQAIWQIATLGFYSLREQLPIILIAFTESV

SEQ ID NO: 1011485 - protein, 63 aa, Homo sapiens
MGHLTHEEHVVDLDYAHVAEQRYPLATRRISFTRRGQYGRGVRNQAVACMAHSGGRANIAQTK

SEQ ID NO: 1011486 - protein, 121 aa, Homo sapiens
MNSQVPTFLELLYGNMGVIDHAWTSPKTDTLASPLGIVASQTSASIECPNGEGPNISVGRVSASQSLDMWPTGSQSSLHVGAKYKGWIGSSWAWAWVLYLVRVDLFLSFDQSSCARILRQK

SEQ ID NO: 1011487 - protein, 168 aa, Homo sapiens
AERTPAAPRAGRRAPLLRRSAPRLLLRRRCLPRPAGSPLQLGGPPSLKSGPARPPPPPDARSQSSRGLLGRLSVPGRDAEGAVGPAARHTPTDRAADRNGAREERWNSTILETPAARLPDIAKEKYPAVQLTADQDLPSLSSKTDDDYSPPSKRPKANELPEAASPGT

SEQ ID NO: 1011488 - protein, 95 aa, Homo sapiens
SGARLRRCWLQTALRYRDPVGMVLGYIFMLGFITRPFLTDSCPFLCSMVCPVYRLDIIYATLGASSPRLPEPHGVISFIPSMLGTCTLAGIVCSG

SEQ ID NO: 1011489 - protein, 160 aa, Homo sapiens
RGRGARGGVRRGGRGLCILGDLGLGRLDLTLGRIGSVSGRDMRTAASGKVRSQTVHQVQGALELTHFGDVIERNMGQGFEEVTGTNRQDGGVHGVSRTFTCEIQRMRHASNQSQSGDGKLEVRRDTWTMITNQGQNEEEEMYRRRHKTTVESTYRVTADR

SEQ ID NO: 1011490 - protein, 150 aa, Homo sapiens
SGDRVLTPVSFHLLLQQWLLEQQIAAGNLQAAPRDKSPGMVLQPKRGGYESHRKRVYVYGKAGRRSLETMLDGPVRQNTIAEQSITKKKHTKDRKMRRQHQKDRKRTPREEKTRTREARRKRKGGRTERQKKKNEKQSSQRNDNTKEDKE

SEQ ID NO: 1011491 - protein, 108 aa, Homo sapiens
MLGAAGPAAAACVPGAERMPLRAGEERGRRSAAVARVGVTGAARAKAASPSLGVVRWGAVREVRSEAGVGTMTLRSVASQGLVREPADTGYSTGSPGTLPMTDWVLVL

SEQ ID NO: 1011492 - protein, 132 aa, Homo sapiens
MALARIATMGKIPTDTGTNLKRNGSEKTGAHPLSRLSSFEAQGHTVQGTAKGLLPRRVIPKRQIPFTCELNRDTAKRETQSGVPFVVVWKPLPFEGFAHPWEENAELEKGRFFSTRRMLGSCIMRPENRKFR

SEQ ID NO: 1011493 - protein, 237 aa, Homo sapiens
AAYFAESPWRLGPWYTYSCKTGEAFKASHQLLRYSGAQVRVLSASTPLPSLAKASRSPLNFRPRNSPGRQGPSNGEGDDGVLCALSSNAHLLYYVEHMQELREKYSQRAAAPGECRWVSFADSDIAAPSPGTWVYPHLGHHAPQQTRPLRMQREEGEAEYWGCVECYTVKDELTFLVGERVDIGCTSHVVCTLLWLYKHGFYEPSFRQAFPNTNRWFLTCINQPQFRAVLGEVKLCE

SEQ ID NO: 1011494 - protein, 422 aa, Homo sapiens
MAGWQDATCDNRECCEWSAATEARSLVGYCDATIPFWDSSRLWAVFHEHYANEKYDMIAQGRRPGHMRFVYTDTVYTSLAPGHDKLRPARSQTDKSSYRSNRSHFAGKLVGPSRGREKAVHRFGGDADSDTNIVARGPRTACLRAQAGYFVLSSRPTGGKKRTCVVPHGEAARHIKRQHTGIFESIRRLYISPSQSETCSFEIDRYTTSPLFAPMSLNPKGENPWIILVQIENPRDTYKLSSNYDIAVTSINPYGKARLGIRPTDSCVPFLRRPYAFVSVTPCLRSWKFVPPWLFLAPRALWVPVSPRALGVRWVLQPPHGFSLLGFSTARSPPVLTPFGPQPTLRRFATARLAPSPWSLLVTAWDLSRVVHEFRAGRRTLRAPPFAPDYGVGARPVRTAPGLPSSCPSIYPLGAPFVVDHH

SEQ ID NO: 1011495 - protein, 126 aa, Homo sapiens
MSIGSDDRVRYVHGSIVEILVTISNGGTGVDAVKHSVSESDLVGCACARDDDNRSGSAKKLEARNHCVRRCCADHINAHQSQLPYYVGVEPFIWICGTRGMASHRRYPHTSITTLVYTKEVDIVNN

SEQ ID NO: 1011496 - protein, 142 aa, Homo sapiens
RGPHAVNTCYGVQVPSVVLDCHAEAHDAYRNRNGGAVYGFVGAWIRGTIRSHGWLQDRICSDVFIYLEPFWSIISMEITELERDLSRNPPGEDLRAKSQGHQTHHIAYLEGWTFEEVTHQSGSRMTDDADLEDLTRDTHDRQ

SEQ ID NO: 1011497 - protein, 180 aa, Homo sapiens
AGRRRLTRREGATSSRREAGEPVEDRPSAEPGSRRTSPPTGRTSTGTSFMSDHLIASYLMRYSTKSNPLNHQLGGHIDFFYLWSHRITLKALGEKDEAGNVCVQMAAPKLLTPHCACCSEADLPEMEGVEGALVAALSSSRECHKVRRGVAISHFSSCRKGKKVPIAQIVMPNPTYILLS

SEQ ID NO: 1011498 - protein, 68 aa, Homo sapiens
RREKSHLYLHPYDQWAELAHFFHMVDVMATGHEEMATFQFWTGFPEGPVLTECTLLPVKPSREFLAYP

SEQ ID NO: 1011499 - protein, 411 aa, Homo sapiens
SGVWRMGPALRHLMPRHGAKCLTEEHARYAVAMRGYRTADLDAQARECQSGPSDPRRIGMLTEIGRIRPLEDAMGPLVGISSGDLLGSYVVRQHRSELSQLNRIGVSLVGRANRFIQRGRVIFDEKRHLIVLTYGRLHLRVMVLESQVCSPRDLPGTSIRNEEKMQHPTESFEPWCMLGEGPFGLGSQDLTEGSGDPPCQRLLLNAGYEKTGKCSVTTGDWHSFRATLAIGLLLMLLYPSGVRTIVRVILVLGLFHLQGHFDGEPPFNLGALERVLSMEPILAGGPVSLWTPFPCFPPLEGNHARFLPCTFPGRWNPKALRLALFAFREGNSSWGVGRGTIENTYMFMPNWEPECLDVPAKSLCHPGSQGALRITGTFDGRKWVPPFTNRGHTEASSVPRVSFLGANIVAR

SEQ ID NO: 1011500 - protein, 179 aa, Homo sapiens
RRGGGRAGSAVGLGVGRSRHVPVPQRPCGFAQGAAPSYHQGVAYESAMSRLCPSCTLAGPAFLDSSLFPVTAKEHHAGIGTCNVAPLKRPADGGDKLLTLGWFGRCKALLARKDRLGVEIIAWTMLVNARTIVFLLTICCDIVPDSQRLKSWTDSMVSNPLCHKACANHEPSQWLPASR

SEQ ID NO: 1011501 - protein, 213 aa, Homo sapiens
AGARARTLHWGTARKSSGSMVEMLPGAEMSAASPTVISSLLVCLVDVRAAGILVIGWDTAPLLEASLTTPKPVKTVNTVSINHTICSHEGSAYLTIGPNVKRYMTGRSDTHAYQHIPSTPYIANPHNSLSLTSHTYTKPPTAITCHTTDTAPRPYLQLILLSHITRPQYALHSILLTTHSSTRKLHQLYTQTHTPHLYYDITRHQNTLTNYNT

SEQ ID NO: 1011502 - protein, 279 aa, Homo sapiens
AARSVPDGGEGACVVPRVAGRRHAWRAARRERAQGSFWSVFRSPSRTFIFCLGPQPGRQCRLSMARVYPSTWAVRRWAACAWGPLTWIIAMSSRDSAAPGLVRRVGNCTETDCTIGQGVMLVPRKLLGVDNCAANDEPAPGAFKTRGSMSRPPALAREIGPLLSRPYADCRSRRQRPRWLFPVPLPVGKQVLSERNLRYALDFGGGRDLPFQASLRRLLSRVYQVEPGLTAACGLEEGEHVRGSLARHESALTVPSPSGTPKLVSRTGLTARGDSAGNG

SEQ ID NO: 1011503 - protein, 170 aa, Homo sapiens
RVEENADGVDAVYEMSFLQDPRLSSPWGLCAPSVARSPGGAASLEHSLALRILSCRDLLFQVPRQRPWQYLEDIDLKNTGRRNQGLSDAKRAYAEYDNWTSCELVAVSRGRGWFHSGRRVNAAGLCPPCKSMLDPDWASPSMQLCIPEHIRTDSEGFAMALLVSTDEDLS

SEQ ID NO: 1011504 - protein, 120 aa, Homo sapiens
MEICDIISETEKGQKDAIRALTKRLNGNLVNYRRGGAGIKQCWRHCSRMNCWPARIAKIHCVPNLRCSLRQVVAWKRVISHRAMNQGLSHSMCSCELDVALVLTPCAMVLDAFLKAGPDL

SEQ ID NO: 1011505 - protein, 69 aa, Homo sapiens
AGPSAPSARLEGRELRAPIGPTDTLPFPPVRAPAAAAASPPSLESEPDQLRKRRENRKKNNLKIKIKQK

SEQ ID NO: 1011506 - protein, 38 aa, Homo sapiens
MRVFADGPDSIHAPSEIAGAGGLSGSLRLYCVEEGYDA

SEQ ID NO: 1011507 - protein, 69 aa, Homo sapiens
SGVSRCAVSAIGELSSSAKREAEYKFYAVVDSVFGLRPSGAFPRQYSMKPEWSSPTPSPLIPARPCEGP

SEQ ID NO: 1011508 - protein, 166 aa, Homo sapiens
SGRPGGAGAQRVAVRPPPRGCGKLGLSQDRQSPPLTLPFPLCVGPPSHPAPRSESRGGPSCPLRSLLRLHVAPTRDSSAPRESLRAGPPRSQIAGAWKKLSGNYWSCQAQTAAQEELLCESSVNVGKRKPELPADRLPNQENICRMDFLVLFLCYLASVLMGLVLI

SEQ ID NO: 1011509 - protein, 46 aa, Homo sapiens
MLAIVDLTPRQIGLSTSETSRYGPNLIGLCSVVRFVETFTTPNDPS

SEQ ID NO: 1011510 - protein, 161 aa, Homo sapiens
MYLMLVMNVGIGVIRMELLPLIHSNRCNISLFDNVSPVVTLIWWDEHVRLGSLYVIRHLVFPANLVRHQDDIPLTPTSHRHGQGEQVSDATTARRHHSHDAQWPPTGARERATTRPHGRHRPPDSSPTRPTHKLPGPSKAHSYTARARYATIAVHALRTLP

SEQ ID NO: 1011511 - protein, 104 aa, Homo sapiens
MTDLPADPTVRRQCAPDRRNERKSNPGRDADDPAERSKQDTHGPKERYTALRTKLNEAKATWPQYAKTSCEQTEAMEGLRDSLIDTKTLTKGALDVTFRPSRRH

SEQ ID NO: 1011512 - protein, 214 aa, Homo sapiens
SGSCGRPGWAVTLLLGSEVSYPGLSAATGVPTFPLGYPTCRRQVIICPPFWLEQSVYPRWHIPSKWERGCLTSTKVTKLAGLASERGRTTHCAWQDYARSSVDVLMRWVSAISRIGGWLHRYSSELSSTGKGVSEVALPRAGSIGMSSSSVLQHADAFSKSMIETDGPIASKGSNYRRWLFQWKRQDCRIVEVNSPGRGRNLTFTRLKVQGSSK

SEQ ID NO: 1011513 - protein, 408 aa, Homo sapiens
RRCGLALPVWRLEEPGGTQTGQGHGRMGGRREAQWLLAVAAGHLATIPWCPGAQAAADGRWPVVPCRLKCRLGVGSRCQALVVGRWECKASKSSRMLGVSSLSQRNQGCLVLDATHWPMIRRTPWMSQVLLASRLVGPQKPAKDSRGARCHGVVERLGPGKATQGCLLGTETRHTLRDGAWAEGCYLQLLPQVNRADGAKVGILDPGWFGPPARVGNHNCFVSPGELGRLPQNSGVDGPDKRGTERGVMKRSGYFKFRLRRDSIGNQVAEDPQERKNVLPKLNPVRRTKNLGSDTPIISRTRVSCDLCQTRSENTPQVGSVHRKVTWNGQSHPLETQGAQRFQGGDINPSNTRKRSAQATTALAQSRHAGKDKAQASTTIRANAYTPTTNGGGNPQTERHPHRTNPKR

SEQ ID NO: 1011514 - protein, 140 aa, Homo sapiens
MQASVLLETKISGCRKFRVSTSDGLSPNQCMERIGELTGTLKAMYRSIMAMGPYARESSKAEVQRLRASLELGRGHTFRRTTGAVKIGKFFAIPYWAQGIIEAIIPVRKTRRGAVSAGNTLCVFHTCEPHNKATRGFVNL

SEQ ID NO: 1011515 - protein, 175 aa, Homo sapiens
RVCWPLCLQMGGNGSGQPNTPSLPVLRAGLRYKESAIARTGMRARKRSSLEMREADTAQSRHQRIPTWTLGRDGEQRHWHETDREARAGGRGRHTDTEKHMQLRPDGTNERGTLDERGKCGRHQPQGDIYEPWSDTNEGIWNTTPKSIWESYQETGKRNIIRDDTQSHHDIRNEQ

SEQ ID NO: 1011516 - protein, 119 aa, Homo sapiens
MNSSKDIARGHLGGLDRPWDSETIVLNDPGGEFSQRGTPRSFLRLEHINSSARQASRSRTEDKNQQPKGIKDVMGRWVRGPQEKWPPYSIGLGSAFLARGCEPQVGNRASQVDKGRKHP

SEQ ID NO: 1011517 - protein, 169 aa, Homo sapiens
MKRRMFWKESYCGKSGLAKQRSVPHEARACDCIVGRGVLCKSLLGSVRGKMSVYSNLACVKLNAMQCACICALRGCIVHVSNHKKGQHCEWVGLRGVCCVSDTILEWNGCHGTSELTTAVTLCEAASRRRSGTLGPDAIGVGRYYGEVVGLAGEVVAMFDRPSVYLRIL

SEQ ID NO: 1011518 - protein, 196 aa, Homo sapiens
RAARAAAMLRPRLAGVPSGRLLAWELLGASCAADLLCVWLVRLAGPCGWEVWAAAGPQFLRQCAACCPASGDMTMDALLARFETSEYQMTLEKNIVKAGVDTCGPITSTTRFIFENTIGSGFTGRKEEGCLLSTTMRQVSPALKPGSPTKDFEASLKGTQVNQAGLSEDRDMGYRCGPESSRRGKLVTSKNLLGDP

SEQ ID NO: 1011519 - protein, 181 aa, Homo sapiens
MSFLLCSEEFTTDLSVLIKHGIQKTTNKLKALTFSLDLPLVCLDSLDPVDLLALSRWTAHISDGCSLDYLSPVVVHETFGLRCLLTLLWTGLELSETVLSDVGVSAETPSIVEPSLLLVTPDVSYVMWYQLFPTTNVTRTRVTGMYFYEIMSRLYRQDFHFTLREHSNCSHQESISGHSGD

SEQ ID NO: 1011520 - protein, 177 aa, Homo sapiens
SGVVSVRPMCPPGEGPGSGACRGHAAAGAWCKWGHAGAARCGAASEPEPAPGAGGLWGARCGGPGLARGGGRAECDAARCGSRQNGRAVGFIIAGHSHLHVGLRETITRSIQTRFGIHNQEIPREEHRGKHLHRKSGPKDPKDHTNIEGHHIRAAGAPPQRGSQARRKIQHGSRMTQ

SEQ ID NO: 1011521 - protein, 217 aa, Homo sapiens
MTPPPILTSPEAYAFSCFGTGNWEGLPLRPSYRGISAALGPARFYTRRPRTDVSYNAAGGPQTNGYEELRHYPAFWGPPPFSLVPRGPLRVFSHLYTPLLLVPPCHNRRQAPAGERDLKTRRPLIGSGVPTVTVNFPFYAVFETTLLRPLETHSAPYGLAARTLDTAVRPGHRALALAYGLSLTSRFLAWHPVSNLVCLYVERRIRAPALALRLSLF

SEQ ID NO: 1011522 - protein, 108 aa, Homo sapiens
MQKDRLVAEFHRTSLLTRLPRRSRGRAAELSRKEFVARVRASSRVSGSFPEDSSYRKEVVVSWESQTQAQVPVQDEEDHTRMTSVLFMRENLVSGNLKRDIMDINETI

SEQ ID NO: 1011523 - protein, 159 aa, Homo sapiens
AEGPASAGRLQPWSGELNLLLYLALFFFLLFSYFSSCLFVVITQLKTLRWPDDVPRALQPGLPLGCTASLGASPDEQGGVIPQCWALGGRAPSCAGAGLGLRLDSPCSRAPSFQSRAAALDWCSGDHSCNDSLASCRKEWLEQREYGQLSANCSTTWYP

SEQ ID NO: 1011524 - protein, 172 aa, Homo sapiens
MVFVAVPYLCCYKLRTCVADSCCPRALDIRRLAVAVHRHSEGEGSLEDAVGRTRDAQALCQALYCCRCARKHLAWHLTSPVGVDVVVVARFRCASWSTWARYGQEFSRMGCRCGPSRRGIYHRCTIPDAPNAHARCATVFLDGGARGAPFAGLAALDSPCKRSFPPMQSVKR

SEQ ID NO: 1011525 - protein, 330 aa, Homo sapiens
AGWSLPQPTHCDAAGLNCSSCALALMTGTSCGPLPFCLHCPLSPTLDCLQQRFTLDDPALSRWPRCRAHHIRTGVTGQGPMRQLRDDVPRTLTWPCPTDCEHSCCAARFPGDCPGARRTANLALPQRIAPGSTASGSTRGPFTMALQPHVPLWHQHPTRFAVISEQVGKDPLLIPMRPTYHSLNTRTKALASKLGSAPRAQKLASPLQAGGPTSQKGMPILRGFPWFPSTQRVPKVPHAVIWRQHWRNLTAHTPLYLPPPILGSPSRTTRFLGPLWLLTQRALYIKGLDHNHPKRTHTTAQLPSTGHNPQACSHEYHNSPEQSSFHGYLL

SEQ ID NO: 1011526 - protein, 302 aa, Homo sapiens
RGGGRGYHERRKRRFTVRGLRGGGTTSFTSRPEVCGTERSGPEPGILSSEALSSLSTSEHLALTVPSTPFSSSRVEETPGLYVRVSGGSMLGKGMDWVVESRTAWLHVADADALYTYQRSEGIINNFRMTPEMVSRKVFEGTMRGTHFAPLNPVCPQILGGYGSLLREGAPKARRNRSPQALPPEEHKKRDMPRSAHKNRTNRKESVQRVAMSTTSTSTLKTGKGHFLRCGQHVDGHFVQQLILEVQAGQPSLALLRDSRPSAAVCNLGASSYQEWLYVPARAITRRKGDTWHAVLALTLHV

SEQ ID NO: 1011527 - protein, 77 aa, Homo sapiens
SGRCGHRAAGSQHIPLSHLSPVPFAFLYLSWPTPLRGLANAEPADLPPRTTVSFLYGSRSSKTFNTKEEHSRGFSPV

SEQ ID NO: 1011528 - protein, 109 aa, Homo sapiens
RGVAVARVVAAALPPPPPPPPQKQEPKSSACLPPLPGVFWSGALQPWRISSVISDDSGSESSGGCPPCGPGRWSAAPGPLSANLRRCLPPPEPWTFIDFNLGRDQDQGT

SEQ ID NO: 1011529 - protein, 134 aa, Homo sapiens
MGDMTNQIKSVIQHKLDMRLPRRKTQTTGLQKDTLNYKREIIKRKGKKLNKNHKTKEHTREHANTTENTSESTQSNKRQPRLDTRTSQEDAKKPTRGPQSVHSTHNEGRRRHKTATKSKKGKKKRSAKEAHKKR

SEQ ID NO: 1011530 - protein, 143 aa, Homo sapiens
MSIMDHSPSTGVVTVIVILIAIAGLEGLDPGAAGGYLRLKRIRQSEDEESIVADGETKEPFLLVQFLAKGPVRGEKRPQLMTPNRPGSPRAESSDASVLVLCCSRPRGAEEEAKPYWMRVLSGEDGLTLAGDGLCGLPIIALH

SEQ ID NO: 1011531 - protein, 34 aa, Homo sapiens
SGVRGLLLTAPPVTRTPPLSRLPVPVPGCEGVPC

SEQ ID NO: 1011532 - protein, 112 aa, Homo sapiens
MVLTPYTHLIHNVISNHFQTKHTCYQMSHPKIINFPLTTAPVTNNTILLPPNPNLLCVSENPLATTTSSLQYNPHSIMMTTRKAESHIRPTATALGVSCNPILGGPKGGENS

SEQ ID NO: 1011533 - protein, 121 aa, Homo sapiens
MLPAALRSAGLASGPGKCGAVVRCSTVCGEENGRRGENCTGSRRSSHRPAVGLFTSWHSNGNRARSINLEAWRSACMSAAGLKITGSTETKRRLLLISIDWVYCQAEARGEEGTASGSLPV

SEQ ID NO: 1011534 - protein, 153 aa, Homo sapiens
SGVLMFAVMCLTARGSRLCCRSEDMMAVDVPSFTPWTSTLLKEPEKPIDPPDRHAHCLLAGSLPTILAVNITAMEDVLPSDICTCSILTLQESSSLRLASLRSVLDTWPWHLVKEDCLPPVMLTNKIVATFTFHSHAESDSTIRTSYTQYHVP

SEQ ID NO: 1011535 - protein, 120 aa, Homo sapiens
RVVRPTERGLQLDLGLPAGLRGCLSSAPGWRRERRRGLACTAFSSAERKDPLYTHVTKEHAVLVFTWLHRSQLRRSLLAEHESAPQRSSIAHTTRHTTYDTEEAIRTEDSMECAFSMTDV

SEQ ID NO: 1011536 - protein, 239 aa, Homo sapiens
MAPSPRGGRCRRLSERVRESGYWLSREENSRMLNFQVFAELCKLNPYSADRGAGPPWTSSCHKLTDVILEADQNDSQIAGAGCTRFQDVHRCPALSRSVRDYARRAIGTLLDRSKSRMRLIRKIEAYMEDEQDLSRHPSWSSRAVCGDDNHAAVGTKERLELVPDSFAKPEVGHGTKSHEMAIVFNQEGLKAIESACVGPEFHRTQRRPVPSVPGWRIYAVVQRPLLKNFSAGTLDRGF

SEQ ID NO: 1011537 - protein, 37 aa, Homo sapiens
SGRVLPPQTQERPPPAQRVKEGRYGQRIRLATSGRAL

SEQ ID NO: 1011538 - protein, 104 aa, Homo sapiens
MGLRQGLVWGHFNSAKTKFFCQLLLLFRSRKVTLSKHTWVRNGGDGGLELLNGWITDCLIDEFWHNRITRMDRRTGQRESMVFEGAKWRGIGTFGERWGMWELV

SEQ ID NO: 1011539 - protein, 112 aa, Homo sapiens
RSPQSASRQPVTVASVRGGRERRGETQSRYALRDNKSNATDYTSNAQMPDKAVSNHSSSSHNYAIHYTHEGISMNAIQGDNIETQSTVKATKDNQLYYHAPPNDSIEELSKH

SEQ ID NO: 1011540 - protein, 308 aa, Homo sapiens
MYPRLFLHRISMKSRTRLRDASTGGTNVPVMGTTVVYSGRWAQNGPIAGNDSAMILEDLSEDPWMRLMLSVLTPKRVNGTVAVRPWWRDGRMDESLCCPSREATNYAHTELCVTGHSVEWKPGRRKASQIGSRGNLIGPRHPLETRRYVAWIAHLRKGRGTGNNGNALSLRPHPFERSNTTSVHMVFYPISTHFLLLPMGYVPHWCRHRRRGHSRCSTYALFPPHISPRASSVGRVWNPDILPTVRNKFTVPGSHAGHKYGISSDHRLQVTRTWAWPTFRSPQREIGAARIKGMGQHTGVFPSVLYLG

SEQ ID NO: 1011541 - protein, 293 aa, Homo sapiens
SGVPVAQLQMEEDATVQTCIRCGTRDTLVALRPSRSGVLRYSPQDACVHPPGSLHQGRLRTSIGMDHKQTHRSQESLCMLRQTTLAKQKNDTVSIAGLGGRSVENRAHSHLTSWCSSGPNPFFQPPAVPVTPSLAMLHEMGDRRRLLATGVSCRMAVSIEALRARQDWVVDWLHPTRGVPWSRKYPSARLSTGPVVYCTPSLNSTRRAPGNRCCTHELSLREGLTPPENIDLALGLKVARHPRPRCLCPKTPVARMLPIKVYVIPMASLTECNRRRADEELGLRPGGAGANPR

SEQ ID NO: 1011542 - protein, 90 aa, Homo sapiens
AGGRTVNGCRLSSSPLCTQAQRAHFSDLAAYPLNLLTRLHDGNSYVVLRKCEYCSVPRHGRLSAYRETCGIPESPACLERRLEVVDKNTW

SEQ ID NO: 1011543 - protein, 142 aa, Homo sapiens
SGVRRGRGGSMFQAPELEPGPRLPAWHRGGGARGLAPAAPCSRRPGRTRPEALRVHRVPPLPEVAPQRSGVHGPAASLRGRRIALSSSRSRVLDRWMDAQHQWTSRTVWPLLEDAGWTIAEGREESFLACREAEPWFEPLLT

SEQ ID NO: 1011544 - protein, 135 aa, Homo sapiens
RWAEKHGGLVRKKPPPAPEGKGEPGPNDVRGGGSRTSSAREDPLGRPLAGPNVSATKGQGGTGGKAWEADDALRPLQLVRAPKARPSATGRRAAASQALAEELPEPRARGAGTSWKPPAKVNPWTKNALPPVLTT

SEQ ID NO: 1011545 - protein, 308 aa, Homo sapiens
SGLSRPGGGDCAPTSARAATARVRPPAIMVHALAHLSPGFTDRTTRLFQELGKACIVVCWSAECVQAEPTIDRTYADRIDHHIPRNLSAQVITKKSRTVEAQDTCRTSRSSPIAVRARSSDHVFSELTGVYTTLRAFDPCSPGRRTLLCHASLSAPRDVTYQCEARMPSPPVIRSASVARSVTPAVRAQTIDQSDRDRRRCRCLMRPACMSPATMSRSCHGRRRLCCMFEAYAESQFPGDEAAIARDSVMRAHRLGVACSSLTVSDGNQIPLVDKSLCDYPGSLRESIRAIYLLRGAYSFAFCGTDGS

SEQ ID NO: 1011546 - protein, 104 aa, Homo sapiens
SGRGWGASCAAPARRAERAPRCRRRVGGAGSRRGRPSARRRRDLGRPAHLSESRLSGTAKWGATADVPLRRRSPRRRLGFDPGALASTLLPRRGIVTSSPTTRW

SEQ ID NO: 1011547 - protein, 323 aa, Homo sapiens
ERVHDAAACGEKGRQRPINAIRAAAAKPSPRPAVLFLRRNFRPPLIGRCGAEGTRAESRRRTRPARNRLRLVASFRPFKLALPGAAPCSILGPGSCEARRGIGRHRNHRRGTWRALRVSLLGLLTTDPPGEWETGALWKRAPRQGGKMHPQSPTIIRGDGNVSETTGRNAGMRHPPKREEHHAPEKPRDPLWQWTEPTGETTPRRTERRQGAQVPGAHMWGGHATSGESTRPLRRQTMNNITKKGRATLVVVIHGDLVVTQVLRVPGHKTTTQSHRSTSVEKQRKRHPVIDQSTRPYAGESTPAPVLQRLGQPRQEKRATKRR

SEQ ID NO: 1011548 - protein, 71 aa, Homo sapiens
RIRKLVCVQRTELPRDRRYENCEGGRKLSPCLKACARYEDSEVLDALVACVTTSVAAGWSVGEVPTIVYER

SEQ ID NO: 1011549 - protein, 276 aa, Homo sapiens
SGGWEVSRAVGGVYAAQLQSPSRLPVLGGGERKEGSRGVGQASSRAEVGLGSQRERREPAGQRLAAAAGAADSRNRMQVFHTKGPRAKTRLTTGPNLGPTVPRKQSCCDQWASIFGKPSQEPDWEDGDAHPDGGPGCRSERPPSYTELNTGGRSSPTIPIHWVQCGDSGSITNIELYSVGCGWPGRRFDPSGDTYFQNTQGLIYVVTVNDRERVNEAGCTADENTGGGRAPGLLYSLSLQTKQDLPNAMNAGEITDKAVPAFHSSPYLVHSGPLCH

SEQ ID NO: 1011550 - protein, 141 aa, Homo sapiens
RICTFTYCHFLPYEELDGMCSSRNIQHNDTDASDEKRRERGGLREHESAQWTRNGRDPESMEMEKHKMRAQKEGEEPNLRRQVNDEQMKYERTQTSQSTAMNNHQSKRRTHASAPDHVQQTTDKQACSVSNNQKDQLDTGT

SEQ ID NO: 1011551 - protein, 97 aa, Homo sapiens
RVMSCRALPGSRPAPMGLCPRRSDPSAPHGAHMSRQAAPRLLACCSGPSAPASWGLVAYLFGSCVRPYVLFMDLGLDAASSLEPAGTGLSLAIDTPS

SEQ ID NO: 1011552 - protein, 106 aa, Homo sapiens
MGIIVICQDEFGIGDVAGEFAIMMGFRTKSGPEGIRSLSVRRWERLNHAQEPNGTNVNVTLRESRHRMYVDIRPAAKGTQEGLSGRHGRNVPADCTDRDHRGKKMT

SEQ ID NO: 1011553 - protein, 270 aa, Homo sapiens
SGNGGALEDSERLGDKALRKDEGEGLAESVIPQETIFVWQPDLSRNWLDGIPEVTASRMIYCERNKQEKHSYYMSNRKLHLLSFDTIYYFFHEFHTKEYNMPGHFQQRRSMVCLLVHDGSMKIWRGFQWRTQESIARTCVDVNRCRFFPSGLVVLMWWEWSAQLTDMVRLKDASCVVTFIYRSTKEVSVDTAIVDRGRNVVSASRDGDKNEFGIVGAQHCLGVLADLWFSYQMDLAVGAVDNSINLGPLTDAMERQVATEAKTAAWPGKY

SEQ ID NO: 1011554 - protein, 107 aa, Homo sapiens
MGIPAASGRVRATLFAAVDRPGVQTGGNRRVFSPDAVVLAWNSFPRRLRLGCGSPRAWDQWGVISRRKGKFQRARCGSILGREVPRQVRCPWATGQHELGILAHGGC

SEQ ID NO: 1011555 - protein, 118 aa, Homo sapiens
MSPDWSSRRRGDRRMRQDVLARRPVWLAEHRRASGHATPTLASRWCTRWPSGSAMRRSWWLVIVPSGCANDQAEFTRRTIRGGSPVSSSPVSAWAVDAASPLWCFHHLATGLDAHERL

SEQ ID NO: 1011556 - protein, 90 aa, Homo sapiens
AGVRPRYRQIYCMPKCRGGMSDQTEGKRGKWSKGKHHSCTLRYGTRTDLSDDVSTSTIPTKLSCRYRRPAELCVVNIAVVQDPKDDVLCK

SEQ ID NO: 1011557 - protein, 103 aa, Homo sapiens
MRGKRKSGWTSFGEQLGAGMVFQPLLRPTTRALVSGEIEPETLCPGSSSHGTGVQGRAQAESGDSGKVYPLSEASTRGVKNPKSLAPALKLALSFRNKRHCRY

SEQ ID NO: 1011558 - protein, 103 aa, Homo sapiens
MTRASCKAHKGNFVMQTQVSTAELIKQKKEYQSLKTVFAKIRQAEKIREQKNEQGMNNNLKELWNYVKDQTYDCLDYLKETRRMEPRWENTLQDIIQEELPPT

SEQ ID NO: 1011559 - protein, 285 aa, Homo sapiens
RSRDCSCRAGAELPLLRARKPVSAPHRFDPVCLVGCAQVQSHATLWVKLEAKMEPLQQQQQQQQPATNRSKHNLGSSARWMPREKQGPADERSPGLGMPKSWVTQPNSTFPPQLGKTFWQHSLRSLKPEYQPNAAVCQVLKRGNYELRCLSEEDGREGSMRMGHDEVAEVGVRKKARGMVSQLFSLLQHAVGLAPRNPQKWQPQLLQYHNFHKQTQGATPKQQIGTNKSHKQNMTRITHKDIAYHNRGLSHVALVIPTQGRETGPESIGNSLDMAGQAISCTDNR

SEQ ID NO: 1011560 - protein, 208 aa, Homo sapiens
MIPPPVGALCYIRHLEHYWTQGHNFLVSSADIWALYAGRYRCVKSHDAPLRTGAYTKPNIEYAGWMSVIAAGRHPCFAIIENRRALHYSPSPRFGLDSNKWIYTYRRFQTVWGATAQFQKRARSHIGPIGALVRRLDTSVYGLTIICKGSAKTSVGSLRESTIFSKRRKSPGNKGMDLGRQTAREVLVRAPTPKLPPFPQRSEDTYRG

SEQ ID NO: 1011561 - protein, 229 aa, Homo sapiens
SGLRQKAAYRGVPASRGLGRTPPSRSVEVMSRKGVGPTFRVGRFLKGEFRQEVTSRRLPFYIAFSLEPGSRCMGTHCRAGMTGEAATDRGTEGGKTPWKLAIVHNRGSTKGSRGSVTTIDWLPYNSTGRRTRGRYVPRGSEEPQRDGVVSGRPWAKPVRRPHRKKGLVGAHPGGGMNPASTRTYERTECGNGLIGTWRLPPSRFERGPICVDNCVFLCPCVSKRGKALG

SEQ ID NO: 1011562 - protein, 128 aa, Homo sapiens
MASEDETDSGAGSRNSFAKATRDSAPQATSVLLERDLSSVQMVKVKFGQSEAQADLQITMSRLNRNQEGPIGYSHLSASVSIVMNLCQQWKSNTWRNSKSHTDRQEKIDGIFTHWTLLCLDLEEPSGL

SEQ ID NO: 1011563 - protein, 199 aa, Homo sapiens
MGVTSLPCCCQERCESSGVDQPGGSIGASQAWLHMREGDASERSSPSSPALSSWSRCCWLVICLLTLSPDPSLCHPGFFCYDSTYAKPYPGLRLPAECLLLLSTHWSLPGHPHDPAGRAGACPFSLHHLQPSQLIGESTIVSGACCRFSPPVREAVKLPGGLLPSGLFTTTIFGNAGQVVTGIPAHFLVRLRPITAWCF

SEQ ID NO: 1011564 - protein, 103 aa, Homo sapiens
AECNLEARCLSEYLRTEWNFPDLLELDQWMPVWFRIKSAHAYESCWYRSPAIHYCRDDPHVEKLTKAFFLELELEVTPNYLSVKAAGDEEKFLKMLHIKTNFL

SEQ ID NO: 1011565 - protein, 202 aa, Homo sapiens
SGEAALLRWPSGSCSPLAPRLSGPPAGHLAATAAFLALARDTVRERRAAALRAPSLGAGHRGPFLGDWAPAPASACAVPGPSPARGGALRPVSPPVRSGPARLCRRNRALGGRHMRALRPEAVGRCQLGPATGERGLKRAAGTHCSSLKPGPEARHSRVLASVAAGARRDESRISLRNRAKEDGGQALTAGDKGENEAPGGR

SEQ ID NO: 1011566 - protein, 119 aa, Homo sapiens
MTGRVGVSLTPVEQAWSFVIGLAGSEELVVYVNARGRAPYVVSQIPVWGFKIPCDTHITRRGFWKRRGYRATGLGVGGIQGYHFGNKQLTLWYKSDISFKEYKAGPNDVNVVIQNALFR

SEQ ID NO: 1011567 - protein, 341 aa, Homo sapiens
RRCTVRGCWFPDHGFALLALVGLVGVASARHASRRGAPRAVLPINCSSQQQEKNHTDLLVVGSDPAGVRTTGPTTVLKQPQAARWDESKQKRGLMPVCAWCSSGVMEPESALTVNELSSDTLYPGQAPILGTRVSSGGKRGGGQGRDWCRRQREAYQAVVLSLRGQRTSGPWKFLVTELPGVCVRRAYRGLGYNGLPENQELEPETMSCDDRRDSVGQGNVGLERGRILLTPTEHRERTDMRRQALGVTEAGVRVKTRVAQLGRMWNPCDVELQHDGASGKNDPGTDSPDQFGNPVGVPGGITQDRRLEEVPTTDDKRGQKGIERATEKHRTGKTYHNRNT

SEQ ID NO: 1011568 - protein, 70 aa, Homo sapiens
MRDVEDQASTLSGLRPFIALKHYALASPALLPTHLSPWLPGPKAERVFSICKHFSRTIKTVWHYGKKEKK

SEQ ID NO: 1011569 - protein, 90 aa, Homo sapiens
RTLIDSRSAERTADTTVQTHRRRLVDYHQVRLEPQMTGLGPGLLIAYMSLEEHDPSSPVYDNKRTCDLGKAAKDVFNKGYGISTSGHAYT

SEQ ID NO: 1011570 - protein, 68 aa, Homo sapiens
RLFLCASSVTRGTGLPGGYHEPDLEPTRGSCPGAEEAAVGAAVHSRHQKFGRSQGGVVAYPCDGVFRN

SEQ ID NO: 1011571 - protein, 288 aa, Homo sapiens
SFLAPRSSYPSQPAPEPSTFRSMDVKAPSPQRPSEILCVFLRFLRPYSILGGSPLPLHLPVPVPLSRNMPPFLHQGPSEGAACLKPGDAAPSSAPPPTAGSRGMCCACRLKYGDSSECSPDERPRFPACPRPQGIERRTEQNQKTPDTESRRYTYHIIKTRKGRPLTSRPNQRSVHTDVRLHDDNPRIPTSYIRTNIKQRERGDSQTQRGNLPREETYRKRQKTLGSNPIPERTNKKNVTPESQQTKEPAKHTNAQKHRPPQQHSQHRQKRTNSKQGTNSQREHYTIQ

SEQ ID NO: 1011572 - protein, 196 aa, Homo sapiens
RIEMGGWDRSQPLRGRLILNRPRPVCYTQADGIALKVDERGEAIMDGKTSRITHISGRSRTGLDMLAVVVYSREADGIAQQTRILEALCHSGGRTTIVVQIARGKTSVARGIARGLCRVGLQVSQRRINLWVIPKPCPSYTDEEDWGSLDGNAWNSMNGELALHSSDQGSGEQLGVSLDWLARKHKISEDRVERQC

SEQ ID NO: 1011573 - protein, 153 aa, Homo sapiens
KYSVPVCLGSTMHCPLFVPSLSAVSSYHVPAATLLWAHVAPARGNGRCLIRVLTAGASKRQGGELGKSWASSVYPLGPLPPATAVHFPGSPGCVTVTGLTAGSTARSKQHLEVVFAVLPAFKLQRGRRERTSKPPIIPMSSQALVGSGPDSRG

SEQ ID NO: 1011574 - protein, 132 aa, Homo sapiens
AGFLGKMAAVSAVCSTSLEATLSDNVSVDGMPLRSVADFASRRRIQASKGPEKLRDDHRSGVAHIQDGIVSWQADTTQLTAQDGSVARTRTDHENTLSYLLYILLFGGAGHRLLSDSTMDETRKLHFLSKTW

SEQ ID NO: 1011575 - protein, 146 aa, Homo sapiens
MAETERTAPYHDAHSVYKIYVAMAVLATTKCALEAAFPTKRRWGGEAGYNTHINDNFRRQGTAQYRPVRGLKIARIKNTATVGDPQQRSNLARSNDKTQPPDKQAHLVFGGDTQGVDIVSHLETLGEHIPLEGLFLRSELLRPLFA

SEQ ID NO: 1011576 - protein, 148 aa, Homo sapiens
SGGKSEWRSRRPRQSRPPPNPTQRLGGRSKPRTPTGPQGGHLGPGVPQPSVSRPTPIIRHSDPRHLITSTWPKGSSQVRTQKRTGLCRTHGMGGKAHTTSCMDGHSRVPATVHKKRPPITGIGQAEANRGAAGNVQPARARYQPKCTI

SEQ ID NO: 1011577 - protein, 157 aa, Homo sapiens
MRQKGATAPETSRQAPSEHTYYKSTTGGERRITQRDGVTRGGRQTRDEDGRAKHTGPREEGKIENPIWKILQEQVHERRQETRTETTPETHAANENKEGEKTERNDEEYMHHRERDEERKTRKKQAKTEPTTRQTHERRKKTSKNREDTTQREKEGT

SEQ ID NO: 1011578 - protein, 204 aa, Homo sapiens
SGWRWLAAAVRGCNGRPPPCVTMCGRRGPEAMRGTMQVRSCPLSWREFRRGGASPPRSPAPTNLPTGADATLDGLPRRRCRTRGVTREGALAITAQNSSGPNLVIPRPPVAIVGLPWARAVVVGDFVGPPRRTKQASSIFETPGQGKSSSSGSGPFLPPDWEEVTLGAHGASKWGHLGPLLVPHNPMGMLAANAQKSSVARRLA

SEQ ID NO: 1011579 - protein, 317 aa, Homo sapiens
MVPATDTKAPPTLQAETATKPQATSAPCPAPKQSFRVWSTEHLTFQPCDPAASSAPPMFKPIFTAPPKSEKEGPNTDWPFRSQTTAPLQLLPPHEQPGNTDPTFQDFFSSMGPPASVALAMIPSSSRQHSPAHLVPDRTAPVFTGLAKSHLMLLAPITICQSNPTRTLHSEAMRSGLGIKRDVKQDSRCGDTKEPRKQADRQTVNEDMIHHHGAPQGPHGVAKRFNTTGPMGVPNNPKDRGKPLPWAVGQTKQPTWTPTHLRPTVTPLHPVRRAQAGSHKQGTQPAGSVKRDKRQETQNRRTPTQRTQKQIRPNIER

SEQ ID NO: 1011580 - protein, 236 aa, Homo sapiens
SGRAGLGPQAGRGVRGAARPGRHRAFRRRGGVHRRRLGGAGPHSSSRSPSERSSAVASRGSPRAAARPRKPPSAAGEARCPGAGAGGRQRRGRASEPTPRGTERAARKRRGPRTGTSDERGGQRRGTPGPKPGAQAECSGGPLPLAGHAVPVWEKSSKSPGRTLVNESEGEQWVVWKSKTFSDSTSGKRVTEGKFPKDLVGHGPKFRYGHNFDNAASDRSRTLKLAQELYTSGLLS

SEQ ID NO: 1011581 - protein, 115 aa, Homo sapiens
MVDTEGGGGCPKKGTLAVKADGVGGGAHVIAVTDAYGLPDHIPPRRRQEDRVSDQRSYETNFLRRKEVTLCCTSHDKLNGWSQGPEWRNDRCVRQVTTESMSREHEPCGRLRREE

SEQ ID NO: 1011582 - protein, 139 aa, Homo sapiens
MANGFIDPGERGVCEKKAGRLGRKDGQMLSWRTMNHFMPWLLARSHGRTVKTGSWNRYENILEAGYRKNFQDGPRNGSTRKIASVREVGLSLKVGPFRGANDIQDAYRTLGGGQRNREHFHTHNCVPTCVIGLARWFSP

SEQ ID NO: 1011583 - protein, 121 aa, Homo sapiens
RAGRGLSASARSASGPGPPATSARGGRGAPAWARSLPRGGRARAGVSRAAALLAGILSLISCFFSFLGEGRVGLDEFVSGSPDEATLGVPALFRGSLGARLGKGVVFAWVGDFPRSAGDHD

SEQ ID NO: 1011584 - protein, 250 aa, Homo sapiens
RGRAAGAQPCLPLCSLSAPGQFRDPTEAGGRSEAVTGVGAREGVGGQAAEGGTLKRAGRAQQSRLEKRGQQASGPIKGKGQDSPPLPRAYPSVRTQSVCFGMYELWIEEGEEERMMVLGSLGFVILFPVCLSVHEHMSSRRHKDRLAGKTPKPSSQHSKLQKHAALAVSILKSKLALQKQLTKTLAARFLASPSPTEHWHLCSARGPCASGLALQQPLPLPGPILGPALFRPQRSCPPAQDLSSLPLLAS

SEQ ID NO: 1011585 - protein, 275 aa, Homo sapiens
MAYSTAQRARRAPCQEVDGVATNRYSIGGLSPFLEYAFRVRAGTASGRGPPSEAVRARTGEQAPSSPPRRVQARMLSASTMLVQMGASRGAQRLVRGYRVYYTPDSRRPPNAVAQAQATDAGAPQRPWGSVNPDYAWQWVHPCPTCSGMMGAEELTKEDEMPVGRNVLELSNVVRSANYTCVAISSLGMIEATAQVTVKALPKPPDDSVVTETTATSVPSPGDSGELGSLVTYYVHYTIGVRVLAFNRRGRWASQTHTSGQTQRECWPAGDSGKV

SEQ ID NO: 1011586 - protein, 76 aa, Homo sapiens
MEDRKGPRKSNGDHITQENIEVHEGKTNKEEGNRDEKLPMGQMEPNYEPCPRHPWEQAKDTRRGWKYTRNTLRKEN

SEQ ID NO: 1011587 - protein, 135 aa, Homo sapiens
MITLGKVGAHKVGYTRDQHTPEFIIHQSSRRRAPTTRAMGGLWRTVQPKYGDEDGPHGARVWVNAGHPYPVRDGHSLSTRARKDQRHRCTYYWGRGTLPMSWKMATGRRTTTQVSIVEIDGAPLLPFIQGRRKKA

SEQ ID NO: 1011588 - protein, 115 aa, Homo sapiens
MLSAPRGNHVDNAHLGPHETVSVLKIHVVLIHHFSHGKSGGTAKPDYFNYLEDMRIRIFRCHGAEDSLILMCGEPGIPSWLSLEHQTHVYLSNSKNMGKVVQFIACISITWSRTC

SEQ ID NO: 1011589 - protein, 132 aa, Homo sapiens
AEVPAKVTGSNRRAKMAAEEGVASAASCLCGRLCGHLRPCGRGSTRLLVGCQSPPRRMGQLWLPGAGLRTTWPGGSWGKPLTVLGSGHALPINGCFFFFDALCAMPLGNGGESSLRCPWDVGPPYHGTTIYH

SEQ ID NO: 1011590 - protein, 148 aa, Homo sapiens
MLVPVIHCCSVTCMSAPWLSAPRSLCGKGTAAFSPSASFIGTETRNSRNPYRERTSLISDIERDSETRVDGQPRGAAIAWPEKKTRSAVPASTVLLYIYAASCSSGSQHLADSISLGTARISKDRVASKTSESDHTEPANTNGHEEPG

SEQ ID NO: 1011591 - protein, 112 aa, Homo sapiens
RGCPGKPTAAAGLRDAASSAPRVMASRGAAESPKCEGIKLSARCQTIVSPDLPGLRCGMVRVLRSMCLPQSLQQHSIRCGQEPPCDRAENIYVKTWPCEASRFFHLSIDLLR

SEQ ID NO: 1011592 - protein, 109 aa, Homo sapiens
RAVLDFLLLQDPASTQSIRARRNSGAPYGLGAYAASEQLGSSSSYPVDGPSGVKLTAARAECLGPESLSQEPCMYAPLFVRTGALIPPYNMRLRHPLPGCPMRHCQTSH

SEQ ID NO: 1011593 - protein, 182 aa, Homo sapiens
MTRATTRRSHSHRAQDLSPLQTRLYHSRHIHLSRSIPGRIHILTHTKHLYYTPMNSHILIIEIPYTRTQKTYTINYISRTSTIIYSTVYKYTHYTALDPPNYHTYHPPSAPHYFQNDTPLPKSTPQYSQTKSRNLHYTNHTTTTYQHNVSHILSSQPSTAYHLPTHTTYYYPLTRSHLQSFL

SEQ ID NO: 1011594 - protein, 247 aa, Homo sapiens
ERAPRCGSPGGPRCAAPAIPAPPACAMDGGPSAWAGCSSPEDAMVTELLTPRGLQYRFVENIGLKGPREKYEEDEFHDLQMKRTWARRYPKGTRTCTRSTPAAGAPTCNGQVKAKLAGGDSDGGAAPRGVPRDPRAHLRCDDVALLHGPCMPPACNLHIPVLAANPEAPETQRGSMPHVSAEEVPAKRKPYHTPGFVRMIPDIEIQESSVVVTTKYTNSGQKPSFSGNPSCFQRIPGAQFPTRTPGT

SEQ ID NO: 1011595 - protein, 114 aa, Homo sapiens
RVSEEEEEAWHVGLWLLGECSPARYFMISRIACDRSHSLEPLMGSGLLLERDIAREEVTVHVALCFDIDNAFSMNMSEYVRALEGQGRNLVVTYHAVTQCRQLAAGMPARQKQV

SEQ ID NO: 1011596 - protein, 138 aa, Homo sapiens
SGGSSEEGIARSCVLDSQCSVEGEGSVFCFLSGTVRRIRGLAPPGAIAGLEMAELGGALFDLELLRSFHGPVPGAGQPVTLCVASTRLYECVVLEHGLRGLTPIFRRDSKTDEGTPSHVWFDYALLEMNLEQLHEDKA

SEQ ID NO: 1011597 - protein, 139 aa, Homo sapiens
RGSSLAKAAEGGTNQDRTVTVVESPRSRARVEITASRYEGRRLVESGAKFPSGIHTALWLSRLQYLLEYKYLVSQPIVKKDELAKDSSGFERKRYIAELQKGYLILKEMFLLLIKRSFWYPEVTSVLLSSFDLVTDPGK

SEQ ID NO: 1011598 - protein, 208 aa, Homo sapiens
RADDVRGEPRRAAAAAGGAAAAAARQQQQQQQQQQPPPPQPQRQQHPPPPSTAQHGRRTVGPGADLHLVPPLDGERSGERRSSAPFLKVMPGTRRGICVVDGFQSFLGQDDTAKYFGLLSMPSDDYYVVWCVTSCTSRLSNPQDISDHIMKRRHSSSMQAAFGRSSHLQYYPCLPFSVQKQRRQCKWKQPFVPVEVFLSASSIKFQVV

SEQ ID NO: 1011599 - protein, 293 aa, Homo sapiens
AGAGLAEREVHEANVSPQLSGRLQRGPSKTSPSRQIQRITHIAGTEVIVPTRALPSVSEIIDCPAVPEGAHMAVTCDAPQSILAPSTGDVLSPFPLALVTFRMSCRPGCWCNECSGYYQVAAIPQETSSRRMDLQSARRPQGQSTESFPESRKTRRSWRAYLGPAENLALLLVSSELSSPRGWGEREYYLSDAGNLRLAINLGDTCTQSQQRPWRISLEKPHISVVPPRGGGYGTGGWNVQLRWCRDKWARACCPELELGWATRGWREARLCWAGCGRTRAPGVQVSLVHFRA

SEQ ID NO: 1011600 - protein, 129 aa, Homo sapiens
MVAYYPREDFVKFETYREFEPLHVNYTPCDTYSDHMIWQTQICCVDGQSVCYALGCQYSRPWVDIEAYDLRGVFGLVYILCGVSLYGVIDLVGKPTVKPWLHFIQNIPLHTGLELKPKVPALWAKVHNL

SEQ ID NO: 1011601 - protein, 153 aa, Homo sapiens
AELDWITRPLPRGAWLPPRWRTRYGAPLRKSSRESGQVAGISEEASGAQRAVLQRLMVPCECAQRRRGDIRLPAEFRLPCQTACVYAEGATQELAEEKRTGPNLTSSERPLTLLITTSSLEKGPLTGKKPEGERRNSPPHGGRVLPLPVNVSS

SEQ ID NO: 1011602 - protein, 165 aa, Homo sapiens
SGGGGGADKGTGGVEGGAELSVGQVARVVDVEARVELYVSCVSVPWTGLAEFGCTVAAVVRCGLWNGISGLCACRGHGWRRGVYVRGASISVPCDWSDVRRGDPRSVCIAPLFMRAWGLGALGAWACRRPQLRRLMGCASVEAVGRALFGRAGGSSRCGWLRKLS

SEQ ID NO: 1011603 - protein, 164 aa, Homo sapiens
SRHGRILYKNPLTSKHCMCSCEPCLLWLLPFGLPHAQPPCEPAAPPYDYHEMLSVLGTLAVVLQDVPLPLSSVQCTELSAALFSLSAYVSIGRTGQWDGVADTQFLLLGLLPSQGHLEAHDNESSSSTPESALPKHRSPTHPRHHDSLALEVQVTVYSGRKALC

SEQ ID NO: 1011604 - protein, 119 aa, Homo sapiens
REYEWRERAELVVVVRVSRNRYALCQHGLTILNSESQHCRNFNQNAFLAVLCTREWVTGELVSTQEDVGEPVTEDLWAQKSAHEAQSYRSSDLKSNVRVLDAVTLGSTFELPLEFVVTK

SEQ ID NO: 1011605 - protein, 149 aa, Homo sapiens
MRPPQAPVSGKVFIQLMIVRQWHSAASCHDQGSLRSWRTGLIGSSLIETVLNSNSKPLCTKHEQARRPVISRRFVLACLTAYTIFRMPWKLIMTKVLKKVSEIRFTEQNEKIYAPQGPPPCTDPIERGLRGYLKVTILLKTRAHAAVER

SEQ ID NO: 1011606 - protein, 235 aa, Homo sapiens
SGIGGQLREGRFLPCSRLSSAAPHPSPAVLRAPRPGSWSSPSRSVSLLGWGGNRQGRKEPRPDNRETDRSPEVSASLRVSIHRRGAASPCCKSRTRKDEEERRKGREARKKPKEGKKKAQNGEGRPRGGKSDGHTGRNHQGTTDGKAEQQNPSRSKEVKSNKNHGGRTSQVAVTGALPIKAKQQGPTETDRQERLSGKNQQETTDQGRDGPQKAKLATQQHRSPGTEHDEENKEP

SEQ ID NO: 1011607 - protein, 69 aa, Homo sapiens
AGPVFRSPEHLQLAHSRSPGTLTRRTRSAPAEGRRQYVATVRLLPRSLIRACPHAPDGIHAECSTQSPD

SEQ ID NO: 1011608 - protein, 111 aa, Homo sapiens
MVTKKLRYRKSMHTTIQDGRRSPHRRTQDWRHTLCEKTQSRTVHNIPDKKEVHLTRAQERTAADQEIGTPKVTSREHCFMNKIPAAEATHAGREQPGKDPHQRAGPTEERE

SEQ ID NO: 1011609 - protein, 74 aa, Homo sapiens
RAFWDYFFTVGEGSALNEVLRAKVLEVPNLFSYGLSRVKTLRLIGLVPQGHQARRGYWTPRTHFVCQRGPKGKP

SEQ ID NO: 1011610 - protein, 284 aa, Homo sapiens
RTVPPRSRLREAAAGGAGHCLGIVVGERARDPLAETRPGTTLSTTNYTTMMPNEWGKTNGKPEADHRGERERQRIHDLGTERGHDELKAEMAGNKDHAETHGTKKITVSPIRRKKHGKTTISKQAEGAVMAEAQYHERKGNETKQWEQEAYQAPYTRQISGQGDREQAKERSQKERGNTGRGRTWKRHEQEEEQTRGNKPAYRKTRTQTRESPETHTKQQRDELREQTKAEVRGRNGNTKDDEKSTHKQNEHGQTETQTQRRDEEQDTLREGRRTQKTIHKKSL

SEQ ID NO: 1011611 - protein, 106 aa, Homo sapiens
ESSKPRAVLKPRRVCVGGKRRRDDISVDTLGLHQEDPAHGLATRLRTSLPLPEPTTVYIFQDKVNSDMHYGMCRSRAMPPSLMQVIPDMTFTTVNARRGSKVTGTD

SEQ ID NO: 1011612 - protein, 83 aa, Homo sapiens
SGVSLTGSKWRRLLQRLLLCEGNNTSSPAAAAGGGGSRSTIPSGMGTVDRIMIYPWSTGDAPGEGGSKRTEEAHNPTGNSRHT

SEQ ID NO: 1011613 - protein, 101 aa, Homo sapiens
MEKQRGINRRRCRSPAQRTDGLESGRLLQVLYLGGWCDGTQKARPYSANDYIAGVWETQRRPDERMPRCCCTLEEEHFSLVARRTWWERRPMAACQSIKGP

SEQ ID NO: 1011614 - protein, 101 aa, Homo sapiens
RRSLGLGLGVGWGGQASPPTRKPNIIPGRRKRNKNKDVPMTTKRGQKREDIAHGVTRASGKHRDKRKEREITRTKEEGQKQERDKKKQRNNEISEKGKKKR

SEQ ID NO: 1011615 - protein, 150 aa, Homo sapiens
MSLVSNLTHRQHTPSTPTPRHNQQSETLPAKSFLPPTRRGALTNDPTQTCGRPNNYIPHDTITPPPKHNSPSDIPSQLGYHLLSQTPYRHQTLCVTTHTPILTTDFFLDEHQTHTCPNVTPSTNKTQNNDLQLRLTSQINHHTYHDSLSA

SEQ ID NO: 1011616 - protein, 79 aa, Homo sapiens
ADAVWQTMLMCVMSGSQVTSILGNAVQALSRISDEFWLDPSKKGLALRCVNSSRSAYGCVLSSPVFDQHHQWSALVQNE

SEQ ID NO: 1011617 - protein, 73 aa, Homo sapiens
MCGVSLGPWIPSHRLIMHLTPGHFGVVYHGEYIDQAQNRIQCAIKSLSRITEMQQVEAFLREGLLMRGLNHPN

SEQ ID NO: 1011618 - protein, 229 aa, Homo sapiens
REGHVAVDHLEIRRPCVDAGAAAARCLVWRETQWAALICQRISVTASGTRVAGRHHVDARVEIERSYFCAPPIVRWSYSRERARSSLRRRSRLYGRYLYRKTDNMRHRLRTKFETTHEPKKTSRNPTRHRITQPKQVRSARIRTPLSMSRTYGTRSGWAMGQGRNINADEPDAQDRTVRNPRARGKTKHRSSCGEHRSEYPQDESSTAPGRKSSSEDRKAHARRNPEGT

SEQ ID NO: 1011619 - protein, 230 aa, Homo sapiens
SGAASVTAAAAAAPPWTPGAPRAAEQLAPRPLEPRELRELRSASRSASLPLPPRAGDAAPTRVPRWSPGRPDCCSAEAACAGGGVWAAPRNARCKSGVHRSLTAEHRTSDIIQDWVLTHEEDNHQYNKHKPWLEPTYHGIVTENDNTVLLEPPLIALDEQMRLCDLAGEISGSNIHGQNVHLMQLVVDKSTGDAESFVPTENLDCELQNRLSIQPSRPNDCGKGPDGTNA

SEQ ID NO: 1011620 - protein, 173 aa, Homo sapiens
SGVACAPQPDGPPFGAPQPCHPLLVFLFSSSLAPLTTRSRAAGSSGPHSSPRSGAPSTAFAPPGAGRELLPAAIMSTANPETPNSTISREASTQSSSAATSQGYILPEGKIMPNTVFLEELDVRMDETEIRSFFARYGSVKEVKIITDRTGVSKGYWIQSSFPNDRGMLPEDT

SEQ ID NO: 1011621 - protein, 106 aa, Homo sapiens
RDHLCEQQVAGLCPYMDISYAICGSYQIVKSPIEDLVPHNKCSSEVWFIRDSLVSVAHAGVQCSTDSFLQYNVIDCRYNNMQKWRGLGRLMPVIPASLGARGRGLT

SEQ ID NO: 1011622 - protein, 109 aa, Homo sapiens
QWRMQPALARGEGMAVGCLCRAAIMDEDYYVERGRDGADEAGLACQQEDDSGEGEDRCGGSCKNACLNFPPGDYIMEPSYLQHSEEVFQGRRVSRRMLIPALNLDKSYT

SEQ ID NO: 1011623 - protein, 243 aa, Homo sapiens
AGSSCTPPSTLPQPRGTQAPDTRSVAREKWIRHHTLWIGYCGPCWWGAGGDLGRQASRRPGEFSVAAPIFQQDHMIPGSRLGFRQRRLVLPEVECMASRVRMNRRQCVHGAKSYVVWTPLVHRSIGLVRQIQGTSYPSISEETRVVKTLETRCVLAMRQRGITLGLSYTACAEVLASCVDMHPILPGVNVVGEEQLIVTEAMVTAAVIVSRSKGHVKWRSLASAGPFGDSWSQHISNDVRKNR

SEQ ID NO: 1011624 - protein, 142 aa, Homo sapiens
RSGWGQHRLAPVVEARAGGGSSNRRPCASLLCGRRRRGAGRASGEQPLFKNLRPNPGKNLWGITSTAVRNIDGSINNINLNDDERTMYVDLARLMHVLNKLLHRILSRIQVTVWKFHTKDPSSPALAAVNDILNDVCALHME

SEQ ID NO: 1011625 - protein, 246 aa, Homo sapiens
MAEKFDVPRTCMGSLAGEEVCAIRMATTVCLKCFDKFCANTCVEGREGRNRVQEVPNGRVHLIRNPHSWRDTLTYRMDANVPVNPLDQLRPIVGKDNKILCKKCYHIGRISHSSARGAVKAVVAGDRNVEYKGTCLAQQYCIHAVSNCSESSGLEASSPKGEDFQCVTCHETKLPSMREVQQGITSGGIHLPGISPGMPDGECGTWLYEAGWEPVTAVEEPRDGGMRQTTWATNGREAKPHQGCEG

SEQ ID NO: 1011626 - protein, 129 aa, Homo sapiens
SGDASWQGDGGVAAGLVALDDCFFSYMRHSLPPTSSSRKELVLRDSDQRLLFLSDQRYQPEIREDTVTPDYQRDEIMTITVSNERLIIELCSVLVKTWDRRSCNGRSLGHCQNMSVTYSLIDHPWMRHG

SEQ ID NO: 1011627 - protein, 179 aa, Homo sapiens
MVPPVDPHGYYWLARPLSASMYDWMNASLALVLLECKLGPYMGNLRGPAVCCLDAPGPFNGVHSDLAADALVNLGANVVLQVTRGIQLAAPGQGCVQPWSTLGITSDEAGRTERLDCDQHGVRRRCPWKFPGNSLGMPPGALRATTTGCCNGFAVAKPRWYQVVKRGGTGGCLVKKEDT

SEQ ID NO: 1011628 - protein, 270 aa, Homo sapiens
GDIARRSEAVREGDKSTALDVLATAAGVTHDSPSPDSIATISGRRSITWIDADPASITMADLPAVAEVIARTGARMLELAQASADAAALKLVDAHRLLCAHREGPYGVDEWSQRMVTVLSDVLPGVGQGRWVLGETAIVTHNLAQLGVNNGDCGVIVETRPVPTIALPGPGGVPRRLPCSLIPSLQPLQAMTIHKAQGSQFTDVTVVLPTPDSPLLSRELLYTAITRAREHLTVDGHNGLLCKTATGPGYSIDVLGISAGGQESRTSRLR

SEQ ID NO: 1011629 - protein, 210 aa, Homo sapiens
MKAHDISMLPTGSFAVGLALRLLELYRAFAFFCRNSHLLIKGRDSVNKERIRYVAVYWYESDFHFFQVYTELLTRADLSVVFMTDVMIYSEASGDHQSVTRHKGDVTSVSSILDKILRELAVKYEGFATLGASYRSYTYRARTPHFITGGSGTVLKRLADLRAFDMETRPDVPKVQGRIAPCLKLSMKYSRGLTRAPEQPIPRGTSPRIS

SEQ ID NO: 1011630 - protein, 94 aa, Homo sapiens
SGALLWASAWAATLQLSTRPGPGRGGVGRGRIRSSPRIAAPDKLRQDPRVRLAAGGCERSWGIRPGLSGPEAGGTQDIPAERDNDNKGAYLQST

SEQ ID NO: 1011631 - protein, 333 aa, Homo sapiens
AGFAALLAAPFRCLPRLLSPVSVRRCAAPHRRHPSSLGSCHWQPMLNGAGHYLAWSMLTRPSCVSTTVHSWVQGLQGSVLIPREVEACCVRGPRTPAELEMTHELRFLLACMSSRHGRNQWALDSSSYVTVRAMEMIRGSPHKGEDGQAHCSALPMMLAPQTHKRMHSNYRSSTCRRHGATEDRHKPLLLVVSPWMPPWHHQGLGAALQLSFHGGTQVPLIALVCGLDCLCLSQSMDARRVSRVHSMVHLAYREWAARHSLLLPGPKVFGDSIHFPPNHGVGRGPGWVGLTPLGPATWVKGAGHSTWCLAQAYALPGTYSYATFSPTPCGLCQ

SEQ ID NO: 1011632 - protein, 141 aa, Homo sapiens
MSKEERPWSGGRSVECQVMWEPDSKKNTSDVTAFRAGCGAAACPAIGPLETLVMTCTIGPGLSHMQTSGQSSWQNSVELSSHGVYDEGCETTFEKRICQMFRRRWYKRQVGSAIAGNTSCRHNENDRVAINVAKGRQNRKS

SEQ ID NO: 1011633 - protein, 121 aa, Homo sapiens
RSCVPAPAPCAPLLRTALPPSTRGSPSQLGGPPHFCPSPVRPPSSPTRLAPSSRGPRCQAVGAGMDCGGWRGPRIVTPADELPPDGGAGRTIGTSTIPGSTGAAKFAQDVAKRRVIPNVSN

SEQ ID NO: 1011634 - protein, 105 aa, Homo sapiens
MRECYPGRALTPKLRGEVIITQNKRPAVPCRNVKYSETFTRSVVYQYLNICREEKEVAQKILSIATKRDLRAGEASATTVSSSREAPPPNSSFSYQSSLIPSSDT

SEQ ID NO: 1011635 - protein, 135 aa, Homo sapiens
SGANRLGPSRYPGGLLYLLFAIDLVAACSLGPHCLYELITLPAEVCSFMLEASETTNPLGGTNNSKRATCKSCNTPCEGSVASLLKSARPGTHRKESPDTKNCNTHPRVCGFILEVSEIKNPPEGTSSGRAEFKQ

SEQ ID NO: 1011636 - protein, 98 aa, Homo sapiens
RGSLATLWNCFLSKWIYNLSNDKEEVWKQYLELRKLDTAPVETSALFMIETGLFNWKKVRKKHRHGHIRREKRLLVAWWYIANGSIKARGVPGSIRNT

SEQ ID NO: 1011637 - protein, 89 aa, Homo sapiens
ERSVRVQALQDLGRVTSAALLPVGDSTWHWTSNMTRRMDVLAQPNNKLASEQHWGNMPFHTLTWALYTERRPWAPHFSYTDGTTNADIR

SEQ ID NO: 1011638 - protein, 207 aa, Homo sapiens
RGRELLRQGHGLRMHHLLGPLPLRALPMAQYVIESDLHSLVQLVLHPIPYSASSACCCWAWSHSFELKPRGSGPFICAGRADSIALRRERHSCGLKSCADPVPMFFMTTYLTQHAWSVTRYIPTIAVLPICKVGSVPPDAMEEPSLKTSQDGSLRKELSYQACGAFGNPVEAQSSRVSARDNADQNPLPAFHVGRKSKLTKVRQEGG

SEQ ID NO: 1011639 - protein, 197 aa, Homo sapiens
SGAVAAGSVVDAVPLLVAGGGGTRRRRDSAQCALTSKQQQLASIRMVPPTGRSTPASCVHVSPQLTSCVFRPFDIAAMDDQNEPKTQELLRFVMGSLRSLSLALEDWQHGGASTRLTGHYGRHVDEVTLGSINLQTSIALKFGMRISYHSDMLGLALNWVNLGQTRCRACALTVHLGIVAYWELGSLRDRHIWDPGT

SEQ ID NO: 1011640 - protein, 368 aa, Homo sapiens
MRVTAPRTLLLLLGGAVALYLDHPGAGRPELAVRVVSDIRPLFPGPGSVAGSSRFHRSVGLSWNGLLLFREVQNMRSAVEIRTTRRPVVRPWDWEAKSADRQYCENRRRPTRILTKVPTCQPELDPASTVTPGEDPRASGHIHNGTPKEQQSLPGSATKALTKAKDGNRECQQMLEEAQMIEENGHVHIPGKEFTRSHMCTALPRRQGQKGVEKQKRDPHRRNRERNPGKGYPLGNRRHRRETKPVDRELYQELRSTLNGQHTGRAKWAGGTQCKNGRQEQRPMAVAMKVTGIRPGGKGEAAQECIQIGHSVEDFTGQEHVERRREHKNRRVQADTKRHCNKPMGGESPHGTHTDPYTVGDTTSRNGP

SEQ ID NO: 1011641 - protein, 116 aa, Homo sapiens
RIFPSPPLSSRLSRYPPAARGSSVVFSRLSPRSGRSVFPPLRLSNFCDVGGTAPCPAAERRDCELRHYAVTMQLTGRAHLERRNCVNSGGEWIPGGKNMLCSRSLHAIGTRLSHDV

SEQ ID NO: 1011642 - protein, 101 aa, Homo sapiens
MEVGLWVRAYLDLRARGREIVLLCSGKSVGPSIRTTGGVEKAALELLHGRFGGGRQGVGVNPLPAVEQLVVAWRGVLAENDRVCDPEIAPEVVSVQYGKTR

SEQ ID NO: 1011643 - protein, 215 aa, Homo sapiens
MAESFGREKMSLKGTTDDSWISGKGLVYIHAEDDSLIHFCVEGQDVRERGRRLESSSLIDCEFNAGAACAPAGRVQRAEVSGQGPSRLFFWHAGIPKTDQDEDALPGDVNEYLNNTADAWMHMEGQRKTAATNSTDGYGGEGGRAGGLMGNDEATDMLMQNIGPCRPREDWSRGWRALDLDLGLDNINWRKQMEPPREACSSSKFTLDATVGKRV

SEQ ID NO: 1011644 - protein, 132 aa, Homo sapiens
MAWLPGQKVLCILVHRNLNIPEWLLQTLGRIMNVMKNLFDELRSHQNQTICSHCIAECYQSSMDTEVYEQEILVTGIKGSRICQLPMPQGGENSASRWCCKFAKTGLAPGVTQKLSPKPWWFSVIADVGDRT

SEQ ID NO: 1011645 - protein, 96 aa, Homo sapiens
MFSCRIWFGPFPKGPLCCTSDVPPQRWRNVGAPAIAFRGDRGGDTARDFCLALVSLHTHPGECVGSPPFRFWSLKALSARGPLADILWHTPGGIDA

SEQ ID NO: 1011646 - protein, 130 aa, Homo sapiens
AGLLRSLPPRCPLSRRPAPLSGAQSGLEFVERPPPSPLAVVLARWPLPPHAGRCPRDAPEAMVLPPAPAKSPPCLESRSVSPGWSVVEPSRLTDNLRPPRIQSNISRHQPSPEYLRNYSAPSKPSTRHTF

SEQ ID NO: 1011647 - protein, 130 aa, Homo sapiens
MQCESSERFDAKYPDRVPVIVEIRSQALIIVDIDKRSTWSHLYIDLCVVQFMWHRSGNRGSRFPSEKAIFLFVDIDSPINDPGLNVVRTGVIRGRTRTHERLDSLYMWHYSVKSNTFRHSEGQLLGLGAP

SEQ ID NO: 1011648 - protein, 106 aa, Homo sapiens
MLTPNDWGYPGNWAPGVESTTFSGKTKATGTMGQAHNEARTTHGHQGKARRRNTRRPEGTRSYGVLKPKIPGVGTQDQGRAVARTDKKSTTHDTAQASTNTRHSAP

SEQ ID NO: 1011649 - protein, 158 aa, Homo sapiens
MDIPGCLLYTKTGSDPKLNHHTLQIISTGFPAMASALQLCIPEQIIMTVYDRISRKAVGQVYRHCQNQILYCIPGTNRRSSTLAELVNVTYEDVLSPGDETWVGKGTKIGNLDLVFPKVSTGHTTKKGPFHNPEMVSQMHTPDGQKVHRYGPTNESHK

SEQ ID NO: 1011650 - protein, 89 aa, Homo sapiens
MESDEVAMAAFKGMPPLPNDPETRLLIGTSRGEGTQSENEVQVGLTRSAETQSQHSSPEYIKTVSTIELRANVAFRFDDSPELSKSAGI

SEQ ID NO: 1011651 - protein, 33 aa, Homo sapiens
AEPLAAAATGSRGVSSRTWEAGFSLLPVVIAAR

SEQ ID NO: 1011652 - protein, 107 aa, Homo sapiens
MSSTSVCSVLEVQLVGDTRVTGMLLPSRFRASLPAIGLLGQAWDFTMSDNVHTIATVLNVVWYYIKYQKNRKVFVNTLRVNTPFDTSLPKIEVIRKKPRKKPYSNFW

SEQ ID NO: 1011653 - protein, 403 aa, Homo sapiens
RELVNQRPAPRSAVAALKKPGQRTCPRDLQTCATGSALSPVDALNASASPHTLPASLQSMWLRSKCCIKCLGGVPYASLVATILCFSRGCPYILLAVVHVALAGTVVILEKDFSTKASDHALLIEVITCCESCAILLLTLRRHPFDLTRHWDSFLLYKKGRYRHRPKVPVEKRLVRVEVGQTYQLCWARIAIHGGNVVASCCFSFKRLICCRLRTVGLSAWRVVVVRVISTAWGLAPGRWYFFLLQNHYWGQALVDTIRFHTFNPARTHSGGQPNKVSVEKGPGTTCLDGNFSPEAKITRAYFGSSPLGRMVVIAALVGTPLYGVVPVLALCVASTPESVPTHADTECSYPMCAFILSQGRAIDWGPWLVRGSLGVRPRRCSTLSPPVRVILHLYVESSETLV

SEQ ID NO: 1011654 - protein, 91 aa, Homo sapiens
MRTTCGYLPIILSRRNSLKCGKRIGGRRNEFEYNHWFGGTSRTKLYLGGKPGEPTRVSRQKQLGDCPPRDKAVVHLSPGRPTGEFPGVTTL

SEQ ID NO: 1011655 - protein, 213 aa, Homo sapiens
MSEQLHWCLLLGISYFYRLLVCEEPHVCATEDERHACMNICIAQVKGEIPDAHYRYREDHDCTMTVGKSFKNDVTGYRHNMSLQTHPPGFRMIAYQGKGDIMDPNRIIAGLARRTFDSTHIVVRKKLDNAHDAQCTSHAADFHGGKVDGREVEGYEGIAVNRTACDSASCVNDGPTCSEDTTPPVHKGQLLCQQPDHCNGLQKPQEPWRGTLP

SEQ ID NO: 1011656 - protein, 145 aa, Homo sapiens
MGLADVENGTLVVSGFHVKRRREALWGRSKTDHVPDGLDLSLKASRHWEQLHAGTTDALVGPALGMVEQGEGLGTIRCDDRLAWVSMHTKGSKEAVLRVKCPRRGLTAGRRKTCPLRRSIWGRPPRGGRSQARSELVYGRPRGNS

SEQ ID NO: 1011657 - protein, 168 aa, Homo sapiens
AEAPNTGASAIGYVVVLPESLHRILLVAYSCQLLEDSSASLCNEPSARPRDNSLREMEREQRKNLEHVFMCAASCSVASSTIAWRWKSCSQCNQSDRGHIRIVDSRSGDMVMAWTLLYSTPLMHHKRNKRMNMVARCVFGECVRPMTSLHRDNSWRAKYSICSTGPFA

SEQ ID NO: 1011658 - protein, 245 aa, Homo sapiens
AEKPEEPDRVLAAASSECVYETMCCYVCLNKYLTCTFGESFAIKCSGWIKRLIRMVMSIKLEYACNQCTFGLGSHMVRLEGIRRGKIGTNWSLHSVSNEYSLQINYAMQQNGVPATQERMQLASVMLTVWMGSQTKKESVSARLRTTRSDQEASPSDDLSFLSTKAPKQSRFPYHDWVYNEEAQPEDPSAGQMRKPLQEMIVRSRKNELAASQRLRLPELLTQQEHAKFSLQVDLDSSTFGTSTT

SEQ ID NO: 1011659 - protein, 148 aa, Homo sapiens
MTSADVNPKAYPLADAQLTKKLLDLGSGTSCNYESSSGIGRQSRPRKRRLKQGHLMSIDWLEDRRSHWDDHVWHSAASCLIDEKCSPNVFDAAPSQAHGETPDAGLPGTVMRTVLVTNQEKRSLSLKRAGYRSAYSKRVHSEDGSYRY

SEQ ID NO: 1011660 - protein, 95 aa, Homo sapiens
SGSLARQCWQRSGRAYSIGRPWIVSTIAEQHAGVQSLVLGILAGMCGTSPAAPSVPRESDMGGRVDANLQQCRLHVWKAMNSRKLLLSLARFHQT

SEQ ID NO: 1011661 - protein, 144 aa, Homo sapiens
ADIESGTGRRREPGDGDSGSAWPQEGVMGKDYYQTVGPGPAGASDEEINAGLPDCQALRYNPDKNNGARLPRQKSKGRSAEWPNEGCSADPGDKAAENLSERTKRGQARALKGVEVEPQVWAGNAGPERVRPKWDSTILSDITD

SEQ ID NO: 1011662 - protein, 193 aa, Homo sapiens
MVAGGCSKVLASTLLTHRLCALGVMVVDGKGSSKAHNGPNDEDTLRIFCHLSRLYCMLEQNVVSSWEGVNTTKRVANRASRPWELTNRGNLPEVRCAYFDAWDILHAGTRILPPLVHCVGLEARWNVPCVRPMQLKTGIAVTGQTLAELENTERLGGRTEESNWANEEGRPGEGRQNEDPGEAGGARELPRTN

SEQ ID NO: 1011663 - protein, 70 aa, Homo sapiens
SVGVRWRGSGGGEAPVWLSAGAWRERDERRREPVGLCDCSLGGQQMAVYALVCPGWSVVASSRLTATSAS

SEQ ID NO: 1011664 - protein, 70 aa, Homo sapiens
RGGSRGRRIQTILANTVKPRLYLEVQEIGRVWWRTPVVPATREAEAVEIAWAREAEVAVSGDSATALQPG

SEQ ID NO: 1011665 - protein, 246 aa, Homo sapiens
SGSPARNGSTMLYVGVLAQQAGAAGGGAAGRRRAFRHCVFVEDRGRGCATEHGPHHPTRGAEPEAGRLTLTEHEALTNKLQLKYTYEHEQMNNATLDGGRCFIQQAENSFVGLSKKDKSNEVPEHLGLILFKDYAVSTVPVADGYAFARVSAAWLGPNLICNWALVNLHQKALKIMQQMSDHRYDETSLCPDDIASKTCIYLNIPATKGTVSAGTEPRKSIQKVQRVHRESWNGTNMLRYPAEAMV

SEQ ID NO: 1011666 - protein, 205 aa, Homo sapiens
RGAQPGTCVSAGLCCRTPGCRRGVGRPRASAEVQRCPRGHCACCSCSVRPCAAPGCGRCECLPAASSAATAYSRHGCTSVLDVSPGFRAHRWRADFCFAPRTRRQVGGGKPQSGETPARTLRARAPMPVIAQLAGWQVGSAPKQHRSLDAWDGRNRHPPAKPGDPRGPDPFGTQGTHRDSFAGPGSLTSPNVDDFRNHIMTSMYT

SEQ ID NO: 1011667 - protein, 198 aa, Homo sapiens
MSPREHGGEIHSRPHSSRPVLLSKIEGHQDAVTAALLIPNGGRRDHGQRGQNHPGMAEKRQWSLLGQLYNHKGLLPWLRLMRFPHSCTREHGIYVCAQDKWQRVVEFNVPEDFNNHETYITDLPSSIMNRVSAISFSLATECLDQYRPRQSVCTLGCCTPERAHARAGHFYTSWAIVSAKYDCDTQLCLPVGDYSWAA

SEQ ID NO: 1011668 - protein, 229 aa, Homo sapiens
MALVRGGWLWRQSSILRRWTRNWFALWLDGTLGYYHDETAQDEEDRVLIHFNVQDVKIGPECHDVQPPEGREPDDGLLTVNLREVRRTGPLLLESTGLMPYAWNDYALLEAKCPARCRVYTAYQDYYESGAPPKCTARATYVPQATYRNATTQALDVDSTVIVREDHCYRQPDAPLAMGDALPVASTGGGAWARFMLVRPCLVLSPGTRQHLIPCAWMADSLFLREPIL

SEQ ID NO: 1011669 - protein, 241 aa, Homo sapiens
RTLVSLWRRGRGRILASTDVRVAHSQYLLLSGAHAWSCVCAGSCGAGRGSVRRCCITGPVGRVFAAGLLLDPCGLPVPVGVAATREEASYLLSAPLKCHSESELLVQDRVIAMNEYFVSYLWELRCDTQFNRCTSEIRFDPSALDIPVDSQIEPMFLRGENLSRPEPTNLGIRLTHLPNGSTNLGTGSKFPGLDAKSRTLACWWMPFSVYRDSGRDRRKGKDAYFCDTNNASEYSTILAEI

SEQ ID NO: 1011670 - protein, 79 aa, Homo sapiens
RRVGKGVSGGPGRVKGSKGEGGTGAELKGQDGQRSTTALQLTGYLDCAETMERSLEMALRTPESVYLLLLTSGQEQEGP

SEQ ID NO: 1011671 - protein, 200 aa, Homo sapiens
MVGPAGPSLQPSLIDAAHPRLVTDRARSFYNVCEWASVFEPRNLQRINAGSPSLLLQGLTVKIKPQRRSQVCSNDFHWLVCLSHLATEVYAEPDGDRVVYTGTYDTEGVEPNEEVENGNPSRSPMPFTDIGTFETVWQVKFYNYHKRDHCQWGSPFSVIEYECKPNETRRSDVGEQGVLPLKVALSDATGQSFQNIYCFR

SEQ ID NO: 1011672 - protein, 219 aa, Homo sapiens
MRLTAVTRRLWEPLAPKKNPAEMLAEQPGETEFEMTGRTSPWYDHQDLQQDLQPCCLTLGGRTSYLGSGTQSQEDSGSADCSTSQLRSRLQGKLSSSGRKQDGDCATGKMKRDKHANRVYGTNCRRSTSNSAHPGLKHTHTLTHQAYAWPGPGQRPSQPGHPDEFPWTPLDPWTHPALCTVALGQTPQATFWTSPLSLECPTRGDAERIGTVPLLGPHK

SEQ ID NO: 1011673 - protein, 331 aa, Homo sapiens
AGCPDALMPRERSRGELALLEDGERPGRAAALCWLGWLLLLMCLLLLGSSAGLAHIKKAEATTINYERRSAEAAEGQIRPATYHEQEWESALREAAAGASPALDRPLKHRRSVDGRPLWVLRLNRLAWGSLIPEVDPGPDRCRARRFGPRCMPGPGPQTINTCDATTAMATEDPAVRRPALHNLPCAREPETAGPSRTREPQPPGTAGLVTTTHRTGGYPGLGHRRSKARGSGSQTTVATRRRRPCGKTRPATDRPDPRRPRTETAQEQNRDREGRAHTAQRQTASHEHRFTHTKPENPPEPRHHSVRPRSDAPRHTTNNERNTPKANTLN

SEQ ID NO: 1011674 - protein, 72 aa, Homo sapiens
RVCVDVSVLTSRAGGPGLLGAGGGLRVSLDWVPVTPRQAPPSAVGATGIHAVPGQLGGGRKHPLRCIRLYGW

SEQ ID NO: 1011675 - protein, 75 aa, Homo sapiens
AVRCSRGNQEQVHPPLEFEHPKNRYFVSALLMYPQQPELPDICILSVRHQAVEEESMATLYLLIYSFCIYQAQFW

SEQ ID NO: 1011676 - protein, 106 aa, Homo sapiens
RVWEAPALSAGSVKMCALVAWRRPRLSLSGAGSLRGAGKGAGRGSLRVRRQWRLCPDHRARLRAEDGDPGPESRPNVLLAEPCCCRILGRSERLMLAPASPSMLCG

SEQ ID NO: 1011677 - protein, 209 aa, Homo sapiens
RNGGGGGGDGDSSGGGVWLAGGGRSRRRRLRGTRAEGRGGRPPAKGPASRVEVGGARGQAASEECVRRPNGSRPVFPSLVTEEKWCLCDASDQPCGKWQDSESGSVTLPDRCLTHPNQEILEGPEARVSLHSYCDKARAIQQLFSIRTPAMRARYHRRYLDDSAKGFLPSLRNYRIVATHKISIAQAHFGGAQNKLELMLKQRFFTTAC

SEQ ID NO: 1011678 - protein, 238 aa, Homo sapiens
SGGAPGGVWMAASAAAASAAAASAASGSPGPGEGSSCAGDKGAPDAPFRRSLGLLPSAAASSPAGGGAEALELLEHCGVCRERLSTEREPRLLPCFDSACSACLGAPLCPAGRQQLGGRGGGGRRHRWSDLYPLCKQQCFSKDIVGEIISCVIVAARPAPDAQGCEPVLELAVRIHAQATGYSVKCSEPLSETCVRGAPSRVTVHQGPYMCALLGAKQDLGDVVNVLAYCNVHQGMNP

SEQ ID NO: 1011679 - protein, 109 aa, Homo sapiens
MPQGILRVTPFESPGGAMIENEHGGSPWWRGASPMRVWCAAPLAFSAFLCVESLRFSVASPPCRGRNLEATFGCEHLFQRRPRRQFGGSSSFPERLGKRLSSSFGWDLG

SEQ ID NO: 1011680 - protein, 160 aa, Homo sapiens
MACAVVPGSEALAAFSTIVRGRRQLRRTALFVVRHQCGRLAAHMSGDVAPAGSPSTQFPLPIGPTNAGPARLELPRGAVPGACSAGVRVDFSLVPGGPGGQTVAGVSAGEVAAFKVKRRALARVTELDTRPGVPHAVRYNPTSTPPGQLSSRRARRPPLN

SEQ ID NO: 1011681 - protein, 153 aa, Homo sapiens
MLAESGQARGRVLLLVLLSRMSPSPRLPVAGQSWGREWLLRSEWRGRSALGMPGRVLSPPLPCGLIAGRLLPGDRSGRAAFAQDTRSGVCSFGRDASFNGYAVFPTGADLRVAVVTRTAVLQIQAGGSGEPGLVLEEQRSAQVTRWPQVCRYL

SEQ ID NO: 1011682 - protein, 151 aa, Homo sapiens
RVETMELQNAEVFTSRTNECQGQCGRQLLPPAWVQHAPDQPTWKSSLYSSLAYSEAFHYSFAARSRLPHAACAGAASQSLSGFVCAPPRCAPNDISHLLTGVFRNFDSAEVIGDEVSSKLDQGPRQRECAPQRKFVDQLQQNRELYKHAAG

SEQ ID NO: 1011683 - protein, 100 aa, Homo sapiens
MVLGTKKVGLRNIRFGEELSGETQKNGNHKRTLSVSSFLLRERPTWGICNSRNENEVDFFRLWERKTFLAYPRPKIELVVQGLRHYQGQVRLSRKGEYFP

SEQ ID NO: 1011684 - protein, 195 aa, Homo sapiens
SGGSWGKEFNGSAHTRGLLRNRPLSAPPLHDQVIAKQLSEYTVETKRDRLEVKKKRDQRAERPRDIVGMQKTQTRIVATGEASKCVAERKHHTTRYTNIKPTSEKYATKQMQMEPMKQVEELERIKGQPRTIHKQSKEGKARRKQYKAKQNRRSGEPQQRSATRKSANKKRKSIAQEVEETQDKGTQNKHRGDNK

SEQ ID NO: 1011685 - protein, 120 aa, Homo sapiens
SGLALSPPRFLPEPPPVPTLPRLRRPRAVPTGNSAQGRSPLLRSWGSVLSAALVRDGPESLGAEGEYALRLPMIPPGVPKPCLANRSCTGPMGPCQAGHLDRPACGQLRREVQMGTTAKR

SEQ ID NO: 1011686 - protein, 82 aa, Homo sapiens
SVTRYRVLRDDPQRQRDKSACNGACEVTRSPRTMTGATISGLRACGSQSHNMSLLSEMMRKWCQSEQATSGLLEDATTQPCE

SEQ ID NO: 1011687 - protein, 115 aa, Homo sapiens
MGNQPIKWKKAWESCCSTASISPEQFHVVENPGKEAESDGVGSEVTGRNDEEAICSSVAFILHLQHSERMLTGHKREPEGQWLANDEQKASVRKDVRDSKDEEKQHKIRRERKKL

SEQ ID NO: 1011688 - protein, 101 aa, Homo sapiens
RGAILEPWCQFPTLAFKRWHFFPTLPSLFGQLSVVCKVNRKRKKAMRRTDKNKKQTKKGIVKWRREERKEEERKKCQKKNEEKAEKRKKQPQKKKRGRRRK

SEQ ID NO: 1011689 - protein, 102 aa, Homo sapiens
MPGRVVRQRRRPRPASDYGGTGKQDCVHAERGLDRGTAEAHTDRSWLVRHMKGCVTAAGSESSSSICNDRYISVSDGLHTNVGCVPVAIFTGMVIQHRLSHA

SEQ ID NO: 1011690 - protein, 234 aa, Homo sapiens
MYLLLLRVGGQGFRKGWALLAVDEDYPWRQVTWGQNGEAHALTSHPMGTNTVRCCLESRCLLSFASYRRTLGDRPRIRVAWRPSLRCVNPRSADVLCRPSSLALEMLPILRRGERSSITIQPPFCYHSSTSWMSCGWRLVGIARSRGIHDGEHLGNAATVADKNPVGDHPLSSCLAIELSGDHPGAWPFGNLGDVSPAFKAGAGHQHMCCPWPTLSPKGNPGRILDTLMPNLSS

SEQ ID NO: 1011691 - protein, 302 aa, Homo sapiens
SGAGGAEVQKQLRSKLVVPASRVDPEDVPRLRNDSAVSLISLLQHSDTASLDTCLWFWIMISASRGGSLGGAWHALVPFSAFEGDVRLRPLAALTSRMSCGPLWLLVSGSSTSPVAPEKLPPGGSSTSRTPSSPRELSWAAVASVGDLGLRNCSPPESANVLHPTLGGEVLVPWVPGAVTKQYTFSEHSVLDYSYNIPNIVVPPDVVASTEVEVSMHGAGAVSRDCGLAELSGPLKGLWGAPCAGAGLRDDDGTLGCMLSLAALVVPMTGKAYGPESWDCQASFRKQAFSPEGLDHDGSQYP

SEQ ID NO: 1011692 - protein, 274 aa, Homo sapiens
AELFCSPGLLGSPGRARVMVVGRGLLGRAQCSCALGAVCARSRTRVHALRGSFRAMSRFCVKNLSRVTRASVRGRGAGCPETRITCTWSFDWSRSTRGLASLWILRCMPQEKVRRTAGGRNAAGGCKVDHQVLSRKAQTIHIGSPCFGGDIEEISWVNAMERSGDLKTCCIGRGLTDSVILEDLVSSANEIYVRPLFQQLDKRWVMSSIGSGRTIALGLNHPMARNYQSEPPVFVTFSGGEQTPPGEAASEKGPTPGPVWLQQRGWRRPYWFDV

SEQ ID NO: 1011693 - protein, 521 aa, Homo sapiens
RVRKEGGLGPGLRLVGACCAPSGSLLHAVFRLQHSPNFHLAHAAAGAAGSKHHAQAAQLRSEPTRCAPASLHRRNELRTTRTGMPRNSKANPLRPAHANSGHLSALHTAQGLYTDTYCRINASPPWGKLLTLATASQQHATLQGTPGFHGSNTLGLNFSRPTEPRQRPEPKATFARGTKRSATQFTYTQWSPKNGVQFLSNFRNHGSPVGKTRNTPHNLRTRTWEETPKVPNNTVGNAKHHGKPQLLANPTNNEQRAEKRETRSGKKTPSWAPRQLLQPEGFRGARREKNAKSSPQRLAQQEVPHNGRTAQTRYTQNALNPSLFPRKGPGWDPQERLGSIKDGPIRSPTRAKQHRWRNFGKRENANNKRWAHSRAKRQKFNRLSYNLRTFLVPQYISAYIVPAQIPRQVCPKPPIEMGPDTVYSHWENFTHFGNWTPADSSRNTKELGVNTRAGNGKTLEPIIWGPSDVDNSSPSPYHFRERKKPNSMGASQTFWKAILTPTTFWGTQRNFSGGRKGCAAV

SEQ ID NO: 1011694 - protein, 277 aa, Homo sapiens
MQHCTLARDYPEHHTTKRLAPARHHTCMSTDTHAQDTHHPPTSRTHDHYPEPPPGATPRHPTARAPTRFRDETPPTPPPPILLPQPQPANLAYFHLPHRPRTTPLFPLSQHPPPRSLTPLSHPPPLPSLDNKIRDPTPPLQQPSPSPSTPHTISAPILPSITPTAPHPTTTPSSNHHHHHSTHPPSNPPHQLLHPSHSLIDHSPQTSTSYTLALPTHAPTTHTLSHSPTTSRAHYPHSNTSHTYSQFLHPQYTIRPTLNTPIITPSLHTPNNYQAPS

SEQ ID NO: 1011695 - protein, 106 aa, Homo sapiens
MRRRFRGRIQLLWCAESLVSRALRRRRYGRSMDSFESAVDAHCTHEEAHVDTQATRYKPRARCFSRKHRAGWNGKRFMILTICRSKLGLLEQMLPRCSDRKLLMTL

SEQ ID NO: 1011696 - protein, 71 aa, Homo sapiens
SGLFQDGGASSRATGPTVEASECRRKTAARDERLNGCSCRRLASGPDAVFAAATGCCHEARLGDGPHFPGV

SEQ ID NO: 1011697 - protein, 79 aa, Homo sapiens
MRLRTTVSDPDNVGVAASLSSSVLFHTFGRSITRPLPLRTTRESYKPPIGSLHSQQSTMLLIRTVLCVPPYYYLIYSTA

SEQ ID NO: 1011698 - protein, 159 aa, Homo sapiens
MRENGTRKTSPGSGARDFHSCSEAKRSRRTENQEGRDSGFLTKYEPGAGPRQVNHQRDKAPSSLWTGRRNRRFPLAFKGQETSMNEANQPRINFINVGSFDWDPSRNSHPIWKRTRNFYNTVVNVIPFAQKEIPQRGQPLKSTVLHDAKIYAIPKCKNK

SEQ ID NO: 1011699 - protein, 91 aa, Homo sapiens
RVLLLRSADLTPGRSVPRAPAGNPAGGEDGGEQRSRRLEQRERRGEGGELSAEQVIAGFNRLRQEQRGLASKAADVGDGRRMSTSLVTRYS

SEQ ID NO: 1011700 - protein, 108 aa, Homo sapiens
MDKVLCPVGPTEATQSDWAVSNFAPPVTGRMNPEFATWTPRKESDWNSEGNRNKRVSPYERGISQTQAPLTQRVSVKGRKEAQLRGKFVALTTYKGVPLLRKFVARSN

SEQ ID NO: 1011701 - protein, 41 aa, Homo sapiens
MRTKPPIDTLRHYLGDDNSRNSTIDTKVQGNMENRKPPIMS

SEQ ID NO: 1011702 - protein, 181 aa, Homo sapiens
SGNVFCSVPGTSVCHVPAAFLGPMAPPYVATIVATIKEAQPLEWVKDPLHAHLPKSPVGLDMTSVVIPISSHIPTWESPHAPTSPSRPVGLMITLEALMLPQRCQPQPRGIRLKNLVTIPGTPGIPGWRSSPWGPEQVLGFTSKDLQGQAESTGKTSRVCAQRKLNDQDSSSDVGAFGLKT

SEQ ID NO: 1011703 - protein, 290 aa, Homo sapiens
AAGPEPLKNESPVISAPVKDHRSLGPSSSKESKSYGSSRKLRIKALWYQSLVQRINGSYGFLSRVKESKRPSGPMASFKDEWSHGSQQSVKDLEVPWSQHLVNGSMVPIVTSHLSKGERSHRSLAPVNGGEVPMVLSDLSRSQDPMVPESIRKDEQLRMGTAPIKNQSSMVSEPVKNRKFTWSQGPRHRINDVVVPEQCEQVHDSARLSATCRGITGPVVPESVKNLRPPCSQVLVKDQGPPQSYSRPRNQGRIVPEPLKNRSAYKSQCLCRIHDPLGASTSKRTEGPGS

SEQ ID NO: 1011704 - protein, 312 aa, Homo sapiens
AGRRIDAWRPRVSNGLDLAAQALTRPGGDAGRWPWLGRGLNPAWADLAPACELEAGGPGVGAYSGPNWNGTALYGRATTAGRPGLVLPSRLLTCTKPPECAGALRTNPKDGHLNSTGRYTQLSTGPNQAHTQRTSASGSTSHPEHLDNHSQPWAHNVTSSPEKDKQTNHNQLDLATLTAHTVPHHLGQIPYKGPQRRKARRFSRLSTEDQHHGTPSNLRSDTPLLTNALDTPQQARENARPRQPPTQRQRGPPHPKQNRGRKQYPTKTQVRSRKQTAPQLPTLYREMARAYREGHKSTRTHTDNKNSRRVKN

SEQ ID NO: 1011705 - protein, 103 aa, Homo sapiens
SGLSGSQRMLLPNRMAPVSAGRIATCLANSLTIAPHERSSRKVAMHKPVTKTSSLLGTVPRRPNPYWRCFSCDTGIVLCKRVSELKPIQAKFCHYANVCKGPR

SEQ ID NO: 1011706 - protein, 360 aa, Homo sapiens
RGRAPSLARDAPLDGARAWALSLLAGAGAERRGARVHQSLSPPMGTLMFLLDRLSQRLSLNRGSPGFGQCVGQLVASTARWAPVGPALPSLVHGGQFWRILRVVLRFRLSHKLGVRACHMVCGCVLLAPRRIGVDYHYHRVAVSGVGTELLQRQTMLSCRLVEGQSMVAPELNAEMHAKMIDLGLLWVRLGNWSGPHQDVSHLVVWHPTPLVVYVNASKGNHLTALIRAQAWENNFCIEGDRGFRNVRQNGVPMGNDVSKRYRNVPIHSRPPWCPVKQQTTRGHFLCGYPVGQLNPNATMFKMVFTTQQALEWGAVPNFLRNWRKWQEPGTSKGIHSGPNGKNSTRSPTRELFPGPDGPM

SEQ ID NO: 1011707 - protein, 376 aa, Homo sapiens
RALGEGRRAGAVGVRGCAGADGAGLKTFSVALAEQRQALGVAGSLVHKSPEEEILLTICVHTPTYCDLRKGCYTDVFTKGIMELILTTGHAYTEQGKASGNPRNPNIRLGTLMGPYPFTPRNDTTRPIPLAGQNTLLGTRTIQLHLTRRGKRELLDTNTLLPGHHSAHAAGGDKLERAFLITAAHRPHTLSPTQHGRKKYRNLILGDPNPFLFGMAPSAYRAPFRTEYGPTLWRYIKNSRFGNRHAKASKNLVHRTYIFGPLRGYTTGIWLEAYPQGDRADPQFVEHPNWATWKVSAQGVPTILPHEMRLKLQNRDSQHFSVYNLCTGDTRLGKVNQLPPVQVTWAANRDNMRERGINTSLSTVQKLSISAGYDDD

SEQ ID NO: 1011708 - protein, 216 aa, Homo sapiens
MVKPVRQGEDPFAPWHNNTASIYAHRSSFIAKVGSPRRGGRGQEASQWGLLLAPGSQTTPARCHPFLVGGGHFPPPCGVPSPWKFASSLSGGPFFDRRGDFRSLEKGADQKGVGVVGGTTAAIIAPPEEVSSVPRGEAFFSACRCRPAARCVVECQWPFVLGPEIRNFHLLVAHLTILGNTRSRECGPGRLSRVRAPLFDLPLAPVVPFTKKDFGG

SEQ ID NO: 1011709 - protein, 70 aa, Homo sapiens
SGVWRLERQYVRFNGDCVKLAAADGKGQEVETSVTYYRLEEVAKRRSPCKELWSCDPCGESTYVYPTSSN

SEQ ID NO: 1011710 - protein, 211 aa, Homo sapiens
MAIALADAQLVPNVEAYWTSIHAVHVDIVMQSFGKEPTLRSSSQYPSHLGGRSPACFNQVDCACQEADSEDRSLGDSVCFANSWLGLSCGLKSIERILIDPLTMILVADCPKPSDAPRVGMHATEIERATYTRSRVVRIRPLDFFVANPDLREVNGAFGPKPRREQGLRNPSIPQFSHAKFRNVEKGLLMYRLRARCWRPSLARPGLPFRL

SEQ ID NO: 1011711 - protein, 188 aa, Homo sapiens
SGSWFGPGIKGFAAQDSLALRTRVHVVCIVRASRPLPTASFQVIGLRVTRAIVKAIPLSFKVHQPVSGWRASKVKLFGTTYREGTLGPLCFYSFLGLVTIMCCAQHVGSISDSSDDRCDAGTLPAQCLGRVLVSGIGADYGVVSCLYVSIALALWPLVDSTSIPSSRAYRTWDALCDPSTGEFPLDLR

SEQ ID NO: 1011712 - protein, 119 aa, Homo sapiens
RSVSRNLLVRTVGGGGAGAGPGGGAGVPGAGAACPSPVTSCRACGAPERLFSVMRRRLPRHLSAPRFLLTCLPPPHGPVRQTRRIPSQWGTLPGARIARPRYTYAHSYNHIRHLYMRYS

SEQ ID NO: 1011713 - protein, 208 aa, Homo sapiens
ADGPHCLLRTRDVRLPSGLLAMDADDSRAPKGLLAEVPGAPLRGRKAIGVLTSGGGCSRYERCRPVPWCAWVSTWGPTVVLHLRGLAGHGGRRLKPSLEADMRECLRAILQVGGTIIASSGGAKRLPSTAGEGARLKGWLIATLASKQLDYTNLVLLIVRGNGDPHPRAQTFFASEGGVEVGPCLAGGMPRKQSDSDDRWPPARSRPT

SEQ ID NO: 1011714 - protein, 255 aa, Homo sapiens
SGVWSRACPGMWELPDYPDATVSDRKRHRGASGCMHLIAKITSSLRTCSPCLRNGSEAGTWKWVTPAEAALHVWRTGDLLSFSPRAITTMHTGWWRTRNEAQIDIDAGTTSPRRVPWAPAHVLFACVVMPGGLAGTSIVLPSHRGWSSPQFVAASFYGGMNRAVVHASQFEWRGHGVMEGLGIWVSCPPMPRQKGPASLGKPSVSLAQARVWLIGRVRMVGTGTPVGAGEAELSRLFPFVTTTIGDVLYEQVHQA

SEQ ID NO: 1011715 - protein, 104 aa, Homo sapiens
SGLLRKVSEAGGSSEDNAALGHTAAEDGTPIESSCWSGARISTMKSHSEIAPLHSSLGNRVRLHLIKKKKVKEKKENVFIPFSFLKKYIGLDKGSWCLTVWWAF

SEQ ID NO: 1011716 - protein, 374 aa, Homo sapiens
AESRCSCVWRWRHCSSERRTRLAGAGRGAGRGEVWGGLAERPGTADRAWGAQQTSPDWRPYRSAAPPGAPAPSPARAIGAAREAGLKAPPALWAPGHGNHRARKCGEGARNTAACAEYWRPGGTQNSGGLRDVGRGRWTPKRPGKLGKKFGSFWTPRMDRSSIPMWTPKDIYPVVFSPRGAPHSPWGFYKPSGTLEGRSNGGINRWAPRSADVTRLPAKEPDAHKGHHTKFTPIKRDLPPFLEKGKKGCVATFGVRGSEHYAYTRGATEYTQSCWPPEYQKTKFVAVPKKTAMSYHKHNKCGDCAQTRGEHSTAKKVCATRRMLCRRKIAEFIDRTTLPREWCVETHTTICEGELQLPQTTEERALLGVKQTAL

SEQ ID NO: 1011717 - protein, 34 aa, Homo sapiens
MRQQNNPDRAVKTGRPRDKHKTTGRKTQKTDTRR

SEQ ID NO: 1011718 - protein, 136 aa, Homo sapiens
SGRLPPLLLARGRGRALREALVPAAAALLRRPGLRRFSPGGVSPPGDPPCPGISRVPEPRPRVPRPAGENALSCSSRPGLAPPGHEEGPVRRARSRRKRREEGGRGGGRGRRRMPPRAAAAPPPAGPRLTLTPGPR

SEQ ID NO: 1011719 - protein, 85 aa, Homo sapiens
MSNRRTTLIPTIVNPTSNTDDKLVQPRHMQLASIDTNVNKPGMCMGRPPPWHPGNTSGQLKETPTVWSKSTTLWRLYVRHNDHDT

SEQ ID NO: 1011720 - protein, 189 aa, Homo sapiens
RERASERGFPGRPGPSLHIAGLRRRLRSTIRLTPPKLRPPSGGGKARDREPVANHPKLPSNSHSRRGPSVRRKGPDRTETSGRRNHGDGPNGPVLGSTWSGLRPWLAERNTGGSPGSNDTEDRQRGRNQATGASGGPSGNREARSQNVQMQRGNWDDTEKAPGTEPATDTSRTRTEHENGPPTTARDCN

SEQ ID NO: 1011721 - protein, 319 aa, Homo sapiens
RRGGSRQAVGASDELLLPPLDFLHGSLRRFVLVWPGRAWFLLQTPTGEGLDLTAFHPCSPARVISGSERGRSRGMDRRVSRRHSDRGVAVRLEPSVHCDARPPVRGRCCTRYASAMSATLAGPPVACRLVEGYSRRLHRLSSVRVSYRSACAACVAMLGRLCGVRLGRSARGPLLGCLPLMTSPLWIRLSCKAYRESNPMIPGRHRVGWGDMKTWYKGEACPFRDRMSRRPSHSSIVKDCSPRLFNQKAAPDGAMYDAHDGKHSGYARLLGLSAWEVPERTRRSLALTGRGLMSGQDCTQGAVAHFGGLGLGNRVYPLA

SEQ ID NO: 1011722 - protein, 121 aa, Homo sapiens
MAQKHLESATKGENFREGVEWWDRSPIGCTLGGWARIHAGGVTAVDCGPTLRQEHHKEVHPVSRGRKDTQKRGLVTETEPLGRTYWDQRGPRHPSAGYESMRHTAQEHPLGGDAATTEVSQ

SEQ ID NO: 1011723 - protein, 263 aa, Homo sapiens
MLHRVFAFVALPCVVVAGCCMMSELPCRQVHARPPYKARHCRDTWVPWNPNQRTEGRHRRPTGATVTEATADRDAGRGDSGKKHKRKTGGPPLKDTERRYHKKGAKGKTGNEEGETTKTEQRQKNETDPKEKLRQGSQGRKHTNQEHRDKKNHGGERAQKREGPQTAPARPDKRQPAEHEEKRTTEWERQRTNKGGGRKRREEDNTLRGQEREGGRRGRKHQNRNERGREREEHEREEHGEDKERDKADRDETGRGKEPRREQ

SEQ ID NO: 1011724 - protein, 273 aa, Homo sapiens
RIGPSCFQLLQSGLRRQSIQQPPAQAQHGERRARSPRKAPAANLTHFIYDYNTDAYCGHDSGYRLVPAGYPHSSSTQEGEVQARRTPVSESPDLAEVLYSLSFPLQPLVAAACCTFPRYISACRTCPELLGSLHVTVVRRLVWVTLADSAWWTRSPRRWRPVTMHPKVGGRCKLLYLLQALSRDDSAESPVCIRIPKGLKGLSSGDRGRSIRGPLSITKHSLAPRSFHGDGGEWITPNISQLREPWVPNPPLLLRVWCCVVQHARVAGRPIMS

SEQ ID NO: 1011725 - protein, 88 aa, Homo sapiens
MTCTEDKALSRWPASPILTGAETLGGRTSKGTQYYPYEKGIPQRGESICAQIAIGRQETGTQTSRKRIDKKIKPTKLIVGANRNKESN

SEQ ID NO: 1011726 - protein, 247 aa, Homo sapiens
RECAELSASTLSPAPGLPRHSRLNALLGLDHAGGPQSKLVRALVACKKWTSSRSTHCMITLRRGRAVDELGKCADARPRSKNRPDAAFRGMVLIHGEALQLLVLTDPGMLPTQEGSANSRELSSHFPLVVNIEGASDIKQWRYVLSDLCGLCGLPTGHRPPHASVWLVYDAGAGRLKCRQSPSSVNRIWRTTDGKVQGWRSFRFKRTEAHGPPRWLASVLPWADVAMTNVAQSCYDATVSEEGSAGQ

SEQ ID NO: 1011727 - protein, 62 aa, Homo sapiens
MRRATPENGDGITKYAHILLGVNRMERGACNFPGIPRYTSIGPGLGHKVKRNTLRGILEHRS

SEQ ID NO: 1011728 - protein, 196 aa, Homo sapiens
MDEERDAPCSPDSLVYQIFLSLGPADVLAAGLGVPPDGRAVSRDGVPVGGSSFYTYYQVAADVPRNPAAMSWYEESSGCYDTVPVRGGAERCGNKTDQVLCTLSFSTFRGTQFDVRESKGTATCEGSWSNDPGTSRMMQQRGHAALQCGSLTHKFSQVSTRDELRYVLASEGVPGGRHKFLIRAKIGGISLGEHGG

SEQ ID NO: 1011729 - protein, 105 aa, Homo sapiens
MLMLDARTCCSPFRSAIMIDLPGPHQSTDEMFSEHLRRILRMIACGVVPVTVGGEDESVSDQNGDIDSTSLHWWENASDVKGPDGAIRYPTMLSDRITGALTIVM

SEQ ID NO: 1011730 - protein, 342 aa, Homo sapiens
MLLSLLLLLPNVLGRRRSRWPRGRLPHLGLMLIGPDHRLSSRASEVGEQGYGLAGMGPNLFHRHVRAPVRERDHGDQQLTRAPVADEYAQWTLTGRAAVLSRSSPPGSDSTAGADLMTSSSWMGAENLTKAEACSCQCRPPAPLGLSVALWPSSAGGRTFGGFVPLLWGPGGAGSTFPGPNKSSAMGKELASPWDGEGGEAPRNGYRKGKHRRGMKKPRKSPKNTDGNNDQDTKACHYMDQRENKSQPTSHCTETNYRNLGERRETRSNETRQRKHPQLVTREPDEGRPSQQDMSDIQMKIDNRTQQRQKTKKDKENKKAKGEKTGKKKEERTTRRKKTTTK

SEQ ID NO: 1011731 - protein, 227 aa, Homo sapiens
MRRRGAEKKQLRTPRTSEGAGGVPRGAQTCLSLEPRTRVPTASLGWAQAPAGRGLQLAPSFMARPGPENLASMKSAREHPPAAGQRLDHLRPSKFHTWSTTTTKHAMVNQVTRQKAPHLGQQPEDTTPEDALVQGPVETHLIPQGAATPVDITMAQQESTLPERRRKYQQRAAQHVDCLATTLSAPHRRERGETQPTNRRCQAPPQTDVGRHRTAANASGALQQHPR

SEQ ID NO: 1011732 - protein, 182 aa, Homo sapiens
RVHDAETELGTRLGRSMIPVPGNYPAHASYPVQPPGNQGIPSDALQSASGFSRTPTAIMPTQSSIVLSSGAPIVGSHMSRTIDQSVVSSRASLFLPLAQVCVCVAPSTVPRSPWLHLVHVRYPLYLDLCLHMELCVKEMGINAMCDHEYRVAVGVYVTWRYIRVPHNLLIGIRSLFTNHVCV

SEQ ID NO: 1011733 - protein, 121 aa, Homo sapiens
MFTGKAACPNPGPPERKVLVIMAARLDNFMGCCHLRDVIASEDIYFLNTEGIASFRDHVNQLNQTKCSVIYYLRSNGRIHVITPNICMLMSMLWHRGQNGSDRLARSVTSHIVREWTGNQA

SEQ ID NO: 1011734 - protein, 146 aa, Homo sapiens
RRIALDSRARTLKLSVIPPVLRGTGHRLDPHPQFLHSATPPVGALGGRPKVSSGPPACPLSGAPAATNWAHVEFAARLDPRGTSPPSLPHRQALVMARGLIIGFDEPVVIYAPALPLRFHVPTASGPSHHLSICRRQSHCQVRIGK

SEQ ID NO: 1011735 - protein, 313 aa, Homo sapiens
MENSSSAEYKLAHRSDNQYAYSRVEYHLAPSNHSVEHLPLQIPKNRGSPLCTDLQFREPCRIASQLGLDPDWNRSPGDCELISSILLVRRLRVPGVRSHKAYTSVSVPLPSNGPTLHSALRRNASTSSKDSSFPTFHTMVGLDNPTRPPNMLGQVQGPGGRNCKPGRAIVGARCCRAGDFRNLTGLAKTDKVRVTQKPIELGKLATNPFRTPRFTHLIAPRKKFHWGPSSMPRIDWGLTQGGPELMHHWVTTTGAPELWVRQMERFRRSQAPWALIRASEPKFPQPQNPRDKGTLNPNLLETSKPVGREKLRT

SEQ ID NO: 1011736 - protein, 141 aa, Homo sapiens
MACSYLLYVLCLLTAGLWIVYFIAVDSMTTNFYHEIHAERKPGVKHAPYISIAGDDPPARLMCKSQVMNMAAFLPFVVRCDCSYHSNLKTEEASKTPCAAISQLPSVPPVLMGIPIRKMTLTCGYTSHHAFNKIECNNTSH

SEQ ID NO: 1011737 - protein, 103 aa, Homo sapiens
MLCHSRFLMVPCCHDDCSLLLPTTPHPPAALCSAVFSCGCHVLLPTCLACSMPDLPLLLQPMSNQGPVILISFLTCMGLFWLCPSAPAGCLAMKHHKTLEAYC

SEQ ID NO: 1011738 - protein, 255 aa, Homo sapiens
RTRAEPCRRARVDYSRSLVGRVAAQLSRTCGLRLQPVNRTFSPGDESYHGVAAVPGVWWPPCCLGLNLIFLVAYLGLCMPLPVGDDAVQTEAAPPPCCITWTAVSEPGSSAVLPEGSGYLCEDTRMTNDGAVANLMYSLDDANHNFSGIDALVSGTTQKMKVDLDQHLALAQLEIFAARGDYLKTLKFIQADGGQRKSSTLSGLARVGEEVTNGADQSYPDKTGLRGSTKSGYSKLLLFRLDLSHLPHCRLGWQG

SEQ ID NO: 1011739 - protein, 200 aa, Homo sapiens
MCYRPFFNVRVAIFVVSNWSPKAHIVCPTCRGPCGHPFANLGYSRTWLLQYFSPCKYCVFWDVTLTLQHNRRSKTMKSSVSQALFLVRALVLPVKWHGFSGMLYCPNLMHSALSPLQPLPGQTASTSPLPTGPESLPWLLLTCLHHWQSPGPGPIHSTGSPSTQPGNKSTGHTDPPLALRTTASTTTARPAHTMRNAPAL

SEQ ID NO: 1011740 - protein, 87 aa, Homo sapiens
DDGDALGLTGFDARGSALRLGRDVRRTPSRGITVVPADQEPFVHCHTRGAGQADILDRDGSIAVVGDDLGRDHLASLRAGTYGSARS

SEQ ID NO: 1011741 - protein, 106 aa, Homo sapiens
MWPMAQESVASHCRFCSESRLMAFLYFFSLLNGYGYGCDKEAVNSKVEVALGPGSLVLLTYIAPPEVCRMSLRTNLWVLKGTIENAGQLVRGDIQNSPKMAMCLPR

SEQ ID NO: 1011742 - protein, 112 aa, Homo sapiens
MSDTIQAAWTLLHEIAIIVIPRGLITKCSKAEMTWRISSRVDPVHDTTSLPWKPGKRRSDSVFKRRAYGEPKALKVAHAKEPHVYHACRAVSPSNEGKGDRNNGAARKVKSE

SEQ ID NO: 1011743 - protein, 246 aa, Homo sapiens
RNVGVAGHVSLDLSSTSSSCYGRNLGLKHAAREINLRIRQVSKVPSSSIQLPALLSVSLTRVIMPRGQKSKLRAREKRHQARCENQDLGATQATVAEGESPSSAYLLFGDRPQNLPAAETPSIPEALQGAPSTTNAIAPVSCSSNEGASSQDEKSLGSSREAEGWKRRSFKQESSVAGAFLASEDDNDKSQLHRADMIPVVIRKESVHFNEILKRASEHMELALGVDLKEVDPIRHYYAFYSKLDL

SEQ ID NO: 1011744 - protein, 182 aa, Homo sapiens
MADKFPTRVSHTHKHFRQCHRGLSTWCSSSCHRITSFVNRTPSCVSKRRGTGGIFGTLDPNTGFRRHTRIEKCRVVVRGRVGQPVCVLEVHLRRTRAPLIHHIWRRTDQIGRMSEGNLFTQYNVKFSHADRLATIGHCPRTSCGGGSPPWVNNTHTWAVHVGDPRHLYPIVVYVKPVRAPSS

SEQ ID NO: 1011745 - protein, 99 aa, Homo sapiens
MHYQRNNGGEKRKTKRDNGHLALGYRKVIQKERVGQEAKDPDQDSKGNTNRQRRTRHPSKDEEQETRDTGETRAKATNQDNGARQRYKERQENTNTKHT

SEQ ID NO: 1011746 - protein, 122 aa, Homo sapiens
MGVLAAPTGGDTKRVGVTVILHKRGSLSRGCCTTDYCSMGRGPSHGYEAPKEWPLYRGTPCLPILWPRMSKRGIISARPTFWCRPIRETLCFAHRAFVRQDTTPRGRGSFFRPAECVCVDSK

SEQ ID NO: 1011747 - protein, 75 aa, Homo sapiens
RNRTHTRAQEAGGPGAERAPMDARQHGALRPPDVRMPSPVRLRHAEGSLDRTRLRSYSPRNNNAGTHKPSLDKKY

SEQ ID NO: 1011748 - protein, 97 aa, Homo sapiens
MASYCFLSKTEQHLQVLKVTKALKLHDKLSSAVVSECTYRLHQTEYAGVWITINGMFPDHIKADSNQHEACQVVGMAINSRNTYNSCTQMQVAYHKK

SEQ ID NO: 1011749 - protein, 106 aa, Homo sapiens
MVAWFREPLILSIAQEDRFHSRTASRSCDFGWSSTGPTHLTRQTVLSPMENVHDKRAHGDTRKLDLRLGRQEDIRGGASSKISSHFRSTPGCVLPTGCGIHEIEPL

SEQ ID NO: 1011750 - protein, 155 aa, Homo sapiens
SGLKALLCAAGVLAVLACGCVGLCACQPVPRSAGRSLLGCAVVRGWDPVCLAGGSSLGGGSGHAGWCSLAGLVCPPCVAPAELLLRPAQLSLSLPSFALTAGKLVAPARLPGFRDGDHFLSRSRASARCALSRPTVPEPFGERLTPLPPSSPRTN

SEQ ID NO: 1011751 - protein, 277 aa, Homo sapiens
MRHHLRQCTKMAPYRRYWCLCCRKLWVCGRYHCGRQILVPTGQGWIVDLANVLMPRWMLSSPVYDHGIVAKISLEKIDSTQQTCEILVRMILVFGSSFVVVGTHPGVNPRLDAWINMNAEASNVLRSLAGASVLWEPDVGPSAGDCRKGSRRMRLIASNVTIPGHTGGMSEKGRALLALIASAESRTLDGKPISPFGSTRWLGRGARSKSNVWPPWPDRRQIQRPDRTVFMNLSPGPKRSNGCLRQIFERCGLFHGERLVGHSLGKVHFATRQNLLA

SEQ ID NO: 1011752 - protein, 148 aa, Homo sapiens
MQLVQGVQEWQDGCMYQGESGGTWKLVIWHNVSLATGDSYHGQSYRYHCHGRGTYMWPDGIQVFNGHILTVSIEKATGAMYMKDTAFPDIRCQNENCQRFSCELWGQTVKKWLKMRGLTEPQHVFPLPLAPSSPSSPNVVKRTILKPR

SEQ ID NO: 1011753 - protein, 372 aa, Homo sapiens
MTSPWWWMTSVCCCCEADVMDIEAEVSCFRGCCHPLKEACMFVRLISENAAASLGPSCAMPAIALSIYLESPDQCAIARGWTRNSSPRSSEVSIRSPPSMLRERGVKGDECAGRVCQQCWCGLTAHVAGRADCPGPGTPDVGAQAIPTMGQMHASANCTLSYLRLYHQSRLWGDLTLASNGLSSPLYQLRLVGEPEAANKAGLFVIALCIIRSLLQGPVISLLDRAHSMFEAGWQGKPGKYAPTKFMQDIREGMGTKARGPWESKGSTLLAVGKSTKDFTCVDGAPHWSTSWPLAKWPLITNGLWRGVIEQCPGGDPLQVFYPRGTPKIGPTGIRSRALKSRYLSLINVTSSCVLSVGATPVYVAKDSTEIS

SEQ ID NO: 1011754 - protein, 162 aa, Homo sapiens
SGGSRRRRGTSERRLPGAHARPRCGLAVVFFVFFPRAGPGGWRTGLVGRGSERPKRRGCSGAVRSSQREAAGELGEQLGRAEPGAEHLQARARAPPGRFGKKRHQGAPSAGATEFVLQESRRDIVSCVADGSLRLGLSVGGYGQKLHIILGNSSVQVSPSQQ

SEQ ID NO: 1011755 - protein, 141 aa, Homo sapiens
MAALLGAACWAWAVARGPRPPYPAQSSPLWDRVDGWREEMTGELAPRCPGPGGRVGEGETGGWPGLGARDPHRGSGRRWTTRRCTKELDQWVEQLNECKQLNENQVRTLCEKAKEILTKESNVQEVRCPVTVCGRCAWSIS

SEQ ID NO: 1011756 - protein, 157 aa, Homo sapiens
MSADGSFEPLLERSISVTECLSDWRASSELSRRERGLSAGQLTLSGSPQPWATWPRLAKTVNLWGPARGEVEEVVSVRKMSYVYCTLVIHRVGKARGERNASCLGTRISDWPALTWVVRSACREIDTSERHRQTKGAFGNAPKCPYLELKPQSMGRS

SEQ ID NO: 1011757 - protein, 126 aa, Homo sapiens
MALSPLKCHCGGWDHWTPFCGDWAATVFDPLMWAPGKSISVWCCSECGACFPGASRNTHIGYWPNLRDSSWGCDYEYLLTRKTVAFCPACQGKLEGPKLAQRMVEALVGPLESFKSASLSNPGKEH

SEQ ID NO: 1011758 - protein, 90 aa, Homo sapiens
AGWLEVAESNVAAGSPSEEKVSRTAVNFLTVHGGDSVIPKGPAPVFSTLYRCNLVTTEPDERFLQLTPVGRNTRRQTSDRRCRMAVVLVN

SEQ ID NO: 1011759 - protein, 71 aa, Homo sapiens
ADWGSGNGAVTGIPEGAAEATMAERARGSPRPPPGCRDDWTEEGPQSTVTIPHEKDPSIHKPHRYSMTNRR

SEQ ID NO: 1011760 - protein, 207 aa, Homo sapiens
AGGQDVPVTSPKMLAAPPSPGPPGNPAARCLRDPTQGTRAGLRRPWDPSRASQPASDSTWRPQRVYISREPSVAGVRRLSREKHRPGARPGLPRPFAPECPREKRQLHDIPRAGRNPLSRPVDDPDARKTRVAVQLKAPKPKGIQGRHHFNPIIRTGAKQHEQRREHAPGLDTPDEAGQLEASNGHKQAGTQEQRSEGYPPKEQPGN

SEQ ID NO: 1011761 - protein, 307 aa, Homo sapiens
RELLVVPVVLGSRWPLSMTPRRCISLVLPVLTSTRLSVRMSARGPGYRHRPGHHLFCASVSSNMATVEIIDQRPWAIVTTPSYVAFTDTETSSSTTLAMNQVAHEPHAMTHLRRQEADLVRKFDGCHSAVWILNTGLFLGELRDEDGKPRVQVEVQGGDQDLLPMKEISSMVLTEDDSEIAGSLAWGAHCAHRGSLTVPAYFNDSQSQANKDSRHHHMGSSVLLLIERAHGGGIAYGLDEKGCAVRRQDTVASSLTRGLRHFRRCPSWTIEDGIFEGEVHGPGKPPEPLELRPSPLVSHLAEEFTRH

SEQ ID NO: 1011762 - protein, 135 aa, Homo sapiens
SGALACVRVVAGGLVLSAWPREEEGACGVQCEWAGTLAAWLVVSSLGDVSGLLGGPVALVACWCARLVVTCLRWLLLLERCGGGLAARLGGTYVGVAVTVCFGQSPDVGRSSVRRLIGARCLDIAVDCDILYKPA

SEQ ID NO: 1011763 - protein, 294 aa, Homo sapiens
RRPKSVRLDPRVTNWDWGQQSWVAAVLQSAPWPAQGAAQHGLGGSAEAFGLRVSSSSPWRVRSAWLILGLVLCLVCWGGLILACGLPIWRVTALPGPANRSLTAADPTLEPGCGVSCCGACAPGHIAVLLVYDLGSLALMLSRCRAGSGALFRRAAVTAVRYVCAHSLPLAGLRKCHHLLCAHVARAYASLVCVPHEGGRASTMVLAELARRARCHLLTGFCQSIVRPAKFYPTRLVPRGRKTVPNAGLQRLVQSGCGVATAACFHVRRAALLVLRAPEVCTGRPVLSFPVEVL

SEQ ID NO: 1011764 - protein, 55 aa, Homo sapiens
MLTCDSYCKHTKPKNSSLVELCASNHVVWKALRKETLKAHTVHKELGRKLGIEGD

SEQ ID NO: 1011765 - protein, 299 aa, Homo sapiens
SGSAWVTDGKTLSPTKKTKKQKISKLPYLRSRALRGLGEEPRNPGNSSYYSHSQELRILRFSGNCCCEDFWKISDVSVTSDTSRAHVLFVRTLQNDPMASTSPRTVADRQFPQPRADCCVPCRLPIGGPVLQGQSMLLALWCAWGRPTLLSRLLCAPGVFTPLERPLTVVHHHQVGPPRKKKIFSPVVKYKRGENLETQPSATQPRWRHLYGERTCLLIQPADIVGAKKHISFYAHKRISFEHGKSLDAASGVPIWVFLSVDASFCERQTQVNFSFSVVLSAPEKRPLAKLCPSRGDSL

SEQ ID NO: 1011766 - protein, 73 aa, Homo sapiens
MPSMWQTLGDHSKEQHLTVVKSSPSCTPPFMQSNVLIAKAHREDPCCYRGQRIGLVLAKTEIQVVQESGGCSR

SEQ ID NO: 1011767 - protein, 253 aa, Homo sapiens
SGAVGDAGVLAGGSSIEADLAESGTRSGEVDCGVTTGPPSSALLPGWLLGTCALRGPLYSVHKVDPDFQLLDEEVRAGVCYTIFDLGFRFDVAWFLTEHFALHVVQPGHWSLPISLSVVGAEPKGISIFTRAHSIHLVRGDESAPKESMNQRTLGSVSQSLLVSASVPVLRTSIHGKLSLRNMAEPFSATEPKAIGHRNYHAGYSMSGAGLTGSLSNLFCGVCVRIVGSGAALADAQNPSLFVKILIVEIFGR

SEQ ID NO: 1011768 - protein, 167 aa, Homo sapiens
MCVENMRGINMGVVEETVCKGSYDEYGIIRSGLPAQEARRQCEEAKKTIKHGHQGRHTTRKWKRASWGFHNDRAVRQYRERRGMRHKVAVDQCEGAKTKRKQGGTTRGRHQHHNDGSTEERENDRPKQKPGTSEETAGEVTPRVKSNGARRERKKSNKTRHADATSK

SEQ ID NO: 1011769 - protein, 169 aa, Homo sapiens
SGVEAAATLAASQAPRSRRHRRQPVRPRLRTRSRSHPRSPARGSARPPRTVSRCGSASDGRPKIDRIDGLPARRTILVRDRTAYGQLIWVTFKYDGSTIVHGEQGAEYQTFIQQCTDDVYGSLCLRVASPSGDAMQQDGPKVGPHHVVSVRTVMRAAAAPRTGTDQTLV

SEQ ID NO: 1011770 - protein, 194 aa, Homo sapiens
SGGFTLRSTGSAAGRGLRKLRPTLSRGACDVGRSVWKLRPSHCRVGRGARGIFHAPPLCRLKCVGGKRWAGCHLAPPFSCGVGQAAASSSCSSHRLHSDPSPAAWILLPRRGSFSRKSPCASPVSTRSLPTHPLGSKPPLPQVSWLRERQRERGGKTREQAMGGDGESLLEQTRGRKPTFLHSPSIHLWPYVFH

SEQ ID NO: 1011771 - protein, 109 aa, Homo sapiens
MALSGTTLVSNASCRAGLPFVNGALHAGEFVRVNFEALIITMSVVGGTLLREALPVMLAAAAVQEEEAAGSRHRQVQEKASAEREERRIRQEERRAEMKTRSSDESREQ

SEQ ID NO: 1011772 - protein, 146 aa, Homo sapiens
MSPCLPLLQKHETLTYDTTLITDEAEGEQFDFGSGAAVTRSGHAQAPIRPMQHRSVLEPDAKPLHPPGRCRHWSLDAREHSTSWARSTILKALADFARNVSSHIPNYFLSLIELSHRPDSQAGNLGMRLTQRLPPAAAAGRMLALA

SEQ ID NO: 1011773 - protein, 112 aa, Homo sapiens
MTPETNAADEMLQAFRTSETGDLRSCQGDEPRQQAMCRPYFRSDPWGVPSGRRLRIPRGLSRMRGVPQVSVVECLECGKSDESRDGKHGQGCQARAPEGNNFTDSGCSPIIA

SEQ ID NO: 1011774 - protein, 116 aa, Homo sapiens
MTNSPLKSGNCLDPCPAEVSTRDVMLENLQEAGLPGFGDLSAQTLCHLSGAKIKEPCEFARYYETAAKPPAICAPFSQDLSPVQGIEDAVPENLYWEEIREIVDMRIDNYEKVVNV

SEQ ID NO: 1011775 - protein, 104 aa, Homo sapiens
MAVSGPAVRGAWWVHAEARSSRASLGLGREREQRIYLWDVRRQKIIFDFLEFYYSSCQPKAHQSRRKIVNALNESSGANLTLTSRAFYNNVLGEYEEYITKLIN

SEQ ID NO: 1011776 - protein, 97 aa, Homo sapiens
RSPFVLALCREPADRCRRPARSCLRRQRAPLRSARLAQVRFPEPCASSTLPRCAVRRPMLVPSSTPERVPVTETGVQDYHGHNNLMTPYAWLEDPDS

SEQ ID NO: 1011777 - protein, 135 aa, Homo sapiens
SGVCGELRVAVVDMCQVPDSEGGRAGSRAHESRPGGDIEQSFADMSKKKLILRSRPNRMVSNMLGPNRRTIENIPEEDNHPPRGVNKECGYRCGAESKRHRMAMTATEHHRNRNAGEEDMTLSSNYLSRRSPGSN

SEQ ID NO: 1011778 - protein, 211 aa, Homo sapiens
SGAVGRAEKTEGGVNDLLQVEKRLELVKLGVPQARTRSSPHVCGASKGQRRDYTLHKVAFDRHRGSVSDGGVSYPGQMTHFLGRWLKALWRDGRTIRGVKSMSTCLLSLQGMTRDVSGAPLYAWRREIPMICQEAEETLSASWCWTVDCLTNQGGSRLPRSSGVSQQLTGLRVPKADALREETGGWRANRVEILQGPSSQLICADDVAKGN

SEQ ID NO: 1011779 - protein, 120 aa, Homo sapiens
MFRVRGCSISRALSRFPLPFPQPGHSRSAGTGSQRMDKRLCAALEQCNVVMSLWVSYFGNPELTDLIQANQSWYSSWFVDLTDQLTSGVTCRRDLLIRSAFKRSPTCPSDYQYPTKSVHS

SEQ ID NO: 1011780 - protein, 183 aa, Homo sapiens
MESGEEKPSDSVHARHSKKTRKINKKPDMPSISGYETACEVSDCVKEHGGLRGQKAYDGNSRRIQLDYGLNARRDDRHKAKSPSCRLRDKDGGSLCDHDVPTSVKDSLLIREARPFVGKDTAWLGHDLKEGACTTWLLTSWRKTFVNVTYASRIKYWIHLLVRNSKLVVDTSVSTINVKAASE

SEQ ID NO: 1011781 - protein, 112 aa, Homo sapiens
MSFFLQREGGLTDMSQMHDPRFNAHGLEDAENGVPELLLEVAQVALCHAHMGSTLTEAKEVSGLWLIRFALNTYSDVMQIIVMIPYYPERTSNTDVLTNDGYSNGPTPVKSV

SEQ ID NO: 1011782 - protein, 117 aa, Homo sapiens
MERDMCDTLEQVELMDAVGTRCAAGCVLAVVERSVLTNPAQSSWGVARSHVGRMLSLTVPYIRRGPHLGPPPPPPPTSSSDLRIGQYPSDDGADTPLAQSDEEEERGAGGAEPGACS

SEQ ID NO: 1011783 - protein, 286 aa, Homo sapiens
SGLGSDPDPADPPYPRILPMADGLYSAQYPGVSSRFARSRVRMACLTSLPRKTLPAALRAQVRTSAQMGQEGWSGAQRHGKGSKERECRKGRSTEGKRAEEYGIYMNDRKKQDTAVRERTLMNSKDMFKCAMDKGIYAEAYMAAGERKSQKRKDKLGLNEEEIQARQGQRTADTEQTRRVSEENAQQQAAPQTQKQREEVASQKRQASKRSTPTAKHNKGQRAAPVYRPAEKPTRKDNKQKEKNEGDIKEHKKRRHCEIMRTITDEHHKTMRKNEKRAKTTTKTVK

SEQ ID NO: 1011784 - protein, 117 aa, Homo sapiens
MRNKIREQNRYDLKTAGPQSQLLAGIVVDKPPSTMNVKMMIMAQQLLLTHLVISQKENLQEYKRTNRERYTKRAKKRKPSGGGITKELLSPWQVPVMVVNGKDDMHDVEDELAKRSE

SEQ ID NO: 1011785 - protein, 121 aa, Homo sapiens
MADDEANVLWHSQTYRPRVQGETSLRRGQPNGTWDQAHSILNVTMTPEVEGDLVRSVNAIGLQGKHLVTSYFMVVLHVAIANSREAGIYGACIQFAPNFKLLSFQGKDHFSIKPVSLGSLL

SEQ ID NO: 1011786 - protein, 131 aa, Homo sapiens
SGVGPSELGVGYNLLVCRLLSPLEEHSIGVGVTRFPRCHLSPLSLTRKGNSLTPCTSLVRRCLTLLRLMHGALHPLSCNHCPALPSEMNLVTQLEMQKSPIFCVTHTGSCRLELFLFGHLGSTPKAGFFNG

SEQ ID NO: 1011787 - protein, 124 aa, Homo sapiens
RIRRRLPSAAVRLPRPLPPSSSDASDRLIILLMTNQSGRVVTSSGVRVIATPCVTQEVASYQVRMQDSAKSCPRMRVPWDCRRLQPSRKSVARTFYVHACAMCVIRHVQPERPRTVSQMLVCNK

SEQ ID NO: 1011788 - protein, 186 aa, Homo sapiens
RSPACASPHAAGLGPWLPTPTAPAQAALGLLRARRCPTRASCGTSSRGSIKTVSGSDTQTPELQQALSNGCETPSALQDASLGNIVRPCFLHELNKCSGARLYSQLLVRLRWRRSLEPGSVEAAFELMIKATVSMPAETERNPISKQTKKVDACCSCHWIIAASFYLSDMRLLSSICGGSCLRNSR

SEQ ID NO: 1011789 - protein, 119 aa, Homo sapiens
SGVIRQPRLPRCRDCRRSLVHSVLNGAQAGVQWRDLGSLQPPPPSRLPWPPKVPRLQPLPSRHPVWEVRSVSAWPPIVWDMRSLSAWLPSLESEERLCPAAIPSRKRGAPLPRRIPSRK

SEQ ID NO: 1011790 - protein, 108 aa, Homo sapiens
SGVLKAGLRLLGGYPESLAGVGSRLRRRLSLWVRDPSVVAGPGPSCAGSRAPQSSDLLQSGGNGYAARRLEMSIRSLSPRPFMLVRYGPSCPRTLQSRAPLRAGMSCR

SEQ ID NO: 1011791 - protein, 99 aa, Homo sapiens
RESPPSSSLSLDSLTLQVICQALASKGSSELQGAGATVCHRAQGRVSMTRAHNKDSLAIVDKPYFIIYLNMGWMRCYASTFSFPRDEKWGLLPSGIVPD

SEQ ID NO: 1011792 - protein, 224 aa, Homo sapiens
AGDRERGARLPAPLSRLPDPPSPRGLALQGPEGPLDVLPTIERTFQNVLIDELGEYVDEGGPQRMGAVEGAPVRAPWCPRPGGDALLGRRIPPQGGGWEAVVFPLAAGGPPSTGPRECLAVWTRGALWGVGQRVSRRLLAFLGATLLLGDLVARRGRGTKESPCCVPPGGNCLHSPRGGPQDIMGPGAPPGEACTTHATIQGGKWGRRAQVHAIEDIGFSKINR

SEQ ID NO: 1011793 - protein, 269 aa, Homo sapiens
RAWSSCALSAMCYALGIRHAGPLSLCTMKYIEGLLPPGCPCQSTALTWAKVPVDRCCVDRYGDRVRQWFKAPMTMGCADNEITKECILKIGSTADERALLKRVALSWTELKAVIVVLPVGSEAQLGGIRGRQLIQFDEIDSKWSPKDFEMTRQQVEPMQVLHRKEALNDKLDNTWSSGIKGRATVKDVQTLAMQYAWLNPRSKEGVYSAQWADAQRFVFDRAQHLHKDEHRRKTLQVSDWRYNTPLSPRFPMEHSPLKQYFRILQSRGF

SEQ ID NO: 1011794 - protein, 215 aa, Homo sapiens
MDLGNNDRVRTLGYLTEGPCLTQSCEQCVASFPPVLLSVLWATLEGCQMQVRESSDTCVHTKLAGFAERTKGPLEIHSHRKARRKSARLAQSRQMKHFHDIIGLAIWKPASMVVRGRTREVPSPMRGHEAACVLSANTLTWSQPETLGQSLHTPRRWSCRWLAGRDLELLHLTEWLGQGGHDFYLMTSTAFDISDIEMAEAKSHWGLLQEGCCCP

SEQ ID NO: 1011795 - protein, 104 aa, Homo sapiens
AVHSSLGDRVRLRLKKKKKQKKFLESTGLDEHKPQQTLRNPVVAVTRAPLLSKAPLRKHGRGRAWWFTPVIPALGEAGAGGSLEPRSSKTSLGNIVETVSLHKI

SEQ ID NO: 1011796 - protein, 276 aa, Homo sapiens
AGCTFELGQFRPPPRALCLVAGRLPCGRPGPSRPPPPGHFQRGRLMLQLPPVCPLAALHGGLSEAGSCLLVGAALTTPGALAGLRGAVRVPGGGSTGEADRVCKFGCPARPSSLSRRSPKRSVCAVVPMAPVPYRGRRRIACHFWKLPRAYGETPLLSRHGLWCALSRGASRSCPSCARKVRPRHVRCAWSWHRVPIAELRTGHRPKSLCYSPREALRLEGTPLGVKAATSHSGEELLNATRANRVPGEQRLAPLVPLCVPLDGERRSYFPRRGVA

SEQ ID NO: 1011797 - protein, 162 aa, Homo sapiens
SGGAGARAVGRVVRLERWDSAVGWSSGARAPGGGGGSCYTRLVLALQIESERMALPVHNQSHINAGDRGSDCTENQVTWETGVSDKARQVENSEVASAAEDRKISEAVKASCTGHGKGKSIRINRNLDGEEKGEYCKPLKDVRQSTQFSSKKGTVQEQKDHS

SEQ ID NO: 1011798 - protein, 280 aa, Homo sapiens
MPRRSGLVDSKTPFEWISSSAHVRPRSSRRYGMVSYCFHWLRGNHHLATSTGAHLSRSLSRSSMGRHPFAWVIALGHKQIQVDPCDLHLGTISGEYVLASRIVRDPIGWPLIAQQLPQECMVGTPSIGQKGLAQRALAVDRVLHDSDIYWLGNACGFPLAPMHSYGPFPFKKAWVDALFASALVLLGCEGGPTAENMNGLCMPRRECKQRKHWELHYATDRLLGLERVESQRARSFARKRKGEILAWIGRNFLVKREQSSCTRLNLAWRGKTPFWGEESL

SEQ ID NO: 1011799 - protein, 141 aa, Homo sapiens
RVSRNLPARMKGSEKKPLLPVRGRHLVDLPSVRSARTLAGLVLGCLSPTLRTRLSCRAQPGGLRGVSCVRPERVCGSTLVVCTRMALLSAAVRLTGSVAPGGGGVEQACNSRMERAHGVSGPVSTYRSRFKAPADDRLGQQ

SEQ ID NO: 1011800 - protein, 269 aa, Homo sapiens
MGVSQVLYRPDSFPYACTCCALARSLPVAIDFIVVETIVSTLSTLGSSKPCVTIGPRQIIVNFERVRSNQIAYVRRMNEAWLCNAATFIPEWSHSFLVPLRFLDPVFKSFFYEAKLSGTFWLVEDFDVDTVGGGRFYTCLGSNSLFGNLFNETSHEPPSFFSVALVPRGSGMAHLKDDFVRKFSSCMRVLLSWSFSLSLGAGLVMGPWSSAYVSWVGGPSNGFALSVVRRCTPGVPGRVCGNDRVSPLLGVEAMVAPTVFADPGVGVRT

SEQ ID NO: 1011801 - protein, 343 aa, Homo sapiens
MHASRKPSSKPCESQHVDSGASSPVMLPFQAAARNEGPPDPMVGPYCQIVRPNCYGTLLTPGTSAEWRLLTPELREPRCKRAVTPCMCIGGRFRWDRLVEDHSLHHTYLNSCTYPSDATWDNVSCFARKVSEWSSELRVVPGMTKGIGRYEQISPLGKAKKYRLTIWYLQLLKADERLTLEPQEGSSPVKKKRFEAEEIRLRGDGPNPRVRFPLQVGPQLLGELKETSAVTSFCGRNLPEGWLNRAMAFRATLPLGGVFFSRQHWYALTGTPLTILDMRVECNRIILSRFAVPLVNLGSVPPHVASALELGAPWHVIHWGARFSQVVKRDGGGGPHRSGGASS

SEQ ID NO: 1011802 - protein, 172 aa, Homo sapiens
RGTAAACVPPAGGTLDPRVLRYTPVPRHGCTMAALKDAWICRRLKEAFSLFDKDGDGTITTRRELGTVIEIPVEQNPSDAELQDMINDALDADGNVDHRASRMFLTMDGPCKDAIGPTDRSEEDDSERSSRDLFDNGMWKWLLVILRDRSMPLTIDDRIPWGEKLDQMMKLA

SEQ ID NO: 1011803 - protein, 107 aa, Homo sapiens
RVVRPGEAEVARSLARLADSPERSVVGRSAMVGRESGLCGRGLRLCRRWHARMVPAGPGSNGTSPRSFFPRIQCGPSGGRGCRPPILNEPCSVRGARPPPCAPVTDA

SEQ ID NO: 1011804 - protein, 69 aa, Homo sapiens
RKGCEAHPGGQLGSERNGVRMDEDVLTTHARSSSSSRELRVGKVQPCSGGSQSDTFDPRTCSERIGVDL

SEQ ID NO: 1011805 - protein, 110 aa, Homo sapiens
MLRTWSRNAGKLTLCSLFSQTCGNVHCNRSHNYVCFFGYPSFKYSHPHHFLKTTCMLSVDRLFSSSSQTLEKGSEKITVKEWYVHRRTIQCLSLIASREVQSDQSFCDHH

SEQ ID NO: 1011806 - protein, 131 aa, Homo sapiens
MTRTIFVDRAGGGGWLAAAVAQCPGTQSRKCGSGLHDGIGDSDCLRGIPVAKAIAVELSRQQSEESHAVNGCEDPGAWLLKGAHQNFIGVSEEFEQELCTSRGHTTTGQLDLGYSEGTFSKMAFEKAHMKK

SEQ ID NO: 1011807 - protein, 231 aa, Homo sapiens
RFTVPITDVTENALKDLDDVMKTTKIIIGCFVAITFMAAVMLVAFYQCCARAAASSTSTTGPLRTVEIINVEDELPAASAVSVAAAATAASGGGVGGDTPPGPARPGARPLSIDATTTWLPPSMAHYSRATPSWRGLRGRMARPWSSSPSSETICVFKSGSKENVQRDADLMAAGPGGRGAVEPRHQVPNRTQYMTGNPSLHQIQSAANWSTAHGKSRRKRILHNMVMRIG

SEQ ID NO: 1011808 - protein, 360 aa, Homo sapiens
SGGVVAVTRCVRRRSPCSVLVSSASSYWRASFPVFAPSVSNLGYTDVEGQLLLLCAIPPRITVAESPCRVLGSRRLFNQIGVSLKYTAGNKVIHSILQDLVIRLDKGEITIEIARCVDHSAWCGSKLSSRGIQYEARKVHPERIALREKLSVRDAYALVLSRIEGRASSTKNLGRDHSWENNAYIDSRRMRARLDPTGFSFPCLASSEAAIEDSLFIGMYIRRAPIVAFVGLGAALRNVALSLYSPVGVTPMRGNMQRATITPRVGSRQLGTLMYIGDEGLTEEVLFNVGPQYVRRSGGYEKRLHEQKAYNSSNTITRDPMEGISGRFKQTIRKYSLNWLQCGCLREERSKPPQRNVGLS

SEQ ID NO: 1011809 - protein, 208 aa, Homo sapiens
SGGRGRSAGRRVLWRLPRLRLAVRALAPVTLGRARPRPAPAPASSRWPRPGCKLGLRRSLYSDHSASDECGVRRTLPSLLVRWVYRQPGTAASGRAHRECMGTVSVLVDATVTETELYYYGINQSTRDGEFQTTSRQGRPQQHTRDNSSGLIQQRPMRSYPKADCAHNEQFTKKPPASEEAAYTQSNSELYTLTQSNETTNPCATNLY

SEQ ID NO: 1011810 - protein, 104 aa, Homo sapiens
MGLMEPWSENAFSYMDASWMRIDRWHISGFDVYVNDYKGQTYMKALTGKIMKKFNIGQLNERSRERWSNVERRNDALMWVTENNNNGRTKQSLMVDGINKRLMK

SEQ ID NO: 1011811 - protein, 108 aa, Homo sapiens
MTRIINNPKISTPTKDIETKNTMDRGEPNMASNPNNNYFKTNSQTQEDRKKMDHPERKHPDCMSTNEGNELDKSLIIHQNNGLRPIRIDEKFTQFSNSCNNIYQTCAM

SEQ ID NO: 1011812 - protein, 67 aa, Homo sapiens
AGSLVLEGGRRGKLNKDESSRAAIHLVEQRLAIGPEREPLAEIYRRQYPSRKMKEYSRTSSMFHVAC

SEQ ID NO: 1011813 - protein, 135 aa, Homo sapiens
MGSQACEIWDPKSKLNWKPQFAYTLSCQIENRSLNVEILGIKLKENLRVPLKTKIFRDSEKYSCIKRAFSERRKELPIGDFCPEMILPKRENAVVKKKNEFPLGANKVAQYLKNYRKALVVQEPKRFFGKSLQDF

SEQ ID NO: 1011814 - protein, 101 aa, Homo sapiens
MVTWPTATYTRYPAATVPRYSVVREDKEGTEQLPTPVNIIAEPCYIGGNLAIHLSSSAISTKVEAPTSMSLSIMFEINELKRIHFDIIKMSSQYPNLRIDI

SEQ ID NO: 1011815 - protein, 110 aa, Homo sapiens
SGAPPGLARTRSRSLTLLVPMWAVFVLVPAVVLRLPIAGPWQRDKTSKVLQYGLPERTTNKSAAYSRGQLLPVFTSVHRIYVERDQRMRRVEEKQKLHYIRGPHAMKGGT

SEQ ID NO: 1011816 - protein, 188 aa, Homo sapiens
SGSLFLGRVPTERGDADRPVSRIDGSPSAARLRGASMIARTEVATQARFTPGDQVRPHMLERWKRYSCAEDPRGIDYRAWKKDAGAQICDASRTRFMEGIGERQTQRAQCVSKWAYREVSLVPLTCHGGMDSACVTVQLEILLVREIACTSVSSKKPPRGQCVESLHLLAHAEHQAPMTRAGVVKNSE

SEQ ID NO: 1011817 - protein, 190 aa, Homo sapiens
SGAWPGEAEDGGGGPDALGRKSLVPLSYVRSRPVRSATPLRWGEGQDLGQDKRSVLSYKRAYTSKREPFARPSLQWVALSKAALVLSDRPIDAPSPPPLLCLDARYLVVTNVADMHDLRVSVVRLNRGLIVGFTLERQGLCCMGLGPRRSEDRPCGLRCPGAEDDCAGTRTTHPYQSDVQRWTRKPPDGI

SEQ ID NO: 1011818 - protein, 225 aa, Homo sapiens
RGERYVTGRVALAGAVQLIPGVGGSGGSSKGVSPGEPVQLSRWDRASRKPQMVPAEEDWALNMEICDIMRDETEEGPKDGLRAVTEENVGNKNFHDGMLASHRLRNLCQELRAPGSTCWWPGRTSWRSVLVRTMLPKNNPARALVGHDKVLNLIQVLGLTSFRSVGRSDEVWSPSDEDLQEERPGVPHDVTWTCCQRMHRAPEDRVQLRDQSGQETVGTDSSQQE

SEQ ID NO: 1011819 - protein, 242 aa, Homo sapiens
REIPAGSRKHEMLPESWIGLHSGEHMTMDEDPVFYPVNTLDRIFKSDEASSYGYIHGLAFEKELSRQGEESSEAWAVSDARTERNVDSRAGKVVTSAAICDVNIRVPEKAEVLSRKQRRKPQAKEVKSLARKVARARRHCKTRCSGVDTDDGGRAKEASTSSPQTVPNSGYPKEPAAIVSWDPQSPGEGPTHDLSITDKLINWRCSRARGGDLACSPCELAKTRLQNQDGESHVQRNDRMPE

SEQ ID NO: 1011820 - protein, 247 aa, Homo sapiens
RRRQEQSVKTVPGASDLFYLGKESRETPVFHHKPLSKTGNGLAGHEGWTIALPGRAAGPEWILGVKESMSLGCPRRGNSTKRRVRLEEPLLTAEPGVLCEAYAGHVSGPWVIFGTGIIGNTGLVMCIVGTKYYMRRHLHNPSWANWASGNFTQFIFFLASAGSSSNEADQESGCWRDFSLARIGALYRGSVLWEINNLSTLMCSVHRTGFPLLDTQKYQMVPTQMIAELVPHKSGQTCWDIGWEHYC

SEQ ID NO: 1011821 - protein, 140 aa, Homo sapiens
SGSYTFSRRPGYPVMCVRVGPRAAGPCGGAHCPHYWSYSLDLACTPWTAFHSLLGIPTSLSVLTPGVICARRGDFMPRISSGSLSCELTMVGKDGVSSEDSAISERTIEQLKRSLRQKCDPIQIRIDRRVEAPWGALELP

SEQ ID NO: 1011822 - protein, 107 aa, Homo sapiens
MARSQRSICKRVAAPKHGMLDKLIRCVCSSSIQPVPHKLRECLPLIIFLRNRVKYALTGDEVKKILHAAVSLKSMVKDPKRDITLPSWHSVDCHQLTKTGENFRLSL

SEQ ID NO: 1011823 - protein, 123 aa, Homo sapiens
SGHSGDVRPSDRECSVVAPPLNTENSNYRVTVEQEAHEDSSIHWTRVSHVATRRLNTRAGNATTDLGPHTAPASLCGVKSKVSAPWHTAYDRPPTEETNMALDRAGSKVLHVNASSVLDDIAT

SEQ ID NO: 1011824 - protein, 230 aa, Homo sapiens
AGSSSGLPPCLPLLRHDPVDTITGAQRLVHLSYRPLYGMLLHKRPETDRLYVLRASAVIRPDSILSDKTKPFHSYILWHNVRVMDTRLATLQGSERLSFPAAIVTPMTVDCGVLGRVHTRTSRLSLLPRGTDDLGPGSPVHCLLGAGSVRYVPRFLGAGEDPSLHSRPLALCRCSAARLVTLHGSGSVGSMGEMSLPHVALRVRVPWCSRLDWASPNGARRISRGPVLQL

SEQ ID NO: 1011825 - protein, 249 aa, Homo sapiens
SGCDCRRALPRRTSFRIFLVETGFRCVGRAGLQLLTVSDLPASVPGLQTESRSLSPQCYPGWSAVACSRLATTSTSQQPALASQSAEIAASARPPPRLGSEERLCLAANRLRCEEPLCPAAHRLRCGERLLPRRPVWDVRSASAQPRPRLGGEERLCPGAPSAEVRSPSARQTPRRQSEERLRPADRPSGRWGVSPRPVSLTSGDRRWGTVPTRTSQTLRDGKVQRQPANPDNRADWEERWGQPRQSQQ

SEQ ID NO: 1011826 - protein, 276 aa, Homo sapiens
RLLLSDRVVCLGANSRERASQHATGRNLGYVAELMCNPAGGPFGATSRLGPKGSADAESRRSMWLLDKHRRVVSGMGHDFYPWNDPQTSPVELPRRPCIEERDPLGRPLFGIGLTPVLAARFRPIRCVARNRSWRSIESLDLLPLGLAEHEDRISFSMMTACRNPESFPPRSALSSAVLVRTQRSALLDPRHAGQYSNGVRLTAGVVLKHFRCTFNLSRPGFPMKLIDFRLWRISPTGGFVRPVAAVKRGTKLPQQWAKGLEDLASLEERIRKERI

SEQ ID NO: 1011827 - protein, 361 aa, Homo sapiens
AEEGRMADDENRAARPGTNAHVARSLQAVLYYFYHITRAAQPDGSRPTWPTTLGTWSAHHIRGMRRSPVHEAPHDSDYLCLSDSHKPKIHGRPIHPSVWPRSIDHPVLKGSEGPLRMNCPQTRLRTPCKDFTCSRGRTRRNLVKRSPGRIHQDIQDVARRARQDRKGPEEMHLGVALAMAWTVHDWQEDPLEKRSSLQYMAARGDRVGGLRQRATVVTTERIPGRFHILVPLPAPPWSLQRFEREAPQGRIGLLLVRPGAMWVRRHLVARGAKDSAHHGPSRPQGQKVGARETPPREIPPLRRIPVVDPWAFDIPDARGRPGASGTRGAPLSQGIPAAWPLWWFSPWFSLGRHSPGIGGTW

SEQ ID NO: 1011828 - protein, 225 aa, Homo sapiens
RCRASHACSSENLTGLVVLTTCLGQPASAWYEGASASMPQPGELEALAVRVRVMLGWAAVAARVVPLLSQVRKGSGALLTSALPHAVAWAAGMGGGGAWPPAWEAADEAMAPPEEPRGAGNTEDIKAQWAIAQQCVKRTKKRPTTSKRRKATLLHYPEKASPYEGAPRRRDEKGRSDEPECQDATKATRIPFLVAGIPSYGRREQQHSRLRCGGKPRETERTEGH

SEQ ID NO: 1011829 - protein, 123 aa, Homo sapiens
RLFTANWVLPAINTRVSVKYYPYIEPTMGNRNIIVDINICRRLCTPLAFGGNTSTTYLGHSDSHKCSDVHSGTKSNLVEDKMFEQRECVTEHREEGLLSGYGLSSLGIKPDIACSVNDEYSAT

SEQ ID NO: 1011830 - protein, 105 aa, Homo sapiens
AGCWCLPGDSGALGFVALPSVCSAVLYRRGVRDRDVVWLLTVTLEQESAVSRGTPASCMGLDVVQFCDPACHVYDLGGAGLRAPAVAEGRNTVLSPQKFGLGQNI

SEQ ID NO: 1011831 - protein, 111 aa, Homo sapiens
MAEYLISGGTLLRCQTERTSASQSAQSSFEPGGRRAFEPYNWTYRQFSHGYTQTFSVQDHGWILNILHLTRENIDLLEDPASGLYTSYRIGKQRSATCKGIGRMGLPLAYN

SEQ ID NO: 1011832 - protein, 155 aa, Homo sapiens
AGGVGYGRSLRYAALNLAALHCRFGSLSNRQSFALQEADYGIAQDSNDTRVSPALYDAGFYVLGARSEIQSSSVRAWSTSCDRTAVHIWVTVPRLPGNTVPCSTESLLLGRRETKLIGCPRGTPTSCTVNTETGPSSSISDIAQKTVMWRLYGRW

SEQ ID NO: 1011833 - protein, 442 aa, Homo sapiens
SGGRAHAICTPPIAPSHSRVTFSLSTLQQYMSRRGSVIPGPQDKPTQHHSGPVLHDTTVIHREGHAAEQGPPHRDTGHRSTDGTHAPAASQDQQGLAATEPRQTRTDQQRTPERRDGRKAAKKEKEGTRERRAGRGGKQRLPGNRGAHMRGARVGKEGGRRRGEHRQQAVEEEHNARRTQHTTLQTNTRSGRPHVETGRGQAQLHTRLAQRETEERQIEREAQQHDTHDSSSLGTHEPPQTTHQNRPRQERHTAASRTARASGEPTARVHPPAPPTRPTQTETGGAPSDRTPATNHTDARSSQRQPTPPTQTATYTARTAHQHYTQHDAHDRQADGAKSVTPPKRTCPTNHAVTDHTEQGKVGGERQGSYGRSAGEQEAGAKGGRGGARTQPPRARRDAAARRPVTAGAHETRHSTGPDEQAGPEQRVAAGATGASDERDAR

SEQ ID NO: 1011834 - protein, 191 aa, Homo sapiens
MSIEKIWAREILDSRGNPTVEVDLYTAKGLFRAAVPSGASTGIYEALELRDGDKQRYLGKGVLKAQGWGTPDRFKVHHRAALISSGLSVVEQEKLDNLMLELDGTENKSKFGANAILGVSLAVCKAGAAERELPLYRHMAQLAGNSDLILPVPAFNVINWWLSLLATKLAMQEFMSSQWGAESFRDAMATK

SEQ ID NO: 1011835 - protein, 175 aa, Homo sapiens
SRDLSASWSLSAVHSSDVQVALEVGLASLCASEGGSGQPSPQSRLHHLPALWLDGAAGPQRDGTNPGEAAPRAVNGKNWLPREMYSAASTRHWGPQWAWVRQLAWAKRRRLGGNALGNLLLIQVFTLLHTFLPLNLQNMTLSWPEQGTAQVYDASAYGAGRRAVPFQWAATTHIL

SEQ ID NO: 1011836 - protein, 61 aa, Homo sapiens
MENERIGHDDLGATIKVQQRDIAIVVQRENLERQPVCSREQNEHMEVARFTTGVTERQRDV

SEQ ID NO: 1011837 - protein, 199 aa, Homo sapiens
RVVMAGVLKKTTGLVEIALLCNTPHETADSRVIVTPKIHRWSVGGTIRIQKMQTNIATITAHRVDQDADSLAYWLYQSAHRDCLKQVRETHGLLQAGADLSREEFGIHLYSLENSETPDKLLRHRHIDSRIGENRERPTGGEGLQCDVVEPKARSVDANSKVGTQWPRLCTLELSPGVEPVFASRCYPVGGDILTWLHV

SEQ ID NO: 1011838 - protein, 166 aa, Homo sapiens
MNHGVVIQPAYKDQIKHYPVWDSKIQGISFWNITLVVMNGCLHGALLQIPIGIWGMIVQDIGPAYTVVCTGPEYPFRYKFSEEHLIYHLLCDCPSSPHGRSGRSLGQGLRTSAVTLSHPYVDHIWYPAIPPYQEPYVIRWGKDANLPWCLQLGDCERPLSKPVTRG

SEQ ID NO: 1011839 - protein, 60 aa, Homo sapiens
MIVKERDVVWSNAKTLDFDVRCAQNRVMHDAPYSGKAFILQGYTNLICLEEKLEHGSGKH

SEQ ID NO: 1011840 - protein, 46 aa, Homo sapiens
MPSKQEDERTPAGAPRERKRGGCKRSAEQRRASTEGRKDREHERER

SEQ ID NO: 1011841 - protein, 105 aa, Homo sapiens
MENLHGQTALSGALNLNRLLLSRNGSRKHSPHGNGRGPLGVVYFRRGIEFWWTKAVLQTNFLAGLLAPGKFSEYPGKAVNSGVTDEFTVEALELSVWGKTIAHGD

SEQ ID NO: 1011842 - protein, 117 aa, Homo sapiens
SVGSRWTALRFCFYLRPEPHSCPGAERRRESARGLRGLPCRAGDRHGDLEKLMKAFESLKSFQQQQQQQQQQQQQQQQQQQQQQQQQQPPPPPPRRRLLSFLSAAEGRVRLSERRGG

SEQ ID NO: 1011843 - protein, 265 aa, Homo sapiens
AGAGGARARSGEDRGHELGANHRGTAQPAPRRGNRRSPWACGAGRVMLGTCLGRSRKALRWKARRRTVMRHLTDIPHDGSGTRRAVRRVDPWTEDKRTQNADGHQSALPQEALEGKDRRSMDELTMADPGLRIESLTNIVALDDILLRVGAYSLLVICSTVGSRHGELLGLVLWKKATDTGAGLPSQAHRSRCVDAVTITVHDLGHCITGSLRGHENLACTYEPWYERTPQTSIDLSTFGPLPRLGGTLGRCALQRRVETPGYVA

SEQ ID NO: 1011844 - protein, 135 aa, Homo sapiens
MAGRRPSFGRTWTEIDVLEASSAERVETLGVEVTGMGTMGHCKSCDARCSDIRPKTSLCVLAEITVVRETYVASIDYEGWNPRVQQKVRALCTHVRLDLCGGVHQCLYSESALGPYSIHWMTSRLFSHCEGQISI

SEQ ID NO: 1011845 - protein, 109 aa, Homo sapiens
SGRNSRAEKCNWHTIEECIRTFYGITFYGRNDLAEERISELKTGYLKIYVENDKTAKKDKKRHFPTDIENLSLKKGNLRVIALTRRGSTQETGVRQRLFNRKNNRASNT

SEQ ID NO: 1011846 - protein, 283 aa, Homo sapiens
MREKDRFPPCCFLPVAAAGCACASVSASARAHRVRSVCECERVSVCACACRPASARSPGADAAGFSWGDCRRYTTPRQMRSGGQRVATAGEGRLALYPEFPRERTWRRSLDAVTCVREGTMAVYDGLSEDPQRYRTVEKASTLGRQPWHAELVTLAAHEDGHIRTRNRSYSPLEDGDQRNRAMIYAISIQTVDLRTLVSSETGTEATQSSCDTRKSFVKKSSACGASDWPVFTFMVPGSVVVGQAQCRMSEKSLAAGTFALFQLRPPAVKREKPFQFKAAPYP

SEQ ID NO: 1011847 - protein, 226 aa, Homo sapiens
AGGPGAAGAARGIAVQHAEPGLVLARLGAGGREDAGWASPGLGPRSRLGRAPRAAPSSRRRLRVQGRGPESLRSPPPAPAGPRTALPLMPQPQGGRAGPGAHWISQPSSPASSFPLSAGRPADAEGQALRLIPVRIPGPDRRGRYGATGPEPTEAAAQEAGRRQPCSGEARPLQRATTRKRTPTAPEAPAAGGTRDPGKAPAARAGEIPRNKGLTLDHVLTRWYWK

SEQ ID NO: 1011848 - protein, 301 aa, Homo sapiens
AAWTRILQGIVVGASCEERAGCDARLGGLALQSGVGLPPLLPLPLVGLGIYRGWLRLDWVRGAVTPRVEPRNLLCEGLWAQRPRREARRCARVMCSRRFGGRGGGEPSRQRLGVLPWVRAGARQALALLPCCDACVLPLARAFATASFGEGPDSSQREGGRVLTGQVSPGSHRVGAAWGNMGRAPRAAKNERSRPESVPGPCGPGAWPACRKNETPRGVRVPFDDTRRSAASNMGKGVAPARAGGRVYLKEGKPPDLVTSIAQASGTGLAQKQARGDPLQGRTGGGSAQARGRGLNTNGPT

SEQ ID NO: 1011849 - protein, 225 aa, Homo sapiens
RARPRKSMKGYMHSGSCMHADQKDDYGVLQCSSRPRSGIDYTPVTGPRGRDENPSQSPRRDPRAGKDGARKPRRRVWADSRHEEEEAACEGATACDERLIWHEDDGDEWSPSNESHKQALYRVTRKRSRAPLKGSHRVWYERVGEQGPDWVQRHIALRALGGKPPQVADPGSYETFENAPQGTVNEGRTSACKLRDRTSLEERNATEVRGQAGRTSYERNTEPEG

SEQ ID NO: 1011850 - protein, 77 aa, Homo sapiens
MTVEEASSKCARIYVNEELTRGELDPERDGLWLAVRGWGGSRAVRRAMECPAVAQRVVVSVWGRNCLQDRCGAASRE

SEQ ID NO: 1011851 - protein, 226 aa, Homo sapiens
RRGWWRACGRAARSGPCSPVSDAASSLSRSELWRAPHPARPAARGGRTSRWRNDLQYLREGLVETSSARVELEPEEVRAIGEKVSLAQANDGEDQGQRRKAIKGVVQRQVTLIQGACRNSGSSFTGAQEPGLLKTPPTLGSESKHRPLDELGRVLEKLKDYPCVREHQAGARGRMREEGRWGLFPDDVSSVSSLLLFNNTENLEKKYVFLDPLAEVLVATEPCDAG

SEQ ID NO: 1011852 - protein, 264 aa, Homo sapiens
MMSTMVRGHVSLIVLLVVCVHRSRVSQQGDKPWCRMSCTRIQYKVPKMDWNGQKSVKKGMHVPEPYCEDTTRTRIDIYNTEMHVMAPHPRTEALETRTICKDVTRESRFRLTSMNRHSKWFPNEIAAIALVALIGCYLHLHGEVVSYSPYVVMAQTWGWPQAFQLFTPSLSSTIPQDVVYIGRSSGGKTDEPQNCALSICRGIIALDTECPIATGTIPDRILGPLAAFIEARYSSLVKGGFRLCAKQRSVSGETLLLGTSKEDS

SEQ ID NO: 1011853 - protein, 114 aa, Homo sapiens
AESAAAAAAAAAAALQSGGRGQAGVPSLPPSHAMSQEVRGTGPPRSDAAETSSESTKCKRGSMKKGEIRRTEGEGAKGAGIEGGAGDGTTTEVEQSLNESNDTETRAGRRRARE

SEQ ID NO: 1011854 - protein, 197 aa, Homo sapiens
AGSRLSCTLSRRASLMGVCCILGCGRTESGGGRPHLAPRCGLENSEKAEGEGEREREGTRRRSASITSLQDVLEAFPVPCHGLAVLVKVAGKPGKNRSAGAIHSPYRGRQTCNRTRRDGCHHDRGGTGLQARRPWRSHERAVPSRVTWCKDRSPPAGTTGDARRAAGSRNKRQPISAYGQSNSFYMPEGPAERRRRE

SEQ ID NO: 1011855 - protein, 258 aa, Homo sapiens
MASGMCKRLVFAGETTLPEPVFPFQSVWTHPITTMGVNDWSIGVHEQELHTMSQIEEHQEDYDRGAIRIEPLAKDYRQYYERPIGASRCDPHNLCAHSSHLRHGEEIRRVILAKLLFLIHILDDVGRTIGNSPQSKCMAIATKIGLGLGSRRGTHTPGERSAKGTHIQVRTQRTATCRYFTCLVTDTISETSLAGSTCICVCVTLRQVDPDEPGNLFIATILRGRQHNLVDTLSYEGSSGRQNRGVPHNQSRFDFPNS

SEQ ID NO: 1011856 - protein, 132 aa, Homo sapiens
MAYNIRHTKKQPEGMTTYDFDDLRETRKDRGQQGDSLLMLQWITVKDRLVNNVRQIALNNRTCNERFHTAPAVMHHIGSSAIGRPGKLFEAVISRPCNCDLSLLREESNGRLCVLKLHVAWDRDVGVLQVLP

SEQ ID NO: 1011857 - protein, 124 aa, Homo sapiens
RGGSGQSTVDAGRWVRAECRRGLTPNRRSSRTVPRSLPGSRARLVCGPRSKRGVNLSEDLEWTSAIMCEPGNWNATKYDVSQGVLMVVGYRMSAIVCASVDMRSRAPSDLRSLHCAPTLRIRYV

SEQ ID NO: 1011858 - protein, 256 aa, Homo sapiens
RGVAGRGGPSVRGGPVVVRAQAEAAPMPVQPLGACWIAGDDGRRWCRLCVGGPAGLATHGDTWLSLAVSEAVAYRGVHGSPCQETDSAESGLVAERSPTGWTAVHPFCHSQAWRVAYALYTVVVQSQLPGVQASQSAVTRLRCPDALGGRRNPGVSANIVASAALFNNALTHGRLGTLGVPGSGLSTPWMTQTVGVPSLHRRTVLRVHYGVAFGFAGFTPKVHPKFQWTCPIRFRGRLRLRETKSKYVPQFAPRVT

SEQ ID NO: 1011859 - protein, 187 aa, Homo sapiens
MLDVGRGGAESGPWAVWGTGSAGLVPCGLAAMVLLPVYAPRDEWRACQMRSNDDLKGTCGEGPEMKGRRWEGESCMLVGCLGSQGKEHRSCMLDRRIIHVRMAYSEDGSVQAATVAVCLQDTSIHGSIMVHCQSPWVDLPDSTLADSPPEAERHPWAAIGAVLHRPRSKACSLMTVSGVIQRLWADH

SEQ ID NO: 1011860 - protein, 249 aa, Homo sapiens
MIGERAQRDMEKNQNEPNGQTPKKPLTRDRQAGSQEAIEYSQPSRNLAPKSAAPGASGLRERTQSTHEGRPKNRRTEIEKEARHTSERESRGVRKAEEHQRGRPQGKEQAKKREAPQLHQGTRPEGQPKHTPSGGQYRHEQPNATHHTRKPGTTTARGKTPRHYHTPSTGRQKHEKDQQPRTTPNRRQTYNMNTNAQDASAHTAAQPHDTTTSNTRHNPKKTRPNRHRNNTNQKTPSEPISNNQSEEKQ

SEQ ID NO: 1011861 - protein, 141 aa, Homo sapiens
RGEAGGGRREVLGPLKRPPSRGSARVWAKRVCEDRGAHGTSPDSRRPKGCQRVTRQDGVPGNKNTRTMERAQQPRDDTGCMKLEDWETSMDRRRERDAEESQEVAGNHSKIVVRNECNEIEPIRSITRTMRTSKKAKLANE

SEQ ID NO: 1011862 - protein, 107 aa, Homo sapiens
MVTQFTVSMIRGACVTCIITQMRSGGGRFRLCRYACGRPLAWTGTCHVTRSHLEVALPRVTRVAGLVGMLFILLTLALVLGRALWLDHLYQGKHLPRCSSMRVGCDT

SEQ ID NO: 1011863 - protein, 199 aa, Homo sapiens
RVRASPGRAWPCPRPLASSRPASPASPRRLFRARHGPPQALCARVRHAQLPKRQKPTLKYHTTPGALSPRSSGPRGVPVACSRAKPRLHSLFPQLRKPAGETKMLLLIRINSEHLSHAVKLDCYGARRFRRGIQPNSKLEEVPTSCEIGKSDYLNAQAQGDAAHQRARDSGKQGGRDCTCQKGNVHEEDRKGNQKKSVK

SEQ ID NO: 1011864 - protein, 251 aa, Homo sapiens
RGVAPFMTEGRCTRGAPPGTHAQNPTQPVKSKSTGGPSPSSRASHPMRAPIRSTYRQPTMSFHYPSNTLSVQHYRSAPWTSYSSITPLGHPHIGLDPEVRLRVLCQVYSLFDRRYVHSGLPTVFSGAPPEQVWAKFPVTHVHPYETTHSHSCVLPRPDLRTLYSLGTERLQGDRPHLKCKRQVAGQRVQGPKDDGSTKRAVRAPPLWCSEPVERPVITTSSVTPYRVNSDEEWLVYQSKEGPQNVAREFAV

SEQ ID NO: 1011865 - protein, 155 aa, Homo sapiens
MADPDDAHTRWQLKCFLCHTLLALRDIEVKRQIPLCVFVLEYKWSTGGMRWSAQKGLRIAMNPQSFPRHLVIDYYSLKWFRNLIIGGVYRPSTTKLLMHDVHMTLCEGDCDTVHLGTTLSSMRSRVSHSTIWLMHETGRTCQRDRAELTSTNLQP

SEQ ID NO: 1011866 - protein, 102 aa, Homo sapiens
MAKGSPHPKRRDSSGERPQGRGGQSRETEFGGPTKAARKPVAFPRTKRQGPRDHEGHRRKRELTHFNSNSLKVAPELRSTRQQSAYRSAYWSNEGGNTGPRG

SEQ ID NO: 1011867 - protein, 85 aa, Homo sapiens
RNQNNGICRQPGMELADDYSTVKYTQEWKTKALYALTHKWELSFEDAKAQNDLMDFGRTPRERVGRQGDADRKTTTPEYIVYDYV

SEQ ID NO: 1011868 - protein, 147 aa, Homo sapiens
MVTCPQQRCNREGSIEHCSECELDGCGSPLLGERESSDHEVNALCDQFSRELERYARTCLEIAYSSFYSEEVAINNSLSLKYETIVQNLSELVDAAVRGGCTVERYNSLDTIAARERLRWVLHVYEAPVGTTVCARTDNELAFAAWP

SEQ ID NO: 1011869 - protein, 179 aa, Homo sapiens
SVGARGWRRKGGRAWCRWSAAPPGLGGGPREAGAAAHEGAEHRGIMELYRAGLRAEGERVSTPEVVPKIRGGTCWKLKRGPHFARHYQIAKGPSVLPGARSASECRGPQEDPLRARVLMTTTVEKRVPKNPEGDEDNNGKGGWAPSGEAHEYFVGPQMVPGKTRIGKDRLERRNRKGQS

SEQ ID NO: 1011870 - protein, 271 aa, Homo sapiens
SGSRALRREALRGSTLCPAKPAFGARLVWMDPVPGDRLVAAGWSGLARSALCTPGRVGASDWRLVSVTPSHVVAALHYAFGSMLCAQNLWLALLCLEFFWIQSQQNPPDNVVVDIQVVCGDKRPPDCLGCASPRTMNTPNVIPRSTGAPWYETHVLLKAVGTSECHGPRGVLRCPVDMGKDQDRCLDTFLYVGPVVRLCQSWCQRANGPERQCPIPEVSAGIMQGSLSGWQDSQTMKGGLPGADQCPRVMLLGLHFCVKDIDSICEASKPL

SEQ ID NO: 1011871 - protein, 136 aa, Homo sapiens
RLEDGARKQEPDAINVNTQQNWIAAVGKAPQDKPFVGKKNTSRDAQAAGVNSVIGGQSSGGWKPRKAPADILLLGHMPASSAPSSSRALPHSNMHMRCHTSVENATTSCNDLRDWLHFRVHRKLSRKSMKRIHPGA

SEQ ID NO: 1011872 - protein, 126 aa, Homo sapiens
MPKGAAWVRSSAPSRGTARTSYLVPIDCCLTPLVSRVYSSGQVAAVRALGLSRPWGSEASHGVVPGAILQRMEHCCVSQRWHVAPIYSLQRNTLKRRSPWISKRYSAGCFPWCRETQTVWRIVARL

SEQ ID NO: 1011873 - protein, 245 aa, Homo sapiens
MKPRPAGFVDNKLKTAESSSIDYGREKKEMLVGFRRKVFSIISSEKELKKFNRIREMNIWQKGRDKVKRIMSILKAILMMIQVWKTTQIHESANLLVNMFPACLVYRRRIILMSVSDTPEMEQRETTLFNHALNKFHKSGSIPLKTPAKDSEGGMVYGLESPSVEEQTVCPWTCHVRKVILRKPIHCRYRIQKILLYRRVTMKRKGKARAIQEANRTHRRSSGSRWSKLKLSYHRELKPGGRMPG

SEQ ID NO: 1011874 - protein, 134 aa, Homo sapiens
AGSRTSPMRPDPEGTWLCNLCSVCAAGGCKKLVATLPDPWMHVCQGDDGDKRQLVVSQSAVGSAECWCECQERHESSTSAQDREPRTVLFTGDSGFSVSPFHGGQFLLASQVTHVRSPLAAATTKFVTYLLTSA

SEQ ID NO: 1011875 - protein, 75 aa, Homo sapiens
RKDGSGWSWPSEASGIVSAAADPPPARPGVCRPRTVLYHKNGCGLIMKILYHVGPIDKHYLKKCCEHATWIGGVS

SEQ ID NO: 1011876 - protein, 191 aa, Homo sapiens
RGCGAARGGAGRDARSSPPASPRAMAAGPAPPPGRPRAQMPHLRKMERVVVSMQGPRPGREDAEPGPAGYRHSPRGDRQRRRAVVGPEVLLSSEEEALDLGAVLVPGVVTSTRCATPRSLMLRADETPYRFQGQARGLHGGSRWGPGRERERAKALHKSGEHREGAGHEGLTAKSGTGGIRANGWASTDID

SEQ ID NO: 1011877 - protein, 268 aa, Homo sapiens
MAGAGMLGASGVVVGYLHIKPGYSQQVDLRTHSGWFICETVGKRRDDKSQAACKTSQVRPSRSLTWGVHPGALSKTQHYAMASKGSSAPHPWSGEIYIRSRGLHLGALATNTTITLFTSGDKPGDPWELIFGHHHESSVCARQSVVGQAGGKVEVQAVMGSREPIDPRGVRILDALRRGRVATNGAWEWEALRVVTQGARPGCGKWTDGGTLGVAMLVHIGVAESSAPTEGKAVRTKQAWRLAKGFLPPKTNLGNSKGYSQHWEFNEP

SEQ ID NO: 1011878 - protein, 258 aa, Homo sapiens
SGRLPASPPVRSPARWGSMAGVRRLLWGPRCRGRSAFWCLLLLGLFRPPPVALRAAGKGAPSGLRAASPSLAETGAPRRFRRLSAPEVTAAGGGAGAGAGRWRICWRPKRQERARAEAQEAEDQQARVLAQPAGLLWGAAPVTSDSGIMGSGRRPRRALQLQASLCASVSAPGLTPGDLAGQPCPSARYQAWGSDAWTPGRTYKGPVRPADAVGGRAEEDTPTAGTPETVREYLASATDTSRANAKCPERRWEPREGP

SEQ ID NO: 1011879 - protein, 197 aa, Homo sapiens
MRVVTSISWTYPLAPESGEEAKVARSSLSIAVSPVYAFPIHTRLCRQAAPALEGQHMRTTAYVLWMYNGKKATGARAGEGYGILTEDLYPTTGGRPFRGYPPQGTHPGTGQRIPLTREGYQVQPSRGKGPNKSLGKNAGGAPRPGPQPRTNPISTQKPTGLFLRAGSRTGRNPKVIRAKKLQGGFFGDRSITGRYWF

SEQ ID NO: 1011880 - protein, 219 aa, Homo sapiens
MADPGAGHSEFGRPKSVRTIIAPMRAYGGAPVKDETWADVCINDLCNGTWALHAVAWDVLRVSLIYGALVPLALATPWCLDSAQTDSMNADLAVTRMSMWQDSAAATGTRTVGGPCREGCSDDVAAMVVRVMVAAIETWLTLSRTGGRVAAGVCRDGAHCCEDVRSLDAAAENRERCVVRVPCCDVVVAAVGHAVGLLVPHSLVQFDSRKIERELCVLD

SEQ ID NO: 1011881 - protein, 467 aa, Homo sapiens
AGAPLRTRDRTAPLLIGRGDCGPSLSFPARPLTSGLIACSRGAWPTRRCPRAPGSWVRQPRRRAHEVCCWSCGRRECADCAGVLRDRVGPTLGALPCPLPSTRSRSQAHCLVDLSTTVPFLIAFLEPWGDVHSPRVSYLYVTNGYTKKGFDVRPYDIAKVRRSMRSFGWVYSFSYVTLCGHYRCHSNLPWWRSVQPDCVCRGSRPFCLVRRWPSLAVHSLTSVLIALLAAFGKVLVPSAMGAFAALRGVSLPVPPGPLRSVYPTSSCFHQGACPEYAYSVSVLSRGSITTATRRAGLATMAFLGKAWVAGGLPGSDTQLASLGPSLNPSLRLLRERSGPPASFEPEEQNCGDLLAARLVVVTIGHAERYRGGFVCEPPGWEELGKCPAPKGELTKAPHRQTAPFPSPRVHGAHLPVLPPRQTRGAPLEFWGGPARLRLLVRTRGSRVSALVGGNRTQVTLCRKSPCW

SEQ ID NO: 1011882 - protein, 136 aa, Homo sapiens
MRLIEHRRKGARIKGSKRKLESSIASSGPMKKTGDPRVRIESFVGDISETFSRPFPGIAPPVLGREVHSRGGRDCLFEQQRSRMDRSYLWQWKRHTTMISTLGGLPLACEVALRRTTGGVPSRGPSMGPRIYFSNS

SEQ ID NO: 1011883 - protein, 37 aa, Homo sapiens
MTGLINMGDRILLILQGTFSKRWVHWRNTRRRILCTD

SEQ ID NO: 1011884 - protein, 35 aa, Homo sapiens
SGYDPLGFLGLDCCQTRRVFCPCRQPVATQWSAVG

SEQ ID NO: 1011885 - protein, 150 aa, Homo sapiens
RRGEARPRACGSGREEGSRPCPDWTCACMRGSHRQRCLPEEAAPRRKMTDDRGLRALCAGYGQRRQLLLQNAAAAKTQGSCGGRAAGQLVVNPGADEDDIPTRPVSSNGRASVDSDTSTVKEKAEARKESAREKQLKEDEKILESVADGP

SEQ ID NO: 1011886 - protein, 112 aa, Homo sapiens
MAEGRSSGPVTWREPAALAPMEGGVSHRLNKSLPAADGGSGDGTWERRVVVSLDPRALLPLTLHRGCLDAAQDLCGQTLTEAFVALLQSSSIRYLQAFPYDCRRVLRIYRHR

SEQ ID NO: 1011887 - protein, 152 aa, Homo sapiens
MSKGPAVGIDLGTTYSCVGVFHATENSRDNCRMIRVNQNALLSVCLLFTGHCKLVDSVMPLEESELAMEPQSYDSVVDAKTSDWTAEFDDACRPRLDDESIRPLYWMAELTACRVSNGSADVELQMGRRANTRLIVRDRQVCFCWILDEKME

SEQ ID NO: 1011888 - protein, 67 aa, Homo sapiens
RAASPGGARGHRVPLTEACKDSRIGGMMNDSGCMFVGLLAETWESGQVLGTGLETNGKLQEHGSNQG

SEQ ID NO: 1011889 - protein, 170 aa, Homo sapiens
MAPRLPPCRWARWEQGCPIRRGDTTAGAASSLSGSPDVMHRAVLLYEYVGKRIVEPAAHRGPRCLQLGVASPSTFAKAALDFVVEEDLNGPSHLLLHPEVRPGEPPCRRYPGAACSRTPGLQRAGSAPCRTSSTWRFAWPHVLSGNPGSHLGTGAQRLFCRTLICAHVPD

SEQ ID NO: 1011890 - protein, 35 aa, Homo sapiens
ENLADLYFERRRSNVVVDRGVNPRVIRSSSIQKGA

SEQ ID NO: 1011891 - protein, 207 aa, Homo sapiens
SGRVRRGLGGLRSADPGARLPAPCEGARGPRGAGRSPPEMRKLRLREVTWLARGPPASVNPHPASLDDYLKRNNTQRAAQQCRDPLCPHHHPHPLHPTVPMSPITAPCGAEPRLSTQEVSITDGYVPILGNKTLPSRCTVWMSAVSTAGTTGPESTAECQPDMMHHMVSVSGNKHLRVWPSVCPRAERPGVVTDPETVISGAPTRCK

SEQ ID NO: 1011892 - protein, 270 aa, Homo sapiens
ERLNPSVGKEGPPCSPCWLPPLGSGSRLPHELPMYKKEEDRARGHKPVSKKGADRHKEKEQHQQTAETDNKRHNTEYTRRQERKKSPKRTQKRPAEARHRAPSKHRPAEPPGGKDDNTRTGEQKTKTRARPQSRQRRTQSVEMHNTAQRDKLGRTREEKKRDTRRTNKRKRKRRQKEEQRTESDTKEEKTDNKKRGDDRNSKQGRTNRMSKRKQDEHSEQTNTQERDERQCEMKGAERNKRQGKNNKRNTRRANKTETHNPAKKQSSRKK

SEQ ID NO: 1011893 - protein, 109 aa, Homo sapiens
MGYWEAGLSARGSRTYCSPRRRDCLPSGVVLRVTAARAAASHLGQCGRSITLVQIQVNDSGDSSLGADGNAWKEGSQTYDVVSEDLVMSSKSDVRPSQYAHIRRLARLL

SEQ ID NO: 1011894 - protein, 148 aa, Homo sapiens
MTRFEPVAQVFKRLYYLQGVKLKPGTDLEAVAESLSLMASVSHKERMDVPCEYMSEENTFVLDHLRVWAGSAMLAPQVAIDWAAMIMSSGIDECRSDVLQAQEDLRDHADAFAQVLYINVNDGGYKYLEKGLEDEVIKSIAGVFLRKG

SEQ ID NO: 1011895 - protein, 257 aa, Homo sapiens
AEPVPGRERFQSGYFWWDIERANRSERSRRFFPATVFAPESEQEAVKVVSLSLEWSLDRVVHGGRAVKTSTPGSSRGSRQARSGALLGTRETTPMTTRLAITPHAGLVQLTEPHGRTQVKGRQAFQRAGVSTLVLVNVRVPSMTPSHKGSTGCPLGTYTFSAGERRFRTVGPIRKCSWTVGTAAATGTPARGLADIGGGHGTDRADRHTGRISAGTCRVAGMPGRAANGHEGAGEAEDRMTKRAEEERKGHAGPADG

SEQ ID NO: 1011896 - protein, 202 aa, Homo sapiens
MKGQDTEQMTNADWHAVCFHGWARTTVECPSRSYKHMVAVCNSLSLLYFGLQRGSLSRQTQNGTLQQNVYSCKTIYGYDTAFAEGRANGSRSKNLAVTVDLQDSAFMSTDFSSRFSHADVLRPIRHSSDMHFGTVPSREQFPSTGAPLRWPALPCHLGCMVLTFHSAETSSSKFFIGTLQVNVECNDDCGLKGEPLPAPIPI

SEQ ID NO: 1011897 - protein, 71 aa, Homo sapiens
AGPTPETANVDLIPEIPHGYEHLVKDATVYTRCTSHNCVLLDSVVAGQLLVYEGGAKISRKMLDPTEARRP

SEQ ID NO: 1011898 - protein, 121 aa, Homo sapiens
SGRAGAGGDARQLTLLFCRLRLVTDGLQEPFSLRGAKMGNSLKEHKLIGPSLREGSRHKQIHRHTKDLLIAVKCLVTSEASGLLCVSSQYVGNSLMCSDERCIFVGTDPLEGLYAFNKDEK

SEQ ID NO: 1011899 - protein, 212 aa, Homo sapiens
RIVSCCRCLQQDAALRRGGRRVLSARSSVTAGRWGSSLDPRSSPRREHWPRPLEPRELRELRLGVPRASLPLPPRAGDAATDPIPPLVPGRPGCCWLGLLCGGRGSGTVRCEQGIKPLGVEPTYHGSRSLENDNTVLLDPPVIALDKGCASCDLQGEIRGLKIHGQNVPFDAVVVDRITGEGVIRVQKRNWTVSCRTDYSSTIQAYDGGKGP

SEQ ID NO: 1011900 - protein, 156 aa, Homo sapiens
AGPCGAGQQTVQTDTRGILAVSGNETTKTDAMTEADVNPKAYPLADAQPSRNVRHNCDLDFSKFMETSNAAFGNGAELRPLKYSFNQGAISDVHRDGMQTARADWRSLLHLPLLCEDENVTHDDLVRCQAGPWGEPVGSPGLSSPVAVHHLKKARS

SEQ ID NO: 1011901 - protein, 156 aa, Homo sapiens
RFYARGFDGVSVSHESSPLPDMGPFGLPASEAAEVRHRGKVKSFPHGFTRPSLVQPPEHFSWRLHGLGMIHIVRAQQSEQAWDPSVTNVSEGGGRCDHCHRTTTPWLSLMGIDGCYVESTHRSCPPCNFKTDLLHVSDIEMMECTEVLSYDSNLRI

SEQ ID NO: 1011902 - protein, 273 aa, Homo sapiens
NIPAPTYDEGGVLQAHVTNLDASPYLGRLALCRVVSGELTKGQTVAWCKRDGSVQNVKLSELLMTEALERVPAEKAGPGDIVAIAGIPEITIGETLSDPENPVPLPLIHVDEPSMSMTIGINTSPLSGRSGDKLTARLLKARLDQELIGNVSIKVADTDRPDMWEVQGRGELQLAVLVEQMRREGFELTVGKPQVVTKTIDGKLHEPFERVTIDAPEEFMGPVTQMMGLRKGQMMHMVNHGSGWVRMESSSQPVALSASARGSSPRPAVRPSE

SEQ ID NO: 1011903 - protein, 146 aa, Homo sapiens
RRLPVWRQPSGYAKMGALQCYIHGVYRERSISDVMRFLQLRVLMHGSLPRNASRALRWAPRPYPGLHKAAPDSALTVGRKLKVSVSIYGFRGTRRVWPDKEPPNVAKVRNTDLAIAVAPIDGCLTQAQHTLWPPAEPTFQIARLPM

SEQ ID NO: 1011904 - protein, 68 aa, Homo sapiens
PYINALLERIKRKVMNTRTEEPDRDERLTKEKQERLRNEKKSGREKEKNGKEKDDEKRNDREHMKEAR

SEQ ID NO: 1011905 - protein, 77 aa, Homo sapiens
MLTGDPDQERCNDHTEKQQRQKGKNIPMEPAEGAHIKSVHEPPREQQQATPKRGIGQQKHLDKRKGARTPNGLKEHN

SEQ ID NO: 1011906 - protein, 225 aa, Homo sapiens
MPMYQVKPYTRGAGAPLQCGDFPPACTWLPNVHWQELRPSAGRWPRAWNESNLSLRALESRQDDILKRLYELKAAVDGLSKHDSIRARCMTWHVSQLVMPMRMRPTNFNHRMLLGLDIAVALGRITGALHKTIVHQRQTGASHSPHPWLVASAVLASVTHLQGTCPSGAHATPRVKERALKTFSSALENRITKQPRQDYQLGFTLIWNECAKTQTEHSASRTMCP

SEQ ID NO: 1011907 - protein, 154 aa, Homo sapiens
AARGPASQPASLGLAAGTRPVPMPWSQCPSDELASRWCELCWLFCCPPCPEPASPAKLAFLPALSPPTRCWLPGAALAAWLRPCPRPTGPGLTCLHCLPAGPWHCAPARQPRRKGAGRAGRRPRVAGAENFDSHRDRCCRQNQCAMISFQAMPS

SEQ ID NO: 1011908 - protein, 88 aa, Homo sapiens
ERGNTAEYGGIGAARSGEVDALKGTSDCPGSARCVKLEEKLGLWKADNLTQGNYMEQCVTGSEIQNIEGGRWLSRTFSCIPKRHDKKL

SEQ ID NO: 1011909 - protein, 383 aa, Homo sapiens
SGGGAHALIAVLGEGRDTWESTLEVRSSKTSMGNVVKACLLIEIHKVSWCDGEMSVFPATWEAEEQENALETQEVEVASEREMAATGLQPWDNRDVRTSTPHERREEEKRRPRRWDVGANKGARIPWTGGSRSSNVEACHVSEGVRVPETGAGKPHGGRIGQWYAGVVATGVVNATGPEEIATPGKPITRRHSGPRKGTDAVIALPYRRTRNGEVTTRNRKQRMGHSQERQNNKRANETSTQYKRTNTMHQTEENRNTRGKRRTKRQAPTSEEGHARGPGDTGTRRKSKSTEKTNRGNDGTLMREDRYETTRHAQTKNTDATSTHQEPHQDAEPQREGKQRTARKPKRTDRRRHRRTRGQRTKEKDERQHAREKDTRAKTRRR

SEQ ID NO: 1011910 - protein, 112 aa, Homo sapiens
MRTRMNLTLLPRGPVLLPMAVGIGIVPVDTRRDRNTWDMKRTHSRAVSLVIHFEPEWGHTQRELVDRLGRGDCNVTGEYGNAVTWPTAQVIYPFRRSGQWAATKITRKGQFN

SEQ ID NO: 1011911 - protein, 207 aa, Homo sapiens
RGAEERAEPRLRARARLWPRRGDSEAHWGSQRGAARRQPEVYGCARPKEDAAARPGCGAERLSSRRSGSTALGGVGSGTRRAPGGRRAQAGYTLSESAEFAASEGGRRPGWARVAAPTGAPERPGTGGTLECRNRGRRENLGRWPCPGAESRAESERPRVPGRSAASGSHSPRRRSSSALQTKMARRSGKGSEARCVRLPSPLLVGK

SEQ ID NO: 1011912 - protein, 77 aa, Homo sapiens
MGSKVTVPDLPAAQLAVPKRRNFRVLCAATITPMTENGDNQLCSTWSRMWIILCKEQGVTEHFREMAQQDEGLSLSV

SEQ ID NO: 1011913 - protein, 189 aa, Homo sapiens
MTGGSLPEPLPGLTGVVLPLIRAIMVWSWPPTISAAEVPGGFWADPPPLHPGSMVLAHHPWVRFGPVPADPVSTSSPGSQQSSMGANKLVSLNPEKRWRSAWLKADLLPSGVTHLRYHRPTGLRRTSSGQWRAEIACLDSGRTNAITTPFTLTSGALRTPLSLHHPGSRPLDHSLGQIYLAPTLPDFRF

SEQ ID NO: 1011914 - protein, 51 aa, Homo sapiens
MRSTVYAVEDVRKIDSPNLKCLLKVDVVYLVERVISANAQTIPSYFPVMIG

SEQ ID NO: 1011915 - protein, 185 aa, Homo sapiens
MAGDGRRAEAVREGWGVYVDPQWPPIRDGKEAGSPLNNWRLVAECVLAYHDSVLACDSQVGRQVKVVGVIESEARQRVYRGTFEAPWVAIDEKVPRVGIERIPGYERVAGSECLRREESDEKARYLPFGLGMRRQPAYPEGNRRIDEGRRRHYPVFSSRISEHAFRLQSRSPVDDPGEGLRDFSV

SEQ ID NO: 1011916 - protein, 302 aa, Homo sapiens
RVHWRALPSGVPPTHARRHRTPRRFTLTELLGDGRGSGSGRNLTLSPRLECSGTISAHCNLDLTRYKQFSCLSLPSSWDYRWSLALVAPAGVQWCDLSDLSDLSDLSSLQPLPLGDFDAMRRLILQVLLDYRGDYRAPATTPVLVVGMFVVDDGGVHQVGQSGLELLTQVIHQVSVLSDRMVCDIQADSPSHGRFPISKFNDRHKKSFMTPRTCIYRIGQDGNRSNFYAAKNEKGSESEAKNKQEALIAKITILLCLGLLGSPWDSTGLRVGCWVKFLVTTNFFFYGIAGFQRIPCPVKKIA

SEQ ID NO: 1011917 - protein, 252 aa, Homo sapiens
QHVLCLPPRNVTLLQERANKLVKYLMILDYKKIPIKRADMLKDVIMKYDEHSLRSLNEQRTPWNRKFGIHLKEIDKEEHLYILVCTLGLLRSSSLQKTEGTAPRLSLLLVILGVIFMNGNLPDEAVPLGGSYGKMGAGPGVRHPFLGDLRKLITDDFVKQKYLEYKKIPKLAKPSCSMNSSGACEPVDEDQSRMRVLRFIVHNQNRYPREWKAHFLEAVDDAFKDNVDVDMADEHAMALSMRGPDEISGMKR

SEQ ID NO: 1011918 - protein, 67 aa, Homo sapiens
GHSSSRCPTIDDTVRPVFKLETALPKKTNQELFHKLLAEALRRCVILLKDGPNLEIFNHRLVTALGN

SEQ ID NO: 1011919 - protein, 49 aa, Homo sapiens
MVDRSNGGQRSEQRRGPHRYRITTSPHKTLKKYDEKQRRATGTIAEKGK

SEQ ID NO: 1011920 - protein, 110 aa, Homo sapiens
RRERRGAAAMTGSTRSAYKDYPALQGTIDEVETDVVEMRPNWTSLCEAFSWELNGENAKRGRLYLGDLGWHAKLTMRDPTDLESPAISQYQGWPCMWRINFGKEHRRSGR

SEQ ID NO: 1011921 - protein, 537 aa, Homo sapiens
MIYSPVQLGSLYPNKVYGASPRTRGPGVNARIALVQSPTIRGLRTSETREYTAEHDSSERRAERLLSRVRCFRACVCGCSPLAAARMEERVRHSNVAVAGPLCPLVAPRVASSVPTHGLQCDRGRRSVVPCPREACESGSRRMPWCVRLRGALERGGAPLRLLALLGGGKSLDARCGRTYRPRYAPAPPTFLAKVAGCVPVWGLGHLTAGCVAMYWTIPPCAVFPMAPFYVALWARCMGGSSRTSRSLAGLRLPPRLWFTLDTADGPTDAVAPGNFRAGGDRSKSPPGACTGMRGGETCTPRVNTHALPEPNSQRWGTPCGSRQSSRPSCVEKKKFPLIEGDTIEQVGTRTEMGAYKVPQTKRQAKPRRVNPGTRPQAIVGSATRNTDGAAQENPHIAQTDKGVEPPNMRAPLWKNYGQGRRISFRRIAQKMKGAGDARQPRSPTTGVSDKNEEREDNHQTRARAATKEKQETAQAQQTQCYTAQTHRSTTNERTTENKDCTRLNTSNNDATAQASIIGCNNQQRKASTYSTERDDT

SEQ ID NO: 1011922 - protein, 67 aa, Homo sapiens
SGDALLLLYGEPCGAASVGRNLKDSQTMAEHTGDYTEERWLPVEAKHSVEYRQKGTYEITRTNERMH

SEQ ID NO: 1011923 - protein, 333 aa, Homo sapiens
TSSSWFSACTAPSKGGGGRWRNYDSELRGEAGVCRCHHLDHEVTPLLAPPTSHLGLSGPRSSNKTSKTRDWARAQSQAQALGSKLRLYLSLMNSKQSLDDEHCLLPSASSASSYLIFLVTWSLGWNAYMSSAHGFPNLPLYMMIASGFCVNGPCHPVPAYHYSLSPELSLHHLSIPVDVPFHVMPGGLDEWYYIRGQGTENPARIRPIGVPGRKRDRPLADSIYTGRKEGRSEKSVPFGPLSPRDTSGKEVWRDLKAEDNSGELHSKGNYSGQWVVISQAKGLGTEHTWLAYRGESPEGQQLKGALKLTGTVLSEATRKTLFPNGPSDETVKW

SEQ ID NO: 1011924 - protein, 128 aa, Homo sapiens
SGSDAWSHEPGGRGGSLVAEVIKGRNMQFFHVQIALFAILYSRPKSASNGTYISSIDEENLRYENVPRRRVEESTTIQSKKERKNEKQRTKIKKNAKSKMKRNKKKQRTKAQNREDEQETTNRREKNN

SEQ ID NO: 1011925 - protein, 257 aa, Homo sapiens
MRLGSEPAAGPGAAVLLAFPGRWVNTAEAPGLACRCLVVRHGLLSVDARSRALPAARSTMVHFQASGSPASVLHNKFVVILGDSIQRAVYKDLVLLLQNRLTFHSCPAENAKGELSFEQDQLLVLGTNWVSCYNGNTVSVRSASICSGSEAHTLCASTSSPRVYSEYLEDVLEELTYVDLPRTVVNHQLHASGIFPDMVGCSMESYLGATWKRVVCAHWTTLFARLLPVGCGTIGDAPSGNVSLGITYCKSSSPWQG

SEQ ID NO: 1011926 - protein, 124 aa, Homo sapiens
DVVVVRSLHFDLRDDDDAEEEWAQAGAWCSASVGRSGRRASESNNRFELINIDDLEDDPVVNGERSGCAVDMIAVAPGNKGRGSAVKTQRARRMEMTTETVALRADLMQVANSGRRTEKTEHTE

SEQ ID NO: 1011927 - protein, 107 aa, Homo sapiens
LITSTAAHPPLLARSSSSTEMAAAFSSTVGAPASTPTNFLGKKLKKQVTSAVNYHGKSSKANRFTVMAAENIDEKRNTDKWKGLAYDISDDQQDITRGKGIVDSLFQ

SEQ ID NO: 1011928 - protein, 242 aa, Homo sapiens
MKKFLVNDGTFLAESTPLYEEDALSTLTVISPPESLVGQSLSALASSRFAHQLALAATRSSRSSSHHASSGVYLEAAMKDVFNALKKDKEESMKERGGQSKMSLQQGATHTTGDSTPRRNNVGKTEQPHNGLRTTIKHEMPLRTALLYNTIKSREKAGKNKGKHQSSRRTPPNQSPGEECEPQYQLHCNCCRHHTNAQSAPTGLHMKDHSDKTGYSQDEQQDVPTNPRPRIFDTPSTDTHCE

SEQ ID NO: 1011929 - protein, 141 aa, Homo sapiens
SAEAARVPGVTVQDVNHQEFVRALAAFLKKCGKLKVPASGVDTVYDWSTHKRACSLLIEELVLLRRETSFPQAAASCTYRGGAWELGSIDQRFYCGDVLRKRRHCPGHFSRRLQRVWSRRVSSKALEGSEIVVGYYIRTMM

SEQ ID NO: 1011930 - protein, 57 aa, Homo sapiens
MRRAGMLALLAASVALACGLLGPRTCPCAREPLRVHGYCPQRRCTPAARFPAVCPMQ

SEQ ID NO: 1011931 - protein, 115 aa, Homo sapiens
MHMEIIEIKEIPIKLVKKQTILIIATETVMKKTVRSKSEGNQILDNDVKITFGKDGKRKSYILNHFKRITWYPLVGSDLNCAVNTVTSLDFITFALSLLGDALIRGYLYIEFEEN

SEQ ID NO: 1011932 - protein, 172 aa, Homo sapiens
ALSSPARASLRPPLPPVPGHLLEAEPGCCMMGRRGDRMTINIQLSTWSINCVPRAHPGPSCSASLTDFPLGGTQDLERGLAVVLAAWQAPPAHPWSPHWPAGLPLLFGDPFSFGADLNLGFHMQRHCVARARLAYRALMERSRFGLLAPDALGPAAWVACWNPFLPMDSGPF

SEQ ID NO: 1011933 - protein, 330 aa, Homo sapiens
MDITTSRWPKSSLILHYNQPMLPAQAKASLICTILHIHAEPYTNVLGPAVKFRSFISTRHLNFNLKGLSNRYNMGRIYSRFYTGLCNYNIMPNNVQCSEKYLRAHTQYNCLFKCVLTFVMKSAARRSQRGATRLGVLTLFFPRFILYDGSRISQRGPHIVVPRSGSSIASFICDRAFRRCQLESQSAKTFSGHSFTGLLGIIHSIGCDNPAADTPTLFSRVATPPARSRHATPPSFPGRRITSLSALPLSHLISGGATSQSRVITPGIRVFCPILPWHPRLPLRCRHLPWGLMHRLLSFCRPLPNPLAARGAFIRPGNLLYFSTLYYFVI

SEQ ID NO: 1011934 - protein, 230 aa, Homo sapiens
MAWLPHQWHTMTRGILDSIWALIFVRVTCGVLPNAGTLARDVTPTLAKNLLTYWLPCAQRVTLAWTPRIENPPRSHVPSMKPFVTCLSTTDPPVSTGKGGALKRQKNPGTLGLTGQGQNAGSRTLLRIVPCLPTKRGNFPNGAQGSLILPPKGGQPALYFPNINFVLQGPRAETVDTRTDLNDSWAFLGETCQSPPNLGPLRKPGPLASTDSPQCPVGGIPPPGGTLFPA

SEQ ID NO: 1011935 - protein, 260 aa, Homo sapiens
MCNGEVPGPAPGRRRMRSACDLMRLRSLATIAAGPGSGRTRPRSHRSLCWTRLACLRHCRLHRSPVSSVAGDRGPWSALTLDAGCVAQPSPCSYRRARGGVTPFAPCFLCSERVPIGHLRAIAFVWSALRSHRCSEALELESTASAPTCWTPTRLLGLGRLPVHLLARVLAGCLRSLSRGQMVAQFTCTAGEVQRKWWGPDATGQLPRTDPHVPTSNMLTESARKTFFPLPKAAMRGDPGRCTLPIRANAHAFKSAFIPP

SEQ ID NO: 1011936 - protein, 90 aa, Homo sapiens
GLQNVRVRLWGLAEHREGERAEPMRASQYRSPAVPCRREHALFHSRNTSPARLGTAGGIRLRGYNIHVNGVLHMSGALLASSWGCTSRWD

SEQ ID NO: 1011937 - protein, 137 aa, Homo sapiens
SGLRTGPAFEWQVVCYSEHQQHPPFALLSLSFTSHCHTTIITTRHLTINPPRISLPSQHFSVPHITLHPTASISHNMMSLPLPPTISLTSNFYFTYILAPTSSNYTTPPYYAQPLHLTPLISVPSSTYHIHHPDTPL

SEQ ID NO: 1011938 - protein, 281 aa, Homo sapiens
SIQPSPVATTTDPAMATAPPQLLLLALLSCLSLASAAPSLRPLPRADDDGLLARTTGSSSSPSERGVGARTCWYTVQIKTSCSSPARTSDAISLAFGDVYRDEVYAARLGGAAGAFDRCATDTFKIGGPCGYGVCYLYLRRAGRTGWTPEWVRVYEPTAPSAPSNLPLRRPAPQQRLVRLQPLPAPRLLLLVIVSFLRCWCCTGDVAIGRSRSWALVYVCTVGGSRYYIVGFISAVPLSDCVVRPVLVPIRDGLAIMGTHEIKTLFGLFWEHPNTQPTNTK

SEQ ID NO: 1011939 - protein, 96 aa, Homo sapiens
GDLGRASRSATIAEEAAGSWSGADFREAAVRARCPHDFSLWTLFVIFFACVVRVRDGLPLSASTEFLPHPRFYGMEETAQEFSLADCAQYPGRGSA

SEQ ID NO: 1011940 - protein, 166 aa, Homo sapiens
MRSNVRQMSRYQDPGGDFLWPNRPSGNRRSAKGWHHKALEKRVGNATNQTRMQPDAGMHSPPSPTAIPPKPGRPITNRLGTKGIYRKAYAVEGQSTIPCTRPTSKQADPREGLPRREFAQRVNHHSATASDHTAPHTQYTTPHHAAHPQTNSPAEDAHKLPMAASN

SEQ ID NO: 1011941 - protein, 256 aa, Homo sapiens
MAAALRGRAAARVLLLLGLAICPMLTAGPCPGPGTTLTECCCADVKALTLHYDRYTHSRRLDPIPQLETVLGSAPDALCAFLYPKSSITSCQQQQGPRMRYACYKPGNAKHGTLTTTRHTTLREHTCGDACETATELPLTDQYCTNEGLLLASGVLIYDLIPEPLGPARQPDTGGPGKRQPPAFGPLFPADFITYYTLEIHPRRAIPYATQCTLATSDLTHSLSTLPMGQLRPHCTPLLQRHAPLNWTTATHIPHP

SEQ ID NO: 1011942 - protein, 274 aa, Homo sapiens
RSGLAWSAQCEPRGREPPLTPRRGVGLAGGASCPAPAAGALPAPLPAPPPILPSSFAFRRLGPLLPCFASAPRAYGTEPLRIPQHHLRIQETWPERSDTSDPRTPAHQAKQLEELALTRAQNVRQHLEPESNWRPIGLAIAQLLLLAFSHPQYTRLSKLHTNLTKPTIAPAHKRRKRPSGHQENDGRLQETKAKEAQSRSKRQQSTQTDTAQESASVNKAELSQRIEALAAQVERTPGDRQGADPDQENKRTRTSGYQTRARDGSDHRGTTSPL

SEQ ID NO: 1011943 - protein, 317 aa, Homo sapiens
RRALSTGRGKGELGDPACAGPDVARGRDDLWLQPCDEQMGRALTECISQTHVAVHEGEQFMSFDLLSCMQMLLNVDGELGDRLHEDLKPEFQSLFSRPGGAEYEGKVLTAHVLKISAPVPSRTATSCRNQHGCAASCRALESSEGASGDRQADSAGHGTVVGTFLRHADRNQKMEGPWAHAFRLSLKARVSDKSCSHLDGGRSRKSGRCVQAFKFLPVPRAPVIDAGLGSLVAGELCDPWLWGMPVLRDSKDGPRNVTGSSARNQTLRRGPAPVLQGRNLDPWMGAIEGTSRRSPECYTPCTGVVKVWRLEDYSELP

SEQ ID NO: 1011944 - protein, 217 aa, Homo sapiens
MPVSRIAVGSHREVYEVGALKAALAEFISTLIFVFAGQGSGMAFSKLSPDGAATPAGLISAAIAHAFALFVAVSVGANISGGHVNPAVTFGAFVGGNITLFRGLLYWVAQLLGSTADCFLLRFSTGGPPTGTFGLTGIGAWEAVVLEIVMTFGLVYTVYAHGRGPQEEAAMGTIAHISHQAFIVGANIHVSAGAFSGASMKPADILRTRTRQLGDGG

SEQ ID NO: 1011945 - protein, 223 aa, Homo sapiens
MSRRSQGMTPVTLTSKAGILDPEPLEAILTDDEPDHGPLGAPEGDLVDLRHAVGYVCMMNFPWWYILDLYSSDHTESECPKGQSLFRIELWIRPASPSPNLSMKNSIPESRGAEACALLVSGPRRHEQMCVIKRSIVAGKFASQTGEHYCHEYTLLCYLGMGALIPFRLRISSALRGFYIHQRSGTEVPKYAPTGYFVHDEAQPAYGDVAELGEHRRIVDPRC

SEQ ID NO: 1011946 - protein, 377 aa, Homo sapiens
LITSTAAPVHRVLAMVSARSTEYGCCRSSIAPSRAPGFYADQLPREEAQRNAGLIPSDVNLTMSIRAPMVPHMVTTGALRSSVQPHIRTEAMSEAPTKVANGSVLLRISSRADHGRIITQRGKGQSVGLPLSFHARPDLDVSGPSHRGPDPFNINTVVAIEPMVNSMKVRTCRNITHSAEGIRYTLLPLHSQVRRSICFDPILRPYDTYLTPSATTIRRTRQYHIYERIHAGTGNGVKEINFSISVCEAVVPFALQMGGESRAKSSDWSALEDVFGQKVRQIALEVAHGLVLESGACEYPGEGPGSTVIPGRGFRIVAGPSFRFTRSPFDSPSDGDKGMGLGIPTRRLKPFKKPSIGETGTGPCNCWAHARHQRGLP

SEQ ID NO: 1011947 - protein, 107 aa, Homo sapiens
RRLYPGGSYFDPLGLAADPEKKETLQLAEIKHARLAMVAFLGFAVQAAATGKGPLNNWATHLSDPLHTTIFDTLGSFKWSVVEQFLSARLQNGRTRVRVTNVLFVCI

SEQ ID NO: 1011948 - protein, 256 aa, Homo sapiens
MSNAALLSSCLWGLPTSLPPGGRPSSNSRPSLSPPLPPGRTLGGTAASRVPARLPHFPRPTPPPPPCSAGGRRELTAAPNWPAHRRSPRYVQRLPFPAFHIHSFPLPLFREPLAIPPSLSRPPSPAFVPPPFGCPRTRRPTPPLFPCAPRPPLVAPASSLRAPGALPVWRLRPPLVGCGPTTPPCAAFSLPLYGGAPSSSCAPRPCRACAAGVPLGRGPSLRRFRSARVFHPTPFFPPGAGSYHYSFPRVGLAGGW

SEQ ID NO: 1011949 - protein, 140 aa, Homo sapiens
MRSSPEWTAKDADLNKKSLPYESLAAAKAARQQGALRLKSSDSDSDIVPLVDYLNTQYYGVIGLGTPPQNFTVIFDTGSSNLWVPSSKCYFSIACYLHPKYKSSKSSTYKADGEICKITYGSGAISGFFSNDNVWLGTLL

SEQ ID NO: 1011950 - protein, 150 aa, Homo sapiens
MGKTQTTKKPTKTKYNKKTTSNNKKRRRGGRRLQRYPPGGGPNTGARTAQVYWMKGAGSPPQRGGRRQNDSEQSDKDGRRLKQDSAAQDWEQTSVTRAETPCGDRKPPRQQERGGEIIMGGRPHTFFHMGSYMIAPPMGGLKFNRTSGRA

SEQ ID NO: 1011951 - protein, 134 aa, Homo sapiens
MAECDGRGDSDVSQRPERSPRRMIMKIIRMMVTQPSIRWRMGSGDSSRSCETFRVKILVHSYVSSKKLDREQMAYHDDDMVEYYIFKNKSVKYLGVTSFKRKYPDVERRDVSHKEKLYLRELYVITERSVRSRA

SEQ ID NO: 1011952 - protein, 199 aa, Homo sapiens
MTENSDKVPIALVGPDDVEFCSPPAYATLTGEALQPRVGCSNGGSRGPHFGSCAAALMGPVGAFVLLEGERQSHLQCPLHHEYQVVTLQRWVNGDIDAGNNIVRALIMGSGAEEAIVMLMISSNGITGIRLAGGDEVLIIKGASEGSLFLRWAPVTKLEHLLQYWKATIMPVTSMREQFSYLGWAVDQPVKDNSFLRFY

SEQ ID NO: 1011953 - protein, 105 aa, Homo sapiens
GRAWDNLLQNKTAFTTKENYGKGEREAQWATAQRTLHGLQAPEPASHTLFNDKSSYRELSEIAEQAKRRAEIARLRELNTLKGHVESVVKLKGLDIDTINQNYTV

SEQ ID NO: 1011954 - protein, 75 aa, Homo sapiens
IIIPDTKAHLLLLEIFLGPQIWRMSCNCGSGCSCGSDCKCGKMYPDLTEQGSAAAEVAAVVVLGVAPENKAGQFE

SEQ ID NO: 1011955 - protein, 224 aa, Homo sapiens
MRSSRTNGSVQKAGRVSHAQGEGPSWVLVAGGVLLSTLSVRFGCKLKQMFDTKKQNSTSRAKRRHGSCELHSNLYRFDDETNCYCCVSDGGVEIKQAPASSLSKPDEPSLPLAKIPGPESSKENSGVMWTSSPDRLEDHRRPLQYSNSSGSPCVSESGSDIYIKREVIQKLRQHLRRRDEMIMEMQAQIADLKNSLSIEETQAAKLQSQLGWCQSRSVRIREGD

SEQ ID NO: 1011956 - protein, 77 aa, Homo sapiens
MTEPDRNAGREVALDWSIVGIFILFVVATGQAIVEIHPCEPQFICDGALGRIRARSGCHHTPSGGEVEGVAERRSGR
